United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 219

SEQ ID NO: 9075845 - DNA, 22 bp, Homo sapiens
tgcaaggtcttctctctggagg

SEQ ID NO: 9075846 - DNA, 21 bp, Homo sapiens
tgcaagaatcaggaagctgcc

SEQ ID NO: 9075847 - DNA, 23 bp, Homo sapiens
tgcaacaatgaggaaagctactg

SEQ ID NO: 9075848 - DNA, 22 bp, Homo sapiens
tgcaacaaggcctcatttcttg

SEQ ID NO: 9075849 - DNA, 22 bp, Homo sapiens
tgcaacaggagagttcagggca

SEQ ID NO: 9075850 - DNA, 22 bp, Homo sapiens
tgcaacaggctgtgacatggaa

SEQ ID NO: 9075851 - DNA, 22 bp, Homo sapiens
tgcaacagactttattaactct

SEQ ID NO: 9075852 - DNA, 22 bp, Homo sapiens
tgcaaatttgagcagactgttc

SEQ ID NO: 9075853 - DNA, 22 bp, Homo sapiens
tgcaaatttgacttcacacatc

SEQ ID NO: 9075854 - DNA, 22 bp, Homo sapiens
tgcaaatttctttagtacataa

SEQ ID NO: 9075855 - DNA, 22 bp, Homo sapiens
tgcaaatttctttagtacataa

SEQ ID NO: 9075856 - DNA, 22 bp, Homo sapiens
tgcaaatttctttagtacataa

SEQ ID NO: 9075857 - DNA, 22 bp, Homo sapiens
tgcaacagtggggcatgctgaa

SEQ ID NO: 9075858 - DNA, 22 bp, Homo sapiens
tgcaacctgcactctgtcttta

SEQ ID NO: 9075859 - DNA, 22 bp, Homo sapiens
tgcaaaccagttcaaccaatct

SEQ ID NO: 9075860 - DNA, 22 bp, Homo sapiens
tgcaaactattggtagagatgg

SEQ ID NO: 9075861 - DNA, 22 bp, Homo sapiens
tgcaaacatccgactgaaagcc

SEQ ID NO: 9075862 - DNA, 22 bp, Homo sapiens
tgcaaacagaaagtttattgtg

SEQ ID NO: 9075863 - DNA, 22 bp, Homo sapiens
tgcaaacaggagagtaagtata

SEQ ID NO: 9075864 - DNA, 22 bp, Homo sapiens
tgcaaacagttaagatgcaggc

SEQ ID NO: 9075865 - DNA, 22 bp, Homo sapiens
tgcaaacaggcatttcacaaac

SEQ ID NO: 9075866 - DNA, 22 bp, Homo sapiens
tgcaaacaggcatttcacaaac

SEQ ID NO: 9075867 - DNA, 22 bp, Homo sapiens
tgcaaacaactgtttaatgctg

SEQ ID NO: 9075868 - DNA, 17 bp, Homo sapiens
tgcaaacaatcacatat

SEQ ID NO: 9075869 - DNA, 22 bp, Homo sapiens
tgcaaacaatttcctataaagt

SEQ ID NO: 9075870 - DNA, 20 bp, Homo sapiens
tgcaaacacagagtgtatga

SEQ ID NO: 9075871 - DNA, 22 bp, Homo sapiens
tgcaaacaccacagagacaatt

SEQ ID NO: 9075872 - DNA, 22 bp, Homo sapiens
tgcaaatggagcatgtataaga

SEQ ID NO: 9075873 - DNA, 18 bp, Homo sapiens
tgcaaatggctgtttgat

SEQ ID NO: 9075874 - DNA, 22 bp, Homo sapiens
tgcaaattattgggccccaact

SEQ ID NO: 9075875 - DNA, 23 bp, Homo sapiens
tgcaaattaggccgggactcagc

SEQ ID NO: 9075876 - DNA, 22 bp, Homo sapiens
tgcaaattggtgaggaccactt

SEQ ID NO: 9075877 - DNA, 22 bp, Homo sapiens
tgcaaattgcatgatgtgtatc

SEQ ID NO: 9075878 - DNA, 22 bp, Homo sapiens
tgcaaatttaatgaaactatgt

SEQ ID NO: 9075879 - DNA, 22 bp, Homo sapiens
tgcaaatttatatggtgactgc

SEQ ID NO: 9075880 - DNA, 22 bp, Homo sapiens
tgcaaattgcgatttttattag

SEQ ID NO: 9075881 - DNA, 22 bp, Homo sapiens
tgcaaattcaaacattttcctg

SEQ ID NO: 9075882 - DNA, 22 bp, Homo sapiens
tgcaaattcagaagaactgccc

SEQ ID NO: 9075883 - DNA, 22 bp, Homo sapiens
tgcaaattccatttaaacacta

SEQ ID NO: 9075884 - DNA, 19 bp, Homo sapiens
tgcaaattctaaaaactga

SEQ ID NO: 9075885 - DNA, 19 bp, Homo sapiens
tgcaaattctaaaaactga

SEQ ID NO: 9075886 - DNA, 22 bp, Homo sapiens
tgcaaattctttactctgtgat

SEQ ID NO: 9075887 - DNA, 22 bp, Homo sapiens
tgcaaagatgaaatattaaagg

SEQ ID NO: 9075888 - DNA, 22 bp, Homo sapiens
tgcaaatatttccttatagcca

SEQ ID NO: 9075889 - DNA, 22 bp, Homo sapiens
tgcaaatattgggacagtctag

SEQ ID NO: 9075890 - DNA, 22 bp, Homo sapiens
tgcaaatcataaacaatagtgt

SEQ ID NO: 9075891 - DNA, 22 bp, Homo sapiens
tgcaaatgcccatttattttct

SEQ ID NO: 9075892 - DNA, 22 bp, Homo sapiens
tgcaaaaaggcagactggtgat

SEQ ID NO: 9075893 - DNA, 22 bp, Homo sapiens
tgcaaaaagagcgaggagccct

SEQ ID NO: 9075894 - DNA, 22 bp, Homo sapiens
tgcaaaaagagcgaggagccct

SEQ ID NO: 9075895 - DNA, 22 bp, Homo sapiens
tgcaaaaactgcaattgctttt

SEQ ID NO: 9075896 - DNA, 22 bp, Homo sapiens
tgcaaaaactgcaattgctttt

SEQ ID NO: 9075897 - DNA, 22 bp, Homo sapiens
tgcaaaaacagccttgaggcct

SEQ ID NO: 9075898 - DNA, 22 bp, Homo sapiens
tgcaaaaattgctggaatcttt

SEQ ID NO: 9075899 - DNA, 22 bp, Homo sapiens
tgcaaaaattgctggaatcttt

SEQ ID NO: 9075900 - DNA, 22 bp, Homo sapiens
tgcaaaaaggcagactggtgat

SEQ ID NO: 9075901 - DNA, 22 bp, Homo sapiens
tgcaaaaaggcagactggtgat

SEQ ID NO: 9075902 - DNA, 22 bp, Homo sapiens
tgcaaaagaatatagatattgt

SEQ ID NO: 9075903 - DNA, 22 bp, Homo sapiens
tgcaaaataatgaacgattttt

SEQ ID NO: 9075904 - DNA, 22 bp, Homo sapiens
tgcaaaaacagccttgaggcct

SEQ ID NO: 9075905 - DNA, 22 bp, Homo sapiens
tgatttttagctattctgaaga

SEQ ID NO: 9075906 - DNA, 22 bp, Homo sapiens
tgattttctccattgtaaattc

SEQ ID NO: 9075907 - DNA, 20 bp, Homo sapiens
tgattttctgaaacagcaca

SEQ ID NO: 9075908 - DNA, 20 bp, Homo sapiens
tgattttctgaaacagcaca

SEQ ID NO: 9075909 - DNA, 22 bp, Homo sapiens
tgattttcatgggtgatctttg

SEQ ID NO: 9075910 - DNA, 22 bp, Homo sapiens
tgattttcatgggtgatctttg

SEQ ID NO: 9075911 - DNA, 19 bp, Homo sapiens
tgatttagggatccggcac

SEQ ID NO: 9075912 - DNA, 22 bp, Homo sapiens
tgatttaggaaacagctacagg

SEQ ID NO: 9075913 - DNA, 22 bp, Homo sapiens
tgatttacttctggataaatcc

SEQ ID NO: 9075914 - DNA, 22 bp, Homo sapiens
tgatttacaattgtaaaagttt

SEQ ID NO: 9075915 - DNA, 22 bp, Homo sapiens
tgatttacacacctatgattta

SEQ ID NO: 9075916 - DNA, 22 bp, Homo sapiens
tgatttacacatcaaagcagca

SEQ ID NO: 9075917 - DNA, 22 bp, Homo sapiens
tgatttacagtagtgtctaaac

SEQ ID NO: 9075918 - DNA, 22 bp, Homo sapiens
tgatttaccagttactatcttg

SEQ ID NO: 9075919 - DNA, 22 bp, Homo sapiens
tgagtgggttatcaggaaaggt

SEQ ID NO: 9075920 - DNA, 22 bp, Homo sapiens
tgagtgtggggaatgtcatgag

SEQ ID NO: 9075921 - DNA, 23 bp, Homo sapiens
tgagtgtgttccctgtgagattt

SEQ ID NO: 9075922 - DNA, 22 bp, Homo sapiens
tgagttactgcctagtaacttg

SEQ ID NO: 9075923 - DNA, 17 bp, Homo sapiens
tgagttaagtttagatc

SEQ ID NO: 9075924 - DNA, 22 bp, Homo sapiens
tgagttcaagtccaagttgctg

SEQ ID NO: 9075925 - DNA, 17 bp, Homo sapiens
tgagtggccgggggaca

SEQ ID NO: 9075926 - DNA, 20 bp, Homo sapiens
tgagtggccactgggtcgca

SEQ ID NO: 9075927 - DNA, 22 bp, Homo sapiens
tgagtggagactgtgtgtagag

SEQ ID NO: 9075928 - DNA, 22 bp, Homo sapiens
tgagtggagtagtgaatgcatt

SEQ ID NO: 9075929 - DNA, 22 bp, Homo sapiens
tgagtggacgtgaggctgagta

SEQ ID NO: 9075930 - DNA, 22 bp, Homo sapiens
tgagtggagaacagaggctctc

SEQ ID NO: 9075931 - DNA, 22 bp, Homo sapiens
tgagtggacacctgcttcttta

SEQ ID NO: 9075932 - DNA, 22 bp, Homo sapiens
tgagtcttttatcctgggaatg

SEQ ID NO: 9075933 - DNA, 22 bp, Homo sapiens
tgagtcttttcattgtgtggat

SEQ ID NO: 9075934 - DNA, 22 bp, Homo sapiens
tgagtgcctgaacatagagtag

SEQ ID NO: 9075935 - DNA, 21 bp, Homo sapiens
tgagtgccacctgctggccaa

SEQ ID NO: 9075936 - DNA, 22 bp, Homo sapiens
tgagtgcctaccaagtgctgga

SEQ ID NO: 9075937 - DNA, 22 bp, Homo sapiens
tgagttctgactgtgatgccag

SEQ ID NO: 9075938 - DNA, 22 bp, Homo sapiens
tgagttctcatgaaatctagtt

SEQ ID NO: 9075939 - DNA, 22 bp, Homo sapiens
tgatataagaagtagtatggat

SEQ ID NO: 9075940 - DNA, 22 bp, Homo sapiens
tgatagagcactaagtagtgta

SEQ ID NO: 9075941 - DNA, 22 bp, Homo sapiens
tgatagaaaatgctgtcaagct

SEQ ID NO: 9075942 - DNA, 22 bp, Homo sapiens
tgatatgtaactactccttata

SEQ ID NO: 9075943 - DNA, 22 bp, Homo sapiens
tgatatgggaaaagggctcgga

SEQ ID NO: 9075944 - DNA, 20 bp, Homo sapiens
tgatatggtttggctgtgtt

SEQ ID NO: 9075945 - DNA, 22 bp, Homo sapiens
tgatatttaagcaaaaatatgg

SEQ ID NO: 9075946 - DNA, 22 bp, Homo sapiens
tgatatttgctgactgcattgt

SEQ ID NO: 9075947 - DNA, 22 bp, Homo sapiens
tgatcccaatctttcctgctcc

SEQ ID NO: 9075948 - DNA, 22 bp, Homo sapiens
tgatccctggacttgagtaagt

SEQ ID NO: 9075949 - DNA, 18 bp, Homo sapiens
tgatctttcatgattcca

SEQ ID NO: 9075950 - DNA, 22 bp, Homo sapiens
tgatctttactgctgtttataa

SEQ ID NO: 9075951 - DNA, 22 bp, Homo sapiens
tgatctggtcctactgtgggca

SEQ ID NO: 9075952 - DNA, 22 bp, Homo sapiens
tgatctggtcctactgtgggca

SEQ ID NO: 9075953 - DNA, 22 bp, Homo sapiens
tgatctggtcctactgtgggca

SEQ ID NO: 9075954 - DNA, 19 bp, Homo sapiens
tgatctggaaggaaccagg

SEQ ID NO: 9075955 - DNA, 22 bp, Homo sapiens
tgatctggaattccctgtggta

SEQ ID NO: 9075956 - DNA, 22 bp, Homo sapiens
tgatcaaaacattactccacca

SEQ ID NO: 9075957 - DNA, 22 bp, Homo sapiens
tgatcagcatcttcccagctcg

SEQ ID NO: 9075958 - DNA, 22 bp, Homo sapiens
tgatcagcatcttcccagctcg

SEQ ID NO: 9075959 - DNA, 21 bp, Homo sapiens
tgatcacatgaaaaccatgca

SEQ ID NO: 9075960 - DNA, 22 bp, Homo sapiens
tgatggaagtgactgtcagttc

SEQ ID NO: 9075961 - DNA, 22 bp, Homo sapiens
tgatggagcatgtgtgcttcct

SEQ ID NO: 9075962 - DNA, 22 bp, Homo sapiens
tgatggaggacccagcgtggga

SEQ ID NO: 9075963 - DNA, 18 bp, Homo sapiens
tgatggaggagggctggt

SEQ ID NO: 9075964 - DNA, 23 bp, Homo sapiens
tgatggccgccctttgccctgtc

SEQ ID NO: 9075965 - DNA, 22 bp, Homo sapiens
tgatgggaggtgctgcaggacc

SEQ ID NO: 9075966 - DNA, 22 bp, Homo sapiens
tgatggggaattaattaatggg

SEQ ID NO: 9075967 - DNA, 22 bp, Homo sapiens
tgatgggaaaatgaggcctggg

SEQ ID NO: 9075968 - DNA, 22 bp, Homo sapiens
tgatgggaggtgctgcaggacc

SEQ ID NO: 9075969 - DNA, 22 bp, Homo sapiens
tgatgggaggtgctgcaggacc

SEQ ID NO: 9075970 - DNA, 22 bp, Homo sapiens
tgatgatgtttatcttggtatt

SEQ ID NO: 9075971 - DNA, 22 bp, Homo sapiens
tgatgaggtggattcaaagcag

SEQ ID NO: 9075972 - DNA, 18 bp, Homo sapiens
tgatctttgagtataatg

SEQ ID NO: 9075973 - DNA, 22 bp, Homo sapiens
tgatctttgggccattaataaa

SEQ ID NO: 9075974 - DNA, 22 bp, Homo sapiens
tgatctttggtagtacgataat

SEQ ID NO: 9075975 - DNA, 22 bp, Homo sapiens
tgatctttgggccattaataaa

SEQ ID NO: 9075976 - DNA, 22 bp, Homo sapiens
tgatcttttcaaagacaagctt

SEQ ID NO: 9075977 - DNA, 22 bp, Homo sapiens
tgatctttggtagtacgataat

SEQ ID NO: 9075978 - DNA, 22 bp, Homo sapiens
tgatctttttggtcatttgggt

SEQ ID NO: 9075979 - DNA, 22 bp, Homo sapiens
tgatgatttgaaaccagtttct

SEQ ID NO: 9075980 - DNA, 22 bp, Homo sapiens
tgatgattgggagacatttggg

SEQ ID NO: 9075981 - DNA, 22 bp, Homo sapiens
tgatgatttcatttctagctgt

SEQ ID NO: 9075982 - DNA, 22 bp, Homo sapiens
tgatgcattgccgacttactgg

SEQ ID NO: 9075983 - DNA, 22 bp, Homo sapiens
tgatgcattgccgacttactgg

SEQ ID NO: 9075984 - DNA, 19 bp, Homo sapiens
tgatgccctgacctgagcc

SEQ ID NO: 9075985 - DNA, 23 bp, Homo sapiens
tgattgaaatgaggagtatttgt

SEQ ID NO: 9075986 - DNA, 22 bp, Homo sapiens
tgattctttctccaccaattca

SEQ ID NO: 9075987 - DNA, 22 bp, Homo sapiens
tgattctgttctccttgagaat

SEQ ID NO: 9075988 - DNA, 18 bp, Homo sapiens
tgattctgtgatgtggtc

SEQ ID NO: 9075989 - DNA, 22 bp, Homo sapiens
tgattctgtgaattagttgggt

SEQ ID NO: 9075990 - DNA, 22 bp, Homo sapiens
tgattctgtaagtcatattgtt

SEQ ID NO: 9075991 - DNA, 22 bp, Homo sapiens
tgattgtttcctatgtacacct

SEQ ID NO: 9075992 - DNA, 22 bp, Homo sapiens
tgatttaaaagaaacattgtct

SEQ ID NO: 9075993 - DNA, 22 bp, Homo sapiens
tgattgaattcaaatgcaatct

SEQ ID NO: 9075994 - DNA, 22 bp, Homo sapiens
tgattgactttagaatagcact

SEQ ID NO: 9075995 - DNA, 22 bp, Homo sapiens
tgattctgcttatgggtggatt

SEQ ID NO: 9075996 - DNA, 22 bp, Homo sapiens
tgattctgccacgtactggctg

SEQ ID NO: 9075997 - DNA, 22 bp, Homo sapiens
tgattcatcagaataggagttt

SEQ ID NO: 9075998 - DNA, 22 bp, Homo sapiens
tgatgtggccccacttagctgt

SEQ ID NO: 9075999 - DNA, 22 bp, Homo sapiens
tgattaaattaattaagatgag

SEQ ID NO: 9076000 - DNA, 22 bp, Homo sapiens
tgattcagacctgtcagacttc

SEQ ID NO: 9076001 - DNA, 22 bp, Homo sapiens
tgattcaattatctgatgcttt

SEQ ID NO: 9076002 - DNA, 22 bp, Homo sapiens
tgattcaagctactgttactgg

SEQ ID NO: 9076003 - DNA, 22 bp, Homo sapiens
tgattcaataggaattgagtag

SEQ ID NO: 9076004 - DNA, 22 bp, Homo sapiens
tgattcaataggaattgagtag

SEQ ID NO: 9076005 - DNA, 22 bp, Homo sapiens
tgattcatcagaataggagttt

SEQ ID NO: 9076006 - DNA, 22 bp, Homo sapiens
tgattcagtactttctctaact

SEQ ID NO: 9076007 - DNA, 23 bp, Homo sapiens
tgattcagcaagtccacttctgg

SEQ ID NO: 9076008 - DNA, 23 bp, Homo sapiens
tgattacaagggccaaagaaagg

SEQ ID NO: 9076009 - DNA, 22 bp, Homo sapiens
tgattaagttcaaaatatagaa

SEQ ID NO: 9076010 - DNA, 22 bp, Homo sapiens
tgattaatatcaccaccattgg

SEQ ID NO: 9076011 - DNA, 22 bp, Homo sapiens
tgcagcagagtgggcctgggtg

SEQ ID NO: 9076012 - DNA, 21 bp, Homo sapiens
tgcagcagagtaagcagggga

SEQ ID NO: 9076013 - DNA, 21 bp, Homo sapiens
tgcagcagatttgggggaaga

SEQ ID NO: 9076014 - DNA, 22 bp, Homo sapiens
tgcagcagacataatgtggatt

SEQ ID NO: 9076015 - DNA, 22 bp, Homo sapiens
tgcagcagactgagtatgagaa

SEQ ID NO: 9076016 - DNA, 22 bp, Homo sapiens
tgcagcagactgagtatgagaa

SEQ ID NO: 9076017 - DNA, 21 bp, Homo sapiens
tgcagcagagtaagcagggga

SEQ ID NO: 9076018 - DNA, 22 bp, Homo sapiens
tgcagcagggcccaggcacaga

SEQ ID NO: 9076019 - DNA, 22 bp, Homo sapiens
tgcagcagggacctctatgtga

SEQ ID NO: 9076020 - DNA, 22 bp, Homo sapiens
tgcagcagggcccaggcacaga

SEQ ID NO: 9076021 - DNA, 22 bp, Homo sapiens
tgcagcaggcacaggacggaag

SEQ ID NO: 9076022 - DNA, 22 bp, Homo sapiens
tgcagcaggagccaggcctggt

SEQ ID NO: 9076023 - DNA, 22 bp, Homo sapiens
tgcagcaggagccaggcctggt

SEQ ID NO: 9076024 - DNA, 22 bp, Homo sapiens
tgcagcaggagccaggcctggt

SEQ ID NO: 9076025 - DNA, 22 bp, Homo sapiens
tgcagcagccaaggttctgtgc

SEQ ID NO: 9076026 - DNA, 22 bp, Homo sapiens
tgcagcagccaaggttctgtgc

SEQ ID NO: 9076027 - DNA, 22 bp, Homo sapiens
tgcagcagcagggaggaggctc

SEQ ID NO: 9076028 - DNA, 22 bp, Homo sapiens
tgcagcagcctcatctggtttc

SEQ ID NO: 9076029 - DNA, 22 bp, Homo sapiens
tgcagcagctccaggttaccct

SEQ ID NO: 9076030 - DNA, 23 bp, Homo sapiens
tgcagccactcaggagctcagtg

SEQ ID NO: 9076031 - DNA, 22 bp, Homo sapiens
tgcagccaggaaatatttgctg

SEQ ID NO: 9076032 - DNA, 22 bp, Homo sapiens
tgcagccagcaagtgaatacat

SEQ ID NO: 9076033 - DNA, 19 bp, Homo sapiens
tgcagccacgtgagagact

SEQ ID NO: 9076034 - DNA, 23 bp, Homo sapiens
tgcagcagggtggtctacttctc

SEQ ID NO: 9076035 - DNA, 21 bp, Homo sapiens
tgcagccattcagccctatgc

SEQ ID NO: 9076036 - DNA, 22 bp, Homo sapiens
tgcagcccagccccagaacctt

SEQ ID NO: 9076037 - DNA, 22 bp, Homo sapiens
tgcagccattttctgccaatgc

SEQ ID NO: 9076038 - DNA, 22 bp, Homo sapiens
tgcagccatcgcagagtctgta

SEQ ID NO: 9076039 - DNA, 22 bp, Homo sapiens
tgcagccatctttcttggagga

SEQ ID NO: 9076040 - DNA, 22 bp, Homo sapiens
tgcagcccttccttcctctggg

SEQ ID NO: 9076041 - DNA, 22 bp, Homo sapiens
tgcagcccttccttcctctggg

SEQ ID NO: 9076042 - DNA, 22 bp, Homo sapiens
tgcagcccaggcgtcaggtggt

SEQ ID NO: 9076043 - DNA, 19 bp, Homo sapiens
tgcagcccctaccacattc

SEQ ID NO: 9076044 - DNA, 22 bp, Homo sapiens
tgcagccccccagatggccgta

SEQ ID NO: 9076045 - DNA, 22 bp, Homo sapiens
tgcagcccctatcgcggacagg

SEQ ID NO: 9076046 - DNA, 22 bp, Homo sapiens
tgcagcccctgaaaatggcagc

SEQ ID NO: 9076047 - DNA, 22 bp, Homo sapiens
tgcagccctgtgcacatcccct

SEQ ID NO: 9076048 - DNA, 21 bp, Homo sapiens
tgcagctgggttctggtttgc

SEQ ID NO: 9076049 - DNA, 22 bp, Homo sapiens
tgcagctggtatcccatggatt

SEQ ID NO: 9076050 - DNA, 21 bp, Homo sapiens
tgcagctgggttctggtttgc

SEQ ID NO: 9076051 - DNA, 22 bp, Homo sapiens
tgcagctggtttagaactagat

SEQ ID NO: 9076052 - DNA, 22 bp, Homo sapiens
tgcagctggtatcccatggatt

SEQ ID NO: 9076053 - DNA, 22 bp, Homo sapiens
tgcagctggtttagaactagat

SEQ ID NO: 9076054 - DNA, 22 bp, Homo sapiens
tgcagctggtttagaactagat

SEQ ID NO: 9076055 - DNA, 20 bp, Homo sapiens
tgcagctggtttcacaggga

SEQ ID NO: 9076056 - DNA, 22 bp, Homo sapiens
tgcagctgggtctgccctggct

SEQ ID NO: 9076057 - DNA, 22 bp, Homo sapiens
tgcagctgggtctgccctggct

SEQ ID NO: 9076058 - DNA, 22 bp, Homo sapiens
tgcagctgggacatttttgata

SEQ ID NO: 9076059 - DNA, 22 bp, Homo sapiens
tgcagctgggacatttttgata

SEQ ID NO: 9076060 - DNA, 22 bp, Homo sapiens
tgcagctggatttatcttttcc

SEQ ID NO: 9076061 - DNA, 22 bp, Homo sapiens
tgcagctgcttgattcatcttg

SEQ ID NO: 9076062 - DNA, 22 bp, Homo sapiens
tgcagctggaacttagaggaga

SEQ ID NO: 9076063 - DNA, 22 bp, Homo sapiens
tgcagctggaacttagaggaga

SEQ ID NO: 9076064 - DNA, 22 bp, Homo sapiens
tgcagctgcttgattcatcttg

SEQ ID NO: 9076065 - DNA, 22 bp, Homo sapiens
tgcagctggatttatcttttcc

SEQ ID NO: 9076066 - DNA, 22 bp, Homo sapiens
tgcagctgaggccagctatgcc

SEQ ID NO: 9076067 - DNA, 22 bp, Homo sapiens
tgcagctgataattacatgttc

SEQ ID NO: 9076068 - DNA, 22 bp, Homo sapiens
tgcagctgagtcacccagccat

SEQ ID NO: 9076069 - DNA, 22 bp, Homo sapiens
tgcagctgataattacatgttc

SEQ ID NO: 9076070 - DNA, 22 bp, Homo sapiens
tgcagctgatgatacccccatg

SEQ ID NO: 9076071 - DNA, 17 bp, Homo sapiens
tgcagctgatggggaaa

SEQ ID NO: 9076072 - DNA, 22 bp, Homo sapiens
tgcagctgctcttcatttcccc

SEQ ID NO: 9076073 - DNA, 22 bp, Homo sapiens
tgcagctgctggcccaggtgct

SEQ ID NO: 9076074 - DNA, 17 bp, Homo sapiens
tgcagctgctcccaggc

SEQ ID NO: 9076075 - DNA, 17 bp, Homo sapiens
tgcagctgctcccaggc

SEQ ID NO: 9076076 - DNA, 22 bp, Homo sapiens
tgcagctgctggtggctgaaag

SEQ ID NO: 9076077 - DNA, 22 bp, Homo sapiens
tgcagctgcttgattcatcttg

SEQ ID NO: 9076078 - DNA, 22 bp, Homo sapiens
tgcagctgctggcccaggtgct

SEQ ID NO: 9076079 - DNA, 22 bp, Homo sapiens
tgcagctgctcttcatttcccc

SEQ ID NO: 9076080 - DNA, 22 bp, Homo sapiens
tgcagctgctggtggctgaaag

SEQ ID NO: 9076081 - DNA, 21 bp, Homo sapiens
tgcagctgacaccctttggga

SEQ ID NO: 9076082 - DNA, 21 bp, Homo sapiens
tgcagctgacaccctttggga

SEQ ID NO: 9076083 - DNA, 22 bp, Homo sapiens
tgcagctgaacctagagtctgt

SEQ ID NO: 9076084 - DNA, 22 bp, Homo sapiens
tgcagctgaacctagagtctgt

SEQ ID NO: 9076085 - DNA, 22 bp, Homo sapiens
tgcagctctgtatgctgattat

SEQ ID NO: 9076086 - DNA, 22 bp, Homo sapiens
tgcagctgaaaggactgaatga

SEQ ID NO: 9076087 - DNA, 22 bp, Homo sapiens
tgcagctgaaaggactgaatga

SEQ ID NO: 9076088 - DNA, 22 bp, Homo sapiens
tgcagctctgggcaagtgcctt

SEQ ID NO: 9076089 - DNA, 22 bp, Homo sapiens
tgcagctctgaacagtcatgaa

SEQ ID NO: 9076090 - DNA, 22 bp, Homo sapiens
tgcagctgaccagcaagtcctg

SEQ ID NO: 9076091 - DNA, 22 bp, Homo sapiens
tgcagctgaccagcaagtcctg

SEQ ID NO: 9076092 - DNA, 22 bp, Homo sapiens
tgcagctgaccagcaagtcctg

SEQ ID NO: 9076093 - DNA, 21 bp, Homo sapiens
tgcagctgacactggtatgcc

SEQ ID NO: 9076094 - DNA, 21 bp, Homo sapiens
tgcagctgacactggtatgcc

SEQ ID NO: 9076095 - DNA, 22 bp, Homo sapiens
tgcagctgaggccagctatgcc

SEQ ID NO: 9076096 - DNA, 22 bp, Homo sapiens
tgcagctgaggccagctatgcc

SEQ ID NO: 9076097 - DNA, 22 bp, Homo sapiens
tgcagctgacccactccagtcc

SEQ ID NO: 9076098 - DNA, 22 bp, Homo sapiens
tgcagctgacccactccagtcc

SEQ ID NO: 9076099 - DNA, 23 bp, Homo sapiens
tgcagctcaaagatgggtaaatg

SEQ ID NO: 9076100 - DNA, 22 bp, Homo sapiens
tgcagctagcgtgcctagtgaa

SEQ ID NO: 9076101 - DNA, 22 bp, Homo sapiens
tgcagccttgcctcctcccagc

SEQ ID NO: 9076102 - DNA, 22 bp, Homo sapiens
tgcagccttgcctcctcccagc

SEQ ID NO: 9076103 - DNA, 22 bp, Homo sapiens
tgcagctcctctggctgcctga

SEQ ID NO: 9076104 - DNA, 22 bp, Homo sapiens
tgcagctcattgctggggtctg

SEQ ID NO: 9076105 - DNA, 22 bp, Homo sapiens
tgcagctcatattagagagaag

SEQ ID NO: 9076106 - DNA, 22 bp, Homo sapiens
tgcagctcattggtgtcctggt

SEQ ID NO: 9076107 - DNA, 22 bp, Homo sapiens
tgcagctcaggattctcagggc

SEQ ID NO: 9076108 - DNA, 22 bp, Homo sapiens
tgcagctcaggattctcagggc

SEQ ID NO: 9076109 - DNA, 21 bp, Homo sapiens
tgcaggagtgtaatgtgaccc

SEQ ID NO: 9076110 - DNA, 21 bp, Homo sapiens
tgcaggagtctgtgagtcagg

SEQ ID NO: 9076111 - DNA, 22 bp, Homo sapiens
tgcaggcaccattctgcctctc

SEQ ID NO: 9076112 - DNA, 22 bp, Homo sapiens
tgcaggcagctaaaccatgtaa

SEQ ID NO: 9076113 - DNA, 22 bp, Homo sapiens
tgcaggagttcccctctgcctg

SEQ ID NO: 9076114 - DNA, 21 bp, Homo sapiens
tgcaggctacttctgactcta

SEQ ID NO: 9076115 - DNA, 23 bp, Homo sapiens
tgcaggctaggaagagagccttc

SEQ ID NO: 9076116 - DNA, 22 bp, Homo sapiens
tgcaggctatcctttgctgcaa

SEQ ID NO: 9076117 - DNA, 21 bp, Homo sapiens
tgcaggctacttctgactcta

SEQ ID NO: 9076118 - DNA, 22 bp, Homo sapiens
tgcaggcctggactgatgtggt

SEQ ID NO: 9076119 - DNA, 22 bp, Homo sapiens
tgcaggcctcagacttagccat

SEQ ID NO: 9076120 - DNA, 22 bp, Homo sapiens
tgcaggcctcagacttagccat

SEQ ID NO: 9076121 - DNA, 22 bp, Homo sapiens
tgcaggcagctgaaaggtgcct

SEQ ID NO: 9076122 - DNA, 22 bp, Homo sapiens
tgcaggctcacctgccagggcc

SEQ ID NO: 9076123 - DNA, 22 bp, Homo sapiens
tgcaggctccaggtgcacatat

SEQ ID NO: 9076124 - DNA, 22 bp, Homo sapiens
tgcaggctcaccctggagctga

SEQ ID NO: 9076125 - DNA, 22 bp, Homo sapiens
tgcaggctcaccctggagctga

SEQ ID NO: 9076126 - DNA, 22 bp, Homo sapiens
tgcaggctcacctgccagggcc

SEQ ID NO: 9076127 - DNA, 22 bp, Homo sapiens
tgcaggagcccttgggctctgg

SEQ ID NO: 9076128 - DNA, 19 bp, Homo sapiens
tgcaggaggactgagcaga

SEQ ID NO: 9076129 - DNA, 22 bp, Homo sapiens
tgcaggagctgtgcggtgaggg

SEQ ID NO: 9076130 - DNA, 22 bp, Homo sapiens
tgcaggagggagggttacagtt

SEQ ID NO: 9076131 - DNA, 22 bp, Homo sapiens
tgcaggaggattttgtggagct

SEQ ID NO: 9076132 - DNA, 19 bp, Homo sapiens
tgcaggaggactgagcaga

SEQ ID NO: 9076133 - DNA, 22 bp, Homo sapiens
tgcaggagataatggtgcttag

SEQ ID NO: 9076134 - DNA, 22 bp, Homo sapiens
tgcaggagcagagatggctgga

SEQ ID NO: 9076135 - DNA, 22 bp, Homo sapiens
tgcaggagcagagatggctgga

SEQ ID NO: 9076136 - DNA, 22 bp, Homo sapiens
tgcaggagcaccagctcaccct

SEQ ID NO: 9076137 - DNA, 22 bp, Homo sapiens
tgcaggagagctggtctggccc

SEQ ID NO: 9076138 - DNA, 22 bp, Homo sapiens
tgcaggagaaagtacggagcgt

SEQ ID NO: 9076139 - DNA, 22 bp, Homo sapiens
tgcaggagacataatagggact

SEQ ID NO: 9076140 - DNA, 22 bp, Homo sapiens
tgcaggagaaagtacggagcgt

SEQ ID NO: 9076141 - DNA, 22 bp, Homo sapiens
tgcaggagaaagtacggagcgt

SEQ ID NO: 9076142 - DNA, 22 bp, Homo sapiens
tgcaggaagcaaccaggtccaa

SEQ ID NO: 9076143 - DNA, 22 bp, Homo sapiens
tgcaggaagacttcccaagcca

SEQ ID NO: 9076144 - DNA, 22 bp, Homo sapiens
tgcaggaactcgaaaactatag

SEQ ID NO: 9076145 - DNA, 22 bp, Homo sapiens
tgcaggaaacagaggctcaaat

SEQ ID NO: 9076146 - DNA, 22 bp, Homo sapiens
tgcaggaacagaactcactccc

SEQ ID NO: 9076147 - DNA, 22 bp, Homo sapiens
tgcagctgtaacagaggcctca

SEQ ID NO: 9076148 - DNA, 20 bp, Homo sapiens
tgcagctggtttcacaggga

SEQ ID NO: 9076149 - DNA, 20 bp, Homo sapiens
tgcagctggtttcacaggga

SEQ ID NO: 9076150 - DNA, 22 bp, Homo sapiens
tgcagctgtaacagaggcctca

SEQ ID NO: 9076151 - DNA, 22 bp, Homo sapiens
tgcagctgtaacagaggcctca

SEQ ID NO: 9076152 - DNA, 22 bp, Homo sapiens
tgcagctgtaacagaggcctca

SEQ ID NO: 9076153 - DNA, 19 bp, Homo sapiens
tgcagctgtctctatatta

SEQ ID NO: 9076154 - DNA, 19 bp, Homo sapiens
tgcagctgtatgagcttaa

SEQ ID NO: 9076155 - DNA, 22 bp, Homo sapiens
tgcagctgtgaaagggaaccaa

SEQ ID NO: 9076156 - DNA, 22 bp, Homo sapiens
tgcagctgtgcctgaaaagtac

SEQ ID NO: 9076157 - DNA, 22 bp, Homo sapiens
tgcagctgtgaaagggaaccaa

SEQ ID NO: 9076158 - DNA, 22 bp, Homo sapiens
tgcagctgtgggagaatctctg

SEQ ID NO: 9076159 - DNA, 22 bp, Homo sapiens
tgcagctgtgggagaatctctg

SEQ ID NO: 9076160 - DNA, 22 bp, Homo sapiens
tgcagctgtgcctgaaaagtac

SEQ ID NO: 9076161 - DNA, 22 bp, Homo sapiens
tgcagctgttacggaccctgtc

SEQ ID NO: 9076162 - DNA, 22 bp, Homo sapiens
tgcagctgttacggaccctgtc

SEQ ID NO: 9076163 - DNA, 22 bp, Homo sapiens
tgcaggaaaaataaatagtgtt

SEQ ID NO: 9076164 - DNA, 22 bp, Homo sapiens
tgcaggaaacagaggctcaaat

SEQ ID NO: 9076165 - DNA, 20 bp, Homo sapiens
tgcagcttctcatcttcaaa

SEQ ID NO: 9076166 - DNA, 22 bp, Homo sapiens
tgcagctgttacggaccctgtc

SEQ ID NO: 9076167 - DNA, 22 bp, Homo sapiens
tgcagaggagctggaaggctgg

SEQ ID NO: 9076168 - DNA, 22 bp, Homo sapiens
tgcagaggagctggaaggctgg

SEQ ID NO: 9076169 - DNA, 22 bp, Homo sapiens
tgcagaggagtcagcctgggca

SEQ ID NO: 9076170 - DNA, 22 bp, Homo sapiens
tgcagaggagctggaaggctgg

SEQ ID NO: 9076171 - DNA, 22 bp, Homo sapiens
tgcagaggagtcagcctgggca

SEQ ID NO: 9076172 - DNA, 21 bp, Homo sapiens
tgcagaggcacaaacaagccc

SEQ ID NO: 9076173 - DNA, 22 bp, Homo sapiens
tgcagaggcgccgtgggtgggg

SEQ ID NO: 9076174 - DNA, 23 bp, Homo sapiens
tgcagaggcatgatcactgctca

SEQ ID NO: 9076175 - DNA, 23 bp, Homo sapiens
tgcagaggcatgatcactgctca

SEQ ID NO: 9076176 - DNA, 20 bp, Homo sapiens
tgcagaatcctgtgatcagt

SEQ ID NO: 9076177 - DNA, 22 bp, Homo sapiens
tgcagaatattctggtgacaat

SEQ ID NO: 9076178 - DNA, 22 bp, Homo sapiens
tgcagaatattctggtgacaat

SEQ ID NO: 9076179 - DNA, 22 bp, Homo sapiens
tgcagaatgtggacagtgggtt

SEQ ID NO: 9076180 - DNA, 22 bp, Homo sapiens
tgcagaatctcaaccttaccca

SEQ ID NO: 9076181 - DNA, 22 bp, Homo sapiens
tgcagaatgttatcaaagttag

SEQ ID NO: 9076182 - DNA, 22 bp, Homo sapiens
tgcagaattatggtgctggctt

SEQ ID NO: 9076183 - DNA, 22 bp, Homo sapiens
tgcagaattctcagtcagactc

SEQ ID NO: 9076184 - DNA, 21 bp, Homo sapiens
tgcagaattctgggagccccc

SEQ ID NO: 9076185 - DNA, 22 bp, Homo sapiens
tgcagaattctcagtcagactc

SEQ ID NO: 9076186 - DNA, 22 bp, Homo sapiens
tgcagaatttagggaggcagca

SEQ ID NO: 9076187 - DNA, 21 bp, Homo sapiens
tgcagacagggacagaatgga

SEQ ID NO: 9076188 - DNA, 22 bp, Homo sapiens
tgcagacaagtgcatctaaccc

SEQ ID NO: 9076189 - DNA, 22 bp, Homo sapiens
tgcagacagagaaatgaggccc

SEQ ID NO: 9076190 - DNA, 22 bp, Homo sapiens
tgcagacaagtcgtgggatctt

SEQ ID NO: 9076191 - DNA, 22 bp, Homo sapiens
tgcagacctcccatggctgcct

SEQ ID NO: 9076192 - DNA, 21 bp, Homo sapiens
tgcagagatatctgaagcaga

SEQ ID NO: 9076193 - DNA, 22 bp, Homo sapiens
tgcagagattgaacaagaagga

SEQ ID NO: 9076194 - DNA, 20 bp, Homo sapiens
tgcagagctggctggctcct

SEQ ID NO: 9076195 - DNA, 22 bp, Homo sapiens
tgcagaggagctggaaggctgg

SEQ ID NO: 9076196 - DNA, 22 bp, Homo sapiens
tgcagagggacagccacagctc

SEQ ID NO: 9076197 - DNA, 22 bp, Homo sapiens
tgcagagggacagccacagctc

SEQ ID NO: 9076198 - DNA, 23 bp, Homo sapiens
tgcagagggactgaagccagctt

SEQ ID NO: 9076199 - DNA, 22 bp, Homo sapiens
tgcagatacagtatgtggaagc

SEQ ID NO: 9076200 - DNA, 22 bp, Homo sapiens
tgcagatagcgtcattcttgct

SEQ ID NO: 9076201 - DNA, 22 bp, Homo sapiens
tgcagatgaatgctgagacact

SEQ ID NO: 9076202 - DNA, 23 bp, Homo sapiens
tgcagcaaccttggaagcatttc

SEQ ID NO: 9076203 - DNA, 22 bp, Homo sapiens
tgcagattcaaatgaaatgcaa

SEQ ID NO: 9076204 - DNA, 22 bp, Homo sapiens
tgcagcaaaaggtcagagggag

SEQ ID NO: 9076205 - DNA, 22 bp, Homo sapiens
tgcagattcaaatgaaatgcaa

SEQ ID NO: 9076206 - DNA, 22 bp, Homo sapiens
tgcagatgagggatgaaaatga

SEQ ID NO: 9076207 - DNA, 22 bp, Homo sapiens
tgcagatgcctgggctgcacca

SEQ ID NO: 9076208 - DNA, 22 bp, Homo sapiens
tgcagatggggatcagtggctc

SEQ ID NO: 9076209 - DNA, 22 bp, Homo sapiens
tgcagcaccacacctggctaat

SEQ ID NO: 9076210 - DNA, 22 bp, Homo sapiens
tgcagcaatttgcagtaattta

SEQ ID NO: 9076211 - DNA, 21 bp, Homo sapiens
tgcagcagaagtctctgtgtc

SEQ ID NO: 9076212 - DNA, 21 bp, Homo sapiens
tgcagcagaagtctctgtgtc

SEQ ID NO: 9076213 - DNA, 20 bp, Homo sapiens
tgcagcagaagcccatgctc

SEQ ID NO: 9076214 - DNA, 20 bp, Homo sapiens
tgcagcagaagcccatgctc

SEQ ID NO: 9076215 - DNA, 22 bp, Homo sapiens
tgcagcagaagtgttcttctct

SEQ ID NO: 9076216 - DNA, 22 bp, Homo sapiens
tgcagcagaatatggctgcagg

SEQ ID NO: 9076217 - DNA, 20 bp, Homo sapiens
tgcagaagaacgttctggtt

SEQ ID NO: 9076218 - DNA, 20 bp, Homo sapiens
tgcagaagaacgttctggtt

SEQ ID NO: 9076219 - DNA, 22 bp, Homo sapiens
tgcagaagaaaacagctgtgtg

SEQ ID NO: 9076220 - DNA, 22 bp, Homo sapiens
tgcagaagaaaacagctgtgtg

SEQ ID NO: 9076221 - DNA, 22 bp, Homo sapiens
tgcagaagacacaaggtaacgt

SEQ ID NO: 9076222 - DNA, 22 bp, Homo sapiens
tgcagaagaatgagcttggagt

SEQ ID NO: 9076223 - DNA, 22 bp, Homo sapiens
tgcagaagaatgtaggcataag

SEQ ID NO: 9076224 - DNA, 22 bp, Homo sapiens
tgcagaagacacaaggtaacgt

SEQ ID NO: 9076225 - DNA, 19 bp, Homo sapiens
tgcagaagacacagtggtg

SEQ ID NO: 9076226 - DNA, 22 bp, Homo sapiens
tgcagaagaccttccagggctg

SEQ ID NO: 9076227 - DNA, 22 bp, Homo sapiens
tgcagaagaccttccagggctg

SEQ ID NO: 9076228 - DNA, 22 bp, Homo sapiens
tgcagaagatggtctgagcacc

SEQ ID NO: 9076229 - DNA, 22 bp, Homo sapiens
tgcagaagcagagccggtggcc

SEQ ID NO: 9076230 - DNA, 22 bp, Homo sapiens
tgcagaagctgcaggtcagtgg

SEQ ID NO: 9076231 - DNA, 22 bp, Homo sapiens
tgcagaagcagagagttgccaa

SEQ ID NO: 9076232 - DNA, 22 bp, Homo sapiens
tgcagaagcagagagttgccaa

SEQ ID NO: 9076233 - DNA, 22 bp, Homo sapiens
tgcagaagcagagccggtggcc

SEQ ID NO: 9076234 - DNA, 22 bp, Homo sapiens
tgcagaagtgagtcatgaggaa

SEQ ID NO: 9076235 - DNA, 22 bp, Homo sapiens
tgcagaagtgagtcatgaggaa

SEQ ID NO: 9076236 - DNA, 22 bp, Homo sapiens
tgcagaagtattccaggcccca

SEQ ID NO: 9076237 - DNA, 22 bp, Homo sapiens
tgcagaagtgagtcatgaggaa

SEQ ID NO: 9076238 - DNA, 22 bp, Homo sapiens
tgcagaagtattccaggcccca

SEQ ID NO: 9076239 - DNA, 22 bp, Homo sapiens
tgcagaagctgcaggtcagtgg

SEQ ID NO: 9076240 - DNA, 22 bp, Homo sapiens
tgcagaaggaggaggaaatcca

SEQ ID NO: 9076241 - DNA, 22 bp, Homo sapiens
tgcagaaggcctgacattgcac

SEQ ID NO: 9076242 - DNA, 22 bp, Homo sapiens
tgcagaaggcctgacattgcac

SEQ ID NO: 9076243 - DNA, 22 bp, Homo sapiens
tgcaccttttagaagtcatttt

SEQ ID NO: 9076244 - DNA, 22 bp, Homo sapiens
tgcacctttaaattcagcagta

SEQ ID NO: 9076245 - DNA, 22 bp, Homo sapiens
tgcacgtgtgagcattcacatg

SEQ ID NO: 9076246 - DNA, 22 bp, Homo sapiens
tgcacgtgggctctctgctctt

SEQ ID NO: 9076247 - DNA, 22 bp, Homo sapiens
tgcactactgtgatacacagcc

SEQ ID NO: 9076248 - DNA, 22 bp, Homo sapiens
tgcactactgtgatacacagcc

SEQ ID NO: 9076249 - DNA, 22 bp, Homo sapiens
tgcactactgtgatacacagcc

SEQ ID NO: 9076250 - DNA, 22 bp, Homo sapiens
tgcagaacagggccatgtcacc

SEQ ID NO: 9076251 - DNA, 22 bp, Homo sapiens
tgcagaaataactcatattgca

SEQ ID NO: 9076252 - DNA, 22 bp, Homo sapiens
tgcagaaaccaattcaagtaag

SEQ ID NO: 9076253 - DNA, 22 bp, Homo sapiens
tgcagaaataactcatattgca

SEQ ID NO: 9076254 - DNA, 22 bp, Homo sapiens
tgcacctgagaggtctctgagg

SEQ ID NO: 9076255 - DNA, 22 bp, Homo sapiens
tgcaccaagtctggcactgaat

SEQ ID NO: 9076256 - DNA, 22 bp, Homo sapiens
tgcaccaagcccagctggagaa

SEQ ID NO: 9076257 - DNA, 22 bp, Homo sapiens
tgcacagtaaacatgactggag

SEQ ID NO: 9076258 - DNA, 22 bp, Homo sapiens
tgcacagttggctacatcgtgg

SEQ ID NO: 9076259 - DNA, 22 bp, Homo sapiens
tgcacagtgaccactgagcaag

SEQ ID NO: 9076260 - DNA, 18 bp, Homo sapiens
tgcacagctgtgggctgg

SEQ ID NO: 9076261 - DNA, 22 bp, Homo sapiens
tgcacagctgcctcctctctgc

SEQ ID NO: 9076262 - DNA, 20 bp, Homo sapiens
tgcacagctgtgaataggat

SEQ ID NO: 9076263 - DNA, 21 bp, Homo sapiens
tgcacagccataccctccttg

SEQ ID NO: 9076264 - DNA, 22 bp, Homo sapiens
tgcacagcgggtgtctgtcagg

SEQ ID NO: 9076265 - DNA, 22 bp, Homo sapiens
tgcacacagttctcaggaaaga

SEQ ID NO: 9076266 - DNA, 22 bp, Homo sapiens
tgcacacagttctcaggaaaga

SEQ ID NO: 9076267 - DNA, 22 bp, Homo sapiens
tgcacacagtggacaagtcttg

SEQ ID NO: 9076268 - DNA, 20 bp, Homo sapiens
tgcacagggtgggaagcaac

SEQ ID NO: 9076269 - DNA, 22 bp, Homo sapiens
tgcccaaactgacattggcagt

SEQ ID NO: 9076270 - DNA, 20 bp, Homo sapiens
tgcccacatcactcaggagt

SEQ ID NO: 9076271 - DNA, 22 bp, Homo sapiens
tgcccacaggaagacaccagcg

SEQ ID NO: 9076272 - DNA, 22 bp, Homo sapiens
tgcccacaggaagacaccagcg

SEQ ID NO: 9076273 - DNA, 22 bp, Homo sapiens
tgcccacagctcagggctgctc

SEQ ID NO: 9076274 - DNA, 22 bp, Homo sapiens
tgcccacacctgggggaggctg

SEQ ID NO: 9076275 - DNA, 23 bp, Homo sapiens
tgcccacaaaagtaaagacattt

SEQ ID NO: 9076276 - DNA, 20 bp, Homo sapiens
tgcccacaattcacaatgcc

SEQ ID NO: 9076277 - DNA, 22 bp, Homo sapiens
tgcccacagcaaagaggtagga

SEQ ID NO: 9076278 - DNA, 22 bp, Homo sapiens
tgcccacagatatgtgcagtct

SEQ ID NO: 9076279 - DNA, 21 bp, Homo sapiens
tgcccacagcaaatgcagagg

SEQ ID NO: 9076280 - DNA, 20 bp, Homo sapiens
tgccatggtaacagagtgtg

SEQ ID NO: 9076281 - DNA, 22 bp, Homo sapiens
tgccatggtgactgcaggaggt

SEQ ID NO: 9076282 - DNA, 22 bp, Homo sapiens
tgccatggaatcacctccagct

SEQ ID NO: 9076283 - DNA, 22 bp, Homo sapiens
tgccatggcctagacctgtgat

SEQ ID NO: 9076284 - DNA, 22 bp, Homo sapiens
tgcccacattctgaagctccct

SEQ ID NO: 9076285 - DNA, 20 bp, Homo sapiens
tgcccacatcactcaggagt

SEQ ID NO: 9076286 - DNA, 22 bp, Homo sapiens
tgcccacatctgcttatttcat

SEQ ID NO: 9076287 - DNA, 22 bp, Homo sapiens
tgcccacatggtgccatggcca

SEQ ID NO: 9076288 - DNA, 22 bp, Homo sapiens
tgcccacattcaaaaggtgatg

SEQ ID NO: 9076289 - DNA, 22 bp, Homo sapiens
tgcccagcagggagctacctgg

SEQ ID NO: 9076290 - DNA, 22 bp, Homo sapiens
tgcccaggatctggcgatgctc

SEQ ID NO: 9076291 - DNA, 22 bp, Homo sapiens
tgcccagcagggagctacctgg

SEQ ID NO: 9076292 - DNA, 22 bp, Homo sapiens
tgcccagcactgtgccagtcac

SEQ ID NO: 9076293 - DNA, 22 bp, Homo sapiens
tgcccagcactgtgccagtcac

SEQ ID NO: 9076294 - DNA, 22 bp, Homo sapiens
tgcccagcactgtgccagtcac

SEQ ID NO: 9076295 - DNA, 22 bp, Homo sapiens
tgcccagcactgtgccagtcac

SEQ ID NO: 9076296 - DNA, 22 bp, Homo sapiens
tgcccagcaataaaccagaaga

SEQ ID NO: 9076297 - DNA, 20 bp, Homo sapiens
tgcccagcaagagtgcagtt

SEQ ID NO: 9076298 - DNA, 22 bp, Homo sapiens
tgcccagcacccagcatgatgc

SEQ ID NO: 9076299 - DNA, 22 bp, Homo sapiens
tgcccagcacccagcatgatgc

SEQ ID NO: 9076300 - DNA, 22 bp, Homo sapiens
tgcccagcacccagcatgatgc

SEQ ID NO: 9076301 - DNA, 22 bp, Homo sapiens
tgcccctcagggaacgggtatc

SEQ ID NO: 9076302 - DNA, 22 bp, Homo sapiens
tgcccccttttcttgttacact

SEQ ID NO: 9076303 - DNA, 22 bp, Homo sapiens
tgcccctcgacgcaatgaaggg

SEQ ID NO: 9076304 - DNA, 22 bp, Homo sapiens
tgcccctctcctgtgatccaag

SEQ ID NO: 9076305 - DNA, 19 bp, Homo sapiens
tgcccccagcacctccctg

SEQ ID NO: 9076306 - DNA, 22 bp, Homo sapiens
tgcccccaggccctgtggttag

SEQ ID NO: 9076307 - DNA, 19 bp, Homo sapiens
tgcccccagcacctccctg

SEQ ID NO: 9076308 - DNA, 22 bp, Homo sapiens
tgccccctggtggccagagccg

SEQ ID NO: 9076309 - DNA, 20 bp, Homo sapiens
tgccccaggcctgcacctgc

SEQ ID NO: 9076310 - DNA, 22 bp, Homo sapiens
tgccccagacctactgaatggg

SEQ ID NO: 9076311 - DNA, 22 bp, Homo sapiens
tgcccaggtttgagtgcccaag

SEQ ID NO: 9076312 - DNA, 22 bp, Homo sapiens
tgcccaggtttgagtgcccaag

SEQ ID NO: 9076313 - DNA, 22 bp, Homo sapiens
tgcccaggtttgagtgcccaag

SEQ ID NO: 9076314 - DNA, 22 bp, Homo sapiens
tgcccaggctggagtgcagagg

SEQ ID NO: 9076315 - DNA, 22 bp, Homo sapiens
tgcccaggctggagtgcagagg

SEQ ID NO: 9076316 - DNA, 22 bp, Homo sapiens
tgcccaggcttcaccctcagag

SEQ ID NO: 9076317 - DNA, 22 bp, Homo sapiens
tgcccaggcttcaccctcagag

SEQ ID NO: 9076318 - DNA, 22 bp, Homo sapiens
tgcccaggctggaatgcagtgg

SEQ ID NO: 9076319 - DNA, 22 bp, Homo sapiens
tgcccaggctggagtacagtgg

SEQ ID NO: 9076320 - DNA, 22 bp, Homo sapiens
tgcccaggattgtgaggtcagg

SEQ ID NO: 9076321 - DNA, 19 bp, Homo sapiens
tgcccaggcctcccaaaag

SEQ ID NO: 9076322 - DNA, 19 bp, Homo sapiens
tgcccaggcctcccaaaag

SEQ ID NO: 9076323 - DNA, 20 bp, Homo sapiens
tgccagggccagcagaggct

SEQ ID NO: 9076324 - DNA, 21 bp, Homo sapiens
tgccagggatttacagagcct

SEQ ID NO: 9076325 - DNA, 22 bp, Homo sapiens
tgccagggagccctgctgacca

SEQ ID NO: 9076326 - DNA, 22 bp, Homo sapiens
tgccagggagccctgctgacca

SEQ ID NO: 9076327 - DNA, 22 bp, Homo sapiens
tgccaggcttagagcaggggct

SEQ ID NO: 9076328 - DNA, 22 bp, Homo sapiens
tgccaggctgtcaattcaccca

SEQ ID NO: 9076329 - DNA, 22 bp, Homo sapiens
tgccaggctccggaacgacagt

SEQ ID NO: 9076330 - DNA, 22 bp, Homo sapiens
tgccagggtgtcaggagagcta

SEQ ID NO: 9076331 - DNA, 23 bp, Homo sapiens
tgccagggtttgtttgtggttca

SEQ ID NO: 9076332 - DNA, 22 bp, Homo sapiens
tgccatctgaaaattacatcct

SEQ ID NO: 9076333 - DNA, 22 bp, Homo sapiens
tgccatctgcacccacctgccc

SEQ ID NO: 9076334 - DNA, 22 bp, Homo sapiens
tgccatcttccttcctctgcac

SEQ ID NO: 9076335 - DNA, 22 bp, Homo sapiens
tgccatcctgtgtcatgctcat

SEQ ID NO: 9076336 - DNA, 18 bp, Homo sapiens
tgccatccccagtcaagt

SEQ ID NO: 9076337 - DNA, 22 bp, Homo sapiens
tgccaggggacctagggatgtc

SEQ ID NO: 9076338 - DNA, 22 bp, Homo sapiens
tgccagggtcagctgcagctct

SEQ ID NO: 9076339 - DNA, 22 bp, Homo sapiens
tgccagggccatagggagtcta

SEQ ID NO: 9076340 - DNA, 22 bp, Homo sapiens
tgccagggccatagggagtcta

SEQ ID NO: 9076341 - DNA, 20 bp, Homo sapiens
tgccaggcacggagtgcatg

SEQ ID NO: 9076342 - DNA, 22 bp, Homo sapiens
tgccagcctggcctgagtcttt

SEQ ID NO: 9076343 - DNA, 18 bp, Homo sapiens
tgccagccgactggcctg

SEQ ID NO: 9076344 - DNA, 22 bp, Homo sapiens
tgccagcctcctgatatcatcc

SEQ ID NO: 9076345 - DNA, 18 bp, Homo sapiens
tgccagccgactggcctg

SEQ ID NO: 9076346 - DNA, 22 bp, Homo sapiens
tgccagcccaccttggggcctc

SEQ ID NO: 9076347 - DNA, 17 bp, Homo sapiens
tgccagcctgtcccagg

SEQ ID NO: 9076348 - DNA, 17 bp, Homo sapiens
tgccagcctgtcccagg

SEQ ID NO: 9076349 - DNA, 22 bp, Homo sapiens
tgccagcctggcctgagtcttt

SEQ ID NO: 9076350 - DNA, 22 bp, Homo sapiens
tgccaggcatatggcctctttg

SEQ ID NO: 9076351 - DNA, 22 bp, Homo sapiens
tgccaggcatgtagtagacttg

SEQ ID NO: 9076352 - DNA, 22 bp, Homo sapiens
tgccaggcagtgtcagattgag

SEQ ID NO: 9076353 - DNA, 22 bp, Homo sapiens
tgccaggcacgtgagagtggcc

SEQ ID NO: 9076354 - DNA, 20 bp, Homo sapiens
tgccaggcacggagtgcatg

SEQ ID NO: 9076355 - DNA, 22 bp, Homo sapiens
tgccaggcccagctccagagct

SEQ ID NO: 9076356 - DNA, 22 bp, Homo sapiens
tgccaggccacgtagcttcaag

SEQ ID NO: 9076357 - DNA, 22 bp, Homo sapiens
tgccaggccaatgaaggcaggg

SEQ ID NO: 9076358 - DNA, 22 bp, Homo sapiens
tgccaggcatttgacagacact

SEQ ID NO: 9076359 - DNA, 22 bp, Homo sapiens
tgccaggcccagctccagagct

SEQ ID NO: 9076360 - DNA, 22 bp, Homo sapiens
tgccaggcccagctccagagct

SEQ ID NO: 9076361 - DNA, 22 bp, Homo sapiens
tgccaggcccagctccagagct

SEQ ID NO: 9076362 - DNA, 22 bp, Homo sapiens
tgccaggccctcccacagatta

SEQ ID NO: 9076363 - DNA, 22 bp, Homo sapiens
tgccaggccctgtgctggatgc

SEQ ID NO: 9076364 - DNA, 22 bp, Homo sapiens
tgccaggccctgtgctggatgc

SEQ ID NO: 9076365 - DNA, 22 bp, Homo sapiens
tgccaggctaagtggaggactt

SEQ ID NO: 9076366 - DNA, 22 bp, Homo sapiens
tgcctctgtgggccttcctggc

SEQ ID NO: 9076367 - DNA, 22 bp, Homo sapiens
tgcctctgtgggcagagctgcc

SEQ ID NO: 9076368 - DNA, 22 bp, Homo sapiens
tgcctctgtggaaatggtggtc

SEQ ID NO: 9076369 - DNA, 22 bp, Homo sapiens
tgcctctggttatctggtacct

SEQ ID NO: 9076370 - DNA, 22 bp, Homo sapiens
tgcctctggttatctggtacct

SEQ ID NO: 9076371 - DNA, 22 bp, Homo sapiens
tgcctctgtgtgcaggtgagca

SEQ ID NO: 9076372 - DNA, 22 bp, Homo sapiens
tgcctctgtgtgcaggtgagca

SEQ ID NO: 9076373 - DNA, 22 bp, Homo sapiens
tgcctctgtgtgcaggtgagca

SEQ ID NO: 9076374 - DNA, 22 bp, Homo sapiens
tgcctcttggagcctttcctct

SEQ ID NO: 9076375 - DNA, 22 bp, Homo sapiens
tgcctgagtgatgtggcagcca

SEQ ID NO: 9076376 - DNA, 22 bp, Homo sapiens
tgcctgaggagtcagggcaggt

SEQ ID NO: 9076377 - DNA, 22 bp, Homo sapiens
tgcctcaggcacctggcaggtt

SEQ ID NO: 9076378 - DNA, 22 bp, Homo sapiens
tgcctcagagtgggcttgctat

SEQ ID NO: 9076379 - DNA, 22 bp, Homo sapiens
tgcctcaggcacctggcaggtt

SEQ ID NO: 9076380 - DNA, 23 bp, Homo sapiens
tgcctctgcctccctagtctgca

SEQ ID NO: 9076381 - DNA, 22 bp, Homo sapiens
tgcctctgctgctgtggcatca

SEQ ID NO: 9076382 - DNA, 22 bp, Homo sapiens
tgcctctgcctccattgttagt

SEQ ID NO: 9076383 - DNA, 22 bp, Homo sapiens
tgcctccctggcaagtctctcc

SEQ ID NO: 9076384 - DNA, 22 bp, Homo sapiens
tgcctccctctctgccactgga

SEQ ID NO: 9076385 - DNA, 22 bp, Homo sapiens
tgcctccctctctgccactgga

SEQ ID NO: 9076386 - DNA, 22 bp, Homo sapiens
tgcctccttcaggagggcccgg

SEQ ID NO: 9076387 - DNA, 22 bp, Homo sapiens
tgcctcgtgtctgagtctgttc

SEQ ID NO: 9076388 - DNA, 22 bp, Homo sapiens
tgcctccctggcaagtctctcc

SEQ ID NO: 9076389 - DNA, 22 bp, Homo sapiens
tgcctgcattttgtggctggct

SEQ ID NO: 9076390 - DNA, 22 bp, Homo sapiens
tgcctgcaagagttggggctac

SEQ ID NO: 9076391 - DNA, 22 bp, Homo sapiens
tgcctgataccctctgtctctc

SEQ ID NO: 9076392 - DNA, 22 bp, Homo sapiens
tgcctgatgcaggagtatcaga

SEQ ID NO: 9076393 - DNA, 22 bp, Homo sapiens
tgcctgatgcaggagtatcaga

SEQ ID NO: 9076394 - DNA, 22 bp, Homo sapiens
tgcctgatgcaggagtatcaga

SEQ ID NO: 9076395 - DNA, 20 bp, Homo sapiens
tgcctgcccaggtcctgcac

SEQ ID NO: 9076396 - DNA, 22 bp, Homo sapiens
tgcctgcccacgactacagcag

SEQ ID NO: 9076397 - DNA, 22 bp, Homo sapiens
tgcctgccatgcagaaagctga

SEQ ID NO: 9076398 - DNA, 22 bp, Homo sapiens
tgcctgccaggtgcttcttcat

SEQ ID NO: 9076399 - DNA, 22 bp, Homo sapiens
tgcctgccaggcaacctgggag

SEQ ID NO: 9076400 - DNA, 22 bp, Homo sapiens
tgcctgccaatgatgcttgtgt

SEQ ID NO: 9076401 - DNA, 22 bp, Homo sapiens
tgcctgccaggcaacctgggag

SEQ ID NO: 9076402 - DNA, 17 bp, Homo sapiens
tgcctgccagcattgga

SEQ ID NO: 9076403 - DNA, 22 bp, Homo sapiens
tgcctgctgattggagttgaat

SEQ ID NO: 9076404 - DNA, 22 bp, Homo sapiens
tgcctgccccacaaggggttgc

SEQ ID NO: 9076405 - DNA, 22 bp, Homo sapiens
tgcctgctgccactgctgttac

SEQ ID NO: 9076406 - DNA, 22 bp, Homo sapiens
tgcctgctgattggagttgaat

SEQ ID NO: 9076407 - DNA, 22 bp, Homo sapiens
tgcctgctgctaagctctttgt

SEQ ID NO: 9076408 - DNA, 22 bp, Homo sapiens
tgcctgcttgtgtacctggtga

SEQ ID NO: 9076409 - DNA, 22 bp, Homo sapiens
tgcctgcttgtttacctactcc

SEQ ID NO: 9076410 - DNA, 22 bp, Homo sapiens
tgcctggcaagaggggctggct

SEQ ID NO: 9076411 - DNA, 22 bp, Homo sapiens
tgcctggcaactgtggtgggct

SEQ ID NO: 9076412 - DNA, 22 bp, Homo sapiens
tgcctggatgtgctggcctcac

SEQ ID NO: 9076413 - DNA, 19 bp, Homo sapiens
tgcctggcaccagctccac

SEQ ID NO: 9076414 - DNA, 22 bp, Homo sapiens
tgcctggcaatgccagaagcca

SEQ ID NO: 9076415 - DNA, 22 bp, Homo sapiens
tgcctggcacagagcaggtggc

SEQ ID NO: 9076416 - DNA, 22 bp, Homo sapiens
tgcctggcactcctggagctca

SEQ ID NO: 9076417 - DNA, 22 bp, Homo sapiens
tgcctggcaccccagtctgcac

SEQ ID NO: 9076418 - DNA, 22 bp, Homo sapiens
tgcctggcaccccagtctgcac

SEQ ID NO: 9076419 - DNA, 22 bp, Homo sapiens
tgcctggcatctagccctggga

SEQ ID NO: 9076420 - DNA, 22 bp, Homo sapiens
tgcccctctcctgtgatccaag

SEQ ID NO: 9076421 - DNA, 22 bp, Homo sapiens
tgcccctcttgagaagctcagc

SEQ ID NO: 9076422 - DNA, 22 bp, Homo sapiens
tgcccctcttgctggccctgtc

SEQ ID NO: 9076423 - DNA, 19 bp, Homo sapiens
tgccctgcacgctgtcctg

SEQ ID NO: 9076424 - DNA, 22 bp, Homo sapiens
tgccctcaagcaacagagagga

SEQ ID NO: 9076425 - DNA, 22 bp, Homo sapiens
tgccctgcagtgagtgcgtctg

SEQ ID NO: 9076426 - DNA, 22 bp, Homo sapiens
tgccctgcagaccctgcagtgt

SEQ ID NO: 9076427 - DNA, 22 bp, Homo sapiens
tgccctgcccatctaccctgtc

SEQ ID NO: 9076428 - DNA, 22 bp, Homo sapiens
tgccctgccaagactgagtggt

SEQ ID NO: 9076429 - DNA, 22 bp, Homo sapiens
tgccctgccaagactcagtggt

SEQ ID NO: 9076430 - DNA, 22 bp, Homo sapiens
tgccctgccaagaccaagtggt

SEQ ID NO: 9076431 - DNA, 22 bp, Homo sapiens
tgccctggagtcagtggctatt

SEQ ID NO: 9076432 - DNA, 22 bp, Homo sapiens
tgccctggagtcagtggctatt

SEQ ID NO: 9076433 - DNA, 22 bp, Homo sapiens
tgccctggagtcagtggctatt

SEQ ID NO: 9076434 - DNA, 22 bp, Homo sapiens
tgccctggaaccatctacagtc

SEQ ID NO: 9076435 - DNA, 22 bp, Homo sapiens
tgccctggaaccatctacagtc

SEQ ID NO: 9076436 - DNA, 22 bp, Homo sapiens
tgccctggaaccatctacagtc

SEQ ID NO: 9076437 - DNA, 22 bp, Homo sapiens
tgccctgctgtgcctggagcca

SEQ ID NO: 9076438 - DNA, 22 bp, Homo sapiens
tgccctggcacacacacagctg

SEQ ID NO: 9076439 - DNA, 22 bp, Homo sapiens
tgccctggcacacacacagctg

SEQ ID NO: 9076440 - DNA, 22 bp, Homo sapiens
tgccctggcgctgtctctatgg

SEQ ID NO: 9076441 - DNA, 22 bp, Homo sapiens
tgccctggctcttcttgttcca

SEQ ID NO: 9076442 - DNA, 22 bp, Homo sapiens
tgccctggctctccactagttt

SEQ ID NO: 9076443 - DNA, 22 bp, Homo sapiens
tgccctggctctccactagttt

SEQ ID NO: 9076444 - DNA, 22 bp, Homo sapiens
tgccgaggctggagtgcagtgg

SEQ ID NO: 9076445 - DNA, 22 bp, Homo sapiens
tgccctgttcctgcctccagct

SEQ ID NO: 9076446 - DNA, 22 bp, Homo sapiens
tgccctgttcctgcctccagct

SEQ ID NO: 9076447 - DNA, 22 bp, Homo sapiens
tgccctgttatcttggaagagt

SEQ ID NO: 9076448 - DNA, 22 bp, Homo sapiens
tgccctgtgtgtgcaagcactg

SEQ ID NO: 9076449 - DNA, 22 bp, Homo sapiens
tgccctgtgtgtgcaagcactg

SEQ ID NO: 9076450 - DNA, 22 bp, Homo sapiens
tgccctgtgggtatctgatggc

SEQ ID NO: 9076451 - DNA, 22 bp, Homo sapiens
tgccctgggaggctttcctgtt

SEQ ID NO: 9076452 - DNA, 22 bp, Homo sapiens
tgccctgtctaagctgtcagta

SEQ ID NO: 9076453 - DNA, 22 bp, Homo sapiens
tgccctggctggagtgcagtgg

SEQ ID NO: 9076454 - DNA, 22 bp, Homo sapiens
tgccctggctcttcttgttcca

SEQ ID NO: 9076455 - DNA, 22 bp, Homo sapiens
tgcctagttctgtatttacagt

SEQ ID NO: 9076456 - DNA, 22 bp, Homo sapiens
tgcctcagagacctgacagtac

SEQ ID NO: 9076457 - DNA, 22 bp, Homo sapiens
tgcctaggaaacctcatgcttc

SEQ ID NO: 9076458 - DNA, 22 bp, Homo sapiens
tgcctaggaaacctcatgcttc

SEQ ID NO: 9076459 - DNA, 22 bp, Homo sapiens
tgcctaggctggaatgcagtgg

SEQ ID NO: 9076460 - DNA, 22 bp, Homo sapiens
tgccgcagtgcggggagggccc

SEQ ID NO: 9076461 - DNA, 22 bp, Homo sapiens
tgccgtggggctgaggctggag

SEQ ID NO: 9076462 - DNA, 22 bp, Homo sapiens
tgccgtggggctgaggctggag

SEQ ID NO: 9076463 - DNA, 22 bp, Homo sapiens
tgcctaaaccattccccttcct

SEQ ID NO: 9076464 - DNA, 22 bp, Homo sapiens
tgcctacccatggttagacata

SEQ ID NO: 9076465 - DNA, 22 bp, Homo sapiens
tgcctacctgaaaatgtctaat

SEQ ID NO: 9076466 - DNA, 22 bp, Homo sapiens
tgcctactagtactattttgtg

SEQ ID NO: 9076467 - DNA, 20 bp, Homo sapiens
tgcaggtgttggagaaggta

SEQ ID NO: 9076468 - DNA, 22 bp, Homo sapiens
tgcaggttctgaccagccaact

SEQ ID NO: 9076469 - DNA, 21 bp, Homo sapiens
tgcagtatgtatttgtatcca

SEQ ID NO: 9076470 - DNA, 22 bp, Homo sapiens
tgcagtggtggtaaagatgctc

SEQ ID NO: 9076471 - DNA, 22 bp, Homo sapiens
tgcagtggtggtaaagatgctc

SEQ ID NO: 9076472 - DNA, 22 bp, Homo sapiens
tgcagtggtgtccaggtgtact

SEQ ID NO: 9076473 - DNA, 22 bp, Homo sapiens
tgcagtggtgtccaggtgtact

SEQ ID NO: 9076474 - DNA, 22 bp, Homo sapiens
tgcagtggcgccatctcagctc

SEQ ID NO: 9076475 - DNA, 22 bp, Homo sapiens
tgcagtgggccggaggccaggg

SEQ ID NO: 9076476 - DNA, 22 bp, Homo sapiens
tgcagtgggccggaggccaggg

SEQ ID NO: 9076477 - DNA, 22 bp, Homo sapiens
tgcagtggcgccatctcagctc

SEQ ID NO: 9076478 - DNA, 20 bp, Homo sapiens
tgcagtgtggaagactgaga

SEQ ID NO: 9076479 - DNA, 22 bp, Homo sapiens
tgcagtggttgagagcccagac

SEQ ID NO: 9076480 - DNA, 22 bp, Homo sapiens
tgcaggtgtctccagggcaggt

SEQ ID NO: 9076481 - DNA, 22 bp, Homo sapiens
tgcaggtggtttggacactgct

SEQ ID NO: 9076482 - DNA, 22 bp, Homo sapiens
tgcaggtgtagagttgggctcc

SEQ ID NO: 9076483 - DNA, 23 bp, Homo sapiens
tgcaggtgtgcagagggctcttg

SEQ ID NO: 9076484 - DNA, 22 bp, Homo sapiens
tgcaggtgtctgggggcaacag

SEQ ID NO: 9076485 - DNA, 22 bp, Homo sapiens
tgcaggtgtctctgtctagcgt

SEQ ID NO: 9076486 - DNA, 22 bp, Homo sapiens
tgcaggtgtggttcctcagcca

SEQ ID NO: 9076487 - DNA, 22 bp, Homo sapiens
tgcaggtgtgggcaggggagca

SEQ ID NO: 9076488 - DNA, 23 bp, Homo sapiens
tgcaggggaggcttaaagcaggt

SEQ ID NO: 9076489 - DNA, 22 bp, Homo sapiens
tgcaggggcttgtctgggcctg

SEQ ID NO: 9076490 - DNA, 22 bp, Homo sapiens
tgcagggcttcctcttggagtt

SEQ ID NO: 9076491 - DNA, 20 bp, Homo sapiens
tgcagggctctgcttctctc

SEQ ID NO: 9076492 - DNA, 22 bp, Homo sapiens
tgcaggtgagtgcaggggctca

SEQ ID NO: 9076493 - DNA, 22 bp, Homo sapiens
tgcaggtggcagcggggcacca

SEQ ID NO: 9076494 - DNA, 22 bp, Homo sapiens
tgcaggtggattcaatgtggga

SEQ ID NO: 9076495 - DNA, 22 bp, Homo sapiens
tgcaggtgattctgatgcagtt

SEQ ID NO: 9076496 - DNA, 22 bp, Homo sapiens
tgcaggtggacacgggagacgg

SEQ ID NO: 9076497 - DNA, 22 bp, Homo sapiens
tgcaggtgcagcgatactgtga

SEQ ID NO: 9076498 - DNA, 22 bp, Homo sapiens
tgcagggaagcaagggtggctc

SEQ ID NO: 9076499 - DNA, 21 bp, Homo sapiens
tgcaggctgtgcgctcctgcc

SEQ ID NO: 9076500 - DNA, 21 bp, Homo sapiens
tgcaggctgtgcgctcctgcc

SEQ ID NO: 9076501 - DNA, 21 bp, Homo sapiens
tgcaggctgtttaagaggcaa

SEQ ID NO: 9076502 - DNA, 21 bp, Homo sapiens
tgcaggctgtttaagaggcaa

SEQ ID NO: 9076503 - DNA, 18 bp, Homo sapiens
tgcaggctgttgaaactg

SEQ ID NO: 9076504 - DNA, 22 bp, Homo sapiens
tgcaggctgtgtcatttagtga

SEQ ID NO: 9076505 - DNA, 22 bp, Homo sapiens
tgcaggcttggatcacatctcc

SEQ ID NO: 9076506 - DNA, 22 bp, Homo sapiens
tgcaggctgtttggtggatctc

SEQ ID NO: 9076507 - DNA, 20 bp, Homo sapiens
tgcaggcttcgctctaggag

SEQ ID NO: 9076508 - DNA, 22 bp, Homo sapiens
tgcaggctttagccccatggct

SEQ ID NO: 9076509 - DNA, 22 bp, Homo sapiens
tgcaggctttagccccatggct

SEQ ID NO: 9076510 - DNA, 22 bp, Homo sapiens
tgcaggctggaggagggactaa

SEQ ID NO: 9076511 - DNA, 22 bp, Homo sapiens
tgcaggctggcagatatctcat

SEQ ID NO: 9076512 - DNA, 22 bp, Homo sapiens
tgcaggctggcagtgctgaaat

SEQ ID NO: 9076513 - DNA, 22 bp, Homo sapiens
tgcaggctgctcaagacttagt

SEQ ID NO: 9076514 - DNA, 22 bp, Homo sapiens
tgcaggctggggaggcagactt

SEQ ID NO: 9076515 - DNA, 22 bp, Homo sapiens
tgcaggctgggaagagggacaa

SEQ ID NO: 9076516 - DNA, 22 bp, Homo sapiens
tgcaggctgtaatctgaggcta

SEQ ID NO: 9076517 - DNA, 22 bp, Homo sapiens
tgcaggctgtaatctgaggcta

SEQ ID NO: 9076518 - DNA, 17 bp, Homo sapiens
tgcaggctcctgtccct

SEQ ID NO: 9076519 - DNA, 22 bp, Homo sapiens
tgcaggctctctgctgccagat

SEQ ID NO: 9076520 - DNA, 22 bp, Homo sapiens
tgcaggctgcagtctcaggtgg

SEQ ID NO: 9076521 - DNA, 22 bp, Homo sapiens
tgcaggctgaggctggctcaac

SEQ ID NO: 9076522 - DNA, 22 bp, Homo sapiens
tgcaggctgcacccctgccctg

SEQ ID NO: 9076523 - DNA, 22 bp, Homo sapiens
tgcaggctcttggtgacgtggg

SEQ ID NO: 9076524 - DNA, 22 bp, Homo sapiens
tgcaggctctgtgtgtgcctgg

SEQ ID NO: 9076525 - DNA, 22 bp, Homo sapiens
tgcagggccgctggaggtcatg

SEQ ID NO: 9076526 - DNA, 22 bp, Homo sapiens
tgcagggcagctagggagcttt

SEQ ID NO: 9076527 - DNA, 22 bp, Homo sapiens
tgcatctttttccaagtttatt

SEQ ID NO: 9076528 - DNA, 22 bp, Homo sapiens
tgcatctttagtcttatgtctg

SEQ ID NO: 9076529 - DNA, 22 bp, Homo sapiens
tgcatgatagagatggtattag

SEQ ID NO: 9076530 - DNA, 22 bp, Homo sapiens
tgcatgcaacaattcttctata

SEQ ID NO: 9076531 - DNA, 22 bp, Homo sapiens
tgcatgcaaagtgtctgctttg

SEQ ID NO: 9076532 - DNA, 20 bp, Homo sapiens
tgcatggcgcacatctgtgg

SEQ ID NO: 9076533 - DNA, 22 bp, Homo sapiens
tgcatgtatgtgctcacatgtg

SEQ ID NO: 9076534 - DNA, 22 bp, Homo sapiens
tgcatgtcaaggcactcaggat

SEQ ID NO: 9076535 - DNA, 22 bp, Homo sapiens
tgcatgtggacccctggtgcct

SEQ ID NO: 9076536 - DNA, 22 bp, Homo sapiens
tgcatgtgtcgggcctgtgcta

SEQ ID NO: 9076537 - DNA, 22 bp, Homo sapiens
tgcatgtggacccctggtgcct

SEQ ID NO: 9076538 - DNA, 22 bp, Homo sapiens
tgcatgtgtttcccagcaagct

SEQ ID NO: 9076539 - DNA, 22 bp, Homo sapiens
tgcatgttccaactccatcact

SEQ ID NO: 9076540 - DNA, 22 bp, Homo sapiens
tgcatatacccgcatttacata

SEQ ID NO: 9076541 - DNA, 22 bp, Homo sapiens
tgcatatacccgcatttacata

SEQ ID NO: 9076542 - DNA, 22 bp, Homo sapiens
tgcatagaggatccagtgtggt

SEQ ID NO: 9076543 - DNA, 22 bp, Homo sapiens
tgcataatggatgatttcacaa

SEQ ID NO: 9076544 - DNA, 22 bp, Homo sapiens
tgcatacacaagcatacatgta

SEQ ID NO: 9076545 - DNA, 22 bp, Homo sapiens
tgcatctgattctcaggcagaa

SEQ ID NO: 9076546 - DNA, 22 bp, Homo sapiens
tgcatctgttcagagctgtcga

SEQ ID NO: 9076547 - DNA, 18 bp, Homo sapiens
tgcatcatttatgggtca

SEQ ID NO: 9076548 - DNA, 22 bp, Homo sapiens
tgcatcatgcggaactggcttt

SEQ ID NO: 9076549 - DNA, 22 bp, Homo sapiens
tgcatcatttataatgtctttg

SEQ ID NO: 9076550 - DNA, 18 bp, Homo sapiens
tgcatatactgcctatct

SEQ ID NO: 9076551 - DNA, 22 bp, Homo sapiens
tgcatcatataatgtctatgga

SEQ ID NO: 9076552 - DNA, 22 bp, Homo sapiens
tgcatcagctgtgcttcttgac

SEQ ID NO: 9076553 - DNA, 22 bp, Homo sapiens
tgcatcagagtttgctgctgct

SEQ ID NO: 9076554 - DNA, 18 bp, Homo sapiens
tgcatatactgcctatct

SEQ ID NO: 9076555 - DNA, 22 bp, Homo sapiens
tgcagttttgccaggcaatgga

SEQ ID NO: 9076556 - DNA, 22 bp, Homo sapiens
tgcataaaacatgatttctgct

SEQ ID NO: 9076557 - DNA, 22 bp, Homo sapiens
tgcagttttggccattgaaggc

SEQ ID NO: 9076558 - DNA, 21 bp, Homo sapiens
tgcagttcaagtcaatctact

SEQ ID NO: 9076559 - DNA, 22 bp, Homo sapiens
tgcagttctaagtagacaagtc

SEQ ID NO: 9076560 - DNA, 22 bp, Homo sapiens
tgcagtgtttttcagggcatat

SEQ ID NO: 9076561 - DNA, 22 bp, Homo sapiens
tgcataaacagatacttcatgt

SEQ ID NO: 9076562 - DNA, 21 bp, Homo sapiens
tgcataaagaaatacaaatac

SEQ ID NO: 9076563 - DNA, 19 bp, Homo sapiens
tgcataaattatatacttt

SEQ ID NO: 9076564 - DNA, 22 bp, Homo sapiens
tgcataaaatatgagaaatgta

SEQ ID NO: 9076565 - DNA, 19 bp, Homo sapiens
tgcataaattatatacttt

SEQ ID NO: 9076566 - DNA, 22 bp, Homo sapiens
tgccagaacagctcatctggcc

SEQ ID NO: 9076567 - DNA, 22 bp, Homo sapiens
tgccacctagtggtctttagtc

SEQ ID NO: 9076568 - DNA, 22 bp, Homo sapiens
tgccacctggacaaccttatgc

SEQ ID NO: 9076569 - DNA, 22 bp, Homo sapiens
tgccaccaggagaaccagtgca

SEQ ID NO: 9076570 - DNA, 22 bp, Homo sapiens
tgccaccaggagaaccagtgca

SEQ ID NO: 9076571 - DNA, 22 bp, Homo sapiens
tgccaccatctggctgtgttga

SEQ ID NO: 9076572 - DNA, 22 bp, Homo sapiens
tgccacatggtgcatttcctag

SEQ ID NO: 9076573 - DNA, 22 bp, Homo sapiens
tgccacagtttcatggattctg

SEQ ID NO: 9076574 - DNA, 22 bp, Homo sapiens
tgccacagttgtttgtgctcta

SEQ ID NO: 9076575 - DNA, 22 bp, Homo sapiens
tgccacaggcaatccctgcacg

SEQ ID NO: 9076576 - DNA, 22 bp, Homo sapiens
tgccacagggtcctcaggccag

SEQ ID NO: 9076577 - DNA, 22 bp, Homo sapiens
tgccagagatttcacactgcta

SEQ ID NO: 9076578 - DNA, 19 bp, Homo sapiens
tgccagagatactcccaga

SEQ ID NO: 9076579 - DNA, 22 bp, Homo sapiens
tgccagcacttctggctgtctg

SEQ ID NO: 9076580 - DNA, 22 bp, Homo sapiens
tgccagcacttctggctgtctg

SEQ ID NO: 9076581 - DNA, 22 bp, Homo sapiens
tgccagcacaagttaagagatc

SEQ ID NO: 9076582 - DNA, 23 bp, Homo sapiens
tgccagcagggaatgggaaggac

SEQ ID NO: 9076583 - DNA, 22 bp, Homo sapiens
tgccagcagtagcagtaggcca

SEQ ID NO: 9076584 - DNA, 21 bp, Homo sapiens
tgccagcatgtaggctagttg

SEQ ID NO: 9076585 - DNA, 21 bp, Homo sapiens
tgccagcatgtaggctagttg

SEQ ID NO: 9076586 - DNA, 19 bp, Homo sapiens
tgccagcattaggctgaag

SEQ ID NO: 9076587 - DNA, 19 bp, Homo sapiens
tgccagcattaggctgaag

SEQ ID NO: 9076588 - DNA, 22 bp, Homo sapiens
tgccagccagggaagctcaccc

SEQ ID NO: 9076589 - DNA, 22 bp, Homo sapiens
tgccagccagggaagctcaccc

SEQ ID NO: 9076590 - DNA, 22 bp, Homo sapiens
tgccagcccaccttggggcctc

SEQ ID NO: 9076591 - DNA, 22 bp, Homo sapiens
tgccagcccaccttggggcctc

SEQ ID NO: 9076592 - DNA, 22 bp, Homo sapiens
tgccagccaggttctgaggcta

SEQ ID NO: 9076593 - DNA, 22 bp, Homo sapiens
tgccagccaggttctgaggcta

SEQ ID NO: 9076594 - DNA, 22 bp, Homo sapiens
tgccagccaggttctgaggcta

SEQ ID NO: 9076595 - DNA, 22 bp, Homo sapiens
tgcatttcacagactgagaaat

SEQ ID NO: 9076596 - DNA, 22 bp, Homo sapiens
tgcatttgagttgggagcaggc

SEQ ID NO: 9076597 - DNA, 22 bp, Homo sapiens
tgcatttttgataactgtgtac

SEQ ID NO: 9076598 - DNA, 22 bp, Homo sapiens
tgcatttttgaggttaactcaa

SEQ ID NO: 9076599 - DNA, 22 bp, Homo sapiens
tgcatttttgaggttaactcaa

SEQ ID NO: 9076600 - DNA, 22 bp, Homo sapiens
tgcatttttgataactgtgtac

SEQ ID NO: 9076601 - DNA, 22 bp, Homo sapiens
tgccaaaatggccaaaagctag

SEQ ID NO: 9076602 - DNA, 23 bp, Homo sapiens
tgccaaagtttacctaacactgg

SEQ ID NO: 9076603 - DNA, 22 bp, Homo sapiens
tgccaaattagagttcccaggc

SEQ ID NO: 9076604 - DNA, 22 bp, Homo sapiens
tgcatttgttcagtgaaatgtt

SEQ ID NO: 9076605 - DNA, 22 bp, Homo sapiens
tgcattttacttacctgttagt

SEQ ID NO: 9076606 - DNA, 22 bp, Homo sapiens
tgcatttttaacaaggctaatt

SEQ ID NO: 9076607 - DNA, 22 bp, Homo sapiens
tgcatttggggcagactagcag

SEQ ID NO: 9076608 - DNA, 22 bp, Homo sapiens
tgcatttgtaacattcaagaat

SEQ ID NO: 9076609 - DNA, 22 bp, Homo sapiens
tgcatttgtcttgtctcatgaa

SEQ ID NO: 9076610 - DNA, 20 bp, Homo sapiens
tgcatttgttatttgtactc

SEQ ID NO: 9076611 - DNA, 17 bp, Homo sapiens
tgcattgttggaaattt

SEQ ID NO: 9076612 - DNA, 22 bp, Homo sapiens
tgcattggtcttaatcttcagg

SEQ ID NO: 9076613 - DNA, 22 bp, Homo sapiens
tgcattgagtcatttcagtatg

SEQ ID NO: 9076614 - DNA, 22 bp, Homo sapiens
tgcattgatcatatccttcctg

SEQ ID NO: 9076615 - DNA, 22 bp, Homo sapiens
tgcattgaggggctctcttcct

SEQ ID NO: 9076616 - DNA, 22 bp, Homo sapiens
tgcattcctttgtctgttaaag

SEQ ID NO: 9076617 - DNA, 22 bp, Homo sapiens
tgcattctgacttagttaatat

SEQ ID NO: 9076618 - DNA, 19 bp, Homo sapiens
tgcattgagggctgtctca

SEQ ID NO: 9076619 - DNA, 22 bp, Homo sapiens
tgcattgagattttaaaattca

SEQ ID NO: 9076620 - DNA, 22 bp, Homo sapiens
tctcctggatggaccttctctt

SEQ ID NO: 9076621 - DNA, 22 bp, Homo sapiens
tctcctggagcaggaaggtggg

SEQ ID NO: 9076622 - DNA, 22 bp, Homo sapiens
tctcctgcttcaactgatggac

SEQ ID NO: 9076623 - DNA, 22 bp, Homo sapiens
tctcctgctcccaactgctgca

SEQ ID NO: 9076624 - DNA, 22 bp, Homo sapiens
tctcctactcactcaaggcttg

SEQ ID NO: 9076625 - DNA, 22 bp, Homo sapiens
tctcctcaccaccagcagcaga

SEQ ID NO: 9076626 - DNA, 22 bp, Homo sapiens
tctcctctgtgccacagcttgg

SEQ ID NO: 9076627 - DNA, 22 bp, Homo sapiens
tctcctctgcgcggcagtgccc

SEQ ID NO: 9076628 - DNA, 22 bp, Homo sapiens
tctcctctgcgcggcagtgccc

SEQ ID NO: 9076629 - DNA, 22 bp, Homo sapiens
tctcctctactgggtctgcaga

SEQ ID NO: 9076630 - DNA, 22 bp, Homo sapiens
tctcctctatttctgtatgtat

SEQ ID NO: 9076631 - DNA, 22 bp, Homo sapiens
tctcctctcttacctggtacaa

SEQ ID NO: 9076632 - DNA, 22 bp, Homo sapiens
tctcctctcctttcatgttgtt

SEQ ID NO: 9076633 - DNA, 22 bp, Homo sapiens
tctcctctcctttcatgttgtt

SEQ ID NO: 9076634 - DNA, 22 bp, Homo sapiens
tctcctttaagatttcctcagg

SEQ ID NO: 9076635 - DNA, 22 bp, Homo sapiens
tctcctttgaaagttaggactg

SEQ ID NO: 9076636 - DNA, 22 bp, Homo sapiens
tctcgatctcctgaccttgtga

SEQ ID NO: 9076637 - DNA, 22 bp, Homo sapiens
tctcgctctgtcgcccaggctg

SEQ ID NO: 9076638 - DNA, 22 bp, Homo sapiens
tctcgctctgtcgcccaggctg

SEQ ID NO: 9076639 - DNA, 22 bp, Homo sapiens
tctcgctctgtcgcccaggctg

SEQ ID NO: 9076640 - DNA, 22 bp, Homo sapiens
tctcgctctgtcgcccaggctg

SEQ ID NO: 9076641 - DNA, 22 bp, Homo sapiens
tctctagtctcctttaacctga

SEQ ID NO: 9076642 - DNA, 22 bp, Homo sapiens
tctctaaagatatttatggcaa

SEQ ID NO: 9076643 - DNA, 22 bp, Homo sapiens
tctctaaagatagctgcctcga

SEQ ID NO: 9076644 - DNA, 22 bp, Homo sapiens
tctctaaagaagcctccctaaa

SEQ ID NO: 9076645 - DNA, 21 bp, Homo sapiens
tctctaaaaagattctatttg

SEQ ID NO: 9076646 - DNA, 22 bp, Homo sapiens
tctctaaacttatatgaactat

SEQ ID NO: 9076647 - DNA, 22 bp, Homo sapiens
tctctaaacttatatgaactat

SEQ ID NO: 9076648 - DNA, 22 bp, Homo sapiens
tctctaaaattcccggccaact

SEQ ID NO: 9076649 - DNA, 22 bp, Homo sapiens
tctcctggtatgtatgcacctg

SEQ ID NO: 9076650 - DNA, 22 bp, Homo sapiens
tctcctggtacccttcctagca

SEQ ID NO: 9076651 - DNA, 21 bp, Homo sapiens
tctcctgggtccaacccatgc

SEQ ID NO: 9076652 - DNA, 20 bp, Homo sapiens
tctcctggtgacagtaccca

SEQ ID NO: 9076653 - DNA, 19 bp, Homo sapiens
tctcccatgcctgtgtcta

SEQ ID NO: 9076654 - DNA, 22 bp, Homo sapiens
tctcccagtgtctggcagtcag

SEQ ID NO: 9076655 - DNA, 22 bp, Homo sapiens
tctcccagtgtctggcagtcag

SEQ ID NO: 9076656 - DNA, 22 bp, Homo sapiens
tctcccagtgtctggcagtcag

SEQ ID NO: 9076657 - DNA, 22 bp, Homo sapiens
tctcccagtgtctggcagtcag

SEQ ID NO: 9076658 - DNA, 22 bp, Homo sapiens
tctccccaaccatggcactcac

SEQ ID NO: 9076659 - DNA, 22 bp, Homo sapiens
tctccccaaccatggcactcac

SEQ ID NO: 9076660 - DNA, 22 bp, Homo sapiens
tctccccagctgagctgccctt

SEQ ID NO: 9076661 - DNA, 22 bp, Homo sapiens
tctccccaggggtatgggtatt

SEQ ID NO: 9076662 - DNA, 21 bp, Homo sapiens
tctccccattcttattcccat

SEQ ID NO: 9076663 - DNA, 22 bp, Homo sapiens
tctcccctgttggccaggtttt

SEQ ID NO: 9076664 - DNA, 22 bp, Homo sapiens
tctcccgacccatgtgccaggg

SEQ ID NO: 9076665 - DNA, 22 bp, Homo sapiens
tctcctaattaaatgctcttat

SEQ ID NO: 9076666 - DNA, 22 bp, Homo sapiens
tctccctcattcctgcttccat

SEQ ID NO: 9076667 - DNA, 22 bp, Homo sapiens
tctcccaggtgggtgcctggag

SEQ ID NO: 9076668 - DNA, 22 bp, Homo sapiens
tctcccagtggtgcagaaagca

SEQ ID NO: 9076669 - DNA, 22 bp, Homo sapiens
tctcccagtcctctgtgcttac

SEQ ID NO: 9076670 - DNA, 22 bp, Homo sapiens
tctcccagtcctctgtgcttac

SEQ ID NO: 9076671 - DNA, 22 bp, Homo sapiens
tctcccaggtgggtgcctggag

SEQ ID NO: 9076672 - DNA, 22 bp, Homo sapiens
tctcccaggctggagtgcagtg

SEQ ID NO: 9076673 - DNA, 22 bp, Homo sapiens
tctcccaggtgggtgcctggag

SEQ ID NO: 9076674 - DNA, 22 bp, Homo sapiens
tctcccaggtcatacacagaga

SEQ ID NO: 9076675 - DNA, 19 bp, Homo sapiens
tctcccagctgagaagggc

SEQ ID NO: 9076676 - DNA, 19 bp, Homo sapiens
tctcccagctgagaagggc

SEQ ID NO: 9076677 - DNA, 22 bp, Homo sapiens
tctcccaggcaggagtgcagtg

SEQ ID NO: 9076678 - DNA, 20 bp, Homo sapiens
tctcccaggctcagggaaga

SEQ ID NO: 9076679 - DNA, 22 bp, Homo sapiens
tctcccaggcaggagtgcagtg

SEQ ID NO: 9076680 - DNA, 22 bp, Homo sapiens
tctcccaggctggagtgcagtg

SEQ ID NO: 9076681 - DNA, 22 bp, Homo sapiens
tctcccaggctgccctgtggac

SEQ ID NO: 9076682 - DNA, 22 bp, Homo sapiens
tctcccaggctgccctgtggac

SEQ ID NO: 9076683 - DNA, 22 bp, Homo sapiens
tctcccaggctgccctgtggac

SEQ ID NO: 9076684 - DNA, 22 bp, Homo sapiens
tctcccaggctgccctgtggac

SEQ ID NO: 9076685 - DNA, 22 bp, Homo sapiens
tctccaggtgctaagtgtgcct

SEQ ID NO: 9076686 - DNA, 22 bp, Homo sapiens
tctccaggtgagggtggttaga

SEQ ID NO: 9076687 - DNA, 22 bp, Homo sapiens
tctccaggtgactctgatgtat

SEQ ID NO: 9076688 - DNA, 22 bp, Homo sapiens
tctcccactgcaagcccaggct

SEQ ID NO: 9076689 - DNA, 22 bp, Homo sapiens
tctcccagaggatcccagtgga

SEQ ID NO: 9076690 - DNA, 22 bp, Homo sapiens
tctcccagaagtcctcagtaca

SEQ ID NO: 9076691 - DNA, 22 bp, Homo sapiens
tctcccactggccttgtatgat

SEQ ID NO: 9076692 - DNA, 22 bp, Homo sapiens
tctccaggctttttgtgaattg

SEQ ID NO: 9076693 - DNA, 22 bp, Homo sapiens
tctccagggactgaggctggag

SEQ ID NO: 9076694 - DNA, 19 bp, Homo sapiens
tctcagagccctagaggcc

SEQ ID NO: 9076695 - DNA, 22 bp, Homo sapiens
tctcagagcttcagttattttc

SEQ ID NO: 9076696 - DNA, 23 bp, Homo sapiens
tctcagaggattcctgggccttg

SEQ ID NO: 9076697 - DNA, 23 bp, Homo sapiens
tctcagaggattcctgggccttg

SEQ ID NO: 9076698 - DNA, 19 bp, Homo sapiens
tctcagaggaaaaattgct

SEQ ID NO: 9076699 - DNA, 22 bp, Homo sapiens
tctcagagcatcattttcttag

SEQ ID NO: 9076700 - DNA, 19 bp, Homo sapiens
tctcagagccctagaggcc

SEQ ID NO: 9076701 - DNA, 22 bp, Homo sapiens
tctcagagatgttagggaagag

SEQ ID NO: 9076702 - DNA, 23 bp, Homo sapiens
tctcagaaaggagaagtaatttg

SEQ ID NO: 9076703 - DNA, 23 bp, Homo sapiens
tctcagaaaggagaagtaatttg

SEQ ID NO: 9076704 - DNA, 22 bp, Homo sapiens
tctcagaaatgacaggaggtac

SEQ ID NO: 9076705 - DNA, 22 bp, Homo sapiens
tctcagagatctttctgcatgt

SEQ ID NO: 9076706 - DNA, 22 bp, Homo sapiens
tctcagagagatgaaacttcca

SEQ ID NO: 9076707 - DNA, 22 bp, Homo sapiens
tctcagaaggcaagggctgggg

SEQ ID NO: 9076708 - DNA, 22 bp, Homo sapiens
tctcagagaggggccgggcctt

SEQ ID NO: 9076709 - DNA, 22 bp, Homo sapiens
tctcagagagctgtgttttcct

SEQ ID NO: 9076710 - DNA, 22 bp, Homo sapiens
tctcacagtgagcctgaggtcg

SEQ ID NO: 9076711 - DNA, 22 bp, Homo sapiens
tctcacaggtgcacgtggctgt

SEQ ID NO: 9076712 - DNA, 22 bp, Homo sapiens
tctcacagtgcaggtctgtctc

SEQ ID NO: 9076713 - DNA, 22 bp, Homo sapiens
tctcacatctgccctgtgctgg

SEQ ID NO: 9076714 - DNA, 22 bp, Homo sapiens
tctcactgggtcacagcagagg

SEQ ID NO: 9076715 - DNA, 22 bp, Homo sapiens
tctcactgcaaatattatgtat

SEQ ID NO: 9076716 - DNA, 22 bp, Homo sapiens
tctcactgggtataaatgagta

SEQ ID NO: 9076717 - DNA, 22 bp, Homo sapiens
tctcactcatttcctaggtctt

SEQ ID NO: 9076718 - DNA, 22 bp, Homo sapiens
tctcactcatttcctaggtctt

SEQ ID NO: 9076719 - DNA, 20 bp, Homo sapiens
tctcaggccccctccttgct

SEQ ID NO: 9076720 - DNA, 22 bp, Homo sapiens
tctcagctcttttttcacagaa

SEQ ID NO: 9076721 - DNA, 22 bp, Homo sapiens
tctcagctgcctgccctgctcc

SEQ ID NO: 9076722 - DNA, 22 bp, Homo sapiens
tctcagggagcccagtacttac

SEQ ID NO: 9076723 - DNA, 22 bp, Homo sapiens
tctcagagtttacggggctgaa

SEQ ID NO: 9076724 - DNA, 22 bp, Homo sapiens
tctcagagtttagagctgagcc

SEQ ID NO: 9076725 - DNA, 22 bp, Homo sapiens
tctcagagtttagagctgagcc

SEQ ID NO: 9076726 - DNA, 22 bp, Homo sapiens
tctcagagtttagagctgagcc

SEQ ID NO: 9076727 - DNA, 22 bp, Homo sapiens
tctcagagtttagagctgagcc

SEQ ID NO: 9076728 - DNA, 22 bp, Homo sapiens
tctcagagtttgaatctggagt

SEQ ID NO: 9076729 - DNA, 22 bp, Homo sapiens
tctcagagtttgaatctggagt

SEQ ID NO: 9076730 - DNA, 22 bp, Homo sapiens
tctcagcagccagatccagagc

SEQ ID NO: 9076731 - DNA, 22 bp, Homo sapiens
tctcagcagccagatccagagc

SEQ ID NO: 9076732 - DNA, 20 bp, Homo sapiens
tctcagcataagaacccttc

SEQ ID NO: 9076733 - DNA, 18 bp, Homo sapiens
tctcagcccagctccggc

SEQ ID NO: 9076734 - DNA, 22 bp, Homo sapiens
tctcagcacgttgttttcattg

SEQ ID NO: 9076735 - DNA, 22 bp, Homo sapiens
tctcagcaacgatccggagtaa

SEQ ID NO: 9076736 - DNA, 22 bp, Homo sapiens
tctcagcaacgatccggagtaa

SEQ ID NO: 9076737 - DNA, 22 bp, Homo sapiens
tctcagcaaggaaagaggcagg

SEQ ID NO: 9076738 - DNA, 22 bp, Homo sapiens
tctcagaggtgccctggcatct

SEQ ID NO: 9076739 - DNA, 22 bp, Homo sapiens
tctcagagttcctctggagtcc

SEQ ID NO: 9076740 - DNA, 22 bp, Homo sapiens
tctcagagggaggattactgcc

SEQ ID NO: 9076741 - DNA, 22 bp, Homo sapiens
tctcagaggcccgacgttctcc

SEQ ID NO: 9076742 - DNA, 22 bp, Homo sapiens
tctcagagggaaacatgagtga

SEQ ID NO: 9076743 - DNA, 22 bp, Homo sapiens
tctcattcataccctacatgct

SEQ ID NO: 9076744 - DNA, 22 bp, Homo sapiens
tctcatgtgattcccgtgcatg

SEQ ID NO: 9076745 - DNA, 23 bp, Homo sapiens
tctcatgtctttcctacaagcat

SEQ ID NO: 9076746 - DNA, 22 bp, Homo sapiens
tctcattgccttcactcttcag

SEQ ID NO: 9076747 - DNA, 22 bp, Homo sapiens
tctcattggtatatacatgtgt

SEQ ID NO: 9076748 - DNA, 22 bp, Homo sapiens
tctcatttggctttgttttaaa

SEQ ID NO: 9076749 - DNA, 22 bp, Homo sapiens
tctcatttggctttgttttaaa

SEQ ID NO: 9076750 - DNA, 19 bp, Homo sapiens
tctccaaaaccaatcacta

SEQ ID NO: 9076751 - DNA, 19 bp, Homo sapiens
tctccaaaaccaatcacta

SEQ ID NO: 9076752 - DNA, 22 bp, Homo sapiens
tctccaaatagttatatttaga

SEQ ID NO: 9076753 - DNA, 22 bp, Homo sapiens
tctccaagaaaagatctcagct

SEQ ID NO: 9076754 - DNA, 22 bp, Homo sapiens
tctccaggactgagctccagcc

SEQ ID NO: 9076755 - DNA, 22 bp, Homo sapiens
tctccaggagaaatatgaagga

SEQ ID NO: 9076756 - DNA, 22 bp, Homo sapiens
tctccaggcccactgatttata

SEQ ID NO: 9076757 - DNA, 19 bp, Homo sapiens
tctccaggcaggtgagcga

SEQ ID NO: 9076758 - DNA, 22 bp, Homo sapiens
tctcatcttcatatctgaaaga

SEQ ID NO: 9076759 - DNA, 22 bp, Homo sapiens
tctcatggagtcaggagcagaa

SEQ ID NO: 9076760 - DNA, 22 bp, Homo sapiens
tctcataatagcatttctcacc

SEQ ID NO: 9076761 - DNA, 19 bp, Homo sapiens
tctcagtgccgctgaccgc

SEQ ID NO: 9076762 - DNA, 22 bp, Homo sapiens
tctcagtgctatccatattcca

SEQ ID NO: 9076763 - DNA, 22 bp, Homo sapiens
tctcagtgcagcttgacagaga

SEQ ID NO: 9076764 - DNA, 23 bp, Homo sapiens
tctcagtgccgattgcatacaca

SEQ ID NO: 9076765 - DNA, 23 bp, Homo sapiens
tctcagtgccgattgcatacaca

SEQ ID NO: 9076766 - DNA, 22 bp, Homo sapiens
tctcagtggacgtgtctgtctt

SEQ ID NO: 9076767 - DNA, 22 bp, Homo sapiens
tctcatcattccttcaaagccc

SEQ ID NO: 9076768 - DNA, 22 bp, Homo sapiens
tctcatctattcacattaactg

SEQ ID NO: 9076769 - DNA, 22 bp, Homo sapiens
tctcagtccaaatgagaggttg

SEQ ID NO: 9076770 - DNA, 22 bp, Homo sapiens
tctcagtcagccttgatgtccc

SEQ ID NO: 9076771 - DNA, 22 bp, Homo sapiens
tctcagtcagtttggactgtgt

SEQ ID NO: 9076772 - DNA, 22 bp, Homo sapiens
tctcagtgaagagtataacaaa

SEQ ID NO: 9076773 - DNA, 22 bp, Homo sapiens
tctcagtctttttggttactca

SEQ ID NO: 9076774 - DNA, 22 bp, Homo sapiens
tctcagtgacactcttcataca

SEQ ID NO: 9076775 - DNA, 23 bp, Homo sapiens
tctcagtgaatctcagaattcgc

SEQ ID NO: 9076776 - DNA, 22 bp, Homo sapiens
tctcagtgcagagaggctatct

SEQ ID NO: 9076777 - DNA, 22 bp, Homo sapiens
tctcagtgcagcaaggaattta

SEQ ID NO: 9076778 - DNA, 23 bp, Homo sapiens
tctcagtgcacgcaccatgcctg

SEQ ID NO: 9076779 - DNA, 22 bp, Homo sapiens
tctcagtgcagcaaggaattta

SEQ ID NO: 9076780 - DNA, 22 bp, Homo sapiens
tctcagtgatggcccatttgga

SEQ ID NO: 9076781 - DNA, 22 bp, Homo sapiens
tctcagtgagcttttctatgtt

SEQ ID NO: 9076782 - DNA, 17 bp, Homo sapiens
tctcagtgactgatagc

SEQ ID NO: 9076783 - DNA, 22 bp, Homo sapiens
tctcagtgactgctgggtcccc

SEQ ID NO: 9076784 - DNA, 22 bp, Homo sapiens
tctcagggtttgtacaagtgta

SEQ ID NO: 9076785 - DNA, 17 bp, Homo sapiens
tctcaggggctagccct

SEQ ID NO: 9076786 - DNA, 18 bp, Homo sapiens
tctgaaggaatgattcca

SEQ ID NO: 9076787 - DNA, 22 bp, Homo sapiens
tctgaaggaaaagggtagatat

SEQ ID NO: 9076788 - DNA, 18 bp, Homo sapiens
tctgaaggaatgattcca

SEQ ID NO: 9076789 - DNA, 21 bp, Homo sapiens
tctgaaggcattttccaaggt

SEQ ID NO: 9076790 - DNA, 22 bp, Homo sapiens
tctgaaggcctggagggtccca

SEQ ID NO: 9076791 - DNA, 22 bp, Homo sapiens
tctgaagcctttgtacaggcct

SEQ ID NO: 9076792 - DNA, 22 bp, Homo sapiens
tctgaagctggaggaagctttg

SEQ ID NO: 9076793 - DNA, 22 bp, Homo sapiens
tctgaaggaaaagggtagatat

SEQ ID NO: 9076794 - DNA, 22 bp, Homo sapiens
tctgaagctggaggaagctttg

SEQ ID NO: 9076795 - DNA, 17 bp, Homo sapiens
tctgaagccagtctgct

SEQ ID NO: 9076796 - DNA, 22 bp, Homo sapiens
tctgaaggtctgagaaccagga

SEQ ID NO: 9076797 - DNA, 22 bp, Homo sapiens
tctgaaggtgctagagaaagct

SEQ ID NO: 9076798 - DNA, 22 bp, Homo sapiens
tctgaaggtgctagagaaagct

SEQ ID NO: 9076799 - DNA, 22 bp, Homo sapiens
tctgaaggttacttctgctcag

SEQ ID NO: 9076800 - DNA, 22 bp, Homo sapiens
tctgaaggttgagaagggctga

SEQ ID NO: 9076801 - DNA, 22 bp, Homo sapiens
tctgaattttaactacacaaag

SEQ ID NO: 9076802 - DNA, 22 bp, Homo sapiens
tctgaaggttgagaagggctga

SEQ ID NO: 9076803 - DNA, 22 bp, Homo sapiens
tctgaattttaactacacaaag

SEQ ID NO: 9076804 - DNA, 22 bp, Homo sapiens
tctgaagagctttggaagtatg

SEQ ID NO: 9076805 - DNA, 22 bp, Homo sapiens
tctgaagacatatgatatggtg

SEQ ID NO: 9076806 - DNA, 19 bp, Homo sapiens
tctgaagaattagagagca

SEQ ID NO: 9076807 - DNA, 22 bp, Homo sapiens
tctgaagagtcttgcaagaaag

SEQ ID NO: 9076808 - DNA, 22 bp, Homo sapiens
tctgaagcacagcaggaagggt

SEQ ID NO: 9076809 - DNA, 22 bp, Homo sapiens
tctgaagcactgcaatgcttta

SEQ ID NO: 9076810 - DNA, 22 bp, Homo sapiens
tctgaagaataggatgttgtgt

SEQ ID NO: 9076811 - DNA, 22 bp, Homo sapiens
tctgaagaactgagtaaacatg

SEQ ID NO: 9076812 - DNA, 22 bp, Homo sapiens
tctgaaattttagttatagaaa

SEQ ID NO: 9076813 - DNA, 22 bp, Homo sapiens
tctgaaatgcaaatttgactga

SEQ ID NO: 9076814 - DNA, 22 bp, Homo sapiens
tctctttaagtataatcttata

SEQ ID NO: 9076815 - DNA, 23 bp, Homo sapiens
tctctttcaagagcttaatgtgc

SEQ ID NO: 9076816 - DNA, 22 bp, Homo sapiens
tctctttaaagactcagagatt

SEQ ID NO: 9076817 - DNA, 22 bp, Homo sapiens
tctctttaaaaatagtgaaata

SEQ ID NO: 9076818 - DNA, 21 bp, Homo sapiens
tctctttgggaacattaatca

SEQ ID NO: 9076819 - DNA, 22 bp, Homo sapiens
tctctttgcctgctgccatcca

SEQ ID NO: 9076820 - DNA, 22 bp, Homo sapiens
tctctttgaccctttagctcca

SEQ ID NO: 9076821 - DNA, 17 bp, Homo sapiens
tctctttccctttctgc

SEQ ID NO: 9076822 - DNA, 17 bp, Homo sapiens
tctctttccctttctgc

SEQ ID NO: 9076823 - DNA, 22 bp, Homo sapiens
tctctttctattgcaccatgct

SEQ ID NO: 9076824 - DNA, 23 bp, Homo sapiens
tctgaaagggatgctgggcagga

SEQ ID NO: 9076825 - DNA, 22 bp, Homo sapiens
tctgaaagatgagtggtccatt

SEQ ID NO: 9076826 - DNA, 22 bp, Homo sapiens
tctgaaataaatgcactgttag

SEQ ID NO: 9076827 - DNA, 22 bp, Homo sapiens
tctgaaaactccatgagctcgt

SEQ ID NO: 9076828 - DNA, 22 bp, Homo sapiens
tctgaaaatgttgactttgttt

SEQ ID NO: 9076829 - DNA, 22 bp, Homo sapiens
tctgaaaatgttgactttgttt

SEQ ID NO: 9076830 - DNA, 22 bp, Homo sapiens
tctgaaaatgttgactttgttt

SEQ ID NO: 9076831 - DNA, 22 bp, Homo sapiens
tctgaaagaagggcagtctttt

SEQ ID NO: 9076832 - DNA, 20 bp, Homo sapiens
tctcttttagcttacagctg

SEQ ID NO: 9076833 - DNA, 22 bp, Homo sapiens
tctctttgtggccaggagagga

SEQ ID NO: 9076834 - DNA, 22 bp, Homo sapiens
tctctttgtggccaggagagga

SEQ ID NO: 9076835 - DNA, 22 bp, Homo sapiens
tctctttgtctgctcttagttg

SEQ ID NO: 9076836 - DNA, 22 bp, Homo sapiens
tctctttgtctgctcttagttg

SEQ ID NO: 9076837 - DNA, 22 bp, Homo sapiens
tctctgtcacacaatctacaca

SEQ ID NO: 9076838 - DNA, 23 bp, Homo sapiens
tctctggttaggggagattggtg

SEQ ID NO: 9076839 - DNA, 22 bp, Homo sapiens
tctctggttatgtcattaagca

SEQ ID NO: 9076840 - DNA, 22 bp, Homo sapiens
tctctgggtttttgtcctgtac

SEQ ID NO: 9076841 - DNA, 22 bp, Homo sapiens
tctctgtccctaggagccttgc

SEQ ID NO: 9076842 - DNA, 22 bp, Homo sapiens
tctctgtctcccgtgtgtccgg

SEQ ID NO: 9076843 - DNA, 22 bp, Homo sapiens
tctctgtctcccgtgtgtccgg

SEQ ID NO: 9076844 - DNA, 22 bp, Homo sapiens
tctctgtctttgttgtcttcac

SEQ ID NO: 9076845 - DNA, 22 bp, Homo sapiens
tctctgtctttgttgtcttcac

SEQ ID NO: 9076846 - DNA, 22 bp, Homo sapiens
tctctgtctgcacccaatcaat

SEQ ID NO: 9076847 - DNA, 22 bp, Homo sapiens
tctctgtctgagcctggcagac

SEQ ID NO: 9076848 - DNA, 22 bp, Homo sapiens
tctctgtctgagcctggcagac

SEQ ID NO: 9076849 - DNA, 22 bp, Homo sapiens
tctctgtctgagcctggcagac

SEQ ID NO: 9076850 - DNA, 22 bp, Homo sapiens
tctctgtgcttgactttcccat

SEQ ID NO: 9076851 - DNA, 22 bp, Homo sapiens
tctctgtggcaacaattcacta

SEQ ID NO: 9076852 - DNA, 21 bp, Homo sapiens
tctctgtggcctaccctctac

SEQ ID NO: 9076853 - DNA, 22 bp, Homo sapiens
tctctgtggcaagcatgctgct

SEQ ID NO: 9076854 - DNA, 22 bp, Homo sapiens
tctctgtggtgggaggctgagt

SEQ ID NO: 9076855 - DNA, 22 bp, Homo sapiens
tctcttccagtaagagtcttta

SEQ ID NO: 9076856 - DNA, 20 bp, Homo sapiens
tctcttcaggaggtccatgt

SEQ ID NO: 9076857 - DNA, 22 bp, Homo sapiens
tctcttaatccggtgctttctg

SEQ ID NO: 9076858 - DNA, 22 bp, Homo sapiens
tctcttaattcagaggcagtta

SEQ ID NO: 9076859 - DNA, 23 bp, Homo sapiens
tctctgtgtgcctcagtttcttc

SEQ ID NO: 9076860 - DNA, 22 bp, Homo sapiens
tctcttccagtaagagtcttta

SEQ ID NO: 9076861 - DNA, 22 bp, Homo sapiens
tctcttccagtggctttgattt

SEQ ID NO: 9076862 - DNA, 22 bp, Homo sapiens
tctcttccctttatggtatgtg

SEQ ID NO: 9076863 - DNA, 22 bp, Homo sapiens
tctcttcccctttcctttaaca

SEQ ID NO: 9076864 - DNA, 22 bp, Homo sapiens
tctcttccttgacctattgtaa

SEQ ID NO: 9076865 - DNA, 22 bp, Homo sapiens
tctcttctaacactagaaattc

SEQ ID NO: 9076866 - DNA, 22 bp, Homo sapiens
tctcttcttgattttcactgga

SEQ ID NO: 9076867 - DNA, 22 bp, Homo sapiens
tctcttcttgattttcactgga

SEQ ID NO: 9076868 - DNA, 22 bp, Homo sapiens
tctcttcttgtgttttcctgcc

SEQ ID NO: 9076869 - DNA, 22 bp, Homo sapiens
tctcttcttgtgttttcctgcc

SEQ ID NO: 9076870 - DNA, 18 bp, Homo sapiens
tctcttcttggcagtcaa

SEQ ID NO: 9076871 - DNA, 22 bp, Homo sapiens
tctcttctgaaacctgtcttta

SEQ ID NO: 9076872 - DNA, 22 bp, Homo sapiens
tctcttctgaaacctgtcttta

SEQ ID NO: 9076873 - DNA, 22 bp, Homo sapiens
tctcttctagcttcttgtggtt

SEQ ID NO: 9076874 - DNA, 22 bp, Homo sapiens
tctcttctatttgagactattt

SEQ ID NO: 9076875 - DNA, 22 bp, Homo sapiens
tctcttctatttgagactattt

SEQ ID NO: 9076876 - DNA, 22 bp, Homo sapiens
tctcttctgaaacctgtcttta

SEQ ID NO: 9076877 - DNA, 22 bp, Homo sapiens
tctctggcttaggttgagtgca

SEQ ID NO: 9076878 - DNA, 22 bp, Homo sapiens
tctctggctggcaccccaggga

SEQ ID NO: 9076879 - DNA, 19 bp, Homo sapiens
tctctggcttgtctgcctg

SEQ ID NO: 9076880 - DNA, 22 bp, Homo sapiens
tctctgggaaatggagaatttt

SEQ ID NO: 9076881 - DNA, 22 bp, Homo sapiens
tctctgggatcaggtggcccag

SEQ ID NO: 9076882 - DNA, 22 bp, Homo sapiens
tctctgggatcgttttgggctc

SEQ ID NO: 9076883 - DNA, 21 bp, Homo sapiens
tctctgggccctcctgtgggg

SEQ ID NO: 9076884 - DNA, 22 bp, Homo sapiens
tctctgggcctcagttttctca

SEQ ID NO: 9076885 - DNA, 22 bp, Homo sapiens
tctctgggcccagaccttcctt

SEQ ID NO: 9076886 - DNA, 22 bp, Homo sapiens
tctctggggatgcttattcttg

SEQ ID NO: 9076887 - DNA, 19 bp, Homo sapiens
tctctggggacactttcac

SEQ ID NO: 9076888 - DNA, 19 bp, Homo sapiens
tctctggggacactttcac

SEQ ID NO: 9076889 - DNA, 22 bp, Homo sapiens
tctctgggctcaggagcccggc

SEQ ID NO: 9076890 - DNA, 22 bp, Homo sapiens
tctctgggctcaggagcccggc

SEQ ID NO: 9076891 - DNA, 22 bp, Homo sapiens
tctctggggaaaaggctgatac

SEQ ID NO: 9076892 - DNA, 22 bp, Homo sapiens
tctctgggcctgttttctcatc

SEQ ID NO: 9076893 - DNA, 22 bp, Homo sapiens
tctctgggcctccctttccaag

SEQ ID NO: 9076894 - DNA, 22 bp, Homo sapiens
tctctgggctaaaatcaaggtg

SEQ ID NO: 9076895 - DNA, 22 bp, Homo sapiens
tctctgggttgagaactaggac

SEQ ID NO: 9076896 - DNA, 16 bp, Homo sapiens
tctctgggttgcacag

SEQ ID NO: 9076897 - DNA, 22 bp, Homo sapiens
tctctgggttgagaactaggac

SEQ ID NO: 9076898 - DNA, 22 bp, Homo sapiens
tctctgggttctcactcagcac

SEQ ID NO: 9076899 - DNA, 20 bp, Homo sapiens
tctctgggttctcactcagc

SEQ ID NO: 9076900 - DNA, 22 bp, Homo sapiens
tctctgggtgatggcagggcac

SEQ ID NO: 9076901 - DNA, 22 bp, Homo sapiens
tctctgggtgatggcagggcac

SEQ ID NO: 9076902 - DNA, 22 bp, Homo sapiens
tctctgggtcctggcaagctca

SEQ ID NO: 9076903 - DNA, 22 bp, Homo sapiens
tctctgggtcctggcaagctca

SEQ ID NO: 9076904 - DNA, 22 bp, Homo sapiens
tctctgggtctcagtttgtaca

SEQ ID NO: 9076905 - DNA, 22 bp, Homo sapiens
tctctgggtgatggcagggcac

SEQ ID NO: 9076906 - DNA, 23 bp, Homo sapiens
tctctgggtgggctgtgtctata

SEQ ID NO: 9076907 - DNA, 22 bp, Homo sapiens
tctctgggggtagaactcaggc

SEQ ID NO: 9076908 - DNA, 22 bp, Homo sapiens
tctctgggggtagaactcaggc

SEQ ID NO: 9076909 - DNA, 22 bp, Homo sapiens
tctctggggcctttctacatca

SEQ ID NO: 9076910 - DNA, 22 bp, Homo sapiens
tctctggggatggacctgggag

SEQ ID NO: 9076911 - DNA, 22 bp, Homo sapiens
tctctgggtattcactgccttc

SEQ ID NO: 9076912 - DNA, 22 bp, Homo sapiens
tctctgggtatggtaacgttgg

SEQ ID NO: 9076913 - DNA, 22 bp, Homo sapiens
tctctgggtattcactgccttc

SEQ ID NO: 9076914 - DNA, 22 bp, Homo sapiens
tctctgggtaaagttctctcat

SEQ ID NO: 9076915 - DNA, 22 bp, Homo sapiens
tctctggggtagggcccaggac

SEQ ID NO: 9076916 - DNA, 22 bp, Homo sapiens
tctctggctcctgccgggtcca

SEQ ID NO: 9076917 - DNA, 22 bp, Homo sapiens
tctctggctgatattcctctgc

SEQ ID NO: 9076918 - DNA, 22 bp, Homo sapiens
tctctggctggcaccccaggga

SEQ ID NO: 9076919 - DNA, 22 bp, Homo sapiens
tctctggccgagagtccctggg

SEQ ID NO: 9076920 - DNA, 21 bp, Homo sapiens
tctctggcggtgtttggctcc

SEQ ID NO: 9076921 - DNA, 23 bp, Homo sapiens
tctctggcctttgatcaggttga

SEQ ID NO: 9076922 - DNA, 22 bp, Homo sapiens
tctctggccctgttttctatct

SEQ ID NO: 9076923 - DNA, 22 bp, Homo sapiens
tctctggccccatggctgagct

SEQ ID NO: 9076924 - DNA, 19 bp, Homo sapiens
tctctggcatagactcaat

SEQ ID NO: 9076925 - DNA, 19 bp, Homo sapiens
tctctggcagttcagagca

SEQ ID NO: 9076926 - DNA, 20 bp, Homo sapiens
tctctggccagaaacaacag

SEQ ID NO: 9076927 - DNA, 22 bp, Homo sapiens
tctctggcagactggctgggct

SEQ ID NO: 9076928 - DNA, 22 bp, Homo sapiens
tctctggcagaggccctatccc

SEQ ID NO: 9076929 - DNA, 22 bp, Homo sapiens
tctctggcagggatatctggct

SEQ ID NO: 9076930 - DNA, 22 bp, Homo sapiens
tctctggcagcttgtgctgttg

SEQ ID NO: 9076931 - DNA, 22 bp, Homo sapiens
tctctggcacataataaggtct

SEQ ID NO: 9076932 - DNA, 22 bp, Homo sapiens
tctctggcactcccttatggct

SEQ ID NO: 9076933 - DNA, 22 bp, Homo sapiens
tctctggcagacacctccctga

SEQ ID NO: 9076934 - DNA, 20 bp, Homo sapiens
tctctggcaagaagctgcag

SEQ ID NO: 9076935 - DNA, 19 bp, Homo sapiens
tctctgccgatcagggccc

SEQ ID NO: 9076936 - DNA, 22 bp, Homo sapiens
tctctgcccatgagcaatctgc

SEQ ID NO: 9076937 - DNA, 22 bp, Homo sapiens
tctctgctaagattgtgtctag

SEQ ID NO: 9076938 - DNA, 22 bp, Homo sapiens
tctctgctaagattgtgtctag

SEQ ID NO: 9076939 - DNA, 22 bp, Homo sapiens
tctctgctctgtgcctcagttt

SEQ ID NO: 9076940 - DNA, 22 bp, Homo sapiens
tctctgctctgtgcctcagttt

SEQ ID NO: 9076941 - DNA, 22 bp, Homo sapiens
tctctgctgagaagggctggca

SEQ ID NO: 9076942 - DNA, 19 bp, Homo sapiens
tctctgcttctcttggcat

SEQ ID NO: 9076943 - DNA, 19 bp, Homo sapiens
tctctgcttctcttggcat

SEQ ID NO: 9076944 - DNA, 19 bp, Homo sapiens
tctctgcttctcttggcat

SEQ ID NO: 9076945 - DNA, 22 bp, Homo sapiens
tctctggaattggctgaggcaa

SEQ ID NO: 9076946 - DNA, 22 bp, Homo sapiens
tctctggaattggctgaggcaa

SEQ ID NO: 9076947 - DNA, 21 bp, Homo sapiens
tctctggagttagcagagaga

SEQ ID NO: 9076948 - DNA, 22 bp, Homo sapiens
tctctgaacttcctggaaaggc

SEQ ID NO: 9076949 - DNA, 22 bp, Homo sapiens
tctctgaagagtcagacataac

SEQ ID NO: 9076950 - DNA, 22 bp, Homo sapiens
tctctgaagagtcagacataac

SEQ ID NO: 9076951 - DNA, 22 bp, Homo sapiens
tctctgaagagctcagactagt

SEQ ID NO: 9076952 - DNA, 23 bp, Homo sapiens
tctctctggcaaatttcacatat

SEQ ID NO: 9076953 - DNA, 23 bp, Homo sapiens
tctctctggcaaatttcacatat

SEQ ID NO: 9076954 - DNA, 22 bp, Homo sapiens
tctctctttttaatcatgtaat

SEQ ID NO: 9076955 - DNA, 22 bp, Homo sapiens
tctctctgccaactcacagcca

SEQ ID NO: 9076956 - DNA, 22 bp, Homo sapiens
tctctgaataatgctattcttt

SEQ ID NO: 9076957 - DNA, 22 bp, Homo sapiens
tctctgaagctgttgtagtctc

SEQ ID NO: 9076958 - DNA, 22 bp, Homo sapiens
tctctgaattctgatgcaagtg

SEQ ID NO: 9076959 - DNA, 22 bp, Homo sapiens
tctctgagaagctgaggctggg

SEQ ID NO: 9076960 - DNA, 22 bp, Homo sapiens
tctctgagcccaatgtagcaat

SEQ ID NO: 9076961 - DNA, 21 bp, Homo sapiens
tctctgagacactctggagcc

SEQ ID NO: 9076962 - DNA, 22 bp, Homo sapiens
tctctgagatcagccactgact

SEQ ID NO: 9076963 - DNA, 22 bp, Homo sapiens
tctctgagctgcttcttgcata

SEQ ID NO: 9076964 - DNA, 22 bp, Homo sapiens
tctctgagctcaggagctgcag

SEQ ID NO: 9076965 - DNA, 22 bp, Homo sapiens
tctctgaggaagaggctgtaat

SEQ ID NO: 9076966 - DNA, 22 bp, Homo sapiens
tctctgagtcaccgtggagacg

SEQ ID NO: 9076967 - DNA, 22 bp, Homo sapiens
tctctgaggttgtttccagcac

SEQ ID NO: 9076968 - DNA, 22 bp, Homo sapiens
tctctgagggagatggcctgcc

SEQ ID NO: 9076969 - DNA, 22 bp, Homo sapiens
tctctcctaatttcaggtgctt

SEQ ID NO: 9076970 - DNA, 22 bp, Homo sapiens
tctctcccctggccgctacgcg

SEQ ID NO: 9076971 - DNA, 22 bp, Homo sapiens
tctctcccaaatctgcagatag

SEQ ID NO: 9076972 - DNA, 22 bp, Homo sapiens
tctctcccaaatctgcagatag

SEQ ID NO: 9076973 - DNA, 22 bp, Homo sapiens
tctctccctttccttatcagtt

SEQ ID NO: 9076974 - DNA, 22 bp, Homo sapiens
tctctccttatcattgtgttta

SEQ ID NO: 9076975 - DNA, 22 bp, Homo sapiens
tctctctactggggcactagga

SEQ ID NO: 9076976 - DNA, 22 bp, Homo sapiens
tctctctcagccattacagaac

SEQ ID NO: 9076977 - DNA, 22 bp, Homo sapiens
tctctctgagttgagcaggagt

SEQ ID NO: 9076978 - DNA, 22 bp, Homo sapiens
tctctcagaggaagaggcagtg

SEQ ID NO: 9076979 - DNA, 22 bp, Homo sapiens
tctctcaacctcggcactattg

SEQ ID NO: 9076980 - DNA, 22 bp, Homo sapiens
tctctagttgaggactgagcag

SEQ ID NO: 9076981 - DNA, 18 bp, Homo sapiens
tctctcagggaaacagaa

SEQ ID NO: 9076982 - DNA, 22 bp, Homo sapiens
tcctggagttgtgcagtgcaca

SEQ ID NO: 9076983 - DNA, 22 bp, Homo sapiens
tcctggattctgccctgaaggc

SEQ ID NO: 9076984 - DNA, 22 bp, Homo sapiens
tcctggattaatagggagctgt

SEQ ID NO: 9076985 - DNA, 22 bp, Homo sapiens
tcctggatatcaaacaaacatt

SEQ ID NO: 9076986 - DNA, 22 bp, Homo sapiens
tcctggatcagcgggggcaggc

SEQ ID NO: 9076987 - DNA, 22 bp, Homo sapiens
tcctggccacccgacagaagtc

SEQ ID NO: 9076988 - DNA, 22 bp, Homo sapiens
tcctggccacccgacagaagtc

SEQ ID NO: 9076989 - DNA, 18 bp, Homo sapiens
tcctggccacactacctt

SEQ ID NO: 9076990 - DNA, 22 bp, Homo sapiens
tcctggccaggatgacctaaca

SEQ ID NO: 9076991 - DNA, 22 bp, Homo sapiens
tcctggccagaggacaaagctg

SEQ ID NO: 9076992 - DNA, 21 bp, Homo sapiens
tcctggccagggcactaggca

SEQ ID NO: 9076993 - DNA, 17 bp, Homo sapiens
tcctggcagtcccctgg

SEQ ID NO: 9076994 - DNA, 22 bp, Homo sapiens
tcctggctctctacaaaccaga

SEQ ID NO: 9076995 - DNA, 17 bp, Homo sapiens
tcctggctctgccactg

SEQ ID NO: 9076996 - DNA, 22 bp, Homo sapiens
tcctggctctaagtcctgagtg

SEQ ID NO: 9076997 - DNA, 22 bp, Homo sapiens
tcctggctcgattgctaccaat

SEQ ID NO: 9076998 - DNA, 22 bp, Homo sapiens
tcctggctcctgatctgtcact

SEQ ID NO: 9076999 - DNA, 22 bp, Homo sapiens
tcctggctcctggagacctgct

SEQ ID NO: 9077000 - DNA, 22 bp, Homo sapiens
tcctggccctgtggcctgcagt

SEQ ID NO: 9077001 - DNA, 22 bp, Homo sapiens
tcctggccctctgcaaacgcca

SEQ ID NO: 9077002 - DNA, 22 bp, Homo sapiens
tcctggcccactatgccagcat

SEQ ID NO: 9077003 - DNA, 22 bp, Homo sapiens
tcctggcccactatgccagcat

SEQ ID NO: 9077004 - DNA, 22 bp, Homo sapiens
tcctggcccactcctagcttct

SEQ ID NO: 9077005 - DNA, 22 bp, Homo sapiens
tcctggcccactcctagcttct

SEQ ID NO: 9077006 - DNA, 22 bp, Homo sapiens
tcctggcccactatgccagcat

SEQ ID NO: 9077007 - DNA, 22 bp, Homo sapiens
tcctggcccactatgccagcat

SEQ ID NO: 9077008 - DNA, 22 bp, Homo sapiens
tcctgcttccttgtctttagac

SEQ ID NO: 9077009 - DNA, 19 bp, Homo sapiens
tcctgctgtgtgaagggga

SEQ ID NO: 9077010 - DNA, 22 bp, Homo sapiens
tcctgctggattgtgtctggtg

SEQ ID NO: 9077011 - DNA, 22 bp, Homo sapiens
tcctgctgtgtctagctggttc

SEQ ID NO: 9077012 - DNA, 22 bp, Homo sapiens
taagaattgtgttgaatagagt

SEQ ID NO: 9077013 - DNA, 22 bp, Homo sapiens
taagaattatctcatggataat

SEQ ID NO: 9077014 - DNA, 22 bp, Homo sapiens
taagaatcgatgtttatttaga

SEQ ID NO: 9077015 - DNA, 22 bp, Homo sapiens
taagaacagtagaacagtaggt

SEQ ID NO: 9077016 - DNA, 22 bp, Homo sapiens
taagaacagtagaacagtaggt

SEQ ID NO: 9077017 - DNA, 23 bp, Homo sapiens
taagaacagacaagcatttacat

SEQ ID NO: 9077018 - DNA, 22 bp, Homo sapiens
taagaacaagctgggggttcca

SEQ ID NO: 9077019 - DNA, 22 bp, Homo sapiens
taagaacagtgtttcatctcta

SEQ ID NO: 9077020 - DNA, 22 bp, Homo sapiens
taagaacagtgtctgtctcaca

SEQ ID NO: 9077021 - DNA, 22 bp, Homo sapiens
taagaacagtgacagccaacat

SEQ ID NO: 9077022 - DNA, 22 bp, Homo sapiens
taagaatagtccctagatgtgt

SEQ ID NO: 9077023 - DNA, 22 bp, Homo sapiens
tcctggaggcactcgctggggc

SEQ ID NO: 9077024 - DNA, 22 bp, Homo sapiens
tcctggagggaggcggtgctac

SEQ ID NO: 9077025 - DNA, 22 bp, Homo sapiens
tcctggaggcaaatgagcacat

SEQ ID NO: 9077026 - DNA, 22 bp, Homo sapiens
tcctggaggcaaatgaagactc

SEQ ID NO: 9077027 - DNA, 22 bp, Homo sapiens
tcctggaggcaaatgaagactc

SEQ ID NO: 9077028 - DNA, 22 bp, Homo sapiens
tcctggaggggacagcatgggc

SEQ ID NO: 9077029 - DNA, 22 bp, Homo sapiens
tcctggaggggacagcatgggc

SEQ ID NO: 9077030 - DNA, 22 bp, Homo sapiens
tcctggaggggacagcatgggc

SEQ ID NO: 9077031 - DNA, 22 bp, Homo sapiens
tcctggagtatttctgtggtgt

SEQ ID NO: 9077032 - DNA, 22 bp, Homo sapiens
tcctggagtatttctgtggtgt

SEQ ID NO: 9077033 - DNA, 22 bp, Homo sapiens
tcctggagaatcctgccacctg

SEQ ID NO: 9077034 - DNA, 22 bp, Homo sapiens
tcctggagagtgggcgagcaca

SEQ ID NO: 9077035 - DNA, 22 bp, Homo sapiens
tcctggagataattgcagtgaa

SEQ ID NO: 9077036 - DNA, 22 bp, Homo sapiens
tcctggagccaatgtgctgctg

SEQ ID NO: 9077037 - DNA, 22 bp, Homo sapiens
tcctggagaaactcagagatct

SEQ ID NO: 9077038 - DNA, 22 bp, Homo sapiens
tcctggacaagcccttcaccct

SEQ ID NO: 9077039 - DNA, 22 bp, Homo sapiens
tcctggactggctcagcaccct

SEQ ID NO: 9077040 - DNA, 22 bp, Homo sapiens
tcctggacagatccccatcatc

SEQ ID NO: 9077041 - DNA, 22 bp, Homo sapiens
tcctggcttgtcacatctacgt

SEQ ID NO: 9077042 - DNA, 18 bp, Homo sapiens
tcctgggaaaggcataca

SEQ ID NO: 9077043 - DNA, 22 bp, Homo sapiens
tcctggcttttcttggctcatc

SEQ ID NO: 9077044 - DNA, 21 bp, Homo sapiens
tcctggctttatgctacctct

SEQ ID NO: 9077045 - DNA, 21 bp, Homo sapiens
tcctggctttatgctacctct

SEQ ID NO: 9077046 - DNA, 22 bp, Homo sapiens
tcctgggaactcggaaagctct

SEQ ID NO: 9077047 - DNA, 18 bp, Homo sapiens
tcctgggaacttgctagc

SEQ ID NO: 9077048 - DNA, 22 bp, Homo sapiens
tcctggctgccgtcgtcctgcg

SEQ ID NO: 9077049 - DNA, 22 bp, Homo sapiens
tcctggctgtcactcgggttga

SEQ ID NO: 9077050 - DNA, 22 bp, Homo sapiens
tcctggctggaatttctcactc

SEQ ID NO: 9077051 - DNA, 22 bp, Homo sapiens
tcctggcttaggtttccagaac

SEQ ID NO: 9077052 - DNA, 22 bp, Homo sapiens
tcctggcttccactcctctgtt

SEQ ID NO: 9077053 - DNA, 22 bp, Homo sapiens
tcctgggaagagacctgagcat

SEQ ID NO: 9077054 - DNA, 22 bp, Homo sapiens
tcctgggaccaggcacctactg

SEQ ID NO: 9077055 - DNA, 22 bp, Homo sapiens
tcctgggaagttgcatcaccgt

SEQ ID NO: 9077056 - DNA, 22 bp, Homo sapiens
tcctgggaggcggaggttgcag

SEQ ID NO: 9077057 - DNA, 22 bp, Homo sapiens
tcctgggctgcagggaagagca

SEQ ID NO: 9077058 - DNA, 19 bp, Homo sapiens
tcctgggctgcgtcttgcc

SEQ ID NO: 9077059 - DNA, 22 bp, Homo sapiens
tcctgggctgcagggaagagca

SEQ ID NO: 9077060 - DNA, 19 bp, Homo sapiens
tcctgggctgggccaggtc

SEQ ID NO: 9077061 - DNA, 22 bp, Homo sapiens
tcctgggctgtgtgccactctg

SEQ ID NO: 9077062 - DNA, 22 bp, Homo sapiens
tcctgggctgtgtgccactctg

SEQ ID NO: 9077063 - DNA, 22 bp, Homo sapiens
tcctgggccctccggatcaggt

SEQ ID NO: 9077064 - DNA, 22 bp, Homo sapiens
tcctgggcctgtactccatccg

SEQ ID NO: 9077065 - DNA, 22 bp, Homo sapiens
tcctgggcctgtactccatccg

SEQ ID NO: 9077066 - DNA, 22 bp, Homo sapiens
tcctgggcccaggctgccaggg

SEQ ID NO: 9077067 - DNA, 22 bp, Homo sapiens
tcctgggcccaggctgccaggg

SEQ ID NO: 9077068 - DNA, 22 bp, Homo sapiens
tcctgggcagcgggacgctcag

SEQ ID NO: 9077069 - DNA, 22 bp, Homo sapiens
tcctgggcaaagaggggcagtg

SEQ ID NO: 9077070 - DNA, 22 bp, Homo sapiens
tcctgggattctgcatttctaa

SEQ ID NO: 9077071 - DNA, 22 bp, Homo sapiens
tcctgggcacaagtgagtctcc

SEQ ID NO: 9077072 - DNA, 22 bp, Homo sapiens
tcctgggcacaagtgagtctcc

SEQ ID NO: 9077073 - DNA, 22 bp, Homo sapiens
tcctgggatgacttttgaaatg

SEQ ID NO: 9077074 - DNA, 22 bp, Homo sapiens
tcctgggagtggccatgtaatg

SEQ ID NO: 9077075 - DNA, 21 bp, Homo sapiens
tcctgggagtctgagatcctg

SEQ ID NO: 9077076 - DNA, 22 bp, Homo sapiens
tcctgtctaaagacctgcaggc

SEQ ID NO: 9077077 - DNA, 22 bp, Homo sapiens
tcctgtccacagccctgacctc

SEQ ID NO: 9077078 - DNA, 22 bp, Homo sapiens
tcctgtcagtgaggcagatgaa

SEQ ID NO: 9077079 - DNA, 22 bp, Homo sapiens
tcctgtcagtgaggcagatgaa

SEQ ID NO: 9077080 - DNA, 22 bp, Homo sapiens
tcctggtggtctgtgcttcttc

SEQ ID NO: 9077081 - DNA, 20 bp, Homo sapiens
tcctgtggacattgctggcc

SEQ ID NO: 9077082 - DNA, 22 bp, Homo sapiens
tcctgtggaagacagtgttggg

SEQ ID NO: 9077083 - DNA, 22 bp, Homo sapiens
tcctgtggagaggactggaggt

SEQ ID NO: 9077084 - DNA, 22 bp, Homo sapiens
tcctgtggagaggactggaggt

SEQ ID NO: 9077085 - DNA, 22 bp, Homo sapiens
tcctgtggcgttatcatgtgat

SEQ ID NO: 9077086 - DNA, 17 bp, Homo sapiens
tcctgtgggtgcagcag

SEQ ID NO: 9077087 - DNA, 22 bp, Homo sapiens
tcctgtctgctcacagagctgg

SEQ ID NO: 9077088 - DNA, 22 bp, Homo sapiens
tcctgtctgctcacagagctgg

SEQ ID NO: 9077089 - DNA, 22 bp, Homo sapiens
tcctgtctgtctttggtccctt

SEQ ID NO: 9077090 - DNA, 22 bp, Homo sapiens
tcctgtcttaatgatctcgtgc

SEQ ID NO: 9077091 - DNA, 22 bp, Homo sapiens
tcctggggctctgagcgagaca

SEQ ID NO: 9077092 - DNA, 22 bp, Homo sapiens
tcctggggctctgagcgagaca

SEQ ID NO: 9077093 - DNA, 22 bp, Homo sapiens
tcctggggctgcaaggcctgtc

SEQ ID NO: 9077094 - DNA, 22 bp, Homo sapiens
tcctggggctgcaaggcctgtc

SEQ ID NO: 9077095 - DNA, 22 bp, Homo sapiens
tcctggggctgcaaggcctgtc

SEQ ID NO: 9077096 - DNA, 20 bp, Homo sapiens
tcctggggtaagccatggtc

SEQ ID NO: 9077097 - DNA, 20 bp, Homo sapiens
tcctggggtaagccatggtc

SEQ ID NO: 9077098 - DNA, 22 bp, Homo sapiens
tcctggggaggtcgaggctgag

SEQ ID NO: 9077099 - DNA, 22 bp, Homo sapiens
tcctggggccaggcacctctgg

SEQ ID NO: 9077100 - DNA, 22 bp, Homo sapiens
tcctggggccagcactggtgga

SEQ ID NO: 9077101 - DNA, 22 bp, Homo sapiens
tcctggggtttagagggaagtg

SEQ ID NO: 9077102 - DNA, 22 bp, Homo sapiens
tcctggggttttggccgcagct

SEQ ID NO: 9077103 - DNA, 22 bp, Homo sapiens
tcctgggtagagacctgatgaa

SEQ ID NO: 9077104 - DNA, 20 bp, Homo sapiens
tcctggggtaagccatggtc

SEQ ID NO: 9077105 - DNA, 22 bp, Homo sapiens
tcctggggtgtgttttgctgct

SEQ ID NO: 9077106 - DNA, 22 bp, Homo sapiens
tcctgggtggtggtaggagcag

SEQ ID NO: 9077107 - DNA, 22 bp, Homo sapiens
tcctgggtccatggcagccgaa

SEQ ID NO: 9077108 - DNA, 22 bp, Homo sapiens
tcctgggtccatggcagccgaa

SEQ ID NO: 9077109 - DNA, 22 bp, Homo sapiens
tctattttatactcaaatcttc

SEQ ID NO: 9077110 - DNA, 22 bp, Homo sapiens
tctattcattcaatttagctct

SEQ ID NO: 9077111 - DNA, 22 bp, Homo sapiens
tctatttaccaaatgtagttcc

SEQ ID NO: 9077112 - DNA, 22 bp, Homo sapiens
tctatttacagaaagcagaatt

SEQ ID NO: 9077113 - DNA, 22 bp, Homo sapiens
tctatttttatagttgaagtgc

SEQ ID NO: 9077114 - DNA, 23 bp, Homo sapiens
tctcaaatatgatctgggtcatc

SEQ ID NO: 9077115 - DNA, 22 bp, Homo sapiens
tctcaaataggccttggtcctg

SEQ ID NO: 9077116 - DNA, 22 bp, Homo sapiens
tctcaaatatttggagagagga

SEQ ID NO: 9077117 - DNA, 22 bp, Homo sapiens
tctcaaatatttggagagagga

SEQ ID NO: 9077118 - DNA, 22 bp, Homo sapiens
tctcaaagtagctcccacagat

SEQ ID NO: 9077119 - DNA, 18 bp, Homo sapiens
tctcaaaaataatggctt

SEQ ID NO: 9077120 - DNA, 19 bp, Homo sapiens
tctcacaagcaacattgtt

SEQ ID NO: 9077121 - DNA, 22 bp, Homo sapiens
tctcacaagctcaaggattagt

SEQ ID NO: 9077122 - DNA, 22 bp, Homo sapiens
tctcaaatggacaatattgtgg

SEQ ID NO: 9077123 - DNA, 23 bp, Homo sapiens
tctcaaatctttgcgttgtatct

SEQ ID NO: 9077124 - DNA, 22 bp, Homo sapiens
tctcaaatcaaactttgagctt

SEQ ID NO: 9077125 - DNA, 22 bp, Homo sapiens
tctcaaatggcaaatgtgggtc

SEQ ID NO: 9077126 - DNA, 22 bp, Homo sapiens
tctcaaggactttgggcactaa

SEQ ID NO: 9077127 - DNA, 22 bp, Homo sapiens
tctcacagcaggggccaggtct

SEQ ID NO: 9077128 - DNA, 22 bp, Homo sapiens
tctcacaccgtccctaaaccat

SEQ ID NO: 9077129 - DNA, 22 bp, Homo sapiens
tctcacagccatttctccctct

SEQ ID NO: 9077130 - DNA, 22 bp, Homo sapiens
tctcacagcatcattgctcatg

SEQ ID NO: 9077131 - DNA, 22 bp, Homo sapiens
tctcacagggctaggccctgcc

SEQ ID NO: 9077132 - DNA, 22 bp, Homo sapiens
tctaggcattgttattacaact

SEQ ID NO: 9077133 - DNA, 20 bp, Homo sapiens
tctaggcaggcaggctcgtg

SEQ ID NO: 9077134 - DNA, 22 bp, Homo sapiens
tctaggcctggcttgggcccag

SEQ ID NO: 9077135 - DNA, 22 bp, Homo sapiens
tctataaagggccagatagtag

SEQ ID NO: 9077136 - DNA, 22 bp, Homo sapiens
tctataaaactcaagagcaatt

SEQ ID NO: 9077137 - DNA, 22 bp, Homo sapiens
tctataaaactcaagagcaatt

SEQ ID NO: 9077138 - DNA, 22 bp, Homo sapiens
tctatgaatcaattttaacatc

SEQ ID NO: 9077139 - DNA, 22 bp, Homo sapiens
tctatgcttgagacagatgggg

SEQ ID NO: 9077140 - DNA, 22 bp, Homo sapiens
tctatattttgaaaggtattta

SEQ ID NO: 9077141 - DNA, 21 bp, Homo sapiens
tctatcacctaaattaaacag

SEQ ID NO: 9077142 - DNA, 22 bp, Homo sapiens
tctatcagagtagaaggcaacg

SEQ ID NO: 9077143 - DNA, 22 bp, Homo sapiens
tctataaagggccagatagtag

SEQ ID NO: 9077144 - DNA, 19 bp, Homo sapiens
tctatgggctttttgtagt

SEQ ID NO: 9077145 - DNA, 22 bp, Homo sapiens
tctagctgagggtaggagacct

SEQ ID NO: 9077146 - DNA, 22 bp, Homo sapiens
tctagctctgcttatcatggct

SEQ ID NO: 9077147 - DNA, 22 bp, Homo sapiens
tctagctcctgagtgccagagg

SEQ ID NO: 9077148 - DNA, 22 bp, Homo sapiens
tctaggaaattgttactatatt

SEQ ID NO: 9077149 - DNA, 22 bp, Homo sapiens
tctaggaaataatgactcatcc

SEQ ID NO: 9077150 - DNA, 22 bp, Homo sapiens
tctaggaaagcctttcacaact

SEQ ID NO: 9077151 - DNA, 22 bp, Homo sapiens
tctaggaaagcctttcacaact

SEQ ID NO: 9077152 - DNA, 20 bp, Homo sapiens
tctagcttagtgcctgcctc

SEQ ID NO: 9077153 - DNA, 22 bp, Homo sapiens
tctagcttggcgtttgccttct

SEQ ID NO: 9077154 - DNA, 22 bp, Homo sapiens
tctaggaatttcatctagttct

SEQ ID NO: 9077155 - DNA, 22 bp, Homo sapiens
tctaggaatttcatctagttct

SEQ ID NO: 9077156 - DNA, 22 bp, Homo sapiens
tctaggaacctgacatctctca

SEQ ID NO: 9077157 - DNA, 22 bp, Homo sapiens
tctaggaacctgacatctctca

SEQ ID NO: 9077158 - DNA, 22 bp, Homo sapiens
tctagagacaaaggaaggaggg

SEQ ID NO: 9077159 - DNA, 22 bp, Homo sapiens
tctagagactataatgtgtcct

SEQ ID NO: 9077160 - DNA, 22 bp, Homo sapiens
tctagagaaaaaactcaagtga

SEQ ID NO: 9077161 - DNA, 19 bp, Homo sapiens
tctagcaacccactgcatg

SEQ ID NO: 9077162 - DNA, 22 bp, Homo sapiens
tctagatgaatgtgaggatatc

SEQ ID NO: 9077163 - DNA, 22 bp, Homo sapiens
tctactatgtttcttaaataga

SEQ ID NO: 9077164 - DNA, 17 bp, Homo sapiens
tctactcctgaaggaag

SEQ ID NO: 9077165 - DNA, 22 bp, Homo sapiens
tctacctatttcttctattggt

SEQ ID NO: 9077166 - DNA, 22 bp, Homo sapiens
tctacctggagtccgttgttaa

SEQ ID NO: 9077167 - DNA, 22 bp, Homo sapiens
tctaccgaaccccctgtggcct

SEQ ID NO: 9077168 - DNA, 22 bp, Homo sapiens
tctaccctgcggtcttggggca

SEQ ID NO: 9077169 - DNA, 22 bp, Homo sapiens
tctagaaaaacaaagtatctga

SEQ ID NO: 9077170 - DNA, 22 bp, Homo sapiens
tctagaaaaacaaagtatctga

SEQ ID NO: 9077171 - DNA, 22 bp, Homo sapiens
tctactttataagtatataagt

SEQ ID NO: 9077172 - DNA, 22 bp, Homo sapiens
tctacttttccctatacagttt

SEQ ID NO: 9077173 - DNA, 22 bp, Homo sapiens
tctactttcactcatacttatt

SEQ ID NO: 9077174 - DNA, 22 bp, Homo sapiens
tctagaaaaccaatattacatg

SEQ ID NO: 9077175 - DNA, 22 bp, Homo sapiens
tctagaaaaccaatattacatg

SEQ ID NO: 9077176 - DNA, 23 bp, Homo sapiens
tctagaaaatgaaagaatgcagt

SEQ ID NO: 9077177 - DNA, 22 bp, Homo sapiens
tctacagttttcttgggagttg

SEQ ID NO: 9077178 - DNA, 20 bp, Homo sapiens
tctacatgcctcttcccatc

SEQ ID NO: 9077179 - DNA, 22 bp, Homo sapiens
tctacaaagccattcaggatct

SEQ ID NO: 9077180 - DNA, 19 bp, Homo sapiens
tctacaaagtggcatcagg

SEQ ID NO: 9077181 - DNA, 22 bp, Homo sapiens
tctacaaataaattactatgta

SEQ ID NO: 9077182 - DNA, 22 bp, Homo sapiens
tctacaacgtggttttgttgta

SEQ ID NO: 9077183 - DNA, 22 bp, Homo sapiens
tctacaagttgtgacttgatac

SEQ ID NO: 9077184 - DNA, 22 bp, Homo sapiens
tctacagactcctatgtaacac

SEQ ID NO: 9077185 - DNA, 22 bp, Homo sapiens
tctacactgtagaattataagg

SEQ ID NO: 9077186 - DNA, 22 bp, Homo sapiens
tctaacatttatggccactgga

SEQ ID NO: 9077187 - DNA, 22 bp, Homo sapiens
tctaacattgaatggctgatta

SEQ ID NO: 9077188 - DNA, 22 bp, Homo sapiens
tctaacattgtttttcacagat

SEQ ID NO: 9077189 - DNA, 19 bp, Homo sapiens
tctaacagctttcattcta

SEQ ID NO: 9077190 - DNA, 22 bp, Homo sapiens
tctaacattgtttttcacagat

SEQ ID NO: 9077191 - DNA, 22 bp, Homo sapiens
tctaaagtatgctaatatgtga

SEQ ID NO: 9077192 - DNA, 22 bp, Homo sapiens
tctaaatggaaagaaaatacct

SEQ ID NO: 9077193 - DNA, 22 bp, Homo sapiens
tctaaatgtatcacatctggat

SEQ ID NO: 9077194 - DNA, 22 bp, Homo sapiens
tctaaatgtggtagtcataaga

SEQ ID NO: 9077195 - DNA, 22 bp, Homo sapiens
tctaaatgtggtagtcataaga

SEQ ID NO: 9077196 - DNA, 22 bp, Homo sapiens
tctaaatgtcagtacagaatga

SEQ ID NO: 9077197 - DNA, 21 bp, Homo sapiens
tctaaatgtccagcaatagaa

SEQ ID NO: 9077198 - DNA, 22 bp, Homo sapiens
tctaaattcagtttattttgat

SEQ ID NO: 9077199 - DNA, 22 bp, Homo sapiens
tctaaattcagtttattttgat

SEQ ID NO: 9077200 - DNA, 22 bp, Homo sapiens
tctaaattactttgggcagtat

SEQ ID NO: 9077201 - DNA, 22 bp, Homo sapiens
tctaaattctttcctgggttga

SEQ ID NO: 9077202 - DNA, 22 bp, Homo sapiens
tctaaattctttcctgggttga

SEQ ID NO: 9077203 - DNA, 22 bp, Homo sapiens
tctaaattactttgggcagtat

SEQ ID NO: 9077204 - DNA, 19 bp, Homo sapiens
tctaacagaagtgtcgtcc

SEQ ID NO: 9077205 - DNA, 22 bp, Homo sapiens
tctaacagaaattctgacaaaa

SEQ ID NO: 9077206 - DNA, 22 bp, Homo sapiens
tctacaaagaagaattaatgtc

SEQ ID NO: 9077207 - DNA, 22 bp, Homo sapiens
tctacaaagccattcaggatct

SEQ ID NO: 9077208 - DNA, 23 bp, Homo sapiens
tctacaaagctgtgtcaggaccc

SEQ ID NO: 9077209 - DNA, 22 bp, Homo sapiens
tctacaaagaagaattaatgtc

SEQ ID NO: 9077210 - DNA, 22 bp, Homo sapiens
tctacaaagccattcaggatct

SEQ ID NO: 9077211 - DNA, 22 bp, Homo sapiens
tctaagaaagattaagaaattt

SEQ ID NO: 9077212 - DNA, 22 bp, Homo sapiens
tctaagaaagattaagaaattt

SEQ ID NO: 9077213 - DNA, 22 bp, Homo sapiens
tctaacttgtgagtatagatga

SEQ ID NO: 9077214 - DNA, 22 bp, Homo sapiens
tctaattccattaaattgatgt

SEQ ID NO: 9077215 - DNA, 20 bp, Homo sapiens
tctaattaaaattgtctagt

SEQ ID NO: 9077216 - DNA, 22 bp, Homo sapiens
tctaagaaatcagatgatgagg

SEQ ID NO: 9077217 - DNA, 22 bp, Homo sapiens
tctaattttaggcatttgttca

SEQ ID NO: 9077218 - DNA, 22 bp, Homo sapiens
tctaaactagggttaaaggaaa

SEQ ID NO: 9077219 - DNA, 22 bp, Homo sapiens
tctaaacattgtgatagacctt

SEQ ID NO: 9077220 - DNA, 22 bp, Homo sapiens
tctaaagaaacattgagacctg

SEQ ID NO: 9077221 - DNA, 22 bp, Homo sapiens
tctaaagaagagggttctgcgg

SEQ ID NO: 9077222 - DNA, 22 bp, Homo sapiens
tctaaagacactttttacaggg

SEQ ID NO: 9077223 - DNA, 22 bp, Homo sapiens
tctaaacttcactttaagtgct

SEQ ID NO: 9077224 - DNA, 22 bp, Homo sapiens
tctaaagatttggattcatttg

SEQ ID NO: 9077225 - DNA, 22 bp, Homo sapiens
tctaaagatgtttattgacata

SEQ ID NO: 9077226 - DNA, 22 bp, Homo sapiens
tctaaagatttggattcatttg

SEQ ID NO: 9077227 - DNA, 22 bp, Homo sapiens
tctaaagatgtttattgacata

SEQ ID NO: 9077228 - DNA, 22 bp, Homo sapiens
tctaaagacactttttacaggg

SEQ ID NO: 9077229 - DNA, 22 bp, Homo sapiens
tctaaagagaaccttttctcat

SEQ ID NO: 9077230 - DNA, 22 bp, Homo sapiens
tctaaagagaaccttttctcat

SEQ ID NO: 9077231 - DNA, 22 bp, Homo sapiens
tctaaagagagtgggtacatgt

SEQ ID NO: 9077232 - DNA, 22 bp, Homo sapiens
tctaaacacgtctctttgaata

SEQ ID NO: 9077233 - DNA, 22 bp, Homo sapiens
tctaaacactaagtcttgatgc

SEQ ID NO: 9077234 - DNA, 22 bp, Homo sapiens
tctaaacataactttgtgtgat

SEQ ID NO: 9077235 - DNA, 22 bp, Homo sapiens
tctaaacattatgatagtagag

SEQ ID NO: 9077236 - DNA, 22 bp, Homo sapiens
tctaaaaaagtctgttcacttg

SEQ ID NO: 9077237 - DNA, 22 bp, Homo sapiens
tctaaaaaagtctgttcacttg

SEQ ID NO: 9077238 - DNA, 22 bp, Homo sapiens
tcgtctgtgaaattgggataag

SEQ ID NO: 9077239 - DNA, 22 bp, Homo sapiens
tcgcccaggctggaagtgcagt

SEQ ID NO: 9077240 - DNA, 17 bp, Homo sapiens
tcggtttgccaggcttc

SEQ ID NO: 9077241 - DNA, 22 bp, Homo sapiens
tcgcaccattgcactccagcca

SEQ ID NO: 9077242 - DNA, 22 bp, Homo sapiens
tcgcccaggctggaagtgcagt

SEQ ID NO: 9077243 - DNA, 22 bp, Homo sapiens
tcgcatttgggcaggagatgct

SEQ ID NO: 9077244 - DNA, 22 bp, Homo sapiens
tcgcaccattgcactccagcca

SEQ ID NO: 9077245 - DNA, 22 bp, Homo sapiens
tcgcaccattgcactccagcca

SEQ ID NO: 9077246 - DNA, 22 bp, Homo sapiens
tcgcaccattgcactccagcca

SEQ ID NO: 9077247 - DNA, 21 bp, Homo sapiens
tcgtgcagcagctgaggcttg

SEQ ID NO: 9077248 - DNA, 22 bp, Homo sapiens
tcgtgatctgtccacctcggcc

SEQ ID NO: 9077249 - DNA, 19 bp, Homo sapiens
tcgtggggaggtgggcagc

SEQ ID NO: 9077250 - DNA, 23 bp, Homo sapiens
tcgttgaatagcaatagcacaac

SEQ ID NO: 9077251 - DNA, 23 bp, Homo sapiens
tcgttgaatagcaatagcacaac

SEQ ID NO: 9077252 - DNA, 23 bp, Homo sapiens
tcgttgaatagcaatagcacaac

SEQ ID NO: 9077253 - DNA, 22 bp, Homo sapiens
tcctttccctttccatcctggc

SEQ ID NO: 9077254 - DNA, 22 bp, Homo sapiens
tcctttccatgcttctagaggc

SEQ ID NO: 9077255 - DNA, 22 bp, Homo sapiens
tccttggctttctggagcttct

SEQ ID NO: 9077256 - DNA, 22 bp, Homo sapiens
tccttgggaaatcactagcact

SEQ ID NO: 9077257 - DNA, 22 bp, Homo sapiens
tccttggctctttgataaatac

SEQ ID NO: 9077258 - DNA, 22 bp, Homo sapiens
tccttggcagcagggagcatga

SEQ ID NO: 9077259 - DNA, 22 bp, Homo sapiens
tccttgggaaacatcatgtaat

SEQ ID NO: 9077260 - DNA, 22 bp, Homo sapiens
tccttggcctgggtggggtctc

SEQ ID NO: 9077261 - DNA, 22 bp, Homo sapiens
tccttggcctaaggagaagagg

SEQ ID NO: 9077262 - DNA, 22 bp, Homo sapiens
tccttggcatgccgtcttctcc

SEQ ID NO: 9077263 - DNA, 22 bp, Homo sapiens
tccttggctagtactggccagc

SEQ ID NO: 9077264 - DNA, 22 bp, Homo sapiens
tcctttgtggaaatacttgtgg

SEQ ID NO: 9077265 - DNA, 23 bp, Homo sapiens
tcctttgtctttgcatagatggt

SEQ ID NO: 9077266 - DNA, 22 bp, Homo sapiens
tcctttggttgtagacaggaat

SEQ ID NO: 9077267 - DNA, 22 bp, Homo sapiens
tcctttgttgtacaattatttt

SEQ ID NO: 9077268 - DNA, 22 bp, Homo sapiens
tcctttgttcgggtgtgctgtc

SEQ ID NO: 9077269 - DNA, 22 bp, Homo sapiens
tcctttgcttctgtcattctcc

SEQ ID NO: 9077270 - DNA, 22 bp, Homo sapiens
tcctttggtagttttcttaaag

SEQ ID NO: 9077271 - DNA, 22 bp, Homo sapiens
tcctttggttgtagacaggaat

SEQ ID NO: 9077272 - DNA, 22 bp, Homo sapiens
tcctttggttctctaagatgct

SEQ ID NO: 9077273 - DNA, 22 bp, Homo sapiens
tcctttggcaagctctgctctt

SEQ ID NO: 9077274 - DNA, 20 bp, Homo sapiens
tcctttggccttagagctgt

SEQ ID NO: 9077275 - DNA, 22 bp, Homo sapiens
tcctttggagcttgactggtag

SEQ ID NO: 9077276 - DNA, 22 bp, Homo sapiens
tcctttggaactgactccgtta

SEQ ID NO: 9077277 - DNA, 22 bp, Homo sapiens
tcctttggacacattttttata

SEQ ID NO: 9077278 - DNA, 22 bp, Homo sapiens
tcctttggaactgactccgtta

SEQ ID NO: 9077279 - DNA, 22 bp, Homo sapiens
tcctttggacacattttttata

SEQ ID NO: 9077280 - DNA, 22 bp, Homo sapiens
tcctttggaactgactccgtta

SEQ ID NO: 9077281 - DNA, 22 bp, Homo sapiens
tcgaaataatttagaatataga

SEQ ID NO: 9077282 - DNA, 22 bp, Homo sapiens
tcgaactcatagtcgtagctgt

SEQ ID NO: 9077283 - DNA, 22 bp, Homo sapiens
tcctttttaagtcgttgtggta

SEQ ID NO: 9077284 - DNA, 22 bp, Homo sapiens
tcctttttatagttagagaaac

SEQ ID NO: 9077285 - DNA, 22 bp, Homo sapiens
tcctttttggtccaaggtgacc

SEQ ID NO: 9077286 - DNA, 22 bp, Homo sapiens
tcgaggcagtgcgctggctgtt

SEQ ID NO: 9077287 - DNA, 22 bp, Homo sapiens
tcgcaccattgcactccagcca

SEQ ID NO: 9077288 - DNA, 22 bp, Homo sapiens
tccttgagaggacagagccata

SEQ ID NO: 9077289 - DNA, 22 bp, Homo sapiens
tccttgagccgtggccagggcc

SEQ ID NO: 9077290 - DNA, 22 bp, Homo sapiens
tccttctttgacaagtggcaga

SEQ ID NO: 9077291 - DNA, 22 bp, Homo sapiens
tccttctttcacctcatagtca

SEQ ID NO: 9077292 - DNA, 22 bp, Homo sapiens
tccttctttccccctagtcatt

SEQ ID NO: 9077293 - DNA, 22 bp, Homo sapiens
tccttcttcatgaagatatatg

SEQ ID NO: 9077294 - DNA, 22 bp, Homo sapiens
tccttggagctctccaagggat

SEQ ID NO: 9077295 - DNA, 22 bp, Homo sapiens
tccttggcaagctgcaatggga

SEQ ID NO: 9077296 - DNA, 22 bp, Homo sapiens
tccttggcacactcggatctga

SEQ ID NO: 9077297 - DNA, 17 bp, Homo sapiens
tccttggcaaccagttc

SEQ ID NO: 9077298 - DNA, 22 bp, Homo sapiens
tccttggcaagacacagcacag

SEQ ID NO: 9077299 - DNA, 21 bp, Homo sapiens
tccttgctattttcctcagct

SEQ ID NO: 9077300 - DNA, 21 bp, Homo sapiens
tccttgctattttcctcagct

SEQ ID NO: 9077301 - DNA, 21 bp, Homo sapiens
tccttgctattttcctcagct

SEQ ID NO: 9077302 - DNA, 23 bp, Homo sapiens
tccttgagtgtcccccaagagtc

SEQ ID NO: 9077303 - DNA, 22 bp, Homo sapiens
tccttcctggggtctctgctgc

SEQ ID NO: 9077304 - DNA, 23 bp, Homo sapiens
tccttcctttgagaggctccatc

SEQ ID NO: 9077305 - DNA, 23 bp, Homo sapiens
tccttcctttgagaggctccatc

SEQ ID NO: 9077306 - DNA, 22 bp, Homo sapiens
tccttcctgctctaacattcag

SEQ ID NO: 9077307 - DNA, 19 bp, Homo sapiens
tccttcagtcagatctggg

SEQ ID NO: 9077308 - DNA, 22 bp, Homo sapiens
tccttcagggggccgcctgcac

SEQ ID NO: 9077309 - DNA, 19 bp, Homo sapiens
tccttctccggccaccccg

SEQ ID NO: 9077310 - DNA, 22 bp, Homo sapiens
tccttagacaaagagtgggctt

SEQ ID NO: 9077311 - DNA, 22 bp, Homo sapiens
tccttagacaaagagtgggctt

SEQ ID NO: 9077312 - DNA, 22 bp, Homo sapiens
tccttaaatgtgatctagattt

SEQ ID NO: 9077313 - DNA, 21 bp, Homo sapiens
tccttatatttgaatacttta

SEQ ID NO: 9077314 - DNA, 22 bp, Homo sapiens
tccttcaagtgcagtacctgag

SEQ ID NO: 9077315 - DNA, 17 bp, Homo sapiens
tccttcagggcctcaca

SEQ ID NO: 9077316 - DNA, 22 bp, Homo sapiens
tccttcagggggccgcctgcac

SEQ ID NO: 9077317 - DNA, 22 bp, Homo sapiens
tccttcaggcctcattctcata

SEQ ID NO: 9077318 - DNA, 22 bp, Homo sapiens
tccttcagctctctatttagat

SEQ ID NO: 9077319 - DNA, 22 bp, Homo sapiens
tccttcagcttatttcttagga

SEQ ID NO: 9077320 - DNA, 22 bp, Homo sapiens
tccttcagcttgttagagtgac

SEQ ID NO: 9077321 - DNA, 22 bp, Homo sapiens
tccttcagccatgggctctcca

SEQ ID NO: 9077322 - DNA, 22 bp, Homo sapiens
tccttcagctactcagtttcca

SEQ ID NO: 9077323 - DNA, 22 bp, Homo sapiens
tccttcagccatgggctctcca

SEQ ID NO: 9077324 - DNA, 22 bp, Homo sapiens
tccttcagattcctgcttctgg

SEQ ID NO: 9077325 - DNA, 22 bp, Homo sapiens
tccttcagaggacggcagccag

SEQ ID NO: 9077326 - DNA, 22 bp, Homo sapiens
tccttcagaggataaggaagaa

SEQ ID NO: 9077327 - DNA, 20 bp, Homo sapiens
tccttcagacgacaagcaag

SEQ ID NO: 9077328 - DNA, 23 bp, Homo sapiens
tccttcaagttaggaagtgaaca

SEQ ID NO: 9077329 - DNA, 18 bp, Homo sapiens
tccttcacagcaggaagg

SEQ ID NO: 9077330 - DNA, 22 bp, Homo sapiens
tccttcaatcacccagtgggga

SEQ ID NO: 9077331 - DNA, 22 bp, Homo sapiens
tccttcaccttagccctcctag

SEQ ID NO: 9077332 - DNA, 22 bp, Homo sapiens
tccttcactccctctgcatcca

SEQ ID NO: 9077333 - DNA, 22 bp, Homo sapiens
tccttcacctcaagcttttgaa

SEQ ID NO: 9077334 - DNA, 19 bp, Homo sapiens
tccttcacttcttaccagg

SEQ ID NO: 9077335 - DNA, 22 bp, Homo sapiens
tccttcagaaaacctcagtctt

SEQ ID NO: 9077336 - DNA, 22 bp, Homo sapiens
tccttcagaacctgtgatggaa

SEQ ID NO: 9077337 - DNA, 22 bp, Homo sapiens
tcttggaatctccatagagtga

SEQ ID NO: 9077338 - DNA, 22 bp, Homo sapiens
tcttggaagtagaacacagtct

SEQ ID NO: 9077339 - DNA, 22 bp, Homo sapiens
tcttggaagcctcaagatactc

SEQ ID NO: 9077340 - DNA, 20 bp, Homo sapiens
tcttggagagggtggactta

SEQ ID NO: 9077341 - DNA, 22 bp, Homo sapiens
tcttggattttaatggatcaaa

SEQ ID NO: 9077342 - DNA, 22 bp, Homo sapiens
tcttggctagtaccttcctgcc

SEQ ID NO: 9077343 - DNA, 22 bp, Homo sapiens
tcttggctacttaggaggattc

SEQ ID NO: 9077344 - DNA, 22 bp, Homo sapiens
tcttgacattcaatcatgtata

SEQ ID NO: 9077345 - DNA, 22 bp, Homo sapiens
tcttgaattgtactcccataag

SEQ ID NO: 9077346 - DNA, 22 bp, Homo sapiens
tcttgctaaagaccaacacatt

SEQ ID NO: 9077347 - DNA, 22 bp, Homo sapiens
tcttgctagaatcatttggaga

SEQ ID NO: 9077348 - DNA, 22 bp, Homo sapiens
tcttgctaggagctatggaaga

SEQ ID NO: 9077349 - DNA, 22 bp, Homo sapiens
tcttgcttctgctcaaggggag

SEQ ID NO: 9077350 - DNA, 19 bp, Homo sapiens
tcttgatgaggtttctcca

SEQ ID NO: 9077351 - DNA, 22 bp, Homo sapiens
tcttgatgctttttctaaatgt

SEQ ID NO: 9077352 - DNA, 19 bp, Homo sapiens
tcttgatgaggtttctcca

SEQ ID NO: 9077353 - DNA, 22 bp, Homo sapiens
tcttgagggatcttcagtgtgt

SEQ ID NO: 9077354 - DNA, 22 bp, Homo sapiens
tcttgagtgcgcttgggtgttc

SEQ ID NO: 9077355 - DNA, 22 bp, Homo sapiens
tctttaattgtggaagagcagc

SEQ ID NO: 9077356 - DNA, 22 bp, Homo sapiens
tctttacaatctaagcatagtt

SEQ ID NO: 9077357 - DNA, 22 bp, Homo sapiens
tctttaatatctgccccagagc

SEQ ID NO: 9077358 - DNA, 22 bp, Homo sapiens
tctttaatgtactttctttcac

SEQ ID NO: 9077359 - DNA, 22 bp, Homo sapiens
tctttaatcataaccaagatgg

SEQ ID NO: 9077360 - DNA, 21 bp, Homo sapiens
tcttggggaggagggctgcac

SEQ ID NO: 9077361 - DNA, 22 bp, Homo sapiens
tctttacacaagacaagaataa

SEQ ID NO: 9077362 - DNA, 22 bp, Homo sapiens
tctttacagtcctctgtcaatc

SEQ ID NO: 9077363 - DNA, 23 bp, Homo sapiens
tctttacagcagcaggatttgga

SEQ ID NO: 9077364 - DNA, 22 bp, Homo sapiens
tctttacagtcctctgtcaatc

SEQ ID NO: 9077365 - DNA, 22 bp, Homo sapiens
tctttacatagtgtggactact

SEQ ID NO: 9077366 - DNA, 22 bp, Homo sapiens
tctttactggaatggaactttc

SEQ ID NO: 9077367 - DNA, 22 bp, Homo sapiens
tcttgggattgccctgcagttc

SEQ ID NO: 9077368 - DNA, 22 bp, Homo sapiens
tcttgggcaatttctctagagg

SEQ ID NO: 9077369 - DNA, 22 bp, Homo sapiens
tcttgggattgccctgcagttc

SEQ ID NO: 9077370 - DNA, 22 bp, Homo sapiens
tcttgggcatgtgtttgatttc

SEQ ID NO: 9077371 - DNA, 22 bp, Homo sapiens
tcttgggagtcccaggacatag

SEQ ID NO: 9077372 - DNA, 22 bp, Homo sapiens
tcttgggaagcccatttccacc

SEQ ID NO: 9077373 - DNA, 22 bp, Homo sapiens
tcttggctggtcatttaaaatc

SEQ ID NO: 9077374 - DNA, 20 bp, Homo sapiens
tcttggctgtgtgaggacac

SEQ ID NO: 9077375 - DNA, 22 bp, Homo sapiens
tcttggctgcagagccggcaag

SEQ ID NO: 9077376 - DNA, 22 bp, Homo sapiens
tcttggctactttcctgtctgc

SEQ ID NO: 9077377 - DNA, 22 bp, Homo sapiens
tcttggctcctcacagcatcag

SEQ ID NO: 9077378 - DNA, 22 bp, Homo sapiens
tcttggctcctcacagcatcag

SEQ ID NO: 9077379 - DNA, 22 bp, Homo sapiens
tctttctctctaatcaagcaca

SEQ ID NO: 9077380 - DNA, 22 bp, Homo sapiens
tctttgaacttggctgatctct

SEQ ID NO: 9077381 - DNA, 22 bp, Homo sapiens
tctttgaacttggctgatctct

SEQ ID NO: 9077382 - DNA, 21 bp, Homo sapiens
tctttgagaataggtttttca

SEQ ID NO: 9077383 - DNA, 22 bp, Homo sapiens
tctttgaattcaaactgttcaa

SEQ ID NO: 9077384 - DNA, 22 bp, Homo sapiens
tctttgaatttctgactgtctt

SEQ ID NO: 9077385 - DNA, 22 bp, Homo sapiens
tctttgaatttctgactgtctt

SEQ ID NO: 9077386 - DNA, 22 bp, Homo sapiens
tctttgaagttcccctggaaga

SEQ ID NO: 9077387 - DNA, 22 bp, Homo sapiens
tctttgaatacaggaagcatga

SEQ ID NO: 9077388 - DNA, 22 bp, Homo sapiens
tctttcctactttattgtgaac

SEQ ID NO: 9077389 - DNA, 22 bp, Homo sapiens
tctttcctaggtgatatgcaat

SEQ ID NO: 9077390 - DNA, 23 bp, Homo sapiens
tctttcctcagcacacaccaaga

SEQ ID NO: 9077391 - DNA, 22 bp, Homo sapiens
tctttcctaggtgatatgcaat

SEQ ID NO: 9077392 - DNA, 22 bp, Homo sapiens
tctttcctaggtgatatgcaat

SEQ ID NO: 9077393 - DNA, 22 bp, Homo sapiens
tctttcctctgagctcctgtag

SEQ ID NO: 9077394 - DNA, 17 bp, Homo sapiens
tctttcctgccatgctc

SEQ ID NO: 9077395 - DNA, 22 bp, Homo sapiens
tctttatgtttgaaagtacaat

SEQ ID NO: 9077396 - DNA, 22 bp, Homo sapiens
tctttatgagaaaaagattgta

SEQ ID NO: 9077397 - DNA, 22 bp, Homo sapiens
tctttatgcacataaagaaact

SEQ ID NO: 9077398 - DNA, 22 bp, Homo sapiens
tctttataaaagtcattatgtc

SEQ ID NO: 9077399 - DNA, 19 bp, Homo sapiens
tctttagccagagctctgg

SEQ ID NO: 9077400 - DNA, 20 bp, Homo sapiens
tctttagatttatcttatgt

SEQ ID NO: 9077401 - DNA, 22 bp, Homo sapiens
tctttcatgtatatgcaaccta

SEQ ID NO: 9077402 - DNA, 22 bp, Homo sapiens
tctttcagctcttcaggaccca

SEQ ID NO: 9077403 - DNA, 22 bp, Homo sapiens
tctttcaatgtgaaaccatgta

SEQ ID NO: 9077404 - DNA, 22 bp, Homo sapiens
tctttattgctactggtttgtc

SEQ ID NO: 9077405 - DNA, 22 bp, Homo sapiens
tctttccatggccacacagtct

SEQ ID NO: 9077406 - DNA, 22 bp, Homo sapiens
tctttccagaggaatttttaga

SEQ ID NO: 9077407 - DNA, 22 bp, Homo sapiens
tcttcacaccgggcagcaggaa

SEQ ID NO: 9077408 - DNA, 22 bp, Homo sapiens
tcttcacaccgggcagcaggaa

SEQ ID NO: 9077409 - DNA, 22 bp, Homo sapiens
tcttcacaaagctgttgttaaa

SEQ ID NO: 9077410 - DNA, 22 bp, Homo sapiens
tcttcaaatacagtcatattga

SEQ ID NO: 9077411 - DNA, 22 bp, Homo sapiens
tcttcacagctttgtccagaag

SEQ ID NO: 9077412 - DNA, 23 bp, Homo sapiens
tcttcacagggcttcccatgtgc

SEQ ID NO: 9077413 - DNA, 22 bp, Homo sapiens
tcttcacatcatgttttttaat

SEQ ID NO: 9077414 - DNA, 22 bp, Homo sapiens
tcttcacagtcctggtcagtgg

SEQ ID NO: 9077415 - DNA, 22 bp, Homo sapiens
tcttcagattgcactgagcaag

SEQ ID NO: 9077416 - DNA, 22 bp, Homo sapiens
tcttcagattgcactgagcaag

SEQ ID NO: 9077417 - DNA, 22 bp, Homo sapiens
tcttcacatggaacatgaagct

SEQ ID NO: 9077418 - DNA, 22 bp, Homo sapiens
tcttattattgttgtaaaagca

SEQ ID NO: 9077419 - DNA, 22 bp, Homo sapiens
tcttatgggaaagatgtaatta

SEQ ID NO: 9077420 - DNA, 22 bp, Homo sapiens
tcttcaaaaactgcaccttgct

SEQ ID NO: 9077421 - DNA, 22 bp, Homo sapiens
tcttcaaaccctggctcttcct

SEQ ID NO: 9077422 - DNA, 22 bp, Homo sapiens
tcttcaaaccctggttttgtga

SEQ ID NO: 9077423 - DNA, 22 bp, Homo sapiens
tcttcaaaaatacaggttttca

SEQ ID NO: 9077424 - DNA, 22 bp, Homo sapiens
tcttcaaaaatacaggttttca

SEQ ID NO: 9077425 - DNA, 22 bp, Homo sapiens
tcttcaaactgaaaatttagaa

SEQ ID NO: 9077426 - DNA, 22 bp, Homo sapiens
tcttcaaagaagccttggatta

SEQ ID NO: 9077427 - DNA, 22 bp, Homo sapiens
tcttcaaagcatatgcaggcat

SEQ ID NO: 9077428 - DNA, 22 bp, Homo sapiens
tcttcatacaatttcagacatc

SEQ ID NO: 9077429 - DNA, 18 bp, Homo sapiens
tcttcatctcctgagctg

SEQ ID NO: 9077430 - DNA, 22 bp, Homo sapiens
tcttcatctcagattaacagga

SEQ ID NO: 9077431 - DNA, 22 bp, Homo sapiens
tcttcatgccaaatgagttttg

SEQ ID NO: 9077432 - DNA, 22 bp, Homo sapiens
tcttcatggtctggttctccag

SEQ ID NO: 9077433 - DNA, 23 bp, Homo sapiens
tcttcatgcccaggccttggtgc

SEQ ID NO: 9077434 - DNA, 22 bp, Homo sapiens
tcttcatgttgcttattctggg

SEQ ID NO: 9077435 - DNA, 22 bp, Homo sapiens
tcttcagctctgaggctctggc

SEQ ID NO: 9077436 - DNA, 22 bp, Homo sapiens
tcttcaggaagggaaatcatcc

SEQ ID NO: 9077437 - DNA, 22 bp, Homo sapiens
tcttcaggagctgaaagcctgc

SEQ ID NO: 9077438 - DNA, 22 bp, Homo sapiens
tcttcaggaagggaaatcatcc

SEQ ID NO: 9077439 - DNA, 22 bp, Homo sapiens
tcttcagtgcatgttacctata

SEQ ID NO: 9077440 - DNA, 22 bp, Homo sapiens
tcttccagagcctccatcccta

SEQ ID NO: 9077441 - DNA, 22 bp, Homo sapiens
tcttccagcaatgtgaaatcac

SEQ ID NO: 9077442 - DNA, 22 bp, Homo sapiens
tcttccagcccttctaatggta

SEQ ID NO: 9077443 - DNA, 22 bp, Homo sapiens
tcttccagccaatagcgtcctt

SEQ ID NO: 9077444 - DNA, 22 bp, Homo sapiens
tcttccagctccccacggtgtc

SEQ ID NO: 9077445 - DNA, 22 bp, Homo sapiens
tcttcctcttctgctgagaagt

SEQ ID NO: 9077446 - DNA, 22 bp, Homo sapiens
tcttcctcttctgctgagaagt

SEQ ID NO: 9077447 - DNA, 22 bp, Homo sapiens
tcttcctctctaattgatcaga

SEQ ID NO: 9077448 - DNA, 22 bp, Homo sapiens
tcttcctccctacagagctcag

SEQ ID NO: 9077449 - DNA, 22 bp, Homo sapiens
tcttcctctagatctgaggccc

SEQ ID NO: 9077450 - DNA, 22 bp, Homo sapiens
tcttcctgaaaccctgttccag

SEQ ID NO: 9077451 - DNA, 23 bp, Homo sapiens
tcttcctgaactatcaggcacat

SEQ ID NO: 9077452 - DNA, 22 bp, Homo sapiens
tcttcctccctacagagctcag

SEQ ID NO: 9077453 - DNA, 22 bp, Homo sapiens
tcttccttgctccttgtcactt

SEQ ID NO: 9077454 - DNA, 22 bp, Homo sapiens
tcttccttgccttgcttcatca

SEQ ID NO: 9077455 - DNA, 22 bp, Homo sapiens
tcttccttgccttgcttcatca

SEQ ID NO: 9077456 - DNA, 22 bp, Homo sapiens
tcttcctttcattcatgtgtta

SEQ ID NO: 9077457 - DNA, 22 bp, Homo sapiens
tcttccttgtaagggctttaga

SEQ ID NO: 9077458 - DNA, 22 bp, Homo sapiens
tcttctaatggttcagatatat

SEQ ID NO: 9077459 - DNA, 22 bp, Homo sapiens
tcttctaatggttcagatatat

SEQ ID NO: 9077460 - DNA, 22 bp, Homo sapiens
tcttctagtaggccaagaagct

SEQ ID NO: 9077461 - DNA, 22 bp, Homo sapiens
tcttcctgtcaatgagaattaa

SEQ ID NO: 9077462 - DNA, 22 bp, Homo sapiens
tcttccttcgcccttgctgttt

SEQ ID NO: 9077463 - DNA, 22 bp, Homo sapiens
tcttccttctttgatgacaagg

SEQ ID NO: 9077464 - DNA, 22 bp, Homo sapiens
tcttcctgcttggtgtgtctgg

SEQ ID NO: 9077465 - DNA, 22 bp, Homo sapiens
tcttcctgcttggtgtgtctgg

SEQ ID NO: 9077466 - DNA, 21 bp, Homo sapiens
tcttcctgctccacactcccc

SEQ ID NO: 9077467 - DNA, 22 bp, Homo sapiens
tcttcctgctttggtgaggctt

SEQ ID NO: 9077468 - DNA, 22 bp, Homo sapiens
tcttcctggcattgatgctgca

SEQ ID NO: 9077469 - DNA, 22 bp, Homo sapiens
tcttcctggcattgatgctgca

SEQ ID NO: 9077470 - DNA, 22 bp, Homo sapiens
tcttctccataatcaacactct

SEQ ID NO: 9077471 - DNA, 22 bp, Homo sapiens
tcttctcagtttctctaggatg

SEQ ID NO: 9077472 - DNA, 22 bp, Homo sapiens
tcttctgtgagaattcaagcaa

SEQ ID NO: 9077473 - DNA, 22 bp, Homo sapiens
tcttctctcatgtaggagggaa

SEQ ID NO: 9077474 - DNA, 22 bp, Homo sapiens
tcttctggatgagagcggaggc

SEQ ID NO: 9077475 - DNA, 21 bp, Homo sapiens
tcttgaaaagttagattctct

SEQ ID NO: 9077476 - DNA, 23 bp, Homo sapiens
tcttgaaaagcctacagcagttc

SEQ ID NO: 9077477 - DNA, 22 bp, Homo sapiens
tcttctttttgtcccacagaat

SEQ ID NO: 9077478 - DNA, 22 bp, Homo sapiens
tcttcttttatttcaagggtgt

SEQ ID NO: 9077479 - DNA, 22 bp, Homo sapiens
tcttcttttatttcaagggtgt

SEQ ID NO: 9077480 - DNA, 22 bp, Homo sapiens
tcttctttggatgaaagaatat

SEQ ID NO: 9077481 - DNA, 22 bp, Homo sapiens
tcttctttggatgaaagaatat

SEQ ID NO: 9077482 - DNA, 22 bp, Homo sapiens
tcttctttggatgaaagaatat

SEQ ID NO: 9077483 - DNA, 22 bp, Homo sapiens
tcttctttgaatcatagtgacc

SEQ ID NO: 9077484 - DNA, 22 bp, Homo sapiens
tcttcttcctcatttatacata

SEQ ID NO: 9077485 - DNA, 22 bp, Homo sapiens
tcttcttcctccacagggccca

SEQ ID NO: 9077486 - DNA, 22 bp, Homo sapiens
tcttcttcctccacagggccca

SEQ ID NO: 9077487 - DNA, 22 bp, Homo sapiens
tcttcttatgtgccattatctc

SEQ ID NO: 9077488 - DNA, 22 bp, Homo sapiens
tcttcttaaagtatgttctctt

SEQ ID NO: 9077489 - DNA, 22 bp, Homo sapiens
tcttctgttaccacagcgatga

SEQ ID NO: 9077490 - DNA, 22 bp, Homo sapiens
tctgtctttgtcaggaccagag

SEQ ID NO: 9077491 - DNA, 22 bp, Homo sapiens
tctgtctttgtcaggaccagag

SEQ ID NO: 9077492 - DNA, 22 bp, Homo sapiens
tctgtctttgagatctcagcct

SEQ ID NO: 9077493 - DNA, 22 bp, Homo sapiens
tctgtctgcctgtgtccccacc

SEQ ID NO: 9077494 - DNA, 22 bp, Homo sapiens
tctgtctgccttgtgagggcac

SEQ ID NO: 9077495 - DNA, 22 bp, Homo sapiens
tctgtctgcacctaagcacagt

SEQ ID NO: 9077496 - DNA, 22 bp, Homo sapiens
tctgtctgactaccatgaggca

SEQ ID NO: 9077497 - DNA, 22 bp, Homo sapiens
tctgtctgaggagtttttgacc

SEQ ID NO: 9077498 - DNA, 22 bp, Homo sapiens
tctgtctgagtggtgttagagt

SEQ ID NO: 9077499 - DNA, 22 bp, Homo sapiens
tctgtctgcacctaagcacagt

SEQ ID NO: 9077500 - DNA, 17 bp, Homo sapiens
tctgtgatagtgtagat

SEQ ID NO: 9077501 - DNA, 22 bp, Homo sapiens
tctgtgaaaggaaagaactgac

SEQ ID NO: 9077502 - DNA, 22 bp, Homo sapiens
tctgtgaagctctgaacagcag

SEQ ID NO: 9077503 - DNA, 22 bp, Homo sapiens
tctgtgaatgtgaccttatttg

SEQ ID NO: 9077504 - DNA, 23 bp, Homo sapiens
tctgtgccagtttccatgtctgt

SEQ ID NO: 9077505 - DNA, 23 bp, Homo sapiens
tctgtgccagtttccatgtctgt

SEQ ID NO: 9077506 - DNA, 22 bp, Homo sapiens
tctgtgcctttaagaagctcat

SEQ ID NO: 9077507 - DNA, 22 bp, Homo sapiens
tctgtgccaagcttatatctgt

SEQ ID NO: 9077508 - DNA, 22 bp, Homo sapiens
tctgtgcagggaccccaagagt

SEQ ID NO: 9077509 - DNA, 22 bp, Homo sapiens
tctgtgcagaatcaaggagctt

SEQ ID NO: 9077510 - DNA, 22 bp, Homo sapiens
tctgtgcactaacattcctggt

SEQ ID NO: 9077511 - DNA, 22 bp, Homo sapiens
tctgtgcaggatttgaggaacc

SEQ ID NO: 9077512 - DNA, 22 bp, Homo sapiens
tctgtgctgtctcagagaaagc

SEQ ID NO: 9077513 - DNA, 18 bp, Homo sapiens
tctgtggagagggcagtt

SEQ ID NO: 9077514 - DNA, 22 bp, Homo sapiens
tctgtggagtgacctgggcttt

SEQ ID NO: 9077515 - DNA, 22 bp, Homo sapiens
tctgtggagttgaggaaggttg

SEQ ID NO: 9077516 - DNA, 22 bp, Homo sapiens
tctgtgctaggcagcctggccc

SEQ ID NO: 9077517 - DNA, 22 bp, Homo sapiens
tctgtgctaggcagcctggccc

SEQ ID NO: 9077518 - DNA, 22 bp, Homo sapiens
tctgtgctagaggagttggcca

SEQ ID NO: 9077519 - DNA, 19 bp, Homo sapiens
tctgtgctgggaggcagca

SEQ ID NO: 9077520 - DNA, 21 bp, Homo sapiens
tctgtgctgccgtcaacatcc

SEQ ID NO: 9077521 - DNA, 22 bp, Homo sapiens
tctgtgtcagaagatatcatgg

SEQ ID NO: 9077522 - DNA, 23 bp, Homo sapiens
tctgtgtcctcctggaccacaga

SEQ ID NO: 9077523 - DNA, 22 bp, Homo sapiens
tctgtgtcctgctagctgtctt

SEQ ID NO: 9077524 - DNA, 22 bp, Homo sapiens
tctgtgtcctgctagctgtctt

SEQ ID NO: 9077525 - DNA, 22 bp, Homo sapiens
tctgtgtcctgctagctgtctt

SEQ ID NO: 9077526 - DNA, 22 bp, Homo sapiens
tctgtgtcgttctgtgctctgg

SEQ ID NO: 9077527 - DNA, 23 bp, Homo sapiens
tctgtgtctccacccaaatctca

SEQ ID NO: 9077528 - DNA, 22 bp, Homo sapiens
tctgtgtctgttacttcactgc

SEQ ID NO: 9077529 - DNA, 22 bp, Homo sapiens
tctgtgtctgcagaagttcagc

SEQ ID NO: 9077530 - DNA, 22 bp, Homo sapiens
tctgtgtctggttgggccagta

SEQ ID NO: 9077531 - DNA, 22 bp, Homo sapiens
tctgtggcttcctatttcttgg

SEQ ID NO: 9077532 - DNA, 22 bp, Homo sapiens
tctgtgggcatttataatctgg

SEQ ID NO: 9077533 - DNA, 18 bp, Homo sapiens
tctgtgggatcagtgagg

SEQ ID NO: 9077534 - DNA, 22 bp, Homo sapiens
tctgtggggagcaggagccggg

SEQ ID NO: 9077535 - DNA, 22 bp, Homo sapiens
tctgtgggggtgtcttaaccta

SEQ ID NO: 9077536 - DNA, 22 bp, Homo sapiens
tctgtgggttttgcagagttgc

SEQ ID NO: 9077537 - DNA, 22 bp, Homo sapiens
tctgtgggtttcagggggctgt

SEQ ID NO: 9077538 - DNA, 22 bp, Homo sapiens
tctgtgggtgcctccagcagtg

SEQ ID NO: 9077539 - DNA, 22 bp, Homo sapiens
tctgtgggtagagtgagtactt

SEQ ID NO: 9077540 - DNA, 22 bp, Homo sapiens
tcttataagcaaactgctgaga

SEQ ID NO: 9077541 - DNA, 22 bp, Homo sapiens
tcttataaaaggactcccattt

SEQ ID NO: 9077542 - DNA, 22 bp, Homo sapiens
tcttagcatttgttaataccca

SEQ ID NO: 9077543 - DNA, 22 bp, Homo sapiens
tcttagcatttcataacaactg

SEQ ID NO: 9077544 - DNA, 22 bp, Homo sapiens
tcttagcaaatactacttagaa

SEQ ID NO: 9077545 - DNA, 22 bp, Homo sapiens
tcttagcaaattttctttgcct

SEQ ID NO: 9077546 - DNA, 22 bp, Homo sapiens
tcttagcaaattttctttgcct

SEQ ID NO: 9077547 - DNA, 22 bp, Homo sapiens
tcttagcagtgctgagaagaat

SEQ ID NO: 9077548 - DNA, 20 bp, Homo sapiens
tcttagcatcacttgcttaa

SEQ ID NO: 9077549 - DNA, 22 bp, Homo sapiens
tcttagcacagctatataagtt

SEQ ID NO: 9077550 - DNA, 22 bp, Homo sapiens
tcttagcagacttggctactgt

SEQ ID NO: 9077551 - DNA, 22 bp, Homo sapiens
tcttatcttatacctaacagcc

SEQ ID NO: 9077552 - DNA, 22 bp, Homo sapiens
tcttatagctcaaaggaagagt

SEQ ID NO: 9077553 - DNA, 21 bp, Homo sapiens
tcttatacagcaatagatctg

SEQ ID NO: 9077554 - DNA, 22 bp, Homo sapiens
tcttatacagaagatgtttaat

SEQ ID NO: 9077555 - DNA, 20 bp, Homo sapiens
tcttatacagaaaacatttt

SEQ ID NO: 9077556 - DNA, 22 bp, Homo sapiens
tcttataatgttgaagggttgg

SEQ ID NO: 9077557 - DNA, 22 bp, Homo sapiens
tcttataatctctattttaatg

SEQ ID NO: 9077558 - DNA, 22 bp, Homo sapiens
tcttaacaagctcctcagtgct

SEQ ID NO: 9077559 - DNA, 22 bp, Homo sapiens
tcttaagtacctcctttatcac

SEQ ID NO: 9077560 - DNA, 22 bp, Homo sapiens
tcttaagccactgagaaaataa

SEQ ID NO: 9077561 - DNA, 22 bp, Homo sapiens
tcttaagaaagtgacaaatagg

SEQ ID NO: 9077562 - DNA, 22 bp, Homo sapiens
tcttaagcagagaagaagttga

SEQ ID NO: 9077563 - DNA, 22 bp, Homo sapiens
tctgtttttgaggctatcttct

SEQ ID NO: 9077564 - DNA, 22 bp, Homo sapiens
tctgttttgtaccagatacagc

SEQ ID NO: 9077565 - DNA, 22 bp, Homo sapiens
tctgttttgtaccagatacagc

SEQ ID NO: 9077566 - DNA, 22 bp, Homo sapiens
tctgttttgtaccagatacagc

SEQ ID NO: 9077567 - DNA, 22 bp, Homo sapiens
tctgttttggtcacctttatat

SEQ ID NO: 9077568 - DNA, 22 bp, Homo sapiens
tctgttttagataagaaaggct

SEQ ID NO: 9077569 - DNA, 22 bp, Homo sapiens
tctgttttctctgtattttgac

SEQ ID NO: 9077570 - DNA, 22 bp, Homo sapiens
tctgttttgcataatgttcttt

SEQ ID NO: 9077571 - DNA, 22 bp, Homo sapiens
tctgttttctctgtattttgac

SEQ ID NO: 9077572 - DNA, 22 bp, Homo sapiens
tctgtttcacgtcctgaatctc

SEQ ID NO: 9077573 - DNA, 22 bp, Homo sapiens
tctgttaaaagtggaataatag

SEQ ID NO: 9077574 - DNA, 22 bp, Homo sapiens
tctgtgtttaaaagatatgtcc

SEQ ID NO: 9077575 - DNA, 22 bp, Homo sapiens
tctgtgtgaccataagccagct

SEQ ID NO: 9077576 - DNA, 20 bp, Homo sapiens
tctgtgtgccatcacctaac

SEQ ID NO: 9077577 - DNA, 20 bp, Homo sapiens
tctgtgtgccatcacctaac

SEQ ID NO: 9077578 - DNA, 20 bp, Homo sapiens
tctgtgtgccatcacctaac

SEQ ID NO: 9077579 - DNA, 22 bp, Homo sapiens
tctgtgtgcccacctgacacct

SEQ ID NO: 9077580 - DNA, 22 bp, Homo sapiens
tctgtgtggtagtttcagtgaa

SEQ ID NO: 9077581 - DNA, 22 bp, Homo sapiens
tctgtgtgttgtcaggaggatt

SEQ ID NO: 9077582 - DNA, 22 bp, Homo sapiens
tctgtgtgggatagtttgagga

SEQ ID NO: 9077583 - DNA, 22 bp, Homo sapiens
tctgttgactcctagcagccat

SEQ ID NO: 9077584 - DNA, 22 bp, Homo sapiens
tctgttcttgtccccacttcag

SEQ ID NO: 9077585 - DNA, 22 bp, Homo sapiens
tctgttcttggtgcagctggga

SEQ ID NO: 9077586 - DNA, 22 bp, Homo sapiens
tctgttcttggtgcagctggga

SEQ ID NO: 9077587 - DNA, 22 bp, Homo sapiens
tctgtttaatgggaatgatact

SEQ ID NO: 9077588 - DNA, 22 bp, Homo sapiens
tctgttgctttcttcctgtgtg

SEQ ID NO: 9077589 - DNA, 22 bp, Homo sapiens
tctgttgcatatgctgctgggt

SEQ ID NO: 9077590 - DNA, 22 bp, Homo sapiens
tctgttgcaatgtgcatggtga

SEQ ID NO: 9077591 - DNA, 22 bp, Homo sapiens
tctgggcttggattggctctgc

SEQ ID NO: 9077592 - DNA, 22 bp, Homo sapiens
tctgggcttgggtagaaatcac

SEQ ID NO: 9077593 - DNA, 22 bp, Homo sapiens
tctgggcttggttagggctgtt

SEQ ID NO: 9077594 - DNA, 22 bp, Homo sapiens
tctgggctttaagaactctgtt

SEQ ID NO: 9077595 - DNA, 22 bp, Homo sapiens
tctgggcttggttagggctgtt

SEQ ID NO: 9077596 - DNA, 22 bp, Homo sapiens
tctgggctttacactgtgctta

SEQ ID NO: 9077597 - DNA, 22 bp, Homo sapiens
tctgggctttacactgtgctta

SEQ ID NO: 9077598 - DNA, 22 bp, Homo sapiens
tctgggctttacactgtgctta

SEQ ID NO: 9077599 - DNA, 22 bp, Homo sapiens
tctgggctttagtttgttatct

SEQ ID NO: 9077600 - DNA, 22 bp, Homo sapiens
tctgggctttgtaatgggaggt

SEQ ID NO: 9077601 - DNA, 22 bp, Homo sapiens
tctgggctttgtaatgggaggt

SEQ ID NO: 9077602 - DNA, 21 bp, Homo sapiens
tctgggctttcttataaggca

SEQ ID NO: 9077603 - DNA, 21 bp, Homo sapiens
tctgggctttcttataaggca

SEQ ID NO: 9077604 - DNA, 22 bp, Homo sapiens
tctgggggcgaccagggactgc

SEQ ID NO: 9077605 - DNA, 22 bp, Homo sapiens
tctgggggcgaccagggactgc

SEQ ID NO: 9077606 - DNA, 21 bp, Homo sapiens
tctgggggtgagcctagaaat

SEQ ID NO: 9077607 - DNA, 22 bp, Homo sapiens
tctgggggaggaggcatggccc

SEQ ID NO: 9077608 - DNA, 22 bp, Homo sapiens
tctgggggaggaggcatggccc

SEQ ID NO: 9077609 - DNA, 20 bp, Homo sapiens
tctggggatgaggtctagga

SEQ ID NO: 9077610 - DNA, 22 bp, Homo sapiens
tctgggcttttccatgcctgtg

SEQ ID NO: 9077611 - DNA, 17 bp, Homo sapiens
tctgggcttcagtggtc

SEQ ID NO: 9077612 - DNA, 17 bp, Homo sapiens
tctgggcttcagtggtc

SEQ ID NO: 9077613 - DNA, 20 bp, Homo sapiens
tctgggcttcccccagctcc

SEQ ID NO: 9077614 - DNA, 22 bp, Homo sapiens
tctgggctgtgggaattcaaca

SEQ ID NO: 9077615 - DNA, 22 bp, Homo sapiens
tctgggctgtgccaaagctctt

SEQ ID NO: 9077616 - DNA, 22 bp, Homo sapiens
tctgggctgtgccaaagctctt

SEQ ID NO: 9077617 - DNA, 22 bp, Homo sapiens
tctgggctgtggttccactccg

SEQ ID NO: 9077618 - DNA, 22 bp, Homo sapiens
tctgggcttggattggctctgc

SEQ ID NO: 9077619 - DNA, 22 bp, Homo sapiens
tctgggcttggattggctctgc

SEQ ID NO: 9077620 - DNA, 22 bp, Homo sapiens
tctgggcttgcctggttgtgca

SEQ ID NO: 9077621 - DNA, 22 bp, Homo sapiens
tctgggcttgcctggttgtgca

SEQ ID NO: 9077622 - DNA, 22 bp, Homo sapiens
tctgggcttgcctggttgtgca

SEQ ID NO: 9077623 - DNA, 20 bp, Homo sapiens
tctgggcttcccccagctcc

SEQ ID NO: 9077624 - DNA, 20 bp, Homo sapiens
tctgggcttcccccagctcc

SEQ ID NO: 9077625 - DNA, 18 bp, Homo sapiens
tctgggcttcccgaggct

SEQ ID NO: 9077626 - DNA, 18 bp, Homo sapiens
tctgggcttcccgaggct

SEQ ID NO: 9077627 - DNA, 18 bp, Homo sapiens
tctgggcttcccgaggct

SEQ ID NO: 9077628 - DNA, 22 bp, Homo sapiens
tctgggctgtctacaggttggc

SEQ ID NO: 9077629 - DNA, 22 bp, Homo sapiens
tctgggctgtctacaggttggc

SEQ ID NO: 9077630 - DNA, 22 bp, Homo sapiens
tctgggctgtctacaggttggc

SEQ ID NO: 9077631 - DNA, 15 bp, Homo sapiens
tctgggctgtgagca

SEQ ID NO: 9077632 - DNA, 15 bp, Homo sapiens
tctgggctgtgagca

SEQ ID NO: 9077633 - DNA, 22 bp, Homo sapiens
tctgggctggttgtgcttgctt

SEQ ID NO: 9077634 - DNA, 22 bp, Homo sapiens
tctgggctggtgctcatgaatt

SEQ ID NO: 9077635 - DNA, 22 bp, Homo sapiens
tctgggctggctttatgctgac

SEQ ID NO: 9077636 - DNA, 22 bp, Homo sapiens
tctgggctggctttatgctgac

SEQ ID NO: 9077637 - DNA, 22 bp, Homo sapiens
tctgggctgcttcagccttcgc

SEQ ID NO: 9077638 - DNA, 22 bp, Homo sapiens
tctgggctgcttcagccttcgc

SEQ ID NO: 9077639 - DNA, 23 bp, Homo sapiens
tctgggctgcttaaggatcaagg

SEQ ID NO: 9077640 - DNA, 22 bp, Homo sapiens
tctgggctgggagcgtgtggac

SEQ ID NO: 9077641 - DNA, 22 bp, Homo sapiens
tctgggctgggagcgtgtggac

SEQ ID NO: 9077642 - DNA, 22 bp, Homo sapiens
tctgggctgggagcgtgtggac

SEQ ID NO: 9077643 - DNA, 22 bp, Homo sapiens
tctgggctgggcttaggaaccc

SEQ ID NO: 9077644 - DNA, 22 bp, Homo sapiens
tctgggtgtcactcctgcctgc

SEQ ID NO: 9077645 - DNA, 22 bp, Homo sapiens
tctgggtgtagggcctggcaac

SEQ ID NO: 9077646 - DNA, 22 bp, Homo sapiens
tctgggtgtagggcctggcaac

SEQ ID NO: 9077647 - DNA, 22 bp, Homo sapiens
tctgtaaaacttctttgtaaat

SEQ ID NO: 9077648 - DNA, 22 bp, Homo sapiens
tctgggtgatgaaatgcactgt

SEQ ID NO: 9077649 - DNA, 22 bp, Homo sapiens
tctgggtgatgaaatgcactgt

SEQ ID NO: 9077650 - DNA, 22 bp, Homo sapiens
tctgggtgaccctgggcaaggc

SEQ ID NO: 9077651 - DNA, 22 bp, Homo sapiens
tctgggtgaccctgggcaaggc

SEQ ID NO: 9077652 - DNA, 22 bp, Homo sapiens
tctgggtgccctttgctctgtt

SEQ ID NO: 9077653 - DNA, 22 bp, Homo sapiens
tctgggtgccctttgctctgtt

SEQ ID NO: 9077654 - DNA, 22 bp, Homo sapiens
tctgggtgccctttgctctgtt

SEQ ID NO: 9077655 - DNA, 22 bp, Homo sapiens
tctgggtgccactgtctgtaca

SEQ ID NO: 9077656 - DNA, 22 bp, Homo sapiens
tctgggtgctacaaacagtatt

SEQ ID NO: 9077657 - DNA, 22 bp, Homo sapiens
tctgggtggctgccaatctgcc

SEQ ID NO: 9077658 - DNA, 22 bp, Homo sapiens
tctgggtggcttcagaggccac

SEQ ID NO: 9077659 - DNA, 22 bp, Homo sapiens
tctgggtctatgatctcacttc

SEQ ID NO: 9077660 - DNA, 22 bp, Homo sapiens
tctgggtctatcccatgccttt

SEQ ID NO: 9077661 - DNA, 22 bp, Homo sapiens
tctgggtccgggactgtggatg

SEQ ID NO: 9077662 - DNA, 22 bp, Homo sapiens
tctgggtctcagagtgaccatg

SEQ ID NO: 9077663 - DNA, 22 bp, Homo sapiens
tctgggtctggctgctggtgca

SEQ ID NO: 9077664 - DNA, 22 bp, Homo sapiens
tctgggtctttacccatggaat

SEQ ID NO: 9077665 - DNA, 22 bp, Homo sapiens
tctggggttttcacgctgtctc

SEQ ID NO: 9077666 - DNA, 22 bp, Homo sapiens
tctggggttggtgcttacacca

SEQ ID NO: 9077667 - DNA, 22 bp, Homo sapiens
tctggggtttgtggttcttctg

SEQ ID NO: 9077668 - DNA, 22 bp, Homo sapiens
tctggggttgagtctgggtcag

SEQ ID NO: 9077669 - DNA, 22 bp, Homo sapiens
tctgggtcactgtgggagggca

SEQ ID NO: 9077670 - DNA, 22 bp, Homo sapiens
tctgggtccccgaggaaggaga

SEQ ID NO: 9077671 - DNA, 22 bp, Homo sapiens
tctgggtcatgactcagcgtga

SEQ ID NO: 9077672 - DNA, 22 bp, Homo sapiens
tctgggggttaagtgaggacaa

SEQ ID NO: 9077673 - DNA, 22 bp, Homo sapiens
tctgggggttaagtgaggacaa

SEQ ID NO: 9077674 - DNA, 22 bp, Homo sapiens
tctggggtgcagcctaggcatc

SEQ ID NO: 9077675 - DNA, 22 bp, Homo sapiens
tctggggtgaggcctggttatc

SEQ ID NO: 9077676 - DNA, 20 bp, Homo sapiens
tctggggtgaagcccaggaa

SEQ ID NO: 9077677 - DNA, 22 bp, Homo sapiens
tctggggtgcagcctggacata

SEQ ID NO: 9077678 - DNA, 22 bp, Homo sapiens
tctggggtgcagcctggacata

SEQ ID NO: 9077679 - DNA, 22 bp, Homo sapiens
tctggggtggagccctggagtc

SEQ ID NO: 9077680 - DNA, 22 bp, Homo sapiens
tctggggtgtgacctgagcatg

SEQ ID NO: 9077681 - DNA, 19 bp, Homo sapiens
tctggggtgtggcctggca

SEQ ID NO: 9077682 - DNA, 22 bp, Homo sapiens
tctggggtgtgacctgagcatg

SEQ ID NO: 9077683 - DNA, 18 bp, Homo sapiens
tctggggtgtgctgtgta

SEQ ID NO: 9077684 - DNA, 22 bp, Homo sapiens
tctgtaagtgttggttattcta

SEQ ID NO: 9077685 - DNA, 22 bp, Homo sapiens
tctgtaaagactccaaaagcca

SEQ ID NO: 9077686 - DNA, 22 bp, Homo sapiens
tctgtacatgagttgagaatca

SEQ ID NO: 9077687 - DNA, 23 bp, Homo sapiens
tctgtacaattgagaagagaaca

SEQ ID NO: 9077688 - DNA, 22 bp, Homo sapiens
tctgtcacccaggctggagtgc

SEQ ID NO: 9077689 - DNA, 22 bp, Homo sapiens
tctgtcacccagagtgcagtgg

SEQ ID NO: 9077690 - DNA, 22 bp, Homo sapiens
tctgtcaccattcagcttgaat

SEQ ID NO: 9077691 - DNA, 22 bp, Homo sapiens
tctgtcacaatttgcttactct

SEQ ID NO: 9077692 - DNA, 22 bp, Homo sapiens
tctgtattttaagatgctgttt

SEQ ID NO: 9077693 - DNA, 22 bp, Homo sapiens
tctgtattgattctgttaggca

SEQ ID NO: 9077694 - DNA, 22 bp, Homo sapiens
tctgtataaggacaaacattta

SEQ ID NO: 9077695 - DNA, 22 bp, Homo sapiens
tctgtagtttacagtatttcag

SEQ ID NO: 9077696 - DNA, 20 bp, Homo sapiens
tctgtagtctatgaggctta

SEQ ID NO: 9077697 - DNA, 22 bp, Homo sapiens
tctgtagtctgtgccatagctg

SEQ ID NO: 9077698 - DNA, 22 bp, Homo sapiens
tctgtattctatggcagttggt

SEQ ID NO: 9077699 - DNA, 22 bp, Homo sapiens
tctgtatcacccgttcccagaa

SEQ ID NO: 9077700 - DNA, 22 bp, Homo sapiens
tctgtagcaagtgagaggcatt

SEQ ID NO: 9077701 - DNA, 22 bp, Homo sapiens
tctgtacttttattttggcact

SEQ ID NO: 9077702 - DNA, 22 bp, Homo sapiens
tctgtacttgttagtcttcatg

SEQ ID NO: 9077703 - DNA, 21 bp, Homo sapiens
tctgtactttgcttccatgct

SEQ ID NO: 9077704 - DNA, 22 bp, Homo sapiens
tctgtacatgagttgagaatca

SEQ ID NO: 9077705 - DNA, 20 bp, Homo sapiens
tctgtaggcaagttagcagg

SEQ ID NO: 9077706 - DNA, 22 bp, Homo sapiens
tctgtaggacagagaaatgggg

SEQ ID NO: 9077707 - DNA, 22 bp, Homo sapiens
tctgtagggtagtagtggagat

SEQ ID NO: 9077708 - DNA, 22 bp, Homo sapiens
tctgtagtatggtacttattta

SEQ ID NO: 9077709 - DNA, 22 bp, Homo sapiens
tctgtccagaggtcctggagac

SEQ ID NO: 9077710 - DNA, 22 bp, Homo sapiens
tctgtccaacactctctagaca

SEQ ID NO: 9077711 - DNA, 22 bp, Homo sapiens
tctgtcattttgtatctacatg

SEQ ID NO: 9077712 - DNA, 19 bp, Homo sapiens
tctgtcatttcttctgtac

SEQ ID NO: 9077713 - DNA, 22 bp, Homo sapiens
tctgtcatctgttcagtgctca

SEQ ID NO: 9077714 - DNA, 22 bp, Homo sapiens
tctgtcatgtttccattacatg

SEQ ID NO: 9077715 - DNA, 22 bp, Homo sapiens
tctgtcatctgtaacaggaggg

SEQ ID NO: 9077716 - DNA, 22 bp, Homo sapiens
tctgtccagctctggggctcac

SEQ ID NO: 9077717 - DNA, 22 bp, Homo sapiens
tctgtctcctgccagtgcctct

SEQ ID NO: 9077718 - DNA, 21 bp, Homo sapiens
tctgtctctccactgccctgc

SEQ ID NO: 9077719 - DNA, 21 bp, Homo sapiens
tctgtctctccactgccctgc

SEQ ID NO: 9077720 - DNA, 23 bp, Homo sapiens
tctgtctgaataatttactcttt

SEQ ID NO: 9077721 - DNA, 22 bp, Homo sapiens
tctgtctgactaccatgaggca

SEQ ID NO: 9077722 - DNA, 18 bp, Homo sapiens
tctgtctctgtccttgct

SEQ ID NO: 9077723 - DNA, 18 bp, Homo sapiens
tctgtctctgtccttgct

SEQ ID NO: 9077724 - DNA, 21 bp, Homo sapiens
tctgtctctccactgccctgc

SEQ ID NO: 9077725 - DNA, 20 bp, Homo sapiens
tctgtctctgagctagactt

SEQ ID NO: 9077726 - DNA, 20 bp, Homo sapiens
tctgtctctgagctagactt

SEQ ID NO: 9077727 - DNA, 22 bp, Homo sapiens
tctgtctcctctgaggtgccag

SEQ ID NO: 9077728 - DNA, 22 bp, Homo sapiens
tctgtctcaagttcttgcactc

SEQ ID NO: 9077729 - DNA, 22 bp, Homo sapiens
tctgtctcaagttcttgcactc

SEQ ID NO: 9077730 - DNA, 22 bp, Homo sapiens
tctgtcctctccctgaccacaa

SEQ ID NO: 9077731 - DNA, 22 bp, Homo sapiens
tctggcccagcccctgatccca

SEQ ID NO: 9077732 - DNA, 22 bp, Homo sapiens
tctggcccagcccctgaggtca

SEQ ID NO: 9077733 - DNA, 22 bp, Homo sapiens
tctggccatggcaagccgagtg

SEQ ID NO: 9077734 - DNA, 22 bp, Homo sapiens
tctggccatggcaagccgagtg

SEQ ID NO: 9077735 - DNA, 22 bp, Homo sapiens
tctggccaggatggcaagacca

SEQ ID NO: 9077736 - DNA, 22 bp, Homo sapiens
tctggccaggatggcaagacca

SEQ ID NO: 9077737 - DNA, 22 bp, Homo sapiens
tctggccagcatgagacctggt

SEQ ID NO: 9077738 - DNA, 22 bp, Homo sapiens
tctggccaggggtccctgaagg

SEQ ID NO: 9077739 - DNA, 22 bp, Homo sapiens
tctggccagtgaaatgcagaat

SEQ ID NO: 9077740 - DNA, 22 bp, Homo sapiens
tctggccaggggtccctgaagg

SEQ ID NO: 9077741 - DNA, 22 bp, Homo sapiens
tctggccacttgcttcacactg

SEQ ID NO: 9077742 - DNA, 22 bp, Homo sapiens
tctggccagcatgagacctggt

SEQ ID NO: 9077743 - DNA, 22 bp, Homo sapiens
tctggccaacaaaaactaagtc

SEQ ID NO: 9077744 - DNA, 22 bp, Homo sapiens
tctggcatcactcgcaagagca

SEQ ID NO: 9077745 - DNA, 22 bp, Homo sapiens
tctggcagttgccgcttcagtc

SEQ ID NO: 9077746 - DNA, 22 bp, Homo sapiens
tctggccacccgaggcccctgc

SEQ ID NO: 9077747 - DNA, 22 bp, Homo sapiens
tctggccacccgaggcccctgc

SEQ ID NO: 9077748 - DNA, 22 bp, Homo sapiens
tctggcatttcaggcatctata

SEQ ID NO: 9077749 - DNA, 22 bp, Homo sapiens
tctggcagtgatttctgtgatc

SEQ ID NO: 9077750 - DNA, 22 bp, Homo sapiens
tctggcagttccttgttgatat

SEQ ID NO: 9077751 - DNA, 22 bp, Homo sapiens
tctggcaccactgagtctgcag

SEQ ID NO: 9077752 - DNA, 20 bp, Homo sapiens
tctggcaggtgaacgagctg

SEQ ID NO: 9077753 - DNA, 22 bp, Homo sapiens
tctggcagtgagcaacttgaca

SEQ ID NO: 9077754 - DNA, 22 bp, Homo sapiens
tctggcagggtgtgtatttaca

SEQ ID NO: 9077755 - DNA, 22 bp, Homo sapiens
tctggagggggatgcctcatcc

SEQ ID NO: 9077756 - DNA, 22 bp, Homo sapiens
tctggaggggtttagagggaca

SEQ ID NO: 9077757 - DNA, 22 bp, Homo sapiens
tctggaggctctgagggtgagt

SEQ ID NO: 9077758 - DNA, 22 bp, Homo sapiens
tctggagcaacagagcaggaca

SEQ ID NO: 9077759 - DNA, 22 bp, Homo sapiens
tctggaggctctgagggtgagt

SEQ ID NO: 9077760 - DNA, 21 bp, Homo sapiens
tctggagccctaagctgagaa

SEQ ID NO: 9077761 - DNA, 21 bp, Homo sapiens
tctggagccctaagctgagaa

SEQ ID NO: 9077762 - DNA, 21 bp, Homo sapiens
tctggagtcatctttaccata

SEQ ID NO: 9077763 - DNA, 22 bp, Homo sapiens
tctggagtctgagatctgagga

SEQ ID NO: 9077764 - DNA, 22 bp, Homo sapiens
tctggatggtcagctcttcctg

SEQ ID NO: 9077765 - DNA, 22 bp, Homo sapiens
tctggatgttgcggagtacaga

SEQ ID NO: 9077766 - DNA, 22 bp, Homo sapiens
tctggatttgtggaaaatctgc

SEQ ID NO: 9077767 - DNA, 22 bp, Homo sapiens
tctggcaaaggcaaccacagtt

SEQ ID NO: 9077768 - DNA, 22 bp, Homo sapiens
tctggatgggatgaggcaacaa

SEQ ID NO: 9077769 - DNA, 22 bp, Homo sapiens
tctggatgacagaatggtcata

SEQ ID NO: 9077770 - DNA, 22 bp, Homo sapiens
tctggatgaagacccagaggct

SEQ ID NO: 9077771 - DNA, 22 bp, Homo sapiens
tctggatctccctcatcctggg

SEQ ID NO: 9077772 - DNA, 22 bp, Homo sapiens
tctgctctagttgcttcctgcc

SEQ ID NO: 9077773 - DNA, 22 bp, Homo sapiens
tctgctctagttgcttcctgcc

SEQ ID NO: 9077774 - DNA, 22 bp, Homo sapiens
tctgctctccatacttccgcac

SEQ ID NO: 9077775 - DNA, 22 bp, Homo sapiens
tctgctctccatacttccgcac

SEQ ID NO: 9077776 - DNA, 23 bp, Homo sapiens
tctgctctgaagttcggctgagc

SEQ ID NO: 9077777 - DNA, 22 bp, Homo sapiens
tctgctctgagagggccatcag

SEQ ID NO: 9077778 - DNA, 17 bp, Homo sapiens
tctgctctgccaatcca

SEQ ID NO: 9077779 - DNA, 22 bp, Homo sapiens
tctgctctgtggcttcagctaa

SEQ ID NO: 9077780 - DNA, 22 bp, Homo sapiens
tctgctctgtactgcactggcc

SEQ ID NO: 9077781 - DNA, 22 bp, Homo sapiens
tctgctgctacagactctctag

SEQ ID NO: 9077782 - DNA, 22 bp, Homo sapiens
tctgctgctacagactctctag

SEQ ID NO: 9077783 - DNA, 22 bp, Homo sapiens
tctgctgaatcagatagctaag

SEQ ID NO: 9077784 - DNA, 22 bp, Homo sapiens
tctgctgacctttctctgacac

SEQ ID NO: 9077785 - DNA, 22 bp, Homo sapiens
tctgctgagtaccgccatgtct

SEQ ID NO: 9077786 - DNA, 18 bp, Homo sapiens
tctgctgctgcgtcctgc

SEQ ID NO: 9077787 - DNA, 22 bp, Homo sapiens
tctgctgctgcagctacactat

SEQ ID NO: 9077788 - DNA, 22 bp, Homo sapiens
tctgctgctgaccaacactgtg

SEQ ID NO: 9077789 - DNA, 22 bp, Homo sapiens
tctgctgttgagcacaagtgaa

SEQ ID NO: 9077790 - DNA, 22 bp, Homo sapiens
tctggacatcctggagaatgac

SEQ ID NO: 9077791 - DNA, 22 bp, Homo sapiens
tctggactaacagcagcctcag

SEQ ID NO: 9077792 - DNA, 22 bp, Homo sapiens
tctggaagtgatgttcatagtg

SEQ ID NO: 9077793 - DNA, 22 bp, Homo sapiens
tctggaagttagaggaggaaag

SEQ ID NO: 9077794 - DNA, 22 bp, Homo sapiens
tctggaataggtcctgagtatt

SEQ ID NO: 9077795 - DNA, 22 bp, Homo sapiens
tctggagataagacagacagat

SEQ ID NO: 9077796 - DNA, 22 bp, Homo sapiens
tctggagataagacagacagat

SEQ ID NO: 9077797 - DNA, 22 bp, Homo sapiens
tctggagaggaggatgtggaca

SEQ ID NO: 9077798 - DNA, 22 bp, Homo sapiens
tctggagagtcacagtgccaga

SEQ ID NO: 9077799 - DNA, 22 bp, Homo sapiens
tctggagaagcccagggagctg

SEQ ID NO: 9077800 - DNA, 22 bp, Homo sapiens
tctggagaagcagtgagagtca

SEQ ID NO: 9077801 - DNA, 22 bp, Homo sapiens
tctggagaagcagtgagagtca

SEQ ID NO: 9077802 - DNA, 22 bp, Homo sapiens
tctggagaaggaagagtctttg

SEQ ID NO: 9077803 - DNA, 22 bp, Homo sapiens
tctggctgcgtggcctttagca

SEQ ID NO: 9077804 - DNA, 19 bp, Homo sapiens
tctggctgccaaggattga

SEQ ID NO: 9077805 - DNA, 22 bp, Homo sapiens
tctggctgggtgagagcttctc

SEQ ID NO: 9077806 - DNA, 22 bp, Homo sapiens
tctggctgtgtatgagagtttt

SEQ ID NO: 9077807 - DNA, 21 bp, Homo sapiens
tctggctttcattccccttct

SEQ ID NO: 9077808 - DNA, 22 bp, Homo sapiens
tctggctttctcagcatggcat

SEQ ID NO: 9077809 - DNA, 22 bp, Homo sapiens
tctggctttcatttgtttaaag

SEQ ID NO: 9077810 - DNA, 22 bp, Homo sapiens
tctggctttcctggagcaagaa

SEQ ID NO: 9077811 - DNA, 23 bp, Homo sapiens
tctggctttgctggaagttttga

SEQ ID NO: 9077812 - DNA, 22 bp, Homo sapiens
tctggcttttattcagttggca

SEQ ID NO: 9077813 - DNA, 22 bp, Homo sapiens
tctgggaaacactgcatcccca

SEQ ID NO: 9077814 - DNA, 22 bp, Homo sapiens
tctgggaaatagaggaccctag

SEQ ID NO: 9077815 - DNA, 21 bp, Homo sapiens
tctgggaaattgggaaagaag

SEQ ID NO: 9077816 - DNA, 22 bp, Homo sapiens
tctgggaaggagcctgagaatt

SEQ ID NO: 9077817 - DNA, 22 bp, Homo sapiens
tctgggaaggctctgcagatat

SEQ ID NO: 9077818 - DNA, 22 bp, Homo sapiens
tctgggaaccaaagggtgctta

SEQ ID NO: 9077819 - DNA, 22 bp, Homo sapiens
tctggcccctggtctctggtgt

SEQ ID NO: 9077820 - DNA, 21 bp, Homo sapiens
tctggccctaggttgggcctc

SEQ ID NO: 9077821 - DNA, 22 bp, Homo sapiens
tctggccctatggcatgtacct

SEQ ID NO: 9077822 - DNA, 22 bp, Homo sapiens
tctggccccgcatgcactttat

SEQ ID NO: 9077823 - DNA, 22 bp, Homo sapiens
tctggccccggtcttcacagct

SEQ ID NO: 9077824 - DNA, 22 bp, Homo sapiens
tctggccccggtcttcacagct

SEQ ID NO: 9077825 - DNA, 22 bp, Homo sapiens
tctggctccactctgtgcatgc

SEQ ID NO: 9077826 - DNA, 23 bp, Homo sapiens
tctggctccatccttggggatcc

SEQ ID NO: 9077827 - DNA, 22 bp, Homo sapiens
tctggctcctggctccactgcc

SEQ ID NO: 9077828 - DNA, 22 bp, Homo sapiens
tctggctcctggctccactgcc

SEQ ID NO: 9077829 - DNA, 22 bp, Homo sapiens
tctggctcggatttgtctagca

SEQ ID NO: 9077830 - DNA, 22 bp, Homo sapiens
tctggctcggatttgtctagca

SEQ ID NO: 9077831 - DNA, 22 bp, Homo sapiens
tctggctctaactaggcatcag

SEQ ID NO: 9077832 - DNA, 22 bp, Homo sapiens
tctggctctcatactcgccagt

SEQ ID NO: 9077833 - DNA, 22 bp, Homo sapiens
tctggctctgacactactgtta

SEQ ID NO: 9077834 - DNA, 22 bp, Homo sapiens
tctggctctctcatcacccaat

SEQ ID NO: 9077835 - DNA, 22 bp, Homo sapiens
tctggctctggagtccacctgc

SEQ ID NO: 9077836 - DNA, 22 bp, Homo sapiens
tctggctgaaattagaaggttc

SEQ ID NO: 9077837 - DNA, 22 bp, Homo sapiens
tctggctctttgggtgattgta

SEQ ID NO: 9077838 - DNA, 22 bp, Homo sapiens
tctggctctttgggtgattgta

SEQ ID NO: 9077839 - DNA, 22 bp, Homo sapiens
tctggctgaaaggggctgtgcc

SEQ ID NO: 9077840 - DNA, 23 bp, Homo sapiens
tctgggcatatctagtcacatcg

SEQ ID NO: 9077841 - DNA, 22 bp, Homo sapiens
tctgggcagttcggatcctctg

SEQ ID NO: 9077842 - DNA, 19 bp, Homo sapiens
tctgggcagggccagcacc

SEQ ID NO: 9077843 - DNA, 22 bp, Homo sapiens
tctgggcagcctcaggccaggg

SEQ ID NO: 9077844 - DNA, 22 bp, Homo sapiens
tctgggcagcagcagctagtag

SEQ ID NO: 9077845 - DNA, 22 bp, Homo sapiens
tctgggcagcagcagctagtag

SEQ ID NO: 9077846 - DNA, 21 bp, Homo sapiens
tctgggcagcccagtcctgag

SEQ ID NO: 9077847 - DNA, 22 bp, Homo sapiens
tctgggcagccatgtgcctggc

SEQ ID NO: 9077848 - DNA, 22 bp, Homo sapiens
tctgggcagcagcagctagtag

SEQ ID NO: 9077849 - DNA, 22 bp, Homo sapiens
tctgggcagccatgtgcctggc

SEQ ID NO: 9077850 - DNA, 22 bp, Homo sapiens
tctgggataagaccacagattt

SEQ ID NO: 9077851 - DNA, 23 bp, Homo sapiens
tctgggcaccttgttgacatgat

SEQ ID NO: 9077852 - DNA, 22 bp, Homo sapiens
tctgggcactgctgagcctgta

SEQ ID NO: 9077853 - DNA, 22 bp, Homo sapiens
tctgggcactgctgagcctgta

SEQ ID NO: 9077854 - DNA, 22 bp, Homo sapiens
tctgggcactgctgagcctgta

SEQ ID NO: 9077855 - DNA, 22 bp, Homo sapiens
tctgggctcttagtgtaccctc

SEQ ID NO: 9077856 - DNA, 22 bp, Homo sapiens
tctgggctcttagtgtaccctc

SEQ ID NO: 9077857 - DNA, 21 bp, Homo sapiens
tctgggctgctgctgcccatc

SEQ ID NO: 9077858 - DNA, 22 bp, Homo sapiens
tctgggctgctgtgcagtgacc

SEQ ID NO: 9077859 - DNA, 22 bp, Homo sapiens
tctgggctgctgtgcagtgacc

SEQ ID NO: 9077860 - DNA, 22 bp, Homo sapiens
tctgggctgctatgaggcagag

SEQ ID NO: 9077861 - DNA, 22 bp, Homo sapiens
tctgggctgctatgaggcagag

SEQ ID NO: 9077862 - DNA, 22 bp, Homo sapiens
tctgggctgctatgaggcagag

SEQ ID NO: 9077863 - DNA, 22 bp, Homo sapiens
tctgggctgaaatgaaggcctt

SEQ ID NO: 9077864 - DNA, 23 bp, Homo sapiens
tctgggctgagacttggaaggtc

SEQ ID NO: 9077865 - DNA, 23 bp, Homo sapiens
tctgggctgagacttggaaggtc

SEQ ID NO: 9077866 - DNA, 23 bp, Homo sapiens
tctgggctgagctcgagtgtaga

SEQ ID NO: 9077867 - DNA, 23 bp, Homo sapiens
tctgggctgagctcgagtgtaga

SEQ ID NO: 9077868 - DNA, 22 bp, Homo sapiens
tctgggctgctatgaggcagag

SEQ ID NO: 9077869 - DNA, 22 bp, Homo sapiens
tctgggaggtgttttgagaact

SEQ ID NO: 9077870 - DNA, 22 bp, Homo sapiens
tctgggaggtgttttgagaact

SEQ ID NO: 9077871 - DNA, 22 bp, Homo sapiens
tctgggagtgggtccaaggaat

SEQ ID NO: 9077872 - DNA, 22 bp, Homo sapiens
tctgggagttagaatacatggg

SEQ ID NO: 9077873 - DNA, 22 bp, Homo sapiens
tctgggaggtaaccatgctgat

SEQ ID NO: 9077874 - DNA, 22 bp, Homo sapiens
tctgggaggggctgccattgct

SEQ ID NO: 9077875 - DNA, 22 bp, Homo sapiens
tctgggagagtcacaggcattg

SEQ ID NO: 9077876 - DNA, 22 bp, Homo sapiens
tctgggagagcacgtggctgac

SEQ ID NO: 9077877 - DNA, 22 bp, Homo sapiens
tctgggagagctgctgtcagag

SEQ ID NO: 9077878 - DNA, 22 bp, Homo sapiens
tctgggagagggaaagaagact

SEQ ID NO: 9077879 - DNA, 22 bp, Homo sapiens
tctgggagaagctgatgtgaag

SEQ ID NO: 9077880 - DNA, 19 bp, Homo sapiens
tctgggaatgatgccagca

SEQ ID NO: 9077881 - DNA, 23 bp, Homo sapiens
tctgggaattggctgtccacagg

SEQ ID NO: 9077882 - DNA, 22 bp, Homo sapiens
tctgggaatggttgatccacac

SEQ ID NO: 9077883 - DNA, 22 bp, Homo sapiens
tctgggaagtgagatgctgtgt

SEQ ID NO: 9077884 - DNA, 22 bp, Homo sapiens
tctgcctgttcaagtcttctag

SEQ ID NO: 9077885 - DNA, 22 bp, Homo sapiens
tctgcctgttcaagtcttctag

SEQ ID NO: 9077886 - DNA, 22 bp, Homo sapiens
tctgcctgtggtggaggaagtt

SEQ ID NO: 9077887 - DNA, 22 bp, Homo sapiens
tctgcctgtgctgtgttttcat

SEQ ID NO: 9077888 - DNA, 22 bp, Homo sapiens
tctgcctgtagtcccacacctc

SEQ ID NO: 9077889 - DNA, 22 bp, Homo sapiens
tctgcctgtggtggaggaagtt

SEQ ID NO: 9077890 - DNA, 22 bp, Homo sapiens
tctgcctgttgctagaatgtca

SEQ ID NO: 9077891 - DNA, 22 bp, Homo sapiens
tctgcctgttgagcctaaggcc

SEQ ID NO: 9077892 - DNA, 22 bp, Homo sapiens
tctgcctgttgagcctaaggcc

SEQ ID NO: 9077893 - DNA, 22 bp, Homo sapiens
tctgctcactattacatggaca

SEQ ID NO: 9077894 - DNA, 22 bp, Homo sapiens
tctgctcactattacatggaca

SEQ ID NO: 9077895 - DNA, 22 bp, Homo sapiens
tctgctcacgtgtattctccat

SEQ ID NO: 9077896 - DNA, 22 bp, Homo sapiens
tctgctcagcatccctctgaga

SEQ ID NO: 9077897 - DNA, 22 bp, Homo sapiens
tctgctcaggttacctagctag

SEQ ID NO: 9077898 - DNA, 22 bp, Homo sapiens
tctgcctgcggctgcaggtggc

SEQ ID NO: 9077899 - DNA, 22 bp, Homo sapiens
tctgcctgcggctgcaggtggc

SEQ ID NO: 9077900 - DNA, 22 bp, Homo sapiens
tctgcctgctaactcctgcacc

SEQ ID NO: 9077901 - DNA, 22 bp, Homo sapiens
tctgcctgctaactcctgcacc

SEQ ID NO: 9077902 - DNA, 22 bp, Homo sapiens
tctgcctggatgatggcagggc

SEQ ID NO: 9077903 - DNA, 22 bp, Homo sapiens
tctgcctggagagttcttctct

SEQ ID NO: 9077904 - DNA, 22 bp, Homo sapiens
tctgcctggattccattctcca

SEQ ID NO: 9077905 - DNA, 22 bp, Homo sapiens
tctgcctggattccattctcca

SEQ ID NO: 9077906 - DNA, 22 bp, Homo sapiens
tctgcctggatgatggcagggc

SEQ ID NO: 9077907 - DNA, 22 bp, Homo sapiens
tctgcctggatgatggcagggc

SEQ ID NO: 9077908 - DNA, 22 bp, Homo sapiens
tctgcctggattttggaaagct

SEQ ID NO: 9077909 - DNA, 22 bp, Homo sapiens
tctgcctggattttggaaagct

SEQ ID NO: 9077910 - DNA, 22 bp, Homo sapiens
tctgcctggcctggagggcaca

SEQ ID NO: 9077911 - DNA, 22 bp, Homo sapiens
tctgcctgggtgtggagcagag

SEQ ID NO: 9077912 - DNA, 22 bp, Homo sapiens
tctgcctgtacctcttttttgc

SEQ ID NO: 9077913 - DNA, 22 bp, Homo sapiens
tctgcctggctcatggcagtga

SEQ ID NO: 9077914 - DNA, 22 bp, Homo sapiens
tctgcctggctcatggcagtga

SEQ ID NO: 9077915 - DNA, 22 bp, Homo sapiens
tctgccctggggtcagcctcca

SEQ ID NO: 9077916 - DNA, 22 bp, Homo sapiens
tctgcccttggctctcttgttg

SEQ ID NO: 9077917 - DNA, 22 bp, Homo sapiens
tctgcctgagcagagggaggcc

SEQ ID NO: 9077918 - DNA, 22 bp, Homo sapiens
tctgcctgagcagagggaggcc

SEQ ID NO: 9077919 - DNA, 22 bp, Homo sapiens
tctgccctggggtcagcctcca

SEQ ID NO: 9077920 - DNA, 22 bp, Homo sapiens
tctgcctgcagtgtggcagggc

SEQ ID NO: 9077921 - DNA, 22 bp, Homo sapiens
tctgcctgcagtgtggcagggc

SEQ ID NO: 9077922 - DNA, 22 bp, Homo sapiens
tctgcctgcagtgtggcagggc

SEQ ID NO: 9077923 - DNA, 22 bp, Homo sapiens
tctgcctgccagtctggtcctc

SEQ ID NO: 9077924 - DNA, 22 bp, Homo sapiens
tctgcctgccagtctggtcctc

SEQ ID NO: 9077925 - DNA, 22 bp, Homo sapiens
tctgcctgccagtctggtcctc

SEQ ID NO: 9077926 - DNA, 22 bp, Homo sapiens
tctgcctgagggagctgaggaa

SEQ ID NO: 9077927 - DNA, 22 bp, Homo sapiens
tctgcctgagggagctgaggaa

SEQ ID NO: 9077928 - DNA, 22 bp, Homo sapiens
tctgcctgagggagctgaggaa

SEQ ID NO: 9077929 - DNA, 21 bp, Homo sapiens
tctgccctccaggagctcata

SEQ ID NO: 9077930 - DNA, 21 bp, Homo sapiens
tctgccctccaggagctcata

SEQ ID NO: 9077931 - DNA, 22 bp, Homo sapiens
tctgcccagtttgtgctcaggt

SEQ ID NO: 9077932 - DNA, 19 bp, Homo sapiens
tctgcccagttgtctgccc

SEQ ID NO: 9077933 - DNA, 22 bp, Homo sapiens
tctgcccagggacccacaggga

SEQ ID NO: 9077934 - DNA, 22 bp, Homo sapiens
tctgcccaggaggtcccatggg

SEQ ID NO: 9077935 - DNA, 22 bp, Homo sapiens
tctgcccaccagcggttgcata

SEQ ID NO: 9077936 - DNA, 22 bp, Homo sapiens
tctgcccactgctctgctgccc

SEQ ID NO: 9077937 - DNA, 22 bp, Homo sapiens
tctgcccactgctctgctgccc

SEQ ID NO: 9077938 - DNA, 16 bp, Homo sapiens
tctgccagggacaggc

SEQ ID NO: 9077939 - DNA, 22 bp, Homo sapiens
tctgccaggcttggtgctagat

SEQ ID NO: 9077940 - DNA, 22 bp, Homo sapiens
tctgccaggtggggagaggcca

SEQ ID NO: 9077941 - DNA, 22 bp, Homo sapiens
tctgccatcttaattctctttt

SEQ ID NO: 9077942 - DNA, 22 bp, Homo sapiens
tctgccattgatgagctggcat

SEQ ID NO: 9077943 - DNA, 23 bp, Homo sapiens
tctgccagtgtgtgccaggagcc

SEQ ID NO: 9077944 - DNA, 22 bp, Homo sapiens
tctgcatggagaggagatgcta

SEQ ID NO: 9077945 - DNA, 22 bp, Homo sapiens
tctgcaggtgttggaagggtca

SEQ ID NO: 9077946 - DNA, 22 bp, Homo sapiens
tctgcatattgttaatggaatg

SEQ ID NO: 9077947 - DNA, 22 bp, Homo sapiens
tctgcatattgttaatggaatg

SEQ ID NO: 9077948 - DNA, 22 bp, Homo sapiens
tctgcaggtagagctcaggaat

SEQ ID NO: 9077949 - DNA, 22 bp, Homo sapiens
tctgcaggcttggagtggcagc

SEQ ID NO: 9077950 - DNA, 22 bp, Homo sapiens
tctgcacaccgccaggctgact

SEQ ID NO: 9077951 - DNA, 22 bp, Homo sapiens
tctgcacacttttattgacctc

SEQ ID NO: 9077952 - DNA, 22 bp, Homo sapiens
tctgcacaattgatcatggcaa

SEQ ID NO: 9077953 - DNA, 22 bp, Homo sapiens
tctgcacattttaccaatactc

SEQ ID NO: 9077954 - DNA, 22 bp, Homo sapiens
tctgcacatgtagtaaatatta

SEQ ID NO: 9077955 - DNA, 22 bp, Homo sapiens
tctgcacatcccccaaagtatt

SEQ ID NO: 9077956 - DNA, 22 bp, Homo sapiens
tctgcacatggcgctggtcctg

SEQ ID NO: 9077957 - DNA, 22 bp, Homo sapiens
tctgcacataggtaggctggaa

SEQ ID NO: 9077958 - DNA, 22 bp, Homo sapiens
tctgcacaggcgtaggttgact

SEQ ID NO: 9077959 - DNA, 21 bp, Homo sapiens
tctgcacagccccgcaggagg

SEQ ID NO: 9077960 - DNA, 22 bp, Homo sapiens
tctgcacagattctctgagaat

SEQ ID NO: 9077961 - DNA, 20 bp, Homo sapiens
tctgcagcacttgacaatgt

SEQ ID NO: 9077962 - DNA, 22 bp, Homo sapiens
tctgcaggatgcaaagtgtaca

SEQ ID NO: 9077963 - DNA, 22 bp, Homo sapiens
tctgcaggatcagagccagagg

SEQ ID NO: 9077964 - DNA, 22 bp, Homo sapiens
tctgcagcttcttgccagagag

SEQ ID NO: 9077965 - DNA, 22 bp, Homo sapiens
tctgcagcgtgcaggctggtgc

SEQ ID NO: 9077966 - DNA, 22 bp, Homo sapiens
tctgcagctttttggtggggtg

SEQ ID NO: 9077967 - DNA, 22 bp, Homo sapiens
tctgcagcttgcacaggcaggc

SEQ ID NO: 9077968 - DNA, 22 bp, Homo sapiens
tctgagcacaattacttacatc

SEQ ID NO: 9077969 - DNA, 22 bp, Homo sapiens
tctgagcaccttatattcttga

SEQ ID NO: 9077970 - DNA, 22 bp, Homo sapiens
tctgagcaccttatattcttga

SEQ ID NO: 9077971 - DNA, 22 bp, Homo sapiens
tctgagcagatgctcgctctcc

SEQ ID NO: 9077972 - DNA, 22 bp, Homo sapiens
tctgagaatggtggatgtggtg

SEQ ID NO: 9077973 - DNA, 22 bp, Homo sapiens
tctgagccaatttctgtgtcca

SEQ ID NO: 9077974 - DNA, 22 bp, Homo sapiens
tctgagcattgagctctccaaa

SEQ ID NO: 9077975 - DNA, 22 bp, Homo sapiens
tctgagcattgaattttcttcc

SEQ ID NO: 9077976 - DNA, 22 bp, Homo sapiens
tctgagcatatgcagcacctgg

SEQ ID NO: 9077977 - DNA, 22 bp, Homo sapiens
tctgagccaatttctgtgtcca

SEQ ID NO: 9077978 - DNA, 22 bp, Homo sapiens
tctgagcccagtgagtctcgca

SEQ ID NO: 9077979 - DNA, 22 bp, Homo sapiens
tctgagcccctagaactgagcg

SEQ ID NO: 9077980 - DNA, 22 bp, Homo sapiens
tctgagcccctagaactgagcg

SEQ ID NO: 9077981 - DNA, 22 bp, Homo sapiens
tctgagccataagagtacagga

SEQ ID NO: 9077982 - DNA, 22 bp, Homo sapiens
tctgagccagacaagacagcca

SEQ ID NO: 9077983 - DNA, 22 bp, Homo sapiens
tctgagccagacaagacagcca

SEQ ID NO: 9077984 - DNA, 22 bp, Homo sapiens
tctgagctgggcacagaaggcg

SEQ ID NO: 9077985 - DNA, 22 bp, Homo sapiens
tctgagctggagcccatcacct

SEQ ID NO: 9077986 - DNA, 22 bp, Homo sapiens
tctgagctggagcccatcacct

SEQ ID NO: 9077987 - DNA, 22 bp, Homo sapiens
tctgagctgggcacagaaggcg

SEQ ID NO: 9077988 - DNA, 23 bp, Homo sapiens
tctgagctgtcttttcagcagaa

SEQ ID NO: 9077989 - DNA, 22 bp, Homo sapiens
tctgagctgtggccattcttcc

SEQ ID NO: 9077990 - DNA, 22 bp, Homo sapiens
tctgagcttctgcatttccaac

SEQ ID NO: 9077991 - DNA, 21 bp, Homo sapiens
tctgagctgagtcctctaggt

SEQ ID NO: 9077992 - DNA, 22 bp, Homo sapiens
tctgagctgcagagtggggtgg

SEQ ID NO: 9077993 - DNA, 22 bp, Homo sapiens
tctgagctccatgcaggaggct

SEQ ID NO: 9077994 - DNA, 22 bp, Homo sapiens
tctgagctctatctgtgggaat

SEQ ID NO: 9077995 - DNA, 22 bp, Homo sapiens
tctgagctctatctgtgggaat

SEQ ID NO: 9077996 - DNA, 22 bp, Homo sapiens
tctgagctacgatgcctgtcac

SEQ ID NO: 9077997 - DNA, 22 bp, Homo sapiens
tctgagctagtgatttataaga

SEQ ID NO: 9077998 - DNA, 22 bp, Homo sapiens
tctgagccgtatggcttggcta

SEQ ID NO: 9077999 - DNA, 22 bp, Homo sapiens
tctgagctaatcctgttgccga

SEQ ID NO: 9078000 - DNA, 22 bp, Homo sapiens
tctgagccctcttttgcagccc

SEQ ID NO: 9078001 - DNA, 22 bp, Homo sapiens
tctgacagctccaggcagcaat

SEQ ID NO: 9078002 - DNA, 22 bp, Homo sapiens
tctgacagggccaaacatgaca

SEQ ID NO: 9078003 - DNA, 22 bp, Homo sapiens
tctgacagtcacagtggaggat

SEQ ID NO: 9078004 - DNA, 22 bp, Homo sapiens
tctgacaggtgttcttccaggc

SEQ ID NO: 9078005 - DNA, 22 bp, Homo sapiens
tctgacattttgagaatgacat

SEQ ID NO: 9078006 - DNA, 22 bp, Homo sapiens
tctgacccagatggcaccgtgg

SEQ ID NO: 9078007 - DNA, 22 bp, Homo sapiens
tctgacccgtggctctgcctcc

SEQ ID NO: 9078008 - DNA, 22 bp, Homo sapiens
tctgaccagtgagctctgaaat

SEQ ID NO: 9078009 - DNA, 22 bp, Homo sapiens
tctgacccacaagcatcctgga

SEQ ID NO: 9078010 - DNA, 22 bp, Homo sapiens
tctgagaaggaagctctgtgta

SEQ ID NO: 9078011 - DNA, 22 bp, Homo sapiens
tctgagaagcgtgtctctgttt

SEQ ID NO: 9078012 - DNA, 22 bp, Homo sapiens
tctgagaagcgtgtctctgttt

SEQ ID NO: 9078013 - DNA, 22 bp, Homo sapiens
tctgagaagcgtgtctctgttt

SEQ ID NO: 9078014 - DNA, 22 bp, Homo sapiens
tctgagaagccctgtggggagg

SEQ ID NO: 9078015 - DNA, 22 bp, Homo sapiens
tctgagaagcgggagcctgtga

SEQ ID NO: 9078016 - DNA, 17 bp, Homo sapiens
tctgagaatgctggagg

SEQ ID NO: 9078017 - DNA, 17 bp, Homo sapiens
tctgagaatgctggagg

SEQ ID NO: 9078018 - DNA, 17 bp, Homo sapiens
tctgagaatgctggagg

SEQ ID NO: 9078019 - DNA, 17 bp, Homo sapiens
tctgagaacttgaagca

SEQ ID NO: 9078020 - DNA, 22 bp, Homo sapiens
tctgagaagcaccttctggaca

SEQ ID NO: 9078021 - DNA, 22 bp, Homo sapiens
tctgagaagcaccttctggaca

SEQ ID NO: 9078022 - DNA, 21 bp, Homo sapiens
tctgagaacttctgctgcagc

SEQ ID NO: 9078023 - DNA, 21 bp, Homo sapiens
tctgagaacttctgctgcagc

SEQ ID NO: 9078024 - DNA, 22 bp, Homo sapiens
tctgagaaatcagtggtgaata

SEQ ID NO: 9078025 - DNA, 22 bp, Homo sapiens
tctgacttttctcactgttgtg

SEQ ID NO: 9078026 - DNA, 22 bp, Homo sapiens
tctgagaaagtactgtatgttc

SEQ ID NO: 9078027 - DNA, 17 bp, Homo sapiens
tctgaggcctctaggag

SEQ ID NO: 9078028 - DNA, 22 bp, Homo sapiens
tctgaggcctgaagcagcagag

SEQ ID NO: 9078029 - DNA, 22 bp, Homo sapiens
tctgaggccttcagcatgaatc

SEQ ID NO: 9078030 - DNA, 22 bp, Homo sapiens
tctgaggcctgaagcagcagag

SEQ ID NO: 9078031 - DNA, 22 bp, Homo sapiens
tctgaggccctgcaggcagtgt

SEQ ID NO: 9078032 - DNA, 22 bp, Homo sapiens
tctgaggccctgcaggcagtgt

SEQ ID NO: 9078033 - DNA, 22 bp, Homo sapiens
tctgaggcctagagaggggctt

SEQ ID NO: 9078034 - DNA, 22 bp, Homo sapiens
tctgaggctaagagacagaggc

SEQ ID NO: 9078035 - DNA, 22 bp, Homo sapiens
tctgaggctaagagacagaggc

SEQ ID NO: 9078036 - DNA, 22 bp, Homo sapiens
tctgaggctaagagacagaggc

SEQ ID NO: 9078037 - DNA, 22 bp, Homo sapiens
tctgaggccttgggacagaagt

SEQ ID NO: 9078038 - DNA, 22 bp, Homo sapiens
tctgaggccttgggacagaagt

SEQ ID NO: 9078039 - DNA, 22 bp, Homo sapiens
tctgagctttagctgggatttt

SEQ ID NO: 9078040 - DNA, 22 bp, Homo sapiens
tctgaggccctaccctgagcct

SEQ ID NO: 9078041 - DNA, 22 bp, Homo sapiens
tctgaggccctgcaggcagtgt

SEQ ID NO: 9078042 - DNA, 19 bp, Homo sapiens
tctgagggagcacgaaggc

SEQ ID NO: 9078043 - DNA, 22 bp, Homo sapiens
tctgaggcttcagactgtactg

SEQ ID NO: 9078044 - DNA, 22 bp, Homo sapiens
tctgaggctgaatggactccgt

SEQ ID NO: 9078045 - DNA, 22 bp, Homo sapiens
tctgaggctatgttcaggctaa

SEQ ID NO: 9078046 - DNA, 22 bp, Homo sapiens
tctgaggctatgttcaggctaa

SEQ ID NO: 9078047 - DNA, 20 bp, Homo sapiens
tctgaggctgagctctactt

SEQ ID NO: 9078048 - DNA, 22 bp, Homo sapiens
tctgagggtgggagaaggagct

SEQ ID NO: 9078049 - DNA, 22 bp, Homo sapiens
tctgaggggctggaagggctgc

SEQ ID NO: 9078050 - DNA, 23 bp, Homo sapiens
tctgagggagtgggcagtggcac

SEQ ID NO: 9078051 - DNA, 22 bp, Homo sapiens
tctgagggtgggagaaggagct

SEQ ID NO: 9078052 - DNA, 22 bp, Homo sapiens
tctgagggtgggagaaggagct

SEQ ID NO: 9078053 - DNA, 22 bp, Homo sapiens
tctgagggttgtagagagggac

SEQ ID NO: 9078054 - DNA, 22 bp, Homo sapiens
tctgatctgtcagtcatgaagg

SEQ ID NO: 9078055 - DNA, 22 bp, Homo sapiens
tctgaggtggggctggagcatt

SEQ ID NO: 9078056 - DNA, 22 bp, Homo sapiens
tctgcaagcgtcacatgattct

SEQ ID NO: 9078057 - DNA, 22 bp, Homo sapiens
tctgcaagatcattaaagcaga

SEQ ID NO: 9078058 - DNA, 23 bp, Homo sapiens
tctgcaagataatgaagatgata

SEQ ID NO: 9078059 - DNA, 22 bp, Homo sapiens
tctgcaacattcctctccccac

SEQ ID NO: 9078060 - DNA, 22 bp, Homo sapiens
tctgcaacattcctctccccac

SEQ ID NO: 9078061 - DNA, 22 bp, Homo sapiens
tctgcaacattcctctccccac

SEQ ID NO: 9078062 - DNA, 22 bp, Homo sapiens
tctgcaacagtgccctgtaaat

SEQ ID NO: 9078063 - DNA, 22 bp, Homo sapiens
tctgcaaactggctcttactgc

SEQ ID NO: 9078064 - DNA, 22 bp, Homo sapiens
tctgatttactggaaaaaagga

SEQ ID NO: 9078065 - DNA, 22 bp, Homo sapiens
tctgatttctcttgtggatgct

SEQ ID NO: 9078066 - DNA, 22 bp, Homo sapiens
tctgatttctcttgtggatgct

SEQ ID NO: 9078067 - DNA, 22 bp, Homo sapiens
ttccaggaacaaactcacctta

SEQ ID NO: 9078068 - DNA, 22 bp, Homo sapiens
ttccaggaaaacagttggaagt

SEQ ID NO: 9078069 - DNA, 22 bp, Homo sapiens
acttatagccagaattaattat

SEQ ID NO: 9078070 - DNA, 22 bp, Homo sapiens
acttataagagtgctatgggga

SEQ ID NO: 9078071 - DNA, 20 bp, Homo sapiens
acttagtgtagggttcctag

SEQ ID NO: 9078072 - DNA, 22 bp, Homo sapiens
acttagtggctatgtgacctta

SEQ ID NO: 9078073 - DNA, 22 bp, Homo sapiens
acttagcaggtggtgactcgaa

SEQ ID NO: 9078074 - DNA, 22 bp, Homo sapiens
acttagcattatgtaattacta

SEQ ID NO: 9078075 - DNA, 22 bp, Homo sapiens
acttagcagtttagaatatgtc

SEQ ID NO: 9078076 - DNA, 22 bp, Homo sapiens
acttagcattatgtaattacta

SEQ ID NO: 9078077 - DNA, 22 bp, Homo sapiens
acttagtgccctggcccttaca

SEQ ID NO: 9078078 - DNA, 22 bp, Homo sapiens
acttagcaatttgattaaaaga

SEQ ID NO: 9078079 - DNA, 22 bp, Homo sapiens
acttagcaaatcttttggattc

SEQ ID NO: 9078080 - DNA, 22 bp, Homo sapiens
acttagcacctatggcattttt

SEQ ID NO: 9078081 - DNA, 22 bp, Homo sapiens
acttagcaatttgattaaaaga

SEQ ID NO: 9078082 - DNA, 22 bp, Homo sapiens
acttagcacgaacatttacttt

SEQ ID NO: 9078083 - DNA, 22 bp, Homo sapiens
acttagcacgaacatttacttt

SEQ ID NO: 9078084 - DNA, 22 bp, Homo sapiens
acttagcagagttgaatgtact

SEQ ID NO: 9078085 - DNA, 22 bp, Homo sapiens
acttagcaggtactttcatatt

SEQ ID NO: 9078086 - DNA, 22 bp, Homo sapiens
acttagcagagttgaatgtact

SEQ ID NO: 9078087 - DNA, 22 bp, Homo sapiens
acttagcagagtgagttgacta

SEQ ID NO: 9078088 - DNA, 22 bp, Homo sapiens
acttccagggtagaggggaaga

SEQ ID NO: 9078089 - DNA, 16 bp, Homo sapiens
acttccaggggagccc

SEQ ID NO: 9078090 - DNA, 22 bp, Homo sapiens
acttccaggaggtgtcactgaa

SEQ ID NO: 9078091 - DNA, 22 bp, Homo sapiens
acttatcagttgtctctaatgt

SEQ ID NO: 9078092 - DNA, 22 bp, Homo sapiens
acttattagacatcttcattgt

SEQ ID NO: 9078093 - DNA, 22 bp, Homo sapiens
aatatcagctctgtcacttact

SEQ ID NO: 9078094 - DNA, 22 bp, Homo sapiens
aatatcttctaaggatagaact

SEQ ID NO: 9078095 - DNA, 19 bp, Homo sapiens
acttcctgcccgctccttt

SEQ ID NO: 9078096 - DNA, 19 bp, Homo sapiens
acttcctgcccgctccttt

SEQ ID NO: 9078097 - DNA, 22 bp, Homo sapiens
aatatcttggcccaactccaga

SEQ ID NO: 9078098 - DNA, 22 bp, Homo sapiens
aatatgacatagaattgagatg

SEQ ID NO: 9078099 - DNA, 22 bp, Homo sapiens
aatatgaattattgttacaagt

SEQ ID NO: 9078100 - DNA, 23 bp, Homo sapiens
acttccagttataggaactcttc

SEQ ID NO: 9078101 - DNA, 22 bp, Homo sapiens
acttcccaacgtgggcctccca

SEQ ID NO: 9078102 - DNA, 22 bp, Homo sapiens
acttcctgaatggggctaatta

SEQ ID NO: 9078103 - DNA, 22 bp, Homo sapiens
acttcctgacttctgggttgga

SEQ ID NO: 9078104 - DNA, 22 bp, Homo sapiens
acttccctgtgggcaggtagtg

SEQ ID NO: 9078105 - DNA, 22 bp, Homo sapiens
acttccctgtgggcaggtagtg

SEQ ID NO: 9078106 - DNA, 22 bp, Homo sapiens
aataacagggttgatttgcaat

SEQ ID NO: 9078107 - DNA, 21 bp, Homo sapiens
aataaccactaatatagtggc

SEQ ID NO: 9078108 - DNA, 21 bp, Homo sapiens
aataaccactaatatagtggc

SEQ ID NO: 9078109 - DNA, 19 bp, Homo sapiens
actgtgctcgggaaccact

SEQ ID NO: 9078110 - DNA, 22 bp, Homo sapiens
actgtgctttctctggaggcat

SEQ ID NO: 9078111 - DNA, 22 bp, Homo sapiens
actgtgctggcaatgactcagg

SEQ ID NO: 9078112 - DNA, 22 bp, Homo sapiens
actgtgggacatccctccctat

SEQ ID NO: 9078113 - DNA, 22 bp, Homo sapiens
actgtgggaaccactgaatcag

SEQ ID NO: 9078114 - DNA, 22 bp, Homo sapiens
aatacttgtcagatgaataaga

SEQ ID NO: 9078115 - DNA, 22 bp, Homo sapiens
aatacttgtcagatgaataaga

SEQ ID NO: 9078116 - DNA, 22 bp, Homo sapiens
aatacttgtcagatgaataaga

SEQ ID NO: 9078117 - DNA, 22 bp, Homo sapiens
aatacttgtgaattcaaagtct

SEQ ID NO: 9078118 - DNA, 22 bp, Homo sapiens
aatagaaaggaggggctcttgt

SEQ ID NO: 9078119 - DNA, 22 bp, Homo sapiens
aatagaaaggaggggctcttgt

SEQ ID NO: 9078120 - DNA, 22 bp, Homo sapiens
aatactttgccaagttcgaaga

SEQ ID NO: 9078121 - DNA, 22 bp, Homo sapiens
aatactttgccaagttcgaaga

SEQ ID NO: 9078122 - DNA, 22 bp, Homo sapiens
aatactttcctatataaggtgc

SEQ ID NO: 9078123 - DNA, 22 bp, Homo sapiens
aatactttcctatataaggtgc

SEQ ID NO: 9078124 - DNA, 22 bp, Homo sapiens
aatactgtaaatggagcagcca

SEQ ID NO: 9078125 - DNA, 22 bp, Homo sapiens
aatactgtctttcacagatatt

SEQ ID NO: 9078126 - DNA, 22 bp, Homo sapiens
actgtggggtgcgaggcagtga

SEQ ID NO: 9078127 - DNA, 21 bp, Homo sapiens
actgtggggttcaactggcag

SEQ ID NO: 9078128 - DNA, 17 bp, Homo sapiens
aatactgcttatccagg

SEQ ID NO: 9078129 - DNA, 22 bp, Homo sapiens
aatactgctgctgctgaaatca

SEQ ID NO: 9078130 - DNA, 22 bp, Homo sapiens
actgtggggggctttgctcagt

SEQ ID NO: 9078131 - DNA, 22 bp, Homo sapiens
actgtggggtgaggcccaagaa

SEQ ID NO: 9078132 - DNA, 22 bp, Homo sapiens
actgtgggggagccagtcccat

SEQ ID NO: 9078133 - DNA, 22 bp, Homo sapiens
actgtgggcctttcctttgacc

SEQ ID NO: 9078134 - DNA, 22 bp, Homo sapiens
actgtgggccattgggttctgt

SEQ ID NO: 9078135 - DNA, 22 bp, Homo sapiens
actgtgggagcgcagtggcagc

SEQ ID NO: 9078136 - DNA, 22 bp, Homo sapiens
actgtgggagcttatcatttca

SEQ ID NO: 9078137 - DNA, 22 bp, Homo sapiens
actgtgggcagcttctgggaac

SEQ ID NO: 9078138 - DNA, 23 bp, Homo sapiens
actgtgggcaccacagagagtgt

SEQ ID NO: 9078139 - DNA, 22 bp, Homo sapiens
agaaaactgggaggagagcttc

SEQ ID NO: 9078140 - DNA, 22 bp, Homo sapiens
agaaaataatttcttggctggt

SEQ ID NO: 9078141 - DNA, 22 bp, Homo sapiens
agaaaactggagcctggggttg

SEQ ID NO: 9078142 - DNA, 22 bp, Homo sapiens
aatattcaagttattctttctt

SEQ ID NO: 9078143 - DNA, 22 bp, Homo sapiens
agaaaactggagcctggggttg

SEQ ID NO: 9078144 - DNA, 22 bp, Homo sapiens
agaaaataatttcttggctggt

SEQ ID NO: 9078145 - DNA, 22 bp, Homo sapiens
agaaaatattcattgagaggct

SEQ ID NO: 9078146 - DNA, 22 bp, Homo sapiens
agaaaatattcattgagaggct

SEQ ID NO: 9078147 - DNA, 22 bp, Homo sapiens
agaaaatattcattgagaggct

SEQ ID NO: 9078148 - DNA, 21 bp, Homo sapiens
agaaaatggcgttttagattt

SEQ ID NO: 9078149 - DNA, 22 bp, Homo sapiens
agaaacctccatttattcactc

SEQ ID NO: 9078150 - DNA, 22 bp, Homo sapiens
agaaaccatctttatatatctg

SEQ ID NO: 9078151 - DNA, 20 bp, Homo sapiens
agaaaatgttttcagctgga

SEQ ID NO: 9078152 - DNA, 20 bp, Homo sapiens
agaaaatgttttcagctgga

SEQ ID NO: 9078153 - DNA, 22 bp, Homo sapiens
agaaaatgtgaacttgtgaatt

SEQ ID NO: 9078154 - DNA, 22 bp, Homo sapiens
agaaaatgtgaacttgtgaatt

SEQ ID NO: 9078155 - DNA, 22 bp, Homo sapiens
aatatgttccacttaaagctgg

SEQ ID NO: 9078156 - DNA, 22 bp, Homo sapiens
aatatgttccacttaaagctgg

SEQ ID NO: 9078157 - DNA, 22 bp, Homo sapiens
aatatgttcaaaatagatcact

SEQ ID NO: 9078158 - DNA, 22 bp, Homo sapiens
aatatgttcaaaatagatcact

SEQ ID NO: 9078159 - DNA, 22 bp, Homo sapiens
aatatgttcaaaatagatcact

SEQ ID NO: 9078160 - DNA, 22 bp, Homo sapiens
aatatgttcaaaatagatcact

SEQ ID NO: 9078161 - DNA, 22 bp, Homo sapiens
aatatgtttataagatatcttc

SEQ ID NO: 9078162 - DNA, 22 bp, Homo sapiens
aatattatcaaaagctttttca

SEQ ID NO: 9078163 - DNA, 22 bp, Homo sapiens
aatattatacagtcaacctctt

SEQ ID NO: 9078164 - DNA, 20 bp, Homo sapiens
aatatgctgggagtttatat

SEQ ID NO: 9078165 - DNA, 22 bp, Homo sapiens
aatatgcatgtatacatgtgta

SEQ ID NO: 9078166 - DNA, 22 bp, Homo sapiens
aatatgcagcttatcttctagg

SEQ ID NO: 9078167 - DNA, 22 bp, Homo sapiens
aatatggctccattcctttagg

SEQ ID NO: 9078168 - DNA, 22 bp, Homo sapiens
aatatgatgccaaattgctaca

SEQ ID NO: 9078169 - DNA, 22 bp, Homo sapiens
aatatgcaaagcgtgttatctg

SEQ ID NO: 9078170 - DNA, 22 bp, Homo sapiens
aatatgcactctgatttagcag

SEQ ID NO: 9078171 - DNA, 22 bp, Homo sapiens
aatatgcagcatgatgaagtaa

SEQ ID NO: 9078172 - DNA, 22 bp, Homo sapiens
agaaactattatggtaaacaaa

SEQ ID NO: 9078173 - DNA, 22 bp, Homo sapiens
agaaactatcctgagtagcaaa

SEQ ID NO: 9078174 - DNA, 22 bp, Homo sapiens
agaaactacttggaggaaagat

SEQ ID NO: 9078175 - DNA, 22 bp, Homo sapiens
agaaactatcctgagtagcaaa

SEQ ID NO: 9078176 - DNA, 22 bp, Homo sapiens
agaaacgcctgtgaaattatct

SEQ ID NO: 9078177 - DNA, 22 bp, Homo sapiens
aatcttcactcattcagagttg

SEQ ID NO: 9078178 - DNA, 22 bp, Homo sapiens
aatctttttcacaagaaagcac

SEQ ID NO: 9078179 - DNA, 22 bp, Homo sapiens
aatctttttcacaagaaagcac

SEQ ID NO: 9078180 - DNA, 22 bp, Homo sapiens
aatcttttgattctagggctgt

SEQ ID NO: 9078181 - DNA, 22 bp, Homo sapiens
aatcttttaggggatcctgagg

SEQ ID NO: 9078182 - DNA, 22 bp, Homo sapiens
aatcttctttcttaacagtaca

SEQ ID NO: 9078183 - DNA, 22 bp, Homo sapiens
aatcttcattttgacaagattc

SEQ ID NO: 9078184 - DNA, 22 bp, Homo sapiens
aagtgatgctacgactttgaca

SEQ ID NO: 9078185 - DNA, 22 bp, Homo sapiens
aagtgatgctacgactttgaca

SEQ ID NO: 9078186 - DNA, 22 bp, Homo sapiens
aagtgatacgtgtttatttcca

SEQ ID NO: 9078187 - DNA, 22 bp, Homo sapiens
aagtgactatttgagtacatca

SEQ ID NO: 9078188 - DNA, 22 bp, Homo sapiens
aagtgagtgaaaatgcagaata

SEQ ID NO: 9078189 - DNA, 22 bp, Homo sapiens
aagtgatacatctagtctataa

SEQ ID NO: 9078190 - DNA, 22 bp, Homo sapiens
aagtgagttcagcattcactcg

SEQ ID NO: 9078191 - DNA, 22 bp, Homo sapiens
aagtgatttagtcttataaagg

SEQ ID NO: 9078192 - DNA, 22 bp, Homo sapiens
aagtgattctagtcatgattct

SEQ ID NO: 9078193 - DNA, 22 bp, Homo sapiens
aagtgatttagtcttataaagg

SEQ ID NO: 9078194 - DNA, 22 bp, Homo sapiens
aagtgcaaatctgtggctgaaa

SEQ ID NO: 9078195 - DNA, 22 bp, Homo sapiens
aagtgcaatttgaaattctgca

SEQ ID NO: 9078196 - DNA, 22 bp, Homo sapiens
aagtgcaatttgaaattctgca

SEQ ID NO: 9078197 - DNA, 22 bp, Homo sapiens
aagtgcaatttgaaattctgca

SEQ ID NO: 9078198 - DNA, 21 bp, Homo sapiens
aagtgcaagatgcgcgcttgc

SEQ ID NO: 9078199 - DNA, 22 bp, Homo sapiens
aagtgcaagcaggacttagttt

SEQ ID NO: 9078200 - DNA, 22 bp, Homo sapiens
aagtgcaagatcaaggtgtcag

SEQ ID NO: 9078201 - DNA, 22 bp, Homo sapiens
aagtgcaaatttaagaaggcat

SEQ ID NO: 9078202 - DNA, 22 bp, Homo sapiens
aagtgcaatgaatagctgcaat

SEQ ID NO: 9078203 - DNA, 23 bp, Homo sapiens
aagtgcaagtgaaaggcacagtt

SEQ ID NO: 9078204 - DNA, 22 bp, Homo sapiens
accttgtcttttatagaacaag

SEQ ID NO: 9078205 - DNA, 20 bp, Homo sapiens
accttgggtgagtgacggtc

SEQ ID NO: 9078206 - DNA, 22 bp, Homo sapiens
accttgtccatcccaggccctc

SEQ ID NO: 9078207 - DNA, 22 bp, Homo sapiens
aagtgaaattgccattcttata

SEQ ID NO: 9078208 - DNA, 22 bp, Homo sapiens
aagtgaatctcctttctttatt

SEQ ID NO: 9078209 - DNA, 22 bp, Homo sapiens
aagtgaatttcattccaattct

SEQ ID NO: 9078210 - DNA, 22 bp, Homo sapiens
aagtgaatttcattccaattct

SEQ ID NO: 9078211 - DNA, 22 bp, Homo sapiens
aagtgacataccttacatatgt

SEQ ID NO: 9078212 - DNA, 22 bp, Homo sapiens
accttggcagtttctacctttt

SEQ ID NO: 9078213 - DNA, 23 bp, Homo sapiens
accttggacttcccagcttccag

SEQ ID NO: 9078214 - DNA, 22 bp, Homo sapiens
accttctgaccagttatcttga

SEQ ID NO: 9078215 - DNA, 19 bp, Homo sapiens
accttctgggaaacattcc

SEQ ID NO: 9078216 - DNA, 22 bp, Homo sapiens
accttctggtctgcctgacagc

SEQ ID NO: 9078217 - DNA, 22 bp, Homo sapiens
accttgaacccagcttgctgca

SEQ ID NO: 9078218 - DNA, 20 bp, Homo sapiens
acctgggaaaaccttttcct

SEQ ID NO: 9078219 - DNA, 22 bp, Homo sapiens
acctgggaggcagaggttgcag

SEQ ID NO: 9078220 - DNA, 22 bp, Homo sapiens
acctgggaggcggaggttgcag

SEQ ID NO: 9078221 - DNA, 22 bp, Homo sapiens
acctgggatggggccaggttta

SEQ ID NO: 9078222 - DNA, 22 bp, Homo sapiens
acctgggagtatgcagtggtga

SEQ ID NO: 9078223 - DNA, 21 bp, Homo sapiens
aagtaaatcagagaaataacc

SEQ ID NO: 9078224 - DNA, 22 bp, Homo sapiens
aagtaaatatctgtttatagca

SEQ ID NO: 9078225 - DNA, 21 bp, Homo sapiens
aagtaaatcagagaaataacc

SEQ ID NO: 9078226 - DNA, 22 bp, Homo sapiens
aagtaaacttacacatagtaaa

SEQ ID NO: 9078227 - DNA, 22 bp, Homo sapiens
aagtaaaccacagagaagccac

SEQ ID NO: 9078228 - DNA, 22 bp, Homo sapiens
aagtaaaattcaatcttcactg

SEQ ID NO: 9078229 - DNA, 22 bp, Homo sapiens
aagtaaacttacacatagtaaa

SEQ ID NO: 9078230 - DNA, 22 bp, Homo sapiens
aagtaaatatctgtttatagca

SEQ ID NO: 9078231 - DNA, 18 bp, Homo sapiens
aagtaacagaagagcaca

SEQ ID NO: 9078232 - DNA, 18 bp, Homo sapiens
acctgcctgttcttctct

SEQ ID NO: 9078233 - DNA, 18 bp, Homo sapiens
acctgcctgttcttctct

SEQ ID NO: 9078234 - DNA, 22 bp, Homo sapiens
acctgcctctaagcagcaggtg

SEQ ID NO: 9078235 - DNA, 22 bp, Homo sapiens
aagtggctttgagcttctgcca

SEQ ID NO: 9078236 - DNA, 22 bp, Homo sapiens
aagtgggaatagaaatgaaggt

SEQ ID NO: 9078237 - DNA, 22 bp, Homo sapiens
aagtttgtagctggatgtctgt

SEQ ID NO: 9078238 - DNA, 22 bp, Homo sapiens
aagtttggggagaatttcattt

SEQ ID NO: 9078239 - DNA, 22 bp, Homo sapiens
aagtggctcatgtggcttctgc

SEQ ID NO: 9078240 - DNA, 22 bp, Homo sapiens
aagtggcagaatagtggcagga

SEQ ID NO: 9078241 - DNA, 22 bp, Homo sapiens
aagtggcagttcaggaagcaga

SEQ ID NO: 9078242 - DNA, 22 bp, Homo sapiens
aagtttgttcattcattcatcc

SEQ ID NO: 9078243 - DNA, 22 bp, Homo sapiens
aagtttgttcattcattcatcc

SEQ ID NO: 9078244 - DNA, 22 bp, Homo sapiens
aagtttgtggttatacttgatt

SEQ ID NO: 9078245 - DNA, 22 bp, Homo sapiens
aagtttgtcgaaattatcagca

SEQ ID NO: 9078246 - DNA, 22 bp, Homo sapiens
aagttttactgaggacacatgt

SEQ ID NO: 9078247 - DNA, 22 bp, Homo sapiens
actcagtgaattttcatcaaat

SEQ ID NO: 9078248 - DNA, 23 bp, Homo sapiens
actcagtgagggccttgggctgc

SEQ ID NO: 9078249 - DNA, 23 bp, Homo sapiens
actcagtgaagcaaacagatagt

SEQ ID NO: 9078250 - DNA, 22 bp, Homo sapiens
actcagagcagagcagcctgag

SEQ ID NO: 9078251 - DNA, 22 bp, Homo sapiens
actcagtatacaccagtatagg

SEQ ID NO: 9078252 - DNA, 23 bp, Homo sapiens
actcagagaccccgggaagtgac

SEQ ID NO: 9078253 - DNA, 23 bp, Homo sapiens
actcagagaccccgggaagtgac

SEQ ID NO: 9078254 - DNA, 22 bp, Homo sapiens
actcagagatatggtggttgat

SEQ ID NO: 9078255 - DNA, 22 bp, Homo sapiens
actcagtggcactttggaattt

SEQ ID NO: 9078256 - DNA, 22 bp, Homo sapiens
actcagtgggcttgatgtcgaa

SEQ ID NO: 9078257 - DNA, 22 bp, Homo sapiens
actcatatactgttgtttttaa

SEQ ID NO: 9078258 - DNA, 22 bp, Homo sapiens
actcatgtcctaggagtaaagc

SEQ ID NO: 9078259 - DNA, 22 bp, Homo sapiens
aagtggagtccctacaaccagc

SEQ ID NO: 9078260 - DNA, 22 bp, Homo sapiens
aataacagagtcttcaagatag

SEQ ID NO: 9078261 - DNA, 22 bp, Homo sapiens
aataaatgtttgttggatgttt

SEQ ID NO: 9078262 - DNA, 22 bp, Homo sapiens
aataaatgtttgttggatgttt

SEQ ID NO: 9078263 - DNA, 22 bp, Homo sapiens
aataaatgttaagattgtctca

SEQ ID NO: 9078264 - DNA, 22 bp, Homo sapiens
aataaatgaacaaagcaggttg

SEQ ID NO: 9078265 - DNA, 22 bp, Homo sapiens
aataaagaatggatgagatcgt

SEQ ID NO: 9078266 - DNA, 22 bp, Homo sapiens
aataaagacaaacaggggagcc

SEQ ID NO: 9078267 - DNA, 22 bp, Homo sapiens
aataaagacaaacaggggagcc

SEQ ID NO: 9078268 - DNA, 22 bp, Homo sapiens
aataaagactcagaggcccagg

SEQ ID NO: 9078269 - DNA, 22 bp, Homo sapiens
aataaagaatggatgagatcgt

SEQ ID NO: 9078270 - DNA, 22 bp, Homo sapiens
aataaagaatggatgagatcgt

SEQ ID NO: 9078271 - DNA, 22 bp, Homo sapiens
actgagaaatagcaagtgtctc

SEQ ID NO: 9078272 - DNA, 22 bp, Homo sapiens
actgagaatacaatgttgcagg

SEQ ID NO: 9078273 - DNA, 22 bp, Homo sapiens
actgagaagtcaggttctcttc

SEQ ID NO: 9078274 - DNA, 22 bp, Homo sapiens
actgagaagctcgcagtgatgc

SEQ ID NO: 9078275 - DNA, 22 bp, Homo sapiens
aataaaatggtcagttttctca

SEQ ID NO: 9078276 - DNA, 22 bp, Homo sapiens
acagtgtcatgtcgtgttcccc

SEQ ID NO: 9078277 - DNA, 18 bp, Homo sapiens
acagtggtttgatgtgct

SEQ ID NO: 9078278 - DNA, 20 bp, Homo sapiens
acagtgggtggggagcactg

SEQ ID NO: 9078279 - DNA, 20 bp, Homo sapiens
acagtgggtggggagcactg

SEQ ID NO: 9078280 - DNA, 20 bp, Homo sapiens
acagtgggtggggagcactg

SEQ ID NO: 9078281 - DNA, 22 bp, Homo sapiens
acagtgctaatgatgccaagat

SEQ ID NO: 9078282 - DNA, 22 bp, Homo sapiens
acaggtgtgagaacatgccttg

SEQ ID NO: 9078283 - DNA, 22 bp, Homo sapiens
acaggtgtcctcacagggggtg

SEQ ID NO: 9078284 - DNA, 22 bp, Homo sapiens
acagtgccctatgaacagctct

SEQ ID NO: 9078285 - DNA, 22 bp, Homo sapiens
acagtgcattattgctgaatgc

SEQ ID NO: 9078286 - DNA, 22 bp, Homo sapiens
acagtgcattattgctgaatgc

SEQ ID NO: 9078287 - DNA, 22 bp, Homo sapiens
acagtgcattattgctgaatgc

SEQ ID NO: 9078288 - DNA, 20 bp, Homo sapiens
acagtgcatggggggacagc

SEQ ID NO: 9078289 - DNA, 20 bp, Homo sapiens
acagtgcatggggggacagc

SEQ ID NO: 9078290 - DNA, 19 bp, Homo sapiens
acagtgcatgggacctggt

SEQ ID NO: 9078291 - DNA, 22 bp, Homo sapiens
acagtgcataaaaacaactttt

SEQ ID NO: 9078292 - DNA, 19 bp, Homo sapiens
acagtgcatgggacctggt

SEQ ID NO: 9078293 - DNA, 22 bp, Homo sapiens
acagtgcaggtctcaacaatta

SEQ ID NO: 9078294 - DNA, 22 bp, Homo sapiens
acagtgcaggtctcaacaatta

SEQ ID NO: 9078295 - DNA, 22 bp, Homo sapiens
acagtgcagtgtgatgagtatt

SEQ ID NO: 9078296 - DNA, 22 bp, Homo sapiens
acagtgcataaaaacaactttt

SEQ ID NO: 9078297 - DNA, 22 bp, Homo sapiens
acagtgcagtgtgatgagtatt

SEQ ID NO: 9078298 - DNA, 22 bp, Homo sapiens
acaggtcaacgagagcaggcaa

SEQ ID NO: 9078299 - DNA, 22 bp, Homo sapiens
acaggtctccagagtgagagga

SEQ ID NO: 9078300 - DNA, 22 bp, Homo sapiens
acaggtctgcagtaactgggaa

SEQ ID NO: 9078301 - DNA, 22 bp, Homo sapiens
acaggtctactggcaagcagtg

SEQ ID NO: 9078302 - DNA, 22 bp, Homo sapiens
acaggtctggtctgggtgggac

SEQ ID NO: 9078303 - DNA, 22 bp, Homo sapiens
acaggtctgtgtgcacagtgct

SEQ ID NO: 9078304 - DNA, 22 bp, Homo sapiens
acaggtaccggtcagattacgg

SEQ ID NO: 9078305 - DNA, 22 bp, Homo sapiens
acaggtactttgtaatgaagga

SEQ ID NO: 9078306 - DNA, 23 bp, Homo sapiens
acaggtacacttgattgcaatcc

SEQ ID NO: 9078307 - DNA, 21 bp, Homo sapiens
acaggctttagaaaatgactc

SEQ ID NO: 9078308 - DNA, 21 bp, Homo sapiens
acaggctttagaaaatgactc

SEQ ID NO: 9078309 - DNA, 22 bp, Homo sapiens
acaggcttttttagaatgacat

SEQ ID NO: 9078310 - DNA, 22 bp, Homo sapiens
acaggctgagcgtccatcttca

SEQ ID NO: 9078311 - DNA, 22 bp, Homo sapiens
acaggctgaggatgattgcatc

SEQ ID NO: 9078312 - DNA, 22 bp, Homo sapiens
acaggctgaggatgattgcatc

SEQ ID NO: 9078313 - DNA, 22 bp, Homo sapiens
acaggctgaaagttaagttctg

SEQ ID NO: 9078314 - DNA, 22 bp, Homo sapiens
acaggctgacttcctgccatgt

SEQ ID NO: 9078315 - DNA, 22 bp, Homo sapiens
acaggctgacttcctgccatgt

SEQ ID NO: 9078316 - DNA, 22 bp, Homo sapiens
acaggctgccacttgcatccaa

SEQ ID NO: 9078317 - DNA, 22 bp, Homo sapiens
acaggctgatagaccataaata

SEQ ID NO: 9078318 - DNA, 22 bp, Homo sapiens
acaggctgccacttgcatccaa

SEQ ID NO: 9078319 - DNA, 22 bp, Homo sapiens
acaggcttacaggctgcaagta

SEQ ID NO: 9078320 - DNA, 22 bp, Homo sapiens
acaggcttctcacagaaaaggg

SEQ ID NO: 9078321 - DNA, 22 bp, Homo sapiens
acaggcttggggctcagacaga

SEQ ID NO: 9078322 - DNA, 22 bp, Homo sapiens
acaggcagagaactcagccaga

SEQ ID NO: 9078323 - DNA, 22 bp, Homo sapiens
acaggcagagagtggcggactc

SEQ ID NO: 9078324 - DNA, 22 bp, Homo sapiens
acaggcagagagtggcggactc

SEQ ID NO: 9078325 - DNA, 22 bp, Homo sapiens
aagccctgagcactgcagagaa

SEQ ID NO: 9078326 - DNA, 22 bp, Homo sapiens
aagccctgagcactgcagagaa

SEQ ID NO: 9078327 - DNA, 22 bp, Homo sapiens
aagccctgagcactgcagagaa

SEQ ID NO: 9078328 - DNA, 22 bp, Homo sapiens
aagccctgacctgagagtccgt

SEQ ID NO: 9078329 - DNA, 22 bp, Homo sapiens
aagccctgactatgaagacata

SEQ ID NO: 9078330 - DNA, 22 bp, Homo sapiens
aagccctgactatgaagacata

SEQ ID NO: 9078331 - DNA, 22 bp, Homo sapiens
aagccctgccacccattcactg

SEQ ID NO: 9078332 - DNA, 22 bp, Homo sapiens
aagccctgcagtctctgccaca

SEQ ID NO: 9078333 - DNA, 22 bp, Homo sapiens
aagccctgcagtctctgccaca

SEQ ID NO: 9078334 - DNA, 22 bp, Homo sapiens
aagccctgcagtctctgccaca

SEQ ID NO: 9078335 - DNA, 22 bp, Homo sapiens
aagccctgataggaaaatgctg

SEQ ID NO: 9078336 - DNA, 22 bp, Homo sapiens
aagccctgataggaaaatgctg

SEQ ID NO: 9078337 - DNA, 22 bp, Homo sapiens
aagccctggctcagctcaccag

SEQ ID NO: 9078338 - DNA, 22 bp, Homo sapiens
aagccctggctcagctcaccag

SEQ ID NO: 9078339 - DNA, 22 bp, Homo sapiens
aagccctggcgggtggagggcc

SEQ ID NO: 9078340 - DNA, 22 bp, Homo sapiens
aagccctggcgggtggagggcc

SEQ ID NO: 9078341 - DNA, 22 bp, Homo sapiens
aagccctggcccaaccttgatt

SEQ ID NO: 9078342 - DNA, 22 bp, Homo sapiens
aagccctggcgggtggagggcc

SEQ ID NO: 9078343 - DNA, 22 bp, Homo sapiens
aagccctggcccaaccttgatt

SEQ ID NO: 9078344 - DNA, 22 bp, Homo sapiens
aagccctggcaatgtcagatga

SEQ ID NO: 9078345 - DNA, 22 bp, Homo sapiens
aagccctggcaatgtcagatga

SEQ ID NO: 9078346 - DNA, 22 bp, Homo sapiens
aagccctggcaatgtcagatga

SEQ ID NO: 9078347 - DNA, 22 bp, Homo sapiens
aagccctggcaatgtcagatga

SEQ ID NO: 9078348 - DNA, 22 bp, Homo sapiens
aagccctggattaaagatgcca

SEQ ID NO: 9078349 - DNA, 22 bp, Homo sapiens
aagccctggatagagagaactg

SEQ ID NO: 9078350 - DNA, 22 bp, Homo sapiens
aagccctggattaaagatgcca

SEQ ID NO: 9078351 - DNA, 22 bp, Homo sapiens
aagccctggattaaagatgcca

SEQ ID NO: 9078352 - DNA, 22 bp, Homo sapiens
aagccctggattaaagatgcca

SEQ ID NO: 9078353 - DNA, 22 bp, Homo sapiens
aagccctgccacccattcactg

SEQ ID NO: 9078354 - DNA, 22 bp, Homo sapiens
aagccctggaactttcctagcc

SEQ ID NO: 9078355 - DNA, 22 bp, Homo sapiens
aagccctggaactttcctagcc

SEQ ID NO: 9078356 - DNA, 22 bp, Homo sapiens
aagccctggacggcccttcccc

SEQ ID NO: 9078357 - DNA, 22 bp, Homo sapiens
aagccctggatagagagaactg

SEQ ID NO: 9078358 - DNA, 22 bp, Homo sapiens
aagccctggacggcccttcccc

SEQ ID NO: 9078359 - DNA, 20 bp, Homo sapiens
acaggagatctgaggaaagg

SEQ ID NO: 9078360 - DNA, 20 bp, Homo sapiens
acaggagatctgaggaaagg

SEQ ID NO: 9078361 - DNA, 22 bp, Homo sapiens
acaggagcaacagactaagaca

SEQ ID NO: 9078362 - DNA, 22 bp, Homo sapiens
acaggagccaaacacatgccag

SEQ ID NO: 9078363 - DNA, 22 bp, Homo sapiens
acaggagctctagggacagcac

SEQ ID NO: 9078364 - DNA, 19 bp, Homo sapiens
acaggcagaattgggtgtg

SEQ ID NO: 9078365 - DNA, 19 bp, Homo sapiens
acaggcagaattgggtgtg

SEQ ID NO: 9078366 - DNA, 22 bp, Homo sapiens
acaggaggagctgtttcaggga

SEQ ID NO: 9078367 - DNA, 22 bp, Homo sapiens
acaggcactgtcaagtcatgaa

SEQ ID NO: 9078368 - DNA, 22 bp, Homo sapiens
acaggaaagagctaggcatagg

SEQ ID NO: 9078369 - DNA, 22 bp, Homo sapiens
acaggaaattggcatatcagtt

SEQ ID NO: 9078370 - DNA, 22 bp, Homo sapiens
acagatgaggaaacagggtcag

SEQ ID NO: 9078371 - DNA, 20 bp, Homo sapiens
acagatgaggaaaatgaagt

SEQ ID NO: 9078372 - DNA, 20 bp, Homo sapiens
acagatgaggaaaatgaagt

SEQ ID NO: 9078373 - DNA, 22 bp, Homo sapiens
acagatgagagacaatgtgcta

SEQ ID NO: 9078374 - DNA, 22 bp, Homo sapiens
acagatgaggaaacagggtcag

SEQ ID NO: 9078375 - DNA, 22 bp, Homo sapiens
acagatgaggaagagtcagcca

SEQ ID NO: 9078376 - DNA, 22 bp, Homo sapiens
acagatttaggactgtagcgat

SEQ ID NO: 9078377 - DNA, 22 bp, Homo sapiens
acagatttggcccagccaatgc

SEQ ID NO: 9078378 - DNA, 22 bp, Homo sapiens
acagattttaaatgacactccc

SEQ ID NO: 9078379 - DNA, 22 bp, Homo sapiens
acagatttattgaagctgctgc

SEQ ID NO: 9078380 - DNA, 22 bp, Homo sapiens
acagatttgactggtacctggc

SEQ ID NO: 9078381 - DNA, 22 bp, Homo sapiens
acagattttggtatttgcaatg

SEQ ID NO: 9078382 - DNA, 22 bp, Homo sapiens
acagatttttggtaaataattt

SEQ ID NO: 9078383 - DNA, 22 bp, Homo sapiens
acagctggagtgttggtgaggt

SEQ ID NO: 9078384 - DNA, 22 bp, Homo sapiens
acagcttcttgtttcccaggag

SEQ ID NO: 9078385 - DNA, 22 bp, Homo sapiens
acagatttttcagctcctgtgt

SEQ ID NO: 9078386 - DNA, 22 bp, Homo sapiens
acagattttggtatttgcaatg

SEQ ID NO: 9078387 - DNA, 22 bp, Homo sapiens
acagattttggtatttgcaatg

SEQ ID NO: 9078388 - DNA, 21 bp, Homo sapiens
acagattttatatctctgctg

SEQ ID NO: 9078389 - DNA, 22 bp, Homo sapiens
acagattttaaatttgtagttg

SEQ ID NO: 9078390 - DNA, 22 bp, Homo sapiens
accagctgttaggcttggtgct

SEQ ID NO: 9078391 - DNA, 22 bp, Homo sapiens
accagctgtgtcctggctgcag

SEQ ID NO: 9078392 - DNA, 22 bp, Homo sapiens
aaggtttttttccagtatctct

SEQ ID NO: 9078393 - DNA, 22 bp, Homo sapiens
aaggtttttttccagtatctct

SEQ ID NO: 9078394 - DNA, 22 bp, Homo sapiens
aagtaaaagcaggtgtgctggg

SEQ ID NO: 9078395 - DNA, 22 bp, Homo sapiens
aagtaaaacacacagtccaccg

SEQ ID NO: 9078396 - DNA, 22 bp, Homo sapiens
aagtaaaatgtttcctttatta

SEQ ID NO: 9078397 - DNA, 22 bp, Homo sapiens
aagtaaaagctttaccatgcgc

SEQ ID NO: 9078398 - DNA, 22 bp, Homo sapiens
aaggttgctgttttgcttcaaa

SEQ ID NO: 9078399 - DNA, 22 bp, Homo sapiens
aaggttgcagcagtgttgatga

SEQ ID NO: 9078400 - DNA, 22 bp, Homo sapiens
aaggttccctctctggaagcct

SEQ ID NO: 9078401 - DNA, 23 bp, Homo sapiens
aaggttgaaattggagcttggat

SEQ ID NO: 9078402 - DNA, 23 bp, Homo sapiens
accagctgccctgaactttgtgc

SEQ ID NO: 9078403 - DNA, 22 bp, Homo sapiens
accagctgccttttcttagtag

SEQ ID NO: 9078404 - DNA, 22 bp, Homo sapiens
accagcacggattagaatgctt

SEQ ID NO: 9078405 - DNA, 17 bp, Homo sapiens
accacctctcaccagca

SEQ ID NO: 9078406 - DNA, 22 bp, Homo sapiens
accactgcccatggtgaaaact

SEQ ID NO: 9078407 - DNA, 22 bp, Homo sapiens
aagggcagctgacagatgctta

SEQ ID NO: 9078408 - DNA, 22 bp, Homo sapiens
accacccccttgggtgtggaag

SEQ ID NO: 9078409 - DNA, 22 bp, Homo sapiens
accacccccttgggtgtggaag

SEQ ID NO: 9078410 - DNA, 22 bp, Homo sapiens
accacccccttgggtgtggaag

SEQ ID NO: 9078411 - DNA, 22 bp, Homo sapiens
accaccccagaatttttcaagg

SEQ ID NO: 9078412 - DNA, 22 bp, Homo sapiens
accaccccagaatttttcaagg

SEQ ID NO: 9078413 - DNA, 22 bp, Homo sapiens
accaccccaaatgaacctctgt

SEQ ID NO: 9078414 - DNA, 22 bp, Homo sapiens
accacccagccagcttctccct

SEQ ID NO: 9078415 - DNA, 22 bp, Homo sapiens
accacaggggaggaatgatgcc

SEQ ID NO: 9078416 - DNA, 22 bp, Homo sapiens
acattttgcccttatttgctga

SEQ ID NO: 9078417 - DNA, 22 bp, Homo sapiens
acattttgcccttatttgctga

SEQ ID NO: 9078418 - DNA, 22 bp, Homo sapiens
accacaggacccatgagtcagt

SEQ ID NO: 9078419 - DNA, 22 bp, Homo sapiens
accacaggaggatggctgctgg

SEQ ID NO: 9078420 - DNA, 22 bp, Homo sapiens
acattctgtcaacagtgagcag

SEQ ID NO: 9078421 - DNA, 22 bp, Homo sapiens
acattctgtttccccaaagaga

SEQ ID NO: 9078422 - DNA, 22 bp, Homo sapiens
acattctgtgagtcatgtttta

SEQ ID NO: 9078423 - DNA, 22 bp, Homo sapiens
acataatgagctctttataaat

SEQ ID NO: 9078424 - DNA, 22 bp, Homo sapiens
acataatgagctctttataaat

SEQ ID NO: 9078425 - DNA, 22 bp, Homo sapiens
acataataggtgcctgaatatt

SEQ ID NO: 9078426 - DNA, 18 bp, Homo sapiens
acatacattctgtctgca

SEQ ID NO: 9078427 - DNA, 22 bp, Homo sapiens
acataataggtacctgaataat

SEQ ID NO: 9078428 - DNA, 22 bp, Homo sapiens
acataacaatcataggacatag

SEQ ID NO: 9078429 - DNA, 22 bp, Homo sapiens
acataacactcttctctagtga

SEQ ID NO: 9078430 - DNA, 22 bp, Homo sapiens
acataacactcttctctagtga

SEQ ID NO: 9078431 - DNA, 17 bp, Homo sapiens
acatgggctgagactcc

SEQ ID NO: 9078432 - DNA, 19 bp, Homo sapiens
acatggctctccagtctgg

SEQ ID NO: 9078433 - DNA, 22 bp, Homo sapiens
acatggctggcaccttaaattt

SEQ ID NO: 9078434 - DNA, 19 bp, Homo sapiens
acatggctctccagtctgg

SEQ ID NO: 9078435 - DNA, 22 bp, Homo sapiens
acatgccaagatcctcgtcttt

SEQ ID NO: 9078436 - DNA, 23 bp, Homo sapiens
acatagaacagaatatatttgtg

SEQ ID NO: 9078437 - DNA, 23 bp, Homo sapiens
acatagaacagaatatatttgtg

SEQ ID NO: 9078438 - DNA, 22 bp, Homo sapiens
acatactttttaaaagattgct

SEQ ID NO: 9078439 - DNA, 22 bp, Homo sapiens
acatacttatgtgtatatgtgt

SEQ ID NO: 9078440 - DNA, 22 bp, Homo sapiens
acatacttgaagcaagtgatca

SEQ ID NO: 9078441 - DNA, 22 bp, Homo sapiens
acatacttaacattaaagtcat

SEQ ID NO: 9078442 - DNA, 22 bp, Homo sapiens
acatgtaaaagataaattaaca

SEQ ID NO: 9078443 - DNA, 22 bp, Homo sapiens
acatggtgtgctgagaatgaca

SEQ ID NO: 9078444 - DNA, 22 bp, Homo sapiens
acattacagcaagtttacgtta

SEQ ID NO: 9078445 - DNA, 21 bp, Homo sapiens
acattacagggtgatgtgtct

SEQ ID NO: 9078446 - DNA, 22 bp, Homo sapiens
acattacataagattgtaacct

SEQ ID NO: 9078447 - DNA, 22 bp, Homo sapiens
aaggccaggcctagcacggagg

SEQ ID NO: 9078448 - DNA, 22 bp, Homo sapiens
acattatagttgctacagagta

SEQ ID NO: 9078449 - DNA, 22 bp, Homo sapiens
acattatccctggcacaactgc

SEQ ID NO: 9078450 - DNA, 22 bp, Homo sapiens
acattcaaaaagcatctgtcac

SEQ ID NO: 9078451 - DNA, 22 bp, Homo sapiens
acattcaaaaagcatctgtcac

SEQ ID NO: 9078452 - DNA, 21 bp, Homo sapiens
acattataattcatattccac

SEQ ID NO: 9078453 - DNA, 23 bp, Homo sapiens
acattacttagccagagtctcag

SEQ ID NO: 9078454 - DNA, 22 bp, Homo sapiens
acattagataactcagaaagga

SEQ ID NO: 9078455 - DNA, 23 bp, Homo sapiens
acattacttagccagagtctcag

SEQ ID NO: 9078456 - DNA, 22 bp, Homo sapiens
acattacttaccttgggttcta

SEQ ID NO: 9078457 - DNA, 22 bp, Homo sapiens
acattagaacattaatattggg

SEQ ID NO: 9078458 - DNA, 22 bp, Homo sapiens
acattctcatttggtgatcatt

SEQ ID NO: 9078459 - DNA, 22 bp, Homo sapiens
acattctatttcatcatgtcta

SEQ ID NO: 9078460 - DNA, 22 bp, Homo sapiens
acattcaaccaatgtttgctat

SEQ ID NO: 9078461 - DNA, 22 bp, Homo sapiens
acattctattctgcaggacaag

SEQ ID NO: 9078462 - DNA, 22 bp, Homo sapiens
acattcaaaattaggttagttg

SEQ ID NO: 9078463 - DNA, 22 bp, Homo sapiens
acattcaaaattaggttagttg

SEQ ID NO: 9078464 - DNA, 22 bp, Homo sapiens
acattcaaaattgtggtttaga

SEQ ID NO: 9078465 - DNA, 22 bp, Homo sapiens
acattcaacatggctggtctag

SEQ ID NO: 9078466 - DNA, 22 bp, Homo sapiens
acattcaaaattgtggtttaga

SEQ ID NO: 9078467 - DNA, 22 bp, Homo sapiens
acattcaacatggctggtctag

SEQ ID NO: 9078468 - DNA, 22 bp, Homo sapiens
acattcaaccaatgtttgctat

SEQ ID NO: 9078469 - DNA, 22 bp, Homo sapiens
acattcaaaatatttctgatgt

SEQ ID NO: 9078470 - DNA, 22 bp, Homo sapiens
acattcaaaaagcatctgtcac

SEQ ID NO: 9078471 - DNA, 22 bp, Homo sapiens
acattcaaaatatttctgatgt

SEQ ID NO: 9078472 - DNA, 22 bp, Homo sapiens
acattctctccatgtcttcttt

SEQ ID NO: 9078473 - DNA, 22 bp, Homo sapiens
acattctgaaaaacagtgtttt

SEQ ID NO: 9078474 - DNA, 22 bp, Homo sapiens
aatgaaaattggaccctagaac

SEQ ID NO: 9078475 - DNA, 22 bp, Homo sapiens
aatgaaacatatttaggaataa

SEQ ID NO: 9078476 - DNA, 22 bp, Homo sapiens
aatgaaaattggaccctagaac

SEQ ID NO: 9078477 - DNA, 22 bp, Homo sapiens
aatgctttgagggaagatgaaa

SEQ ID NO: 9078478 - DNA, 22 bp, Homo sapiens
aatgctttgactatatctataa

SEQ ID NO: 9078479 - DNA, 22 bp, Homo sapiens
aatgctttgtctgctccagact

SEQ ID NO: 9078480 - DNA, 22 bp, Homo sapiens
aatgctttttgcgaaatgtgca

SEQ ID NO: 9078481 - DNA, 18 bp, Homo sapiens
aatggaaggggtgctgtt

SEQ ID NO: 9078482 - DNA, 22 bp, Homo sapiens
aatggaatcagtttctctaagt

SEQ ID NO: 9078483 - DNA, 21 bp, Homo sapiens
aatggaagtttaaaggtatcc

SEQ ID NO: 9078484 - DNA, 22 bp, Homo sapiens
aatggaatacctaggtggccca

SEQ ID NO: 9078485 - DNA, 22 bp, Homo sapiens
aatggaatacctaggtggccca

SEQ ID NO: 9078486 - DNA, 22 bp, Homo sapiens
aatggaatacctaggtggccca

SEQ ID NO: 9078487 - DNA, 22 bp, Homo sapiens
aatggagacaagaacccaggac

SEQ ID NO: 9078488 - DNA, 22 bp, Homo sapiens
agaatcaggacctgtggctgtc

SEQ ID NO: 9078489 - DNA, 22 bp, Homo sapiens
agaatcaggacctgtggctgtc

SEQ ID NO: 9078490 - DNA, 19 bp, Homo sapiens
agaatcaggtcaggtgaca

SEQ ID NO: 9078491 - DNA, 22 bp, Homo sapiens
agaatcagtgagcagttgtgat

SEQ ID NO: 9078492 - DNA, 22 bp, Homo sapiens
agaatcagtgctggctattagc

SEQ ID NO: 9078493 - DNA, 22 bp, Homo sapiens
agaataatcactgaagttcaaa

SEQ ID NO: 9078494 - DNA, 22 bp, Homo sapiens
agaataatactgaaatgctgaa

SEQ ID NO: 9078495 - DNA, 22 bp, Homo sapiens
agaataatcactgaagttcaaa

SEQ ID NO: 9078496 - DNA, 22 bp, Homo sapiens
agaataaatgctacctatcaca

SEQ ID NO: 9078497 - DNA, 22 bp, Homo sapiens
agaataaatgctacctatcaca

SEQ ID NO: 9078498 - DNA, 22 bp, Homo sapiens
agaataaatgctacctatcaca

SEQ ID NO: 9078499 - DNA, 22 bp, Homo sapiens
agaataaatcaaatgtcctgag

SEQ ID NO: 9078500 - DNA, 22 bp, Homo sapiens
agaataaatgctacctatcaca

SEQ ID NO: 9078501 - DNA, 22 bp, Homo sapiens
agaataaactgctttagggcag

SEQ ID NO: 9078502 - DNA, 22 bp, Homo sapiens
agaagtttgttatgtaaacaaa

SEQ ID NO: 9078503 - DNA, 22 bp, Homo sapiens
aatggagaccctaaggaagagg

SEQ ID NO: 9078504 - DNA, 22 bp, Homo sapiens
aatggagaccctaaggaagagg

SEQ ID NO: 9078505 - DNA, 22 bp, Homo sapiens
agaagttttgttgaatgtgtga

SEQ ID NO: 9078506 - DNA, 22 bp, Homo sapiens
agaataaaatagtctgaagatg

SEQ ID NO: 9078507 - DNA, 22 bp, Homo sapiens
agaataaactgctttagggcag

SEQ ID NO: 9078508 - DNA, 22 bp, Homo sapiens
aatgtaccagcctaagaagtgg

SEQ ID NO: 9078509 - DNA, 22 bp, Homo sapiens
aatgtagatgagatattttttg

SEQ ID NO: 9078510 - DNA, 22 bp, Homo sapiens
aatgtagatgagatattttttg

SEQ ID NO: 9078511 - DNA, 22 bp, Homo sapiens
aatgtataaagtgttaataact

SEQ ID NO: 9078512 - DNA, 22 bp, Homo sapiens
aatgtataaagtgttaataact

SEQ ID NO: 9078513 - DNA, 22 bp, Homo sapiens
aatgtacaggctggctatgggg

SEQ ID NO: 9078514 - DNA, 22 bp, Homo sapiens
aatgtacaggctggctatgggg

SEQ ID NO: 9078515 - DNA, 23 bp, Homo sapiens
agaatttctaactctagctctgt

SEQ ID NO: 9078516 - DNA, 22 bp, Homo sapiens
agaatttcctatgagagattcc

SEQ ID NO: 9078517 - DNA, 22 bp, Homo sapiens
agaatttggtagttatttttgg

SEQ ID NO: 9078518 - DNA, 22 bp, Homo sapiens
agaatttctggaagattgcaag

SEQ ID NO: 9078519 - DNA, 22 bp, Homo sapiens
agaatttttgcagtttagccat

SEQ ID NO: 9078520 - DNA, 22 bp, Homo sapiens
aatgtacactgaaagcctatca

SEQ ID NO: 9078521 - DNA, 22 bp, Homo sapiens
aatgtacactgaaagcctatca

SEQ ID NO: 9078522 - DNA, 22 bp, Homo sapiens
aatgtaaacagcaagagaaggg

SEQ ID NO: 9078523 - DNA, 20 bp, Homo sapiens
agaatctgacccagagagac

SEQ ID NO: 9078524 - DNA, 20 bp, Homo sapiens
agaatctgacccagagagac

SEQ ID NO: 9078525 - DNA, 22 bp, Homo sapiens
agaatctctactcaagtacttg

SEQ ID NO: 9078526 - DNA, 22 bp, Homo sapiens
agaatttcaaatggaagtttta

SEQ ID NO: 9078527 - DNA, 23 bp, Homo sapiens
agaatttcaaagtccagcacatt

SEQ ID NO: 9078528 - DNA, 23 bp, Homo sapiens
agaatttcaaagtccagcacatt

SEQ ID NO: 9078529 - DNA, 22 bp, Homo sapiens
agaatttcaaaaggaagccagc

SEQ ID NO: 9078530 - DNA, 22 bp, Homo sapiens
agaatttaggatgcatgtgaat

SEQ ID NO: 9078531 - DNA, 22 bp, Homo sapiens
agaatttagctccttggtcata

SEQ ID NO: 9078532 - DNA, 22 bp, Homo sapiens
agaatttagctccttggtcata

SEQ ID NO: 9078533 - DNA, 22 bp, Homo sapiens
aattatgtagccatatgaaaca

SEQ ID NO: 9078534 - DNA, 22 bp, Homo sapiens
aattcacaattatgttgggaga

SEQ ID NO: 9078535 - DNA, 22 bp, Homo sapiens
agagatattatttaccaagtta

SEQ ID NO: 9078536 - DNA, 22 bp, Homo sapiens
agagatcagttaaaatcttttt

SEQ ID NO: 9078537 - DNA, 22 bp, Homo sapiens
agagatccttcaatctagtttt

SEQ ID NO: 9078538 - DNA, 20 bp, Homo sapiens
agagagcacaggcaggaaag

SEQ ID NO: 9078539 - DNA, 23 bp, Homo sapiens
agagagagtttgtgtcaggtacc

SEQ ID NO: 9078540 - DNA, 20 bp, Homo sapiens
agagagcacaggcaggaaag

SEQ ID NO: 9078541 - DNA, 22 bp, Homo sapiens
agagatacttttctttggatgc

SEQ ID NO: 9078542 - DNA, 22 bp, Homo sapiens
agagatacttttctttggatgc

SEQ ID NO: 9078543 - DNA, 22 bp, Homo sapiens
agagataccaaataggcagtta

SEQ ID NO: 9078544 - DNA, 22 bp, Homo sapiens
agagataaagctatgatttatg

SEQ ID NO: 9078545 - DNA, 22 bp, Homo sapiens
agagagacgggggctgctgctt

SEQ ID NO: 9078546 - DNA, 17 bp, Homo sapiens
agagagagcatgccacc

SEQ ID NO: 9078547 - DNA, 17 bp, Homo sapiens
agagagagcatgccacc

SEQ ID NO: 9078548 - DNA, 22 bp, Homo sapiens
agagagaggcagcagtgctcac

SEQ ID NO: 9078549 - DNA, 22 bp, Homo sapiens
agagaaagtaaagattctacct

SEQ ID NO: 9078550 - DNA, 21 bp, Homo sapiens
agagaaagtcatggctgtggc

SEQ ID NO: 9078551 - DNA, 22 bp, Homo sapiens
agagaaagtcctgatctctcta

SEQ ID NO: 9078552 - DNA, 22 bp, Homo sapiens
agagacagggttttgccatgtt

SEQ ID NO: 9078553 - DNA, 22 bp, Homo sapiens
agagacagggttttgccatgtt

SEQ ID NO: 9078554 - DNA, 22 bp, Homo sapiens
agagacagggttttgccatgtt

SEQ ID NO: 9078555 - DNA, 22 bp, Homo sapiens
agagacagggttttgccatgtt

SEQ ID NO: 9078556 - DNA, 22 bp, Homo sapiens
agagagaattggataaattggt

SEQ ID NO: 9078557 - DNA, 22 bp, Homo sapiens
agacactgatgttcagctcaat

SEQ ID NO: 9078558 - DNA, 17 bp, Homo sapiens
agacactgagccaagta

SEQ ID NO: 9078559 - DNA, 22 bp, Homo sapiens
aatgtataaccataggaaattt

SEQ ID NO: 9078560 - DNA, 19 bp, Homo sapiens
agacactggatggaaaatg

SEQ ID NO: 9078561 - DNA, 22 bp, Homo sapiens
agacctctacgtgcgtctcatc

SEQ ID NO: 9078562 - DNA, 19 bp, Homo sapiens
agagaaagaattgagtcta

SEQ ID NO: 9078563 - DNA, 19 bp, Homo sapiens
agagaaagaattgagtcta

SEQ ID NO: 9078564 - DNA, 23 bp, Homo sapiens
agagaaagggataacacgttgaa

SEQ ID NO: 9078565 - DNA, 23 bp, Homo sapiens
agagaaagggataacacgttgaa

SEQ ID NO: 9078566 - DNA, 18 bp, Homo sapiens
agagaaagaccaaagcat

SEQ ID NO: 9078567 - DNA, 23 bp, Homo sapiens
agactggggcataagaagatggc

SEQ ID NO: 9078568 - DNA, 22 bp, Homo sapiens
agagaaactgatgtcctttgaa

SEQ ID NO: 9078569 - DNA, 22 bp, Homo sapiens
agagaaacccttcagtgttttg

SEQ ID NO: 9078570 - DNA, 23 bp, Homo sapiens
agactgaggctgccagggtcaga

SEQ ID NO: 9078571 - DNA, 22 bp, Homo sapiens
agactgggccatttccccagct

SEQ ID NO: 9078572 - DNA, 22 bp, Homo sapiens
agactgggattctccctgatca

SEQ ID NO: 9078573 - DNA, 22 bp, Homo sapiens
aattcagaagcacaaaacctag

SEQ ID NO: 9078574 - DNA, 22 bp, Homo sapiens
aattcagagacatgaagtgaca

SEQ ID NO: 9078575 - DNA, 22 bp, Homo sapiens
aattcagatggaagattctggc

SEQ ID NO: 9078576 - DNA, 22 bp, Homo sapiens
aattcagagactcattctggag

SEQ ID NO: 9078577 - DNA, 22 bp, Homo sapiens
aattcagagtcctggccccacg

SEQ ID NO: 9078578 - DNA, 22 bp, Homo sapiens
agagcagcgtttgtggaacact

SEQ ID NO: 9078579 - DNA, 18 bp, Homo sapiens
agagcagcggcatcacac

SEQ ID NO: 9078580 - DNA, 18 bp, Homo sapiens
agagcagcggcatcacac

SEQ ID NO: 9078581 - DNA, 22 bp, Homo sapiens
agagcagctgcattcagcacct

SEQ ID NO: 9078582 - DNA, 22 bp, Homo sapiens
agagcagcgtttgtggaacact

SEQ ID NO: 9078583 - DNA, 22 bp, Homo sapiens
aattcacagaaccatggtgctc

SEQ ID NO: 9078584 - DNA, 22 bp, Homo sapiens
aattcacaggaggtatttgtcc

SEQ ID NO: 9078585 - DNA, 22 bp, Homo sapiens
aattcacatatacattattcct

SEQ ID NO: 9078586 - DNA, 22 bp, Homo sapiens
aattcacagttctgcaccttac

SEQ ID NO: 9078587 - DNA, 22 bp, Homo sapiens
aattcacaggatcacaggagag

SEQ ID NO: 9078588 - DNA, 22 bp, Homo sapiens
aattcacatccgaccaggtcaa

SEQ ID NO: 9078589 - DNA, 22 bp, Homo sapiens
aattcacatgttgaagtcctaa

SEQ ID NO: 9078590 - DNA, 22 bp, Homo sapiens
aattcacatgttgaagtcctaa

SEQ ID NO: 9078591 - DNA, 22 bp, Homo sapiens
aattcagaaaaattcactccta

SEQ ID NO: 9078592 - DNA, 22 bp, Homo sapiens
agagcaggcataaagctttgaa

SEQ ID NO: 9078593 - DNA, 22 bp, Homo sapiens
agagcaggtggcaactctggga

SEQ ID NO: 9078594 - DNA, 22 bp, Homo sapiens
agagcagctggggcagagacca

SEQ ID NO: 9078595 - DNA, 22 bp, Homo sapiens
agagcagctggggcagagacca

SEQ ID NO: 9078596 - DNA, 22 bp, Homo sapiens
agagcagctggctgcatctaga

SEQ ID NO: 9078597 - DNA, 22 bp, Homo sapiens
agagcagctgtgacatggacag

SEQ ID NO: 9078598 - DNA, 22 bp, Homo sapiens
agagcagctgtgacatggacag

SEQ ID NO: 9078599 - DNA, 22 bp, Homo sapiens
agagcagctgtgacatggacag

SEQ ID NO: 9078600 - DNA, 22 bp, Homo sapiens
agagcagcttttcggaaccact

SEQ ID NO: 9078601 - DNA, 22 bp, Homo sapiens
agagcagcttttcggaaccact

SEQ ID NO: 9078602 - DNA, 22 bp, Homo sapiens
agagcaggcataaagctttgaa

SEQ ID NO: 9078603 - DNA, 22 bp, Homo sapiens
agaggccaagccagactgtgca

SEQ ID NO: 9078604 - DNA, 23 bp, Homo sapiens
agaggccaacttcttgcccctcc

SEQ ID NO: 9078605 - DNA, 23 bp, Homo sapiens
agaggccaacttcttgcccctcc

SEQ ID NO: 9078606 - DNA, 19 bp, Homo sapiens
agaggcagtctccaacagg

SEQ ID NO: 9078607 - DNA, 21 bp, Homo sapiens
agaggcaggcattaagtacac

SEQ ID NO: 9078608 - DNA, 21 bp, Homo sapiens
agaggcaggcattaagtacac

SEQ ID NO: 9078609 - DNA, 19 bp, Homo sapiens
agaggcagtctccaacagg

SEQ ID NO: 9078610 - DNA, 22 bp, Homo sapiens
agaggccacaccagcctcccgt

SEQ ID NO: 9078611 - DNA, 22 bp, Homo sapiens
agaggccaatagtaggtggcat

SEQ ID NO: 9078612 - DNA, 22 bp, Homo sapiens
agaggccaatagtaggtggcat

SEQ ID NO: 9078613 - DNA, 22 bp, Homo sapiens
aatttcaaagctcactggcata

SEQ ID NO: 9078614 - DNA, 22 bp, Homo sapiens
aatttcaagtggcatctttgat

SEQ ID NO: 9078615 - DNA, 22 bp, Homo sapiens
aatttcaagtcttgaagaagta

SEQ ID NO: 9078616 - DNA, 22 bp, Homo sapiens
aatttcaaactaataggaacca

SEQ ID NO: 9078617 - DNA, 22 bp, Homo sapiens
aatttcaaagctcactggcata

SEQ ID NO: 9078618 - DNA, 22 bp, Homo sapiens
aatttcaaactcttgccctcag

SEQ ID NO: 9078619 - DNA, 22 bp, Homo sapiens
aatttcaagtggcatctttgat

SEQ ID NO: 9078620 - DNA, 22 bp, Homo sapiens
aatttcaagtggcatctttgat

SEQ ID NO: 9078621 - DNA, 22 bp, Homo sapiens
aatttcaatgcactcatggttg

SEQ ID NO: 9078622 - DNA, 22 bp, Homo sapiens
agagggcataaaatagagcacg

SEQ ID NO: 9078623 - DNA, 22 bp, Homo sapiens
agagggcataaaatagagcacg

SEQ ID NO: 9078624 - DNA, 22 bp, Homo sapiens
aattttctggtgtgtaatgaag

SEQ ID NO: 9078625 - DNA, 22 bp, Homo sapiens
aattttctggtgtgtaatgaag

SEQ ID NO: 9078626 - DNA, 21 bp, Homo sapiens
aattttgaaggaagattaagg

SEQ ID NO: 9078627 - DNA, 22 bp, Homo sapiens
aattttgtgtgggatcaaagga

SEQ ID NO: 9078628 - DNA, 22 bp, Homo sapiens
aattttgttcttggaaatcagg

SEQ ID NO: 9078629 - DNA, 22 bp, Homo sapiens
agagggcccatgttgggctgct

SEQ ID NO: 9078630 - DNA, 22 bp, Homo sapiens
agagggcccatgttgggctgct

SEQ ID NO: 9078631 - DNA, 22 bp, Homo sapiens
agagggccataggtgcatagtt

SEQ ID NO: 9078632 - DNA, 22 bp, Homo sapiens
agagggccataggtgcatagtt

SEQ ID NO: 9078633 - DNA, 22 bp, Homo sapiens
agagggcataaaatagagcacg

SEQ ID NO: 9078634 - DNA, 22 bp, Homo sapiens
agagggcataaaatagagcacg

SEQ ID NO: 9078635 - DNA, 22 bp, Homo sapiens
agatctgaatctcatccgagga

SEQ ID NO: 9078636 - DNA, 22 bp, Homo sapiens
agatctgacctaaccccaccac

SEQ ID NO: 9078637 - DNA, 21 bp, Homo sapiens
agatcctgtggctgagaagta

SEQ ID NO: 9078638 - DNA, 21 bp, Homo sapiens
agatcctggggtctggggagg

SEQ ID NO: 9078639 - DNA, 22 bp, Homo sapiens
agatatgttactgcatcatggg

SEQ ID NO: 9078640 - DNA, 22 bp, Homo sapiens
agatatgtttgtatatatttgt

SEQ ID NO: 9078641 - DNA, 22 bp, Homo sapiens
agatatctgtattgtttccaat

SEQ ID NO: 9078642 - DNA, 22 bp, Homo sapiens
agatatgtccctgtctaatatt

SEQ ID NO: 9078643 - DNA, 22 bp, Homo sapiens
agatatacagagaattattcac

SEQ ID NO: 9078644 - DNA, 22 bp, Homo sapiens
agatatagttgttgagaagaac

SEQ ID NO: 9078645 - DNA, 22 bp, Homo sapiens
agatatcacctctaggctggtg

SEQ ID NO: 9078646 - DNA, 22 bp, Homo sapiens
agatctggccctcagcttgatt

SEQ ID NO: 9078647 - DNA, 22 bp, Homo sapiens
agatctggttggagtcctgaca

SEQ ID NO: 9078648 - DNA, 22 bp, Homo sapiens
agatctggaactgaggtttatt

SEQ ID NO: 9078649 - DNA, 22 bp, Homo sapiens
agatctggaaaatcacaggtgc

SEQ ID NO: 9078650 - DNA, 23 bp, Homo sapiens
agatctgatgttaccaagaattg

SEQ ID NO: 9078651 - DNA, 22 bp, Homo sapiens
agatctggccctcagcttgatt

SEQ ID NO: 9078652 - DNA, 22 bp, Homo sapiens
agatctggttggagtcctgaca

SEQ ID NO: 9078653 - DNA, 22 bp, Homo sapiens
agatgttttggagacactaacc

SEQ ID NO: 9078654 - DNA, 22 bp, Homo sapiens
agatgttttgtgtatttcatca

SEQ ID NO: 9078655 - DNA, 22 bp, Homo sapiens
agattcaaagtgaagaacttaa

SEQ ID NO: 9078656 - DNA, 22 bp, Homo sapiens
agattatttaagacaggaacca

SEQ ID NO: 9078657 - DNA, 22 bp, Homo sapiens
agattcagaaatgaggagggcc

SEQ ID NO: 9078658 - DNA, 20 bp, Homo sapiens
agattattcctaagatttct

SEQ ID NO: 9078659 - DNA, 19 bp, Homo sapiens
agattattgcacattcatg

SEQ ID NO: 9078660 - DNA, 21 bp, Homo sapiens
agattacaggtgtgatccacc

SEQ ID NO: 9078661 - DNA, 20 bp, Homo sapiens
agattaggggctttcttctt

SEQ ID NO: 9078662 - DNA, 22 bp, Homo sapiens
agattaggtatggtttaagtag

SEQ ID NO: 9078663 - DNA, 22 bp, Homo sapiens
agagggtaacaagaggcctgga

SEQ ID NO: 9078664 - DNA, 22 bp, Homo sapiens
agaggggttatgcttgacattt

SEQ ID NO: 9078665 - DNA, 22 bp, Homo sapiens
agaggtggagctcttggcatca

SEQ ID NO: 9078666 - DNA, 22 bp, Homo sapiens
agaggtggccatgggcgctgga

SEQ ID NO: 9078667 - DNA, 22 bp, Homo sapiens
acaaaaagctccattactgtcc

SEQ ID NO: 9078668 - DNA, 22 bp, Homo sapiens
aattttgtttaagtgatctgct

SEQ ID NO: 9078669 - DNA, 22 bp, Homo sapiens
aattttgtttaagtgatctgct

SEQ ID NO: 9078670 - DNA, 22 bp, Homo sapiens
agaggtttcttaggggcttcct

SEQ ID NO: 9078671 - DNA, 20 bp, Homo sapiens
agaggttcagtctggagaag

SEQ ID NO: 9078672 - DNA, 22 bp, Homo sapiens
agaggttcaaacttcataattt

SEQ ID NO: 9078673 - DNA, 22 bp, Homo sapiens
agaggtggagctcttggcatca

SEQ ID NO: 9078674 - DNA, 22 bp, Homo sapiens
agaggtggccatgggcgctgga

SEQ ID NO: 9078675 - DNA, 22 bp, Homo sapiens
agataatgtcaaattctgtctg

SEQ ID NO: 9078676 - DNA, 22 bp, Homo sapiens
agatatacacccatatcacata

SEQ ID NO: 9078677 - DNA, 22 bp, Homo sapiens
agagtctgtgctttcatcagga

SEQ ID NO: 9078678 - DNA, 22 bp, Homo sapiens
agagtctgttacttgtccccta

SEQ ID NO: 9078679 - DNA, 22 bp, Homo sapiens
agagtcttccaggcagcctgag

SEQ ID NO: 9078680 - DNA, 22 bp, Homo sapiens
agagtgaaaagctagagcagta

SEQ ID NO: 9078681 - DNA, 19 bp, Homo sapiens
agagtctgtgctcttccta

SEQ ID NO: 9078682 - DNA, 22 bp, Homo sapiens
agagtctgcctttttctcctgc

SEQ ID NO: 9078683 - DNA, 21 bp, Homo sapiens
agagtctgcatttctgacaag

SEQ ID NO: 9078684 - DNA, 21 bp, Homo sapiens
agagtctgcatttctgacaag

SEQ ID NO: 9078685 - DNA, 23 bp, Homo sapiens
agagtaatgtttttactgtattc

SEQ ID NO: 9078686 - DNA, 22 bp, Homo sapiens
agagtacactgtacacacaatt

SEQ ID NO: 9078687 - DNA, 22 bp, Homo sapiens
agcagggcttctgtgcctgtgc

SEQ ID NO: 9078688 - DNA, 22 bp, Homo sapiens
agcagggcttgccgcttgtcct

SEQ ID NO: 9078689 - DNA, 22 bp, Homo sapiens
agcagggcctctggcactggtc

SEQ ID NO: 9078690 - DNA, 23 bp, Homo sapiens
agcaggcatctgtggcacaaggc

SEQ ID NO: 9078691 - DNA, 21 bp, Homo sapiens
agcaggcagtgggctggattt

SEQ ID NO: 9078692 - DNA, 23 bp, Homo sapiens
agcaggcatctgtggcacaaggc

SEQ ID NO: 9078693 - DNA, 22 bp, Homo sapiens
agcaggcatagagtagcactca

SEQ ID NO: 9078694 - DNA, 22 bp, Homo sapiens
agcaggcagtgtagagccttca

SEQ ID NO: 9078695 - DNA, 22 bp, Homo sapiens
agcaggcagtgtagagccttca

SEQ ID NO: 9078696 - DNA, 22 bp, Homo sapiens
agcaggcatagagtagcactca

SEQ ID NO: 9078697 - DNA, 19 bp, Homo sapiens
agcaggcaggtggcccagg

SEQ ID NO: 9078698 - DNA, 19 bp, Homo sapiens
agcaggcaggtggcccagg

SEQ ID NO: 9078699 - DNA, 20 bp, Homo sapiens
agcaggtgacggggcctgct

SEQ ID NO: 9078700 - DNA, 19 bp, Homo sapiens
agcagttatatgcatggga

SEQ ID NO: 9078701 - DNA, 22 bp, Homo sapiens
agcagttactagttaaatgcat

SEQ ID NO: 9078702 - DNA, 22 bp, Homo sapiens
agcagttatattgaaataaaaa

SEQ ID NO: 9078703 - DNA, 22 bp, Homo sapiens
agcatccagaaaactctcagaa

SEQ ID NO: 9078704 - DNA, 22 bp, Homo sapiens
agcatcagcctctgtcctggag

SEQ ID NO: 9078705 - DNA, 22 bp, Homo sapiens
agcatccagatgcctgatgtca

SEQ ID NO: 9078706 - DNA, 22 bp, Homo sapiens
agcaggtgacccaagcaggctg

SEQ ID NO: 9078707 - DNA, 22 bp, Homo sapiens
agcagctcttaacaaagcatgg

SEQ ID NO: 9078708 - DNA, 22 bp, Homo sapiens
agcagctctgtttacctggagg

SEQ ID NO: 9078709 - DNA, 22 bp, Homo sapiens
agcagctctggcactgtagcat

SEQ ID NO: 9078710 - DNA, 22 bp, Homo sapiens
agcagctctgagaggccagcac

SEQ ID NO: 9078711 - DNA, 22 bp, Homo sapiens
agcagctcggccagtcaccagg

SEQ ID NO: 9078712 - DNA, 22 bp, Homo sapiens
agcagctgaaaggcaaacttct

SEQ ID NO: 9078713 - DNA, 22 bp, Homo sapiens
agcagctgaaaggcaaacttct

SEQ ID NO: 9078714 - DNA, 22 bp, Homo sapiens
agcagctgaaaggcaaacttct

SEQ ID NO: 9078715 - DNA, 17 bp, Homo sapiens
agcagctgaagcagcca

SEQ ID NO: 9078716 - DNA, 17 bp, Homo sapiens
agcagctgaagcagcca

SEQ ID NO: 9078717 - DNA, 17 bp, Homo sapiens
agcagctgaagcagcca

SEQ ID NO: 9078718 - DNA, 17 bp, Homo sapiens
agcagctgaagcagcca

SEQ ID NO: 9078719 - DNA, 22 bp, Homo sapiens
agcagctgaccagtgagtcctg

SEQ ID NO: 9078720 - DNA, 17 bp, Homo sapiens
agcagctgaagcagcca

SEQ ID NO: 9078721 - DNA, 22 bp, Homo sapiens
agcagctgaccagtgagtcctg

SEQ ID NO: 9078722 - DNA, 22 bp, Homo sapiens
agcagctgaccagtgagtcctg

SEQ ID NO: 9078723 - DNA, 22 bp, Homo sapiens
agcagctgaccagtgagtcctg

SEQ ID NO: 9078724 - DNA, 19 bp, Homo sapiens
agcagccatcgaccatgga

SEQ ID NO: 9078725 - DNA, 19 bp, Homo sapiens
agcagccatcgaccatgga

SEQ ID NO: 9078726 - DNA, 22 bp, Homo sapiens
agcagctcctctaggaacggat

SEQ ID NO: 9078727 - DNA, 22 bp, Homo sapiens
agcagcccaaacagactaagac

SEQ ID NO: 9078728 - DNA, 22 bp, Homo sapiens
agcagccatagatagcatgcaa

SEQ ID NO: 9078729 - DNA, 22 bp, Homo sapiens
agcaggagggttttgtagagtc

SEQ ID NO: 9078730 - DNA, 22 bp, Homo sapiens
agcaggagtgtcccctggctgt

SEQ ID NO: 9078731 - DNA, 22 bp, Homo sapiens
agcaggcaggctgccagtgaat

SEQ ID NO: 9078732 - DNA, 22 bp, Homo sapiens
agcaggcaggctgccagtgaat

SEQ ID NO: 9078733 - DNA, 22 bp, Homo sapiens
agcaggagggttttgtagagtc

SEQ ID NO: 9078734 - DNA, 22 bp, Homo sapiens
agcaggagggttttgtagagtc

SEQ ID NO: 9078735 - DNA, 21 bp, Homo sapiens
agcaggaggcagtcacagctc

SEQ ID NO: 9078736 - DNA, 21 bp, Homo sapiens
agcaggaggcagtcacagctc

SEQ ID NO: 9078737 - DNA, 22 bp, Homo sapiens
agcaggagctgtgggaagatgg

SEQ ID NO: 9078738 - DNA, 22 bp, Homo sapiens
agcaggagctgtgggaagatgg

SEQ ID NO: 9078739 - DNA, 22 bp, Homo sapiens
agcaggagctgtgggaagatgg

SEQ ID NO: 9078740 - DNA, 22 bp, Homo sapiens
agcaggagcccttatcaccagg

SEQ ID NO: 9078741 - DNA, 22 bp, Homo sapiens
agcaggaaagaaaaatctgtgt

SEQ ID NO: 9078742 - DNA, 22 bp, Homo sapiens
agcagctgagatggtaagattc

SEQ ID NO: 9078743 - DNA, 22 bp, Homo sapiens
agcagctgagatggtaagattc

SEQ ID NO: 9078744 - DNA, 22 bp, Homo sapiens
agcagctgagatggtaagattc

SEQ ID NO: 9078745 - DNA, 22 bp, Homo sapiens
agcagctgagatggtaagattc

SEQ ID NO: 9078746 - DNA, 22 bp, Homo sapiens
agcagcagctcagttctcagct

SEQ ID NO: 9078747 - DNA, 19 bp, Homo sapiens
agcagcagctaccacttgt

SEQ ID NO: 9078748 - DNA, 19 bp, Homo sapiens
agcagcagctaccacttgt

SEQ ID NO: 9078749 - DNA, 22 bp, Homo sapiens
agcagcagcattgagcgcttgt

SEQ ID NO: 9078750 - DNA, 22 bp, Homo sapiens
agcagcagccgtagccttatta

SEQ ID NO: 9078751 - DNA, 23 bp, Homo sapiens
agcagcagcaattaagtggatat

SEQ ID NO: 9078752 - DNA, 19 bp, Homo sapiens
agcagcagcaccagggatt

SEQ ID NO: 9078753 - DNA, 21 bp, Homo sapiens
agcagcagcagtggggcttct

SEQ ID NO: 9078754 - DNA, 21 bp, Homo sapiens
agcagcagcagtggggcttct

SEQ ID NO: 9078755 - DNA, 22 bp, Homo sapiens
agcagcagattcagcaggaatg

SEQ ID NO: 9078756 - DNA, 22 bp, Homo sapiens
agcagcagattcagcaggaatg

SEQ ID NO: 9078757 - DNA, 22 bp, Homo sapiens
agcagcagattcagcaggaatg

SEQ ID NO: 9078758 - DNA, 22 bp, Homo sapiens
agcagcagattatggtctacat

SEQ ID NO: 9078759 - DNA, 22 bp, Homo sapiens
agcagcagattatggtctacat

SEQ ID NO: 9078760 - DNA, 22 bp, Homo sapiens
agcagaaccacagcactgttga

SEQ ID NO: 9078761 - DNA, 22 bp, Homo sapiens
agcagcaaagtattgggcaaga

SEQ ID NO: 9078762 - DNA, 22 bp, Homo sapiens
agcagcaactgctagagtggca

SEQ ID NO: 9078763 - DNA, 22 bp, Homo sapiens
agcagcaactgctagagtggca

SEQ ID NO: 9078764 - DNA, 22 bp, Homo sapiens
agcagaacattttcagggctgt

SEQ ID NO: 9078765 - DNA, 21 bp, Homo sapiens
agcagaacagtcgagcactgc

SEQ ID NO: 9078766 - DNA, 21 bp, Homo sapiens
agcagaacagtcgagcactgc

SEQ ID NO: 9078767 - DNA, 21 bp, Homo sapiens
agcagaacagtcgagcactgc

SEQ ID NO: 9078768 - DNA, 22 bp, Homo sapiens
acacacttcacccttgagctaa

SEQ ID NO: 9078769 - DNA, 22 bp, Homo sapiens
acacacttgcagagaggaggga

SEQ ID NO: 9078770 - DNA, 22 bp, Homo sapiens
acacacttcagatgtaatttgt

SEQ ID NO: 9078771 - DNA, 20 bp, Homo sapiens
acacactttgatcttgagcc

SEQ ID NO: 9078772 - DNA, 22 bp, Homo sapiens
acacactggcccccagtactga

SEQ ID NO: 9078773 - DNA, 22 bp, Homo sapiens
agcagcagctcattcttcctgt

SEQ ID NO: 9078774 - DNA, 22 bp, Homo sapiens
agcagccagagtctgaacatta

SEQ ID NO: 9078775 - DNA, 22 bp, Homo sapiens
agcagccaggaatctgcagagc

SEQ ID NO: 9078776 - DNA, 22 bp, Homo sapiens
acacagaacctcatagcctctc

SEQ ID NO: 9078777 - DNA, 23 bp, Homo sapiens
acacagaagaagacccaaggaag

SEQ ID NO: 9078778 - DNA, 22 bp, Homo sapiens
acacagaacctcatagcctctc

SEQ ID NO: 9078779 - DNA, 22 bp, Homo sapiens
agcagcatacacatcatgttga

SEQ ID NO: 9078780 - DNA, 22 bp, Homo sapiens
agcagcagttgctgacgttcta

SEQ ID NO: 9078781 - DNA, 22 bp, Homo sapiens
agcagcagttgctgacgttcta

SEQ ID NO: 9078782 - DNA, 22 bp, Homo sapiens
agatttctgtcaccttctatgc

SEQ ID NO: 9078783 - DNA, 22 bp, Homo sapiens
agatttggtgtctggttgatat

SEQ ID NO: 9078784 - DNA, 23 bp, Homo sapiens
agatttggaaagctgagtggcgt

SEQ ID NO: 9078785 - DNA, 22 bp, Homo sapiens
agatttgtatgtctaaatgtaa

SEQ ID NO: 9078786 - DNA, 22 bp, Homo sapiens
agattttagtttggggaggtgc

SEQ ID NO: 9078787 - DNA, 22 bp, Homo sapiens
agattttagtgtagaggacttg

SEQ ID NO: 9078788 - DNA, 22 bp, Homo sapiens
agattttatagataatttccca

SEQ ID NO: 9078789 - DNA, 22 bp, Homo sapiens
acacacagaaggaagccccact

SEQ ID NO: 9078790 - DNA, 22 bp, Homo sapiens
agatttgttgtgagcaggaata

SEQ ID NO: 9078791 - DNA, 22 bp, Homo sapiens
agcagaaaattggaaatgacaa

SEQ ID NO: 9078792 - DNA, 22 bp, Homo sapiens
agcagaaatagaagtcaatgat

SEQ ID NO: 9078793 - DNA, 23 bp, Homo sapiens
agcacttgtatcttactaaaatg

SEQ ID NO: 9078794 - DNA, 22 bp, Homo sapiens
agcacttaagttaattgaactg

SEQ ID NO: 9078795 - DNA, 17 bp, Homo sapiens
agcacttgaaaatttct

SEQ ID NO: 9078796 - DNA, 22 bp, Homo sapiens
agcacttctcatgggatcaggt

SEQ ID NO: 9078797 - DNA, 22 bp, Homo sapiens
agcacttcattagtaggtagtc

SEQ ID NO: 9078798 - DNA, 22 bp, Homo sapiens
agcctggccactcagggcctga

SEQ ID NO: 9078799 - DNA, 22 bp, Homo sapiens
agcctgcttcctcagggaacaa

SEQ ID NO: 9078800 - DNA, 22 bp, Homo sapiens
agcctgctggaccaagctcatg

SEQ ID NO: 9078801 - DNA, 22 bp, Homo sapiens
agcctggccctgctgaactctg

SEQ ID NO: 9078802 - DNA, 22 bp, Homo sapiens
agcctggcctgggcaggcacat

SEQ ID NO: 9078803 - DNA, 22 bp, Homo sapiens
agcctggcctgggcaggcacat

SEQ ID NO: 9078804 - DNA, 22 bp, Homo sapiens
agccctggggtgcagaaccatg

SEQ ID NO: 9078805 - DNA, 22 bp, Homo sapiens
agccctgggtcccagtcctggc

SEQ ID NO: 9078806 - DNA, 22 bp, Homo sapiens
agccctgggtcccagtcctggc

SEQ ID NO: 9078807 - DNA, 22 bp, Homo sapiens
agccctggtagcctgctgccat

SEQ ID NO: 9078808 - DNA, 22 bp, Homo sapiens
agccctggtagcctgctgccat

SEQ ID NO: 9078809 - DNA, 22 bp, Homo sapiens
agccctggggctggtgcttacc

SEQ ID NO: 9078810 - DNA, 22 bp, Homo sapiens
agccctggggctggtcttggaa

SEQ ID NO: 9078811 - DNA, 22 bp, Homo sapiens
agccctggggctggtcttggaa

SEQ ID NO: 9078812 - DNA, 22 bp, Homo sapiens
agccctgcgctcacgttctgca

SEQ ID NO: 9078813 - DNA, 22 bp, Homo sapiens
agccctgcgatcgtgatttctt

SEQ ID NO: 9078814 - DNA, 22 bp, Homo sapiens
agccctgccctgccatgtggca

SEQ ID NO: 9078815 - DNA, 22 bp, Homo sapiens
agccctgccctgccatgtggca

SEQ ID NO: 9078816 - DNA, 22 bp, Homo sapiens
agccctgccattctctggagct

SEQ ID NO: 9078817 - DNA, 22 bp, Homo sapiens
agccctgccattctctggagct

SEQ ID NO: 9078818 - DNA, 22 bp, Homo sapiens
agccctgccctgccatgtggca

SEQ ID NO: 9078819 - DNA, 22 bp, Homo sapiens
agccctgcaggaggtgggagag

SEQ ID NO: 9078820 - DNA, 22 bp, Homo sapiens
agccctgcaggaggtgggagag

SEQ ID NO: 9078821 - DNA, 22 bp, Homo sapiens
agccctgcacagttcgggagga

SEQ ID NO: 9078822 - DNA, 22 bp, Homo sapiens
agccctgcacagttcgggagga

SEQ ID NO: 9078823 - DNA, 22 bp, Homo sapiens
agccctgcataaatcagttggt

SEQ ID NO: 9078824 - DNA, 22 bp, Homo sapiens
agccctgcaggatgagggaggt

SEQ ID NO: 9078825 - DNA, 22 bp, Homo sapiens
agccctgcaggaggtgggagag

SEQ ID NO: 9078826 - DNA, 22 bp, Homo sapiens
agccctgcacaggtctgtggct

SEQ ID NO: 9078827 - DNA, 22 bp, Homo sapiens
agccctgcacaggtctgtggct

SEQ ID NO: 9078828 - DNA, 22 bp, Homo sapiens
acagacatgctgtttgggtggt

SEQ ID NO: 9078829 - DNA, 22 bp, Homo sapiens
acagacatggaccaagcactgt

SEQ ID NO: 9078830 - DNA, 22 bp, Homo sapiens
acagacatgggccgctcttgag

SEQ ID NO: 9078831 - DNA, 22 bp, Homo sapiens
agccttaaatgctagattcata

SEQ ID NO: 9078832 - DNA, 22 bp, Homo sapiens
agcctgtgtgctttggacaggg

SEQ ID NO: 9078833 - DNA, 22 bp, Homo sapiens
agcctgtgtgctttggacaggg

SEQ ID NO: 9078834 - DNA, 22 bp, Homo sapiens
agcctgtgttgctctggcgata

SEQ ID NO: 9078835 - DNA, 22 bp, Homo sapiens
agcctgtgttttttctattgca

SEQ ID NO: 9078836 - DNA, 22 bp, Homo sapiens
agcctgtggatccctgcactgg

SEQ ID NO: 9078837 - DNA, 22 bp, Homo sapiens
agcctgtggatccctgcactgg

SEQ ID NO: 9078838 - DNA, 22 bp, Homo sapiens
agcctggctgtaacctcatggt

SEQ ID NO: 9078839 - DNA, 22 bp, Homo sapiens
agcctgtctgtctccaaagctg

SEQ ID NO: 9078840 - DNA, 22 bp, Homo sapiens
agcctgtctgtctccaaagctg

SEQ ID NO: 9078841 - DNA, 22 bp, Homo sapiens
agcctgtgagggatgctgcagt

SEQ ID NO: 9078842 - DNA, 22 bp, Homo sapiens
agcctgtgactctgtgaaacca

SEQ ID NO: 9078843 - DNA, 22 bp, Homo sapiens
agctccaaggttgaggagtgag

SEQ ID NO: 9078844 - DNA, 22 bp, Homo sapiens
agctccaaggttgaggagtgag

SEQ ID NO: 9078845 - DNA, 22 bp, Homo sapiens
agctcagggctccaggaccgct

SEQ ID NO: 9078846 - DNA, 22 bp, Homo sapiens
agctcaggtcattccagggatg

SEQ ID NO: 9078847 - DNA, 22 bp, Homo sapiens
agctcagggcaaagactcaaat

SEQ ID NO: 9078848 - DNA, 22 bp, Homo sapiens
agctcagggcaaagactcaaat

SEQ ID NO: 9078849 - DNA, 22 bp, Homo sapiens
agctcaggctctgcagggacta

SEQ ID NO: 9078850 - DNA, 22 bp, Homo sapiens
agccttagataaatgctagctc

SEQ ID NO: 9078851 - DNA, 22 bp, Homo sapiens
agctcaagtgcaagcattctat

SEQ ID NO: 9078852 - DNA, 22 bp, Homo sapiens
acagaacatattgcttctctca

SEQ ID NO: 9078853 - DNA, 22 bp, Homo sapiens
acagaacaggctgagaaaaaca

SEQ ID NO: 9078854 - DNA, 22 bp, Homo sapiens
acagaacaggctgagaaaaaca

SEQ ID NO: 9078855 - DNA, 22 bp, Homo sapiens
acagaacaggctgagaaaaaca

SEQ ID NO: 9078856 - DNA, 22 bp, Homo sapiens
acagaactgcaggaggaaaagc

SEQ ID NO: 9078857 - DNA, 22 bp, Homo sapiens
acagaactgcagacagtgccaa

SEQ ID NO: 9078858 - DNA, 22 bp, Homo sapiens
acagaactgagaattctctatc

SEQ ID NO: 9078859 - DNA, 22 bp, Homo sapiens
acagaacatggatttttgaagt

SEQ ID NO: 9078860 - DNA, 22 bp, Homo sapiens
agcccaggtccagttcactgca

SEQ ID NO: 9078861 - DNA, 22 bp, Homo sapiens
acagaacttcagtagtattccc

SEQ ID NO: 9078862 - DNA, 22 bp, Homo sapiens
acagaacttcagtagtattccc

SEQ ID NO: 9078863 - DNA, 22 bp, Homo sapiens
acagaacttcagtagtattccc

SEQ ID NO: 9078864 - DNA, 22 bp, Homo sapiens
acagaactgggggcacagatag

SEQ ID NO: 9078865 - DNA, 22 bp, Homo sapiens
acagaactgggaaatgcacata

SEQ ID NO: 9078866 - DNA, 22 bp, Homo sapiens
acagacagtaaatagtgtggct

SEQ ID NO: 9078867 - DNA, 22 bp, Homo sapiens
acagacagtatggtggggctga

SEQ ID NO: 9078868 - DNA, 21 bp, Homo sapiens
acagacagggccagtgtcccc

SEQ ID NO: 9078869 - DNA, 22 bp, Homo sapiens
acagacatatttggcccatagc

SEQ ID NO: 9078870 - DNA, 22 bp, Homo sapiens
acagacatcatcaacatcttcc

SEQ ID NO: 9078871 - DNA, 22 bp, Homo sapiens
acagacatctatccatttaatt

SEQ ID NO: 9078872 - DNA, 16 bp, Homo sapiens
acagacatgagtgagc

SEQ ID NO: 9078873 - DNA, 22 bp, Homo sapiens
agcccaggtctggcccagcctg

SEQ ID NO: 9078874 - DNA, 22 bp, Homo sapiens
agcccaggtctggcccagcctg

SEQ ID NO: 9078875 - DNA, 22 bp, Homo sapiens
agcccaggtctcaaagtacagg

SEQ ID NO: 9078876 - DNA, 22 bp, Homo sapiens
agcccaggtgaggggttcgaaa

SEQ ID NO: 9078877 - DNA, 22 bp, Homo sapiens
agccaggacagggcagctcgct

SEQ ID NO: 9078878 - DNA, 22 bp, Homo sapiens
agccaggacagggcagctcgct

SEQ ID NO: 9078879 - DNA, 20 bp, Homo sapiens
agccaggctcaagctccccc

SEQ ID NO: 9078880 - DNA, 22 bp, Homo sapiens
agccaggctactccttgctgac

SEQ ID NO: 9078881 - DNA, 22 bp, Homo sapiens
agccaggctactccttgctgac

SEQ ID NO: 9078882 - DNA, 22 bp, Homo sapiens
acagaacagagggttttagaat

SEQ ID NO: 9078883 - DNA, 22 bp, Homo sapiens
agcatctaaactatcagtttga

SEQ ID NO: 9078884 - DNA, 19 bp, Homo sapiens
agcatctccctgatcattc

SEQ ID NO: 9078885 - DNA, 22 bp, Homo sapiens
agcatctggtcatgagtgagaa

SEQ ID NO: 9078886 - DNA, 22 bp, Homo sapiens
agcatctgcttaatggcttaac

SEQ ID NO: 9078887 - DNA, 23 bp, Homo sapiens
agcatctggcttcccctggatgg

SEQ ID NO: 9078888 - DNA, 22 bp, Homo sapiens
agcattctgtggtcttctatgg

SEQ ID NO: 9078889 - DNA, 21 bp, Homo sapiens
agcattctgcttctttcctgg

SEQ ID NO: 9078890 - DNA, 22 bp, Homo sapiens
agcattccacactgaagtctgc

SEQ ID NO: 9078891 - DNA, 22 bp, Homo sapiens
agcattccacactgaagtctgc

SEQ ID NO: 9078892 - DNA, 22 bp, Homo sapiens
agcattccacactgaagtctgc

SEQ ID NO: 9078893 - DNA, 20 bp, Homo sapiens
agcattcattcagcaagcct

SEQ ID NO: 9078894 - DNA, 22 bp, Homo sapiens
agcattcatgatgacaacagga

SEQ ID NO: 9078895 - DNA, 22 bp, Homo sapiens
agcattcattgctagaatgtaa

SEQ ID NO: 9078896 - DNA, 22 bp, Homo sapiens
agcatgaaaacatgaaacagca

SEQ ID NO: 9078897 - DNA, 20 bp, Homo sapiens
agcatcttgcatcttcaagt

SEQ ID NO: 9078898 - DNA, 22 bp, Homo sapiens
agcatcttgaaatataaagtca

SEQ ID NO: 9078899 - DNA, 22 bp, Homo sapiens
agcattcaagtaattcacttgg

SEQ ID NO: 9078900 - DNA, 22 bp, Homo sapiens
aactttctgaaaagcttgatca

SEQ ID NO: 9078901 - DNA, 22 bp, Homo sapiens
aatgttttttggtctgatgaat

SEQ ID NO: 9078902 - DNA, 22 bp, Homo sapiens
aattactgggtctgagattaat

SEQ ID NO: 9078903 - DNA, 22 bp, Homo sapiens
aactttcagaatcctatgcatt

SEQ ID NO: 9078904 - DNA, 22 bp, Homo sapiens
aactttcaggcaatgaatattt

SEQ ID NO: 9078905 - DNA, 22 bp, Homo sapiens
aactttatcggaacaggtactc

SEQ ID NO: 9078906 - DNA, 20 bp, Homo sapiens
aactttagacataatctctt

SEQ ID NO: 9078907 - DNA, 22 bp, Homo sapiens
aatgtcttttaaatgttgaggt

SEQ ID NO: 9078908 - DNA, 22 bp, Homo sapiens
aatgtcttttcccttactttcc

SEQ ID NO: 9078909 - DNA, 22 bp, Homo sapiens
aatgtgaaaccgcacagaataa

SEQ ID NO: 9078910 - DNA, 22 bp, Homo sapiens
aatgtgaaaccgcacagaataa

SEQ ID NO: 9078911 - DNA, 22 bp, Homo sapiens
aatgtgaactttgtcatgtaac

SEQ ID NO: 9078912 - DNA, 22 bp, Homo sapiens
aatgttaattcacagccaaata

SEQ ID NO: 9078913 - DNA, 22 bp, Homo sapiens
aatgttacagttttaattctga

SEQ ID NO: 9078914 - DNA, 22 bp, Homo sapiens
aatgttacgatcaacaacacat

SEQ ID NO: 9078915 - DNA, 22 bp, Homo sapiens
aatgttatgtggttcaacttaa

SEQ ID NO: 9078916 - DNA, 22 bp, Homo sapiens
aatgttacgatcaacaacacat

SEQ ID NO: 9078917 - DNA, 22 bp, Homo sapiens
aatgttacgatcaacaacacat

SEQ ID NO: 9078918 - DNA, 22 bp, Homo sapiens
aatgtctttctgttctatgaga

SEQ ID NO: 9078919 - DNA, 22 bp, Homo sapiens
aatgtcttctcttgttgaattt

SEQ ID NO: 9078920 - DNA, 22 bp, Homo sapiens
aatgtcttcttcagctgaataa

SEQ ID NO: 9078921 - DNA, 22 bp, Homo sapiens
aatgtcaagggaagcaggaaat

SEQ ID NO: 9078922 - DNA, 22 bp, Homo sapiens
aatgtcaacacttggtatgtca

SEQ ID NO: 9078923 - DNA, 22 bp, Homo sapiens
aatgtcaataactttatccctc

SEQ ID NO: 9078924 - DNA, 22 bp, Homo sapiens
aatgtcaagtagccaatgcttc

SEQ ID NO: 9078925 - DNA, 22 bp, Homo sapiens
aatgtcaaaggctatacattca

SEQ ID NO: 9078926 - DNA, 22 bp, Homo sapiens
aatgtcaaaggctatacattca

SEQ ID NO: 9078927 - DNA, 22 bp, Homo sapiens
aatgtcaaacagagcagagcta

SEQ ID NO: 9078928 - DNA, 22 bp, Homo sapiens
aatgtcaaacagagcagagcta

SEQ ID NO: 9078929 - DNA, 22 bp, Homo sapiens
aatgtcaaaatggaatgagact

SEQ ID NO: 9078930 - DNA, 22 bp, Homo sapiens
aatgtcaaaatggaatgagact

SEQ ID NO: 9078931 - DNA, 22 bp, Homo sapiens
aatgtcaaagtgctttgcaaac

SEQ ID NO: 9078932 - DNA, 22 bp, Homo sapiens
aatgtcaaaggctatacattca

SEQ ID NO: 9078933 - DNA, 22 bp, Homo sapiens
aatgtcaaagtgctttgcaaac

SEQ ID NO: 9078934 - DNA, 22 bp, Homo sapiens
aatgtcaaagtgctttgcaaac

SEQ ID NO: 9078935 - DNA, 22 bp, Homo sapiens
aatgtcaaatgagaggggagaa

SEQ ID NO: 9078936 - DNA, 22 bp, Homo sapiens
aatgtcaacacaagagaaatgc

SEQ ID NO: 9078937 - DNA, 22 bp, Homo sapiens
aatgtattttgggagtttcttt

SEQ ID NO: 9078938 - DNA, 22 bp, Homo sapiens
aatgtcaaaataattgatttgt

SEQ ID NO: 9078939 - DNA, 22 bp, Homo sapiens
aactcttcttataatgcgtgat

SEQ ID NO: 9078940 - DNA, 22 bp, Homo sapiens
aactcttgaattcccttgaaga

SEQ ID NO: 9078941 - DNA, 22 bp, Homo sapiens
aatgtattctgggaaaatgtta

SEQ ID NO: 9078942 - DNA, 22 bp, Homo sapiens
aatgtattctgggaaaatgtta

SEQ ID NO: 9078943 - DNA, 22 bp, Homo sapiens
aatgtacaataagacaaagagg

SEQ ID NO: 9078944 - DNA, 22 bp, Homo sapiens
aactcctcactgcctctggcac

SEQ ID NO: 9078945 - DNA, 20 bp, Homo sapiens
aactcctagcctcaagtgat

SEQ ID NO: 9078946 - DNA, 20 bp, Homo sapiens
aactcctagcctcaagtgat

SEQ ID NO: 9078947 - DNA, 22 bp, Homo sapiens
aactctcattttaggtgtaagg

SEQ ID NO: 9078948 - DNA, 22 bp, Homo sapiens
aattcacaaaaccagattgctt

SEQ ID NO: 9078949 - DNA, 22 bp, Homo sapiens
aattcacaaaaccagattgctt

SEQ ID NO: 9078950 - DNA, 22 bp, Homo sapiens
aagacaagcatcaaatcaggca

SEQ ID NO: 9078951 - DNA, 22 bp, Homo sapiens
aagacaagcatcaaatcaggca

SEQ ID NO: 9078952 - DNA, 17 bp, Homo sapiens
aagacaagacaaatgca

SEQ ID NO: 9078953 - DNA, 17 bp, Homo sapiens
aagacaagacaaatgca

SEQ ID NO: 9078954 - DNA, 22 bp, Homo sapiens
aagacaataatttttgggcagg

SEQ ID NO: 9078955 - DNA, 22 bp, Homo sapiens
aagacaatcctggacagtcagc

SEQ ID NO: 9078956 - DNA, 22 bp, Homo sapiens
aattcaaattacaatagttgtt

SEQ ID NO: 9078957 - DNA, 23 bp, Homo sapiens
aattcaaattcagtgtgactagg

SEQ ID NO: 9078958 - DNA, 22 bp, Homo sapiens
aattcaaagactagaattttgc

SEQ ID NO: 9078959 - DNA, 22 bp, Homo sapiens
aattcaaagactagaattttgc

SEQ ID NO: 9078960 - DNA, 22 bp, Homo sapiens
aattcaaagccgcttgggaatc

SEQ ID NO: 9078961 - DNA, 22 bp, Homo sapiens
aattcaaatttgagtttgtgat

SEQ ID NO: 9078962 - DNA, 23 bp, Homo sapiens
aattcaaattcagtgtgactagg

SEQ ID NO: 9078963 - DNA, 22 bp, Homo sapiens
aattcaatctaagaaatgatca

SEQ ID NO: 9078964 - DNA, 22 bp, Homo sapiens
aattcaatctaagaaatgatca

SEQ ID NO: 9078965 - DNA, 22 bp, Homo sapiens
aattcaatctgtagattgtgat

SEQ ID NO: 9078966 - DNA, 22 bp, Homo sapiens
aattcaatctaagaaatgatca

SEQ ID NO: 9078967 - DNA, 22 bp, Homo sapiens
aattcaatggtttttaggatat

SEQ ID NO: 9078968 - DNA, 22 bp, Homo sapiens
aattcaatggtttttaggatat

SEQ ID NO: 9078969 - DNA, 22 bp, Homo sapiens
aattcaatctaagaaatgatca

SEQ ID NO: 9078970 - DNA, 22 bp, Homo sapiens
aattcaatctgtagattgtgat

SEQ ID NO: 9078971 - DNA, 22 bp, Homo sapiens
aattattgagcatctactgtgt

SEQ ID NO: 9078972 - DNA, 20 bp, Homo sapiens
aattagatgtttaatcaata

SEQ ID NO: 9078973 - DNA, 20 bp, Homo sapiens
aattagatgtttaatcaata

SEQ ID NO: 9078974 - DNA, 22 bp, Homo sapiens
aattagaagctgttagcaaaat

SEQ ID NO: 9078975 - DNA, 22 bp, Homo sapiens
aattagaagctgttagcaaaat

SEQ ID NO: 9078976 - DNA, 22 bp, Homo sapiens
aattagaatcttatttggggaa

SEQ ID NO: 9078977 - DNA, 22 bp, Homo sapiens
aattagaagggagttattgata

SEQ ID NO: 9078978 - DNA, 22 bp, Homo sapiens
aattagaagggagttattgata

SEQ ID NO: 9078979 - DNA, 22 bp, Homo sapiens
aattagaagggagttattgata

SEQ ID NO: 9078980 - DNA, 22 bp, Homo sapiens
acaacaaaatgaggaagtggtc

SEQ ID NO: 9078981 - DNA, 22 bp, Homo sapiens
aagacacacacatatgctgagt

SEQ ID NO: 9078982 - DNA, 22 bp, Homo sapiens
acaacaaaatgaggaagtggtc

SEQ ID NO: 9078983 - DNA, 22 bp, Homo sapiens
aagacaatgtttctgatagata

SEQ ID NO: 9078984 - DNA, 22 bp, Homo sapiens
aagacaatgcattactaagaag

SEQ ID NO: 9078985 - DNA, 22 bp, Homo sapiens
aagacaatgagtcctgatggga

SEQ ID NO: 9078986 - DNA, 22 bp, Homo sapiens
aagacaatttgatactagttgc

SEQ ID NO: 9078987 - DNA, 22 bp, Homo sapiens
aagacaattttgagtatgcaca

SEQ ID NO: 9078988 - DNA, 22 bp, Homo sapiens
aagacaattttgagtatgcaca

SEQ ID NO: 9078989 - DNA, 22 bp, Homo sapiens
acaagaaccaaagaaggatatt

SEQ ID NO: 9078990 - DNA, 22 bp, Homo sapiens
acaactttagtctggagggaaa

SEQ ID NO: 9078991 - DNA, 22 bp, Homo sapiens
acaactttctgggttatctgat

SEQ ID NO: 9078992 - DNA, 22 bp, Homo sapiens
acaacttcaattgggattctcc

SEQ ID NO: 9078993 - DNA, 22 bp, Homo sapiens
acaacttctcacagataaattt

SEQ ID NO: 9078994 - DNA, 22 bp, Homo sapiens
acaactttaatgggtttcagct

SEQ ID NO: 9078995 - DNA, 22 bp, Homo sapiens
acaacaaaatgaggaagtggtc

SEQ ID NO: 9078996 - DNA, 23 bp, Homo sapiens
acaactttacagatacattttgt

SEQ ID NO: 9078997 - DNA, 22 bp, Homo sapiens
aagacattgtggagatgttgct

SEQ ID NO: 9078998 - DNA, 22 bp, Homo sapiens
aagacattgtcattttataatt

SEQ ID NO: 9078999 - DNA, 22 bp, Homo sapiens
aagacattgtcattttataatt

SEQ ID NO: 9079000 - DNA, 22 bp, Homo sapiens
aagacattggcattgactgtaa

SEQ ID NO: 9079001 - DNA, 22 bp, Homo sapiens
aagacattgctgcttttaattg

SEQ ID NO: 9079002 - DNA, 22 bp, Homo sapiens
aagacattggacaatccagagg

SEQ ID NO: 9079003 - DNA, 22 bp, Homo sapiens
aagacattggcattgactgtaa

SEQ ID NO: 9079004 - DNA, 22 bp, Homo sapiens
aagacattccaaagtggctaat

SEQ ID NO: 9079005 - DNA, 22 bp, Homo sapiens
aagacattcatgaagaagggat

SEQ ID NO: 9079006 - DNA, 22 bp, Homo sapiens
aagacattgcatgataatgctg

SEQ ID NO: 9079007 - DNA, 22 bp, Homo sapiens
aagacattccaaagtggctaat

SEQ ID NO: 9079008 - DNA, 22 bp, Homo sapiens
aagacattagaatcagcctgtt

SEQ ID NO: 9079009 - DNA, 22 bp, Homo sapiens
aagacattcacaaatgttcact

SEQ ID NO: 9079010 - DNA, 22 bp, Homo sapiens
aagaggagtagatgtggttggt

SEQ ID NO: 9079011 - DNA, 19 bp, Homo sapiens
aagaggcaaccctcgagcc

SEQ ID NO: 9079012 - DNA, 23 bp, Homo sapiens
aagaggaggccctgctcccgtcc

SEQ ID NO: 9079013 - DNA, 22 bp, Homo sapiens
aagaggagggcagattcaaggc

SEQ ID NO: 9079014 - DNA, 22 bp, Homo sapiens
aagaggcagaaatatcgctgaa

SEQ ID NO: 9079015 - DNA, 22 bp, Homo sapiens
aagaggcagtggtgatgaatgg

SEQ ID NO: 9079016 - DNA, 22 bp, Homo sapiens
aagaggaggattgatgtgggag

SEQ ID NO: 9079017 - DNA, 22 bp, Homo sapiens
aagaggaggattgatgtgggag

SEQ ID NO: 9079018 - DNA, 21 bp, Homo sapiens
aagaggaagcattatggcata

SEQ ID NO: 9079019 - DNA, 22 bp, Homo sapiens
aagacattttgaaattggaagc

SEQ ID NO: 9079020 - DNA, 22 bp, Homo sapiens
aagacattttagagatagggaa

SEQ ID NO: 9079021 - DNA, 22 bp, Homo sapiens
aagacatttatttgaatcaatt

SEQ ID NO: 9079022 - DNA, 22 bp, Homo sapiens
acacacagcgcctaccatgtgc

SEQ ID NO: 9079023 - DNA, 22 bp, Homo sapiens
acacacagagtttatacaggca

SEQ ID NO: 9079024 - DNA, 22 bp, Homo sapiens
acacacagagtttatacaggca

SEQ ID NO: 9079025 - DNA, 20 bp, Homo sapiens
acacacagagacatgcgcat

SEQ ID NO: 9079026 - DNA, 22 bp, Homo sapiens
acacacaggtaaaggagcctgg

SEQ ID NO: 9079027 - DNA, 19 bp, Homo sapiens
aagagggaaagtgctatgc

SEQ ID NO: 9079028 - DNA, 22 bp, Homo sapiens
aagaggtagcagtcacaaaaga

SEQ ID NO: 9079029 - DNA, 20 bp, Homo sapiens
aagaggtgataacaggtgag

SEQ ID NO: 9079030 - DNA, 22 bp, Homo sapiens
aagagtggagctggaaagtggg

SEQ ID NO: 9079031 - DNA, 20 bp, Homo sapiens
aagagtctttactgagctaa

SEQ ID NO: 9079032 - DNA, 22 bp, Homo sapiens
aagagtctattggaactagaca

SEQ ID NO: 9079033 - DNA, 22 bp, Homo sapiens
aagagtttaattttgtctagac

SEQ ID NO: 9079034 - DNA, 22 bp, Homo sapiens
aagagtttaccagtgctgcttc

SEQ ID NO: 9079035 - DNA, 22 bp, Homo sapiens
aagagtttaattttgtctagac

SEQ ID NO: 9079036 - DNA, 22 bp, Homo sapiens
aagagtttaattttgtctagac

SEQ ID NO: 9079037 - DNA, 22 bp, Homo sapiens
aagagttctcagaaacgtgggt

SEQ ID NO: 9079038 - DNA, 22 bp, Homo sapiens
aagagttatacctatttctaac

SEQ ID NO: 9079039 - DNA, 22 bp, Homo sapiens
aagagtcccaaaatgattctta

SEQ ID NO: 9079040 - DNA, 22 bp, Homo sapiens
aagagtctattggaactagaca

SEQ ID NO: 9079041 - DNA, 22 bp, Homo sapiens
aagagtcatagagacattgatt

SEQ ID NO: 9079042 - DNA, 22 bp, Homo sapiens
aagagtcagcttctgtatgggt

SEQ ID NO: 9079043 - DNA, 19 bp, Homo sapiens
aagagtcacaggcagccct

SEQ ID NO: 9079044 - DNA, 22 bp, Homo sapiens
aagaggttctccttggagtggg

SEQ ID NO: 9079045 - DNA, 22 bp, Homo sapiens
aagaggttgtctgtgatgagtt

SEQ ID NO: 9079046 - DNA, 22 bp, Homo sapiens
aagaggttgtacctaaagtgtt

SEQ ID NO: 9079047 - DNA, 22 bp, Homo sapiens
acactacagggagaagactcac

SEQ ID NO: 9079048 - DNA, 22 bp, Homo sapiens
acactacagggagaagactcac

SEQ ID NO: 9079049 - DNA, 22 bp, Homo sapiens
acactacagggccgggatggaa

SEQ ID NO: 9079050 - DNA, 22 bp, Homo sapiens
acactaattaagctgctttact

SEQ ID NO: 9079051 - DNA, 22 bp, Homo sapiens
acactacaacagcagaggtgag

SEQ ID NO: 9079052 - DNA, 22 bp, Homo sapiens
acactacaatctcagaactata

SEQ ID NO: 9079053 - DNA, 22 bp, Homo sapiens
acactacaatctcagaactata

SEQ ID NO: 9079054 - DNA, 22 bp, Homo sapiens
acactaaggttggagtcacagt

SEQ ID NO: 9079055 - DNA, 22 bp, Homo sapiens
acactaatcttttatttggttt

SEQ ID NO: 9079056 - DNA, 22 bp, Homo sapiens
acacggcactttaggaaggggc

SEQ ID NO: 9079057 - DNA, 22 bp, Homo sapiens
acacggcactttaggaaggggc

SEQ ID NO: 9079058 - DNA, 22 bp, Homo sapiens
acacggaaaaggagacagaggg

SEQ ID NO: 9079059 - DNA, 23 bp, Homo sapiens
acacctgtgctgtagtcactaca

SEQ ID NO: 9079060 - DNA, 22 bp, Homo sapiens
acacatttctcccagtctccat

SEQ ID NO: 9079061 - DNA, 23 bp, Homo sapiens
aagagtttagagtcttgcagagt

SEQ ID NO: 9079062 - DNA, 22 bp, Homo sapiens
acagatgaaaaagcttgtggat

SEQ ID NO: 9079063 - DNA, 23 bp, Homo sapiens
acagatgaaagtgtggctcagag

SEQ ID NO: 9079064 - DNA, 22 bp, Homo sapiens
acagatgaaacccagctagttg

SEQ ID NO: 9079065 - DNA, 22 bp, Homo sapiens
acagatgaatttatggatggaa

SEQ ID NO: 9079066 - DNA, 22 bp, Homo sapiens
acagatgaatttatggatggaa

SEQ ID NO: 9079067 - DNA, 22 bp, Homo sapiens
acagatgaattttaattgtgtt

SEQ ID NO: 9079068 - DNA, 22 bp, Homo sapiens
acagatgagaagctgcattcaa

SEQ ID NO: 9079069 - DNA, 22 bp, Homo sapiens
acagatgagactccaggacctt

SEQ ID NO: 9079070 - DNA, 22 bp, Homo sapiens
acagatgagaagctgcattcaa

SEQ ID NO: 9079071 - DNA, 22 bp, Homo sapiens
aagcacatctcctgtgcagaac

SEQ ID NO: 9079072 - DNA, 22 bp, Homo sapiens
aagcacattaaggaacattgaa

SEQ ID NO: 9079073 - DNA, 22 bp, Homo sapiens
aagcacatgagctattcatgct

SEQ ID NO: 9079074 - DNA, 22 bp, Homo sapiens
aagcacattgtacatttgtgct

SEQ ID NO: 9079075 - DNA, 22 bp, Homo sapiens
aagcacattgtacatttgtgct

SEQ ID NO: 9079076 - DNA, 22 bp, Homo sapiens
aagcacattgcctggcacatag

SEQ ID NO: 9079077 - DNA, 22 bp, Homo sapiens
aagcaaaaggttacacttctgg

SEQ ID NO: 9079078 - DNA, 22 bp, Homo sapiens
aagcaaaaggttacacttctgg

SEQ ID NO: 9079079 - DNA, 22 bp, Homo sapiens
aagcaaacaggagaagagctgt

SEQ ID NO: 9079080 - DNA, 22 bp, Homo sapiens
acagagcacatagattggagtt

SEQ ID NO: 9079081 - DNA, 22 bp, Homo sapiens
acagagcttcccagcctgagca

SEQ ID NO: 9079082 - DNA, 22 bp, Homo sapiens
acagagcttcccagcctgagca

SEQ ID NO: 9079083 - DNA, 22 bp, Homo sapiens
acagagcttaggatgactccca

SEQ ID NO: 9079084 - DNA, 22 bp, Homo sapiens
acagagcttaattcaggagctt

SEQ ID NO: 9079085 - DNA, 22 bp, Homo sapiens
aagcacagttcttagagttaca

SEQ ID NO: 9079086 - DNA, 22 bp, Homo sapiens
aagcacagttcttagagttaca

SEQ ID NO: 9079087 - DNA, 22 bp, Homo sapiens
acagaggacaactaggcgctca

SEQ ID NO: 9079088 - DNA, 18 bp, Homo sapiens
acagaggcagacatgtat

SEQ ID NO: 9079089 - DNA, 18 bp, Homo sapiens
acagaggcagacatgtat

SEQ ID NO: 9079090 - DNA, 22 bp, Homo sapiens
acagaggacaactaggcgctca

SEQ ID NO: 9079091 - DNA, 22 bp, Homo sapiens
acagaggaagcatatagcacaa

SEQ ID NO: 9079092 - DNA, 22 bp, Homo sapiens
acagaggaaggctgagctgccc

SEQ ID NO: 9079093 - DNA, 22 bp, Homo sapiens
acagaggaaggctgagctgccc

SEQ ID NO: 9079094 - DNA, 22 bp, Homo sapiens
acagaggacaactaggcgctca

SEQ ID NO: 9079095 - DNA, 22 bp, Homo sapiens
acagaggacaactaggcgctca

SEQ ID NO: 9079096 - DNA, 22 bp, Homo sapiens
aagatttggtatcagaagacct

SEQ ID NO: 9079097 - DNA, 22 bp, Homo sapiens
acagaagcagccgtcacagata

SEQ ID NO: 9079098 - DNA, 22 bp, Homo sapiens
acagaagaccagagagctaact

SEQ ID NO: 9079099 - DNA, 22 bp, Homo sapiens
aagattttctcaactgtatttg

SEQ ID NO: 9079100 - DNA, 22 bp, Homo sapiens
aagatttgtggatttaaggata

SEQ ID NO: 9079101 - DNA, 22 bp, Homo sapiens
aagattttctcaactgtatttg

SEQ ID NO: 9079102 - DNA, 22 bp, Homo sapiens
aagatttttttccacagactca

SEQ ID NO: 9079103 - DNA, 22 bp, Homo sapiens
aagatttttttccacagactca

SEQ ID NO: 9079104 - DNA, 22 bp, Homo sapiens
aagatttttttccacagactca

SEQ ID NO: 9079105 - DNA, 22 bp, Homo sapiens
aagatacatcattcaggagtga

SEQ ID NO: 9079106 - DNA, 22 bp, Homo sapiens
aagatacattttcttcagagaa

SEQ ID NO: 9079107 - DNA, 22 bp, Homo sapiens
aagatactttgcatgcatgaag

SEQ ID NO: 9079108 - DNA, 22 bp, Homo sapiens
aagatactgatgatgtaggcta

SEQ ID NO: 9079109 - DNA, 22 bp, Homo sapiens
aagatacttcacttgccgaaat

SEQ ID NO: 9079110 - DNA, 20 bp, Homo sapiens
aagatactccagaaattaaa

SEQ ID NO: 9079111 - DNA, 22 bp, Homo sapiens
aagatactcagtggatatgcat

SEQ ID NO: 9079112 - DNA, 22 bp, Homo sapiens
aagatatagataaaactatgca

SEQ ID NO: 9079113 - DNA, 22 bp, Homo sapiens
aagatataataactgttgtcat

SEQ ID NO: 9079114 - DNA, 19 bp, Homo sapiens
acagaaatgtaagtgagac

SEQ ID NO: 9079115 - DNA, 19 bp, Homo sapiens
acagaaatgtaagtgagac

SEQ ID NO: 9079116 - DNA, 22 bp, Homo sapiens
acagaactttctgatcctgagc

SEQ ID NO: 9079117 - DNA, 22 bp, Homo sapiens
acagaagaagttcaaggtgaag

SEQ ID NO: 9079118 - DNA, 22 bp, Homo sapiens
acagaagaagttcaaggtgaag

SEQ ID NO: 9079119 - DNA, 19 bp, Homo sapiens
aacaagtaggaatggaaga

SEQ ID NO: 9079120 - DNA, 22 bp, Homo sapiens
aacaagttactcttaaagtata

SEQ ID NO: 9079121 - DNA, 22 bp, Homo sapiens
aacaagcagatgcaatgcactt

SEQ ID NO: 9079122 - DNA, 22 bp, Homo sapiens
aacaataactagacatgccatg

SEQ ID NO: 9079123 - DNA, 22 bp, Homo sapiens
aacaataactagacatgccatg

SEQ ID NO: 9079124 - DNA, 22 bp, Homo sapiens
aagggagacccaccgtcctgga

SEQ ID NO: 9079125 - DNA, 22 bp, Homo sapiens
aagggagacagttgtgtgagga

SEQ ID NO: 9079126 - DNA, 22 bp, Homo sapiens
aacaagttgttgaaaataatta

SEQ ID NO: 9079127 - DNA, 22 bp, Homo sapiens
aacaagttagggtcttttactt

SEQ ID NO: 9079128 - DNA, 22 bp, Homo sapiens
aacaagttactcttaaagtata

SEQ ID NO: 9079129 - DNA, 22 bp, Homo sapiens
aacaagttactcttaaagtata

SEQ ID NO: 9079130 - DNA, 22 bp, Homo sapiens
aacaagttagggtcttttactt

SEQ ID NO: 9079131 - DNA, 22 bp, Homo sapiens
aacaagttctacctcacaaggt

SEQ ID NO: 9079132 - DNA, 22 bp, Homo sapiens
aaatttcagttggaatgagctc

SEQ ID NO: 9079133 - DNA, 22 bp, Homo sapiens
aaatttcaagcaaagtagctat

SEQ ID NO: 9079134 - DNA, 22 bp, Homo sapiens
aaatttctaagcagccacttcc

SEQ ID NO: 9079135 - DNA, 22 bp, Homo sapiens
aaggccaaagttttcaggctaa

SEQ ID NO: 9079136 - DNA, 22 bp, Homo sapiens
aaggccaaagacacctacacag

SEQ ID NO: 9079137 - DNA, 22 bp, Homo sapiens
aaggccaaagacacctacacag

SEQ ID NO: 9079138 - DNA, 22 bp, Homo sapiens
aaggccacacttgctggccagc

SEQ ID NO: 9079139 - DNA, 22 bp, Homo sapiens
aaggccaactaggatgagctag

SEQ ID NO: 9079140 - DNA, 22 bp, Homo sapiens
aaggccaaggctgcagtgagcc

SEQ ID NO: 9079141 - DNA, 22 bp, Homo sapiens
aaggccaactaggatgagctag

SEQ ID NO: 9079142 - DNA, 22 bp, Homo sapiens
aaggccaaggctgcagtgagcc

SEQ ID NO: 9079143 - DNA, 22 bp, Homo sapiens
aaggccacagagcctcagagag

SEQ ID NO: 9079144 - DNA, 22 bp, Homo sapiens
aaggccacgtctccttccagag

SEQ ID NO: 9079145 - DNA, 22 bp, Homo sapiens
aacaatgatatagggattggca

SEQ ID NO: 9079146 - DNA, 22 bp, Homo sapiens
aagtatgtctttgggtattatt

SEQ ID NO: 9079147 - DNA, 22 bp, Homo sapiens
aagtacagaaatagcaggtgca

SEQ ID NO: 9079148 - DNA, 22 bp, Homo sapiens
aagtacaatctttctgtaaagg

SEQ ID NO: 9079149 - DNA, 22 bp, Homo sapiens
aacaatgaccacacaatgtact

SEQ ID NO: 9079150 - DNA, 22 bp, Homo sapiens
aacaatgaggatctgttctgag

SEQ ID NO: 9079151 - DNA, 22 bp, Homo sapiens
aacaatcaagtttctaaatgac

SEQ ID NO: 9079152 - DNA, 22 bp, Homo sapiens
aacaatcaagtttctaaatgac

SEQ ID NO: 9079153 - DNA, 22 bp, Homo sapiens
aagggggcacagtcactgtaat

SEQ ID NO: 9079154 - DNA, 17 bp, Homo sapiens
aacaataggatgtgtat

SEQ ID NO: 9079155 - DNA, 22 bp, Homo sapiens
aacaataggagtgatgcagtat

SEQ ID NO: 9079156 - DNA, 22 bp, Homo sapiens
aacaataggagtgatgcagtat

SEQ ID NO: 9079157 - DNA, 22 bp, Homo sapiens
aagggagccaagaaagcagggc

SEQ ID NO: 9079158 - DNA, 22 bp, Homo sapiens
aagggagcaaatggacagacgg

SEQ ID NO: 9079159 - DNA, 22 bp, Homo sapiens
aagggagaggagggtcttgttg

SEQ ID NO: 9079160 - DNA, 22 bp, Homo sapiens
aagggaggaggatttattgtac

SEQ ID NO: 9079161 - DNA, 22 bp, Homo sapiens
aagggaggccagaggttttgca

SEQ ID NO: 9079162 - DNA, 22 bp, Homo sapiens
aagggagcttaggagatcaggc

SEQ ID NO: 9079163 - DNA, 22 bp, Homo sapiens
aagggaggaggatttattgtac

SEQ ID NO: 9079164 - DNA, 22 bp, Homo sapiens
aagggagcggggagaccctatg

SEQ ID NO: 9079165 - DNA, 22 bp, Homo sapiens
aagggagcttaggagatcaggc

SEQ ID NO: 9079166 - DNA, 22 bp, Homo sapiens
aaggggaagtagcaccagaggt

SEQ ID NO: 9079167 - DNA, 22 bp, Homo sapiens
aaggggaagagaccgcagagtc

SEQ ID NO: 9079168 - DNA, 22 bp, Homo sapiens
aaggggaagtagcaccagaggt

SEQ ID NO: 9079169 - DNA, 22 bp, Homo sapiens
aaggggagttagtgataaaacc

SEQ ID NO: 9079170 - DNA, 22 bp, Homo sapiens
aaggggagatgtcatgggccct

SEQ ID NO: 9079171 - DNA, 22 bp, Homo sapiens
aaggggcctcacagatgggctt

SEQ ID NO: 9079172 - DNA, 23 bp, Homo sapiens
aaggggatacttccactttcttt

SEQ ID NO: 9079173 - DNA, 21 bp, Homo sapiens
aaattgccacacatttcttcc

SEQ ID NO: 9079174 - DNA, 22 bp, Homo sapiens
aaattgcctgagtatgtcacat

SEQ ID NO: 9079175 - DNA, 22 bp, Homo sapiens
aaattgccaaattgttttccag

SEQ ID NO: 9079176 - DNA, 22 bp, Homo sapiens
aaattgcattttaaaggtagat

SEQ ID NO: 9079177 - DNA, 22 bp, Homo sapiens
aaatttaaaaagcagcattgca

SEQ ID NO: 9079178 - DNA, 22 bp, Homo sapiens
aaatttaaaaagcagcattgca

SEQ ID NO: 9079179 - DNA, 22 bp, Homo sapiens
aaggagaaatggtagatgtgca

SEQ ID NO: 9079180 - DNA, 22 bp, Homo sapiens
aaggactgaataattctctttc

SEQ ID NO: 9079181 - DNA, 22 bp, Homo sapiens
aaggactggcattatcttatgt

SEQ ID NO: 9079182 - DNA, 22 bp, Homo sapiens
aaggaccagattatccttaata

SEQ ID NO: 9079183 - DNA, 22 bp, Homo sapiens
aaggacctgattttgagcatct

SEQ ID NO: 9079184 - DNA, 21 bp, Homo sapiens
aaggacgaggttttgattaca

SEQ ID NO: 9079185 - DNA, 22 bp, Homo sapiens
aaattattatgcccctctataa

SEQ ID NO: 9079186 - DNA, 22 bp, Homo sapiens
aaattatcatgggggagaaaca

SEQ ID NO: 9079187 - DNA, 22 bp, Homo sapiens
aaattattacaagctagttggc

SEQ ID NO: 9079188 - DNA, 22 bp, Homo sapiens
aaattagtacattgcaaagtcc

SEQ ID NO: 9079189 - DNA, 22 bp, Homo sapiens
aaattagtacattgcaaagtcc

SEQ ID NO: 9079190 - DNA, 22 bp, Homo sapiens
aaattaactatcacttttgtga

SEQ ID NO: 9079191 - DNA, 22 bp, Homo sapiens
aaattataggtgccaccttgga

SEQ ID NO: 9079192 - DNA, 22 bp, Homo sapiens
aaattagtcggtttaggaattt

SEQ ID NO: 9079193 - DNA, 22 bp, Homo sapiens
aaattagtcggtttaggaattt

SEQ ID NO: 9079194 - DNA, 22 bp, Homo sapiens
aaattagtcggtttaggaattt

SEQ ID NO: 9079195 - DNA, 22 bp, Homo sapiens
aaattagtcatgttgtattact

SEQ ID NO: 9079196 - DNA, 22 bp, Homo sapiens
aagctgtatgacctaaatcttg

SEQ ID NO: 9079197 - DNA, 22 bp, Homo sapiens
aagctgtgaaatagattacaca

SEQ ID NO: 9079198 - DNA, 22 bp, Homo sapiens
aagctgtgaaatagattacaca

SEQ ID NO: 9079199 - DNA, 20 bp, Homo sapiens
aagctgggtaggagaggagc

SEQ ID NO: 9079200 - DNA, 22 bp, Homo sapiens
aagctggggactcagaccccat

SEQ ID NO: 9079201 - DNA, 22 bp, Homo sapiens
aagctttggaagggcagggttg

SEQ ID NO: 9079202 - DNA, 22 bp, Homo sapiens
aagcttttgacttggtagggaa

SEQ ID NO: 9079203 - DNA, 21 bp, Homo sapiens
aagcttttcctgagagttgtc

SEQ ID NO: 9079204 - DNA, 22 bp, Homo sapiens
aagccagcattttcccattcct

SEQ ID NO: 9079205 - DNA, 22 bp, Homo sapiens
aagccagatttcactcttaatt

SEQ ID NO: 9079206 - DNA, 22 bp, Homo sapiens
aagccagccagtgccagtctta

SEQ ID NO: 9079207 - DNA, 22 bp, Homo sapiens
aagccattcccatagacttcag

SEQ ID NO: 9079208 - DNA, 22 bp, Homo sapiens
aagccatcttgtttatatgtta

SEQ ID NO: 9079209 - DNA, 22 bp, Homo sapiens
aagctggcaaacaagcatcatt

SEQ ID NO: 9079210 - DNA, 22 bp, Homo sapiens
aagctggcaaacaagcatcatt

SEQ ID NO: 9079211 - DNA, 22 bp, Homo sapiens
aagctggcaattatcaaaactg

SEQ ID NO: 9079212 - DNA, 22 bp, Homo sapiens
aagccatttgttgtccttcagg

SEQ ID NO: 9079213 - DNA, 22 bp, Homo sapiens
aagcccagatgagatccctgga

SEQ ID NO: 9079214 - DNA, 20 bp, Homo sapiens
aagctggcaggtcatagctt

SEQ ID NO: 9079215 - DNA, 22 bp, Homo sapiens
aagctggcaattatcaaaactg

SEQ ID NO: 9079216 - DNA, 19 bp, Homo sapiens
aagctggcagaatattgcc

SEQ ID NO: 9079217 - DNA, 22 bp, Homo sapiens
aagctggcatgtcacctgagaa

SEQ ID NO: 9079218 - DNA, 22 bp, Homo sapiens
aagctggcctcaaactcctagc

SEQ ID NO: 9079219 - DNA, 22 bp, Homo sapiens
aagctggcctgtacctgctgag

SEQ ID NO: 9079220 - DNA, 22 bp, Homo sapiens
aagctggctctgatgtcagaat

SEQ ID NO: 9079221 - DNA, 22 bp, Homo sapiens
aagctggctaaataaaaggtcc

SEQ ID NO: 9079222 - DNA, 23 bp, Homo sapiens
aagctggctgggagcagaaggga

SEQ ID NO: 9079223 - DNA, 23 bp, Homo sapiens
aagctggctgggagcagaaggga

SEQ ID NO: 9079224 - DNA, 22 bp, Homo sapiens
aacatttatggtagtcattgca

SEQ ID NO: 9079225 - DNA, 22 bp, Homo sapiens
aacatttatggtagtcattgca

SEQ ID NO: 9079226 - DNA, 22 bp, Homo sapiens
aacatttattctaattctggga

SEQ ID NO: 9079227 - DNA, 22 bp, Homo sapiens
aacatttattgagcacctactg

SEQ ID NO: 9079228 - DNA, 22 bp, Homo sapiens
aacatttattgagcacctactg

SEQ ID NO: 9079229 - DNA, 22 bp, Homo sapiens
aacatttatatgggttcatgaa

SEQ ID NO: 9079230 - DNA, 22 bp, Homo sapiens
aacatttacaaatccttctgca

SEQ ID NO: 9079231 - DNA, 22 bp, Homo sapiens
aacatttaggaaggacctcctc

SEQ ID NO: 9079232 - DNA, 22 bp, Homo sapiens
aacatttcagcaaataagaaca

SEQ ID NO: 9079233 - DNA, 22 bp, Homo sapiens
aacatttcagcaaataagaaca

SEQ ID NO: 9079234 - DNA, 21 bp, Homo sapiens
aacatttcaggatccaaattg

SEQ ID NO: 9079235 - DNA, 22 bp, Homo sapiens
aatcacatgtgggtcttgtagc

SEQ ID NO: 9079236 - DNA, 22 bp, Homo sapiens
aatcacatgtgctcaattttaa

SEQ ID NO: 9079237 - DNA, 22 bp, Homo sapiens
aatcacatgtgctcaattttaa

SEQ ID NO: 9079238 - DNA, 22 bp, Homo sapiens
aacattcttaagatttgtgtct

SEQ ID NO: 9079239 - DNA, 22 bp, Homo sapiens
aacattctggttctaaaaacct

SEQ ID NO: 9079240 - DNA, 22 bp, Homo sapiens
aacattaagatggcggaacagt

SEQ ID NO: 9079241 - DNA, 22 bp, Homo sapiens
aacattaagatggcggaacagt

SEQ ID NO: 9079242 - DNA, 22 bp, Homo sapiens
aacatgttgctttaataatatt

SEQ ID NO: 9079243 - DNA, 22 bp, Homo sapiens
aacattgaaatatttgcaatag

SEQ ID NO: 9079244 - DNA, 22 bp, Homo sapiens
aacattctttagctcttcctgc

SEQ ID NO: 9079245 - DNA, 22 bp, Homo sapiens
aacattgagttctacttccatt

SEQ ID NO: 9079246 - DNA, 22 bp, Homo sapiens
aacattgaaatatttgcaatag

SEQ ID NO: 9079247 - DNA, 22 bp, Homo sapiens
aacattgaatttaaaatacagt

SEQ ID NO: 9079248 - DNA, 22 bp, Homo sapiens
aacattgcattctctatgagat

SEQ ID NO: 9079249 - DNA, 22 bp, Homo sapiens
aacatttacaaatccttctgca

SEQ ID NO: 9079250 - DNA, 22 bp, Homo sapiens
aacattgttttccctatatcca

SEQ ID NO: 9079251 - DNA, 20 bp, Homo sapiens
aacattgtttgtaaaagcag

SEQ ID NO: 9079252 - DNA, 22 bp, Homo sapiens
aaccaggaattgcagggctgca

SEQ ID NO: 9079253 - DNA, 22 bp, Homo sapiens
aaccagagtgacactctacaga

SEQ ID NO: 9079254 - DNA, 22 bp, Homo sapiens
aatcacttttctctaatgtagc

SEQ ID NO: 9079255 - DNA, 22 bp, Homo sapiens
aatcactttgcactcttatttg

SEQ ID NO: 9079256 - DNA, 22 bp, Homo sapiens
aatcacttaatagctacactgg

SEQ ID NO: 9079257 - DNA, 22 bp, Homo sapiens
aatcacatttacattgctaatt

SEQ ID NO: 9079258 - DNA, 22 bp, Homo sapiens
aatcacattagtgaaacactga

SEQ ID NO: 9079259 - DNA, 22 bp, Homo sapiens
aatcacattagtgaaacactga

SEQ ID NO: 9079260 - DNA, 22 bp, Homo sapiens
aatcacattacagcatatctgt

SEQ ID NO: 9079261 - DNA, 22 bp, Homo sapiens
aaccagtcccagtgagatgaac

SEQ ID NO: 9079262 - DNA, 22 bp, Homo sapiens
aaccagtgaaacaccaggcaag

SEQ ID NO: 9079263 - DNA, 22 bp, Homo sapiens
aaccaggtgactcatggtgagc

SEQ ID NO: 9079264 - DNA, 22 bp, Homo sapiens
aaccaggagattaaagaaaggt

SEQ ID NO: 9079265 - DNA, 22 bp, Homo sapiens
aaccatgctagcatcaaaatgt

SEQ ID NO: 9079266 - DNA, 22 bp, Homo sapiens
aactcagttacatattagaata

SEQ ID NO: 9079267 - DNA, 22 bp, Homo sapiens
aactccaggcagggaggccact

SEQ ID NO: 9079268 - DNA, 22 bp, Homo sapiens
aactccagggggtcaatattta

SEQ ID NO: 9079269 - DNA, 20 bp, Homo sapiens
aactcctagcctcaagtgat

SEQ ID NO: 9079270 - DNA, 22 bp, Homo sapiens
aataaactgctcaattgcatca

SEQ ID NO: 9079271 - DNA, 20 bp, Homo sapiens
aataaactactgagagatgt

SEQ ID NO: 9079272 - DNA, 20 bp, Homo sapiens
aataaactactgagagatgt

SEQ ID NO: 9079273 - DNA, 22 bp, Homo sapiens
aacagtttgagctttgaatttc

SEQ ID NO: 9079274 - DNA, 22 bp, Homo sapiens
aacagtttgagctttgaatttc

SEQ ID NO: 9079275 - DNA, 22 bp, Homo sapiens
aacagtttgcctgaaatgtatt

SEQ ID NO: 9079276 - DNA, 20 bp, Homo sapiens
aagtttgccccaggaaattg

SEQ ID NO: 9079277 - DNA, 22 bp, Homo sapiens
aagtttgatgagtttctggagg

SEQ ID NO: 9079278 - DNA, 21 bp, Homo sapiens
aagtttgggattcagtttcca

SEQ ID NO: 9079279 - DNA, 22 bp, Homo sapiens
aataaaatggtcagttttctca

SEQ ID NO: 9079280 - DNA, 22 bp, Homo sapiens
aataaaatggtcagttttctca

SEQ ID NO: 9079281 - DNA, 22 bp, Homo sapiens
aataaaatggtcagttttctca

SEQ ID NO: 9079282 - DNA, 22 bp, Homo sapiens
aataaaatggtcagttttctca

SEQ ID NO: 9079283 - DNA, 22 bp, Homo sapiens
aagttgatttaaactactagtc

SEQ ID NO: 9079284 - DNA, 20 bp, Homo sapiens
aagttgcagagagttgtctt

SEQ ID NO: 9079285 - DNA, 22 bp, Homo sapiens
aagttgctaatgatgtgtttgc

SEQ ID NO: 9079286 - DNA, 22 bp, Homo sapiens
aagtttctgtatgctcttctgt

SEQ ID NO: 9079287 - DNA, 22 bp, Homo sapiens
aagtttctgttcatatctctga

SEQ ID NO: 9079288 - DNA, 22 bp, Homo sapiens
aagtcaagataaaggtgctggc

SEQ ID NO: 9079289 - DNA, 22 bp, Homo sapiens
aagtcaaagctttcagaggaaa

SEQ ID NO: 9079290 - DNA, 22 bp, Homo sapiens
aacactgagggaaaagagatag

SEQ ID NO: 9079291 - DNA, 20 bp, Homo sapiens
aacactgagggctactcttc

SEQ ID NO: 9079292 - DNA, 22 bp, Homo sapiens
aacactgagtatcagagttggg

SEQ ID NO: 9079293 - DNA, 22 bp, Homo sapiens
aacactgctgctgggttctgtg

SEQ ID NO: 9079294 - DNA, 20 bp, Homo sapiens
aacactgcttctatattttc

SEQ ID NO: 9079295 - DNA, 22 bp, Homo sapiens
aagtatttcgttctgaaaaagt

SEQ ID NO: 9079296 - DNA, 22 bp, Homo sapiens
aagtatttctggcctgtgaaag

SEQ ID NO: 9079297 - DNA, 22 bp, Homo sapiens
aagtattcataaggacatatgt

SEQ ID NO: 9079298 - DNA, 22 bp, Homo sapiens
aagtattcataaggacatatgt

SEQ ID NO: 9079299 - DNA, 22 bp, Homo sapiens
aagtattcataaggacatatgt

SEQ ID NO: 9079300 - DNA, 22 bp, Homo sapiens
aagtattatttaacaaatttgt

SEQ ID NO: 9079301 - DNA, 22 bp, Homo sapiens
aagtattctacaaagaaattga

SEQ ID NO: 9079302 - DNA, 22 bp, Homo sapiens
aagtattctggcagtcattcag

SEQ ID NO: 9079303 - DNA, 22 bp, Homo sapiens
aagtattctacaaagaaattga

SEQ ID NO: 9079304 - DNA, 19 bp, Homo sapiens
aagtattctttgttagcag

SEQ ID NO: 9079305 - DNA, 22 bp, Homo sapiens
aagtattctggcagtcattcag

SEQ ID NO: 9079306 - DNA, 23 bp, Homo sapiens
aagttcttttagatgtcttcgtg

SEQ ID NO: 9079307 - DNA, 22 bp, Homo sapiens
aagttgagatgtcataggagac

SEQ ID NO: 9079308 - DNA, 22 bp, Homo sapiens
aagttgaatgcgtacgtgacat

SEQ ID NO: 9079309 - DNA, 22 bp, Homo sapiens
aagttgatcaagtagcgagttc

SEQ ID NO: 9079310 - DNA, 22 bp, Homo sapiens
aagttgatagcatgttaagctc

SEQ ID NO: 9079311 - DNA, 19 bp, Homo sapiens
aagttgatcattttgacag

SEQ ID NO: 9079312 - DNA, 22 bp, Homo sapiens
aagttgatggcgtctttgagat

SEQ ID NO: 9079313 - DNA, 22 bp, Homo sapiens
aagttgattaatctttcgagaa

SEQ ID NO: 9079314 - DNA, 22 bp, Homo sapiens
aagttgattgcttcaaatttct

SEQ ID NO: 9079315 - DNA, 22 bp, Homo sapiens
aagttctttctggaaggtctgc

SEQ ID NO: 9079316 - DNA, 23 bp, Homo sapiens
aagttcttttagatgtcttcgtg

SEQ ID NO: 9079317 - DNA, 22 bp, Homo sapiens
aagttcttggaggatgaagagt

SEQ ID NO: 9079318 - DNA, 22 bp, Homo sapiens
aagttcttgctgtgtgtcagat

SEQ ID NO: 9079319 - DNA, 22 bp, Homo sapiens
aagttcttgataagtccactgt

SEQ ID NO: 9079320 - DNA, 22 bp, Homo sapiens
aagttcttagacaagcttgtgg

SEQ ID NO: 9079321 - DNA, 20 bp, Homo sapiens
aagttacattgtattgtacc

SEQ ID NO: 9079322 - DNA, 22 bp, Homo sapiens
aagttctgaagggttctgcaga

SEQ ID NO: 9079323 - DNA, 22 bp, Homo sapiens
aagttctatatctgcctcacca

SEQ ID NO: 9079324 - DNA, 22 bp, Homo sapiens
aagttctatgaatctactccaa

SEQ ID NO: 9079325 - DNA, 23 bp, Homo sapiens
aagttctattagtgctggtctag

SEQ ID NO: 9079326 - DNA, 22 bp, Homo sapiens
aagttctattgtcactttatta

SEQ ID NO: 9079327 - DNA, 19 bp, Homo sapiens
aagttctcagagttcaaag

SEQ ID NO: 9079328 - DNA, 22 bp, Homo sapiens
aacactgtaacagcatcatttt

SEQ ID NO: 9079329 - DNA, 22 bp, Homo sapiens
aacaagaagagagggacgtaat

SEQ ID NO: 9079330 - DNA, 22 bp, Homo sapiens
aacaagaagagagggacgtaat

SEQ ID NO: 9079331 - DNA, 22 bp, Homo sapiens
aacaagaagggaaggcatgatt

SEQ ID NO: 9079332 - DNA, 22 bp, Homo sapiens
aacaagaacacctacagttcta

SEQ ID NO: 9079333 - DNA, 22 bp, Homo sapiens
aacaatgttcttttagcttgaa

SEQ ID NO: 9079334 - DNA, 22 bp, Homo sapiens
aacaatgttcttttagcttgaa

SEQ ID NO: 9079335 - DNA, 22 bp, Homo sapiens
aacaatgttcttttagcttgaa

SEQ ID NO: 9079336 - DNA, 22 bp, Homo sapiens
aacaatgtgttcagcactgtgg

SEQ ID NO: 9079337 - DNA, 22 bp, Homo sapiens
aacaatgtgttcagcactgtgg

SEQ ID NO: 9079338 - DNA, 22 bp, Homo sapiens
aacaatgtgattgaagctagaa

SEQ ID NO: 9079339 - DNA, 22 bp, Homo sapiens
aacacaaagaagctgcaggatc

SEQ ID NO: 9079340 - DNA, 22 bp, Homo sapiens
aacacaaagaagctgcaggatc

SEQ ID NO: 9079341 - DNA, 22 bp, Homo sapiens
aacacataggcagagcatgaca

SEQ ID NO: 9079342 - DNA, 23 bp, Homo sapiens
aacacaaagctgattccagtggc

SEQ ID NO: 9079343 - DNA, 23 bp, Homo sapiens
aacacaaagctgattccagtggc

SEQ ID NO: 9079344 - DNA, 22 bp, Homo sapiens
aacacaaaaattctcaggggca

SEQ ID NO: 9079345 - DNA, 22 bp, Homo sapiens
aacacaaaaattctcaggggca

SEQ ID NO: 9079346 - DNA, 22 bp, Homo sapiens
aacaattgacacttcattgtga

SEQ ID NO: 9079347 - DNA, 22 bp, Homo sapiens
aacagctttgcttctggagaca

SEQ ID NO: 9079348 - DNA, 22 bp, Homo sapiens
aacagctttgcttctggagaca

SEQ ID NO: 9079349 - DNA, 22 bp, Homo sapiens
aacagctttgtatacagtaact

SEQ ID NO: 9079350 - DNA, 22 bp, Homo sapiens
aacagcttttttggtcagcatt

SEQ ID NO: 9079351 - DNA, 22 bp, Homo sapiens
aacagctttgtgctcagatttg

SEQ ID NO: 9079352 - DNA, 22 bp, Homo sapiens
aacagctttgagcagttctgta

SEQ ID NO: 9079353 - DNA, 22 bp, Homo sapiens
aacagcttgctgcaccttaata

SEQ ID NO: 9079354 - DNA, 22 bp, Homo sapiens
aacagctttagaggataatagt

SEQ ID NO: 9079355 - DNA, 22 bp, Homo sapiens
aacacattggaagccaagaatg

SEQ ID NO: 9079356 - DNA, 23 bp, Homo sapiens
aacacattgctaattacattcaa

SEQ ID NO: 9079357 - DNA, 22 bp, Homo sapiens
aacacatggcaagagcaggaaa

SEQ ID NO: 9079358 - DNA, 22 bp, Homo sapiens
aaagcaagtctctacaaagtac

SEQ ID NO: 9079359 - DNA, 22 bp, Homo sapiens
aaagcaagtctctacaaagtac

SEQ ID NO: 9079360 - DNA, 23 bp, Homo sapiens
aaatggtccttggctggcatctt

SEQ ID NO: 9079361 - DNA, 22 bp, Homo sapiens
aaagcaatggcacatgatggta

SEQ ID NO: 9079362 - DNA, 22 bp, Homo sapiens
aaagcaattacaaaagggataa

SEQ ID NO: 9079363 - DNA, 22 bp, Homo sapiens
aaagcaatgtctctgcctggtt

SEQ ID NO: 9079364 - DNA, 22 bp, Homo sapiens
aaatggtcactggtgagtgtca

SEQ ID NO: 9079365 - DNA, 22 bp, Homo sapiens
aaatgggcctggaaagaggatg

SEQ ID NO: 9079366 - DNA, 22 bp, Homo sapiens
aaatggctttgagggtaggaca

SEQ ID NO: 9079367 - DNA, 22 bp, Homo sapiens
aacaaattagttgcaagactgg

SEQ ID NO: 9079368 - DNA, 22 bp, Homo sapiens
aacaaattagttgcaagactgg

SEQ ID NO: 9079369 - DNA, 22 bp, Homo sapiens
aacaacaacggagaaagggttg

SEQ ID NO: 9079370 - DNA, 22 bp, Homo sapiens
aacaacaacggagaaagggttg

SEQ ID NO: 9079371 - DNA, 22 bp, Homo sapiens
aacaaccaaaaagatgaatgta

SEQ ID NO: 9079372 - DNA, 22 bp, Homo sapiens
aaagcacagagctcccacagga

SEQ ID NO: 9079373 - DNA, 22 bp, Homo sapiens
aaagcacagggtgctagagagt

SEQ ID NO: 9079374 - DNA, 22 bp, Homo sapiens
aaagcacagggtgctagagagt

SEQ ID NO: 9079375 - DNA, 22 bp, Homo sapiens
aaagcacagggtgctagagagt

SEQ ID NO: 9079376 - DNA, 22 bp, Homo sapiens
aaagcacatgagtagtgtagta

SEQ ID NO: 9079377 - DNA, 22 bp, Homo sapiens
aaagcacattacaagctcagtc

SEQ ID NO: 9079378 - DNA, 22 bp, Homo sapiens
aaagcacatgagtagtgtagta

SEQ ID NO: 9079379 - DNA, 22 bp, Homo sapiens
aaagcacattacaagctcagtc

SEQ ID NO: 9079380 - DNA, 22 bp, Homo sapiens
aaagcacattacaagctcagtc

SEQ ID NO: 9079381 - DNA, 22 bp, Homo sapiens
aaagcacatagtagaaggattt

SEQ ID NO: 9079382 - DNA, 22 bp, Homo sapiens
aaagcacatagtagaaggattt

SEQ ID NO: 9079383 - DNA, 22 bp, Homo sapiens
aaagcacatagtagaaggattt

SEQ ID NO: 9079384 - DNA, 22 bp, Homo sapiens
aacattctactgtactgcattg

SEQ ID NO: 9079385 - DNA, 22 bp, Homo sapiens
aacatttcattggaagctatgt

SEQ ID NO: 9079386 - DNA, 22 bp, Homo sapiens
aacatttcattggaagctatgt

SEQ ID NO: 9079387 - DNA, 22 bp, Homo sapiens
aacatttctgagaatatcagtt

SEQ ID NO: 9079388 - DNA, 21 bp, Homo sapiens
aacatttctgggagaactcac

SEQ ID NO: 9079389 - DNA, 21 bp, Homo sapiens
aacatttctgggagaactcac

SEQ ID NO: 9079390 - DNA, 21 bp, Homo sapiens
aacatttctgggagaactcac

SEQ ID NO: 9079391 - DNA, 22 bp, Homo sapiens
aacattcaattgaggaagttaa

SEQ ID NO: 9079392 - DNA, 22 bp, Homo sapiens
aacattaattacagtcaaacat

SEQ ID NO: 9079393 - DNA, 22 bp, Homo sapiens
aacattaattacagtcaaacat

SEQ ID NO: 9079394 - DNA, 22 bp, Homo sapiens
aacatgcaaagctatgatgtat

SEQ ID NO: 9079395 - DNA, 22 bp, Homo sapiens
aacatgcaatgtctgaaaatcc

SEQ ID NO: 9079396 - DNA, 22 bp, Homo sapiens
aacagtcttacagaagtagcca

SEQ ID NO: 9079397 - DNA, 22 bp, Homo sapiens
aacagtcttcctacggccatta

SEQ ID NO: 9079398 - DNA, 22 bp, Homo sapiens
aacagtctaaattatacccttt

SEQ ID NO: 9079399 - DNA, 22 bp, Homo sapiens
aacagtctactgaatatctgcg

SEQ ID NO: 9079400 - DNA, 22 bp, Homo sapiens
aacagtattggttgaactcaag

SEQ ID NO: 9079401 - DNA, 22 bp, Homo sapiens
aacagtatctacgggaactatt

SEQ ID NO: 9079402 - DNA, 22 bp, Homo sapiens
aacagtatcttttatcagaaat

SEQ ID NO: 9079403 - DNA, 22 bp, Homo sapiens
aacagtatcttttatcagaaat

SEQ ID NO: 9079404 - DNA, 22 bp, Homo sapiens
aacagtacttgataatttgcac

SEQ ID NO: 9079405 - DNA, 22 bp, Homo sapiens
aacagtactggacaaggagtca

SEQ ID NO: 9079406 - DNA, 20 bp, Homo sapiens
aacagtaccccccttgttct

SEQ ID NO: 9079407 - DNA, 20 bp, Homo sapiens
aacagtaccatttatctcag

SEQ ID NO: 9079408 - DNA, 22 bp, Homo sapiens
aacagtacaactccacaagact

SEQ ID NO: 9079409 - DNA, 22 bp, Homo sapiens
aacaggaactatttgtattcca

SEQ ID NO: 9079410 - DNA, 22 bp, Homo sapiens
aacagtaatggcattgccatga

SEQ ID NO: 9079411 - DNA, 22 bp, Homo sapiens
aacaggaaaacagcacaatagc

SEQ ID NO: 9079412 - DNA, 22 bp, Homo sapiens
aacaggaaaacagcacaatagc

SEQ ID NO: 9079413 - DNA, 22 bp, Homo sapiens
aacaggaaatacttatgaggta

SEQ ID NO: 9079414 - DNA, 22 bp, Homo sapiens
aacaggaaacaagttgttagga

SEQ ID NO: 9079415 - DNA, 22 bp, Homo sapiens
aacaggaaacaagttgttagga

SEQ ID NO: 9079416 - DNA, 20 bp, Homo sapiens
aactcagagatgaaaaagac

SEQ ID NO: 9079417 - DNA, 22 bp, Homo sapiens
aactcactttgtggcttctgaa

SEQ ID NO: 9079418 - DNA, 22 bp, Homo sapiens
aactgatgctagaagagacgtt

SEQ ID NO: 9079419 - DNA, 22 bp, Homo sapiens
aactgaggtctccagtgcagaa

SEQ ID NO: 9079420 - DNA, 22 bp, Homo sapiens
aacttgcagacacctgtctcaa

SEQ ID NO: 9079421 - DNA, 22 bp, Homo sapiens
aactgaggccaagtgaggaaag

SEQ ID NO: 9079422 - DNA, 22 bp, Homo sapiens
aacatttcttctgaaactgagt

SEQ ID NO: 9079423 - DNA, 22 bp, Homo sapiens
aacatttcttctgaaactgagt

SEQ ID NO: 9079424 - DNA, 22 bp, Homo sapiens
aactaatacattaatacatgtg

SEQ ID NO: 9079425 - DNA, 22 bp, Homo sapiens
aactcaaagatgcatgacgctt

SEQ ID NO: 9079426 - DNA, 22 bp, Homo sapiens
aactcaaagatgcatgacgctt

SEQ ID NO: 9079427 - DNA, 22 bp, Homo sapiens
aactatgttaataagtttcatt

SEQ ID NO: 9079428 - DNA, 22 bp, Homo sapiens
aactatttttggagctaactct

SEQ ID NO: 9079429 - DNA, 22 bp, Homo sapiens
aagcaaattctggaggtgaggt

SEQ ID NO: 9079430 - DNA, 22 bp, Homo sapiens
aagcaacagaaacattctaata

SEQ ID NO: 9079431 - DNA, 22 bp, Homo sapiens
aagcaaatgaaccagaggtaat

SEQ ID NO: 9079432 - DNA, 22 bp, Homo sapiens
aagcaaaggcaggagcttgtga

SEQ ID NO: 9079433 - DNA, 22 bp, Homo sapiens
aagcaaagagtttagtgggtga

SEQ ID NO: 9079434 - DNA, 22 bp, Homo sapiens
aagcaaagagtttagtgggtga

SEQ ID NO: 9079435 - DNA, 22 bp, Homo sapiens
aagcaaaggcaggagcttgtga

SEQ ID NO: 9079436 - DNA, 22 bp, Homo sapiens
aagaggagacttcagcaacttg

SEQ ID NO: 9079437 - DNA, 22 bp, Homo sapiens
aagaggagacttcagcaacttg

SEQ ID NO: 9079438 - DNA, 22 bp, Homo sapiens
aagaggagacttcagcaacttg

SEQ ID NO: 9079439 - DNA, 22 bp, Homo sapiens
aagaggagacttcagcaacttg

SEQ ID NO: 9079440 - DNA, 18 bp, Homo sapiens
aagaggaggaaacccagg

SEQ ID NO: 9079441 - DNA, 18 bp, Homo sapiens
aagaggaggagcaggttg

SEQ ID NO: 9079442 - DNA, 18 bp, Homo sapiens
aagaggaggagcaggttg

SEQ ID NO: 9079443 - DNA, 18 bp, Homo sapiens
aagaggaggagcaggttg

SEQ ID NO: 9079444 - DNA, 22 bp, Homo sapiens
aagattctgaaaggggtggggc

SEQ ID NO: 9079445 - DNA, 22 bp, Homo sapiens
aagattctccctgagatattta

SEQ ID NO: 9079446 - DNA, 22 bp, Homo sapiens
aagattctcagaaaaaggctat

SEQ ID NO: 9079447 - DNA, 22 bp, Homo sapiens
aagattctccctgagatattta

SEQ ID NO: 9079448 - DNA, 22 bp, Homo sapiens
aagattctcagagtgaaagaat

SEQ ID NO: 9079449 - DNA, 22 bp, Homo sapiens
aagcaacattctctgtggcatt

SEQ ID NO: 9079450 - DNA, 22 bp, Homo sapiens
aagcaacagaaacattctaata

SEQ ID NO: 9079451 - DNA, 22 bp, Homo sapiens
aagcaacattctctgtggcatt

SEQ ID NO: 9079452 - DNA, 22 bp, Homo sapiens
aaatatcatttataacttttaa

SEQ ID NO: 9079453 - DNA, 22 bp, Homo sapiens
aaatatcatttataacttttaa

SEQ ID NO: 9079454 - DNA, 22 bp, Homo sapiens
aaatatgaatgataagagttat

SEQ ID NO: 9079455 - DNA, 22 bp, Homo sapiens
aagcacagctggaacagcagga

SEQ ID NO: 9079456 - DNA, 22 bp, Homo sapiens
aagcacagctggaacagcagga

SEQ ID NO: 9079457 - DNA, 22 bp, Homo sapiens
aagcacagctggaacagcagga

SEQ ID NO: 9079458 - DNA, 22 bp, Homo sapiens
aagcacctgcagttgacaaaaa

SEQ ID NO: 9079459 - DNA, 22 bp, Homo sapiens
aagcagatattgtgggagtggg

SEQ ID NO: 9079460 - DNA, 22 bp, Homo sapiens
aagcagatattgtgggagtggg

SEQ ID NO: 9079461 - DNA, 22 bp, Homo sapiens
aagcagatctgatagggccctg

SEQ ID NO: 9079462 - DNA, 22 bp, Homo sapiens
aagcagatgcgttggagcagtt

SEQ ID NO: 9079463 - DNA, 22 bp, Homo sapiens
aagcagaaagaacaactgagtg

SEQ ID NO: 9079464 - DNA, 22 bp, Homo sapiens
aagcagaactgggaagtagtgg

SEQ ID NO: 9079465 - DNA, 22 bp, Homo sapiens
aagcagagttagcttgtcacct

SEQ ID NO: 9079466 - DNA, 22 bp, Homo sapiens
aagcactttatgtcaatgtcct

SEQ ID NO: 9079467 - DNA, 22 bp, Homo sapiens
aagcactttatgtcaatgtcct

SEQ ID NO: 9079468 - DNA, 22 bp, Homo sapiens
aagcagaaaaactgagctccaa

SEQ ID NO: 9079469 - DNA, 22 bp, Homo sapiens
aagcagaaaaactgagctccaa

SEQ ID NO: 9079470 - DNA, 22 bp, Homo sapiens
aagcactgagcacagtggctga

SEQ ID NO: 9079471 - DNA, 22 bp, Homo sapiens
aagcactaatattttggcacct

SEQ ID NO: 9079472 - DNA, 22 bp, Homo sapiens
aagcactaatattttggcacct

SEQ ID NO: 9079473 - DNA, 22 bp, Homo sapiens
aagcactaggtcacacaagtta

SEQ ID NO: 9079474 - DNA, 22 bp, Homo sapiens
aagcactttagtgagaataagg

SEQ ID NO: 9079475 - DNA, 22 bp, Homo sapiens
aagcacttagaagagtgcctgc

SEQ ID NO: 9079476 - DNA, 22 bp, Homo sapiens
aagcactgggtatagcaatgat

SEQ ID NO: 9079477 - DNA, 22 bp, Homo sapiens
aagcactgtgcctcatatctga

SEQ ID NO: 9079478 - DNA, 22 bp, Homo sapiens
aagcagcagccatcccccaagg

SEQ ID NO: 9079479 - DNA, 22 bp, Homo sapiens
aagccaatggattggttgcttt

SEQ ID NO: 9079480 - DNA, 22 bp, Homo sapiens
aagccaatgatacgggtgatct

SEQ ID NO: 9079481 - DNA, 22 bp, Homo sapiens
aagccacaatctgcatcagcat

SEQ ID NO: 9079482 - DNA, 22 bp, Homo sapiens
aagccacagatcgttctgtcac

SEQ ID NO: 9079483 - DNA, 18 bp, Homo sapiens
aagccagagaccactgcc

SEQ ID NO: 9079484 - DNA, 22 bp, Homo sapiens
aagccagatagaagaactcatt

SEQ ID NO: 9079485 - DNA, 22 bp, Homo sapiens
aagagcatcaatgactcgcagt

SEQ ID NO: 9079486 - DNA, 22 bp, Homo sapiens
aagagcatcaatgactcgcagt

SEQ ID NO: 9079487 - DNA, 22 bp, Homo sapiens
aagagcattttgtaaaatcctt

SEQ ID NO: 9079488 - DNA, 22 bp, Homo sapiens
aagaggacttgtgaagatgtac

SEQ ID NO: 9079489 - DNA, 22 bp, Homo sapiens
aagaggagaaaggctggctttg

SEQ ID NO: 9079490 - DNA, 22 bp, Homo sapiens
aagaggaagtctccatggagag

SEQ ID NO: 9079491 - DNA, 22 bp, Homo sapiens
aagaggaagtctccatggagag

SEQ ID NO: 9079492 - DNA, 22 bp, Homo sapiens
aagaggacagtattcaatatga

SEQ ID NO: 9079493 - DNA, 22 bp, Homo sapiens
aagaggaatgggtgtgtttatg

SEQ ID NO: 9079494 - DNA, 20 bp, Homo sapiens
aagagcctgggtccctcaga

SEQ ID NO: 9079495 - DNA, 22 bp, Homo sapiens
aagagccttggcaatgagtcct

SEQ ID NO: 9079496 - DNA, 22 bp, Homo sapiens
aagagcctggctgctaggctca

SEQ ID NO: 9079497 - DNA, 22 bp, Homo sapiens
aagagccctggttgaaaataac

SEQ ID NO: 9079498 - DNA, 22 bp, Homo sapiens
aagaatgttcttgtagtcatga

SEQ ID NO: 9079499 - DNA, 22 bp, Homo sapiens
aagaatgttcttgtagtcatga

SEQ ID NO: 9079500 - DNA, 21 bp, Homo sapiens
aagaatgttccaggtcttgcc

SEQ ID NO: 9079501 - DNA, 22 bp, Homo sapiens
aagaatgttagtttctgataca

SEQ ID NO: 9079502 - DNA, 22 bp, Homo sapiens
aagaatgttcaacgcttttttg

SEQ ID NO: 9079503 - DNA, 22 bp, Homo sapiens
aagacagaccacgtgacagggc

SEQ ID NO: 9079504 - DNA, 22 bp, Homo sapiens
aagacagagactctgcaacagg

SEQ ID NO: 9079505 - DNA, 17 bp, Homo sapiens
aagacagaagccatgag

SEQ ID NO: 9079506 - DNA, 22 bp, Homo sapiens
aagacagaagtgatttgatgtg

SEQ ID NO: 9079507 - DNA, 22 bp, Homo sapiens
aagacagaagtgatttgatgtg

SEQ ID NO: 9079508 - DNA, 22 bp, Homo sapiens
aagacagagactctgcaacagg

SEQ ID NO: 9079509 - DNA, 20 bp, Homo sapiens
aagagaggaagttatactag

SEQ ID NO: 9079510 - DNA, 20 bp, Homo sapiens
aagagaggaagttatactag

SEQ ID NO: 9079511 - DNA, 22 bp, Homo sapiens
aagagcagtgttttactcagct

SEQ ID NO: 9079512 - DNA, 22 bp, Homo sapiens
aagaaaggatatatgggaggta

SEQ ID NO: 9079513 - DNA, 22 bp, Homo sapiens
aagaaagggagaaggatggtgt

SEQ ID NO: 9079514 - DNA, 22 bp, Homo sapiens
aacttttaaaatacacagacaa

SEQ ID NO: 9079515 - DNA, 22 bp, Homo sapiens
aacttttaaaatacacagacaa

SEQ ID NO: 9079516 - DNA, 22 bp, Homo sapiens
aacttttagacttgggtataaa

SEQ ID NO: 9079517 - DNA, 22 bp, Homo sapiens
aactttgaggtcactgaattcc

SEQ ID NO: 9079518 - DNA, 22 bp, Homo sapiens
aactttgcaagggggccctgcg

SEQ ID NO: 9079519 - DNA, 22 bp, Homo sapiens
aactttgcataactaactacag

SEQ ID NO: 9079520 - DNA, 23 bp, Homo sapiens
aactttgccaggagacagcacag

SEQ ID NO: 9079521 - DNA, 22 bp, Homo sapiens
aactttggccacaagtaccctg

SEQ ID NO: 9079522 - DNA, 22 bp, Homo sapiens
aactttgcttttgtgggtaaag

SEQ ID NO: 9079523 - DNA, 22 bp, Homo sapiens
aactttgcttgggtcaaactca

SEQ ID NO: 9079524 - DNA, 21 bp, Homo sapiens
aactttgcttaactgtgtgga

SEQ ID NO: 9079525 - DNA, 23 bp, Homo sapiens
aactttgccaggagacagcacag

SEQ ID NO: 9079526 - DNA, 20 bp, Homo sapiens
aactttgcattttattctcc

SEQ ID NO: 9079527 - DNA, 19 bp, Homo sapiens
aactttgctaccctatcct

SEQ ID NO: 9079528 - DNA, 22 bp, Homo sapiens
aactttgctggaaaattggagc

SEQ ID NO: 9079529 - DNA, 22 bp, Homo sapiens
aagaatgattacaaagcaacga

SEQ ID NO: 9079530 - DNA, 22 bp, Homo sapiens
aagaatgagctcaaagatctta

SEQ ID NO: 9079531 - DNA, 22 bp, Homo sapiens
aagaatgagctcaaagatctta

SEQ ID NO: 9079532 - DNA, 22 bp, Homo sapiens
aagaatgtcaagcagaaggtct

SEQ ID NO: 9079533 - DNA, 22 bp, Homo sapiens
aagaatgtcaagcagaaggtct

SEQ ID NO: 9079534 - DNA, 22 bp, Homo sapiens
aagaatggtggtggggccagca

SEQ ID NO: 9079535 - DNA, 22 bp, Homo sapiens
aagaatgtggcatttatttata

SEQ ID NO: 9079536 - DNA, 22 bp, Homo sapiens
aagaatgtgctaatgaaaactt

SEQ ID NO: 9079537 - DNA, 22 bp, Homo sapiens
aagaaaggtgtgtttgcagatg

SEQ ID NO: 9079538 - DNA, 22 bp, Homo sapiens
aagaaagggctattgttctcca

SEQ ID NO: 9079539 - DNA, 22 bp, Homo sapiens
aagaagttaggtgtaacaatat

SEQ ID NO: 9079540 - DNA, 22 bp, Homo sapiens
aagaagttaataatggtgagaa

SEQ ID NO: 9079541 - DNA, 22 bp, Homo sapiens
aaaccatggagtaagttcacat

SEQ ID NO: 9079542 - DNA, 22 bp, Homo sapiens
aaaccatcagataattcatact

SEQ ID NO: 9079543 - DNA, 22 bp, Homo sapiens
aaaccatcagataattcatact

SEQ ID NO: 9079544 - DNA, 22 bp, Homo sapiens
aaaccattgcatctttcttaat

SEQ ID NO: 9079545 - DNA, 22 bp, Homo sapiens
aaacatgagttaaaagtaactg

SEQ ID NO: 9079546 - DNA, 22 bp, Homo sapiens
aaacatgagcatttctgtttaa

SEQ ID NO: 9079547 - DNA, 22 bp, Homo sapiens
aaacatgagcatctcttcaagc

SEQ ID NO: 9079548 - DNA, 22 bp, Homo sapiens
aaacatgagcatctcttcaagc

SEQ ID NO: 9079549 - DNA, 22 bp, Homo sapiens
aaacatgagttaaaagtaactg

SEQ ID NO: 9079550 - DNA, 22 bp, Homo sapiens
aaacatgatattgaggctgggc

SEQ ID NO: 9079551 - DNA, 22 bp, Homo sapiens
aaacatctttctattgcaagtt

SEQ ID NO: 9079552 - DNA, 22 bp, Homo sapiens
aaacatgagcacttgcttcata

SEQ ID NO: 9079553 - DNA, 22 bp, Homo sapiens
aaacatgaatagatattaaaca

SEQ ID NO: 9079554 - DNA, 22 bp, Homo sapiens
aaacatgaatagatattaaaca

SEQ ID NO: 9079555 - DNA, 22 bp, Homo sapiens
aaacatgaatagatattaaaca

SEQ ID NO: 9079556 - DNA, 20 bp, Homo sapiens
aaacacagcctctctttaca

SEQ ID NO: 9079557 - DNA, 22 bp, Homo sapiens
aaacacagatttctttgtccca

SEQ ID NO: 9079558 - DNA, 22 bp, Homo sapiens
aaacacaggtactgcagaagtg

SEQ ID NO: 9079559 - DNA, 22 bp, Homo sapiens
aaacacagggatatatattcca

SEQ ID NO: 9079560 - DNA, 22 bp, Homo sapiens
aaacatctgacttgctttttca

SEQ ID NO: 9079561 - DNA, 22 bp, Homo sapiens
aaagaaggacctggaggaggat

SEQ ID NO: 9079562 - DNA, 22 bp, Homo sapiens
aaagaaggacctggaggaggat

SEQ ID NO: 9079563 - DNA, 22 bp, Homo sapiens
aaagaaggacctggaggaggat

SEQ ID NO: 9079564 - DNA, 18 bp, Homo sapiens
aaagaaggattggagagc

SEQ ID NO: 9079565 - DNA, 22 bp, Homo sapiens
aaagaagatggagacctgacta

SEQ ID NO: 9079566 - DNA, 22 bp, Homo sapiens
aaagatctccccttcaaagagt

SEQ ID NO: 9079567 - DNA, 22 bp, Homo sapiens
aaagatctgtgttaactcaagg

SEQ ID NO: 9079568 - DNA, 22 bp, Homo sapiens
aaagatctatgggcatttagct

SEQ ID NO: 9079569 - DNA, 22 bp, Homo sapiens
aaagagctttagaaatctcaga

SEQ ID NO: 9079570 - DNA, 22 bp, Homo sapiens
aaagatgtcacaagatgtgatg

SEQ ID NO: 9079571 - DNA, 22 bp, Homo sapiens
aaagatgtcacaagatgtgatg

SEQ ID NO: 9079572 - DNA, 22 bp, Homo sapiens
aaagatgatctacaagttcatt

SEQ ID NO: 9079573 - DNA, 22 bp, Homo sapiens
aaagatgatctacaagttcatt

SEQ ID NO: 9079574 - DNA, 21 bp, Homo sapiens
aaagatgagaactggatggct

SEQ ID NO: 9079575 - DNA, 22 bp, Homo sapiens
aaagatgaccgtatgtcagagc

SEQ ID NO: 9079576 - DNA, 22 bp, Homo sapiens
aaagatgagtccggcagacata

SEQ ID NO: 9079577 - DNA, 22 bp, Homo sapiens
aaagatgatctacaagttcatt

SEQ ID NO: 9079578 - DNA, 20 bp, Homo sapiens
aaacttgatggcatagaata

SEQ ID NO: 9079579 - DNA, 22 bp, Homo sapiens
aaacttgagtcacttctcttcc

SEQ ID NO: 9079580 - DNA, 22 bp, Homo sapiens
aaactggtttctgagatggaac

SEQ ID NO: 9079581 - DNA, 22 bp, Homo sapiens
aaacttctggctacaagcaata

SEQ ID NO: 9079582 - DNA, 20 bp, Homo sapiens
aaacttgttggtggatgagg

SEQ ID NO: 9079583 - DNA, 22 bp, Homo sapiens
aaactttaagacagtcctcaag

SEQ ID NO: 9079584 - DNA, 22 bp, Homo sapiens
aaacttgtgagctaaataaatg

SEQ ID NO: 9079585 - DNA, 22 bp, Homo sapiens
aaagaagacagacatttctttc

SEQ ID NO: 9079586 - DNA, 22 bp, Homo sapiens
aaagaactcagagaggatttta

SEQ ID NO: 9079587 - DNA, 22 bp, Homo sapiens
aaagaactacctgtatgatatt

SEQ ID NO: 9079588 - DNA, 22 bp, Homo sapiens
aaagaactacctgtatgatatt

SEQ ID NO: 9079589 - DNA, 22 bp, Homo sapiens
aaacaaacataggtttgaaagt

SEQ ID NO: 9079590 - DNA, 22 bp, Homo sapiens
aaacaaacataggtttgaaagt

SEQ ID NO: 9079591 - DNA, 22 bp, Homo sapiens
aaacaaacataggtttgaaagt

SEQ ID NO: 9079592 - DNA, 22 bp, Homo sapiens
aaacaaacataggtttgaaagt

SEQ ID NO: 9079593 - DNA, 22 bp, Homo sapiens
aaacaaagcatcttgctatgca

SEQ ID NO: 9079594 - DNA, 22 bp, Homo sapiens
aaacaaatttcaagctgtgaca

SEQ ID NO: 9079595 - DNA, 22 bp, Homo sapiens
aaacaaatttcaagctgtgaca

SEQ ID NO: 9079596 - DNA, 22 bp, Homo sapiens
aaacaaagccagggaagttatg

SEQ ID NO: 9079597 - DNA, 22 bp, Homo sapiens
aaacaaatagtgcatgggaatt

SEQ ID NO: 9079598 - DNA, 22 bp, Homo sapiens
aaaattcatggcttgggaaaag

SEQ ID NO: 9079599 - DNA, 22 bp, Homo sapiens
aaacacaatgtttctttgttct

SEQ ID NO: 9079600 - DNA, 22 bp, Homo sapiens
aaacacacagaaatgaatgagg

SEQ ID NO: 9079601 - DNA, 22 bp, Homo sapiens
aaacacacagaaatgaatgagg

SEQ ID NO: 9079602 - DNA, 22 bp, Homo sapiens
aaacaacttctgcactatgggt

SEQ ID NO: 9079603 - DNA, 22 bp, Homo sapiens
aaacaagagcttacatggctgc

SEQ ID NO: 9079604 - DNA, 22 bp, Homo sapiens
aaaatagattctaggatgtctt

SEQ ID NO: 9079605 - DNA, 22 bp, Homo sapiens
aaaatagattctaggatgtctt

SEQ ID NO: 9079606 - DNA, 22 bp, Homo sapiens
aaaatagatgaaaggaagtctg

SEQ ID NO: 9079607 - DNA, 22 bp, Homo sapiens
aaaatagatgaaaggaagtctg

SEQ ID NO: 9079608 - DNA, 22 bp, Homo sapiens
aaaatagatgaaaggaagtctg

SEQ ID NO: 9079609 - DNA, 22 bp, Homo sapiens
aaaagtgatgggatggcacttc

SEQ ID NO: 9079610 - DNA, 22 bp, Homo sapiens
aaaagtgatgggatggcacttc

SEQ ID NO: 9079611 - DNA, 22 bp, Homo sapiens
aaaagtctgctttctattatca

SEQ ID NO: 9079612 - DNA, 22 bp, Homo sapiens
aaaagtgaggcagcccaaggga

SEQ ID NO: 9079613 - DNA, 22 bp, Homo sapiens
aaaatagcatgaaaggcctttg

SEQ ID NO: 9079614 - DNA, 20 bp, Homo sapiens
aaaatagccccaggctcatt

SEQ ID NO: 9079615 - DNA, 22 bp, Homo sapiens
aaaatagattctaggatgtctt

SEQ ID NO: 9079616 - DNA, 22 bp, Homo sapiens
aaaatagcatattgctttcttt

SEQ ID NO: 9079617 - DNA, 22 bp, Homo sapiens
aaaatagcatattgctttcttt

SEQ ID NO: 9079618 - DNA, 22 bp, Homo sapiens
aaaatagcctcacataattgct

SEQ ID NO: 9079619 - DNA, 20 bp, Homo sapiens
aaaatagccccaggctcatt

SEQ ID NO: 9079620 - DNA, 22 bp, Homo sapiens
aaaattcatggcttgggaaaag

SEQ ID NO: 9079621 - DNA, 22 bp, Homo sapiens
aaaatagctatggaatgtcact

SEQ ID NO: 9079622 - DNA, 22 bp, Homo sapiens
aaaagggaaagcagaatgactt

SEQ ID NO: 9079623 - DNA, 22 bp, Homo sapiens
aaaagggactactctcagctcc

SEQ ID NO: 9079624 - DNA, 22 bp, Homo sapiens
aaaagtattttggatctcagat

SEQ ID NO: 9079625 - DNA, 22 bp, Homo sapiens
aaaagtctctctgagtaaaagt

SEQ ID NO: 9079626 - DNA, 19 bp, Homo sapiens
aaaagtctattcaattaca

SEQ ID NO: 9079627 - DNA, 22 bp, Homo sapiens
aaaaatgaattcttcagtggca

SEQ ID NO: 9079628 - DNA, 22 bp, Homo sapiens
aaaaatgctgtggtagctgtgt

SEQ ID NO: 9079629 - DNA, 22 bp, Homo sapiens
aaaaatgtcattatggaactga

SEQ ID NO: 9079630 - DNA, 22 bp, Homo sapiens
aaaaatgtgaccacagggtgtt

SEQ ID NO: 9079631 - DNA, 22 bp, Homo sapiens
aaaaatgtcattatggaactga

SEQ ID NO: 9079632 - DNA, 22 bp, Homo sapiens
aaaaagatagcattgtgctcct

SEQ ID NO: 9079633 - DNA, 22 bp, Homo sapiens
aaaaagatagcattgtgctcct

SEQ ID NO: 9079634 - DNA, 22 bp, Homo sapiens
aaaaagatgtcctgaagtttag

SEQ ID NO: 9079635 - DNA, 19 bp, Homo sapiens
aaaaagaggctataatatt

SEQ ID NO: 9079636 - DNA, 22 bp, Homo sapiens
aaaaagacttccaactcaggag

SEQ ID NO: 9079637 - DNA, 22 bp, Homo sapiens
aaaaagatagcattgtgctcct

SEQ ID NO: 9079638 - DNA, 22 bp, Homo sapiens
aaaaagactagtcgagtgcagt

SEQ ID NO: 9079639 - DNA, 21 bp, Homo sapiens
aaaaatgaagttgttcaggaa

SEQ ID NO: 9079640 - DNA, 22 bp, Homo sapiens
aaaaatgaaacggctggttggc

SEQ ID NO: 9079641 - DNA, 19 bp, Homo sapiens
aaaaacttagtccagaaag

SEQ ID NO: 9079642 - DNA, 20 bp, Homo sapiens
aaaaagacaaaacgagttgg

SEQ ID NO: 9079643 - DNA, 19 bp, Homo sapiens
aaaaacttagtccagaaag

SEQ ID NO: 9079644 - DNA, 22 bp, Homo sapiens
aaaaagacagaggatgaggcag

SEQ ID NO: 9079645 - DNA, 20 bp, Homo sapiens
aaaaagacaaaacgagttgg

SEQ ID NO: 9079646 - DNA, 22 bp, Homo sapiens
aaaaagactagtcgagtgcagt

SEQ ID NO: 9079647 - DNA, 22 bp, Homo sapiens
aaaaagacttccaactcaggag

SEQ ID NO: 9079648 - DNA, 22 bp, Homo sapiens
aaacatcaccattttacctaat

SEQ ID NO: 9079649 - DNA, 22 bp, Homo sapiens
aaacatcaattgcatctcccaa

SEQ ID NO: 9079650 - DNA, 22 bp, Homo sapiens
aaacatagataatagatagatg

SEQ ID NO: 9079651 - DNA, 22 bp, Homo sapiens
aaacatcataggcatgcatgat

SEQ ID NO: 9079652 - DNA, 22 bp, Homo sapiens
aaacatcataggcatgcatgat

SEQ ID NO: 9079653 - DNA, 22 bp, Homo sapiens
aaacatcataggcatgcatgat

SEQ ID NO: 9079654 - DNA, 22 bp, Homo sapiens
aaacatctattatgtgctgagc

SEQ ID NO: 9079655 - DNA, 22 bp, Homo sapiens
aaacatctatcagcatttttta

SEQ ID NO: 9079656 - DNA, 22 bp, Homo sapiens
aaagtgctaggattacaagcgt

SEQ ID NO: 9079657 - DNA, 22 bp, Homo sapiens
aaagtgctcggattacaggtat

SEQ ID NO: 9079658 - DNA, 22 bp, Homo sapiens
aaagtgctgaaattacaggtgt

SEQ ID NO: 9079659 - DNA, 22 bp, Homo sapiens
aaagtgctgaaattacaggggt

SEQ ID NO: 9079660 - DNA, 22 bp, Homo sapiens
aaagtgctgggattacaagcgt

SEQ ID NO: 9079661 - DNA, 22 bp, Homo sapiens
aaagtgctgggattacaagtgt

SEQ ID NO: 9079662 - DNA, 22 bp, Homo sapiens
aaagtgctgagattacaagcgt

SEQ ID NO: 9079663 - DNA, 22 bp, Homo sapiens
aaacagttttgccaaaaggaca

SEQ ID NO: 9079664 - DNA, 22 bp, Homo sapiens
aaagtgctgggattacaggctt

SEQ ID NO: 9079665 - DNA, 22 bp, Homo sapiens
aaagtgctgggattacaggcgt

SEQ ID NO: 9079666 - DNA, 22 bp, Homo sapiens
aaagtgctgggattacaggcct

SEQ ID NO: 9079667 - DNA, 22 bp, Homo sapiens
aaagtgctgggattacaggcat

SEQ ID NO: 9079668 - DNA, 22 bp, Homo sapiens
aaagtgctgggattacaggtgt

SEQ ID NO: 9079669 - DNA, 22 bp, Homo sapiens
aaacactgcagggtttacttga

SEQ ID NO: 9079670 - DNA, 22 bp, Homo sapiens
aaacactgcgtggtggcaactc

SEQ ID NO: 9079671 - DNA, 22 bp, Homo sapiens
aaacactgcgtggtggcaactc

SEQ ID NO: 9079672 - DNA, 22 bp, Homo sapiens
aaacactggcaatttcatgcac

SEQ ID NO: 9079673 - DNA, 20 bp, Homo sapiens
aaacactggctggggcacag

SEQ ID NO: 9079674 - DNA, 22 bp, Homo sapiens
aaacactggtatgatgtatagt

SEQ ID NO: 9079675 - DNA, 22 bp, Homo sapiens
aaacactgtacaatctgcaggg

SEQ ID NO: 9079676 - DNA, 22 bp, Homo sapiens
aaacactgtctctggtattgaa

SEQ ID NO: 9079677 - DNA, 22 bp, Homo sapiens
aaagtcatttagccttatctcc

SEQ ID NO: 9079678 - DNA, 22 bp, Homo sapiens
aaagtgcagtccatgaaattaa

SEQ ID NO: 9079679 - DNA, 23 bp, Homo sapiens
aaagtgcagttgaggaatcatag

SEQ ID NO: 9079680 - DNA, 22 bp, Homo sapiens
aaagtgcagtccatgaaattaa

SEQ ID NO: 9079681 - DNA, 22 bp, Homo sapiens
aaagtgccacaactggacaacc

SEQ ID NO: 9079682 - DNA, 22 bp, Homo sapiens
aaagtgcattcgaaagtccatc

SEQ ID NO: 9079683 - DNA, 22 bp, Homo sapiens
aaagcaatgcttgtggaatgta

SEQ ID NO: 9079684 - DNA, 22 bp, Homo sapiens
aaaggcatggaacagattctcc

SEQ ID NO: 9079685 - DNA, 22 bp, Homo sapiens
aaaggaggaatggagagatgct

SEQ ID NO: 9079686 - DNA, 22 bp, Homo sapiens
aaaggaggaatggagagatgct

SEQ ID NO: 9079687 - DNA, 22 bp, Homo sapiens
aaaggccacacagagcagggag

SEQ ID NO: 9079688 - DNA, 22 bp, Homo sapiens
aaaggccacacagagcagggag

SEQ ID NO: 9079689 - DNA, 22 bp, Homo sapiens
aaaggccaagcatgaggtggac

SEQ ID NO: 9079690 - DNA, 22 bp, Homo sapiens
aaaggcattttaattctaaaga

SEQ ID NO: 9079691 - DNA, 22 bp, Homo sapiens
aaaggcatgggtgcctgcatgt

SEQ ID NO: 9079692 - DNA, 22 bp, Homo sapiens
aaaggccttttccccacttctt

SEQ ID NO: 9079693 - DNA, 22 bp, Homo sapiens
aaaggctacgggggccgtgtgc

SEQ ID NO: 9079694 - DNA, 22 bp, Homo sapiens
aaaggctagtggattcattgat

SEQ ID NO: 9079695 - DNA, 21 bp, Homo sapiens
aaaggccataatcacggagca

SEQ ID NO: 9079696 - DNA, 22 bp, Homo sapiens
aaaggccattacttgcttttag

SEQ ID NO: 9079697 - DNA, 22 bp, Homo sapiens
aaaggcctctgtcctagtgcct

SEQ ID NO: 9079698 - DNA, 22 bp, Homo sapiens
aaaggcctctgtcctagtgcct

SEQ ID NO: 9079699 - DNA, 22 bp, Homo sapiens
aaaggccaataaagacaagctg

SEQ ID NO: 9079700 - DNA, 22 bp, Homo sapiens
aaaggccacactgctctttctc

SEQ ID NO: 9079701 - DNA, 22 bp, Homo sapiens
aaaggccaccaacatgaagcat

SEQ ID NO: 9079702 - DNA, 22 bp, Homo sapiens
aaaggccactgcaagggaaggt

SEQ ID NO: 9079703 - DNA, 22 bp, Homo sapiens
aaaggccacttgaaggattttt

SEQ ID NO: 9079704 - DNA, 22 bp, Homo sapiens
aaaggccaggttggctggtatt

SEQ ID NO: 9079705 - DNA, 22 bp, Homo sapiens
aaaggccatggttggagtgttt

SEQ ID NO: 9079706 - DNA, 21 bp, Homo sapiens
aaaggccataatcacggagca

SEQ ID NO: 9079707 - DNA, 22 bp, Homo sapiens
aaagatgtgtaagaaataaaca

SEQ ID NO: 9079708 - DNA, 22 bp, Homo sapiens
aaagcaataggttaggtcaaga

SEQ ID NO: 9079709 - DNA, 22 bp, Homo sapiens
aaagatgtgcctgtttcatagt

SEQ ID NO: 9079710 - DNA, 23 bp, Homo sapiens
aaagatgtgagtattcatatggc

SEQ ID NO: 9079711 - DNA, 22 bp, Homo sapiens
aaagatgtcagtttgaaataac

SEQ ID NO: 9079712 - DNA, 22 bp, Homo sapiens
aaagatgtcatacacattaaga

SEQ ID NO: 9079713 - DNA, 22 bp, Homo sapiens
aaagatgtcatacacattaaga

SEQ ID NO: 9079714 - DNA, 22 bp, Homo sapiens
aaagatgtccaagtaaagttaa

SEQ ID NO: 9079715 - DNA, 22 bp, Homo sapiens
aaagatgtcagtttgaaataac

SEQ ID NO: 9079716 - DNA, 22 bp, Homo sapiens
aaagatgtcagtttgaaataac

SEQ ID NO: 9079717 - DNA, 22 bp, Homo sapiens
aaagatgtcagtttgaaataac

SEQ ID NO: 9079718 - DNA, 22 bp, Homo sapiens
aaagcaatcagattcagatgtc

SEQ ID NO: 9079719 - DNA, 22 bp, Homo sapiens
aaagcaatagtaatggtaatag

SEQ ID NO: 9079720 - DNA, 22 bp, Homo sapiens
aaagcaatgatggtagacacgt

SEQ ID NO: 9079721 - DNA, 22 bp, Homo sapiens
aaagcaatgcccgttcattatc

SEQ ID NO: 9079722 - DNA, 22 bp, Homo sapiens
aaatagaaaccaacaaggtcag

SEQ ID NO: 9079723 - DNA, 22 bp, Homo sapiens
aaatagaaaccaacaaggtcag

SEQ ID NO: 9079724 - DNA, 22 bp, Homo sapiens
aaatagaaaccaacaaggtcag

SEQ ID NO: 9079725 - DNA, 22 bp, Homo sapiens
aaatagaattaactagctactg

SEQ ID NO: 9079726 - DNA, 22 bp, Homo sapiens
aaatagaattaactagctactg

SEQ ID NO: 9079727 - DNA, 22 bp, Homo sapiens
aaactaaacctggcttagtaag

SEQ ID NO: 9079728 - DNA, 22 bp, Homo sapiens
aaacggatataacagcaaacgc

SEQ ID NO: 9079729 - DNA, 22 bp, Homo sapiens
aaatagaattggaagcagagtt

SEQ ID NO: 9079730 - DNA, 22 bp, Homo sapiens
aaatagaattggaagcagagtt

SEQ ID NO: 9079731 - DNA, 22 bp, Homo sapiens
aaatagaattggaagcagagtt

SEQ ID NO: 9079732 - DNA, 20 bp, Homo sapiens
aaacgagccatcattctggt

SEQ ID NO: 9079733 - DNA, 21 bp, Homo sapiens
aaatactgtcaaatggtgggt

SEQ ID NO: 9079734 - DNA, 22 bp, Homo sapiens
aaatactgtccaccatggagca

SEQ ID NO: 9079735 - DNA, 22 bp, Homo sapiens
aaatatgtgatcagtgaataaa

SEQ ID NO: 9079736 - DNA, 23 bp, Homo sapiens
aaatatgtctgagggcaaagaat

SEQ ID NO: 9079737 - DNA, 22 bp, Homo sapiens
aaatatgtaagattagcactag

SEQ ID NO: 9079738 - DNA, 22 bp, Homo sapiens
aaatataatttctgcctcaata

SEQ ID NO: 9079739 - DNA, 22 bp, Homo sapiens
aaatataatttctgcctcaata

SEQ ID NO: 9079740 - DNA, 23 bp, Homo sapiens
aaactacaacgccaggcactgag

SEQ ID NO: 9079741 - DNA, 22 bp, Homo sapiens
aaactaaggtgctgtggactga

SEQ ID NO: 9079742 - DNA, 19 bp, Homo sapiens
aaactaaggggaaatgttt

SEQ ID NO: 9079743 - DNA, 22 bp, Homo sapiens
aaatggcaggctctttgctagt

SEQ ID NO: 9079744 - DNA, 22 bp, Homo sapiens
aaatggcaggctctttgctagt

SEQ ID NO: 9079745 - DNA, 23 bp, Homo sapiens
aaatgctgaatctttactgttta

SEQ ID NO: 9079746 - DNA, 22 bp, Homo sapiens
aaatgctagggagaaactctcc

SEQ ID NO: 9079747 - DNA, 22 bp, Homo sapiens
aaatgctagaacattttaaagg

SEQ ID NO: 9079748 - DNA, 18 bp, Homo sapiens
aaatgctaggctacatga

SEQ ID NO: 9079749 - DNA, 22 bp, Homo sapiens
aaatgctctggggataagactg

SEQ ID NO: 9079750 - DNA, 22 bp, Homo sapiens
aaatgctacacaggaattctca

SEQ ID NO: 9079751 - DNA, 22 bp, Homo sapiens
aaatgctaacaaggaatgctgc

SEQ ID NO: 9079752 - DNA, 22 bp, Homo sapiens
aaatgcctgtgtaaattctagc

SEQ ID NO: 9079753 - DNA, 22 bp, Homo sapiens
aaatgcagctgggcatgagagg

SEQ ID NO: 9079754 - DNA, 22 bp, Homo sapiens
aaatgcctcattttctctcact

SEQ ID NO: 9079755 - DNA, 22 bp, Homo sapiens
aaatgcctatttgttccttcag

SEQ ID NO: 9079756 - DNA, 22 bp, Homo sapiens
aaatgcctctgggttattctag

SEQ ID NO: 9079757 - DNA, 22 bp, Homo sapiens
aaatgcctcccattctactgac

SEQ ID NO: 9079758 - DNA, 22 bp, Homo sapiens
aaatgcagctgggcatgagagg

SEQ ID NO: 9079759 - DNA, 22 bp, Homo sapiens
aaatccaggtagtttggtttga

SEQ ID NO: 9079760 - DNA, 21 bp, Homo sapiens
aaatccaaacactagtccaca

SEQ ID NO: 9079761 - DNA, 22 bp, Homo sapiens
aaatcatgtgcagagatcagga

SEQ ID NO: 9079762 - DNA, 22 bp, Homo sapiens
aaatcatctctgcatccttagc

SEQ ID NO: 9079763 - DNA, 22 bp, Homo sapiens
aaatattattgcttaaggggag

SEQ ID NO: 9079764 - DNA, 22 bp, Homo sapiens
aaatatgttttccagttgtcat

SEQ ID NO: 9079765 - DNA, 22 bp, Homo sapiens
aaatatgttttccagttgtcat

SEQ ID NO: 9079766 - DNA, 22 bp, Homo sapiens
aaatatgtgatcagtgaataaa

SEQ ID NO: 9079767 - DNA, 22 bp, Homo sapiens
cagagaacaaagctgagggttt

SEQ ID NO: 9079768 - DNA, 22 bp, Homo sapiens
cagagaactccagtggctggcg

SEQ ID NO: 9079769 - DNA, 22 bp, Homo sapiens
cagagaacattcagagctgtag

SEQ ID NO: 9079770 - DNA, 22 bp, Homo sapiens
cagagacattaagtgccatgat

SEQ ID NO: 9079771 - DNA, 22 bp, Homo sapiens
cagagacattctccccattgga

SEQ ID NO: 9079772 - DNA, 22 bp, Homo sapiens
cagagacatgtggcctgcacgt

SEQ ID NO: 9079773 - DNA, 22 bp, Homo sapiens
cagagacattaagtgccatgat

SEQ ID NO: 9079774 - DNA, 20 bp, Homo sapiens
cagagaccaggccaggtgtc

SEQ ID NO: 9079775 - DNA, 22 bp, Homo sapiens
cagagaccctaggcaggtgaca

SEQ ID NO: 9079776 - DNA, 22 bp, Homo sapiens
cagagaccctaggcaggtgaca

SEQ ID NO: 9079777 - DNA, 22 bp, Homo sapiens
agccaggccagactcacaccct

SEQ ID NO: 9079778 - DNA, 22 bp, Homo sapiens
cagagacccttctcagtggcca

SEQ ID NO: 9079779 - DNA, 22 bp, Homo sapiens
cagagccttagttctcctagaa

SEQ ID NO: 9079780 - DNA, 22 bp, Homo sapiens
cagagccttcctagcagactct

SEQ ID NO: 9079781 - DNA, 22 bp, Homo sapiens
cagagccttcctagcagactct

SEQ ID NO: 9079782 - DNA, 22 bp, Homo sapiens
cagagcggccactagagggcgc

SEQ ID NO: 9079783 - DNA, 18 bp, Homo sapiens
cagagctcctggatgcag

SEQ ID NO: 9079784 - DNA, 22 bp, Homo sapiens
agccaggccagctgtcttgagt

SEQ ID NO: 9079785 - DNA, 21 bp, Homo sapiens
cagagcctgtgttgacagttg

SEQ ID NO: 9079786 - DNA, 20 bp, Homo sapiens
cagagcccactttcttatca

SEQ ID NO: 9079787 - DNA, 22 bp, Homo sapiens
cagagcctggcgatgtcatgga

SEQ ID NO: 9079788 - DNA, 22 bp, Homo sapiens
cagagcctggcgatgtcatgga

SEQ ID NO: 9079789 - DNA, 22 bp, Homo sapiens
cagagcctggcgatgtcatgga

SEQ ID NO: 9079790 - DNA, 22 bp, Homo sapiens
cagagccattatggagacttgc

SEQ ID NO: 9079791 - DNA, 22 bp, Homo sapiens
agccaggccttagggagaggca

SEQ ID NO: 9079792 - DNA, 22 bp, Homo sapiens
cactttatatgcattacctcat

SEQ ID NO: 9079793 - DNA, 19 bp, Homo sapiens
cactttatttctgttttgt

SEQ ID NO: 9079794 - DNA, 22 bp, Homo sapiens
cactttattataaatttgagag

SEQ ID NO: 9079795 - DNA, 22 bp, Homo sapiens
cactttcaagtttcagaggata

SEQ ID NO: 9079796 - DNA, 21 bp, Homo sapiens
agccagatccattttgcatgg

SEQ ID NO: 9079797 - DNA, 22 bp, Homo sapiens
agccagagttgaatgtgagtct

SEQ ID NO: 9079798 - DNA, 22 bp, Homo sapiens
agccagagagtgttggagatgt

SEQ ID NO: 9079799 - DNA, 22 bp, Homo sapiens
agccagagagtgttggagatgt

SEQ ID NO: 9079800 - DNA, 22 bp, Homo sapiens
agccagcacggatttcccagga

SEQ ID NO: 9079801 - DNA, 22 bp, Homo sapiens
agccagcacggcgccatggagt

SEQ ID NO: 9079802 - DNA, 22 bp, Homo sapiens
agccagcccctgactgtgtcct

SEQ ID NO: 9079803 - DNA, 19 bp, Homo sapiens
agccagccagcaggtatgc

SEQ ID NO: 9079804 - DNA, 22 bp, Homo sapiens
agccagcatcccttcagtctcc

SEQ ID NO: 9079805 - DNA, 22 bp, Homo sapiens
agccagcatcccttcagtctcc

SEQ ID NO: 9079806 - DNA, 22 bp, Homo sapiens
agccagcatgaagacagaggcc

SEQ ID NO: 9079807 - DNA, 22 bp, Homo sapiens
agccagcatcttgcttcttgag

SEQ ID NO: 9079808 - DNA, 22 bp, Homo sapiens
agccagcaggtgagtgcagcct

SEQ ID NO: 9079809 - DNA, 22 bp, Homo sapiens
agccagcaggtgagtgcagcct

SEQ ID NO: 9079810 - DNA, 22 bp, Homo sapiens
agccagcatatatatagttgaa

SEQ ID NO: 9079811 - DNA, 19 bp, Homo sapiens
agccagcagcgtagcatct

SEQ ID NO: 9079812 - DNA, 22 bp, Homo sapiens
agccagcagggcttagaggaca

SEQ ID NO: 9079813 - DNA, 19 bp, Homo sapiens
agccagcaggcctctgagc

SEQ ID NO: 9079814 - DNA, 22 bp, Homo sapiens
agccctggcagagccaggtagt

SEQ ID NO: 9079815 - DNA, 22 bp, Homo sapiens
agccctggattctgaggtccaa

SEQ ID NO: 9079816 - DNA, 22 bp, Homo sapiens
agccctggagcaaaggtgtctt

SEQ ID NO: 9079817 - DNA, 22 bp, Homo sapiens
agccctggagcaaaggtgtctt

SEQ ID NO: 9079818 - DNA, 22 bp, Homo sapiens
agccctggaagccacagtccta

SEQ ID NO: 9079819 - DNA, 22 bp, Homo sapiens
agccctgattaaccttggcttt

SEQ ID NO: 9079820 - DNA, 22 bp, Homo sapiens
agccctgcgtgccaggggactg

SEQ ID NO: 9079821 - DNA, 22 bp, Homo sapiens
agccctgctgcctgaattagct

SEQ ID NO: 9079822 - DNA, 17 bp, Homo sapiens
agcccccactcccaagt

SEQ ID NO: 9079823 - DNA, 22 bp, Homo sapiens
agcccccacgtttcctgggtcc

SEQ ID NO: 9079824 - DNA, 22 bp, Homo sapiens
agcccccacgtttcctgggtcc

SEQ ID NO: 9079825 - DNA, 22 bp, Homo sapiens
agcccccaaaagtgcttatgat

SEQ ID NO: 9079826 - DNA, 22 bp, Homo sapiens
agcccccaaaagtgcttatgat

SEQ ID NO: 9079827 - DNA, 22 bp, Homo sapiens
agcccccaaaagtgcttatgat

SEQ ID NO: 9079828 - DNA, 22 bp, Homo sapiens
agcccccaaaagtgcttatgat

SEQ ID NO: 9079829 - DNA, 22 bp, Homo sapiens
agccccagttccctggaagtct

SEQ ID NO: 9079830 - DNA, 22 bp, Homo sapiens
agccccagttccctggaagtct

SEQ ID NO: 9079831 - DNA, 22 bp, Homo sapiens
agccctggcccggctgtgcttt

SEQ ID NO: 9079832 - DNA, 22 bp, Homo sapiens
agccctggcccggctgtgcttt

SEQ ID NO: 9079833 - DNA, 22 bp, Homo sapiens
agccctggctcccagcagcgct

SEQ ID NO: 9079834 - DNA, 22 bp, Homo sapiens
agccctggctcccagcagcgct

SEQ ID NO: 9079835 - DNA, 22 bp, Homo sapiens
agccctgggatacagtaaaagc

SEQ ID NO: 9079836 - DNA, 22 bp, Homo sapiens
agccctgggcacctgtgagggg

SEQ ID NO: 9079837 - DNA, 22 bp, Homo sapiens
agccctgggaggccagcttgta

SEQ ID NO: 9079838 - DNA, 22 bp, Homo sapiens
agccctgggagattttctgggt

SEQ ID NO: 9079839 - DNA, 22 bp, Homo sapiens
agccctggctcccagcagcgct

SEQ ID NO: 9079840 - DNA, 22 bp, Homo sapiens
agccctgggcgttactgggatg

SEQ ID NO: 9079841 - DNA, 22 bp, Homo sapiens
agccctgggcgttactgggatg

SEQ ID NO: 9079842 - DNA, 22 bp, Homo sapiens
agccctgggcagccaaggaagc

SEQ ID NO: 9079843 - DNA, 22 bp, Homo sapiens
agccctgggcagccaaggaagc

SEQ ID NO: 9079844 - DNA, 22 bp, Homo sapiens
agccctgggctgtagataagca

SEQ ID NO: 9079845 - DNA, 22 bp, Homo sapiens
cagatgaagatcatagaatagt

SEQ ID NO: 9079846 - DNA, 22 bp, Homo sapiens
agccagtgccagtcatgcctgc

SEQ ID NO: 9079847 - DNA, 22 bp, Homo sapiens
agcccaggttgaggctgcagtg

SEQ ID NO: 9079848 - DNA, 22 bp, Homo sapiens
agcccaggttctaaagccaaac

SEQ ID NO: 9079849 - DNA, 19 bp, Homo sapiens
agccagttctagacaatgg

SEQ ID NO: 9079850 - DNA, 22 bp, Homo sapiens
agccccacactctctctgagaa

SEQ ID NO: 9079851 - DNA, 20 bp, Homo sapiens
agcccatctcccacagctac

SEQ ID NO: 9079852 - DNA, 22 bp, Homo sapiens
agcccaggttgaggctgcagtg

SEQ ID NO: 9079853 - DNA, 22 bp, Homo sapiens
agcccaggttgaggctgcagtg

SEQ ID NO: 9079854 - DNA, 22 bp, Homo sapiens
agcccagtgggccgaggcgggg

SEQ ID NO: 9079855 - DNA, 22 bp, Homo sapiens
agccccaggcccggacgcctct

SEQ ID NO: 9079856 - DNA, 22 bp, Homo sapiens
agccccaggcccggacgcctct

SEQ ID NO: 9079857 - DNA, 22 bp, Homo sapiens
agccccaggatgggccgcagga

SEQ ID NO: 9079858 - DNA, 22 bp, Homo sapiens
agccccagtaagggagggcctg

SEQ ID NO: 9079859 - DNA, 22 bp, Homo sapiens
agccccagtccgctgcgggcgg

SEQ ID NO: 9079860 - DNA, 22 bp, Homo sapiens
agccccagtaagggagggcctg

SEQ ID NO: 9079861 - DNA, 22 bp, Homo sapiens
agccccagcccctctctcacaa

SEQ ID NO: 9079862 - DNA, 22 bp, Homo sapiens
agctagagaatgacagagtctg

SEQ ID NO: 9079863 - DNA, 22 bp, Homo sapiens
agctagagctgagaagcacttg

SEQ ID NO: 9079864 - DNA, 22 bp, Homo sapiens
agctagagctgagaagcacttg

SEQ ID NO: 9079865 - DNA, 22 bp, Homo sapiens
agctacttccctgtaggaaaca

SEQ ID NO: 9079866 - DNA, 22 bp, Homo sapiens
agctactggagaacacaaaacc

SEQ ID NO: 9079867 - DNA, 22 bp, Homo sapiens
agctactctgcagtgcccatgg

SEQ ID NO: 9079868 - DNA, 22 bp, Homo sapiens
agctactcagagttccactcta

SEQ ID NO: 9079869 - DNA, 22 bp, Homo sapiens
agctacagttgccctcagcagg

SEQ ID NO: 9079870 - DNA, 22 bp, Homo sapiens
agctaatgatgagatacagata

SEQ ID NO: 9079871 - DNA, 22 bp, Homo sapiens
agctaatgaaatattttctgat

SEQ ID NO: 9079872 - DNA, 22 bp, Homo sapiens
agctaatgggagaccctttcac

SEQ ID NO: 9079873 - DNA, 23 bp, Homo sapiens
agctaatgggacagattccatgg

SEQ ID NO: 9079874 - DNA, 22 bp, Homo sapiens
agctaatgatacatgctccaca

SEQ ID NO: 9079875 - DNA, 22 bp, Homo sapiens
agctaaggccgcgttggggtaa

SEQ ID NO: 9079876 - DNA, 22 bp, Homo sapiens
agctaaggatgactagtacttc

SEQ ID NO: 9079877 - DNA, 22 bp, Homo sapiens
agctaaggtgtcctggaggccc

SEQ ID NO: 9079878 - DNA, 22 bp, Homo sapiens
agctaaggactggagggtttct

SEQ ID NO: 9079879 - DNA, 22 bp, Homo sapiens
agctaaggagcaagtaggagtt

SEQ ID NO: 9079880 - DNA, 22 bp, Homo sapiens
agctaaggacagttgatttaga

SEQ ID NO: 9079881 - DNA, 20 bp, Homo sapiens
agctaagaggaaaagtgaga

SEQ ID NO: 9079882 - DNA, 22 bp, Homo sapiens
agctaaggaactctgtaacacc

SEQ ID NO: 9079883 - DNA, 23 bp, Homo sapiens
agctaaggaagctgaggcacagt

SEQ ID NO: 9079884 - DNA, 23 bp, Homo sapiens
agctaaggaagctgaggcacagt

SEQ ID NO: 9079885 - DNA, 23 bp, Homo sapiens
agctaaggaagctgaggcacagt

SEQ ID NO: 9079886 - DNA, 22 bp, Homo sapiens
agctaaggaatcagaagaggtt

SEQ ID NO: 9079887 - DNA, 22 bp, Homo sapiens
agctacaaaattactaagtcct

SEQ ID NO: 9079888 - DNA, 22 bp, Homo sapiens
agctacaatcaatgtacatcat

SEQ ID NO: 9079889 - DNA, 19 bp, Homo sapiens
agctacagcatggcgaggt

SEQ ID NO: 9079890 - DNA, 22 bp, Homo sapiens
agcctgggtgggggttcggaga

SEQ ID NO: 9079891 - DNA, 22 bp, Homo sapiens
agcctgggttagggttcttccc

SEQ ID NO: 9079892 - DNA, 22 bp, Homo sapiens
agcctggtgtggggctgcagag

SEQ ID NO: 9079893 - DNA, 22 bp, Homo sapiens
agcctgggtttttattaaggag

SEQ ID NO: 9079894 - DNA, 21 bp, Homo sapiens
agcctgggtatcctttgagga

SEQ ID NO: 9079895 - DNA, 22 bp, Homo sapiens
agcctggggtttcagtttgcac

SEQ ID NO: 9079896 - DNA, 22 bp, Homo sapiens
agcctggggcacttctccaaac

SEQ ID NO: 9079897 - DNA, 18 bp, Homo sapiens
agcctgggctctgcctgg

SEQ ID NO: 9079898 - DNA, 18 bp, Homo sapiens
agcctgggctctgcctgg

SEQ ID NO: 9079899 - DNA, 18 bp, Homo sapiens
agcctgggctctgcctgg

SEQ ID NO: 9079900 - DNA, 22 bp, Homo sapiens
agcctgggcatgggacgggagg

SEQ ID NO: 9079901 - DNA, 22 bp, Homo sapiens
agcctgggcatgggacgggagg

SEQ ID NO: 9079902 - DNA, 22 bp, Homo sapiens
agcctgggccctgcctcttctc

SEQ ID NO: 9079903 - DNA, 22 bp, Homo sapiens
agcctgggccctgcctcttctc

SEQ ID NO: 9079904 - DNA, 22 bp, Homo sapiens
cagcaactcctgtagcttatgc

SEQ ID NO: 9079905 - DNA, 20 bp, Homo sapiens
cagcaactttggactgagtt

SEQ ID NO: 9079906 - DNA, 20 bp, Homo sapiens
cagcaactttggactgagtt

SEQ ID NO: 9079907 - DNA, 22 bp, Homo sapiens
cagcaacatatatgaaactgtg

SEQ ID NO: 9079908 - DNA, 22 bp, Homo sapiens
cagcaaattttaatactgcttt

SEQ ID NO: 9079909 - DNA, 22 bp, Homo sapiens
cagcaacatgtggtagtgtagg

SEQ ID NO: 9079910 - DNA, 22 bp, Homo sapiens
cagcaacccgggggacctttct

SEQ ID NO: 9079911 - DNA, 22 bp, Homo sapiens
cagcaacctaaatccactaact

SEQ ID NO: 9079912 - DNA, 22 bp, Homo sapiens
cagcaacatgtggtagtgtagg

SEQ ID NO: 9079913 - DNA, 22 bp, Homo sapiens
cagcaacatatatgaaactgtg

SEQ ID NO: 9079914 - DNA, 22 bp, Homo sapiens
cagcaacatgtggtagtgtagg

SEQ ID NO: 9079915 - DNA, 22 bp, Homo sapiens
cagatgtgcatgatgggaaggg

SEQ ID NO: 9079916 - DNA, 22 bp, Homo sapiens
cagatgtgattcttccctcagc

SEQ ID NO: 9079917 - DNA, 22 bp, Homo sapiens
cagatgtagtagctttattgca

SEQ ID NO: 9079918 - DNA, 20 bp, Homo sapiens
cagatgggacgtggaggagt

SEQ ID NO: 9079919 - DNA, 22 bp, Homo sapiens
cagatggggcaaggccatctgt

SEQ ID NO: 9079920 - DNA, 22 bp, Homo sapiens
cagatgtaattactcaagtcaa

SEQ ID NO: 9079921 - DNA, 22 bp, Homo sapiens
cagatgtacatgaagggcaatg

SEQ ID NO: 9079922 - DNA, 22 bp, Homo sapiens
agcctggccactcagggcctga

SEQ ID NO: 9079923 - DNA, 22 bp, Homo sapiens
cagcaagaaaattcacatgctc

SEQ ID NO: 9079924 - DNA, 22 bp, Homo sapiens
cagcaagaacagcctgatgtgc

SEQ ID NO: 9079925 - DNA, 22 bp, Homo sapiens
cagcaagaaaattcacatgctc

SEQ ID NO: 9079926 - DNA, 19 bp, Homo sapiens
agcctggctttgctctgct

SEQ ID NO: 9079927 - DNA, 17 bp, Homo sapiens
agcctgggaaggagtga

SEQ ID NO: 9079928 - DNA, 21 bp, Homo sapiens
agcctgggaggcggaggttgc

SEQ ID NO: 9079929 - DNA, 21 bp, Homo sapiens
agcctgggaggcggaggttgc

SEQ ID NO: 9079930 - DNA, 22 bp, Homo sapiens
agcctgggaatttagagttcgg

SEQ ID NO: 9079931 - DNA, 22 bp, Homo sapiens
agcctgggaatttagagttcgg

SEQ ID NO: 9079932 - DNA, 17 bp, Homo sapiens
agcctgggaaggagtga

SEQ ID NO: 9079933 - DNA, 22 bp, Homo sapiens
agcctgggaatttagagttcgg

SEQ ID NO: 9079934 - DNA, 22 bp, Homo sapiens
agcctgggcatgggacgggagg

SEQ ID NO: 9079935 - DNA, 22 bp, Homo sapiens
agcctgggcaacagagcaaaac

SEQ ID NO: 9079936 - DNA, 21 bp, Homo sapiens
agcctgggaggcggaggttgc

SEQ ID NO: 9079937 - DNA, 22 bp, Homo sapiens
agcctgggcaacaacacagcga

SEQ ID NO: 9079938 - DNA, 22 bp, Homo sapiens
agcctgggcaacagagcaaaac

SEQ ID NO: 9079939 - DNA, 22 bp, Homo sapiens
agcctgggcaacaacacagcga

SEQ ID NO: 9079940 - DNA, 22 bp, Homo sapiens
agctcctgcttgacagaagagg

SEQ ID NO: 9079941 - DNA, 19 bp, Homo sapiens
agctcctgattgtgcctcg

SEQ ID NO: 9079942 - DNA, 22 bp, Homo sapiens
agctcctggacgaacagggagt

SEQ ID NO: 9079943 - DNA, 22 bp, Homo sapiens
agctcctggacgaacagggagt

SEQ ID NO: 9079944 - DNA, 20 bp, Homo sapiens
agctcctggactagagagtg

SEQ ID NO: 9079945 - DNA, 20 bp, Homo sapiens
agctcctggactagagagtg

SEQ ID NO: 9079946 - DNA, 21 bp, Homo sapiens
agctccaggctcctggggttc

SEQ ID NO: 9079947 - DNA, 22 bp, Homo sapiens
agctccaggccttgggccccgg

SEQ ID NO: 9079948 - DNA, 22 bp, Homo sapiens
agctccagcctcttctggaggt

SEQ ID NO: 9079949 - DNA, 22 bp, Homo sapiens
agctccagcctcttctggaggt

SEQ ID NO: 9079950 - DNA, 23 bp, Homo sapiens
agctccagctgacgtgggcagcc

SEQ ID NO: 9079951 - DNA, 23 bp, Homo sapiens
agctccagctgacgtgggcagcc

SEQ ID NO: 9079952 - DNA, 23 bp, Homo sapiens
agctccagctgacgtgggcagcc

SEQ ID NO: 9079953 - DNA, 19 bp, Homo sapiens
agctccaggcctggatgct

SEQ ID NO: 9079954 - DNA, 22 bp, Homo sapiens
agctccaggataagacaggtgc

SEQ ID NO: 9079955 - DNA, 22 bp, Homo sapiens
agctccagcccatctgctcgtg

SEQ ID NO: 9079956 - DNA, 22 bp, Homo sapiens
agctccagccgctgatgggttt

SEQ ID NO: 9079957 - DNA, 22 bp, Homo sapiens
agctccagaagcctgcaaggta

SEQ ID NO: 9079958 - DNA, 22 bp, Homo sapiens
agctccagaagcctgcaaggta

SEQ ID NO: 9079959 - DNA, 22 bp, Homo sapiens
agctccagaagcctgcaaggta

SEQ ID NO: 9079960 - DNA, 23 bp, Homo sapiens
agctccagaacatagcacaggaa

SEQ ID NO: 9079961 - DNA, 23 bp, Homo sapiens
agctccagaacatagcacaggaa

SEQ ID NO: 9079962 - DNA, 20 bp, Homo sapiens
agctaggagaaagcatggag

SEQ ID NO: 9079963 - DNA, 22 bp, Homo sapiens
agctaggaaattgaggctgaga

SEQ ID NO: 9079964 - DNA, 22 bp, Homo sapiens
agctagctttaactcttagaca

SEQ ID NO: 9079965 - DNA, 22 bp, Homo sapiens
agctcctgtggcagctcttctg

SEQ ID NO: 9079966 - DNA, 22 bp, Homo sapiens
agctcctgtctcaagggagcct

SEQ ID NO: 9079967 - DNA, 22 bp, Homo sapiens
agctcctgtgtgaagcctccct

SEQ ID NO: 9079968 - DNA, 22 bp, Homo sapiens
agctcctggcaaggtcatggtg

SEQ ID NO: 9079969 - DNA, 22 bp, Homo sapiens
agctcctggcaaggtcatggtg

SEQ ID NO: 9079970 - DNA, 22 bp, Homo sapiens
agctcctggcaaggtcatggtg

SEQ ID NO: 9079971 - DNA, 22 bp, Homo sapiens
agctcctggctttcctctcacc

SEQ ID NO: 9079972 - DNA, 22 bp, Homo sapiens
agctcctggctttcctctcacc

SEQ ID NO: 9079973 - DNA, 22 bp, Homo sapiens
agctcctgggccaagcccatgc

SEQ ID NO: 9079974 - DNA, 19 bp, Homo sapiens
agctcctgggctctgggcc

SEQ ID NO: 9079975 - DNA, 22 bp, Homo sapiens
agctcctgtctcaagggagcct

SEQ ID NO: 9079976 - DNA, 22 bp, Homo sapiens
agctcctgtctcaagggagcct

SEQ ID NO: 9079977 - DNA, 22 bp, Homo sapiens
agctcctggtctttgtccagag

SEQ ID NO: 9079978 - DNA, 22 bp, Homo sapiens
agctcctggtgcctcagccgaa

SEQ ID NO: 9079979 - DNA, 22 bp, Homo sapiens
agctcctgggggttccaagcag

SEQ ID NO: 9079980 - DNA, 18 bp, Homo sapiens
agctcctggtctcaggga

SEQ ID NO: 9079981 - DNA, 18 bp, Homo sapiens
agctcctggtctcaggga

SEQ ID NO: 9079982 - DNA, 22 bp, Homo sapiens
agcagtggagcgagatgtttaa

SEQ ID NO: 9079983 - DNA, 22 bp, Homo sapiens
agcatcagagagaagttaacta

SEQ ID NO: 9079984 - DNA, 22 bp, Homo sapiens
agcatcagcagactctcagcta

SEQ ID NO: 9079985 - DNA, 18 bp, Homo sapiens
agcatgagagaggctgtg

SEQ ID NO: 9079986 - DNA, 22 bp, Homo sapiens
agcatgaagacttcagagctag

SEQ ID NO: 9079987 - DNA, 22 bp, Homo sapiens
agcatgaaagcataggacagtc

SEQ ID NO: 9079988 - DNA, 22 bp, Homo sapiens
agcagtgaaacagctgcatatg

SEQ ID NO: 9079989 - DNA, 22 bp, Homo sapiens
agcagtgaaacagctgcatatg

SEQ ID NO: 9079990 - DNA, 22 bp, Homo sapiens
agcagtgaaacagctgcatatg

SEQ ID NO: 9079991 - DNA, 22 bp, Homo sapiens
agcagtgacttgctttgtttcc

SEQ ID NO: 9079992 - DNA, 22 bp, Homo sapiens
agcagtgagccataagtgctag

SEQ ID NO: 9079993 - DNA, 22 bp, Homo sapiens
agcagtgagccataagtgctag

SEQ ID NO: 9079994 - DNA, 22 bp, Homo sapiens
agcagtgagtaacacagaccag

SEQ ID NO: 9079995 - DNA, 23 bp, Homo sapiens
agcagtgagtaaacagataggat

SEQ ID NO: 9079996 - DNA, 22 bp, Homo sapiens
agcagtgagtgggaggaccatg

SEQ ID NO: 9079997 - DNA, 22 bp, Homo sapiens
agcagtgatgaaatgagcatcc

SEQ ID NO: 9079998 - DNA, 22 bp, Homo sapiens
agcagtgatgcatgacagccta

SEQ ID NO: 9079999 - DNA, 22 bp, Homo sapiens
agcagtgctatggccaggctaa

SEQ ID NO: 9080000 - DNA, 22 bp, Homo sapiens
agcagtggacctcagtgctatt

SEQ ID NO: 9080001 - DNA, 22 bp, Homo sapiens
agcagtgccgcatcttgtgacc

SEQ ID NO: 9080002 - DNA, 22 bp, Homo sapiens
agcagtgatgcatgacagccta

SEQ ID NO: 9080003 - DNA, 22 bp, Homo sapiens
agcagtgcccattctgccccct

SEQ ID NO: 9080004 - DNA, 22 bp, Homo sapiens
agcagtgattctcttggactca

SEQ ID NO: 9080005 - DNA, 22 bp, Homo sapiens
agcaggtgtcggcgagggtctt

SEQ ID NO: 9080006 - DNA, 22 bp, Homo sapiens
agcagtcattttaggtcatgca

SEQ ID NO: 9080007 - DNA, 20 bp, Homo sapiens
agcagtccaaaagggcagac

SEQ ID NO: 9080008 - DNA, 22 bp, Homo sapiens
agcagtccttctttagagagcc

SEQ ID NO: 9080009 - DNA, 18 bp, Homo sapiens
agcagtagcgccaggtgc

SEQ ID NO: 9080010 - DNA, 22 bp, Homo sapiens
agcagtaagtgaagactagttt

SEQ ID NO: 9080011 - DNA, 20 bp, Homo sapiens
agcagtaggacctctgggcc

SEQ ID NO: 9080012 - DNA, 22 bp, Homo sapiens
agcagtagtgatggcccctgag

SEQ ID NO: 9080013 - DNA, 22 bp, Homo sapiens
agcagtattctcctgtggtgga

SEQ ID NO: 9080014 - DNA, 22 bp, Homo sapiens
agcagtaagtgaagactagttt

SEQ ID NO: 9080015 - DNA, 22 bp, Homo sapiens
agcagtaagacttttttctgtg

SEQ ID NO: 9080016 - DNA, 22 bp, Homo sapiens
agcagtaagcaactgagcttgc

SEQ ID NO: 9080017 - DNA, 23 bp, Homo sapiens
agcagtaacttcagaaacatcag

SEQ ID NO: 9080018 - DNA, 22 bp, Homo sapiens
agcagtaagacttttttctgtg

SEQ ID NO: 9080019 - DNA, 22 bp, Homo sapiens
agcaggttgttttgtggccagg

SEQ ID NO: 9080020 - DNA, 23 bp, Homo sapiens
agcagtaacttcagaaacatcag

SEQ ID NO: 9080021 - DNA, 22 bp, Homo sapiens
agcaggtgtttgtatcataagg

SEQ ID NO: 9080022 - DNA, 22 bp, Homo sapiens
cactgtggggtttggctggaac

SEQ ID NO: 9080023 - DNA, 22 bp, Homo sapiens
cactgtgtaagaagatgggctt

SEQ ID NO: 9080024 - DNA, 22 bp, Homo sapiens
cactgtggtgtgagggctgatg

SEQ ID NO: 9080025 - DNA, 22 bp, Homo sapiens
cactgtgtcagtttggttagac

SEQ ID NO: 9080026 - DNA, 22 bp, Homo sapiens
cactgtggggtttggctggaac

SEQ ID NO: 9080027 - DNA, 22 bp, Homo sapiens
cactggtgacttctgagctgga

SEQ ID NO: 9080028 - DNA, 22 bp, Homo sapiens
cactggtgacttctgagctgga

SEQ ID NO: 9080029 - DNA, 22 bp, Homo sapiens
agcattaataagaaatggctcc

SEQ ID NO: 9080030 - DNA, 22 bp, Homo sapiens
agcatgttgggatgagaaggaa

SEQ ID NO: 9080031 - DNA, 23 bp, Homo sapiens
cactgtgttacatgttgaagatg

SEQ ID NO: 9080032 - DNA, 22 bp, Homo sapiens
cactgtttaataatattgttaa

SEQ ID NO: 9080033 - DNA, 22 bp, Homo sapiens
cactgttttacatgttatttaa

SEQ ID NO: 9080034 - DNA, 22 bp, Homo sapiens
cactttactatctataaaataa

SEQ ID NO: 9080035 - DNA, 22 bp, Homo sapiens
agcatgcatttttggactgtgc

SEQ ID NO: 9080036 - DNA, 22 bp, Homo sapiens
agcatgcaggaaccacatggca

SEQ ID NO: 9080037 - DNA, 22 bp, Homo sapiens
agcatggacagtggcagcagtg

SEQ ID NO: 9080038 - DNA, 18 bp, Homo sapiens
agcatggcacaggctccc

SEQ ID NO: 9080039 - DNA, 22 bp, Homo sapiens
agcatggggcaatgcatgtgct

SEQ ID NO: 9080040 - DNA, 22 bp, Homo sapiens
agcatgtctaactcttcagggt

SEQ ID NO: 9080041 - DNA, 22 bp, Homo sapiens
agcatggggctccgcaatgaac

SEQ ID NO: 9080042 - DNA, 22 bp, Homo sapiens
agcattaagcctggctcagagg

SEQ ID NO: 9080043 - DNA, 22 bp, Homo sapiens
agcattaagagagactgaactg

SEQ ID NO: 9080044 - DNA, 23 bp, Homo sapiens
agcatgttgtgatgttaccactg

SEQ ID NO: 9080045 - DNA, 22 bp, Homo sapiens
agcatgttcatcttctgttggt

SEQ ID NO: 9080046 - DNA, 22 bp, Homo sapiens
agcatgtgtggagaaatatttt

SEQ ID NO: 9080047 - DNA, 22 bp, Homo sapiens
agcatgtgtaatctcaatacct

SEQ ID NO: 9080048 - DNA, 22 bp, Homo sapiens
cacagcagaaagtgtaggagga

SEQ ID NO: 9080049 - DNA, 22 bp, Homo sapiens
cacagcagagggagccattgaa

SEQ ID NO: 9080050 - DNA, 22 bp, Homo sapiens
cacagcagagggagccattgaa

SEQ ID NO: 9080051 - DNA, 22 bp, Homo sapiens
agcaggctgggcaatatgggca

SEQ ID NO: 9080052 - DNA, 22 bp, Homo sapiens
agcagggagaccatctcttcct

SEQ ID NO: 9080053 - DNA, 22 bp, Homo sapiens
agcagggagaccatctcttcct

SEQ ID NO: 9080054 - DNA, 22 bp, Homo sapiens
agcaggcttactttctgattag

SEQ ID NO: 9080055 - DNA, 22 bp, Homo sapiens
agcaggcttatggttgaaggga

SEQ ID NO: 9080056 - DNA, 22 bp, Homo sapiens
agcagggaggcccagggcactg

SEQ ID NO: 9080057 - DNA, 22 bp, Homo sapiens
agcagggaggcccagggcactg

SEQ ID NO: 9080058 - DNA, 22 bp, Homo sapiens
agcagggaggtctagcacgtgg

SEQ ID NO: 9080059 - DNA, 22 bp, Homo sapiens
agcagggaggcggtgtgctggc

SEQ ID NO: 9080060 - DNA, 22 bp, Homo sapiens
agcagggaggcggtgtgctggc

SEQ ID NO: 9080061 - DNA, 22 bp, Homo sapiens
cacagcaatagctaactgatac

SEQ ID NO: 9080062 - DNA, 22 bp, Homo sapiens
cacagcaagagctaaatgacca

SEQ ID NO: 9080063 - DNA, 22 bp, Homo sapiens
cacagcaatagctaactgatac

SEQ ID NO: 9080064 - DNA, 22 bp, Homo sapiens
cacagcaatagctaactgatac

SEQ ID NO: 9080065 - DNA, 22 bp, Homo sapiens
cacagcaagagctaaatgacca

SEQ ID NO: 9080066 - DNA, 17 bp, Homo sapiens
agcaggaccccagagca

SEQ ID NO: 9080067 - DNA, 22 bp, Homo sapiens
agcaggaccaagaaggggaaaa

SEQ ID NO: 9080068 - DNA, 22 bp, Homo sapiens
agcaggacacgatgcggcagga

SEQ ID NO: 9080069 - DNA, 22 bp, Homo sapiens
agcaggacaatatgggatcagg

SEQ ID NO: 9080070 - DNA, 20 bp, Homo sapiens
agcaggaatgatgctttcat

SEQ ID NO: 9080071 - DNA, 22 bp, Homo sapiens
agcaggaagtagtctgtaagca

SEQ ID NO: 9080072 - DNA, 22 bp, Homo sapiens
agcaggaaggggatgatgggca

SEQ ID NO: 9080073 - DNA, 22 bp, Homo sapiens
agcaggaaggctttgggggttc

SEQ ID NO: 9080074 - DNA, 22 bp, Homo sapiens
agcaggaagtagtctgtaagca

SEQ ID NO: 9080075 - DNA, 22 bp, Homo sapiens
agcaggaaggtctgtgtgagtc

SEQ ID NO: 9080076 - DNA, 22 bp, Homo sapiens
agcaggaaggtctgtgtgagtc

SEQ ID NO: 9080077 - DNA, 22 bp, Homo sapiens
agcaggaactgacaccaagcca

SEQ ID NO: 9080078 - DNA, 22 bp, Homo sapiens
agcaggaacgagttcatgggga

SEQ ID NO: 9080079 - DNA, 22 bp, Homo sapiens
agcaggaactcagggagttctc

SEQ ID NO: 9080080 - DNA, 22 bp, Homo sapiens
agcagcttgagctggggctggc

SEQ ID NO: 9080081 - DNA, 21 bp, Homo sapiens
agcagctgggcaacatggagg

SEQ ID NO: 9080082 - DNA, 22 bp, Homo sapiens
caccagcagaagactgagggtg

SEQ ID NO: 9080083 - DNA, 20 bp, Homo sapiens
caccagcagcagctgccacc

SEQ ID NO: 9080084 - DNA, 22 bp, Homo sapiens
caccagagttgtccaaatgatt

SEQ ID NO: 9080085 - DNA, 22 bp, Homo sapiens
caccagctacagactactgtgt

SEQ ID NO: 9080086 - DNA, 22 bp, Homo sapiens
caccagccagagtgacagctcc

SEQ ID NO: 9080087 - DNA, 22 bp, Homo sapiens
caccagccagagtgacagctcc

SEQ ID NO: 9080088 - DNA, 22 bp, Homo sapiens
caccagccccctcacgctgtca

SEQ ID NO: 9080089 - DNA, 22 bp, Homo sapiens
caccagccccctcacgctgtca

SEQ ID NO: 9080090 - DNA, 22 bp, Homo sapiens
caccagccccctcacgctgtca

SEQ ID NO: 9080091 - DNA, 22 bp, Homo sapiens
caccagccccctcacgctgtca

SEQ ID NO: 9080092 - DNA, 22 bp, Homo sapiens
agcagggctctgtggagggtgg

SEQ ID NO: 9080093 - DNA, 22 bp, Homo sapiens
agcagggctgcagtgtgtcttt

SEQ ID NO: 9080094 - DNA, 19 bp, Homo sapiens
agcagggagtggttgtggg

SEQ ID NO: 9080095 - DNA, 17 bp, Homo sapiens
agcagggagtcaaggga

SEQ ID NO: 9080096 - DNA, 22 bp, Homo sapiens
agcagggcaaagtcaggctaac

SEQ ID NO: 9080097 - DNA, 22 bp, Homo sapiens
agcagggcaaagtcaggctaac

SEQ ID NO: 9080098 - DNA, 22 bp, Homo sapiens
agcagggcactggaaggcactg

SEQ ID NO: 9080099 - DNA, 22 bp, Homo sapiens
cacatttaatcctttataagta

SEQ ID NO: 9080100 - DNA, 22 bp, Homo sapiens
agcagggcagtgatcagaaagg

SEQ ID NO: 9080101 - DNA, 22 bp, Homo sapiens
agcagggcagtgatcagaaagg

SEQ ID NO: 9080102 - DNA, 22 bp, Homo sapiens
caccacttcataggctttaagg

SEQ ID NO: 9080103 - DNA, 22 bp, Homo sapiens
caccactgtatccctagcactt

SEQ ID NO: 9080104 - DNA, 22 bp, Homo sapiens
agcagggcaggtaaggatcaga

SEQ ID NO: 9080105 - DNA, 19 bp, Homo sapiens
agcagctggaggtggagtg

SEQ ID NO: 9080106 - DNA, 17 bp, Homo sapiens
agcagctggcacaggag

SEQ ID NO: 9080107 - DNA, 19 bp, Homo sapiens
agcagctggaggtggagtg

SEQ ID NO: 9080108 - DNA, 19 bp, Homo sapiens
agcagctggaggtggagtg

SEQ ID NO: 9080109 - DNA, 19 bp, Homo sapiens
agcagctggaggtggagtg

SEQ ID NO: 9080110 - DNA, 22 bp, Homo sapiens
agcagctggaactaatagtggt

SEQ ID NO: 9080111 - DNA, 22 bp, Homo sapiens
agcagctggaactaatagtggt

SEQ ID NO: 9080112 - DNA, 21 bp, Homo sapiens
agcagctgggcaacatggagg

SEQ ID NO: 9080113 - DNA, 21 bp, Homo sapiens
agcagctgggcaacatggagg

SEQ ID NO: 9080114 - DNA, 21 bp, Homo sapiens
agcagctgggcaacatggagg

SEQ ID NO: 9080115 - DNA, 22 bp, Homo sapiens
agcagctggcagcttcttctct

SEQ ID NO: 9080116 - DNA, 17 bp, Homo sapiens
agcagctggcacaggag

SEQ ID NO: 9080117 - DNA, 17 bp, Homo sapiens
agcagctggcacaggag

SEQ ID NO: 9080118 - DNA, 22 bp, Homo sapiens
agcagctggcagcttcttctct

SEQ ID NO: 9080119 - DNA, 17 bp, Homo sapiens
agcagctggcacaggag

SEQ ID NO: 9080120 - DNA, 17 bp, Homo sapiens
agcagctggcacaggag

SEQ ID NO: 9080121 - DNA, 22 bp, Homo sapiens
cacagagatggccagggcacat

SEQ ID NO: 9080122 - DNA, 22 bp, Homo sapiens
cacagagattagaattagacta

SEQ ID NO: 9080123 - DNA, 22 bp, Homo sapiens
cacagagatggtctggcaggtg

SEQ ID NO: 9080124 - DNA, 22 bp, Homo sapiens
agcagctggaacatatgaagaa

SEQ ID NO: 9080125 - DNA, 22 bp, Homo sapiens
agcagctggaacatatgaagaa

SEQ ID NO: 9080126 - DNA, 22 bp, Homo sapiens
agcagctgcttttcttcattgg

SEQ ID NO: 9080127 - DNA, 22 bp, Homo sapiens
agcagctggaacatatgaagaa

SEQ ID NO: 9080128 - DNA, 22 bp, Homo sapiens
agcagctgcttttcttcattgg

SEQ ID NO: 9080129 - DNA, 22 bp, Homo sapiens
agcagctcagaggcaccagggc

SEQ ID NO: 9080130 - DNA, 22 bp, Homo sapiens
agcagctagacttcagaatctg

SEQ ID NO: 9080131 - DNA, 22 bp, Homo sapiens
agcagctcaaagcctgcaagga

SEQ ID NO: 9080132 - DNA, 22 bp, Homo sapiens
agcagcctttgatcatctggga

SEQ ID NO: 9080133 - DNA, 22 bp, Homo sapiens
agcagccttgcaggggtcgcac

SEQ ID NO: 9080134 - DNA, 22 bp, Homo sapiens
cacagagatcggaacagaagta

SEQ ID NO: 9080135 - DNA, 22 bp, Homo sapiens
cacagagatcggaacagaagta

SEQ ID NO: 9080136 - DNA, 21 bp, Homo sapiens
cacagagatattggtgagcct

SEQ ID NO: 9080137 - DNA, 22 bp, Homo sapiens
cacagagatcggaacagaagta

SEQ ID NO: 9080138 - DNA, 21 bp, Homo sapiens
cacagagatattggtgagcct

SEQ ID NO: 9080139 - DNA, 22 bp, Homo sapiens
cacagaacatttttagatgcag

SEQ ID NO: 9080140 - DNA, 21 bp, Homo sapiens
cacagagatattggtgagcct

SEQ ID NO: 9080141 - DNA, 22 bp, Homo sapiens
agcagctcccctcatgctccac

SEQ ID NO: 9080142 - DNA, 22 bp, Homo sapiens
caatacaattaccagttaatca

SEQ ID NO: 9080143 - DNA, 22 bp, Homo sapiens
caatacaattaccagttaatca

SEQ ID NO: 9080144 - DNA, 22 bp, Homo sapiens
caatacaattaccagttaatca

SEQ ID NO: 9080145 - DNA, 22 bp, Homo sapiens
caatacatcaggtcaaaatgtg

SEQ ID NO: 9080146 - DNA, 22 bp, Homo sapiens
caatacatcaggtcaaaatgtg

SEQ ID NO: 9080147 - DNA, 22 bp, Homo sapiens
caatacactaaacttctctgaa

SEQ ID NO: 9080148 - DNA, 16 bp, Homo sapiens
caatacatggcatttc

SEQ ID NO: 9080149 - DNA, 19 bp, Homo sapiens
agcagcagaagtgtgcctt

SEQ ID NO: 9080150 - DNA, 19 bp, Homo sapiens
agcagcagaagtgtgcctt

SEQ ID NO: 9080151 - DNA, 22 bp, Homo sapiens
agcagcagatcaaacaggcttg

SEQ ID NO: 9080152 - DNA, 22 bp, Homo sapiens
agcagcagatcaaacaggcttg

SEQ ID NO: 9080153 - DNA, 22 bp, Homo sapiens
agcagcagatccaaaaaatgtg

SEQ ID NO: 9080154 - DNA, 22 bp, Homo sapiens
agcagcagaggtcagaaaggta

SEQ ID NO: 9080155 - DNA, 22 bp, Homo sapiens
agcagcagaggtcagaaaggta

SEQ ID NO: 9080156 - DNA, 22 bp, Homo sapiens
agcagcagagctctggtctgca

SEQ ID NO: 9080157 - DNA, 22 bp, Homo sapiens
agcagcagagctctggtctgca

SEQ ID NO: 9080158 - DNA, 23 bp, Homo sapiens
agcagcccaatggcaagctctgg

SEQ ID NO: 9080159 - DNA, 21 bp, Homo sapiens
agcagcagatctggtgagggc

SEQ ID NO: 9080160 - DNA, 21 bp, Homo sapiens
agcagcagatctggtgagggc

SEQ ID NO: 9080161 - DNA, 21 bp, Homo sapiens
agcagcagatctggtgagggc

SEQ ID NO: 9080162 - DNA, 22 bp, Homo sapiens
agcagcccagttgtactgagtg

SEQ ID NO: 9080163 - DNA, 23 bp, Homo sapiens
agcagcccagatgccttccatcc

SEQ ID NO: 9080164 - DNA, 22 bp, Homo sapiens
agcagcccctcggcgggtgcgc

SEQ ID NO: 9080165 - DNA, 22 bp, Homo sapiens
agcagcccgaggatcatgtgtc

SEQ ID NO: 9080166 - DNA, 22 bp, Homo sapiens
agcagcccgaggatcatgtgtc

SEQ ID NO: 9080167 - DNA, 22 bp, Homo sapiens
agcagccctagggattgctgtt

SEQ ID NO: 9080168 - DNA, 22 bp, Homo sapiens
agcagcctattcttctcttgga

SEQ ID NO: 9080169 - DNA, 23 bp, Homo sapiens
agcagccctgggacctggcctgc

SEQ ID NO: 9080170 - DNA, 23 bp, Homo sapiens
agcagccctgggacctggcctgc

SEQ ID NO: 9080171 - DNA, 22 bp, Homo sapiens
agcagcctctgtagaggtctcc

SEQ ID NO: 9080172 - DNA, 22 bp, Homo sapiens
agcactgtgatttataacattt

SEQ ID NO: 9080173 - DNA, 22 bp, Homo sapiens
agcactgtggggaactcacaga

SEQ ID NO: 9080174 - DNA, 22 bp, Homo sapiens
agcagagcgcctgctcagaggg

SEQ ID NO: 9080175 - DNA, 22 bp, Homo sapiens
agcagagcggggcctccggaag

SEQ ID NO: 9080176 - DNA, 22 bp, Homo sapiens
agcagagctattcttgtgcaat

SEQ ID NO: 9080177 - DNA, 22 bp, Homo sapiens
agcagagcggggcctccggaag

SEQ ID NO: 9080178 - DNA, 22 bp, Homo sapiens
agcagagctgcagtggcctgct

SEQ ID NO: 9080179 - DNA, 22 bp, Homo sapiens
agcagagctgcagtggcctgct

SEQ ID NO: 9080180 - DNA, 22 bp, Homo sapiens
agcagagctgcagtggcctgct

SEQ ID NO: 9080181 - DNA, 22 bp, Homo sapiens
agcagagctttttggactcaga

SEQ ID NO: 9080182 - DNA, 21 bp, Homo sapiens
agcagaggcagaatgtatgca

SEQ ID NO: 9080183 - DNA, 21 bp, Homo sapiens
agcagaggcagaatgtatgca

SEQ ID NO: 9080184 - DNA, 21 bp, Homo sapiens
agcagaggcagaatgtatgca

SEQ ID NO: 9080185 - DNA, 21 bp, Homo sapiens
agcagaggctgcctggtgact

SEQ ID NO: 9080186 - DNA, 22 bp, Homo sapiens
caatacaattaccagttaatca

SEQ ID NO: 9080187 - DNA, 22 bp, Homo sapiens
caataatatcctgtgctgtttg

SEQ ID NO: 9080188 - DNA, 22 bp, Homo sapiens
caagtgagtgaccagagttggt

SEQ ID NO: 9080189 - DNA, 22 bp, Homo sapiens
caagtgagcctcctctttttaa

SEQ ID NO: 9080190 - DNA, 19 bp, Homo sapiens
caagtgaagcctgggatgg

SEQ ID NO: 9080191 - DNA, 22 bp, Homo sapiens
agcagagtctgtgtgcacttta

SEQ ID NO: 9080192 - DNA, 22 bp, Homo sapiens
agcagaggtttgttggaaacct

SEQ ID NO: 9080193 - DNA, 22 bp, Homo sapiens
agcagagtcttcaagggcaggc

SEQ ID NO: 9080194 - DNA, 21 bp, Homo sapiens
agcagaggggacatgtttgat

SEQ ID NO: 9080195 - DNA, 22 bp, Homo sapiens
agcacctgtggctcatgctcgt

SEQ ID NO: 9080196 - DNA, 20 bp, Homo sapiens
agcacctgtgtagaagcatc

SEQ ID NO: 9080197 - DNA, 20 bp, Homo sapiens
agcacctgtgtagaagcatc

SEQ ID NO: 9080198 - DNA, 22 bp, Homo sapiens
agcacctgtgttcatgcctcat

SEQ ID NO: 9080199 - DNA, 22 bp, Homo sapiens
agcaccttgatcttggacttcc

SEQ ID NO: 9080200 - DNA, 22 bp, Homo sapiens
agcacgttcttcattacttcac

SEQ ID NO: 9080201 - DNA, 17 bp, Homo sapiens
agcactaaaatgcttcc

SEQ ID NO: 9080202 - DNA, 22 bp, Homo sapiens
agcactattccaatgatccaat

SEQ ID NO: 9080203 - DNA, 22 bp, Homo sapiens
agcactgatttaaactggattt

SEQ ID NO: 9080204 - DNA, 22 bp, Homo sapiens
agcactgctttagagcctctgc

SEQ ID NO: 9080205 - DNA, 22 bp, Homo sapiens
agcactgattttgttgcactta

SEQ ID NO: 9080206 - DNA, 20 bp, Homo sapiens
agcactgtctgaccagtggc

SEQ ID NO: 9080207 - DNA, 22 bp, Homo sapiens
agcactgtagttatagctaaca

SEQ ID NO: 9080208 - DNA, 22 bp, Homo sapiens
agcactgtccggtaagatgctc

SEQ ID NO: 9080209 - DNA, 22 bp, Homo sapiens
agcacctgtcaagtccaggctg

SEQ ID NO: 9080210 - DNA, 22 bp, Homo sapiens
agcacctgtcacaagcagaagg

SEQ ID NO: 9080211 - DNA, 17 bp, Homo sapiens
agcacctgtccagtccc

SEQ ID NO: 9080212 - DNA, 19 bp, Homo sapiens
agcacctgtgagagcctgg

SEQ ID NO: 9080213 - DNA, 19 bp, Homo sapiens
agcacctgtgagagcctgg

SEQ ID NO: 9080214 - DNA, 22 bp, Homo sapiens
agcacctggagggctgggacct

SEQ ID NO: 9080215 - DNA, 22 bp, Homo sapiens
agcacctgcttgtgactaggga

SEQ ID NO: 9080216 - DNA, 18 bp, Homo sapiens
agcaccagtcactaacag

SEQ ID NO: 9080217 - DNA, 22 bp, Homo sapiens
caaagggcggctgtcggagggt

SEQ ID NO: 9080218 - DNA, 22 bp, Homo sapiens
caaagggcattttagtgaactg

SEQ ID NO: 9080219 - DNA, 22 bp, Homo sapiens
caaaggcatgtgagtatatgtg

SEQ ID NO: 9080220 - DNA, 22 bp, Homo sapiens
caaaggctttgctatgatgcat

SEQ ID NO: 9080221 - DNA, 22 bp, Homo sapiens
caaaggcttccactgcatcctt

SEQ ID NO: 9080222 - DNA, 22 bp, Homo sapiens
caaagggaaacgcagtgtcaag

SEQ ID NO: 9080223 - DNA, 22 bp, Homo sapiens
caaagggcatggcctgagcact

SEQ ID NO: 9080224 - DNA, 22 bp, Homo sapiens
agagtccatgaagacagctgag

SEQ ID NO: 9080225 - DNA, 22 bp, Homo sapiens
agagtccatatattgatttgtt

SEQ ID NO: 9080226 - DNA, 22 bp, Homo sapiens
agagtctgatatttgtaccaga

SEQ ID NO: 9080227 - DNA, 22 bp, Homo sapiens
agagtctgatatttgtaccaga

SEQ ID NO: 9080228 - DNA, 22 bp, Homo sapiens
agagtctgaggcagctgcagcc

SEQ ID NO: 9080229 - DNA, 22 bp, Homo sapiens
agagtctgaggcagctgcagcc

SEQ ID NO: 9080230 - DNA, 22 bp, Homo sapiens
agagtctgaatgctcagagttg

SEQ ID NO: 9080231 - DNA, 22 bp, Homo sapiens
agagtctgaggaggaccaacag

SEQ ID NO: 9080232 - DNA, 22 bp, Homo sapiens
agagtgagggggcactgagacg

SEQ ID NO: 9080233 - DNA, 23 bp, Homo sapiens
agagtgcagagatatgcttgtgt

SEQ ID NO: 9080234 - DNA, 20 bp, Homo sapiens
agagtgctggactgaggagc

SEQ ID NO: 9080235 - DNA, 20 bp, Homo sapiens
agagtgctggactgaggagc

SEQ ID NO: 9080236 - DNA, 22 bp, Homo sapiens
agagtgctagcctgagggaggt

SEQ ID NO: 9080237 - DNA, 22 bp, Homo sapiens
agagtgctcagatgcatgtctt

SEQ ID NO: 9080238 - DNA, 22 bp, Homo sapiens
agagtgctagcctgagggaggt

SEQ ID NO: 9080239 - DNA, 22 bp, Homo sapiens
agagtccaccctggggtcaggc

SEQ ID NO: 9080240 - DNA, 22 bp, Homo sapiens
agagtcagactaagccatggtg

SEQ ID NO: 9080241 - DNA, 22 bp, Homo sapiens
agagtcagcttatgacacagtc

SEQ ID NO: 9080242 - DNA, 22 bp, Homo sapiens
agagtcagcttatgacacagtc

SEQ ID NO: 9080243 - DNA, 22 bp, Homo sapiens
agagtcagaaagcagacagggg

SEQ ID NO: 9080244 - DNA, 22 bp, Homo sapiens
agagtcagaaagcagacagggg

SEQ ID NO: 9080245 - DNA, 22 bp, Homo sapiens
agagtcagaaagcagacagggg

SEQ ID NO: 9080246 - DNA, 22 bp, Homo sapiens
agagtcagaaccaagatgaggc

SEQ ID NO: 9080247 - DNA, 22 bp, Homo sapiens
agaggtggagctcttggcatca

SEQ ID NO: 9080248 - DNA, 22 bp, Homo sapiens
agaggtgacataggagaggctc

SEQ ID NO: 9080249 - DNA, 22 bp, Homo sapiens
agaggtgacataggagaggctc

SEQ ID NO: 9080250 - DNA, 22 bp, Homo sapiens
agagtactgcctcagttatgaa

SEQ ID NO: 9080251 - DNA, 22 bp, Homo sapiens
agagtcaagtagggcatgggct

SEQ ID NO: 9080252 - DNA, 19 bp, Homo sapiens
agagtattgaatttgccct

SEQ ID NO: 9080253 - DNA, 22 bp, Homo sapiens
agagtatgcatctattgtacct

SEQ ID NO: 9080254 - DNA, 23 bp, Homo sapiens
agaggggagcatctgctggctga

SEQ ID NO: 9080255 - DNA, 23 bp, Homo sapiens
agaggggagcatctgctggctga

SEQ ID NO: 9080256 - DNA, 22 bp, Homo sapiens
agaggggagagctaagcaattc

SEQ ID NO: 9080257 - DNA, 23 bp, Homo sapiens
agaggggagcatctgctggctga

SEQ ID NO: 9080258 - DNA, 22 bp, Homo sapiens
agaggggaagtaatgaatgata

SEQ ID NO: 9080259 - DNA, 22 bp, Homo sapiens
agaggggagtcctaatctgatt

SEQ ID NO: 9080260 - DNA, 22 bp, Homo sapiens
agaggggctcaagcagtggtct

SEQ ID NO: 9080261 - DNA, 22 bp, Homo sapiens
agaggggaaggatgtgatgtga

SEQ ID NO: 9080262 - DNA, 22 bp, Homo sapiens
agagggctttgattctcagttc

SEQ ID NO: 9080263 - DNA, 22 bp, Homo sapiens
agagggctggacgcaggttgga

SEQ ID NO: 9080264 - DNA, 19 bp, Homo sapiens
agaggctgtcacctgtagc

SEQ ID NO: 9080265 - DNA, 22 bp, Homo sapiens
agaggctgggtacgggccacct

SEQ ID NO: 9080266 - DNA, 22 bp, Homo sapiens
agaggctgggaagggtccccgg

SEQ ID NO: 9080267 - DNA, 22 bp, Homo sapiens
agaggctgggaagggtccccgg

SEQ ID NO: 9080268 - DNA, 22 bp, Homo sapiens
agaggctgggcaggacccacag

SEQ ID NO: 9080269 - DNA, 22 bp, Homo sapiens
attacagaaagcaatattgagt

SEQ ID NO: 9080270 - DNA, 22 bp, Homo sapiens
attacagattataaatttgagc

SEQ ID NO: 9080271 - DNA, 22 bp, Homo sapiens
attacagaagatatgctcaaca

SEQ ID NO: 9080272 - DNA, 22 bp, Homo sapiens
attacagatagactttgaagct

SEQ ID NO: 9080273 - DNA, 22 bp, Homo sapiens
attacagtaacagctacaatgc

SEQ ID NO: 9080274 - DNA, 22 bp, Homo sapiens
agaggcaggaggttgacttgag

SEQ ID NO: 9080275 - DNA, 22 bp, Homo sapiens
agaggcaggaggttgacttgag

SEQ ID NO: 9080276 - DNA, 22 bp, Homo sapiens
agaggcaggaggttgacttgag

SEQ ID NO: 9080277 - DNA, 23 bp, Homo sapiens
agaggcaggagtggcttgcccgg

SEQ ID NO: 9080278 - DNA, 22 bp, Homo sapiens
attacagtaacagctacaatgc

SEQ ID NO: 9080279 - DNA, 22 bp, Homo sapiens
agaggcaccgtctgcagcgtgc

SEQ ID NO: 9080280 - DNA, 22 bp, Homo sapiens
agagctggctgtgggtgacttt

SEQ ID NO: 9080281 - DNA, 22 bp, Homo sapiens
agagctggctgtgggtgacttt

SEQ ID NO: 9080282 - DNA, 22 bp, Homo sapiens
agagctgggaccgtctggaagt

SEQ ID NO: 9080283 - DNA, 20 bp, Homo sapiens
agagctgggaagctccctat

SEQ ID NO: 9080284 - DNA, 22 bp, Homo sapiens
agagctggctgtgggtgacttt

SEQ ID NO: 9080285 - DNA, 20 bp, Homo sapiens
agagctgggaagctccctat

SEQ ID NO: 9080286 - DNA, 21 bp, Homo sapiens
agagctgggacttgcctgaga

SEQ ID NO: 9080287 - DNA, 21 bp, Homo sapiens
agagctgggacttgcctgaga

SEQ ID NO: 9080288 - DNA, 22 bp, Homo sapiens
agagctgggaccgtctggaagt

SEQ ID NO: 9080289 - DNA, 22 bp, Homo sapiens
agaggaggctgggtccagataa

SEQ ID NO: 9080290 - DNA, 22 bp, Homo sapiens
agaggcacaacagtcccattgt

SEQ ID NO: 9080291 - DNA, 22 bp, Homo sapiens
agaggcacagaggcagtcccct

SEQ ID NO: 9080292 - DNA, 22 bp, Homo sapiens
agaggcaagttcagagctagga

SEQ ID NO: 9080293 - DNA, 19 bp, Homo sapiens
agaggcaagggtggaagta

SEQ ID NO: 9080294 - DNA, 19 bp, Homo sapiens
agaggcaagggtggaagta

SEQ ID NO: 9080295 - DNA, 22 bp, Homo sapiens
agaggccagcagtgcctatctg

SEQ ID NO: 9080296 - DNA, 22 bp, Homo sapiens
agaggccagcagtgcctatctg

SEQ ID NO: 9080297 - DNA, 23 bp, Homo sapiens
agaggccagcctttggagacacc

SEQ ID NO: 9080298 - DNA, 23 bp, Homo sapiens
agaggccagcctttggagacacc

SEQ ID NO: 9080299 - DNA, 23 bp, Homo sapiens
agaggccagcctttggagacacc

SEQ ID NO: 9080300 - DNA, 22 bp, Homo sapiens
agaggccagcactgcagggaag

SEQ ID NO: 9080301 - DNA, 22 bp, Homo sapiens
agaggccagcactgcagggaag

SEQ ID NO: 9080302 - DNA, 22 bp, Homo sapiens
agaggccagcaaccacagtaaa

SEQ ID NO: 9080303 - DNA, 22 bp, Homo sapiens
agaggccagatcatcatagatg

SEQ ID NO: 9080304 - DNA, 22 bp, Homo sapiens
agaggccagcaaccacagtaaa

SEQ ID NO: 9080305 - DNA, 22 bp, Homo sapiens
agaggccactttgcctgtgatg

SEQ ID NO: 9080306 - DNA, 22 bp, Homo sapiens
agaggccagaaggcgcaccccg

SEQ ID NO: 9080307 - DNA, 22 bp, Homo sapiens
agaggccaccagaggtggtgcc

SEQ ID NO: 9080308 - DNA, 22 bp, Homo sapiens
agaggccaccttctcttgagaa

SEQ ID NO: 9080309 - DNA, 23 bp, Homo sapiens
agaggcaggagtggcttgcccgg

SEQ ID NO: 9080310 - DNA, 23 bp, Homo sapiens
agaggcaggagtggcttgcccgg

SEQ ID NO: 9080311 - DNA, 22 bp, Homo sapiens
agaggccaccactgtcagggac

SEQ ID NO: 9080312 - DNA, 22 bp, Homo sapiens
agaggccaccactgtcagggac

SEQ ID NO: 9080313 - DNA, 22 bp, Homo sapiens
agaggctgcacttgctcatgat

SEQ ID NO: 9080314 - DNA, 22 bp, Homo sapiens
agaggctgcacttgctcatgat

SEQ ID NO: 9080315 - DNA, 22 bp, Homo sapiens
agaggctgcacttgctcatgat

SEQ ID NO: 9080316 - DNA, 22 bp, Homo sapiens
agaggccaggcagcccaaggtg

SEQ ID NO: 9080317 - DNA, 23 bp, Homo sapiens
agaggccagcctttggagacacc

SEQ ID NO: 9080318 - DNA, 22 bp, Homo sapiens
agaggctccttcactctggcac

SEQ ID NO: 9080319 - DNA, 22 bp, Homo sapiens
agaggccaggctgcagagggat

SEQ ID NO: 9080320 - DNA, 22 bp, Homo sapiens
agaggccaggctgcagagggat

SEQ ID NO: 9080321 - DNA, 23 bp, Homo sapiens
agaggctgcagggtattgagaat

SEQ ID NO: 9080322 - DNA, 22 bp, Homo sapiens
agaggctgcacttgctcatgat

SEQ ID NO: 9080323 - DNA, 18 bp, Homo sapiens
agaggctggacaggggat

SEQ ID NO: 9080324 - DNA, 18 bp, Homo sapiens
agaggctggacaggggat

SEQ ID NO: 9080325 - DNA, 22 bp, Homo sapiens
agaggctggattgagcatagac

SEQ ID NO: 9080326 - DNA, 22 bp, Homo sapiens
agaggctggattgagcatagac

SEQ ID NO: 9080327 - DNA, 22 bp, Homo sapiens
agcaaatcagctgctcaggaaa

SEQ ID NO: 9080328 - DNA, 19 bp, Homo sapiens
agcaacaccgtttatttcc

SEQ ID NO: 9080329 - DNA, 18 bp, Homo sapiens
agcaacagaaacatatgg

SEQ ID NO: 9080330 - DNA, 22 bp, Homo sapiens
agcaaattcagaagcagaatgg

SEQ ID NO: 9080331 - DNA, 22 bp, Homo sapiens
agcaaattaggtcaaggagatg

SEQ ID NO: 9080332 - DNA, 22 bp, Homo sapiens
agcaacagaagatagagtgaat

SEQ ID NO: 9080333 - DNA, 22 bp, Homo sapiens
agcaacagcaggtttgcactcc

SEQ ID NO: 9080334 - DNA, 22 bp, Homo sapiens
agcaacagcaacgacatttctc

SEQ ID NO: 9080335 - DNA, 22 bp, Homo sapiens
agcaacaggaatattatggcaa

SEQ ID NO: 9080336 - DNA, 22 bp, Homo sapiens
agcaacaggaaatagctgatta

SEQ ID NO: 9080337 - DNA, 22 bp, Homo sapiens
agcaacaggaatattatggcaa

SEQ ID NO: 9080338 - DNA, 22 bp, Homo sapiens
agcaacagccctgaggttcatg

SEQ ID NO: 9080339 - DNA, 22 bp, Homo sapiens
agcaacagccctgtttcattag

SEQ ID NO: 9080340 - DNA, 22 bp, Homo sapiens
agcaaagctatctctatggaga

SEQ ID NO: 9080341 - DNA, 22 bp, Homo sapiens
agatgtgtttctagttcctgca

SEQ ID NO: 9080342 - DNA, 22 bp, Homo sapiens
agatgtgtttctagttcctgca

SEQ ID NO: 9080343 - DNA, 22 bp, Homo sapiens
agatgtgggcaatggaatggag

SEQ ID NO: 9080344 - DNA, 22 bp, Homo sapiens
attttcaccctgaatatattga

SEQ ID NO: 9080345 - DNA, 22 bp, Homo sapiens
agatgtggatcctagggtagaa

SEQ ID NO: 9080346 - DNA, 22 bp, Homo sapiens
attttcagaacattcattcact

SEQ ID NO: 9080347 - DNA, 22 bp, Homo sapiens
agatgtggcctttgggagatta

SEQ ID NO: 9080348 - DNA, 22 bp, Homo sapiens
agatgtggccggctagggagag

SEQ ID NO: 9080349 - DNA, 22 bp, Homo sapiens
agatgtggccggctagggagag

SEQ ID NO: 9080350 - DNA, 22 bp, Homo sapiens
agatgtggccggctagggagag

SEQ ID NO: 9080351 - DNA, 22 bp, Homo sapiens
agatgtggatcctagggtagaa

SEQ ID NO: 9080352 - DNA, 22 bp, Homo sapiens
attttcagagacatctggactt

SEQ ID NO: 9080353 - DNA, 22 bp, Homo sapiens
agatgtggatcctagggtagaa

SEQ ID NO: 9080354 - DNA, 22 bp, Homo sapiens
attttagcaaatgcaagatgga

SEQ ID NO: 9080355 - DNA, 22 bp, Homo sapiens
attttagctgtccagtggattg

SEQ ID NO: 9080356 - DNA, 22 bp, Homo sapiens
attttcaaaacatctgctgtgt

SEQ ID NO: 9080357 - DNA, 22 bp, Homo sapiens
attttatgacacgattcttcca

SEQ ID NO: 9080358 - DNA, 22 bp, Homo sapiens
attttatctgcttactttcagg

SEQ ID NO: 9080359 - DNA, 22 bp, Homo sapiens
attttagttttagcatccatgc

SEQ ID NO: 9080360 - DNA, 22 bp, Homo sapiens
attttagttttagcatccatgc

SEQ ID NO: 9080361 - DNA, 22 bp, Homo sapiens
agcaagaaaatctctgtccaat

SEQ ID NO: 9080362 - DNA, 17 bp, Homo sapiens
agcaacttctcccacag

SEQ ID NO: 9080363 - DNA, 20 bp, Homo sapiens
agcaagagtaaggacagcga

SEQ ID NO: 9080364 - DNA, 22 bp, Homo sapiens
agcaacaggaccatggagccca

SEQ ID NO: 9080365 - DNA, 18 bp, Homo sapiens
agcaacaggatcccaggg

SEQ ID NO: 9080366 - DNA, 18 bp, Homo sapiens
agcaacaggatcccaggg

SEQ ID NO: 9080367 - DNA, 22 bp, Homo sapiens
agcaacaggcataatgtgttga

SEQ ID NO: 9080368 - DNA, 22 bp, Homo sapiens
agcaacagggggatggccactg

SEQ ID NO: 9080369 - DNA, 22 bp, Homo sapiens
agcaacagggtggtcttcagaa

SEQ ID NO: 9080370 - DNA, 22 bp, Homo sapiens
agcaacagggtggtcttcagaa

SEQ ID NO: 9080371 - DNA, 23 bp, Homo sapiens
agcaacagtgggtgagtgttgct

SEQ ID NO: 9080372 - DNA, 22 bp, Homo sapiens
agcaacaggtttattatcttat

SEQ ID NO: 9080373 - DNA, 22 bp, Homo sapiens
agcaacaggtttattatcttat

SEQ ID NO: 9080374 - DNA, 22 bp, Homo sapiens
agcaacccgtccttgggggact

SEQ ID NO: 9080375 - DNA, 22 bp, Homo sapiens
agcaacatttttcaattaacat

SEQ ID NO: 9080376 - DNA, 22 bp, Homo sapiens
agcaacatttttcaattaacat

SEQ ID NO: 9080377 - DNA, 22 bp, Homo sapiens
agcaacattgagactgcagttg

SEQ ID NO: 9080378 - DNA, 22 bp, Homo sapiens
agcaacagtgtatatcataggc

SEQ ID NO: 9080379 - DNA, 22 bp, Homo sapiens
agcaacagtgtatatcataggc

SEQ ID NO: 9080380 - DNA, 22 bp, Homo sapiens
agcaactagccaggatgcagag

SEQ ID NO: 9080381 - DNA, 22 bp, Homo sapiens
caaagattttagaatttgcaat

SEQ ID NO: 9080382 - DNA, 22 bp, Homo sapiens
caaagcaaggctcagtttgaac

SEQ ID NO: 9080383 - DNA, 22 bp, Homo sapiens
caaagcaaggctcagtttgaac

SEQ ID NO: 9080384 - DNA, 22 bp, Homo sapiens
caaagcaagggctgaagactcc

SEQ ID NO: 9080385 - DNA, 22 bp, Homo sapiens
caaagcaagggctgaagactcc

SEQ ID NO: 9080386 - DNA, 22 bp, Homo sapiens
caaagcaagggctgaagactcc

SEQ ID NO: 9080387 - DNA, 22 bp, Homo sapiens
caaagcaagggctgaagactcc

SEQ ID NO: 9080388 - DNA, 22 bp, Homo sapiens
caaagcaagggctgaagactcc

SEQ ID NO: 9080389 - DNA, 22 bp, Homo sapiens
caaaggcaggtgctgaatattc

SEQ ID NO: 9080390 - DNA, 22 bp, Homo sapiens
caaaggcaggtcatggccactt

SEQ ID NO: 9080391 - DNA, 22 bp, Homo sapiens
caaaggcaggtcatggccactt

SEQ ID NO: 9080392 - DNA, 22 bp, Homo sapiens
caaagataatcacagaataccc

SEQ ID NO: 9080393 - DNA, 20 bp, Homo sapiens
agcaagagtaaggacagcga

SEQ ID NO: 9080394 - DNA, 22 bp, Homo sapiens
caaagatatgacatggaaaatg

SEQ ID NO: 9080395 - DNA, 22 bp, Homo sapiens
caaagatgctgatgttggatca

SEQ ID NO: 9080396 - DNA, 22 bp, Homo sapiens
caaagatgtcattggtaagaca

SEQ ID NO: 9080397 - DNA, 22 bp, Homo sapiens
caaagattttagaatttgcaat

SEQ ID NO: 9080398 - DNA, 22 bp, Homo sapiens
caaagatgtcattggtaagaca

SEQ ID NO: 9080399 - DNA, 22 bp, Homo sapiens
caaagatgccaaaaggaagaca

SEQ ID NO: 9080400 - DNA, 22 bp, Homo sapiens
agatggagaccttggatgaact

SEQ ID NO: 9080401 - DNA, 22 bp, Homo sapiens
agatggagaccttggatgaact

SEQ ID NO: 9080402 - DNA, 22 bp, Homo sapiens
agatggaggaaggctgaactca

SEQ ID NO: 9080403 - DNA, 22 bp, Homo sapiens
agatggagtctcactcttgttg

SEQ ID NO: 9080404 - DNA, 22 bp, Homo sapiens
agatggagaccttggatgaact

SEQ ID NO: 9080405 - DNA, 22 bp, Homo sapiens
agatggagaccttggatgaact

SEQ ID NO: 9080406 - DNA, 22 bp, Homo sapiens
agatggagttagtaccagagtc

SEQ ID NO: 9080407 - DNA, 22 bp, Homo sapiens
agatggagtggagatgagtaaa

SEQ ID NO: 9080408 - DNA, 17 bp, Homo sapiens
agatggcaggaggcaga

SEQ ID NO: 9080409 - DNA, 22 bp, Homo sapiens
agatggcagcagaacaaacagg

SEQ ID NO: 9080410 - DNA, 17 bp, Homo sapiens
agatggcaggaggcaga

SEQ ID NO: 9080411 - DNA, 22 bp, Homo sapiens
agatggagttgtagcagtgact

SEQ ID NO: 9080412 - DNA, 22 bp, Homo sapiens
agatggagttgtagcagtgact

SEQ ID NO: 9080413 - DNA, 22 bp, Homo sapiens
attttaaccctcttatatatac

SEQ ID NO: 9080414 - DNA, 17 bp, Homo sapiens
agatggcctctaagatt

SEQ ID NO: 9080415 - DNA, 22 bp, Homo sapiens
agatggcttagcctggctccca

SEQ ID NO: 9080416 - DNA, 17 bp, Homo sapiens
agatggcctctaagatt

SEQ ID NO: 9080417 - DNA, 22 bp, Homo sapiens
agatggcaggccctgtgggggt

SEQ ID NO: 9080418 - DNA, 21 bp, Homo sapiens
agatgctgtgctccaggagca

SEQ ID NO: 9080419 - DNA, 22 bp, Homo sapiens
agatgctgtgtctgttcccttg

SEQ ID NO: 9080420 - DNA, 22 bp, Homo sapiens
agatggagaccttggatgaact

SEQ ID NO: 9080421 - DNA, 22 bp, Homo sapiens
agatggaaaatatagacagaga

SEQ ID NO: 9080422 - DNA, 22 bp, Homo sapiens
agatggaaaatatagacagaga

SEQ ID NO: 9080423 - DNA, 22 bp, Homo sapiens
agatgctgtgaggaagctagga

SEQ ID NO: 9080424 - DNA, 22 bp, Homo sapiens
agatgctgtcacacacactgtt

SEQ ID NO: 9080425 - DNA, 22 bp, Homo sapiens
agatgctggggcccctcggatg

SEQ ID NO: 9080426 - DNA, 17 bp, Homo sapiens
agatgctggccacatgt

SEQ ID NO: 9080427 - DNA, 22 bp, Homo sapiens
agatgcaatgctgaatttgagt

SEQ ID NO: 9080428 - DNA, 22 bp, Homo sapiens
agatgcaacctctgcttaacaa

SEQ ID NO: 9080429 - DNA, 23 bp, Homo sapiens
agatccaacattgtccatttttt

SEQ ID NO: 9080430 - DNA, 22 bp, Homo sapiens
agatcagaaatgtaatggcagt

SEQ ID NO: 9080431 - DNA, 23 bp, Homo sapiens
agatcagcatggatcagtcttct

SEQ ID NO: 9080432 - DNA, 22 bp, Homo sapiens
agatataataatttacaagtgt

SEQ ID NO: 9080433 - DNA, 22 bp, Homo sapiens
agatatttgtatcttgctattg

SEQ ID NO: 9080434 - DNA, 22 bp, Homo sapiens
agatcaaatctgggatttctaa

SEQ ID NO: 9080435 - DNA, 22 bp, Homo sapiens
agatcaaggtgtcagcaggctt

SEQ ID NO: 9080436 - DNA, 22 bp, Homo sapiens
attggccatttgcatgtattat

SEQ ID NO: 9080437 - DNA, 22 bp, Homo sapiens
attggccatttgcatgtattat

SEQ ID NO: 9080438 - DNA, 20 bp, Homo sapiens
attggccaggcataaaacac

SEQ ID NO: 9080439 - DNA, 22 bp, Homo sapiens
attggctttcttttgtgaaaat

SEQ ID NO: 9080440 - DNA, 22 bp, Homo sapiens
attggctttgatatctaaaggg

SEQ ID NO: 9080441 - DNA, 22 bp, Homo sapiens
agagtggcagcaagtcaggtag

SEQ ID NO: 9080442 - DNA, 22 bp, Homo sapiens
attggggagagctaatatttta

SEQ ID NO: 9080443 - DNA, 22 bp, Homo sapiens
attggtagttttgtatttctct

SEQ ID NO: 9080444 - DNA, 22 bp, Homo sapiens
attggtcaagtcttgcaggtga

SEQ ID NO: 9080445 - DNA, 22 bp, Homo sapiens
attggtcatgtttttgtggtaa

SEQ ID NO: 9080446 - DNA, 22 bp, Homo sapiens
attggtcattttggtttagaag

SEQ ID NO: 9080447 - DNA, 22 bp, Homo sapiens
attggtcaggactggcatgtgg

SEQ ID NO: 9080448 - DNA, 22 bp, Homo sapiens
attggtcagccacgtagggaat

SEQ ID NO: 9080449 - DNA, 22 bp, Homo sapiens
attggtcataaattgagtgatt

SEQ ID NO: 9080450 - DNA, 22 bp, Homo sapiens
attggtcacctccctcagctct

SEQ ID NO: 9080451 - DNA, 22 bp, Homo sapiens
attggtcagagtaaatttattt

SEQ ID NO: 9080452 - DNA, 22 bp, Homo sapiens
agagctggaatcagacctcagg

SEQ ID NO: 9080453 - DNA, 22 bp, Homo sapiens
agagctggacgtctgagcccta

SEQ ID NO: 9080454 - DNA, 22 bp, Homo sapiens
agagctggacgtctgagcccta

SEQ ID NO: 9080455 - DNA, 22 bp, Homo sapiens
agagctggacgtctgagcccta

SEQ ID NO: 9080456 - DNA, 22 bp, Homo sapiens
agagctggagatgcaggtttcg

SEQ ID NO: 9080457 - DNA, 22 bp, Homo sapiens
agagctggagcagccccactgg

SEQ ID NO: 9080458 - DNA, 22 bp, Homo sapiens
agagctggagcagccccactgg

SEQ ID NO: 9080459 - DNA, 22 bp, Homo sapiens
agagctggatggtcaagatggc

SEQ ID NO: 9080460 - DNA, 22 bp, Homo sapiens
agagctggcactgaccctcacc

SEQ ID NO: 9080461 - DNA, 22 bp, Homo sapiens
agagctggcagcagcttctcct

SEQ ID NO: 9080462 - DNA, 22 bp, Homo sapiens
agagctggcagcagcttctcct

SEQ ID NO: 9080463 - DNA, 22 bp, Homo sapiens
agagctggatggtcaagatggc

SEQ ID NO: 9080464 - DNA, 22 bp, Homo sapiens
agagctggatggtcaagatggc

SEQ ID NO: 9080465 - DNA, 22 bp, Homo sapiens
agagctggatggtcaagatggc

SEQ ID NO: 9080466 - DNA, 22 bp, Homo sapiens
agagctggccagggatcactct

SEQ ID NO: 9080467 - DNA, 22 bp, Homo sapiens
agagctggccagggatcactct

SEQ ID NO: 9080468 - DNA, 22 bp, Homo sapiens
agagctggccagggatcactct

SEQ ID NO: 9080469 - DNA, 22 bp, Homo sapiens
agagctggccagggatcactct

SEQ ID NO: 9080470 - DNA, 22 bp, Homo sapiens
agagctggctgctgcggtgctt

SEQ ID NO: 9080471 - DNA, 21 bp, Homo sapiens
agagctggcctgccaggccct

SEQ ID NO: 9080472 - DNA, 22 bp, Homo sapiens
agagctggctggtagccctgat

SEQ ID NO: 9080473 - DNA, 22 bp, Homo sapiens
agagctggctgtgggtgacttt

SEQ ID NO: 9080474 - DNA, 22 bp, Homo sapiens
agagctggctggtagccctgat

SEQ ID NO: 9080475 - DNA, 22 bp, Homo sapiens
agagctggctgctgcggtgctt

SEQ ID NO: 9080476 - DNA, 22 bp, Homo sapiens
agagcctgaggatgtcccagct

SEQ ID NO: 9080477 - DNA, 21 bp, Homo sapiens
agagcctgagatcttccagca

SEQ ID NO: 9080478 - DNA, 22 bp, Homo sapiens
agagctgaaaaagctgacccgg

SEQ ID NO: 9080479 - DNA, 22 bp, Homo sapiens
agagctgaaaaagctgacccgg

SEQ ID NO: 9080480 - DNA, 22 bp, Homo sapiens
agagcctgcagctgtgaagaaa

SEQ ID NO: 9080481 - DNA, 22 bp, Homo sapiens
agagcctgcagctgtgaagaaa

SEQ ID NO: 9080482 - DNA, 22 bp, Homo sapiens
agagcctgaggtctaacagggg

SEQ ID NO: 9080483 - DNA, 22 bp, Homo sapiens
agagcctgaggccaggaaaatg

SEQ ID NO: 9080484 - DNA, 22 bp, Homo sapiens
agagcctgaggatgtcccagct

SEQ ID NO: 9080485 - DNA, 22 bp, Homo sapiens
agagcctgaggccctgagaggg

SEQ ID NO: 9080486 - DNA, 22 bp, Homo sapiens
agagccctggagggcagtcccg

SEQ ID NO: 9080487 - DNA, 22 bp, Homo sapiens
agagccctgaagcagagctaaa

SEQ ID NO: 9080488 - DNA, 22 bp, Homo sapiens
agagcacaggctctggagtcta

SEQ ID NO: 9080489 - DNA, 21 bp, Homo sapiens
agagcacaggtggacaatgct

SEQ ID NO: 9080490 - DNA, 22 bp, Homo sapiens
agagagttctttctagttgaag

SEQ ID NO: 9080491 - DNA, 22 bp, Homo sapiens
agagcacaggctcaccattgtt

SEQ ID NO: 9080492 - DNA, 22 bp, Homo sapiens
agagcacatggttcctgtgtcc

SEQ ID NO: 9080493 - DNA, 22 bp, Homo sapiens
agagcactgctgatttacagtc

SEQ ID NO: 9080494 - DNA, 22 bp, Homo sapiens
agagcactgctgatttacagtc

SEQ ID NO: 9080495 - DNA, 22 bp, Homo sapiens
agagcagaggcatggccgtggg

SEQ ID NO: 9080496 - DNA, 22 bp, Homo sapiens
agagcagagtggctgtagcttg

SEQ ID NO: 9080497 - DNA, 22 bp, Homo sapiens
agagcccctggtggagtgagaa

SEQ ID NO: 9080498 - DNA, 22 bp, Homo sapiens
agagcccctggtggagtgagaa

SEQ ID NO: 9080499 - DNA, 22 bp, Homo sapiens
agagcccctcggtggaggggtc

SEQ ID NO: 9080500 - DNA, 22 bp, Homo sapiens
agagcccctgggtcacacagcc

SEQ ID NO: 9080501 - DNA, 22 bp, Homo sapiens
agagcccctcggtggaggggtc

SEQ ID NO: 9080502 - DNA, 22 bp, Homo sapiens
agagcccctcggtggaggggtc

SEQ ID NO: 9080503 - DNA, 22 bp, Homo sapiens
agagccaggccaggccggggca

SEQ ID NO: 9080504 - DNA, 22 bp, Homo sapiens
agagcagatggccagggggcct

SEQ ID NO: 9080505 - DNA, 22 bp, Homo sapiens
agagcagatggccagggggcct

SEQ ID NO: 9080506 - DNA, 22 bp, Homo sapiens
agagcagcacgttgtccccaca

SEQ ID NO: 9080507 - DNA, 22 bp, Homo sapiens
agagcagcacgttgtccccaca

SEQ ID NO: 9080508 - DNA, 22 bp, Homo sapiens
agagcagatggagctggaagag

SEQ ID NO: 9080509 - DNA, 22 bp, Homo sapiens
agagcagatggccagggggcct

SEQ ID NO: 9080510 - DNA, 22 bp, Homo sapiens
agagagcattgaggaaatcttc

SEQ ID NO: 9080511 - DNA, 22 bp, Homo sapiens
agagagaagcaatcagtggcca

SEQ ID NO: 9080512 - DNA, 22 bp, Homo sapiens
agagagcatggcacagaggggt

SEQ ID NO: 9080513 - DNA, 22 bp, Homo sapiens
agagagcatggcacagaggggt

SEQ ID NO: 9080514 - DNA, 21 bp, Homo sapiens
agagagaaggccatatggtcc

SEQ ID NO: 9080515 - DNA, 22 bp, Homo sapiens
agagacaccgcgcatcatggct

SEQ ID NO: 9080516 - DNA, 22 bp, Homo sapiens
agagacaccgcgcatcatggct

SEQ ID NO: 9080517 - DNA, 22 bp, Homo sapiens
agagacaccgcgcatcatggct

SEQ ID NO: 9080518 - DNA, 22 bp, Homo sapiens
agagacagacacatcgggctgc

SEQ ID NO: 9080519 - DNA, 21 bp, Homo sapiens
agagacagagaaagtaacatt

SEQ ID NO: 9080520 - DNA, 21 bp, Homo sapiens
agagacagagaaagtaacatt

SEQ ID NO: 9080521 - DNA, 20 bp, Homo sapiens
agagaattccctttggagat

SEQ ID NO: 9080522 - DNA, 22 bp, Homo sapiens
agagaattaattaggagcactg

SEQ ID NO: 9080523 - DNA, 22 bp, Homo sapiens
agagaattaacattccatggct

SEQ ID NO: 9080524 - DNA, 22 bp, Homo sapiens
agagaattacagaagaatgtca

SEQ ID NO: 9080525 - DNA, 22 bp, Homo sapiens
agagaattctggtgctaacaag

SEQ ID NO: 9080526 - DNA, 22 bp, Homo sapiens
agagacaatgccaatgcacacg

SEQ ID NO: 9080527 - DNA, 22 bp, Homo sapiens
agagaggctgctggactatatg

SEQ ID NO: 9080528 - DNA, 22 bp, Homo sapiens
agagaggcattcggtgatccca

SEQ ID NO: 9080529 - DNA, 22 bp, Homo sapiens
agagaggcattcggtgatccca

SEQ ID NO: 9080530 - DNA, 22 bp, Homo sapiens
agagagcttccattctagtgat

SEQ ID NO: 9080531 - DNA, 22 bp, Homo sapiens
agagaggatttgtttttctcct

SEQ ID NO: 9080532 - DNA, 22 bp, Homo sapiens
agagagcccgggccagggcaca

SEQ ID NO: 9080533 - DNA, 22 bp, Homo sapiens
agagagcccgggccagggcaca

SEQ ID NO: 9080534 - DNA, 22 bp, Homo sapiens
agagagcctgagtggcagctat

SEQ ID NO: 9080535 - DNA, 22 bp, Homo sapiens
agagagctctggctgggtgacc

SEQ ID NO: 9080536 - DNA, 22 bp, Homo sapiens
agagagctgactttggagtcag

SEQ ID NO: 9080537 - DNA, 21 bp, Homo sapiens
agagagggagatgaaacatcc

SEQ ID NO: 9080538 - DNA, 22 bp, Homo sapiens
agagagggcatagaaaaaggga

SEQ ID NO: 9080539 - DNA, 21 bp, Homo sapiens
agagagggagatgaaacatcc

SEQ ID NO: 9080540 - DNA, 22 bp, Homo sapiens
agagaggttggctaggatgttt

SEQ ID NO: 9080541 - DNA, 22 bp, Homo sapiens
agagaggttaaggagctcttgt

SEQ ID NO: 9080542 - DNA, 19 bp, Homo sapiens
agagaggctgtgtgaggga

SEQ ID NO: 9080543 - DNA, 22 bp, Homo sapiens
agagagggaatatttggggtat

SEQ ID NO: 9080544 - DNA, 22 bp, Homo sapiens
agagaggctgggcgtagggctt

SEQ ID NO: 9080545 - DNA, 22 bp, Homo sapiens
agagaggctgggcgtagggctt

SEQ ID NO: 9080546 - DNA, 22 bp, Homo sapiens
agactttagggccatggtaggt

SEQ ID NO: 9080547 - DNA, 18 bp, Homo sapiens
agactttgagttagaggg

SEQ ID NO: 9080548 - DNA, 19 bp, Homo sapiens
agacttgtcaaattatagt

SEQ ID NO: 9080549 - DNA, 22 bp, Homo sapiens
agacttcactcccagagattct

SEQ ID NO: 9080550 - DNA, 22 bp, Homo sapiens
agacttctctccttgacttgca

SEQ ID NO: 9080551 - DNA, 22 bp, Homo sapiens
agacttctctaacttgaggacc

SEQ ID NO: 9080552 - DNA, 21 bp, Homo sapiens
agacttctagaagtgagatag

SEQ ID NO: 9080553 - DNA, 22 bp, Homo sapiens
agactgtgagaagatggctgcg

SEQ ID NO: 9080554 - DNA, 22 bp, Homo sapiens
agactgtactttctgcagctct

SEQ ID NO: 9080555 - DNA, 22 bp, Homo sapiens
agagaatctgggaagatgttaa

SEQ ID NO: 9080556 - DNA, 22 bp, Homo sapiens
agagaatctgggaagatgttaa

SEQ ID NO: 9080557 - DNA, 22 bp, Homo sapiens
agagaatgcagggcttcggaca

SEQ ID NO: 9080558 - DNA, 22 bp, Homo sapiens
agagaatctagaatgtttatac

SEQ ID NO: 9080559 - DNA, 22 bp, Homo sapiens
agagaatcctctacatgttttt

SEQ ID NO: 9080560 - DNA, 22 bp, Homo sapiens
agagaatctagaatgtttatac

SEQ ID NO: 9080561 - DNA, 22 bp, Homo sapiens
agagaatacagggtaacaggaa

SEQ ID NO: 9080562 - DNA, 22 bp, Homo sapiens
agagaatccccagacagagtta

SEQ ID NO: 9080563 - DNA, 23 bp, Homo sapiens
agagaatcatggaaactctttct

SEQ ID NO: 9080564 - DNA, 23 bp, Homo sapiens
agagaatcatggaaactctttct

SEQ ID NO: 9080565 - DNA, 22 bp, Homo sapiens
agagaatacaaagaagatatgt

SEQ ID NO: 9080566 - DNA, 22 bp, Homo sapiens
agagaagggtgtagcctgggcc

SEQ ID NO: 9080567 - DNA, 22 bp, Homo sapiens
agagaagggtgtagcctgggcc

SEQ ID NO: 9080568 - DNA, 22 bp, Homo sapiens
agagaagggtgtagcctgggcc

SEQ ID NO: 9080569 - DNA, 22 bp, Homo sapiens
agagaaaactcattgaggtgtc

SEQ ID NO: 9080570 - DNA, 23 bp, Homo sapiens
agagaaaaatatctgggcacatt

SEQ ID NO: 9080571 - DNA, 18 bp, Homo sapiens
agactttgagttagaggg

SEQ ID NO: 9080572 - DNA, 22 bp, Homo sapiens
agactttgagctcttagagaag

SEQ ID NO: 9080573 - DNA, 21 bp, Homo sapiens
agactttgcttgcagagagtc

SEQ ID NO: 9080574 - DNA, 19 bp, Homo sapiens
agacttttgtaagttgaga

SEQ ID NO: 9080575 - DNA, 22 bp, Homo sapiens
agagaaaagagttcaggctttg

SEQ ID NO: 9080576 - DNA, 22 bp, Homo sapiens
agagaaaagagttcaggctttg

SEQ ID NO: 9080577 - DNA, 22 bp, Homo sapiens
agagaagggtagcccattctcc

SEQ ID NO: 9080578 - DNA, 22 bp, Homo sapiens
agacctggatgtgagggaagta

SEQ ID NO: 9080579 - DNA, 22 bp, Homo sapiens
agacctgggttcgagtcctaac

SEQ ID NO: 9080580 - DNA, 22 bp, Homo sapiens
agacctgggtgccctgtgcttt

SEQ ID NO: 9080581 - DNA, 22 bp, Homo sapiens
agacctttgctgcttcttatag

SEQ ID NO: 9080582 - DNA, 22 bp, Homo sapiens
agacctggtgatagctgtccta

SEQ ID NO: 9080583 - DNA, 22 bp, Homo sapiens
agactggggttctggcaaggag

SEQ ID NO: 9080584 - DNA, 22 bp, Homo sapiens
agactgggtttgagacttagca

SEQ ID NO: 9080585 - DNA, 22 bp, Homo sapiens
agactggtttttaacttcacct

SEQ ID NO: 9080586 - DNA, 22 bp, Homo sapiens
agacgagggcccccaggacagc

SEQ ID NO: 9080587 - DNA, 22 bp, Homo sapiens
atgcctgtaatcccagcacttt

SEQ ID NO: 9080588 - DNA, 22 bp, Homo sapiens
atgcctgtaatcccagtgcttt

SEQ ID NO: 9080589 - DNA, 22 bp, Homo sapiens
atgcctgtaatcccagtgcttt

SEQ ID NO: 9080590 - DNA, 22 bp, Homo sapiens
atgcctgtaattccagcatttt

SEQ ID NO: 9080591 - DNA, 22 bp, Homo sapiens
atgcatattttctgttggtgac

SEQ ID NO: 9080592 - DNA, 22 bp, Homo sapiens
atgcatattttctactatatcg

SEQ ID NO: 9080593 - DNA, 22 bp, Homo sapiens
atgcatcaccgagttgcccacc

SEQ ID NO: 9080594 - DNA, 22 bp, Homo sapiens
atgcatcaggcactaggaatag

SEQ ID NO: 9080595 - DNA, 22 bp, Homo sapiens
atgcatttgtaaaatataatcg

SEQ ID NO: 9080596 - DNA, 22 bp, Homo sapiens
atgcatttttgagtatgaatga

SEQ ID NO: 9080597 - DNA, 22 bp, Homo sapiens
atgcatttttgagtatgaatga

SEQ ID NO: 9080598 - DNA, 22 bp, Homo sapiens
atgccaaattctactttcagca

SEQ ID NO: 9080599 - DNA, 22 bp, Homo sapiens
atgccaaattctactttcagca

SEQ ID NO: 9080600 - DNA, 22 bp, Homo sapiens
atgccaaagcccaagttcatca

SEQ ID NO: 9080601 - DNA, 22 bp, Homo sapiens
atgccaaagcccaagttcatca

SEQ ID NO: 9080602 - DNA, 22 bp, Homo sapiens
atgccaaagatgtttgatagaa

SEQ ID NO: 9080603 - DNA, 22 bp, Homo sapiens
atgccaaagcccaagttcatca

SEQ ID NO: 9080604 - DNA, 22 bp, Homo sapiens
atgcatattcttagcccctcct

SEQ ID NO: 9080605 - DNA, 22 bp, Homo sapiens
atgcatattggattagcagcca

SEQ ID NO: 9080606 - DNA, 22 bp, Homo sapiens
atgcatattgtcatttagtcct

SEQ ID NO: 9080607 - DNA, 22 bp, Homo sapiens
atgcatattgattatagattca

SEQ ID NO: 9080608 - DNA, 22 bp, Homo sapiens
atgcatattggattagcagcca

SEQ ID NO: 9080609 - DNA, 22 bp, Homo sapiens
atgcatatgtgtgcacacgtgt

SEQ ID NO: 9080610 - DNA, 22 bp, Homo sapiens
atgcatatgtacttgcatatgt

SEQ ID NO: 9080611 - DNA, 22 bp, Homo sapiens
atgcatatgtacttgcatatgt

SEQ ID NO: 9080612 - DNA, 22 bp, Homo sapiens
atgcatatgtacccatgttctg

SEQ ID NO: 9080613 - DNA, 22 bp, Homo sapiens
atgcatatgtacccatgttctg

SEQ ID NO: 9080614 - DNA, 22 bp, Homo sapiens
atgcatattttctactatatcg

SEQ ID NO: 9080615 - DNA, 21 bp, Homo sapiens
atgcatattttaagttgtgtc

SEQ ID NO: 9080616 - DNA, 18 bp, Homo sapiens
atgcatattttaagttgt

SEQ ID NO: 9080617 - DNA, 22 bp, Homo sapiens
atgcatatttcttgggcttacc

SEQ ID NO: 9080618 - DNA, 22 bp, Homo sapiens
atgcatatttcttggagcacct

SEQ ID NO: 9080619 - DNA, 22 bp, Homo sapiens
atgcatatttcatgaatctttg

SEQ ID NO: 9080620 - DNA, 22 bp, Homo sapiens
atgcatattgtcatttagtcct

SEQ ID NO: 9080621 - DNA, 22 bp, Homo sapiens
atgcatattgtcatttagtcct

SEQ ID NO: 9080622 - DNA, 20 bp, Homo sapiens
agacagaatcagagataaag

SEQ ID NO: 9080623 - DNA, 22 bp, Homo sapiens
agacagaatttgtcagataaat

SEQ ID NO: 9080624 - DNA, 22 bp, Homo sapiens
atgatacatcttgtttatttca

SEQ ID NO: 9080625 - DNA, 22 bp, Homo sapiens
atgcatatggcttgagggaata

SEQ ID NO: 9080626 - DNA, 22 bp, Homo sapiens
agacaacatctagtttggtgga

SEQ ID NO: 9080627 - DNA, 22 bp, Homo sapiens
agacaactagaaaactagacag

SEQ ID NO: 9080628 - DNA, 22 bp, Homo sapiens
agacaacaccaaatgctagtgt

SEQ ID NO: 9080629 - DNA, 22 bp, Homo sapiens
agacaacaccaaatgctagtgt

SEQ ID NO: 9080630 - DNA, 22 bp, Homo sapiens
agacaaatttcctgcaatgaag

SEQ ID NO: 9080631 - DNA, 22 bp, Homo sapiens
agacaactgcagagcaaagaat

SEQ ID NO: 9080632 - DNA, 22 bp, Homo sapiens
agacaagactaggcagttgttg

SEQ ID NO: 9080633 - DNA, 22 bp, Homo sapiens
agacaagagctgaggacatatt

SEQ ID NO: 9080634 - DNA, 21 bp, Homo sapiens
agacagaacaactgctctcca

SEQ ID NO: 9080635 - DNA, 21 bp, Homo sapiens
agacagaacaactgctctcca

SEQ ID NO: 9080636 - DNA, 22 bp, Homo sapiens
agacactgttctcacatgcttg

SEQ ID NO: 9080637 - DNA, 22 bp, Homo sapiens
agacaagtgtttctgggtaact

SEQ ID NO: 9080638 - DNA, 22 bp, Homo sapiens
agacaagtgtggtgagagcagt

SEQ ID NO: 9080639 - DNA, 22 bp, Homo sapiens
agacaagtaggaatggttgaag

SEQ ID NO: 9080640 - DNA, 22 bp, Homo sapiens
agacaagttctgtgggtcacct

SEQ ID NO: 9080641 - DNA, 23 bp, Homo sapiens
agacactgtaaagaattgcagtt

SEQ ID NO: 9080642 - DNA, 22 bp, Homo sapiens
agaatcaattagattctatgag

SEQ ID NO: 9080643 - DNA, 22 bp, Homo sapiens
agaatcaaggtgaagcccacag

SEQ ID NO: 9080644 - DNA, 22 bp, Homo sapiens
agaatcaactgaaaattggtga

SEQ ID NO: 9080645 - DNA, 22 bp, Homo sapiens
agaatcaactgaaaattggtga

SEQ ID NO: 9080646 - DNA, 22 bp, Homo sapiens
agaatattgaaagttcttgaca

SEQ ID NO: 9080647 - DNA, 22 bp, Homo sapiens
agaatcaaagagaaatactttg

SEQ ID NO: 9080648 - DNA, 22 bp, Homo sapiens
agaatcaaagagaaatactttg

SEQ ID NO: 9080649 - DNA, 22 bp, Homo sapiens
atgagggaggcaaggagatgct

SEQ ID NO: 9080650 - DNA, 22 bp, Homo sapiens
atgaggctctcaggggagctgt

SEQ ID NO: 9080651 - DNA, 22 bp, Homo sapiens
atgaggctatttcatagatttt

SEQ ID NO: 9080652 - DNA, 22 bp, Homo sapiens
atgaggcctatcttggcagagg

SEQ ID NO: 9080653 - DNA, 19 bp, Homo sapiens
atgaagcattgtttttgta

SEQ ID NO: 9080654 - DNA, 22 bp, Homo sapiens
atgaagcattacaggatgacag

SEQ ID NO: 9080655 - DNA, 22 bp, Homo sapiens
atgaagccagaagaagactggc

SEQ ID NO: 9080656 - DNA, 22 bp, Homo sapiens
atgaagccatctcctccccttc

SEQ ID NO: 9080657 - DNA, 19 bp, Homo sapiens
atgaagccccagggcccgt

SEQ ID NO: 9080658 - DNA, 22 bp, Homo sapiens
atctgcttgaaacttcttatac

SEQ ID NO: 9080659 - DNA, 22 bp, Homo sapiens
atctgcttcctgggctccatga

SEQ ID NO: 9080660 - DNA, 19 bp, Homo sapiens
atctgcctgttatcacata

SEQ ID NO: 9080661 - DNA, 19 bp, Homo sapiens
atctgcctgttatcacata

SEQ ID NO: 9080662 - DNA, 19 bp, Homo sapiens
atctgccttagtgctgctg

SEQ ID NO: 9080663 - DNA, 22 bp, Homo sapiens
atctgcctgtatttaccatcat

SEQ ID NO: 9080664 - DNA, 22 bp, Homo sapiens
atctgcctggtctttgatgcag

SEQ ID NO: 9080665 - DNA, 22 bp, Homo sapiens
atctgcctgcttatgatgcctg

SEQ ID NO: 9080666 - DNA, 22 bp, Homo sapiens
atctgcctgagtctaggttttc

SEQ ID NO: 9080667 - DNA, 22 bp, Homo sapiens
atctgcctggctccaggtgagc

SEQ ID NO: 9080668 - DNA, 22 bp, Homo sapiens
atctgcctggctccaggtgagc

SEQ ID NO: 9080669 - DNA, 22 bp, Homo sapiens
atctgcctccaagtccatgtgt

SEQ ID NO: 9080670 - DNA, 22 bp, Homo sapiens
atctgcctgcagtggaggtggg

SEQ ID NO: 9080671 - DNA, 22 bp, Homo sapiens
atctgcctgcagtggaggtggg

SEQ ID NO: 9080672 - DNA, 22 bp, Homo sapiens
atctgcctcttcttcattgcga

SEQ ID NO: 9080673 - DNA, 22 bp, Homo sapiens
atctgcctgagtctaggttttc

SEQ ID NO: 9080674 - DNA, 22 bp, Homo sapiens
agaatatgaggaaactgtgaat

SEQ ID NO: 9080675 - DNA, 22 bp, Homo sapiens
agaatattcatctgtattctta

SEQ ID NO: 9080676 - DNA, 22 bp, Homo sapiens
agaatatgccttagcaagccca

SEQ ID NO: 9080677 - DNA, 22 bp, Homo sapiens
agaatatgattcagaccattag

SEQ ID NO: 9080678 - DNA, 22 bp, Homo sapiens
agaatatgatcggaatacagat

SEQ ID NO: 9080679 - DNA, 22 bp, Homo sapiens
agaatatgatggttggagaatt

SEQ ID NO: 9080680 - DNA, 22 bp, Homo sapiens
agaatatagttaccaaattctg

SEQ ID NO: 9080681 - DNA, 22 bp, Homo sapiens
atgaagttctagtgagaaatgc

SEQ ID NO: 9080682 - DNA, 22 bp, Homo sapiens
atgaagttctcaataatcatgt

SEQ ID NO: 9080683 - DNA, 22 bp, Homo sapiens
atgaaggccaggcttcagtgtg

SEQ ID NO: 9080684 - DNA, 22 bp, Homo sapiens
atgaagttccagtatatgcagt

SEQ ID NO: 9080685 - DNA, 22 bp, Homo sapiens
atgaaggccaggcttcagtgtg

SEQ ID NO: 9080686 - DNA, 21 bp, Homo sapiens
atgaaggcagtgccaagggct

SEQ ID NO: 9080687 - DNA, 19 bp, Homo sapiens
atgaaggcactgagtggga

SEQ ID NO: 9080688 - DNA, 21 bp, Homo sapiens
atgaaggcagtgccaagggct

SEQ ID NO: 9080689 - DNA, 22 bp, Homo sapiens
atgaagctgaccttgtcttgct

SEQ ID NO: 9080690 - DNA, 22 bp, Homo sapiens
atgaagctgtttattttagcag

SEQ ID NO: 9080691 - DNA, 22 bp, Homo sapiens
atgaagcttgaggtgagagctg

SEQ ID NO: 9080692 - DNA, 19 bp, Homo sapiens
atgaaggcactgagtggga

SEQ ID NO: 9080693 - DNA, 22 bp, Homo sapiens
atgaaggatggctggctgccct

SEQ ID NO: 9080694 - DNA, 22 bp, Homo sapiens
atgaaggcaagactgaggtgtg

SEQ ID NO: 9080695 - DNA, 22 bp, Homo sapiens
atgaaggatggctggctgccct

SEQ ID NO: 9080696 - DNA, 22 bp, Homo sapiens
atgaaggcaagactgaggtgtg

SEQ ID NO: 9080697 - DNA, 22 bp, Homo sapiens
agaagccaagaacagacagtgc

SEQ ID NO: 9080698 - DNA, 22 bp, Homo sapiens
atctctttgatggctcctgtga

SEQ ID NO: 9080699 - DNA, 22 bp, Homo sapiens
agaagccaacagggcaggagag

SEQ ID NO: 9080700 - DNA, 22 bp, Homo sapiens
agaagccaacagggcaggagag

SEQ ID NO: 9080701 - DNA, 22 bp, Homo sapiens
agaagccaagaacagacagtgc

SEQ ID NO: 9080702 - DNA, 22 bp, Homo sapiens
agaagccaattctgtgtgagtc

SEQ ID NO: 9080703 - DNA, 22 bp, Homo sapiens
agaagccacaggaaagcagctt

SEQ ID NO: 9080704 - DNA, 22 bp, Homo sapiens
agaagccacaggaaagcagctt

SEQ ID NO: 9080705 - DNA, 22 bp, Homo sapiens
agaagccaagaacagacagtgc

SEQ ID NO: 9080706 - DNA, 22 bp, Homo sapiens
atctctttgatggctcctgtga

SEQ ID NO: 9080707 - DNA, 22 bp, Homo sapiens
atctctgtgccatcattgcccc

SEQ ID NO: 9080708 - DNA, 22 bp, Homo sapiens
atctctggccttccttttccaa

SEQ ID NO: 9080709 - DNA, 22 bp, Homo sapiens
atctctgggctttgagtttgtt

SEQ ID NO: 9080710 - DNA, 22 bp, Homo sapiens
atctctggcccctggggtccga

SEQ ID NO: 9080711 - DNA, 22 bp, Homo sapiens
atctctgggtccatagaagaga

SEQ ID NO: 9080712 - DNA, 22 bp, Homo sapiens
atctctggttgttttgctccca

SEQ ID NO: 9080713 - DNA, 22 bp, Homo sapiens
atctctggtccaaatgttacct

SEQ ID NO: 9080714 - DNA, 22 bp, Homo sapiens
agaaggagtgtacaggtcatgc

SEQ ID NO: 9080715 - DNA, 21 bp, Homo sapiens
agaaggcaaaagcagacatct

SEQ ID NO: 9080716 - DNA, 21 bp, Homo sapiens
agaaggcaaaagcagacatct

SEQ ID NO: 9080717 - DNA, 22 bp, Homo sapiens
agaaggcacagtgctgctaaga

SEQ ID NO: 9080718 - DNA, 21 bp, Homo sapiens
agaaggcaaaagcagacatct

SEQ ID NO: 9080719 - DNA, 21 bp, Homo sapiens
agaaggcaccagcaaggactg

SEQ ID NO: 9080720 - DNA, 22 bp, Homo sapiens
agaaggcaccgtggccaatatt

SEQ ID NO: 9080721 - DNA, 22 bp, Homo sapiens
agaaggcacagtgctgctaaga

SEQ ID NO: 9080722 - DNA, 22 bp, Homo sapiens
agaaggcacagtgctgctaaga

SEQ ID NO: 9080723 - DNA, 22 bp, Homo sapiens
agaaggagtgtacaggtcatgc

SEQ ID NO: 9080724 - DNA, 22 bp, Homo sapiens
agaaggagtgtacaggtcatgc

SEQ ID NO: 9080725 - DNA, 22 bp, Homo sapiens
agaaggagtgtacaggtcatgc

SEQ ID NO: 9080726 - DNA, 22 bp, Homo sapiens
agaaggcagaaagtccaggtat

SEQ ID NO: 9080727 - DNA, 22 bp, Homo sapiens
agaaggcagatgggacggagca

SEQ ID NO: 9080728 - DNA, 22 bp, Homo sapiens
agaaggcagatgggacggagca

SEQ ID NO: 9080729 - DNA, 22 bp, Homo sapiens
agaaggcagatgggacggagca

SEQ ID NO: 9080730 - DNA, 22 bp, Homo sapiens
agaaggcagatgggacggagca

SEQ ID NO: 9080731 - DNA, 22 bp, Homo sapiens
agaaggcagaaagtccaggtat

SEQ ID NO: 9080732 - DNA, 22 bp, Homo sapiens
agaaggcagaaagtccaggtat

SEQ ID NO: 9080733 - DNA, 22 bp, Homo sapiens
agaaggcagaaagtccaggtat

SEQ ID NO: 9080734 - DNA, 22 bp, Homo sapiens
agaaggcactcacactggcacg

SEQ ID NO: 9080735 - DNA, 22 bp, Homo sapiens
agaaggcactcacactggcacg

SEQ ID NO: 9080736 - DNA, 22 bp, Homo sapiens
agaaggcactcacactggcacg

SEQ ID NO: 9080737 - DNA, 22 bp, Homo sapiens
agaaggcaccgtggccaatatt

SEQ ID NO: 9080738 - DNA, 20 bp, Homo sapiens
agaaggcaggagacaaaagg

SEQ ID NO: 9080739 - DNA, 20 bp, Homo sapiens
agaaggcaggagacaaaagg

SEQ ID NO: 9080740 - DNA, 22 bp, Homo sapiens
agaaggcaggttttaaaatgtc

SEQ ID NO: 9080741 - DNA, 22 bp, Homo sapiens
agaaggcaggttttaaaatgtc

SEQ ID NO: 9080742 - DNA, 22 bp, Homo sapiens
agaaggcaggttttaaaatgtc

SEQ ID NO: 9080743 - DNA, 22 bp, Homo sapiens
agaaggcatagaccggattatg

SEQ ID NO: 9080744 - DNA, 22 bp, Homo sapiens
agaaggcatcagaagtgtgtag

SEQ ID NO: 9080745 - DNA, 22 bp, Homo sapiens
agaaggcatcagaagtgtgtag

SEQ ID NO: 9080746 - DNA, 22 bp, Homo sapiens
agaacatttgtcgatcaatttg

SEQ ID NO: 9080747 - DNA, 22 bp, Homo sapiens
agaacatggattgtcaaaggta

SEQ ID NO: 9080748 - DNA, 22 bp, Homo sapiens
agaacatctgaagatacaaagt

SEQ ID NO: 9080749 - DNA, 22 bp, Homo sapiens
atctcagggctggagccctgga

SEQ ID NO: 9080750 - DNA, 22 bp, Homo sapiens
atctctggcaatgcagcatcgt

SEQ ID NO: 9080751 - DNA, 22 bp, Homo sapiens
agaacagtcgtggtgagagaaa

SEQ ID NO: 9080752 - DNA, 22 bp, Homo sapiens
atccccagaaaataggtgccta

SEQ ID NO: 9080753 - DNA, 22 bp, Homo sapiens
atccccactgctgctggtgtag

SEQ ID NO: 9080754 - DNA, 22 bp, Homo sapiens
atccccagaaaataggtgccta

SEQ ID NO: 9080755 - DNA, 22 bp, Homo sapiens
agaacatatctgttttctaact

SEQ ID NO: 9080756 - DNA, 22 bp, Homo sapiens
agaacatctaaatatctgagac

SEQ ID NO: 9080757 - DNA, 22 bp, Homo sapiens
agaacatagtggactttggcaa

SEQ ID NO: 9080758 - DNA, 22 bp, Homo sapiens
agaacatatctgttttctaact

SEQ ID NO: 9080759 - DNA, 22 bp, Homo sapiens
agaacatagatacctaagacag

SEQ ID NO: 9080760 - DNA, 22 bp, Homo sapiens
agaacatagtggactttggcaa

SEQ ID NO: 9080761 - DNA, 22 bp, Homo sapiens
agaacagtgctgataaatcata

SEQ ID NO: 9080762 - DNA, 22 bp, Homo sapiens
agaacataattatcataaactg

SEQ ID NO: 9080763 - DNA, 22 bp, Homo sapiens
atcccacacccctacaacatat

SEQ ID NO: 9080764 - DNA, 22 bp, Homo sapiens
atcccacctcaatctgaagctc

SEQ ID NO: 9080765 - DNA, 19 bp, Homo sapiens
atcccaaggagctgggact

SEQ ID NO: 9080766 - DNA, 18 bp, Homo sapiens
atcccaaaagacaaggaa

SEQ ID NO: 9080767 - DNA, 22 bp, Homo sapiens
atccatttttgcaaagttgttc

SEQ ID NO: 9080768 - DNA, 21 bp, Homo sapiens
atcccagcacccaggagtgca

SEQ ID NO: 9080769 - DNA, 21 bp, Homo sapiens
atcccagcacccaggagtgca

SEQ ID NO: 9080770 - DNA, 19 bp, Homo sapiens
agaaatctcgagatttgtt

SEQ ID NO: 9080771 - DNA, 22 bp, Homo sapiens
agaaatctctagcacatcgaat

SEQ ID NO: 9080772 - DNA, 22 bp, Homo sapiens
agaaatctatgttttggttaga

SEQ ID NO: 9080773 - DNA, 22 bp, Homo sapiens
agaaatcttatcaagaaatgcc

SEQ ID NO: 9080774 - DNA, 21 bp, Homo sapiens
atcagtaaggttggaggaaga

SEQ ID NO: 9080775 - DNA, 22 bp, Homo sapiens
atcagtcttttaatgatacctt

SEQ ID NO: 9080776 - DNA, 22 bp, Homo sapiens
agaaatcaggaacagtaaggag

SEQ ID NO: 9080777 - DNA, 22 bp, Homo sapiens
atcagtgtttcaaatgtaatct

SEQ ID NO: 9080778 - DNA, 22 bp, Homo sapiens
agaaatcatgtcttatttctat

SEQ ID NO: 9080779 - DNA, 22 bp, Homo sapiens
agaaatcatgtcttatttctat

SEQ ID NO: 9080780 - DNA, 22 bp, Homo sapiens
agaaagcactctgtcttttacc

SEQ ID NO: 9080781 - DNA, 22 bp, Homo sapiens
agaaagcatctccattgtaggt

SEQ ID NO: 9080782 - DNA, 22 bp, Homo sapiens
agaaagcatctccattgtaggt

SEQ ID NO: 9080783 - DNA, 22 bp, Homo sapiens
atcaggtgggttttgaagaaac

SEQ ID NO: 9080784 - DNA, 22 bp, Homo sapiens
agaaagccttatgtacagaggc

SEQ ID NO: 9080785 - DNA, 22 bp, Homo sapiens
agaaagcaccctgcactttctg

SEQ ID NO: 9080786 - DNA, 22 bp, Homo sapiens
agaaagcacagcgggtccattt

SEQ ID NO: 9080787 - DNA, 22 bp, Homo sapiens
agaaagcacgggccccaggctc

SEQ ID NO: 9080788 - DNA, 22 bp, Homo sapiens
agaaagcactctgtcttttacc

SEQ ID NO: 9080789 - DNA, 22 bp, Homo sapiens
agaaagatccttctggctgcct

SEQ ID NO: 9080790 - DNA, 22 bp, Homo sapiens
atcaaaatgctccagtgatggt

SEQ ID NO: 9080791 - DNA, 22 bp, Homo sapiens
atatttctccaaatgttttcaa

SEQ ID NO: 9080792 - DNA, 22 bp, Homo sapiens
atatttctccaaatgttttcaa

SEQ ID NO: 9080793 - DNA, 22 bp, Homo sapiens
atatttctccaaatgttttcaa

SEQ ID NO: 9080794 - DNA, 22 bp, Homo sapiens
agaaaaagtcaaggaattggac

SEQ ID NO: 9080795 - DNA, 21 bp, Homo sapiens
agaaaaaccagcatgttttca

SEQ ID NO: 9080796 - DNA, 22 bp, Homo sapiens
atatttttccatgtgggactct

SEQ ID NO: 9080797 - DNA, 22 bp, Homo sapiens
atatttttccatgtgggactct

SEQ ID NO: 9080798 - DNA, 22 bp, Homo sapiens
atattttgtaacttggaatagg

SEQ ID NO: 9080799 - DNA, 22 bp, Homo sapiens
atattttgtaacttggaatagg

SEQ ID NO: 9080800 - DNA, 22 bp, Homo sapiens
atattttggtagctctcaatga

SEQ ID NO: 9080801 - DNA, 21 bp, Homo sapiens
atatttttgtttggactgtca

SEQ ID NO: 9080802 - DNA, 21 bp, Homo sapiens
atatttttgtttggactgtca

SEQ ID NO: 9080803 - DNA, 21 bp, Homo sapiens
agaaaaacacgatataagccc

SEQ ID NO: 9080804 - DNA, 22 bp, Homo sapiens
actttttgcatagtaagtgtct

SEQ ID NO: 9080805 - DNA, 22 bp, Homo sapiens
actttttacagggtgtatacca

SEQ ID NO: 9080806 - DNA, 22 bp, Homo sapiens
actttttacagggtgtatacca

SEQ ID NO: 9080807 - DNA, 22 bp, Homo sapiens
acttttttataaggaagaagat

SEQ ID NO: 9080808 - DNA, 22 bp, Homo sapiens
actttttgctggtctcttccat

SEQ ID NO: 9080809 - DNA, 23 bp, Homo sapiens
acttttcaattagctatgcttaa

SEQ ID NO: 9080810 - DNA, 22 bp, Homo sapiens
actttttacagggtgtatacca

SEQ ID NO: 9080811 - DNA, 22 bp, Homo sapiens
acttttggttctgtaactgtga

SEQ ID NO: 9080812 - DNA, 22 bp, Homo sapiens
acttttgaagaattatgcaaaa

SEQ ID NO: 9080813 - DNA, 22 bp, Homo sapiens
ataaagtttaaaagtcaatagt

SEQ ID NO: 9080814 - DNA, 19 bp, Homo sapiens
ataaataaaaagtgggaga

SEQ ID NO: 9080815 - DNA, 22 bp, Homo sapiens
ataaagtggaggtagtattcat

SEQ ID NO: 9080816 - DNA, 22 bp, Homo sapiens
ataaagtttaaaagtcaatagt

SEQ ID NO: 9080817 - DNA, 19 bp, Homo sapiens
ataaataaaaagtgggaga

SEQ ID NO: 9080818 - DNA, 22 bp, Homo sapiens
acttccagcacctcaagcggaa

SEQ ID NO: 9080819 - DNA, 22 bp, Homo sapiens
acttcctgggcatgcagagtcc

SEQ ID NO: 9080820 - DNA, 22 bp, Homo sapiens
acttcctgttatgtgtgcctct

SEQ ID NO: 9080821 - DNA, 22 bp, Homo sapiens
acttcctgtgttggtcttgctg

SEQ ID NO: 9080822 - DNA, 22 bp, Homo sapiens
acttccttttcaaccatacagc

SEQ ID NO: 9080823 - DNA, 22 bp, Homo sapiens
acttccttgtcaggtgcatcat

SEQ ID NO: 9080824 - DNA, 22 bp, Homo sapiens
acttctaatcagaaggtctggt

SEQ ID NO: 9080825 - DNA, 22 bp, Homo sapiens
acttaaaaacagatccagcagg

SEQ ID NO: 9080826 - DNA, 22 bp, Homo sapiens
acttaaaaagaatcttttcacg

SEQ ID NO: 9080827 - DNA, 22 bp, Homo sapiens
actgttttctgtaaagggccag

SEQ ID NO: 9080828 - DNA, 22 bp, Homo sapiens
actgtttagtaaattgaaatgg

SEQ ID NO: 9080829 - DNA, 22 bp, Homo sapiens
actgtttatgatgatagagggg

SEQ ID NO: 9080830 - DNA, 22 bp, Homo sapiens
acttaaaaccagacagcgtcat

SEQ ID NO: 9080831 - DNA, 22 bp, Homo sapiens
acttaaaggttagctattctac

SEQ ID NO: 9080832 - DNA, 18 bp, Homo sapiens
ataaagtgctaataatgg

SEQ ID NO: 9080833 - DNA, 22 bp, Homo sapiens
agtttttgagaatttactatgt

SEQ ID NO: 9080834 - DNA, 22 bp, Homo sapiens
agtttttctgggaggcactgct

SEQ ID NO: 9080835 - DNA, 23 bp, Homo sapiens
agtttttctgcatggttctgtat

SEQ ID NO: 9080836 - DNA, 22 bp, Homo sapiens
agtttttctgctggtctcacta

SEQ ID NO: 9080837 - DNA, 22 bp, Homo sapiens
agtttttctcccctggcttcat

SEQ ID NO: 9080838 - DNA, 22 bp, Homo sapiens
actgtttaaaggcttcctttct

SEQ ID NO: 9080839 - DNA, 22 bp, Homo sapiens
agttttatggctcaacctaata

SEQ ID NO: 9080840 - DNA, 22 bp, Homo sapiens
agttttatgtagacaattcatt

SEQ ID NO: 9080841 - DNA, 22 bp, Homo sapiens
agttttatgtagacaattcatt

SEQ ID NO: 9080842 - DNA, 18 bp, Homo sapiens
agtttttaggaagaaatg

SEQ ID NO: 9080843 - DNA, 18 bp, Homo sapiens
agtttttaggaagaaatg

SEQ ID NO: 9080844 - DNA, 22 bp, Homo sapiens
agtttttcctgattttacagaa

SEQ ID NO: 9080845 - DNA, 22 bp, Homo sapiens
agtttttccgtggctacgataa

SEQ ID NO: 9080846 - DNA, 22 bp, Homo sapiens
actgggccttgccatggcagcc

SEQ ID NO: 9080847 - DNA, 22 bp, Homo sapiens
actgggccttgtgtgtctcatc

SEQ ID NO: 9080848 - DNA, 22 bp, Homo sapiens
actgggctaccccaccattacc

SEQ ID NO: 9080849 - DNA, 22 bp, Homo sapiens
actgggctagagtggaagctgg

SEQ ID NO: 9080850 - DNA, 22 bp, Homo sapiens
actgggctagagtggaagctgg

SEQ ID NO: 9080851 - DNA, 22 bp, Homo sapiens
actgggctcaagtgattgtcct

SEQ ID NO: 9080852 - DNA, 21 bp, Homo sapiens
actgggctagcctgacttctg

SEQ ID NO: 9080853 - DNA, 22 bp, Homo sapiens
actgggctcataatgtcataga

SEQ ID NO: 9080854 - DNA, 22 bp, Homo sapiens
actgggctccaaggacctggag

SEQ ID NO: 9080855 - DNA, 22 bp, Homo sapiens
actgggctccagatgtgatacg

SEQ ID NO: 9080856 - DNA, 22 bp, Homo sapiens
actgggctcccaggcttgtcat

SEQ ID NO: 9080857 - DNA, 22 bp, Homo sapiens
agtttctagcaaggattgttga

SEQ ID NO: 9080858 - DNA, 22 bp, Homo sapiens
agttttataaaggcacctcagt

SEQ ID NO: 9080859 - DNA, 22 bp, Homo sapiens
agttttatatcttccattggtt

SEQ ID NO: 9080860 - DNA, 22 bp, Homo sapiens
agttttatgcagtgttctgata

SEQ ID NO: 9080861 - DNA, 22 bp, Homo sapiens
agttttatgcagtgttctgata

SEQ ID NO: 9080862 - DNA, 22 bp, Homo sapiens
agttttatctgtaagctgttca

SEQ ID NO: 9080863 - DNA, 21 bp, Homo sapiens
agttttatattataagctaaa

SEQ ID NO: 9080864 - DNA, 22 bp, Homo sapiens
atacatcatttatggaataagg

SEQ ID NO: 9080865 - DNA, 22 bp, Homo sapiens
atacatcatgctccatatattt

SEQ ID NO: 9080866 - DNA, 22 bp, Homo sapiens
atacatcatgctccatatattt

SEQ ID NO: 9080867 - DNA, 22 bp, Homo sapiens
actttgcaaaataatgctgatt

SEQ ID NO: 9080868 - DNA, 22 bp, Homo sapiens
actttgcactaagttactcatt

SEQ ID NO: 9080869 - DNA, 22 bp, Homo sapiens
actttgcaatgggcagaaccca

SEQ ID NO: 9080870 - DNA, 22 bp, Homo sapiens
actttgcacttcaatataactt

SEQ ID NO: 9080871 - DNA, 22 bp, Homo sapiens
actttgcacttcaatataactt

SEQ ID NO: 9080872 - DNA, 22 bp, Homo sapiens
actttgcactaagttactcatt

SEQ ID NO: 9080873 - DNA, 22 bp, Homo sapiens
actttgcaaggtactaactgta

SEQ ID NO: 9080874 - DNA, 22 bp, Homo sapiens
actttgcaaataaactctctaa

SEQ ID NO: 9080875 - DNA, 22 bp, Homo sapiens
actttgcaaataaactctctaa

SEQ ID NO: 9080876 - DNA, 22 bp, Homo sapiens
actttgcaatacttaatacaaa

SEQ ID NO: 9080877 - DNA, 22 bp, Homo sapiens
actttgcaatacttaatacaaa

SEQ ID NO: 9080878 - DNA, 22 bp, Homo sapiens
actttggaataagctatataac

SEQ ID NO: 9080879 - DNA, 22 bp, Homo sapiens
actttggacaatttattactgt

SEQ ID NO: 9080880 - DNA, 22 bp, Homo sapiens
actttggaagatggctgtattt

SEQ ID NO: 9080881 - DNA, 22 bp, Homo sapiens
actttgcagggcttgatatcca

SEQ ID NO: 9080882 - DNA, 22 bp, Homo sapiens
actttgcaggtacatgagcatc

SEQ ID NO: 9080883 - DNA, 22 bp, Homo sapiens
actttgcagggcttgatatcca

SEQ ID NO: 9080884 - DNA, 22 bp, Homo sapiens
actttgcaggccttttcttgtg

SEQ ID NO: 9080885 - DNA, 22 bp, Homo sapiens
actttgcagagccagaagagaa

SEQ ID NO: 9080886 - DNA, 23 bp, Homo sapiens
actttgcagagccccttgaaaca

SEQ ID NO: 9080887 - DNA, 22 bp, Homo sapiens
actttgcagctgaggacatttc

SEQ ID NO: 9080888 - DNA, 18 bp, Homo sapiens
actttgcaggctcccatt

SEQ ID NO: 9080889 - DNA, 22 bp, Homo sapiens
actttgccccaaagaagttggt

SEQ ID NO: 9080890 - DNA, 21 bp, Homo sapiens
actttgcatctaccttgggtt

SEQ ID NO: 9080891 - DNA, 23 bp, Homo sapiens
actttgcatacccaaattgtttt

SEQ ID NO: 9080892 - DNA, 22 bp, Homo sapiens
actttgcatggaaaatggtcat

SEQ ID NO: 9080893 - DNA, 23 bp, Homo sapiens
actttgcatacccaaattgtttt

SEQ ID NO: 9080894 - DNA, 19 bp, Homo sapiens
actttgcatgtgtgtctaa

SEQ ID NO: 9080895 - DNA, 20 bp, Homo sapiens
actttgcatttcctgatttt

SEQ ID NO: 9080896 - DNA, 20 bp, Homo sapiens
actttgcatttcctgatttt

SEQ ID NO: 9080897 - DNA, 22 bp, Homo sapiens
atagaggcagtgaagctagttg

SEQ ID NO: 9080898 - DNA, 22 bp, Homo sapiens
actttggatctgatgtaatcag

SEQ ID NO: 9080899 - DNA, 22 bp, Homo sapiens
actttggagggtgttgtagatg

SEQ ID NO: 9080900 - DNA, 22 bp, Homo sapiens
actttggacgccatgctgtttg

SEQ ID NO: 9080901 - DNA, 22 bp, Homo sapiens
actttggagggtgttgtagatg

SEQ ID NO: 9080902 - DNA, 17 bp, Homo sapiens
actttggaggcagctgt

SEQ ID NO: 9080903 - DNA, 22 bp, Homo sapiens
actttggacgccatgctgtttg

SEQ ID NO: 9080904 - DNA, 20 bp, Homo sapiens
atagatatcatctttagaag

SEQ ID NO: 9080905 - DNA, 22 bp, Homo sapiens
atacatcacctatatattcaca

SEQ ID NO: 9080906 - DNA, 22 bp, Homo sapiens
atacatcacctatatattcaca

SEQ ID NO: 9080907 - DNA, 22 bp, Homo sapiens
atacatcaatttcttagttatc

SEQ ID NO: 9080908 - DNA, 22 bp, Homo sapiens
atacatcaaggatgatggtgta

SEQ ID NO: 9080909 - DNA, 21 bp, Homo sapiens
actttacaatttacatagtga

SEQ ID NO: 9080910 - DNA, 21 bp, Homo sapiens
actttacaatttacatagtga

SEQ ID NO: 9080911 - DNA, 21 bp, Homo sapiens
actttacaatttacatagtga

SEQ ID NO: 9080912 - DNA, 21 bp, Homo sapiens
actttacaatttacatagtga

SEQ ID NO: 9080913 - DNA, 22 bp, Homo sapiens
actttacaagcttatagcctag

SEQ ID NO: 9080914 - DNA, 22 bp, Homo sapiens
actttacaaactcctcactgtt

SEQ ID NO: 9080915 - DNA, 22 bp, Homo sapiens
actttaaggaggcactcatctc

SEQ ID NO: 9080916 - DNA, 22 bp, Homo sapiens
atacaaaaattagccgggagta

SEQ ID NO: 9080917 - DNA, 22 bp, Homo sapiens
atacaaaaattagccgggagta

SEQ ID NO: 9080918 - DNA, 22 bp, Homo sapiens
atacaaaaattagccgggagta

SEQ ID NO: 9080919 - DNA, 22 bp, Homo sapiens
acttctctcattcagacatagc

SEQ ID NO: 9080920 - DNA, 22 bp, Homo sapiens
acttctctgctacctgcaaaga

SEQ ID NO: 9080921 - DNA, 22 bp, Homo sapiens
acttctctgctacctgcaaaga

SEQ ID NO: 9080922 - DNA, 22 bp, Homo sapiens
acttctcttcataggtggcaat

SEQ ID NO: 9080923 - DNA, 22 bp, Homo sapiens
acttctcttcataggtggcaat

SEQ ID NO: 9080924 - DNA, 22 bp, Homo sapiens
acttctcttcataggtggcaat

SEQ ID NO: 9080925 - DNA, 23 bp, Homo sapiens
atacaaaccttgcaggacatgtt

SEQ ID NO: 9080926 - DNA, 23 bp, Homo sapiens
atacaaaccttgcaggacatgtt

SEQ ID NO: 9080927 - DNA, 22 bp, Homo sapiens
atacaaaatatatactggagac

SEQ ID NO: 9080928 - DNA, 22 bp, Homo sapiens
atacaaaatatatactggagac

SEQ ID NO: 9080929 - DNA, 22 bp, Homo sapiens
atacaaaatatatactggagac

SEQ ID NO: 9080930 - DNA, 22 bp, Homo sapiens
atacaaaatatatactggagac

SEQ ID NO: 9080931 - DNA, 22 bp, Homo sapiens
actgccaatggtagtttgatgg

SEQ ID NO: 9080932 - DNA, 22 bp, Homo sapiens
actgcatttgtctgtctcaatt

SEQ ID NO: 9080933 - DNA, 22 bp, Homo sapiens
actgcatttgtctgtctcaatt

SEQ ID NO: 9080934 - DNA, 22 bp, Homo sapiens
actgccaatggtagtttgatgg

SEQ ID NO: 9080935 - DNA, 22 bp, Homo sapiens
actgccaatggtagtttgatgg

SEQ ID NO: 9080936 - DNA, 23 bp, Homo sapiens
actgccagttttaccacagacgg

SEQ ID NO: 9080937 - DNA, 22 bp, Homo sapiens
actgccattggttctggaaaat

SEQ ID NO: 9080938 - DNA, 22 bp, Homo sapiens
actgcctcttggtgctgagaga

SEQ ID NO: 9080939 - DNA, 22 bp, Homo sapiens
actggcagtttgagaatgcatt

SEQ ID NO: 9080940 - DNA, 22 bp, Homo sapiens
actgcctgctcctggctccaca

SEQ ID NO: 9080941 - DNA, 22 bp, Homo sapiens
actgcctggcagaggtttgcaa

SEQ ID NO: 9080942 - DNA, 22 bp, Homo sapiens
actgcctggcctggcctcactg

SEQ ID NO: 9080943 - DNA, 21 bp, Homo sapiens
actgcctggggtgctggccaa

SEQ ID NO: 9080944 - DNA, 19 bp, Homo sapiens
actgcctgaggctcacagg

SEQ ID NO: 9080945 - DNA, 19 bp, Homo sapiens
actgcctgcaggtgttggg

SEQ ID NO: 9080946 - DNA, 22 bp, Homo sapiens
actgcctgccttccaggtactg

SEQ ID NO: 9080947 - DNA, 22 bp, Homo sapiens
actgcctgcctctgattctgca

SEQ ID NO: 9080948 - DNA, 22 bp, Homo sapiens
actgcctgcatccttagggtag

SEQ ID NO: 9080949 - DNA, 23 bp, Homo sapiens
actgcctgctactatgcccacgg

SEQ ID NO: 9080950 - DNA, 22 bp, Homo sapiens
actgggcagggaaggagaccga

SEQ ID NO: 9080951 - DNA, 21 bp, Homo sapiens
agtgtccttgatcttgccttg

SEQ ID NO: 9080952 - DNA, 22 bp, Homo sapiens
agtgtccttgaggttcctagga

SEQ ID NO: 9080953 - DNA, 22 bp, Homo sapiens
agtgtcctggcaagggtttcag

SEQ ID NO: 9080954 - DNA, 22 bp, Homo sapiens
actgggcatcccatggcagagc

SEQ ID NO: 9080955 - DNA, 22 bp, Homo sapiens
actgggccagatcagagcaact

SEQ ID NO: 9080956 - DNA, 22 bp, Homo sapiens
actgggccagacactgattccc

SEQ ID NO: 9080957 - DNA, 22 bp, Homo sapiens
actgggccagatcagagcaact

SEQ ID NO: 9080958 - DNA, 22 bp, Homo sapiens
actgggccggtgcagagtagtt

SEQ ID NO: 9080959 - DNA, 22 bp, Homo sapiens
actgggcctggattggcgtgtc

SEQ ID NO: 9080960 - DNA, 22 bp, Homo sapiens
actgggcctgtacagagaaaac

SEQ ID NO: 9080961 - DNA, 22 bp, Homo sapiens
actgggcctgtacagagaaaac

SEQ ID NO: 9080962 - DNA, 22 bp, Homo sapiens
actgggcctggattggcgtgtc

SEQ ID NO: 9080963 - DNA, 22 bp, Homo sapiens
actgagagtcaagatagcatgg

SEQ ID NO: 9080964 - DNA, 22 bp, Homo sapiens
actgagaggtgatagtgacatt

SEQ ID NO: 9080965 - DNA, 21 bp, Homo sapiens
actgagagatgttggatcata

SEQ ID NO: 9080966 - DNA, 22 bp, Homo sapiens
actgagagagctgggtatctcc

SEQ ID NO: 9080967 - DNA, 23 bp, Homo sapiens
actgagccagggcctgggtcagc

SEQ ID NO: 9080968 - DNA, 22 bp, Homo sapiens
actctgactggagtgagagagg

SEQ ID NO: 9080969 - DNA, 22 bp, Homo sapiens
actctgagcatcccaagtctta

SEQ ID NO: 9080970 - DNA, 22 bp, Homo sapiens
actctgaattaattgctctcaa

SEQ ID NO: 9080971 - DNA, 22 bp, Homo sapiens
actctgaatgtgcatgtaaatc

SEQ ID NO: 9080972 - DNA, 22 bp, Homo sapiens
actctgaagaagacttccagac

SEQ ID NO: 9080973 - DNA, 22 bp, Homo sapiens
actctgaactccaggaggctca

SEQ ID NO: 9080974 - DNA, 22 bp, Homo sapiens
actctgaaccaattcgcaatga

SEQ ID NO: 9080975 - DNA, 22 bp, Homo sapiens
actctgaaccagagatcatacc

SEQ ID NO: 9080976 - DNA, 22 bp, Homo sapiens
actctgaaccagagatcatacc

SEQ ID NO: 9080977 - DNA, 21 bp, Homo sapiens
actctgaaaattaatagttat

SEQ ID NO: 9080978 - DNA, 22 bp, Homo sapiens
actctgaaatagaggctggtgg

SEQ ID NO: 9080979 - DNA, 21 bp, Homo sapiens
actctgaaaattaatagttat

SEQ ID NO: 9080980 - DNA, 22 bp, Homo sapiens
actctgaaacttgcaacacatt

SEQ ID NO: 9080981 - DNA, 22 bp, Homo sapiens
actctgcctttcagcagatgaa

SEQ ID NO: 9080982 - DNA, 22 bp, Homo sapiens
actctgcaatgtggcaagaaca

SEQ ID NO: 9080983 - DNA, 22 bp, Homo sapiens
actctgcaatgtggcaagaaca

SEQ ID NO: 9080984 - DNA, 21 bp, Homo sapiens
actctgccagtctcctgcact

SEQ ID NO: 9080985 - DNA, 22 bp, Homo sapiens
actctgccatcccaggtgctgt

SEQ ID NO: 9080986 - DNA, 22 bp, Homo sapiens
actctgccccgagttctgggaa

SEQ ID NO: 9080987 - DNA, 23 bp, Homo sapiens
agtgaagctggttagtgatgacc

SEQ ID NO: 9080988 - DNA, 22 bp, Homo sapiens
agtgaaggtttacagggcccct

SEQ ID NO: 9080989 - DNA, 22 bp, Homo sapiens
agtgaaggtttacagggcccct

SEQ ID NO: 9080990 - DNA, 21 bp, Homo sapiens
agtgaagagtgaaacacatgg

SEQ ID NO: 9080991 - DNA, 22 bp, Homo sapiens
agtgaagaggaagtggggcaca

SEQ ID NO: 9080992 - DNA, 20 bp, Homo sapiens
agtgaatagagacattgccc

SEQ ID NO: 9080993 - DNA, 20 bp, Homo sapiens
agtgaatagagacattgccc

SEQ ID NO: 9080994 - DNA, 22 bp, Homo sapiens
agtgaatatttttagacaccca

SEQ ID NO: 9080995 - DNA, 22 bp, Homo sapiens
actgcactgatttatcatccca

SEQ ID NO: 9080996 - DNA, 22 bp, Homo sapiens
actgcactcctgcctgggtaac

SEQ ID NO: 9080997 - DNA, 22 bp, Homo sapiens
actgcactcctgcctgggtaac

SEQ ID NO: 9080998 - DNA, 22 bp, Homo sapiens
actgcactccagcctgggtgat

SEQ ID NO: 9080999 - DNA, 22 bp, Homo sapiens
actgcactccagcctgggtgat

SEQ ID NO: 9081000 - DNA, 22 bp, Homo sapiens
actgcactccagcctgggtgat

SEQ ID NO: 9081001 - DNA, 22 bp, Homo sapiens
actgcactccagcctgggtgat

SEQ ID NO: 9081002 - DNA, 22 bp, Homo sapiens
actgcactccagcctgggtgat

SEQ ID NO: 9081003 - DNA, 22 bp, Homo sapiens
agtgctgaacatagaatggaca

SEQ ID NO: 9081004 - DNA, 22 bp, Homo sapiens
actgcagcctagggaccacagt

SEQ ID NO: 9081005 - DNA, 22 bp, Homo sapiens
actgcattgaggtttcatactt

SEQ ID NO: 9081006 - DNA, 22 bp, Homo sapiens
actgcattggagagcatgaatt

SEQ ID NO: 9081007 - DNA, 22 bp, Homo sapiens
actgcattgaggtttcatactt

SEQ ID NO: 9081008 - DNA, 22 bp, Homo sapiens
actgcattctttatcccacaac

SEQ ID NO: 9081009 - DNA, 22 bp, Homo sapiens
actgcatttggtaaagtcaaga

SEQ ID NO: 9081010 - DNA, 23 bp, Homo sapiens
actgcagcctccgcctgccgggt

SEQ ID NO: 9081011 - DNA, 22 bp, Homo sapiens
agtgctctaacagtcaaaaaag

SEQ ID NO: 9081012 - DNA, 22 bp, Homo sapiens
agtgctatcgagttctaatgct

SEQ ID NO: 9081013 - DNA, 22 bp, Homo sapiens
agtgctcacctgtcaggtcaag

SEQ ID NO: 9081014 - DNA, 22 bp, Homo sapiens
actgcacttcaccctgggtgac

SEQ ID NO: 9081015 - DNA, 22 bp, Homo sapiens
actgcacttcagcctgggtgac

SEQ ID NO: 9081016 - DNA, 22 bp, Homo sapiens
actgcacttcaccctgggtgac

SEQ ID NO: 9081017 - DNA, 22 bp, Homo sapiens
actgcacttcaccctgggtgac

SEQ ID NO: 9081018 - DNA, 22 bp, Homo sapiens
actgcacttcaccctgggtgac

SEQ ID NO: 9081019 - DNA, 22 bp, Homo sapiens
actgcacttcaccctgggtgac

SEQ ID NO: 9081020 - DNA, 22 bp, Homo sapiens
accttcctctaagacatttagc

SEQ ID NO: 9081021 - DNA, 21 bp, Homo sapiens
accttctgaattacctaccaa

SEQ ID NO: 9081022 - DNA, 22 bp, Homo sapiens
acctttggagcatgcattttct

SEQ ID NO: 9081023 - DNA, 22 bp, Homo sapiens
acctttggaggactagggtcat

SEQ ID NO: 9081024 - DNA, 21 bp, Homo sapiens
acctttggaaagaccctggga

SEQ ID NO: 9081025 - DNA, 22 bp, Homo sapiens
acctttggaaataaacactctg

SEQ ID NO: 9081026 - DNA, 22 bp, Homo sapiens
acccttggttttgcagagctgt

SEQ ID NO: 9081027 - DNA, 22 bp, Homo sapiens
acccttctgtgacctgcctgtc

SEQ ID NO: 9081028 - DNA, 22 bp, Homo sapiens
acccttcatagaggagaagctg

SEQ ID NO: 9081029 - DNA, 22 bp, Homo sapiens
aggtattttatagataagtaaa

SEQ ID NO: 9081030 - DNA, 22 bp, Homo sapiens
aggtatttatgagagcacatat

SEQ ID NO: 9081031 - DNA, 22 bp, Homo sapiens
aggtcaaagaacctagctatag

SEQ ID NO: 9081032 - DNA, 22 bp, Homo sapiens
aggtccaaatgttgagactgat

SEQ ID NO: 9081033 - DNA, 22 bp, Homo sapiens
aggtcaaggttcacaggggatc

SEQ ID NO: 9081034 - DNA, 22 bp, Homo sapiens
aggtcaaggctgcagtgagctg

SEQ ID NO: 9081035 - DNA, 22 bp, Homo sapiens
aggtcaagggagctgagggcca

SEQ ID NO: 9081036 - DNA, 22 bp, Homo sapiens
aggtcaagggcaagagtgaggt

SEQ ID NO: 9081037 - DNA, 22 bp, Homo sapiens
actagaaagcaaaagccatttc

SEQ ID NO: 9081038 - DNA, 23 bp, Homo sapiens
actagaaaatgactttctccctg

SEQ ID NO: 9081039 - DNA, 22 bp, Homo sapiens
actacttgagctgaggctagca

SEQ ID NO: 9081040 - DNA, 21 bp, Homo sapiens
actactggtgaaagcctagat

SEQ ID NO: 9081041 - DNA, 22 bp, Homo sapiens
actacatcttgcatatctataa

SEQ ID NO: 9081042 - DNA, 22 bp, Homo sapiens
aggtgagaaaacgagggttgca

SEQ ID NO: 9081043 - DNA, 22 bp, Homo sapiens
actaaatatttgagaggtgtag

SEQ ID NO: 9081044 - DNA, 22 bp, Homo sapiens
aggtgactggtttatctggcag

SEQ ID NO: 9081045 - DNA, 22 bp, Homo sapiens
aggtgactggtttatctggcag

SEQ ID NO: 9081046 - DNA, 22 bp, Homo sapiens
aggtgactggtttatctggcag

SEQ ID NO: 9081047 - DNA, 23 bp, Homo sapiens
actacagatactcctgctgtttg

SEQ ID NO: 9081048 - DNA, 22 bp, Homo sapiens
acctttttgttctgttctcagc

SEQ ID NO: 9081049 - DNA, 22 bp, Homo sapiens
acctttggtcatttacttttca

SEQ ID NO: 9081050 - DNA, 22 bp, Homo sapiens
acctttggtcatttacttttca

SEQ ID NO: 9081051 - DNA, 22 bp, Homo sapiens
acctttggtaagtttccaaaac

SEQ ID NO: 9081052 - DNA, 21 bp, Homo sapiens
acctttgggtgtttataatag

SEQ ID NO: 9081053 - DNA, 22 bp, Homo sapiens
acctttggataatttgagtttg

SEQ ID NO: 9081054 - DNA, 22 bp, Homo sapiens
acctttggataatttgagtttg

SEQ ID NO: 9081055 - DNA, 22 bp, Homo sapiens
acctttggataatctttgtgtt

SEQ ID NO: 9081056 - DNA, 22 bp, Homo sapiens
acctttggagcatgcattttct

SEQ ID NO: 9081057 - DNA, 22 bp, Homo sapiens
acctttggataatctttgtgtt

SEQ ID NO: 9081058 - DNA, 22 bp, Homo sapiens
acctttggtcatttacttttca

SEQ ID NO: 9081059 - DNA, 22 bp, Homo sapiens
acgatgatgaaagagaacattc

SEQ ID NO: 9081060 - DNA, 22 bp, Homo sapiens
acgaggttggagagttgtttgg

SEQ ID NO: 9081061 - DNA, 22 bp, Homo sapiens
acgaggagcctgtggcctggta

SEQ ID NO: 9081062 - DNA, 22 bp, Homo sapiens
acgaatcattcacggacaacac

SEQ ID NO: 9081063 - DNA, 22 bp, Homo sapiens
accttttttcagaactctaaag

SEQ ID NO: 9081064 - DNA, 19 bp, Homo sapiens
aggtgacatgtgacagcct

SEQ ID NO: 9081065 - DNA, 22 bp, Homo sapiens
aggtgaagttaaaaaccagtct

SEQ ID NO: 9081066 - DNA, 22 bp, Homo sapiens
aggtgaagttgaggaggcagaa

SEQ ID NO: 9081067 - DNA, 22 bp, Homo sapiens
aggtgaatgctcacattctaat

SEQ ID NO: 9081068 - DNA, 22 bp, Homo sapiens
actctctgtctaaatgcagttt

SEQ ID NO: 9081069 - DNA, 22 bp, Homo sapiens
actctctcacagcttggctgat

SEQ ID NO: 9081070 - DNA, 22 bp, Homo sapiens
actctcccttggagcctcaggc

SEQ ID NO: 9081071 - DNA, 22 bp, Homo sapiens
actctaaaatgctatgagatct

SEQ ID NO: 9081072 - DNA, 22 bp, Homo sapiens
actctaaatagataaccatgca

SEQ ID NO: 9081073 - DNA, 22 bp, Homo sapiens
actcctgccacacagatgctgt

SEQ ID NO: 9081074 - DNA, 21 bp, Homo sapiens
actccctgcataagtgattta

SEQ ID NO: 9081075 - DNA, 22 bp, Homo sapiens
actcctgggtgctgaccagcgt

SEQ ID NO: 9081076 - DNA, 23 bp, Homo sapiens
agtacatttgacccaaataagct

SEQ ID NO: 9081077 - DNA, 22 bp, Homo sapiens
agtaccattactcacttatttt

SEQ ID NO: 9081078 - DNA, 22 bp, Homo sapiens
agtaccattatccagtaaagga

SEQ ID NO: 9081079 - DNA, 22 bp, Homo sapiens
agtacatttagtttatgaacat

SEQ ID NO: 9081080 - DNA, 23 bp, Homo sapiens
agtacattcgaaaaattctgtga

SEQ ID NO: 9081081 - DNA, 22 bp, Homo sapiens
agtacatgcagaactaacagat

SEQ ID NO: 9081082 - DNA, 22 bp, Homo sapiens
agtacatgcagaactaacagat

SEQ ID NO: 9081083 - DNA, 22 bp, Homo sapiens
agtacatattgagtggtgatat

SEQ ID NO: 9081084 - DNA, 21 bp, Homo sapiens
agtacatctcaaatgtaaatc

SEQ ID NO: 9081085 - DNA, 22 bp, Homo sapiens
agtaataatagctgtaaagtgc

SEQ ID NO: 9081086 - DNA, 22 bp, Homo sapiens
agtaataatagctgtaaagtgc

SEQ ID NO: 9081087 - DNA, 22 bp, Homo sapiens
aggtgggcgctgctcccgctgg

SEQ ID NO: 9081088 - DNA, 21 bp, Homo sapiens
aggtgggcaggtggagtggcc

SEQ ID NO: 9081089 - DNA, 22 bp, Homo sapiens
aggtgggcccagtgggctccag

SEQ ID NO: 9081090 - DNA, 21 bp, Homo sapiens
agtagtttagcacagggtttg

SEQ ID NO: 9081091 - DNA, 21 bp, Homo sapiens
agtagtttagcacagggtttg

SEQ ID NO: 9081092 - DNA, 22 bp, Homo sapiens
agtactttgcactttgctcaga

SEQ ID NO: 9081093 - DNA, 22 bp, Homo sapiens
agtactttcttccgagagagaa

SEQ ID NO: 9081094 - DNA, 22 bp, Homo sapiens
agtactttagcataaagcagtt

SEQ ID NO: 9081095 - DNA, 22 bp, Homo sapiens
agtactttacttcttacagttt

SEQ ID NO: 9081096 - DNA, 22 bp, Homo sapiens
agtactttttgttcaattgtgc

SEQ ID NO: 9081097 - DNA, 22 bp, Homo sapiens
agtacttttttgatatctgagt

SEQ ID NO: 9081098 - DNA, 22 bp, Homo sapiens
agtagaaagaaggcactgggcc

SEQ ID NO: 9081099 - DNA, 22 bp, Homo sapiens
agtagaaagaaggcactgggcc

SEQ ID NO: 9081100 - DNA, 22 bp, Homo sapiens
agtagaaagaaggcactgggcc

SEQ ID NO: 9081101 - DNA, 22 bp, Homo sapiens
agctgtgtaggatcataacacg

SEQ ID NO: 9081102 - DNA, 18 bp, Homo sapiens
agcttagcatacttttcc

SEQ ID NO: 9081103 - DNA, 22 bp, Homo sapiens
agcttcagcttgcagctgtgat

SEQ ID NO: 9081104 - DNA, 22 bp, Homo sapiens
agctgtggggaggaggctagca

SEQ ID NO: 9081105 - DNA, 22 bp, Homo sapiens
agctgtgggcctgggagagctg

SEQ ID NO: 9081106 - DNA, 22 bp, Homo sapiens
agctgtggggaggaggctagca

SEQ ID NO: 9081107 - DNA, 22 bp, Homo sapiens
agctgtgggcctgggagagctg

SEQ ID NO: 9081108 - DNA, 19 bp, Homo sapiens
agctgtggggcctagcacc

SEQ ID NO: 9081109 - DNA, 22 bp, Homo sapiens
agctgtggggcaggcagcgagg

SEQ ID NO: 9081110 - DNA, 22 bp, Homo sapiens
agctgtggggcaggcagcgagg

SEQ ID NO: 9081111 - DNA, 22 bp, Homo sapiens
agctgtggtgttttcaagccct

SEQ ID NO: 9081112 - DNA, 22 bp, Homo sapiens
agctgtggttctgggcagcgac

SEQ ID NO: 9081113 - DNA, 22 bp, Homo sapiens
agctgtgtaagtcatgtaggtg

SEQ ID NO: 9081114 - DNA, 22 bp, Homo sapiens
agctgggatgaggagcatcctt

SEQ ID NO: 9081115 - DNA, 22 bp, Homo sapiens
agctggttcactaagcataata

SEQ ID NO: 9081116 - DNA, 22 bp, Homo sapiens
agctggtgtggatttttgaatg

SEQ ID NO: 9081117 - DNA, 22 bp, Homo sapiens
agctgggcaaaatgtgaggttg

SEQ ID NO: 9081118 - DNA, 22 bp, Homo sapiens
agctgtgggatttgggtgtgcc

SEQ ID NO: 9081119 - DNA, 22 bp, Homo sapiens
agctgtgggcctgggagagctg

SEQ ID NO: 9081120 - DNA, 22 bp, Homo sapiens
agctgtgggatttgggtgtgcc

SEQ ID NO: 9081121 - DNA, 22 bp, Homo sapiens
agctgtgggagaatctctgggt

SEQ ID NO: 9081122 - DNA, 22 bp, Homo sapiens
agctggttcagaaattagatgg

SEQ ID NO: 9081123 - DNA, 19 bp, Homo sapiens
agctggctcttctttgtct

SEQ ID NO: 9081124 - DNA, 21 bp, Homo sapiens
agctggctctctctggagaga

SEQ ID NO: 9081125 - DNA, 22 bp, Homo sapiens
agctgggaggtgggcagtgaga

SEQ ID NO: 9081126 - DNA, 22 bp, Homo sapiens
aggaaaaagagttgctgccttc

SEQ ID NO: 9081127 - DNA, 22 bp, Homo sapiens
aggaaaaagagttgctgccttc

SEQ ID NO: 9081128 - DNA, 22 bp, Homo sapiens
aggaaaaaagtctgtgattata

SEQ ID NO: 9081129 - DNA, 22 bp, Homo sapiens
aggaaaaaagtctgtgattata

SEQ ID NO: 9081130 - DNA, 22 bp, Homo sapiens
aggaaaaacctgttaatggtag

SEQ ID NO: 9081131 - DNA, 22 bp, Homo sapiens
aggaaaaaagtctgtgattata

SEQ ID NO: 9081132 - DNA, 22 bp, Homo sapiens
agcttttacataatgatcttga

SEQ ID NO: 9081133 - DNA, 22 bp, Homo sapiens
agcttcatgcctaaagacagcg

SEQ ID NO: 9081134 - DNA, 22 bp, Homo sapiens
agcttcagggacttgtggcaga

SEQ ID NO: 9081135 - DNA, 22 bp, Homo sapiens
agctttggttgaggggagtgtg

SEQ ID NO: 9081136 - DNA, 22 bp, Homo sapiens
agctttggttgaggggagtgtg

SEQ ID NO: 9081137 - DNA, 20 bp, Homo sapiens
aggaagccaaaggctgtctt

SEQ ID NO: 9081138 - DNA, 22 bp, Homo sapiens
aggaagcagtttataatgcatt

SEQ ID NO: 9081139 - DNA, 18 bp, Homo sapiens
aggaagcaggaggaaggc

SEQ ID NO: 9081140 - DNA, 18 bp, Homo sapiens
aggaagcaggaggaaggc

SEQ ID NO: 9081141 - DNA, 22 bp, Homo sapiens
aggaagccatggtggacgtcta

SEQ ID NO: 9081142 - DNA, 22 bp, Homo sapiens
aggaagcatgttggatccactt

SEQ ID NO: 9081143 - DNA, 18 bp, Homo sapiens
aggaaagaaaggcaggtg

SEQ ID NO: 9081144 - DNA, 22 bp, Homo sapiens
aggaagagcattcacatggtag

SEQ ID NO: 9081145 - DNA, 18 bp, Homo sapiens
aggaaagaaaggcaggtg

SEQ ID NO: 9081146 - DNA, 22 bp, Homo sapiens
aggaagagcattcacatggtag

SEQ ID NO: 9081147 - DNA, 18 bp, Homo sapiens
aggaaagaaaggcaggtg

SEQ ID NO: 9081148 - DNA, 18 bp, Homo sapiens
aggaaagaaaggcaggtg

SEQ ID NO: 9081149 - DNA, 22 bp, Homo sapiens
aggaaagaaaggaggtgcattt

SEQ ID NO: 9081150 - DNA, 22 bp, Homo sapiens
aggaaactgggtatggttatac

SEQ ID NO: 9081151 - DNA, 22 bp, Homo sapiens
aggaaagaaaggaggtgcattt

SEQ ID NO: 9081152 - DNA, 22 bp, Homo sapiens
aggaaactcaaagtgtcaggta

SEQ ID NO: 9081153 - DNA, 22 bp, Homo sapiens
aggaaactaaggctcagtgaag

SEQ ID NO: 9081154 - DNA, 22 bp, Homo sapiens
aggaaactaacttatctttata

SEQ ID NO: 9081155 - DNA, 22 bp, Homo sapiens
aggaaaaataaggcagcagggc

SEQ ID NO: 9081156 - DNA, 22 bp, Homo sapiens
aggaaactaacttatctttata

SEQ ID NO: 9081157 - DNA, 22 bp, Homo sapiens
agctccaggtgcaagtcatggt

SEQ ID NO: 9081158 - DNA, 22 bp, Homo sapiens
agctccaggtgcaagtcatggt

SEQ ID NO: 9081159 - DNA, 20 bp, Homo sapiens
agctccagtgctgacgcttc

SEQ ID NO: 9081160 - DNA, 22 bp, Homo sapiens
agctccaggtgcaagtcatggt

SEQ ID NO: 9081161 - DNA, 22 bp, Homo sapiens
acagccagaggtggtcctgggt

SEQ ID NO: 9081162 - DNA, 20 bp, Homo sapiens
acagccagaggaggcagaca

SEQ ID NO: 9081163 - DNA, 22 bp, Homo sapiens
agctcccaattgacttgaacta

SEQ ID NO: 9081164 - DNA, 22 bp, Homo sapiens
agctcccaattgacttgaacta

SEQ ID NO: 9081165 - DNA, 22 bp, Homo sapiens
agctccagtttcctgactgagc

SEQ ID NO: 9081166 - DNA, 22 bp, Homo sapiens
agctccagtttcctgactgagc

SEQ ID NO: 9081167 - DNA, 22 bp, Homo sapiens
agctccagttacttacctagag

SEQ ID NO: 9081168 - DNA, 22 bp, Homo sapiens
agctccagtttcctgactgagc

SEQ ID NO: 9081169 - DNA, 22 bp, Homo sapiens
acagccagggtctcaggaggcg

SEQ ID NO: 9081170 - DNA, 22 bp, Homo sapiens
acagccaggtaaaggcatggca

SEQ ID NO: 9081171 - DNA, 22 bp, Homo sapiens
acagccaggtaaaggcatggca

SEQ ID NO: 9081172 - DNA, 22 bp, Homo sapiens
acagccagtcatctcagcaggg

SEQ ID NO: 9081173 - DNA, 22 bp, Homo sapiens
agctgcagccgcagctgtggcc

SEQ ID NO: 9081174 - DNA, 22 bp, Homo sapiens
agctgcagccgcagctgtggcc

SEQ ID NO: 9081175 - DNA, 22 bp, Homo sapiens
acagccagtgactggacaagct

SEQ ID NO: 9081176 - DNA, 22 bp, Homo sapiens
acagccagtgctccgtgaggac

SEQ ID NO: 9081177 - DNA, 22 bp, Homo sapiens
acagccagtgactggacaagct

SEQ ID NO: 9081178 - DNA, 22 bp, Homo sapiens
agctgcagcttcctagtccagc

SEQ ID NO: 9081179 - DNA, 22 bp, Homo sapiens
agctgcaggattatggaatgga

SEQ ID NO: 9081180 - DNA, 22 bp, Homo sapiens
agctgcaggcccatgctcagtc

SEQ ID NO: 9081181 - DNA, 22 bp, Homo sapiens
agctgctcaggagagccaggtc

SEQ ID NO: 9081182 - DNA, 22 bp, Homo sapiens
agctgctgggatacagtagtga

SEQ ID NO: 9081183 - DNA, 22 bp, Homo sapiens
agctgcttataagatttgggag

SEQ ID NO: 9081184 - DNA, 18 bp, Homo sapiens
agctgcttgcaggccttc

SEQ ID NO: 9081185 - DNA, 22 bp, Homo sapiens
agctgcttcctctttgatgtca

SEQ ID NO: 9081186 - DNA, 22 bp, Homo sapiens
acagccccccgctcagtttcca

SEQ ID NO: 9081187 - DNA, 23 bp, Homo sapiens
acagccccatgcaggtgtgtttg

SEQ ID NO: 9081188 - DNA, 22 bp, Homo sapiens
acagcccaggactccagtgggc

SEQ ID NO: 9081189 - DNA, 22 bp, Homo sapiens
acagcccaggactccagtgggc

SEQ ID NO: 9081190 - DNA, 22 bp, Homo sapiens
agctgctggtttaagggatggg

SEQ ID NO: 9081191 - DNA, 22 bp, Homo sapiens
agctgctgtcctaggcactgta

SEQ ID NO: 9081192 - DNA, 22 bp, Homo sapiens
agctgctgtcctaggcactgta

SEQ ID NO: 9081193 - DNA, 22 bp, Homo sapiens
agctgctggggagggcagacac

SEQ ID NO: 9081194 - DNA, 22 bp, Homo sapiens
agctgcttagagtcctcaggat

SEQ ID NO: 9081195 - DNA, 22 bp, Homo sapiens
agctgctgtttcttgcacgtat

SEQ ID NO: 9081196 - DNA, 21 bp, Homo sapiens
agctgctgtggccagaatcca

SEQ ID NO: 9081197 - DNA, 22 bp, Homo sapiens
agctgctgtggggctcggcctg

SEQ ID NO: 9081198 - DNA, 22 bp, Homo sapiens
agctggcctgttagagctgagt

SEQ ID NO: 9081199 - DNA, 20 bp, Homo sapiens
agctggcctgtcctaggcct

SEQ ID NO: 9081200 - DNA, 22 bp, Homo sapiens
acagcctgcagccccaggtcgc

SEQ ID NO: 9081201 - DNA, 22 bp, Homo sapiens
acagcctgagagtggagctggc

SEQ ID NO: 9081202 - DNA, 22 bp, Homo sapiens
acagcctgcagccccaggtcgc

SEQ ID NO: 9081203 - DNA, 21 bp, Homo sapiens
agctggctctctctggagaga

SEQ ID NO: 9081204 - DNA, 21 bp, Homo sapiens
agctggctctctctggagaga

SEQ ID NO: 9081205 - DNA, 21 bp, Homo sapiens
agctggctctctctggagaga

SEQ ID NO: 9081206 - DNA, 21 bp, Homo sapiens
agctggctctctctggagaga

SEQ ID NO: 9081207 - DNA, 22 bp, Homo sapiens
agctggctatgccctgtgaacc

SEQ ID NO: 9081208 - DNA, 22 bp, Homo sapiens
agctggctcagccgggtggtct

SEQ ID NO: 9081209 - DNA, 22 bp, Homo sapiens
agctggctatgccctgtgaacc

SEQ ID NO: 9081210 - DNA, 22 bp, Homo sapiens
agctggctatgccctgtgaacc

SEQ ID NO: 9081211 - DNA, 22 bp, Homo sapiens
agctggctatgccctgtgaacc

SEQ ID NO: 9081212 - DNA, 22 bp, Homo sapiens
agctggctatgccctgtgaacc

SEQ ID NO: 9081213 - DNA, 22 bp, Homo sapiens
agctggctatacttgaaaagtc

SEQ ID NO: 9081214 - DNA, 21 bp, Homo sapiens
agctggctatagttagtgatg

SEQ ID NO: 9081215 - DNA, 22 bp, Homo sapiens
agctggctatacttgaaaagtc

SEQ ID NO: 9081216 - DNA, 22 bp, Homo sapiens
agctggctatacttgaaaagtc

SEQ ID NO: 9081217 - DNA, 22 bp, Homo sapiens
agctggcctgttagagctgagt

SEQ ID NO: 9081218 - DNA, 22 bp, Homo sapiens
agctggcctgttagagctgagt

SEQ ID NO: 9081219 - DNA, 22 bp, Homo sapiens
agctggccttagtgagcacctg

SEQ ID NO: 9081220 - DNA, 22 bp, Homo sapiens
agctggccttagtgagcacctg

SEQ ID NO: 9081221 - DNA, 22 bp, Homo sapiens
acatacacaagcgtacatgaac

SEQ ID NO: 9081222 - DNA, 22 bp, Homo sapiens
acatacacatgaatatattttt

SEQ ID NO: 9081223 - DNA, 23 bp, Homo sapiens
acatacataagcaccacattttg

SEQ ID NO: 9081224 - DNA, 22 bp, Homo sapiens
acatacatatgtttaaatgcat

SEQ ID NO: 9081225 - DNA, 22 bp, Homo sapiens
acatacatcaagtatcacaaga

SEQ ID NO: 9081226 - DNA, 22 bp, Homo sapiens
acatacatcaagtatcacaaga

SEQ ID NO: 9081227 - DNA, 22 bp, Homo sapiens
aggcacagatttggggaaagca

SEQ ID NO: 9081228 - DNA, 22 bp, Homo sapiens
aggcacagatttggggaaagca

SEQ ID NO: 9081229 - DNA, 22 bp, Homo sapiens
aggcacagagaggttaaatgca

SEQ ID NO: 9081230 - DNA, 22 bp, Homo sapiens
aggcacagagaatgccctccat

SEQ ID NO: 9081231 - DNA, 22 bp, Homo sapiens
aggcacagagaagtaaagtatc

SEQ ID NO: 9081232 - DNA, 22 bp, Homo sapiens
aggcaacaagggtagtcagtga

SEQ ID NO: 9081233 - DNA, 22 bp, Homo sapiens
aggcaacaagggtagtcagtga

SEQ ID NO: 9081234 - DNA, 22 bp, Homo sapiens
aggcaacataacacgaaagtct

SEQ ID NO: 9081235 - DNA, 22 bp, Homo sapiens
aggcaacatgggccaggcagaa

SEQ ID NO: 9081236 - DNA, 22 bp, Homo sapiens
aggcaacatgactcacttgcac

SEQ ID NO: 9081237 - DNA, 22 bp, Homo sapiens
aggcacacagaccccagcaagt

SEQ ID NO: 9081238 - DNA, 22 bp, Homo sapiens
aggaggggttctcgggtgctga

SEQ ID NO: 9081239 - DNA, 21 bp, Homo sapiens
aggaggggtctttcccactga

SEQ ID NO: 9081240 - DNA, 22 bp, Homo sapiens
aggaggggttctcgggtgctga

SEQ ID NO: 9081241 - DNA, 22 bp, Homo sapiens
aggcaaatctgagacatttaaa

SEQ ID NO: 9081242 - DNA, 22 bp, Homo sapiens
aggcaaatagatagtccataca

SEQ ID NO: 9081243 - DNA, 22 bp, Homo sapiens
aggcaaagaggatattttgggg

SEQ ID NO: 9081244 - DNA, 22 bp, Homo sapiens
aggaggccgatttcagaggtcg

SEQ ID NO: 9081245 - DNA, 22 bp, Homo sapiens
aggaggccgatttcagaggtcg

SEQ ID NO: 9081246 - DNA, 22 bp, Homo sapiens
aggagggacaccaatatatgtt

SEQ ID NO: 9081247 - DNA, 17 bp, Homo sapiens
aggagggaaatagcttg

SEQ ID NO: 9081248 - DNA, 17 bp, Homo sapiens
aggagggaaatagcttg

SEQ ID NO: 9081249 - DNA, 22 bp, Homo sapiens
aggagggaataagaaagagtca

SEQ ID NO: 9081250 - DNA, 22 bp, Homo sapiens
aggaggggcatagaaatgtaat

SEQ ID NO: 9081251 - DNA, 22 bp, Homo sapiens
aggagggagatgcccatcctgg

SEQ ID NO: 9081252 - DNA, 20 bp, Homo sapiens
aggagggacctggattggcg

SEQ ID NO: 9081253 - DNA, 22 bp, Homo sapiens
aggagggagatgcccatcctgg

SEQ ID NO: 9081254 - DNA, 22 bp, Homo sapiens
aggagggagatgcccatcctgg

SEQ ID NO: 9081255 - DNA, 20 bp, Homo sapiens
aggagggacctggattggcg

SEQ ID NO: 9081256 - DNA, 22 bp, Homo sapiens
aggagggacctaggaatattgc

SEQ ID NO: 9081257 - DNA, 21 bp, Homo sapiens
aggagctggagaaaactttcc

SEQ ID NO: 9081258 - DNA, 22 bp, Homo sapiens
aggagctggaatggtccttttg

SEQ ID NO: 9081259 - DNA, 22 bp, Homo sapiens
aggagctgcttaaatggttggt

SEQ ID NO: 9081260 - DNA, 22 bp, Homo sapiens
aggagctgcttaaatggttggt

SEQ ID NO: 9081261 - DNA, 22 bp, Homo sapiens
aggagctgcatggatacctggt

SEQ ID NO: 9081262 - DNA, 22 bp, Homo sapiens
aggagctgcatggatacctggt

SEQ ID NO: 9081263 - DNA, 22 bp, Homo sapiens
aggagctgcatggatacctggt

SEQ ID NO: 9081264 - DNA, 22 bp, Homo sapiens
aggagctgcactgggagttttt

SEQ ID NO: 9081265 - DNA, 22 bp, Homo sapiens
aggagctgcaaatattagtaat

SEQ ID NO: 9081266 - DNA, 22 bp, Homo sapiens
aggagctgcaaaaccggccgct

SEQ ID NO: 9081267 - DNA, 22 bp, Homo sapiens
aggagcctgaatcagagggtga

SEQ ID NO: 9081268 - DNA, 22 bp, Homo sapiens
aggagcctccatggtcacattc

SEQ ID NO: 9081269 - DNA, 22 bp, Homo sapiens
aggagcctccatggtcacattc

SEQ ID NO: 9081270 - DNA, 22 bp, Homo sapiens
aggagcctccatggtcacattc

SEQ ID NO: 9081271 - DNA, 20 bp, Homo sapiens
aggagccattgactgcagca

SEQ ID NO: 9081272 - DNA, 22 bp, Homo sapiens
aggagccattttccaagggcga

SEQ ID NO: 9081273 - DNA, 22 bp, Homo sapiens
acaggggtgcatggtgcatggt

SEQ ID NO: 9081274 - DNA, 22 bp, Homo sapiens
acaggggtgcatggtgcatggt

SEQ ID NO: 9081275 - DNA, 22 bp, Homo sapiens
acagggtcttagagatcacctg

SEQ ID NO: 9081276 - DNA, 22 bp, Homo sapiens
acaggggctccgaaggtgaggg

SEQ ID NO: 9081277 - DNA, 22 bp, Homo sapiens
acaggggctccgaaggtgaggg

SEQ ID NO: 9081278 - DNA, 22 bp, Homo sapiens
acaggggctccgaaggtgaggg

SEQ ID NO: 9081279 - DNA, 22 bp, Homo sapiens
acagggtggggatggtgagctt

SEQ ID NO: 9081280 - DNA, 22 bp, Homo sapiens
aggagcagaccgtagtcctgca

SEQ ID NO: 9081281 - DNA, 22 bp, Homo sapiens
acagggtgactttgtgacagat

SEQ ID NO: 9081282 - DNA, 22 bp, Homo sapiens
acagggtgactttgtgacagat

SEQ ID NO: 9081283 - DNA, 22 bp, Homo sapiens
aggagacatggaatagtgaggc

SEQ ID NO: 9081284 - DNA, 22 bp, Homo sapiens
aggagacatctaactgtaggtt

SEQ ID NO: 9081285 - DNA, 22 bp, Homo sapiens
aggagacatactataggaatat

SEQ ID NO: 9081286 - DNA, 22 bp, Homo sapiens
aggagacatactataggaatat

SEQ ID NO: 9081287 - DNA, 22 bp, Homo sapiens
aggagacataactatgatgaga

SEQ ID NO: 9081288 - DNA, 22 bp, Homo sapiens
aggagacataactatgatgaga

SEQ ID NO: 9081289 - DNA, 22 bp, Homo sapiens
aggagacatactataggaatat

SEQ ID NO: 9081290 - DNA, 22 bp, Homo sapiens
acaggggctccgaaggtgaggg

SEQ ID NO: 9081291 - DNA, 22 bp, Homo sapiens
aggacttcttagatgccttccg

SEQ ID NO: 9081292 - DNA, 22 bp, Homo sapiens
aggacttctgaggtcaagtcgc

SEQ ID NO: 9081293 - DNA, 22 bp, Homo sapiens
aggacttctgagctgctttaaa

SEQ ID NO: 9081294 - DNA, 19 bp, Homo sapiens
aggacttctgaacccgtcc

SEQ ID NO: 9081295 - DNA, 22 bp, Homo sapiens
aggacttctagtggtactgtga

SEQ ID NO: 9081296 - DNA, 22 bp, Homo sapiens
aggacttctaagctaagaagtt

SEQ ID NO: 9081297 - DNA, 22 bp, Homo sapiens
aggacttccatggatggattgg

SEQ ID NO: 9081298 - DNA, 22 bp, Homo sapiens
aggacttctccgataagtcaga

SEQ ID NO: 9081299 - DNA, 23 bp, Homo sapiens
aggagacagggaagtgcctggct

SEQ ID NO: 9081300 - DNA, 22 bp, Homo sapiens
aggagacagccaggggcctgag

SEQ ID NO: 9081301 - DNA, 22 bp, Homo sapiens
aggaagcctgcaggtgactgct

SEQ ID NO: 9081302 - DNA, 22 bp, Homo sapiens
aggaagcccttgtcatttctgt

SEQ ID NO: 9081303 - DNA, 22 bp, Homo sapiens
aggaagcctggggctgccctcg

SEQ ID NO: 9081304 - DNA, 17 bp, Homo sapiens
aggaagcgagctggcct

SEQ ID NO: 9081305 - DNA, 17 bp, Homo sapiens
aggaagcgagctggcct

SEQ ID NO: 9081306 - DNA, 22 bp, Homo sapiens
aggaagctagaaggtcttcttt

SEQ ID NO: 9081307 - DNA, 23 bp, Homo sapiens
aggaagctaccaattttgtaggc

SEQ ID NO: 9081308 - DNA, 20 bp, Homo sapiens
aggaaggagaatctgagcaa

SEQ ID NO: 9081309 - DNA, 22 bp, Homo sapiens
aggaagctagagccaccggact

SEQ ID NO: 9081310 - DNA, 23 bp, Homo sapiens
aggaagctaagtgtggctgcgga

SEQ ID NO: 9081311 - DNA, 23 bp, Homo sapiens
aggaagctaagtgtggctgcgga

SEQ ID NO: 9081312 - DNA, 23 bp, Homo sapiens
aggaagctaagtgtggctgcgga

SEQ ID NO: 9081313 - DNA, 23 bp, Homo sapiens
aggaagctaagtgtggctgcgga

SEQ ID NO: 9081314 - DNA, 22 bp, Homo sapiens
aggaagctaaccagggagtgag

SEQ ID NO: 9081315 - DNA, 22 bp, Homo sapiens
aggaagctaaccagggagtgag

SEQ ID NO: 9081316 - DNA, 22 bp, Homo sapiens
aggaagctaaccagggagtgag

SEQ ID NO: 9081317 - DNA, 22 bp, Homo sapiens
aggaaggcacattgttggctaa

SEQ ID NO: 9081318 - DNA, 22 bp, Homo sapiens
aggaaggcatgaggtgttcaca

SEQ ID NO: 9081319 - DNA, 22 bp, Homo sapiens
aggaaggctgatcactgcttgt

SEQ ID NO: 9081320 - DNA, 22 bp, Homo sapiens
aggaaggcttctttggtcttct

SEQ ID NO: 9081321 - DNA, 22 bp, Homo sapiens
aggaagggatacataggatagt

SEQ ID NO: 9081322 - DNA, 23 bp, Homo sapiens
aggaaggaggtcctaacagtatc

SEQ ID NO: 9081323 - DNA, 22 bp, Homo sapiens
aggaaggagggcagatattaag

SEQ ID NO: 9081324 - DNA, 23 bp, Homo sapiens
aggaaggaggtcctaacagtatc

SEQ ID NO: 9081325 - DNA, 23 bp, Homo sapiens
aggaaggaggtcctaacagtatc

SEQ ID NO: 9081326 - DNA, 22 bp, Homo sapiens
accctgggcttggcctgctcag

SEQ ID NO: 9081327 - DNA, 22 bp, Homo sapiens
accctggagcaataatccctgg

SEQ ID NO: 9081328 - DNA, 22 bp, Homo sapiens
accctggagcttttctggccct

SEQ ID NO: 9081329 - DNA, 22 bp, Homo sapiens
accctctgccttgagcagtgcc

SEQ ID NO: 9081330 - DNA, 18 bp, Homo sapiens
accctctggcttctgagc

SEQ ID NO: 9081331 - DNA, 22 bp, Homo sapiens
accccagcgcatatggtctgcg

SEQ ID NO: 9081332 - DNA, 22 bp, Homo sapiens
accccagccctgcttctgggag

SEQ ID NO: 9081333 - DNA, 20 bp, Homo sapiens
accccagcccctctatctga

SEQ ID NO: 9081334 - DNA, 22 bp, Homo sapiens
accccaagacagtagaagagaa

SEQ ID NO: 9081335 - DNA, 22 bp, Homo sapiens
accccaagacagtagaagagaa

SEQ ID NO: 9081336 - DNA, 22 bp, Homo sapiens
accccagaggcggaggctgcag

SEQ ID NO: 9081337 - DNA, 22 bp, Homo sapiens
accccacagcatacaaaggcac

SEQ ID NO: 9081338 - DNA, 22 bp, Homo sapiens
acccattcctttacttcatctg

SEQ ID NO: 9081339 - DNA, 19 bp, Homo sapiens
acccattttcagtattggc

SEQ ID NO: 9081340 - DNA, 22 bp, Homo sapiens
acccatgtgctcttttgtaccc

SEQ ID NO: 9081341 - DNA, 22 bp, Homo sapiens
acccattcctctcctgagggat

SEQ ID NO: 9081342 - DNA, 22 bp, Homo sapiens
acccatccagtgtccctgctag

SEQ ID NO: 9081343 - DNA, 23 bp, Homo sapiens
acccatctctcctgtcatgcaga

SEQ ID NO: 9081344 - DNA, 22 bp, Homo sapiens
acccagagcacagatgcaacgt

SEQ ID NO: 9081345 - DNA, 22 bp, Homo sapiens
acccagagcacagatgcaacgt

SEQ ID NO: 9081346 - DNA, 22 bp, Homo sapiens
acccaggctggcgtgcagtggc

SEQ ID NO: 9081347 - DNA, 22 bp, Homo sapiens
acccagagcactgggtgtgggc

SEQ ID NO: 9081348 - DNA, 22 bp, Homo sapiens
acccagagcacagatgcaacgt

SEQ ID NO: 9081349 - DNA, 17 bp, Homo sapiens
acccagagaaggaggtc

SEQ ID NO: 9081350 - DNA, 22 bp, Homo sapiens
acccagagactagcacggtaca

SEQ ID NO: 9081351 - DNA, 22 bp, Homo sapiens
acccagagatggacctggctgc

SEQ ID NO: 9081352 - DNA, 22 bp, Homo sapiens
acccagggtagagtgcagtggc

SEQ ID NO: 9081353 - DNA, 22 bp, Homo sapiens
acccagggtagagtgcagtggc

SEQ ID NO: 9081354 - DNA, 22 bp, Homo sapiens
acccagggtagaacctcagagc

SEQ ID NO: 9081355 - DNA, 22 bp, Homo sapiens
acccagggaccccgctgacgcc

SEQ ID NO: 9081356 - DNA, 22 bp, Homo sapiens
acccaggctggcgtgcagtggc

SEQ ID NO: 9081357 - DNA, 19 bp, Homo sapiens
acccagggttgatgtccag

SEQ ID NO: 9081358 - DNA, 22 bp, Homo sapiens
acccagggtcaccccgtagggt

SEQ ID NO: 9081359 - DNA, 22 bp, Homo sapiens
acccagggttcctgggtcccag

SEQ ID NO: 9081360 - DNA, 22 bp, Homo sapiens
acccagtgacatcctttacctg

SEQ ID NO: 9081361 - DNA, 22 bp, Homo sapiens
acccagggtttgagctctgcag

SEQ ID NO: 9081362 - DNA, 22 bp, Homo sapiens
acccaggtggctctgacggggg

SEQ ID NO: 9081363 - DNA, 22 bp, Homo sapiens
acccacagccgctgtgcgtccc

SEQ ID NO: 9081364 - DNA, 22 bp, Homo sapiens
acccaccacagtggctggcaca

SEQ ID NO: 9081365 - DNA, 22 bp, Homo sapiens
agggcctgagctctcctccagt

SEQ ID NO: 9081366 - DNA, 19 bp, Homo sapiens
agggcctgagcagatgttg

SEQ ID NO: 9081367 - DNA, 19 bp, Homo sapiens
agggcctgagcagatgttg

SEQ ID NO: 9081368 - DNA, 19 bp, Homo sapiens
agggcctgagcagatgttg

SEQ ID NO: 9081369 - DNA, 22 bp, Homo sapiens
acccagagaactgaggcatgaa

SEQ ID NO: 9081370 - DNA, 22 bp, Homo sapiens
acccagagaactgaggcatgaa

SEQ ID NO: 9081371 - DNA, 22 bp, Homo sapiens
acccacgaagatgagcggcatg

SEQ ID NO: 9081372 - DNA, 22 bp, Homo sapiens
acccacgaagatgagcggcatg

SEQ ID NO: 9081373 - DNA, 22 bp, Homo sapiens
acccactgtagccactctgggt

SEQ ID NO: 9081374 - DNA, 22 bp, Homo sapiens
agggcctgacacccttgccagc

SEQ ID NO: 9081375 - DNA, 22 bp, Homo sapiens
agggcctgacacccttgccagc

SEQ ID NO: 9081376 - DNA, 22 bp, Homo sapiens
agggcctgagaccgtggcttga

SEQ ID NO: 9081377 - DNA, 22 bp, Homo sapiens
agggcctgagaccgtggcttga

SEQ ID NO: 9081378 - DNA, 22 bp, Homo sapiens
accaggagggaccctggtggcc

SEQ ID NO: 9081379 - DNA, 22 bp, Homo sapiens
accagggttgagtcagctgcgt

SEQ ID NO: 9081380 - DNA, 22 bp, Homo sapiens
accagggcttacagcagtagct

SEQ ID NO: 9081381 - DNA, 22 bp, Homo sapiens
accagggcggcttgaggaggca

SEQ ID NO: 9081382 - DNA, 22 bp, Homo sapiens
accagggcagccgaggtgtgtc

SEQ ID NO: 9081383 - DNA, 23 bp, Homo sapiens
agggcccaagcctggacagcagg

SEQ ID NO: 9081384 - DNA, 22 bp, Homo sapiens
accatacacaatttgcaacggt

SEQ ID NO: 9081385 - DNA, 22 bp, Homo sapiens
accatacacaatttgcaacggt

SEQ ID NO: 9081386 - DNA, 22 bp, Homo sapiens
accatacttgaaatggatagga

SEQ ID NO: 9081387 - DNA, 22 bp, Homo sapiens
accagtaagatcctgtacatac

SEQ ID NO: 9081388 - DNA, 22 bp, Homo sapiens
accagtaagatcctgtacatac

SEQ ID NO: 9081389 - DNA, 21 bp, Homo sapiens
accagtccctagtcttatcct

SEQ ID NO: 9081390 - DNA, 22 bp, Homo sapiens
accagtccgcggagctccgggg

SEQ ID NO: 9081391 - DNA, 22 bp, Homo sapiens
accagtgagtatttgtaacaga

SEQ ID NO: 9081392 - DNA, 22 bp, Homo sapiens
accagtgtcttattgaccatct

SEQ ID NO: 9081393 - DNA, 22 bp, Homo sapiens
accaggaacaagccatggagga

SEQ ID NO: 9081394 - DNA, 22 bp, Homo sapiens
accacagaggaatttgaagagg

SEQ ID NO: 9081395 - DNA, 23 bp, Homo sapiens
accaacaagcctctggagagtgg

SEQ ID NO: 9081396 - DNA, 22 bp, Homo sapiens
accaaggagacaaaggtgtatt

SEQ ID NO: 9081397 - DNA, 23 bp, Homo sapiens
aggcttcctatcttagagctggg

SEQ ID NO: 9081398 - DNA, 23 bp, Homo sapiens
accaacaagcctctggagagtgg

SEQ ID NO: 9081399 - DNA, 19 bp, Homo sapiens
accaggagacagtgagctt

SEQ ID NO: 9081400 - DNA, 22 bp, Homo sapiens
accaggagaggcacttgcaatg

SEQ ID NO: 9081401 - DNA, 22 bp, Homo sapiens
accaggagccacaggaggagcc

SEQ ID NO: 9081402 - DNA, 22 bp, Homo sapiens
acatgaaaagactatctgatta

SEQ ID NO: 9081403 - DNA, 22 bp, Homo sapiens
acatgaaaactggttccttcag

SEQ ID NO: 9081404 - DNA, 22 bp, Homo sapiens
aggccagccctgggctgagaga

SEQ ID NO: 9081405 - DNA, 22 bp, Homo sapiens
acatctttgctcttatagagct

SEQ ID NO: 9081406 - DNA, 22 bp, Homo sapiens
acatctttttggaaacggctga

SEQ ID NO: 9081407 - DNA, 22 bp, Homo sapiens
acatctttgctcttatagagct

SEQ ID NO: 9081408 - DNA, 22 bp, Homo sapiens
aggccagcagcatgacggcatc

SEQ ID NO: 9081409 - DNA, 22 bp, Homo sapiens
aggccagcagacgtgggactga

SEQ ID NO: 9081410 - DNA, 22 bp, Homo sapiens
aggccagcagacgtgggactga

SEQ ID NO: 9081411 - DNA, 22 bp, Homo sapiens
aggccagccctcacctgtgttc

SEQ ID NO: 9081412 - DNA, 18 bp, Homo sapiens
aggccagccctgctactg

SEQ ID NO: 9081413 - DNA, 22 bp, Homo sapiens
aggccagccctgggctgagaga

SEQ ID NO: 9081414 - DNA, 22 bp, Homo sapiens
aggccagccctcacctgtgttc

SEQ ID NO: 9081415 - DNA, 22 bp, Homo sapiens
aggccagccctcacctgtgttc

SEQ ID NO: 9081416 - DNA, 21 bp, Homo sapiens
aggcccagctttcctcttgct

SEQ ID NO: 9081417 - DNA, 21 bp, Homo sapiens
aggcccagctttcctcttgct

SEQ ID NO: 9081418 - DNA, 22 bp, Homo sapiens
aggcccagggctgctctctgaa

SEQ ID NO: 9081419 - DNA, 22 bp, Homo sapiens
aggcccagggctgctctctgaa

SEQ ID NO: 9081420 - DNA, 22 bp, Homo sapiens
aggcccagggctgctctctgaa

SEQ ID NO: 9081421 - DNA, 22 bp, Homo sapiens
aggccctgagaaaatccctgca

SEQ ID NO: 9081422 - DNA, 22 bp, Homo sapiens
aggcccagctgggccaggaaca

SEQ ID NO: 9081423 - DNA, 21 bp, Homo sapiens
aggcccagctttcctcttgct

SEQ ID NO: 9081424 - DNA, 22 bp, Homo sapiens
aggcccagcttgaagtgggaag

SEQ ID NO: 9081425 - DNA, 22 bp, Homo sapiens
aggcccagcttgaagtgggaag

SEQ ID NO: 9081426 - DNA, 22 bp, Homo sapiens
acatgaaacccagccgtggtcc

SEQ ID NO: 9081427 - DNA, 22 bp, Homo sapiens
acatgaaacctgagtctaactc

SEQ ID NO: 9081428 - DNA, 20 bp, Homo sapiens
acatgaaaggaaacaggaaa

SEQ ID NO: 9081429 - DNA, 22 bp, Homo sapiens
aggcagtgttcttctaagggca

SEQ ID NO: 9081430 - DNA, 22 bp, Homo sapiens
aggcagtgttcttctaagggca

SEQ ID NO: 9081431 - DNA, 22 bp, Homo sapiens
aggcagtgttcttctaagggca

SEQ ID NO: 9081432 - DNA, 22 bp, Homo sapiens
aggcagtgttcttctaagggca

SEQ ID NO: 9081433 - DNA, 22 bp, Homo sapiens
acatacatgtaaaggaaattat

SEQ ID NO: 9081434 - DNA, 22 bp, Homo sapiens
acatacatggtgctttcttggt

SEQ ID NO: 9081435 - DNA, 22 bp, Homo sapiens
acatacatgggattaaaaaatt

SEQ ID NO: 9081436 - DNA, 20 bp, Homo sapiens
aggcatgggatgcccagatt

SEQ ID NO: 9081437 - DNA, 22 bp, Homo sapiens
aggcatggggctgcagtcaggt

SEQ ID NO: 9081438 - DNA, 20 bp, Homo sapiens
aggcatgggatgcccagatt

SEQ ID NO: 9081439 - DNA, 22 bp, Homo sapiens
aggcatggctttaggcaggcgt

SEQ ID NO: 9081440 - DNA, 22 bp, Homo sapiens
aggccagcacgacagccgcagg

SEQ ID NO: 9081441 - DNA, 22 bp, Homo sapiens
aggccacacaactcttagagat

SEQ ID NO: 9081442 - DNA, 22 bp, Homo sapiens
aggccacaagaactaccccatc

SEQ ID NO: 9081443 - DNA, 17 bp, Homo sapiens
aggcatggtctggggtg

SEQ ID NO: 9081444 - DNA, 22 bp, Homo sapiens
acattgaatgtatgtgatgaaa

SEQ ID NO: 9081445 - DNA, 22 bp, Homo sapiens
acattgaagggaatgcaaagat

SEQ ID NO: 9081446 - DNA, 22 bp, Homo sapiens
acattgaactacttgtaatgag

SEQ ID NO: 9081447 - DNA, 22 bp, Homo sapiens
acattgaagctgtgaaatcaaa

SEQ ID NO: 9081448 - DNA, 22 bp, Homo sapiens
acattgaacagtacaaatgatc

SEQ ID NO: 9081449 - DNA, 22 bp, Homo sapiens
acattgaacagtacaaatgatc

SEQ ID NO: 9081450 - DNA, 22 bp, Homo sapiens
acattgaacatggcaggacatt

SEQ ID NO: 9081451 - DNA, 22 bp, Homo sapiens
acattgatatttcaaatacagg

SEQ ID NO: 9081452 - DNA, 22 bp, Homo sapiens
aggctccacggtcactggctct

SEQ ID NO: 9081453 - DNA, 23 bp, Homo sapiens
aggctccactccctgggatgtgg

SEQ ID NO: 9081454 - DNA, 19 bp, Homo sapiens
acattgaattttcttcttt

SEQ ID NO: 9081455 - DNA, 22 bp, Homo sapiens
aggctccagcccaaggctgcag

SEQ ID NO: 9081456 - DNA, 22 bp, Homo sapiens
aggctccagcagccagaggaag

SEQ ID NO: 9081457 - DNA, 22 bp, Homo sapiens
aggctccaggcaaaatttcgga

SEQ ID NO: 9081458 - DNA, 22 bp, Homo sapiens
aggctccagggctgtgtgggag

SEQ ID NO: 9081459 - DNA, 23 bp, Homo sapiens
aggcttcctatcttagagctggg

SEQ ID NO: 9081460 - DNA, 18 bp, Homo sapiens
aggcttcccaggcaggcc

SEQ ID NO: 9081461 - DNA, 22 bp, Homo sapiens
acattcaagtttctgctcatgg

SEQ ID NO: 9081462 - DNA, 22 bp, Homo sapiens
acattcaagtttctgctcatgg

SEQ ID NO: 9081463 - DNA, 21 bp, Homo sapiens
acattcacaggatattatcat

SEQ ID NO: 9081464 - DNA, 22 bp, Homo sapiens
acattcaccacacttatagggc

SEQ ID NO: 9081465 - DNA, 22 bp, Homo sapiens
acattcaaggccttctgacaca

SEQ ID NO: 9081466 - DNA, 22 bp, Homo sapiens
acattcaaggccttctgacaca

SEQ ID NO: 9081467 - DNA, 22 bp, Homo sapiens
acattcaaggcagcactgagtg

SEQ ID NO: 9081468 - DNA, 22 bp, Homo sapiens
acattcaaggcagcactgagtg

SEQ ID NO: 9081469 - DNA, 22 bp, Homo sapiens
aggccctgcattgtactgaggg

SEQ ID NO: 9081470 - DNA, 22 bp, Homo sapiens
acattcaagatgcattcactta

SEQ ID NO: 9081471 - DNA, 22 bp, Homo sapiens
acattcaagatgcattcactta

SEQ ID NO: 9081472 - DNA, 22 bp, Homo sapiens
acattacactgtggtcctgttc

SEQ ID NO: 9081473 - DNA, 23 bp, Homo sapiens
acattacacgcagtaattgcccc

SEQ ID NO: 9081474 - DNA, 22 bp, Homo sapiens
acattctatgaagataatttta

SEQ ID NO: 9081475 - DNA, 22 bp, Homo sapiens
acattctagatatgttatattt

SEQ ID NO: 9081476 - DNA, 22 bp, Homo sapiens
acattcttggactccactctag

SEQ ID NO: 9081477 - DNA, 22 bp, Homo sapiens
acattctatggttgatgagttg

SEQ ID NO: 9081478 - DNA, 22 bp, Homo sapiens
acattctacagttaaccattag

SEQ ID NO: 9081479 - DNA, 22 bp, Homo sapiens
acattctacagttaaccattag

SEQ ID NO: 9081480 - DNA, 22 bp, Homo sapiens
acattctaacattgtacagata

SEQ ID NO: 9081481 - DNA, 22 bp, Homo sapiens
acattctacagttaaccattag

SEQ ID NO: 9081482 - DNA, 22 bp, Homo sapiens
acattcctgaggaaatacattc

SEQ ID NO: 9081483 - DNA, 22 bp, Homo sapiens
ccctgccagatgtgcttcagtt

SEQ ID NO: 9081484 - DNA, 17 bp, Homo sapiens
ccctgccaccaggaagc

SEQ ID NO: 9081485 - DNA, 18 bp, Homo sapiens
ccctgccagctcccagca

SEQ ID NO: 9081486 - DNA, 18 bp, Homo sapiens
ccctgccagctcccagca

SEQ ID NO: 9081487 - DNA, 22 bp, Homo sapiens
ccctgccaatcccgtctctctg

SEQ ID NO: 9081488 - DNA, 22 bp, Homo sapiens
ccctcccaggagtggccagaga

SEQ ID NO: 9081489 - DNA, 22 bp, Homo sapiens
ccctgatggcctatctggcagt

SEQ ID NO: 9081490 - DNA, 22 bp, Homo sapiens
ccctgatgttttctctgccttt

SEQ ID NO: 9081491 - DNA, 22 bp, Homo sapiens
ccctcccaggagtggccagaga

SEQ ID NO: 9081492 - DNA, 22 bp, Homo sapiens
ccctcccagatgggcttgaggt

SEQ ID NO: 9081493 - DNA, 22 bp, Homo sapiens
ccctcccagatgggcttgaggt

SEQ ID NO: 9081494 - DNA, 20 bp, Homo sapiens
ccctcccagatgcttcccaa

SEQ ID NO: 9081495 - DNA, 20 bp, Homo sapiens
ccctcccagatgcttcccaa

SEQ ID NO: 9081496 - DNA, 22 bp, Homo sapiens
ccctcccaagcactctgacata

SEQ ID NO: 9081497 - DNA, 22 bp, Homo sapiens
ccctcccaagcactctgacata

SEQ ID NO: 9081498 - DNA, 22 bp, Homo sapiens
ccctcccaagcactctgacata

SEQ ID NO: 9081499 - DNA, 22 bp, Homo sapiens
ccctcccaagcactctgacata

SEQ ID NO: 9081500 - DNA, 22 bp, Homo sapiens
ccctccatgagtgtgctgctgg

SEQ ID NO: 9081501 - DNA, 22 bp, Homo sapiens
ccctcagctccaccctcagcag

SEQ ID NO: 9081502 - DNA, 22 bp, Homo sapiens
ccctgccagggtcctgacagac

SEQ ID NO: 9081503 - DNA, 22 bp, Homo sapiens
ccctgccagggtcctgacagac

SEQ ID NO: 9081504 - DNA, 22 bp, Homo sapiens
ccctgcccaccacatgctggga

SEQ ID NO: 9081505 - DNA, 22 bp, Homo sapiens
ccctgctgtcaggtgctgggag

SEQ ID NO: 9081506 - DNA, 22 bp, Homo sapiens
ccctgccctggagacacttaaa

SEQ ID NO: 9081507 - DNA, 22 bp, Homo sapiens
ccctaggctgggctcttggctt

SEQ ID NO: 9081508 - DNA, 22 bp, Homo sapiens
ccctaggctgaggccagggtgc

SEQ ID NO: 9081509 - DNA, 22 bp, Homo sapiens
ccccagcactaccagaagccag

SEQ ID NO: 9081510 - DNA, 22 bp, Homo sapiens
ccccagcactctgactcttacc

SEQ ID NO: 9081511 - DNA, 21 bp, Homo sapiens
ccccagcaccttgccagcctg

SEQ ID NO: 9081512 - DNA, 22 bp, Homo sapiens
ccccagcacaggctcctcagat

SEQ ID NO: 9081513 - DNA, 22 bp, Homo sapiens
ccctcactgtccttgggccctt

SEQ ID NO: 9081514 - DNA, 22 bp, Homo sapiens
ccctcacttcacgctctgcaga

SEQ ID NO: 9081515 - DNA, 22 bp, Homo sapiens
ccctcacttcacgctctgcaga

SEQ ID NO: 9081516 - DNA, 22 bp, Homo sapiens
ccctcaccaggctccaggcatg

SEQ ID NO: 9081517 - DNA, 22 bp, Homo sapiens
ccctcaccaggctccaggcatg

SEQ ID NO: 9081518 - DNA, 22 bp, Homo sapiens
ccctaggggcaatgatggtgct

SEQ ID NO: 9081519 - DNA, 22 bp, Homo sapiens
cccatgagattctgaatttggc

SEQ ID NO: 9081520 - DNA, 22 bp, Homo sapiens
cccatgaggtggaggttgcagt

SEQ ID NO: 9081521 - DNA, 22 bp, Homo sapiens
cccatgagtgctgctcagaggc

SEQ ID NO: 9081522 - DNA, 22 bp, Homo sapiens
cccatggcaataaggtcacagg

SEQ ID NO: 9081523 - DNA, 22 bp, Homo sapiens
cccatggcttaggagggagtgt

SEQ ID NO: 9081524 - DNA, 22 bp, Homo sapiens
cccatggcagtcagagataaga

SEQ ID NO: 9081525 - DNA, 22 bp, Homo sapiens
cccatggggacaccatgaagga

SEQ ID NO: 9081526 - DNA, 22 bp, Homo sapiens
cccatgctgagtggcctgagat

SEQ ID NO: 9081527 - DNA, 22 bp, Homo sapiens
cccatggagtgcctgagggcca

SEQ ID NO: 9081528 - DNA, 22 bp, Homo sapiens
cccatgccttctgactcacagg

SEQ ID NO: 9081529 - DNA, 22 bp, Homo sapiens
ccccagagtgagggattgagtg

SEQ ID NO: 9081530 - DNA, 22 bp, Homo sapiens
ccccagagtgagggattgagtg

SEQ ID NO: 9081531 - DNA, 22 bp, Homo sapiens
ccccagagagcaccatgaagcc

SEQ ID NO: 9081532 - DNA, 22 bp, Homo sapiens
ccccagagagcaccatgaagcc

SEQ ID NO: 9081533 - DNA, 22 bp, Homo sapiens
ccccagagaaagtcagcagcat

SEQ ID NO: 9081534 - DNA, 22 bp, Homo sapiens
ccccagaagtttgcacaagaga

SEQ ID NO: 9081535 - DNA, 22 bp, Homo sapiens
ccccagagaaagtcagcagcat

SEQ ID NO: 9081536 - DNA, 22 bp, Homo sapiens
ccccactctcggccagataggc

SEQ ID NO: 9081537 - DNA, 22 bp, Homo sapiens
ccccagaaagcctggcactagg

SEQ ID NO: 9081538 - DNA, 22 bp, Homo sapiens
ccccagaaggggacagagggta

SEQ ID NO: 9081539 - DNA, 22 bp, Homo sapiens
aggctgtcatggctataggccc

SEQ ID NO: 9081540 - DNA, 21 bp, Homo sapiens
aggctgtcctttgccagccct

SEQ ID NO: 9081541 - DNA, 22 bp, Homo sapiens
aggctgtctcacctcaggaggg

SEQ ID NO: 9081542 - DNA, 22 bp, Homo sapiens
aggctgtctgaccccagagccc

SEQ ID NO: 9081543 - DNA, 22 bp, Homo sapiens
aggctgtctgaccccagagccc

SEQ ID NO: 9081544 - DNA, 22 bp, Homo sapiens
aggctgtctcagcctgcttgca

SEQ ID NO: 9081545 - DNA, 22 bp, Homo sapiens
aggctggtgtgtcctgaagcct

SEQ ID NO: 9081546 - DNA, 22 bp, Homo sapiens
aggctggtgtctctgtcctgtc

SEQ ID NO: 9081547 - DNA, 22 bp, Homo sapiens
aggctgtcatctttgcaggcag

SEQ ID NO: 9081548 - DNA, 22 bp, Homo sapiens
aggctgtcatctttgcaggcag

SEQ ID NO: 9081549 - DNA, 22 bp, Homo sapiens
aggctggtgcctgcagtgaatc

SEQ ID NO: 9081550 - DNA, 22 bp, Homo sapiens
aggctggtgcctgcagtgaatc

SEQ ID NO: 9081551 - DNA, 22 bp, Homo sapiens
aggctggtgattagaagcagcc

SEQ ID NO: 9081552 - DNA, 22 bp, Homo sapiens
aggctggtcccagggagggaat

SEQ ID NO: 9081553 - DNA, 22 bp, Homo sapiens
aggctggtctatacggagacga

SEQ ID NO: 9081554 - DNA, 22 bp, Homo sapiens
aggctggtctatacggagacga

SEQ ID NO: 9081555 - DNA, 22 bp, Homo sapiens
aggctggtagtatttagtcaca

SEQ ID NO: 9081556 - DNA, 22 bp, Homo sapiens
aggctggtagtatttagtcaca

SEQ ID NO: 9081557 - DNA, 22 bp, Homo sapiens
cccaggagatgcactccattgg

SEQ ID NO: 9081558 - DNA, 22 bp, Homo sapiens
cccaggagatggaggttgcagt

SEQ ID NO: 9081559 - DNA, 22 bp, Homo sapiens
cccaggagatggaggttgcagt

SEQ ID NO: 9081560 - DNA, 20 bp, Homo sapiens
cccaggagctgtgccccatc

SEQ ID NO: 9081561 - DNA, 20 bp, Homo sapiens
cccaggagctgtgccccatc

SEQ ID NO: 9081562 - DNA, 22 bp, Homo sapiens
cccaggagcttctctctgcctc

SEQ ID NO: 9081563 - DNA, 23 bp, Homo sapiens
cccaggagcctgagtcctctctg

SEQ ID NO: 9081564 - DNA, 23 bp, Homo sapiens
cccaggagcctgagtcctctctg

SEQ ID NO: 9081565 - DNA, 22 bp, Homo sapiens
cccaggaggtagaggttgcagt

SEQ ID NO: 9081566 - DNA, 22 bp, Homo sapiens
cccaggagggtggcctctgccc

SEQ ID NO: 9081567 - DNA, 22 bp, Homo sapiens
cccaggagcttctctctgcctc

SEQ ID NO: 9081568 - DNA, 22 bp, Homo sapiens
cccaggaggtagaggttgcagt

SEQ ID NO: 9081569 - DNA, 22 bp, Homo sapiens
cccagtttcaactttccagtgg

SEQ ID NO: 9081570 - DNA, 22 bp, Homo sapiens
cccatccctgattttcactcgt

SEQ ID NO: 9081571 - DNA, 22 bp, Homo sapiens
cccagtacctctgttccctgct

SEQ ID NO: 9081572 - DNA, 22 bp, Homo sapiens
cccaggcttttctcttgcccca

SEQ ID NO: 9081573 - DNA, 22 bp, Homo sapiens
cccaggcttttctcttgcccca

SEQ ID NO: 9081574 - DNA, 22 bp, Homo sapiens
cccaggcttttaagttagacag

SEQ ID NO: 9081575 - DNA, 22 bp, Homo sapiens
cccaggcttttaagttagacag

SEQ ID NO: 9081576 - DNA, 22 bp, Homo sapiens
cccaggcttttctcttgcccca

SEQ ID NO: 9081577 - DNA, 22 bp, Homo sapiens
cccaggcttttctcttgcccca

SEQ ID NO: 9081578 - DNA, 22 bp, Homo sapiens
cccaggctggaattccaggcct

SEQ ID NO: 9081579 - DNA, 18 bp, Homo sapiens
cccaggctttgtgggtct

SEQ ID NO: 9081580 - DNA, 18 bp, Homo sapiens
cccaggctttgtgggtct

SEQ ID NO: 9081581 - DNA, 22 bp, Homo sapiens
cccaggctgtgcaaacttcaaa

SEQ ID NO: 9081582 - DNA, 22 bp, Homo sapiens
cccaggctgcatgagtccatgg

SEQ ID NO: 9081583 - DNA, 22 bp, Homo sapiens
cccaggctgcatgagtccatgg

SEQ ID NO: 9081584 - DNA, 22 bp, Homo sapiens
cccaggctgatgggatgggcca

SEQ ID NO: 9081585 - DNA, 22 bp, Homo sapiens
cccaggctgatgttcagcgggt

SEQ ID NO: 9081586 - DNA, 22 bp, Homo sapiens
cccaggctgatgttcagcgggt

SEQ ID NO: 9081587 - DNA, 22 bp, Homo sapiens
cccaggctgatgttcagcgggt

SEQ ID NO: 9081588 - DNA, 22 bp, Homo sapiens
cccaggaggtcgaagctgcagt

SEQ ID NO: 9081589 - DNA, 22 bp, Homo sapiens
cccaggaggtcgaagctgcagt

SEQ ID NO: 9081590 - DNA, 22 bp, Homo sapiens
cccaggaggtcgaagctgcagt

SEQ ID NO: 9081591 - DNA, 22 bp, Homo sapiens
cccaggaggtggagcttgcagt

SEQ ID NO: 9081592 - DNA, 23 bp, Homo sapiens
cccaggctacaaattatgctctg

SEQ ID NO: 9081593 - DNA, 22 bp, Homo sapiens
cccaggaggtcgaagctgcagt

SEQ ID NO: 9081594 - DNA, 22 bp, Homo sapiens
cccaggaggtcaaggctgcagt

SEQ ID NO: 9081595 - DNA, 22 bp, Homo sapiens
cccaggaggtcaaggctgcagt

SEQ ID NO: 9081596 - DNA, 22 bp, Homo sapiens
cccaggaggtcaaggctgcagt

SEQ ID NO: 9081597 - DNA, 22 bp, Homo sapiens
aggggaggtgtccccaaatctc

SEQ ID NO: 9081598 - DNA, 22 bp, Homo sapiens
aggggaggcagcgataaacctg

SEQ ID NO: 9081599 - DNA, 22 bp, Homo sapiens
aggggaggcagcgataaacctg

SEQ ID NO: 9081600 - DNA, 22 bp, Homo sapiens
aggggagagttaatgtgaatgt

SEQ ID NO: 9081601 - DNA, 22 bp, Homo sapiens
agggctggctaggtgcgttccc

SEQ ID NO: 9081602 - DNA, 22 bp, Homo sapiens
agggctggcatctctaatgctg

SEQ ID NO: 9081603 - DNA, 22 bp, Homo sapiens
agggctggccacatgatttggt

SEQ ID NO: 9081604 - DNA, 22 bp, Homo sapiens
cctcttccactgggccccatcc

SEQ ID NO: 9081605 - DNA, 22 bp, Homo sapiens
cctcttccactgggccccatcc

SEQ ID NO: 9081606 - DNA, 22 bp, Homo sapiens
aggggcacttctcaggctgtgg

SEQ ID NO: 9081607 - DNA, 23 bp, Homo sapiens
aggggcagcaagttttggtgtta

SEQ ID NO: 9081608 - DNA, 22 bp, Homo sapiens
aggggatggagctggaaggcag

SEQ ID NO: 9081609 - DNA, 20 bp, Homo sapiens
aggggcacctgcgacggggc

SEQ ID NO: 9081610 - DNA, 19 bp, Homo sapiens
aggggcactgtctctagag

SEQ ID NO: 9081611 - DNA, 22 bp, Homo sapiens
aggggcactagaatgggagact

SEQ ID NO: 9081612 - DNA, 22 bp, Homo sapiens
aggggcacgagtagagctctag

SEQ ID NO: 9081613 - DNA, 22 bp, Homo sapiens
aggggatggagctggaaggcag

SEQ ID NO: 9081614 - DNA, 22 bp, Homo sapiens
aggggatggagctggaaggcag

SEQ ID NO: 9081615 - DNA, 22 bp, Homo sapiens
aggggatggagctggaaggcag

SEQ ID NO: 9081616 - DNA, 22 bp, Homo sapiens
cctgaagagcactctagagttg

SEQ ID NO: 9081617 - DNA, 22 bp, Homo sapiens
cctgaagagcactctagagttg

SEQ ID NO: 9081618 - DNA, 22 bp, Homo sapiens
cctgaagaattcaaatccagat

SEQ ID NO: 9081619 - DNA, 22 bp, Homo sapiens
cctgaagagtgaatgtggcagt

SEQ ID NO: 9081620 - DNA, 22 bp, Homo sapiens
cctgaagagtgaatgtggcagt

SEQ ID NO: 9081621 - DNA, 22 bp, Homo sapiens
cctgaagatgctgtggcctggt

SEQ ID NO: 9081622 - DNA, 22 bp, Homo sapiens
cctgaagatgagggacagctaa

SEQ ID NO: 9081623 - DNA, 22 bp, Homo sapiens
cctgaagatgctgtggcctggt

SEQ ID NO: 9081624 - DNA, 22 bp, Homo sapiens
cctgaagaaaattccacgagaa

SEQ ID NO: 9081625 - DNA, 22 bp, Homo sapiens
cctgagagagtgagccctgaca

SEQ ID NO: 9081626 - DNA, 22 bp, Homo sapiens
cctgagagagtgagccctgaca

SEQ ID NO: 9081627 - DNA, 22 bp, Homo sapiens
cctgaagatgctgtggcctggt

SEQ ID NO: 9081628 - DNA, 22 bp, Homo sapiens
cctgagagagaagcgacctggt

SEQ ID NO: 9081629 - DNA, 22 bp, Homo sapiens
cctgagagccctagccaggcgc

SEQ ID NO: 9081630 - DNA, 22 bp, Homo sapiens
cctgagagccagtgcctgccca

SEQ ID NO: 9081631 - DNA, 22 bp, Homo sapiens
cctgagagccctagccaggcgc

SEQ ID NO: 9081632 - DNA, 22 bp, Homo sapiens
cctgagagggggccctagaaat

SEQ ID NO: 9081633 - DNA, 22 bp, Homo sapiens
cctgagaggccctctcactgtc

SEQ ID NO: 9081634 - DNA, 22 bp, Homo sapiens
agggtcaagaataaagattaca

SEQ ID NO: 9081635 - DNA, 22 bp, Homo sapiens
agggtcaacactttaaacatat

SEQ ID NO: 9081636 - DNA, 22 bp, Homo sapiens
agggtatgttttaggctgagtt

SEQ ID NO: 9081637 - DNA, 22 bp, Homo sapiens
agggtagggtaaatgatgcatc

SEQ ID NO: 9081638 - DNA, 22 bp, Homo sapiens
agggtagggccgtagggccatg

SEQ ID NO: 9081639 - DNA, 22 bp, Homo sapiens
agggtaggaactgagtggaagg

SEQ ID NO: 9081640 - DNA, 22 bp, Homo sapiens
cctgagagtgagtgccacctta

SEQ ID NO: 9081641 - DNA, 22 bp, Homo sapiens
cctgagagtgagggcctcctta

SEQ ID NO: 9081642 - DNA, 22 bp, Homo sapiens
cctgagagtgagtgccacctta

SEQ ID NO: 9081643 - DNA, 22 bp, Homo sapiens
agggtagggcccggagacagac

SEQ ID NO: 9081644 - DNA, 22 bp, Homo sapiens
agggtaggaactgagtggaagg

SEQ ID NO: 9081645 - DNA, 22 bp, Homo sapiens
agggcctgctctatcactctca

SEQ ID NO: 9081646 - DNA, 22 bp, Homo sapiens
agggcctgctctatcactctca

SEQ ID NO: 9081647 - DNA, 20 bp, Homo sapiens
agggcctgctctgtggtgtc

SEQ ID NO: 9081648 - DNA, 20 bp, Homo sapiens
agggcctgctctgtggtgtc

SEQ ID NO: 9081649 - DNA, 20 bp, Homo sapiens
agggcctgctctgtggtgtc

SEQ ID NO: 9081650 - DNA, 22 bp, Homo sapiens
agggcctggaactgtgggcagg

SEQ ID NO: 9081651 - DNA, 22 bp, Homo sapiens
agggcctggaactgtgggcagg

SEQ ID NO: 9081652 - DNA, 22 bp, Homo sapiens
agggcctggaactgtgggcagg

SEQ ID NO: 9081653 - DNA, 22 bp, Homo sapiens
agggcctggactaattggatcc

SEQ ID NO: 9081654 - DNA, 22 bp, Homo sapiens
agggcctggaactggagaccac

SEQ ID NO: 9081655 - DNA, 22 bp, Homo sapiens
agggcctggaactggagaccac

SEQ ID NO: 9081656 - DNA, 22 bp, Homo sapiens
agggcctggaactggagaccac

SEQ ID NO: 9081657 - DNA, 20 bp, Homo sapiens
agggcctggagtacagcagg

SEQ ID NO: 9081658 - DNA, 22 bp, Homo sapiens
agggcctggactaattggatcc

SEQ ID NO: 9081659 - DNA, 23 bp, Homo sapiens
agggcctggcgtggagtgtgtgc

SEQ ID NO: 9081660 - DNA, 22 bp, Homo sapiens
agggcctggcgcgtggccgccg

SEQ ID NO: 9081661 - DNA, 23 bp, Homo sapiens
agggcctggcgtggagtgtgtgc

SEQ ID NO: 9081662 - DNA, 22 bp, Homo sapiens
cctcagcttgatttctgcagag

SEQ ID NO: 9081663 - DNA, 22 bp, Homo sapiens
cctcagcttgatttctgcagag

SEQ ID NO: 9081664 - DNA, 22 bp, Homo sapiens
agggcctgaggctgacggggag

SEQ ID NO: 9081665 - DNA, 22 bp, Homo sapiens
agggcctgaggctgacggggag

SEQ ID NO: 9081666 - DNA, 23 bp, Homo sapiens
agggcctgatggctcccgctggc

SEQ ID NO: 9081667 - DNA, 23 bp, Homo sapiens
agggcctgatggctcccgctggc

SEQ ID NO: 9081668 - DNA, 22 bp, Homo sapiens
agggcctgagctggctgacctc

SEQ ID NO: 9081669 - DNA, 22 bp, Homo sapiens
agggcctgagctggctgacctc

SEQ ID NO: 9081670 - DNA, 22 bp, Homo sapiens
agggcctgcatcaggagcttgg

SEQ ID NO: 9081671 - DNA, 22 bp, Homo sapiens
agggcctgcatcaggagcttgg

SEQ ID NO: 9081672 - DNA, 22 bp, Homo sapiens
agggcctgcatcaggagcttgg

SEQ ID NO: 9081673 - DNA, 19 bp, Homo sapiens
agggcctgcagctcaagct

SEQ ID NO: 9081674 - DNA, 19 bp, Homo sapiens
agggcctgcagctcaagct

SEQ ID NO: 9081675 - DNA, 19 bp, Homo sapiens
agggcctgcagctcaagct

SEQ ID NO: 9081676 - DNA, 22 bp, Homo sapiens
agggcgggctcatcacatgctc

SEQ ID NO: 9081677 - DNA, 20 bp, Homo sapiens
agggcctgttgcaagcgttt

SEQ ID NO: 9081678 - DNA, 22 bp, Homo sapiens
agggccttgctgtctgaagctg

SEQ ID NO: 9081679 - DNA, 22 bp, Homo sapiens
agggcgacaatggagagcgttt

SEQ ID NO: 9081680 - DNA, 22 bp, Homo sapiens
cctcaggccctgtccctgcgcc

SEQ ID NO: 9081681 - DNA, 22 bp, Homo sapiens
cctcaggcaggaaactgtcccg

SEQ ID NO: 9081682 - DNA, 22 bp, Homo sapiens
cctcaggcaggaaactgtcccg

SEQ ID NO: 9081683 - DNA, 22 bp, Homo sapiens
cctcaggccagggggcggccag

SEQ ID NO: 9081684 - DNA, 22 bp, Homo sapiens
cctcaggcaagtcacttaacat

SEQ ID NO: 9081685 - DNA, 22 bp, Homo sapiens
cctcaggatccgcaggtgcagt

SEQ ID NO: 9081686 - DNA, 22 bp, Homo sapiens
cctcaggatacaggagccacag

SEQ ID NO: 9081687 - DNA, 22 bp, Homo sapiens
agggctggcaagggattgaaat

SEQ ID NO: 9081688 - DNA, 22 bp, Homo sapiens
agggctggagccacagctggga

SEQ ID NO: 9081689 - DNA, 22 bp, Homo sapiens
agggctggagccacagctggga

SEQ ID NO: 9081690 - DNA, 22 bp, Homo sapiens
agggctggagggtactagttta

SEQ ID NO: 9081691 - DNA, 22 bp, Homo sapiens
ccaggtcttcactttactgaag

SEQ ID NO: 9081692 - DNA, 22 bp, Homo sapiens
ccaggtctgtcttcttagctca

SEQ ID NO: 9081693 - DNA, 19 bp, Homo sapiens
ccaggtctggggccagatt

SEQ ID NO: 9081694 - DNA, 22 bp, Homo sapiens
ccaggtctggaaccaccagggc

SEQ ID NO: 9081695 - DNA, 22 bp, Homo sapiens
ccaggtctggcactggccagtc

SEQ ID NO: 9081696 - DNA, 22 bp, Homo sapiens
ccaggtctttggccttggcact

SEQ ID NO: 9081697 - DNA, 22 bp, Homo sapiens
aggctgctcagtagatggagct

SEQ ID NO: 9081698 - DNA, 22 bp, Homo sapiens
ccaggtcttggcccccggacct

SEQ ID NO: 9081699 - DNA, 21 bp, Homo sapiens
ccaggtcttggtccttggact

SEQ ID NO: 9081700 - DNA, 21 bp, Homo sapiens
ccaggtcttggtccttggact

SEQ ID NO: 9081701 - DNA, 22 bp, Homo sapiens
ccaggtcttgtttgacatcaat

SEQ ID NO: 9081702 - DNA, 22 bp, Homo sapiens
ccaggtctttgactaatatgct

SEQ ID NO: 9081703 - DNA, 22 bp, Homo sapiens
ccaggtcttgtttgacatcaat

SEQ ID NO: 9081704 - DNA, 22 bp, Homo sapiens
aggctggaaagggaccagagtg

SEQ ID NO: 9081705 - DNA, 22 bp, Homo sapiens
aggctggaaagggaccagagtg

SEQ ID NO: 9081706 - DNA, 22 bp, Homo sapiens
aggctggagtgctggagtgctg

SEQ ID NO: 9081707 - DNA, 22 bp, Homo sapiens
aggctggagtgcaatggcgtga

SEQ ID NO: 9081708 - DNA, 22 bp, Homo sapiens
aggctggagtgcaatggcgtga

SEQ ID NO: 9081709 - DNA, 22 bp, Homo sapiens
aggctggagtgcagtggcgtga

SEQ ID NO: 9081710 - DNA, 22 bp, Homo sapiens
aggctggccagtgctgcagtgg

SEQ ID NO: 9081711 - DNA, 22 bp, Homo sapiens
aggctggagtgtagcagtgcag

SEQ ID NO: 9081712 - DNA, 22 bp, Homo sapiens
aggctggagtacagtggctatt

SEQ ID NO: 9081713 - DNA, 22 bp, Homo sapiens
aggctggaggtttgttgcggct

SEQ ID NO: 9081714 - DNA, 22 bp, Homo sapiens
aggctggagggcaatggcaaga

SEQ ID NO: 9081715 - DNA, 22 bp, Homo sapiens
aggctggagcaagggggcatat

SEQ ID NO: 9081716 - DNA, 19 bp, Homo sapiens
aggctggagacaccaggcc

SEQ ID NO: 9081717 - DNA, 22 bp, Homo sapiens
aggctggagacccgccaagaaa

SEQ ID NO: 9081718 - DNA, 22 bp, Homo sapiens
aggctggagagtgcagtggcgt

SEQ ID NO: 9081719 - DNA, 22 bp, Homo sapiens
aggctggagagtgcagtggcgt

SEQ ID NO: 9081720 - DNA, 22 bp, Homo sapiens
aggctggcggtgactgctctga

SEQ ID NO: 9081721 - DNA, 22 bp, Homo sapiens
aggctggcggtgactgctctga

SEQ ID NO: 9081722 - DNA, 22 bp, Homo sapiens
ccatttagtaaggaagaacagc

SEQ ID NO: 9081723 - DNA, 22 bp, Homo sapiens
ccatttggaggtcattaggaca

SEQ ID NO: 9081724 - DNA, 22 bp, Homo sapiens
ccatttcattgcctgtaaagtg

SEQ ID NO: 9081725 - DNA, 22 bp, Homo sapiens
ccatttggtatagtgaaaagga

SEQ ID NO: 9081726 - DNA, 22 bp, Homo sapiens
ccatttggcaagaaagagtcat

SEQ ID NO: 9081727 - DNA, 22 bp, Homo sapiens
aggctggcgacatctggcgggc

SEQ ID NO: 9081728 - DNA, 22 bp, Homo sapiens
aggctggccctactggctgcct

SEQ ID NO: 9081729 - DNA, 22 bp, Homo sapiens
aggctggggaattgaatttgct

SEQ ID NO: 9081730 - DNA, 22 bp, Homo sapiens
aggctggctggggatgcgtctt

SEQ ID NO: 9081731 - DNA, 22 bp, Homo sapiens
ccatttgtattactgccccagg

SEQ ID NO: 9081732 - DNA, 22 bp, Homo sapiens
aggctaagatgtggtctgagca

SEQ ID NO: 9081733 - DNA, 22 bp, Homo sapiens
aggctaagaaagattcattgca

SEQ ID NO: 9081734 - DNA, 22 bp, Homo sapiens
aggctaagaggccttcagatac

SEQ ID NO: 9081735 - DNA, 22 bp, Homo sapiens
aggctaagaggccttcagatac

SEQ ID NO: 9081736 - DNA, 22 bp, Homo sapiens
ccaggctctgcgctggacatgg

SEQ ID NO: 9081737 - DNA, 22 bp, Homo sapiens
ccaggctgctgttggtgtccgc

SEQ ID NO: 9081738 - DNA, 22 bp, Homo sapiens
ccaggctctgcgctggacatgg

SEQ ID NO: 9081739 - DNA, 22 bp, Homo sapiens
ccaggctgcttagccttatctt

SEQ ID NO: 9081740 - DNA, 22 bp, Homo sapiens
ccaggctgctgttggtgtccgc

SEQ ID NO: 9081741 - DNA, 22 bp, Homo sapiens
ccaggctgctgttggtgtccgc

SEQ ID NO: 9081742 - DNA, 22 bp, Homo sapiens
aggctacatgttggggtggaag

SEQ ID NO: 9081743 - DNA, 22 bp, Homo sapiens
aggctacagatacagaggctac

SEQ ID NO: 9081744 - DNA, 22 bp, Homo sapiens
ccaggctgcttagccttatctt

SEQ ID NO: 9081745 - DNA, 22 bp, Homo sapiens
ccaggctgctttattactctgt

SEQ ID NO: 9081746 - DNA, 22 bp, Homo sapiens
ccaggctgctttattactctgt

SEQ ID NO: 9081747 - DNA, 22 bp, Homo sapiens
ccaggctgctttattactctgt

SEQ ID NO: 9081748 - DNA, 22 bp, Homo sapiens
ccaggctggaatcaatattctg

SEQ ID NO: 9081749 - DNA, 22 bp, Homo sapiens
ccaggctggagtatagtggcgc

SEQ ID NO: 9081750 - DNA, 22 bp, Homo sapiens
ccaggctggagtatagtggcgc

SEQ ID NO: 9081751 - DNA, 22 bp, Homo sapiens
ccaggctggagtatagtggcgc

SEQ ID NO: 9081752 - DNA, 22 bp, Homo sapiens
ccaggctggagtatagtggcgc

SEQ ID NO: 9081753 - DNA, 22 bp, Homo sapiens
ccaggctggagtatagtggcgc

SEQ ID NO: 9081754 - DNA, 22 bp, Homo sapiens
ccaggctggtctgaatttctag

SEQ ID NO: 9081755 - DNA, 15 bp, Homo sapiens
ccaggctgggtgagc

SEQ ID NO: 9081756 - DNA, 22 bp, Homo sapiens
ccaggctgggctacaagttgag

SEQ ID NO: 9081757 - DNA, 22 bp, Homo sapiens
ccaggctgggctacaagttgag

SEQ ID NO: 9081758 - DNA, 22 bp, Homo sapiens
ccaggctgggctacaagttgag

SEQ ID NO: 9081759 - DNA, 22 bp, Homo sapiens
ccaggctgggctacaagttgag

SEQ ID NO: 9081760 - DNA, 22 bp, Homo sapiens
ccaggctgggctacaagttgag

SEQ ID NO: 9081761 - DNA, 22 bp, Homo sapiens
ccaggctgggctacaagttgag

SEQ ID NO: 9081762 - DNA, 21 bp, Homo sapiens
ccaggctgggagggcagttcc

SEQ ID NO: 9081763 - DNA, 22 bp, Homo sapiens
ccaggctgggcggggaacctgg

SEQ ID NO: 9081764 - DNA, 22 bp, Homo sapiens
ccaggctgggcggggaacctgg

SEQ ID NO: 9081765 - DNA, 22 bp, Homo sapiens
ccaggctgggcggggaacctgg

SEQ ID NO: 9081766 - DNA, 22 bp, Homo sapiens
aggctgaggatcgtactttcca

SEQ ID NO: 9081767 - DNA, 22 bp, Homo sapiens
aggctgaggatccctgtgttct

SEQ ID NO: 9081768 - DNA, 22 bp, Homo sapiens
ccagggctggtgggagatgctg

SEQ ID NO: 9081769 - DNA, 22 bp, Homo sapiens
aggctgagctgacctggtttgg

SEQ ID NO: 9081770 - DNA, 22 bp, Homo sapiens
ccaggtctgcgggcggcaggca

SEQ ID NO: 9081771 - DNA, 22 bp, Homo sapiens
ccaggtctggaaccaccagggc

SEQ ID NO: 9081772 - DNA, 22 bp, Homo sapiens
ccaggtctcgggtctgctcgtg

SEQ ID NO: 9081773 - DNA, 22 bp, Homo sapiens
ccaggtctgcgggcggcaggca

SEQ ID NO: 9081774 - DNA, 22 bp, Homo sapiens
aggctgaggcaggtggatcacc

SEQ ID NO: 9081775 - DNA, 22 bp, Homo sapiens
aggctgaggcaagaggatcact

SEQ ID NO: 9081776 - DNA, 22 bp, Homo sapiens
aggctgaggcaagaggatcact

SEQ ID NO: 9081777 - DNA, 22 bp, Homo sapiens
aggctgaggcaagaggatcact

SEQ ID NO: 9081778 - DNA, 20 bp, Homo sapiens
ccagggctggctcctgggat

SEQ ID NO: 9081779 - DNA, 22 bp, Homo sapiens
ccaggctgtaaacaccttcaaa

SEQ ID NO: 9081780 - DNA, 22 bp, Homo sapiens
ccagggcctcgtgttctgagtg

SEQ ID NO: 9081781 - DNA, 22 bp, Homo sapiens
ccagggcctgccacttagcaag

SEQ ID NO: 9081782 - DNA, 23 bp, Homo sapiens
ccagggctacgggcaccgtcctg

SEQ ID NO: 9081783 - DNA, 22 bp, Homo sapiens
ccagctgacgatgcctggtctc

SEQ ID NO: 9081784 - DNA, 22 bp, Homo sapiens
ccagctcttttggctgagtgag

SEQ ID NO: 9081785 - DNA, 22 bp, Homo sapiens
ccagctcttttggctgagtgag

SEQ ID NO: 9081786 - DNA, 22 bp, Homo sapiens
ccagctggaacggcagcccagc

SEQ ID NO: 9081787 - DNA, 22 bp, Homo sapiens
ccagctggaaacaaatagagtg

SEQ ID NO: 9081788 - DNA, 22 bp, Homo sapiens
ccagctgagaagtgtaaagtga

SEQ ID NO: 9081789 - DNA, 22 bp, Homo sapiens
ccagctggaagagtgcagaact

SEQ ID NO: 9081790 - DNA, 22 bp, Homo sapiens
ccagctggaagagtgcagaact

SEQ ID NO: 9081791 - DNA, 22 bp, Homo sapiens
ccagctggaagagtgcagaact

SEQ ID NO: 9081792 - DNA, 22 bp, Homo sapiens
ccagctggaacggcagcccagc

SEQ ID NO: 9081793 - DNA, 22 bp, Homo sapiens
ccagctggaagagtgcagaact

SEQ ID NO: 9081794 - DNA, 22 bp, Homo sapiens
ccagctggaagagtgcagaact

SEQ ID NO: 9081795 - DNA, 22 bp, Homo sapiens
ccagctggagctcgcagatagg

SEQ ID NO: 9081796 - DNA, 22 bp, Homo sapiens
ccagctggagctcgcagatagg

SEQ ID NO: 9081797 - DNA, 22 bp, Homo sapiens
ccagctggagccaaggtggact

SEQ ID NO: 9081798 - DNA, 22 bp, Homo sapiens
ccagctggagctcgcagatagg

SEQ ID NO: 9081799 - DNA, 22 bp, Homo sapiens
ccagctggagccaaggtggact

SEQ ID NO: 9081800 - DNA, 22 bp, Homo sapiens
ccagctggcactgtggctgccc

SEQ ID NO: 9081801 - DNA, 22 bp, Homo sapiens
ccagctggagctcgcagatagg

SEQ ID NO: 9081802 - DNA, 22 bp, Homo sapiens
ccagctggagctcgcagatagg

SEQ ID NO: 9081803 - DNA, 22 bp, Homo sapiens
ccagctggcaggagagtcaggg

SEQ ID NO: 9081804 - DNA, 22 bp, Homo sapiens
ccagctggcaggagagtcaggg

SEQ ID NO: 9081805 - DNA, 22 bp, Homo sapiens
ccagctggcaggagagtcaggg

SEQ ID NO: 9081806 - DNA, 22 bp, Homo sapiens
ccagctggcaggagagtcaggg

SEQ ID NO: 9081807 - DNA, 22 bp, Homo sapiens
ccagctggcaggagagtcaggg

SEQ ID NO: 9081808 - DNA, 22 bp, Homo sapiens
aggcctgcctggatcacacaga

SEQ ID NO: 9081809 - DNA, 22 bp, Homo sapiens
aggcctctggaggtggcagtgt

SEQ ID NO: 9081810 - DNA, 22 bp, Homo sapiens
aggcctctgctggaaagagttg

SEQ ID NO: 9081811 - DNA, 22 bp, Homo sapiens
ccagctggcccagctgtgctcc

SEQ ID NO: 9081812 - DNA, 22 bp, Homo sapiens
ccagcaggagatgcctgtgtct

SEQ ID NO: 9081813 - DNA, 22 bp, Homo sapiens
ccagcaggagatgcctgtgtct

SEQ ID NO: 9081814 - DNA, 23 bp, Homo sapiens
ccagctccgtgagcctcgggctc

SEQ ID NO: 9081815 - DNA, 22 bp, Homo sapiens
ccagctccggtgtgcttatttc

SEQ ID NO: 9081816 - DNA, 22 bp, Homo sapiens
ccagctctgtaagctgtgaaat

SEQ ID NO: 9081817 - DNA, 22 bp, Homo sapiens
ccagctcttggtgcacttacat

SEQ ID NO: 9081818 - DNA, 22 bp, Homo sapiens
ccagctcttttggctgagtgag

SEQ ID NO: 9081819 - DNA, 22 bp, Homo sapiens
ccagctctggcttcttgctggg

SEQ ID NO: 9081820 - DNA, 22 bp, Homo sapiens
ccagctctggcttcttgctggg

SEQ ID NO: 9081821 - DNA, 22 bp, Homo sapiens
ccagctctggcttcttgctggg

SEQ ID NO: 9081822 - DNA, 22 bp, Homo sapiens
ccagctctgcttgcccagtcag

SEQ ID NO: 9081823 - DNA, 21 bp, Homo sapiens
ccagctctgcctccagttggt

SEQ ID NO: 9081824 - DNA, 22 bp, Homo sapiens
ccagctctgcttgcccagtcag

SEQ ID NO: 9081825 - DNA, 22 bp, Homo sapiens
ccagctctgcttgcccagtcag

SEQ ID NO: 9081826 - DNA, 22 bp, Homo sapiens
ccaggaaggtatgggaagaaaa

SEQ ID NO: 9081827 - DNA, 22 bp, Homo sapiens
ccaggaaggtgtttaactagag

SEQ ID NO: 9081828 - DNA, 22 bp, Homo sapiens
ccaggaagtatgacccaacaga

SEQ ID NO: 9081829 - DNA, 22 bp, Homo sapiens
aggcctggtgtgccggatgcag

SEQ ID NO: 9081830 - DNA, 22 bp, Homo sapiens
aggcctgtaattttcctctttt

SEQ ID NO: 9081831 - DNA, 22 bp, Homo sapiens
aggcctgtaatcccagcacttt

SEQ ID NO: 9081832 - DNA, 22 bp, Homo sapiens
aggcgctgcgctggggccagaa

SEQ ID NO: 9081833 - DNA, 22 bp, Homo sapiens
aggcgctgtgcttggggctgga

SEQ ID NO: 9081834 - DNA, 22 bp, Homo sapiens
aggcgctgcgctggggccagaa

SEQ ID NO: 9081835 - DNA, 22 bp, Homo sapiens
ccaggaaggtatgggaagaaaa

SEQ ID NO: 9081836 - DNA, 22 bp, Homo sapiens
ccaggaaggcaggcctccccgc

SEQ ID NO: 9081837 - DNA, 22 bp, Homo sapiens
aggcctgggacgggagccgtga

SEQ ID NO: 9081838 - DNA, 22 bp, Homo sapiens
aggcctgggacgggagccgtga

SEQ ID NO: 9081839 - DNA, 22 bp, Homo sapiens
ccaggaaggatcgtttgggagt

SEQ ID NO: 9081840 - DNA, 22 bp, Homo sapiens
ccaggaaggcaggcctccccgc

SEQ ID NO: 9081841 - DNA, 22 bp, Homo sapiens
ccaggaaggcaggcctccccgc

SEQ ID NO: 9081842 - DNA, 18 bp, Homo sapiens
aggcctgggaagctgagg

SEQ ID NO: 9081843 - DNA, 18 bp, Homo sapiens
aggcctgggaagctgagg

SEQ ID NO: 9081844 - DNA, 22 bp, Homo sapiens
aggcctggcatgagacctgaga

SEQ ID NO: 9081845 - DNA, 22 bp, Homo sapiens
aggcctggccccagttgctagg

SEQ ID NO: 9081846 - DNA, 22 bp, Homo sapiens
aggcctggccccagttgctagg

SEQ ID NO: 9081847 - DNA, 22 bp, Homo sapiens
aggcctggccccagttgctagg

SEQ ID NO: 9081848 - DNA, 22 bp, Homo sapiens
aggcctggcatgagacctgaga

SEQ ID NO: 9081849 - DNA, 22 bp, Homo sapiens
aggcctggcctgggcggcattg

SEQ ID NO: 9081850 - DNA, 22 bp, Homo sapiens
aggcctggcctgggcggcattg

SEQ ID NO: 9081851 - DNA, 22 bp, Homo sapiens
aggcctggctttggtttgctga

SEQ ID NO: 9081852 - DNA, 22 bp, Homo sapiens
aggcctggctttggtttgctga

SEQ ID NO: 9081853 - DNA, 22 bp, Homo sapiens
aggcctggcctttatgttcaag

SEQ ID NO: 9081854 - DNA, 22 bp, Homo sapiens
aggcctggcctttatgttcaag

SEQ ID NO: 9081855 - DNA, 22 bp, Homo sapiens
aggcctggcctttatgttcaag

SEQ ID NO: 9081856 - DNA, 22 bp, Homo sapiens
aggccacagttgaggccagcaa

SEQ ID NO: 9081857 - DNA, 22 bp, Homo sapiens
aggccaccaccctatctcctgg

SEQ ID NO: 9081858 - DNA, 22 bp, Homo sapiens
aggccagaaaaagacagctcca

SEQ ID NO: 9081859 - DNA, 22 bp, Homo sapiens
ccagagcctggcatctgcataa

SEQ ID NO: 9081860 - DNA, 22 bp, Homo sapiens
ccagagctgagggagcctgagc

SEQ ID NO: 9081861 - DNA, 22 bp, Homo sapiens
ccagagctccagggctacagaa

SEQ ID NO: 9081862 - DNA, 17 bp, Homo sapiens
ccagagctactgagact

SEQ ID NO: 9081863 - DNA, 22 bp, Homo sapiens
aggcccagactcagcggggcgg

SEQ ID NO: 9081864 - DNA, 22 bp, Homo sapiens
aggccatgtggccccagagtct

SEQ ID NO: 9081865 - DNA, 22 bp, Homo sapiens
aggccatgggatttccaattgg

SEQ ID NO: 9081866 - DNA, 22 bp, Homo sapiens
aggccatgccaggcccaggaag

SEQ ID NO: 9081867 - DNA, 22 bp, Homo sapiens
aggccatgaggtcatgggagat

SEQ ID NO: 9081868 - DNA, 22 bp, Homo sapiens
ccagcagctttgcatacactaa

SEQ ID NO: 9081869 - DNA, 19 bp, Homo sapiens
ccagcagctttgattctct

SEQ ID NO: 9081870 - DNA, 22 bp, Homo sapiens
aggccaggtggtcatgcttgct

SEQ ID NO: 9081871 - DNA, 22 bp, Homo sapiens
aggccaggttcctcaatcttga

SEQ ID NO: 9081872 - DNA, 22 bp, Homo sapiens
aggccacagttgaggccagcaa

SEQ ID NO: 9081873 - DNA, 22 bp, Homo sapiens
ccagagaaaaatgtgtccctgt

SEQ ID NO: 9081874 - DNA, 22 bp, Homo sapiens
ccagactgtggagttcctggtg

SEQ ID NO: 9081875 - DNA, 22 bp, Homo sapiens
ccagactgtcagcaacttcaag

SEQ ID NO: 9081876 - DNA, 22 bp, Homo sapiens
ccagactggggctccttgaggg

SEQ ID NO: 9081877 - DNA, 22 bp, Homo sapiens
ccagagaaaagaggccaaggat

SEQ ID NO: 9081878 - DNA, 22 bp, Homo sapiens
ccagagaaagctcacaggcagt

SEQ ID NO: 9081879 - DNA, 22 bp, Homo sapiens
ccagaccaccctggccatgcac

SEQ ID NO: 9081880 - DNA, 22 bp, Homo sapiens
ccagaccctccattcaagctcc

SEQ ID NO: 9081881 - DNA, 22 bp, Homo sapiens
ccagaccagactgacttgagcc

SEQ ID NO: 9081882 - DNA, 21 bp, Homo sapiens
ccagactggcctatgtggtag

SEQ ID NO: 9081883 - DNA, 21 bp, Homo sapiens
ccagactggcctatgtggtag

SEQ ID NO: 9081884 - DNA, 22 bp, Homo sapiens
ccagaccctgctctggggctct

SEQ ID NO: 9081885 - DNA, 22 bp, Homo sapiens
ccagaaaatgcagaacatagaa

SEQ ID NO: 9081886 - DNA, 22 bp, Homo sapiens
ccagaaaatatggctaaggtga

SEQ ID NO: 9081887 - DNA, 22 bp, Homo sapiens
ccagaaaatatggctaaggtga

SEQ ID NO: 9081888 - DNA, 22 bp, Homo sapiens
ccagaaaatgcagaacatagaa

SEQ ID NO: 9081889 - DNA, 22 bp, Homo sapiens
ccagaaagaatgaactgaaccc

SEQ ID NO: 9081890 - DNA, 22 bp, Homo sapiens
ccagaaagactttttaggtacg

SEQ ID NO: 9081891 - DNA, 22 bp, Homo sapiens
aggcaggctgctatggagtaga

SEQ ID NO: 9081892 - DNA, 22 bp, Homo sapiens
ccactgggggctgctcccaggt

SEQ ID NO: 9081893 - DNA, 22 bp, Homo sapiens
ccagaaagttcagctgtgaatg

SEQ ID NO: 9081894 - DNA, 22 bp, Homo sapiens
ccagaacacagtggaagaatat

SEQ ID NO: 9081895 - DNA, 22 bp, Homo sapiens
ccagaagaacttaattcaaaac

SEQ ID NO: 9081896 - DNA, 22 bp, Homo sapiens
catgtctgagtagagtgtgatt

SEQ ID NO: 9081897 - DNA, 22 bp, Homo sapiens
catgtgtgaatcttgtgatcat

SEQ ID NO: 9081898 - DNA, 21 bp, Homo sapiens
catgtgtcttgtgttactgct

SEQ ID NO: 9081899 - DNA, 22 bp, Homo sapiens
catgtgtcctagctattctcct

SEQ ID NO: 9081900 - DNA, 22 bp, Homo sapiens
aggcacagggatgcggagccag

SEQ ID NO: 9081901 - DNA, 23 bp, Homo sapiens
aggatcctggtacaggagcagag

SEQ ID NO: 9081902 - DNA, 22 bp, Homo sapiens
aggatctgtgagtgctgcagac

SEQ ID NO: 9081903 - DNA, 22 bp, Homo sapiens
aggatcctgtatggagaagctg

SEQ ID NO: 9081904 - DNA, 22 bp, Homo sapiens
aggatataaaaagactatttgg

SEQ ID NO: 9081905 - DNA, 22 bp, Homo sapiens
aggataagtttgattcttgcca

SEQ ID NO: 9081906 - DNA, 22 bp, Homo sapiens
aggagtttatccgagggcataa

SEQ ID NO: 9081907 - DNA, 22 bp, Homo sapiens
aggagttatggcagaatcaaat

SEQ ID NO: 9081908 - DNA, 21 bp, Homo sapiens
aggagttgctgtggcctggtt

SEQ ID NO: 9081909 - DNA, 22 bp, Homo sapiens
aggcactttccttgaggagttt

SEQ ID NO: 9081910 - DNA, 22 bp, Homo sapiens
aggcactgattctgttttccat

SEQ ID NO: 9081911 - DNA, 22 bp, Homo sapiens
aggcactgagaggctgtgttgc

SEQ ID NO: 9081912 - DNA, 22 bp, Homo sapiens
aggcactgattctcagagttac

SEQ ID NO: 9081913 - DNA, 22 bp, Homo sapiens
aggcagagagcagtggccgtct

SEQ ID NO: 9081914 - DNA, 16 bp, Homo sapiens
aggcagagatttaccc

SEQ ID NO: 9081915 - DNA, 22 bp, Homo sapiens
aggcactgactcaagggagcca

SEQ ID NO: 9081916 - DNA, 22 bp, Homo sapiens
aggcactgactcaagggagcca

SEQ ID NO: 9081917 - DNA, 22 bp, Homo sapiens
aggcactgacctgcttccttga

SEQ ID NO: 9081918 - DNA, 22 bp, Homo sapiens
aggcactgactcaagggagcca

SEQ ID NO: 9081919 - DNA, 22 bp, Homo sapiens
aggcactgacaattctggactg

SEQ ID NO: 9081920 - DNA, 22 bp, Homo sapiens
aggcactgacagattctgtgtc

SEQ ID NO: 9081921 - DNA, 23 bp, Homo sapiens
aggcactgaatgtgtcagtgagt

SEQ ID NO: 9081922 - DNA, 22 bp, Homo sapiens
aggcactgaaggaagcttgcgc

SEQ ID NO: 9081923 - DNA, 22 bp, Homo sapiens
aggcactgaaggaagcttgcgc

SEQ ID NO: 9081924 - DNA, 22 bp, Homo sapiens
aggcactgaagaactctttttg

SEQ ID NO: 9081925 - DNA, 22 bp, Homo sapiens
aggcactgaagtggtaaatgta

SEQ ID NO: 9081926 - DNA, 22 bp, Homo sapiens
aggcactgaatatccagtaaaa

SEQ ID NO: 9081927 - DNA, 22 bp, Homo sapiens
aggcactgaagaactctttttg

SEQ ID NO: 9081928 - DNA, 22 bp, Homo sapiens
aggcactgaaaggtggccagag

SEQ ID NO: 9081929 - DNA, 22 bp, Homo sapiens
aggcactgaaaggtggccagag

SEQ ID NO: 9081930 - DNA, 20 bp, Homo sapiens
aggcacagttcctagttggg

SEQ ID NO: 9081931 - DNA, 19 bp, Homo sapiens
aggcacaggttgtctggac

SEQ ID NO: 9081932 - DNA, 19 bp, Homo sapiens
aggcacaggttgtctggac

SEQ ID NO: 9081933 - DNA, 20 bp, Homo sapiens
aggcacagttcctagttggg

SEQ ID NO: 9081934 - DNA, 18 bp, Homo sapiens
aggcaggcggatcacaag

SEQ ID NO: 9081935 - DNA, 22 bp, Homo sapiens
aggcaggcctacacaatgggag

SEQ ID NO: 9081936 - DNA, 22 bp, Homo sapiens
aggcaggccctctggaaaggta

SEQ ID NO: 9081937 - DNA, 22 bp, Homo sapiens
aggcaggccctctggaaaggta

SEQ ID NO: 9081938 - DNA, 22 bp, Homo sapiens
aggcaggccctgggccatcccg

SEQ ID NO: 9081939 - DNA, 22 bp, Homo sapiens
aggcaggccctgggccatcccg

SEQ ID NO: 9081940 - DNA, 22 bp, Homo sapiens
aggcaggctagtcgcttgagcc

SEQ ID NO: 9081941 - DNA, 22 bp, Homo sapiens
aggcaggctagtcgcttgagcc

SEQ ID NO: 9081942 - DNA, 22 bp, Homo sapiens
aggcaggctagtcgcttgagcc

SEQ ID NO: 9081943 - DNA, 22 bp, Homo sapiens
aggcaggctcaggcccatgctt

SEQ ID NO: 9081944 - DNA, 22 bp, Homo sapiens
aggcaggctcaggcccatgctt

SEQ ID NO: 9081945 - DNA, 22 bp, Homo sapiens
aggcaggctctgggtatgtgca

SEQ ID NO: 9081946 - DNA, 22 bp, Homo sapiens
ccaaaatgtttgaatgcatgtg

SEQ ID NO: 9081947 - DNA, 22 bp, Homo sapiens
ccaaaataacagcccaattcac

SEQ ID NO: 9081948 - DNA, 22 bp, Homo sapiens
ccaaaataacagcccaattcac

SEQ ID NO: 9081949 - DNA, 22 bp, Homo sapiens
ccaaaatattagtgcttaagta

SEQ ID NO: 9081950 - DNA, 22 bp, Homo sapiens
ccaaaatattagtgcttaagta

SEQ ID NO: 9081951 - DNA, 22 bp, Homo sapiens
ccaaacaaatccccattcttag

SEQ ID NO: 9081952 - DNA, 22 bp, Homo sapiens
ccaaactgtgtcgtctgcatag

SEQ ID NO: 9081953 - DNA, 22 bp, Homo sapiens
ccaaactgtttcgtatttatgc

SEQ ID NO: 9081954 - DNA, 22 bp, Homo sapiens
ccaaagaaacccaagctcaggg

SEQ ID NO: 9081955 - DNA, 22 bp, Homo sapiens
ccaaacaaatccccattcttag

SEQ ID NO: 9081956 - DNA, 23 bp, Homo sapiens
aggcaggcagttcagctgttgtt

SEQ ID NO: 9081957 - DNA, 22 bp, Homo sapiens
aggcaggcccctgagaatagac

SEQ ID NO: 9081958 - DNA, 22 bp, Homo sapiens
aggcaggcccctgagaatagac

SEQ ID NO: 9081959 - DNA, 18 bp, Homo sapiens
aggcaggatcctggcctc

SEQ ID NO: 9081960 - DNA, 22 bp, Homo sapiens
ccaaagcaagtcacatgatcaa

SEQ ID NO: 9081961 - DNA, 22 bp, Homo sapiens
ccaaagcaagtcacatgatcaa

SEQ ID NO: 9081962 - DNA, 19 bp, Homo sapiens
ccaaaggaagtttccctcc

SEQ ID NO: 9081963 - DNA, 22 bp, Homo sapiens
ccaaaggatgtccctgtgtttt

SEQ ID NO: 9081964 - DNA, 22 bp, Homo sapiens
ccaaagagctagaattataggc

SEQ ID NO: 9081965 - DNA, 22 bp, Homo sapiens
ccaaagcaagtcacatgatcaa

SEQ ID NO: 9081966 - DNA, 22 bp, Homo sapiens
aggcagagctaggaagaattgt

SEQ ID NO: 9081967 - DNA, 22 bp, Homo sapiens
aggcagagctgatgttctgtga

SEQ ID NO: 9081968 - DNA, 22 bp, Homo sapiens
aggcagagctgatgttctgtga

SEQ ID NO: 9081969 - DNA, 22 bp, Homo sapiens
aggcagagctgatgttctgtga

SEQ ID NO: 9081970 - DNA, 22 bp, Homo sapiens
aggcagagctgatgttctgtga

SEQ ID NO: 9081971 - DNA, 22 bp, Homo sapiens
aggcagaggagaatgatcttcc

SEQ ID NO: 9081972 - DNA, 22 bp, Homo sapiens
aggcagaggagaatgatcttcc

SEQ ID NO: 9081973 - DNA, 22 bp, Homo sapiens
aggcagaggagaatgatcttcc

SEQ ID NO: 9081974 - DNA, 23 bp, Homo sapiens
aggcagctgggtagcatctttct

SEQ ID NO: 9081975 - DNA, 20 bp, Homo sapiens
aggcagctgggaaatgaggg

SEQ ID NO: 9081976 - DNA, 20 bp, Homo sapiens
aggcagctgggaaatgaggg

SEQ ID NO: 9081977 - DNA, 20 bp, Homo sapiens
aggcagctgggaaatgaggg

SEQ ID NO: 9081978 - DNA, 22 bp, Homo sapiens
aggcagctgtgaggactggatt

SEQ ID NO: 9081979 - DNA, 20 bp, Homo sapiens
aggcagctggccaggcaggt

SEQ ID NO: 9081980 - DNA, 20 bp, Homo sapiens
aggcagctggccaggcaggt

SEQ ID NO: 9081981 - DNA, 20 bp, Homo sapiens
aggcagctggccaggcaggt

SEQ ID NO: 9081982 - DNA, 20 bp, Homo sapiens
aggcagctggccaggcaggt

SEQ ID NO: 9081983 - DNA, 22 bp, Homo sapiens
aggcagcgtagcaaggctagta

SEQ ID NO: 9081984 - DNA, 19 bp, Homo sapiens
aggcagaggcttggctagc

SEQ ID NO: 9081985 - DNA, 22 bp, Homo sapiens
aggcagaggagaatgatcttcc

SEQ ID NO: 9081986 - DNA, 22 bp, Homo sapiens
aggcagctggcagcacccaggg

SEQ ID NO: 9081987 - DNA, 22 bp, Homo sapiens
aggcagctggcagcacccaggg

SEQ ID NO: 9081988 - DNA, 22 bp, Homo sapiens
aggcagctggcagcacccaggg

SEQ ID NO: 9081989 - DNA, 22 bp, Homo sapiens
aggcagctggcagcacccaggg

SEQ ID NO: 9081990 - DNA, 22 bp, Homo sapiens
aggcagctggcaaattctagag

SEQ ID NO: 9081991 - DNA, 22 bp, Homo sapiens
aggcagcgtagcaaggctagta

SEQ ID NO: 9081992 - DNA, 21 bp, Homo sapiens
aggcagcgtgagggccactca

SEQ ID NO: 9081993 - DNA, 22 bp, Homo sapiens
aggcagctgtgaggactggatt

SEQ ID NO: 9081994 - DNA, 22 bp, Homo sapiens
aggcagcttctgattagcagcg

SEQ ID NO: 9081995 - DNA, 22 bp, Homo sapiens
aggcagcttaagccctggccca

SEQ ID NO: 9081996 - DNA, 22 bp, Homo sapiens
aggcagcttaagccctggccca

SEQ ID NO: 9081997 - DNA, 22 bp, Homo sapiens
aggcagctgtgaggactggatt

SEQ ID NO: 9081998 - DNA, 22 bp, Homo sapiens
aggcagcttaagccctggccca

SEQ ID NO: 9081999 - DNA, 22 bp, Homo sapiens
aggcagcttctgattagcagcg

SEQ ID NO: 9082000 - DNA, 22 bp, Homo sapiens
aggcagctttaactggtagtag

SEQ ID NO: 9082001 - DNA, 22 bp, Homo sapiens
aggcagctttaactggtagtag

SEQ ID NO: 9082002 - DNA, 22 bp, Homo sapiens
aggcagctttcagtgtctctca

SEQ ID NO: 9082003 - DNA, 22 bp, Homo sapiens
aggcagctttcagtgtctctca

SEQ ID NO: 9082004 - DNA, 22 bp, Homo sapiens
aggcagctttctggtgcaccat

SEQ ID NO: 9082005 - DNA, 22 bp, Homo sapiens
aggcagctttctggtgcaccat

SEQ ID NO: 9082006 - DNA, 22 bp, Homo sapiens
aggcagctttaactggtagtag

SEQ ID NO: 9082007 - DNA, 22 bp, Homo sapiens
aggcagctttgtagtaaagcta

SEQ ID NO: 9082008 - DNA, 22 bp, Homo sapiens
aggcagctttctgtaggggtgt

SEQ ID NO: 9082009 - DNA, 22 bp, Homo sapiens
aggcagctttctgtaggggtgt

SEQ ID NO: 9082010 - DNA, 22 bp, Homo sapiens
aggcagctttgtagtaaagcta

SEQ ID NO: 9082011 - DNA, 22 bp, Homo sapiens
aggagctgggagaaggactaaa

SEQ ID NO: 9082012 - DNA, 22 bp, Homo sapiens
aggagctgggagaaggactaaa

SEQ ID NO: 9082013 - DNA, 22 bp, Homo sapiens
aggagctgggagaaggactaaa

SEQ ID NO: 9082014 - DNA, 22 bp, Homo sapiens
aggagctgggagaaggactaaa

SEQ ID NO: 9082015 - DNA, 22 bp, Homo sapiens
aggagctgggctgctgctggga

SEQ ID NO: 9082016 - DNA, 22 bp, Homo sapiens
aggagctgggctgctgctggga

SEQ ID NO: 9082017 - DNA, 17 bp, Homo sapiens
aggagctgggggtggtg

SEQ ID NO: 9082018 - DNA, 22 bp, Homo sapiens
aggagctggcctagaaaggaga

SEQ ID NO: 9082019 - DNA, 22 bp, Homo sapiens
aggagctggcctagaaaggaga

SEQ ID NO: 9082020 - DNA, 22 bp, Homo sapiens
aggagctggcctagaaaggaga

SEQ ID NO: 9082021 - DNA, 22 bp, Homo sapiens
aggagctggcctagaaaggaga

SEQ ID NO: 9082022 - DNA, 22 bp, Homo sapiens
aggagctggccactaggatgca

SEQ ID NO: 9082023 - DNA, 22 bp, Homo sapiens
aggagctgatgattctttgatc

SEQ ID NO: 9082024 - DNA, 22 bp, Homo sapiens
aggagctgatagtctatggaga

SEQ ID NO: 9082025 - DNA, 22 bp, Homo sapiens
aggagctgatagtctatggaga

SEQ ID NO: 9082026 - DNA, 22 bp, Homo sapiens
aggagctgatagtctatggaga

SEQ ID NO: 9082027 - DNA, 22 bp, Homo sapiens
cagtggaagactcagctctccc

SEQ ID NO: 9082028 - DNA, 22 bp, Homo sapiens
aggagcagattggtaagatcat

SEQ ID NO: 9082029 - DNA, 22 bp, Homo sapiens
aggagatggagctcagtgggca

SEQ ID NO: 9082030 - DNA, 22 bp, Homo sapiens
aggagcagcccactcctgtcct

SEQ ID NO: 9082031 - DNA, 22 bp, Homo sapiens
aggagcagcccactcctgtcct

SEQ ID NO: 9082032 - DNA, 22 bp, Homo sapiens
aggagcagcccactcctgtcct

SEQ ID NO: 9082033 - DNA, 22 bp, Homo sapiens
aggagccaaattactagctctg

SEQ ID NO: 9082034 - DNA, 22 bp, Homo sapiens
aggagccaaattactagctctg

SEQ ID NO: 9082035 - DNA, 22 bp, Homo sapiens
aggagcagcttctgaaccatgt

SEQ ID NO: 9082036 - DNA, 22 bp, Homo sapiens
cagtgctgttgtaagctcattg

SEQ ID NO: 9082037 - DNA, 22 bp, Homo sapiens
aggagccaaggaaaacagtatt

SEQ ID NO: 9082038 - DNA, 22 bp, Homo sapiens
aggagccaagatgctgtctggc

SEQ ID NO: 9082039 - DNA, 22 bp, Homo sapiens
cagtgaggagtccagggcagag

SEQ ID NO: 9082040 - DNA, 22 bp, Homo sapiens
aggacaaaggaccagatctgga

SEQ ID NO: 9082041 - DNA, 22 bp, Homo sapiens
aggacaaaggaccagatctgga

SEQ ID NO: 9082042 - DNA, 22 bp, Homo sapiens
aggaattgagatcctaggtttt

SEQ ID NO: 9082043 - DNA, 22 bp, Homo sapiens
aggaattcaagaccagctgggc

SEQ ID NO: 9082044 - DNA, 22 bp, Homo sapiens
aggaattttgtatggatactgt

SEQ ID NO: 9082045 - DNA, 22 bp, Homo sapiens
aggaatttggggttacatgatg

SEQ ID NO: 9082046 - DNA, 22 bp, Homo sapiens
aggaattggttcaaggtttatc

SEQ ID NO: 9082047 - DNA, 22 bp, Homo sapiens
aggaattgtgttgtagtggaga

SEQ ID NO: 9082048 - DNA, 22 bp, Homo sapiens
aggaatttagacagggcataaa

SEQ ID NO: 9082049 - DNA, 22 bp, Homo sapiens
cagtgagggaagatctcagcac

SEQ ID NO: 9082050 - DNA, 22 bp, Homo sapiens
cagtgagggcccccttccaggt

SEQ ID NO: 9082051 - DNA, 20 bp, Homo sapiens
aggagatgatccagagtcag

SEQ ID NO: 9082052 - DNA, 22 bp, Homo sapiens
cagtgcagccaaggacaggcac

SEQ ID NO: 9082053 - DNA, 22 bp, Homo sapiens
cagttccatcttcatctttccc

SEQ ID NO: 9082054 - DNA, 19 bp, Homo sapiens
cagttccagcttcttgacc

SEQ ID NO: 9082055 - DNA, 19 bp, Homo sapiens
cagttccagcttcttgacc

SEQ ID NO: 9082056 - DNA, 22 bp, Homo sapiens
cagttcaaaattttgaagaagg

SEQ ID NO: 9082057 - DNA, 22 bp, Homo sapiens
cagttcaaagttaagcagcagt

SEQ ID NO: 9082058 - DNA, 22 bp, Homo sapiens
cagttcaaaattttgaagaagg

SEQ ID NO: 9082059 - DNA, 22 bp, Homo sapiens
cagttataggagccattgtata

SEQ ID NO: 9082060 - DNA, 22 bp, Homo sapiens
cagttctacttggatgtctgca

SEQ ID NO: 9082061 - DNA, 22 bp, Homo sapiens
cagttctatcattttagagatg

SEQ ID NO: 9082062 - DNA, 22 bp, Homo sapiens
cagttctatcattttagagatg

SEQ ID NO: 9082063 - DNA, 22 bp, Homo sapiens
cagttctaattaataggagtaa

SEQ ID NO: 9082064 - DNA, 22 bp, Homo sapiens
cagttctcttgatcgtctcttg

SEQ ID NO: 9082065 - DNA, 22 bp, Homo sapiens
cagttctctgtgcctcgctggg

SEQ ID NO: 9082066 - DNA, 22 bp, Homo sapiens
catattttagttgctgaacagc

SEQ ID NO: 9082067 - DNA, 19 bp, Homo sapiens
catatttttgggctggcat

SEQ ID NO: 9082068 - DNA, 22 bp, Homo sapiens
catattttagttgctgaacagc

SEQ ID NO: 9082069 - DNA, 22 bp, Homo sapiens
catcagaaaccttgaggaaact

SEQ ID NO: 9082070 - DNA, 22 bp, Homo sapiens
catcactggctgctgacagatg

SEQ ID NO: 9082071 - DNA, 22 bp, Homo sapiens
catcagaaccagtggggacatt

SEQ ID NO: 9082072 - DNA, 22 bp, Homo sapiens
catcagaaccagctgggtgagg

SEQ ID NO: 9082073 - DNA, 22 bp, Homo sapiens
catcagaaggccagagggtagc

SEQ ID NO: 9082074 - DNA, 22 bp, Homo sapiens
aggaggctgggcacagtggcct

SEQ ID NO: 9082075 - DNA, 22 bp, Homo sapiens
aggaggctggttcaggccatat

SEQ ID NO: 9082076 - DNA, 22 bp, Homo sapiens
aggaggctgcaaccctgaggcc

SEQ ID NO: 9082077 - DNA, 22 bp, Homo sapiens
aggaggctgcaaccctgaggcc

SEQ ID NO: 9082078 - DNA, 22 bp, Homo sapiens
catcagaggtacttaatgaatg

SEQ ID NO: 9082079 - DNA, 23 bp, Homo sapiens
catcagaggttgccactccctgg

SEQ ID NO: 9082080 - DNA, 22 bp, Homo sapiens
catcagaatgttagagaaggga

SEQ ID NO: 9082081 - DNA, 22 bp, Homo sapiens
catcagaattacttggggagct

SEQ ID NO: 9082082 - DNA, 22 bp, Homo sapiens
aggagggtggggtctgcctgtc

SEQ ID NO: 9082083 - DNA, 22 bp, Homo sapiens
aggagggtggggtctgcctgtc

SEQ ID NO: 9082084 - DNA, 22 bp, Homo sapiens
aggaggctggttcaggccatat

SEQ ID NO: 9082085 - DNA, 22 bp, Homo sapiens
aggaggctggttcaggccatat

SEQ ID NO: 9082086 - DNA, 22 bp, Homo sapiens
aggagggtttcaatgggatgag

SEQ ID NO: 9082087 - DNA, 22 bp, Homo sapiens
aggagggttctctggacagagg

SEQ ID NO: 9082088 - DNA, 22 bp, Homo sapiens
aggaggtcagagccccatgctg

SEQ ID NO: 9082089 - DNA, 22 bp, Homo sapiens
aggaggtgagcggtcatgtggt

SEQ ID NO: 9082090 - DNA, 22 bp, Homo sapiens
aggaggtgagcggtcatgtggt

SEQ ID NO: 9082091 - DNA, 23 bp, Homo sapiens
catcatgcaatcttgggatttct

SEQ ID NO: 9082092 - DNA, 22 bp, Homo sapiens
catcatgccccgctacagtgca

SEQ ID NO: 9082093 - DNA, 22 bp, Homo sapiens
catcatttgtttgcatgcagga

SEQ ID NO: 9082094 - DNA, 22 bp, Homo sapiens
catcatttcacttagatgaagt

SEQ ID NO: 9082095 - DNA, 22 bp, Homo sapiens
catcattgttagggactctaac

SEQ ID NO: 9082096 - DNA, 21 bp, Homo sapiens
catcatgcttgtgttggagaa

SEQ ID NO: 9082097 - DNA, 22 bp, Homo sapiens
catcatgccccgctacagtgca

SEQ ID NO: 9082098 - DNA, 22 bp, Homo sapiens
aggaggttgccagtctgggggt

SEQ ID NO: 9082099 - DNA, 22 bp, Homo sapiens
catcattttattaaccaagaaa

SEQ ID NO: 9082100 - DNA, 22 bp, Homo sapiens
aggagtggtgcaggacctgcca

SEQ ID NO: 9082101 - DNA, 22 bp, Homo sapiens
agctgctttgccaatgcgttcc

SEQ ID NO: 9082102 - DNA, 21 bp, Homo sapiens
agctgctttcagctcctagag

SEQ ID NO: 9082103 - DNA, 21 bp, Homo sapiens
agctggaatctggctgtgctt

SEQ ID NO: 9082104 - DNA, 22 bp, Homo sapiens
agctggaagctgatgagcacag

SEQ ID NO: 9082105 - DNA, 18 bp, Homo sapiens
agctgcttttggcttaaa

SEQ ID NO: 9082106 - DNA, 22 bp, Homo sapiens
agctggaacccgggtgggcagc

SEQ ID NO: 9082107 - DNA, 22 bp, Homo sapiens
agctgcctccatggtcaaagat

SEQ ID NO: 9082108 - DNA, 22 bp, Homo sapiens
agctgcctgcttatgagctcca

SEQ ID NO: 9082109 - DNA, 21 bp, Homo sapiens
agctgcctccacttctgaggc

SEQ ID NO: 9082110 - DNA, 22 bp, Homo sapiens
agctgccgatgcccagctgcat

SEQ ID NO: 9082111 - DNA, 22 bp, Homo sapiens
agctgccctgggtcttgctgct

SEQ ID NO: 9082112 - DNA, 22 bp, Homo sapiens
agctgccctgggtcttgctgct

SEQ ID NO: 9082113 - DNA, 22 bp, Homo sapiens
agctgcccttctcttgcccttg

SEQ ID NO: 9082114 - DNA, 22 bp, Homo sapiens
agctgccctttatgatgctgaa

SEQ ID NO: 9082115 - DNA, 22 bp, Homo sapiens
agctgcccccagggctgtgctt

SEQ ID NO: 9082116 - DNA, 22 bp, Homo sapiens
caggaagaccagggctgtggct

SEQ ID NO: 9082117 - DNA, 22 bp, Homo sapiens
agctgccactgagggtgcacag

SEQ ID NO: 9082118 - DNA, 22 bp, Homo sapiens
agctgccagatgacagtgctat

SEQ ID NO: 9082119 - DNA, 22 bp, Homo sapiens
agctgccctggcggagctgctc

SEQ ID NO: 9082120 - DNA, 22 bp, Homo sapiens
agctgccctggcggagctgctc

SEQ ID NO: 9082121 - DNA, 23 bp, Homo sapiens
caggaaatgcttggaggggctgg

SEQ ID NO: 9082122 - DNA, 23 bp, Homo sapiens
caggaaatgaatccaggaggatg

SEQ ID NO: 9082123 - DNA, 22 bp, Homo sapiens
caggaaatgaaagctagctaat

SEQ ID NO: 9082124 - DNA, 21 bp, Homo sapiens
caggaaatcagtgtgaattag

SEQ ID NO: 9082125 - DNA, 22 bp, Homo sapiens
caggaaatgaaagctagctaat

SEQ ID NO: 9082126 - DNA, 22 bp, Homo sapiens
caggaaatgaggctgaagggtg

SEQ ID NO: 9082127 - DNA, 22 bp, Homo sapiens
caggaaatgcgtagttgaactt

SEQ ID NO: 9082128 - DNA, 22 bp, Homo sapiens
caggaagaagggtggtgagtcc

SEQ ID NO: 9082129 - DNA, 21 bp, Homo sapiens
agctgaaaagttgtttacaag

SEQ ID NO: 9082130 - DNA, 22 bp, Homo sapiens
agctgaaacttcccattaattg

SEQ ID NO: 9082131 - DNA, 22 bp, Homo sapiens
caggaaatataggaaaaggaac

SEQ ID NO: 9082132 - DNA, 22 bp, Homo sapiens
caggaaaatctgcccacacaag

SEQ ID NO: 9082133 - DNA, 22 bp, Homo sapiens
caggaaatataggaaaaggaac

SEQ ID NO: 9082134 - DNA, 22 bp, Homo sapiens
caggaaatatctcaacacttta

SEQ ID NO: 9082135 - DNA, 22 bp, Homo sapiens
caggaaatcactctgattttgg

SEQ ID NO: 9082136 - DNA, 22 bp, Homo sapiens
caggaaatcagaactcaagtgg

SEQ ID NO: 9082137 - DNA, 22 bp, Homo sapiens
caggaaatcactctgattttgg

SEQ ID NO: 9082138 - DNA, 22 bp, Homo sapiens
caggaaatcactctgattttgg

SEQ ID NO: 9082139 - DNA, 23 bp, Homo sapiens
caggaaatcaattcttccagcat

SEQ ID NO: 9082140 - DNA, 22 bp, Homo sapiens
caggaaatatctcctggcagag

SEQ ID NO: 9082141 - DNA, 22 bp, Homo sapiens
caggaaatatctcctggcagag

SEQ ID NO: 9082142 - DNA, 22 bp, Homo sapiens
agctggtatttgttagggagtt

SEQ ID NO: 9082143 - DNA, 22 bp, Homo sapiens
agctggtatgaacaggatagga

SEQ ID NO: 9082144 - DNA, 22 bp, Homo sapiens
agctggtaaaggggaaagcaga

SEQ ID NO: 9082145 - DNA, 22 bp, Homo sapiens
agctgggtgtgtatcagataaa

SEQ ID NO: 9082146 - DNA, 22 bp, Homo sapiens
agctgggtgttcttgggcctaa

SEQ ID NO: 9082147 - DNA, 22 bp, Homo sapiens
agctgggttcagaggcacatgg

SEQ ID NO: 9082148 - DNA, 22 bp, Homo sapiens
agctgggttgacaagatggaaa

SEQ ID NO: 9082149 - DNA, 17 bp, Homo sapiens
agctgggttctcaggaa

SEQ ID NO: 9082150 - DNA, 22 bp, Homo sapiens
agctggtgctcaggggcatgga

SEQ ID NO: 9082151 - DNA, 22 bp, Homo sapiens
agctggtgctcaggggcatgga

SEQ ID NO: 9082152 - DNA, 22 bp, Homo sapiens
agctggtgcctgcttttgtgtg

SEQ ID NO: 9082153 - DNA, 22 bp, Homo sapiens
agctggtgatgtggtccctcac

SEQ ID NO: 9082154 - DNA, 20 bp, Homo sapiens
agctggtgaattaaagactg

SEQ ID NO: 9082155 - DNA, 22 bp, Homo sapiens
agctggtgagggttgaggggta

SEQ ID NO: 9082156 - DNA, 22 bp, Homo sapiens
agctggtgagggttgaggggta

SEQ ID NO: 9082157 - DNA, 22 bp, Homo sapiens
agctggtgatggcctaagaagg

SEQ ID NO: 9082158 - DNA, 22 bp, Homo sapiens
agctggtgaacctgaggcacag

SEQ ID NO: 9082159 - DNA, 18 bp, Homo sapiens
agctggtgaaatccagta

SEQ ID NO: 9082160 - DNA, 22 bp, Homo sapiens
caggcagaggcttttcatggct

SEQ ID NO: 9082161 - DNA, 22 bp, Homo sapiens
caggcagaggaagtctgggtct

SEQ ID NO: 9082162 - DNA, 22 bp, Homo sapiens
caggcagaggaagtctgggtct

SEQ ID NO: 9082163 - DNA, 20 bp, Homo sapiens
caggcagaggatgctgacca

SEQ ID NO: 9082164 - DNA, 22 bp, Homo sapiens
caggcagagtgagaagcccttg

SEQ ID NO: 9082165 - DNA, 19 bp, Homo sapiens
agctggggcggtgtgtgtt

SEQ ID NO: 9082166 - DNA, 22 bp, Homo sapiens
agctgggtgcggtggctcatgc

SEQ ID NO: 9082167 - DNA, 21 bp, Homo sapiens
agctgggtgggctgagtgaca

SEQ ID NO: 9082168 - DNA, 23 bp, Homo sapiens
agctgggtggcctgcgtgaagct

SEQ ID NO: 9082169 - DNA, 23 bp, Homo sapiens
agctgggtggcctgcgtgaagct

SEQ ID NO: 9082170 - DNA, 22 bp, Homo sapiens
agctggagagtttccaggaagg

SEQ ID NO: 9082171 - DNA, 22 bp, Homo sapiens
agctggagatcatgctgatact

SEQ ID NO: 9082172 - DNA, 22 bp, Homo sapiens
agctggagatcatgctgatact

SEQ ID NO: 9082173 - DNA, 22 bp, Homo sapiens
agctggagatcatgctgatact

SEQ ID NO: 9082174 - DNA, 22 bp, Homo sapiens
agctggagatgcccagcaccgg

SEQ ID NO: 9082175 - DNA, 20 bp, Homo sapiens
agctggagaagggcccttcc

SEQ ID NO: 9082176 - DNA, 22 bp, Homo sapiens
agctggagaaacctgggagggt

SEQ ID NO: 9082177 - DNA, 20 bp, Homo sapiens
agctggagaagggcccttcc

SEQ ID NO: 9082178 - DNA, 22 bp, Homo sapiens
agctggagaaacctgggagggt

SEQ ID NO: 9082179 - DNA, 22 bp, Homo sapiens
agctggagcttcaagcaggtaa

SEQ ID NO: 9082180 - DNA, 22 bp, Homo sapiens
agctggagccagtgtgaggctt

SEQ ID NO: 9082181 - DNA, 22 bp, Homo sapiens
agctggagccagtgtgaggctt

SEQ ID NO: 9082182 - DNA, 22 bp, Homo sapiens
agctggagcttcaagcaggtaa

SEQ ID NO: 9082183 - DNA, 19 bp, Homo sapiens
agctggagattggagggca

SEQ ID NO: 9082184 - DNA, 22 bp, Homo sapiens
agctggagattctggggacagt

SEQ ID NO: 9082185 - DNA, 22 bp, Homo sapiens
agctggagattctggggacagt

SEQ ID NO: 9082186 - DNA, 22 bp, Homo sapiens
agctggaggagtttctcctagc

SEQ ID NO: 9082187 - DNA, 22 bp, Homo sapiens
agctgggactcaactgtctggg

SEQ ID NO: 9082188 - DNA, 23 bp, Homo sapiens
agctgggccaggtggtcagacct

SEQ ID NO: 9082189 - DNA, 22 bp, Homo sapiens
agctgggctgatgactcatgtt

SEQ ID NO: 9082190 - DNA, 22 bp, Homo sapiens
agctgggcctgagctggaagct

SEQ ID NO: 9082191 - DNA, 21 bp, Homo sapiens
agctgggcctcagcctgcagt

SEQ ID NO: 9082192 - DNA, 21 bp, Homo sapiens
agctgggcctcagcctgcagt

SEQ ID NO: 9082193 - DNA, 22 bp, Homo sapiens
aggaagggttctttgtgaaaga

SEQ ID NO: 9082194 - DNA, 22 bp, Homo sapiens
caggtcccctcccctaccaggc

SEQ ID NO: 9082195 - DNA, 17 bp, Homo sapiens
caggtcccagggtctct

SEQ ID NO: 9082196 - DNA, 22 bp, Homo sapiens
aggaaggggagaagttaaagct

SEQ ID NO: 9082197 - DNA, 20 bp, Homo sapiens
aggaaggagaatctgagcaa

SEQ ID NO: 9082198 - DNA, 22 bp, Homo sapiens
aggaagggctgtttctccaaga

SEQ ID NO: 9082199 - DNA, 22 bp, Homo sapiens
caggtcctggcatcaggcaggt

SEQ ID NO: 9082200 - DNA, 22 bp, Homo sapiens
caggtcctggcatcaggcaggt

SEQ ID NO: 9082201 - DNA, 22 bp, Homo sapiens
aggaatgaactcgagtgatctg

SEQ ID NO: 9082202 - DNA, 22 bp, Homo sapiens
aggaatgaactcgagtgatctg

SEQ ID NO: 9082203 - DNA, 22 bp, Homo sapiens
caggtcctggcatcaggcaggt

SEQ ID NO: 9082204 - DNA, 22 bp, Homo sapiens
caggtcctcgggggaggccggc

SEQ ID NO: 9082205 - DNA, 22 bp, Homo sapiens
caggtcctgccttggttaccct

SEQ ID NO: 9082206 - DNA, 22 bp, Homo sapiens
caggtcctgcagggagagtaaa

SEQ ID NO: 9082207 - DNA, 23 bp, Homo sapiens
aggaatgtgcccacccatctcct

SEQ ID NO: 9082208 - DNA, 23 bp, Homo sapiens
aggaatgtgcccacccatctcct

SEQ ID NO: 9082209 - DNA, 22 bp, Homo sapiens
aggaagcaaaaggcagggtcta

SEQ ID NO: 9082210 - DNA, 22 bp, Homo sapiens
aggaagcaaaaggcagggtcta

SEQ ID NO: 9082211 - DNA, 22 bp, Homo sapiens
aggaagatgtgtttagcaggtt

SEQ ID NO: 9082212 - DNA, 20 bp, Homo sapiens
aggaaggagaatctgagcaa

SEQ ID NO: 9082213 - DNA, 22 bp, Homo sapiens
aggaagatgtgcaaagttggaa

SEQ ID NO: 9082214 - DNA, 22 bp, Homo sapiens
aggaagcaaaaggcagggtcta

SEQ ID NO: 9082215 - DNA, 22 bp, Homo sapiens
aggaagaggtgtgcaatggtgt

SEQ ID NO: 9082216 - DNA, 22 bp, Homo sapiens
aggaagaggtagctgtcaaggg

SEQ ID NO: 9082217 - DNA, 22 bp, Homo sapiens
aggaagaggtgtgcaatggtgt

SEQ ID NO: 9082218 - DNA, 22 bp, Homo sapiens
aggaagagtgttacctatgggt

SEQ ID NO: 9082219 - DNA, 22 bp, Homo sapiens
aggaagagtgttacctatgggt

SEQ ID NO: 9082220 - DNA, 21 bp, Homo sapiens
aggaagatctggaggtcggcg

SEQ ID NO: 9082221 - DNA, 22 bp, Homo sapiens
cagggtttcaccatgttagcag

SEQ ID NO: 9082222 - DNA, 22 bp, Homo sapiens
cagggtttcaccatgttagcag

SEQ ID NO: 9082223 - DNA, 22 bp, Homo sapiens
aggaagaggtagctgtcaaggg

SEQ ID NO: 9082224 - DNA, 22 bp, Homo sapiens
aggaagaggtagctgtcaaggg

SEQ ID NO: 9082225 - DNA, 22 bp, Homo sapiens
aggaagagggtggcagataatc

SEQ ID NO: 9082226 - DNA, 22 bp, Homo sapiens
aggaaacatccttatctattct

SEQ ID NO: 9082227 - DNA, 22 bp, Homo sapiens
aggaaacatgaatctgccttga

SEQ ID NO: 9082228 - DNA, 22 bp, Homo sapiens
aggaaacatgaatctgccttga

SEQ ID NO: 9082229 - DNA, 22 bp, Homo sapiens
aggaaacattgatattgggaaa

SEQ ID NO: 9082230 - DNA, 17 bp, Homo sapiens
aggaaacattttctttc

SEQ ID NO: 9082231 - DNA, 22 bp, Homo sapiens
cagggtggggctggctatcaaa

SEQ ID NO: 9082232 - DNA, 22 bp, Homo sapiens
cagggtgctgcaccatccctca

SEQ ID NO: 9082233 - DNA, 22 bp, Homo sapiens
agcttctcctggtacagaactg

SEQ ID NO: 9082234 - DNA, 22 bp, Homo sapiens
agcttctccctttcctattggt

SEQ ID NO: 9082235 - DNA, 22 bp, Homo sapiens
agcttctctctttgcactcaca

SEQ ID NO: 9082236 - DNA, 22 bp, Homo sapiens
agcttctctctttgcactcaca

SEQ ID NO: 9082237 - DNA, 22 bp, Homo sapiens
agcttctctctttgcactcaca

SEQ ID NO: 9082238 - DNA, 23 bp, Homo sapiens
agcttctggttcaggtcaagcag

SEQ ID NO: 9082239 - DNA, 22 bp, Homo sapiens
agcttctgttcatcttccaggc

SEQ ID NO: 9082240 - DNA, 22 bp, Homo sapiens
agcttctggaaggcaaggcttg

SEQ ID NO: 9082241 - DNA, 23 bp, Homo sapiens
agcttctggttcaggtcaagcag

SEQ ID NO: 9082242 - DNA, 22 bp, Homo sapiens
agcttctgttcatcttccaggc

SEQ ID NO: 9082243 - DNA, 22 bp, Homo sapiens
agctttcagtctctgaaggaac

SEQ ID NO: 9082244 - DNA, 22 bp, Homo sapiens
agctttcagttactaatgaagg

SEQ ID NO: 9082245 - DNA, 22 bp, Homo sapiens
caggcttcgctctgtgggcagg

SEQ ID NO: 9082246 - DNA, 22 bp, Homo sapiens
caggcttcagggaacgcagtct

SEQ ID NO: 9082247 - DNA, 21 bp, Homo sapiens
caggcttgaccctagtgggaa

SEQ ID NO: 9082248 - DNA, 22 bp, Homo sapiens
caggcttgattattcagacaat

SEQ ID NO: 9082249 - DNA, 22 bp, Homo sapiens
agcttctcaggagtctgaggca

SEQ ID NO: 9082250 - DNA, 22 bp, Homo sapiens
agcttctccatctgcccagaga

SEQ ID NO: 9082251 - DNA, 22 bp, Homo sapiens
agcttctcaggagtctgaggca

SEQ ID NO: 9082252 - DNA, 22 bp, Homo sapiens
caggcttgctgctagagcactt

SEQ ID NO: 9082253 - DNA, 22 bp, Homo sapiens
caggctgtgaaactgagatgcg

SEQ ID NO: 9082254 - DNA, 22 bp, Homo sapiens
caggctggagttcagtggtgtg

SEQ ID NO: 9082255 - DNA, 22 bp, Homo sapiens
agctggtgctgaagctcttgag

SEQ ID NO: 9082256 - DNA, 22 bp, Homo sapiens
agctggtgctgaagctcttgag

SEQ ID NO: 9082257 - DNA, 22 bp, Homo sapiens
caggctggagttacctttaggg

SEQ ID NO: 9082258 - DNA, 22 bp, Homo sapiens
agctggtgctcggggagctggc

SEQ ID NO: 9082259 - DNA, 22 bp, Homo sapiens
agctggtgctcggggagctggc

SEQ ID NO: 9082260 - DNA, 22 bp, Homo sapiens
agctggtgctcggggagctggc

SEQ ID NO: 9082261 - DNA, 22 bp, Homo sapiens
caggcttaggagtcagcctgct

SEQ ID NO: 9082262 - DNA, 22 bp, Homo sapiens
caggctgtggatcaggagcctt

SEQ ID NO: 9082263 - DNA, 22 bp, Homo sapiens
aggaaacaacttggcatgagcc

SEQ ID NO: 9082264 - DNA, 21 bp, Homo sapiens
aggaaaattgagggttgttgt

SEQ ID NO: 9082265 - DNA, 22 bp, Homo sapiens
aggaaaatggaccagagttgtt

SEQ ID NO: 9082266 - DNA, 22 bp, Homo sapiens
aggaaaagtgtgaagtatggag

SEQ ID NO: 9082267 - DNA, 22 bp, Homo sapiens
aggaaaatcgagtctggaggca

SEQ ID NO: 9082268 - DNA, 22 bp, Homo sapiens
aggaaaatgatattctgctgtt

SEQ ID NO: 9082269 - DNA, 22 bp, Homo sapiens
aggaaaacacagtattgatgga

SEQ ID NO: 9082270 - DNA, 22 bp, Homo sapiens
aggaaaaataaggcagcagggc

SEQ ID NO: 9082271 - DNA, 23 bp, Homo sapiens
agctttggtgatgtgacagataa

SEQ ID NO: 9082272 - DNA, 20 bp, Homo sapiens
aggaaaaatggaaactggag

SEQ ID NO: 9082273 - DNA, 22 bp, Homo sapiens
cagggacagcgggactctgaca

SEQ ID NO: 9082274 - DNA, 22 bp, Homo sapiens
cagggacatgactggtctctgt

SEQ ID NO: 9082275 - DNA, 22 bp, Homo sapiens
cagggacagcgggactctgaca

SEQ ID NO: 9082276 - DNA, 22 bp, Homo sapiens
cagggactcccagggtagctcc

SEQ ID NO: 9082277 - DNA, 22 bp, Homo sapiens
agctttgggggtaggtatagag

SEQ ID NO: 9082278 - DNA, 22 bp, Homo sapiens
agctttgggccactggctggat

SEQ ID NO: 9082279 - DNA, 22 bp, Homo sapiens
agctttgggccactggctggat

SEQ ID NO: 9082280 - DNA, 22 bp, Homo sapiens
cagggacattggtggccaggtt

SEQ ID NO: 9082281 - DNA, 22 bp, Homo sapiens
cagggacatgactggtctctgt

SEQ ID NO: 9082282 - DNA, 22 bp, Homo sapiens
cagggacatgactggtctctgt

SEQ ID NO: 9082283 - DNA, 22 bp, Homo sapiens
atcaagaattgggagctattga

SEQ ID NO: 9082284 - DNA, 22 bp, Homo sapiens
atcacaaagggttttctctgag

SEQ ID NO: 9082285 - DNA, 22 bp, Homo sapiens
atcacaaaggtctcagagcaca

SEQ ID NO: 9082286 - DNA, 22 bp, Homo sapiens
atcacaaaggtctcagagcaca

SEQ ID NO: 9082287 - DNA, 22 bp, Homo sapiens
atcacaatccctctctctgata

SEQ ID NO: 9082288 - DNA, 22 bp, Homo sapiens
atcacaatgtacgttaaaatgt

SEQ ID NO: 9082289 - DNA, 22 bp, Homo sapiens
atcacagattgtgaataactat

SEQ ID NO: 9082290 - DNA, 22 bp, Homo sapiens
ctgtaaatatgaagaatatatg

SEQ ID NO: 9082291 - DNA, 22 bp, Homo sapiens
ctgtaaatatgaagaatatatg

SEQ ID NO: 9082292 - DNA, 22 bp, Homo sapiens
ctgtaatcccagctacctggga

SEQ ID NO: 9082293 - DNA, 22 bp, Homo sapiens
ctgtaatcccagctactcggga

SEQ ID NO: 9082294 - DNA, 22 bp, Homo sapiens
ctgtaatcccagctactcggga

SEQ ID NO: 9082295 - DNA, 22 bp, Homo sapiens
ctgtaatcccagctacctggga

SEQ ID NO: 9082296 - DNA, 22 bp, Homo sapiens
atcagctgatgaatggatgaat

SEQ ID NO: 9082297 - DNA, 22 bp, Homo sapiens
atcagctcattttgatggaaat

SEQ ID NO: 9082298 - DNA, 22 bp, Homo sapiens
atcagctgaaaaacaggcagca

SEQ ID NO: 9082299 - DNA, 22 bp, Homo sapiens
atcagctgaaaaacaggcagca

SEQ ID NO: 9082300 - DNA, 22 bp, Homo sapiens
atcagctgaaaaacaggcagca

SEQ ID NO: 9082301 - DNA, 22 bp, Homo sapiens
atcagcagtgtctacctcggtg

SEQ ID NO: 9082302 - DNA, 22 bp, Homo sapiens
atcagcaggtgctggtggagac

SEQ ID NO: 9082303 - DNA, 22 bp, Homo sapiens
atcagcaggaagggcaccttta

SEQ ID NO: 9082304 - DNA, 22 bp, Homo sapiens
atcaggaaaaattgtgaaaggg

SEQ ID NO: 9082305 - DNA, 22 bp, Homo sapiens
atcaggaaaaattgtgaaaggg

SEQ ID NO: 9082306 - DNA, 22 bp, Homo sapiens
atcaggaaagagtggaactctg

SEQ ID NO: 9082307 - DNA, 19 bp, Homo sapiens
ctgtccttggctgcactgt

SEQ ID NO: 9082308 - DNA, 22 bp, Homo sapiens
ctgtctcaagactgcaggcact

SEQ ID NO: 9082309 - DNA, 22 bp, Homo sapiens
ctgtctccagggcaggtgcagg

SEQ ID NO: 9082310 - DNA, 22 bp, Homo sapiens
ctgtctccagggcaggtgcagg

SEQ ID NO: 9082311 - DNA, 23 bp, Homo sapiens
ctgtccttggtcttggctgagtg

SEQ ID NO: 9082312 - DNA, 22 bp, Homo sapiens
ctgtctcctccactgcatggga

SEQ ID NO: 9082313 - DNA, 22 bp, Homo sapiens
atcaggtgaagtcactgagtgg

SEQ ID NO: 9082314 - DNA, 22 bp, Homo sapiens
ctgtctctctaggacactgggg

SEQ ID NO: 9082315 - DNA, 22 bp, Homo sapiens
atcataaagtgctatctgattg

SEQ ID NO: 9082316 - DNA, 22 bp, Homo sapiens
atcataaaccactttgtaatct

SEQ ID NO: 9082317 - DNA, 22 bp, Homo sapiens
atcataagacccagccagtatt

SEQ ID NO: 9082318 - DNA, 22 bp, Homo sapiens
atcataagacccagccagtatt

SEQ ID NO: 9082319 - DNA, 22 bp, Homo sapiens
atcataattgctccagtgatat

SEQ ID NO: 9082320 - DNA, 22 bp, Homo sapiens
atcataaaattgcaccatttct

SEQ ID NO: 9082321 - DNA, 19 bp, Homo sapiens
ctggggctttggtactgcc

SEQ ID NO: 9082322 - DNA, 22 bp, Homo sapiens
ctgggggcaagcagacagctgt

SEQ ID NO: 9082323 - DNA, 22 bp, Homo sapiens
ctgggggcaagcagacagctgt

SEQ ID NO: 9082324 - DNA, 22 bp, Homo sapiens
ctgggggcaagcagacagctgt

SEQ ID NO: 9082325 - DNA, 22 bp, Homo sapiens
ctgggggcaatggtcagagtgt

SEQ ID NO: 9082326 - DNA, 22 bp, Homo sapiens
atattattctagctcttgtgtg

SEQ ID NO: 9082327 - DNA, 22 bp, Homo sapiens
atattatgtgactcttcaccag

SEQ ID NO: 9082328 - DNA, 22 bp, Homo sapiens
atattattctagtaacagtgat

SEQ ID NO: 9082329 - DNA, 22 bp, Homo sapiens
atattattctagctcttgtgtg

SEQ ID NO: 9082330 - DNA, 22 bp, Homo sapiens
atattattctagtaacagtgat

SEQ ID NO: 9082331 - DNA, 22 bp, Homo sapiens
ctggggctgtgggagacaaggc

SEQ ID NO: 9082332 - DNA, 23 bp, Homo sapiens
ctggggctttcaaatctgggcag

SEQ ID NO: 9082333 - DNA, 19 bp, Homo sapiens
ctgggaggtgttcagagaa

SEQ ID NO: 9082334 - DNA, 22 bp, Homo sapiens
ctggggcatctgacagataaat

SEQ ID NO: 9082335 - DNA, 22 bp, Homo sapiens
ctgggaggcggaggttgtagtg

SEQ ID NO: 9082336 - DNA, 22 bp, Homo sapiens
ctgggaggcggaggttgtagtg

SEQ ID NO: 9082337 - DNA, 20 bp, Homo sapiens
ctgggaggtcttccaaatca

SEQ ID NO: 9082338 - DNA, 20 bp, Homo sapiens
ctgggaggtcttccaaatca

SEQ ID NO: 9082339 - DNA, 20 bp, Homo sapiens
ctgggaggtcttccaaatca

SEQ ID NO: 9082340 - DNA, 22 bp, Homo sapiens
ctgggaggggtagccaatccta

SEQ ID NO: 9082341 - DNA, 22 bp, Homo sapiens
ctgggaggggtagccaatccta

SEQ ID NO: 9082342 - DNA, 22 bp, Homo sapiens
ctgggaggggtagccaatccta

SEQ ID NO: 9082343 - DNA, 22 bp, Homo sapiens
ctgggaggtgaacagaaaaact

SEQ ID NO: 9082344 - DNA, 22 bp, Homo sapiens
ctgggaggtgaacagaaaaact

SEQ ID NO: 9082345 - DNA, 22 bp, Homo sapiens
ctgggaggtgcagcaaaaatca

SEQ ID NO: 9082346 - DNA, 22 bp, Homo sapiens
ctgggaggtgcagcaaaaatca

SEQ ID NO: 9082347 - DNA, 22 bp, Homo sapiens
ctgggaggtggaggttgcattg

SEQ ID NO: 9082348 - DNA, 22 bp, Homo sapiens
ctgggaggtggaggttgcattg

SEQ ID NO: 9082349 - DNA, 22 bp, Homo sapiens
ctgggaggtggaggttgcattg

SEQ ID NO: 9082350 - DNA, 22 bp, Homo sapiens
ctgggaggatacacaagatcag

SEQ ID NO: 9082351 - DNA, 22 bp, Homo sapiens
ctgggaggatacacaagatcag

SEQ ID NO: 9082352 - DNA, 22 bp, Homo sapiens
ctgggaggacaacttggagctc

SEQ ID NO: 9082353 - DNA, 22 bp, Homo sapiens
ctgggaggattcattgaggtga

SEQ ID NO: 9082354 - DNA, 22 bp, Homo sapiens
ctgggaggcggaggttgcagtg

SEQ ID NO: 9082355 - DNA, 22 bp, Homo sapiens
ctgggaggcggaggttgcagtg

SEQ ID NO: 9082356 - DNA, 22 bp, Homo sapiens
ctgggaggacaacttggagctc

SEQ ID NO: 9082357 - DNA, 22 bp, Homo sapiens
atattcacactgtttagttaca

SEQ ID NO: 9082358 - DNA, 18 bp, Homo sapiens
atattcaagaagacagag

SEQ ID NO: 9082359 - DNA, 18 bp, Homo sapiens
atattcaagaagacagag

SEQ ID NO: 9082360 - DNA, 18 bp, Homo sapiens
atattcaagaagacagag

SEQ ID NO: 9082361 - DNA, 23 bp, Homo sapiens
atattcacgccgccagaggtccc

SEQ ID NO: 9082362 - DNA, 22 bp, Homo sapiens
atattcacagtaagtgtagcag

SEQ ID NO: 9082363 - DNA, 22 bp, Homo sapiens
atattcacagatagaaggttct

SEQ ID NO: 9082364 - DNA, 22 bp, Homo sapiens
atattcactcctggtgagacta

SEQ ID NO: 9082365 - DNA, 22 bp, Homo sapiens
atattcactgagcataaagcca

SEQ ID NO: 9082366 - DNA, 18 bp, Homo sapiens
ctgggtctccaggctgcc

SEQ ID NO: 9082367 - DNA, 18 bp, Homo sapiens
ctgggtctccaggctgcc

SEQ ID NO: 9082368 - DNA, 22 bp, Homo sapiens
atattcaaattacatttactaa

SEQ ID NO: 9082369 - DNA, 22 bp, Homo sapiens
atattcaaattacatttactaa

SEQ ID NO: 9082370 - DNA, 22 bp, Homo sapiens
ctgggtggcagagcctgcagtg

SEQ ID NO: 9082371 - DNA, 20 bp, Homo sapiens
ctgggtggcaagcaaggggg

SEQ ID NO: 9082372 - DNA, 22 bp, Homo sapiens
ctggtccctgcagtgtgctggg

SEQ ID NO: 9082373 - DNA, 22 bp, Homo sapiens
ctggtccctgcagtgtgctggg

SEQ ID NO: 9082374 - DNA, 22 bp, Homo sapiens
ctggtccctgagtagttatgca

SEQ ID NO: 9082375 - DNA, 22 bp, Homo sapiens
ctggtccccagactgggcttag

SEQ ID NO: 9082376 - DNA, 22 bp, Homo sapiens
atcaagaatgttcattcttcta

SEQ ID NO: 9082377 - DNA, 22 bp, Homo sapiens
ctggtccagtggatgctgaggg

SEQ ID NO: 9082378 - DNA, 17 bp, Homo sapiens
ctggtcccaccaagccc

SEQ ID NO: 9082379 - DNA, 22 bp, Homo sapiens
ctggtcccagcagagctctgag

SEQ ID NO: 9082380 - DNA, 22 bp, Homo sapiens
ctggtcccagcagagctctgag

SEQ ID NO: 9082381 - DNA, 22 bp, Homo sapiens
ctggtcccagctctgccaccaa

SEQ ID NO: 9082382 - DNA, 22 bp, Homo sapiens
ctggtcccatcctggcttcatg

SEQ ID NO: 9082383 - DNA, 22 bp, Homo sapiens
ctgggtggcgtctggggccagt

SEQ ID NO: 9082384 - DNA, 22 bp, Homo sapiens
ctgggtggcgtctggggccagt

SEQ ID NO: 9082385 - DNA, 22 bp, Homo sapiens
ctgggtggctgtccagccagcc

SEQ ID NO: 9082386 - DNA, 22 bp, Homo sapiens
ctgggtggctgtccagccagcc

SEQ ID NO: 9082387 - DNA, 22 bp, Homo sapiens
atctgtaattttgaatgcaaat

SEQ ID NO: 9082388 - DNA, 22 bp, Homo sapiens
atctggttcttcttaggcatca

SEQ ID NO: 9082389 - DNA, 22 bp, Homo sapiens
atctggttttggctgtgtccct

SEQ ID NO: 9082390 - DNA, 22 bp, Homo sapiens
atctgtaactgctatcatctcc

SEQ ID NO: 9082391 - DNA, 22 bp, Homo sapiens
atctgtaaagataatcatatgt

SEQ ID NO: 9082392 - DNA, 22 bp, Homo sapiens
atctggttcttcttaggcatca

SEQ ID NO: 9082393 - DNA, 22 bp, Homo sapiens
atctggtgacacgaggagctgg

SEQ ID NO: 9082394 - DNA, 22 bp, Homo sapiens
atctggtatgaggttttgcttt

SEQ ID NO: 9082395 - DNA, 22 bp, Homo sapiens
atctggtgctaacaaatgtgga

SEQ ID NO: 9082396 - DNA, 22 bp, Homo sapiens
cttcttaaagattacacaatga

SEQ ID NO: 9082397 - DNA, 22 bp, Homo sapiens
atctgtctatgtggctatgtat

SEQ ID NO: 9082398 - DNA, 22 bp, Homo sapiens
atcttatttaacacagcaaaac

SEQ ID NO: 9082399 - DNA, 22 bp, Homo sapiens
atcttatttaacacagcaaaac

SEQ ID NO: 9082400 - DNA, 22 bp, Homo sapiens
atctgtggctggtgagaggcag

SEQ ID NO: 9082401 - DNA, 22 bp, Homo sapiens
atctgtggcgcaaacaaaggct

SEQ ID NO: 9082402 - DNA, 22 bp, Homo sapiens
atctgtgtgttcaggaagtcct

SEQ ID NO: 9082403 - DNA, 22 bp, Homo sapiens
atctgtgtccttataagagaca

SEQ ID NO: 9082404 - DNA, 22 bp, Homo sapiens
atctgtgtatgtgaccttatct

SEQ ID NO: 9082405 - DNA, 22 bp, Homo sapiens
cttctgcaagagcatcagttgt

SEQ ID NO: 9082406 - DNA, 22 bp, Homo sapiens
cttctgcaataagttttggtcc

SEQ ID NO: 9082407 - DNA, 22 bp, Homo sapiens
cttctgcactgaccttttgtcc

SEQ ID NO: 9082408 - DNA, 22 bp, Homo sapiens
cttctgcaggccctgtctgacc

SEQ ID NO: 9082409 - DNA, 22 bp, Homo sapiens
cttctgcagaattaattcacta

SEQ ID NO: 9082410 - DNA, 22 bp, Homo sapiens
cttctgagatgttgttttacag

SEQ ID NO: 9082411 - DNA, 22 bp, Homo sapiens
cttctgaggcagctattcagtt

SEQ ID NO: 9082412 - DNA, 22 bp, Homo sapiens
cttctgagggcctttgcttcca

SEQ ID NO: 9082413 - DNA, 22 bp, Homo sapiens
cttctgagggcctttgcttcca

SEQ ID NO: 9082414 - DNA, 22 bp, Homo sapiens
cttctgtgatttggttaggata

SEQ ID NO: 9082415 - DNA, 23 bp, Homo sapiens
cttctgtgcaagagggagggaaa

SEQ ID NO: 9082416 - DNA, 22 bp, Homo sapiens
cttctgtgcaattgtggaggag

SEQ ID NO: 9082417 - DNA, 22 bp, Homo sapiens
cttctgtgcttcacagttgcca

SEQ ID NO: 9082418 - DNA, 22 bp, Homo sapiens
cttctgtgcttcacagttgcca

SEQ ID NO: 9082419 - DNA, 22 bp, Homo sapiens
cttctgtgctaaatgcaaaacc

SEQ ID NO: 9082420 - DNA, 22 bp, Homo sapiens
cttctgtgttttactatatgta

SEQ ID NO: 9082421 - DNA, 22 bp, Homo sapiens
cttctgtgttttactatatgta

SEQ ID NO: 9082422 - DNA, 22 bp, Homo sapiens
cttctgtgttaaatgagtcttt

SEQ ID NO: 9082423 - DNA, 22 bp, Homo sapiens
cttctgtggatatgttctctct

SEQ ID NO: 9082424 - DNA, 22 bp, Homo sapiens
cttctgtggatatgttctctct

SEQ ID NO: 9082425 - DNA, 22 bp, Homo sapiens
cttctgtggatatgttctctct

SEQ ID NO: 9082426 - DNA, 22 bp, Homo sapiens
cttctgtgcttcacagttgcca

SEQ ID NO: 9082427 - DNA, 22 bp, Homo sapiens
cttctgtggtaaactttgttgt

SEQ ID NO: 9082428 - DNA, 22 bp, Homo sapiens
cttctgtggtaaactttgttgt

SEQ ID NO: 9082429 - DNA, 22 bp, Homo sapiens
cttctgtggatgttggatgcat

SEQ ID NO: 9082430 - DNA, 22 bp, Homo sapiens
cttccttggcttctggggtgtg

SEQ ID NO: 9082431 - DNA, 22 bp, Homo sapiens
cttccttgtggtccttctcatt

SEQ ID NO: 9082432 - DNA, 22 bp, Homo sapiens
cttccttggcttctggggtgtg

SEQ ID NO: 9082433 - DNA, 22 bp, Homo sapiens
cttccttgtggtccttctcatt

SEQ ID NO: 9082434 - DNA, 21 bp, Homo sapiens
atctcgggcttctcgcccagc

SEQ ID NO: 9082435 - DNA, 22 bp, Homo sapiens
atctctaatttaaaaagtaaca

SEQ ID NO: 9082436 - DNA, 23 bp, Homo sapiens
atctcctgagaacccacagtggt

SEQ ID NO: 9082437 - DNA, 20 bp, Homo sapiens
atctcctgctaccacccatt

SEQ ID NO: 9082438 - DNA, 22 bp, Homo sapiens
cttctccttatatgtcccgttc

SEQ ID NO: 9082439 - DNA, 22 bp, Homo sapiens
cttctccttatatgtcccgttc

SEQ ID NO: 9082440 - DNA, 22 bp, Homo sapiens
cttctgagatgttgttttacag

SEQ ID NO: 9082441 - DNA, 22 bp, Homo sapiens
cttctgacccctggtctacagc

SEQ ID NO: 9082442 - DNA, 22 bp, Homo sapiens
atctctctatgcactgaggact

SEQ ID NO: 9082443 - DNA, 22 bp, Homo sapiens
cttaacaagcccaactttcatt

SEQ ID NO: 9082444 - DNA, 22 bp, Homo sapiens
atcataggatttaggtccatct

SEQ ID NO: 9082445 - DNA, 22 bp, Homo sapiens
atcatcatcaacaagaaacatt

SEQ ID NO: 9082446 - DNA, 22 bp, Homo sapiens
cttaagaaattgcattctaatc

SEQ ID NO: 9082447 - DNA, 21 bp, Homo sapiens
cttaacattttaaatgaaagg

SEQ ID NO: 9082448 - DNA, 22 bp, Homo sapiens
cttaacatggggggtaagtctg

SEQ ID NO: 9082449 - DNA, 22 bp, Homo sapiens
cttaacatcctgcatttttctt

SEQ ID NO: 9082450 - DNA, 20 bp, Homo sapiens
cttaacaatggctctgatga

SEQ ID NO: 9082451 - DNA, 22 bp, Homo sapiens
cttaagattgtcagcttcagcc

SEQ ID NO: 9082452 - DNA, 21 bp, Homo sapiens
atccatccatcttggcctaac

SEQ ID NO: 9082453 - DNA, 22 bp, Homo sapiens
atccatgatcaatttattacta

SEQ ID NO: 9082454 - DNA, 22 bp, Homo sapiens
atccatgaaggtacttctcagg

SEQ ID NO: 9082455 - DNA, 22 bp, Homo sapiens
cttaatctcacctgcaaagtcc

SEQ ID NO: 9082456 - DNA, 22 bp, Homo sapiens
cttaatctcacctgcaaagtcc

SEQ ID NO: 9082457 - DNA, 18 bp, Homo sapiens
atccatttaatgcctgga

SEQ ID NO: 9082458 - DNA, 22 bp, Homo sapiens
atccatgattgcccagaggtgt

SEQ ID NO: 9082459 - DNA, 20 bp, Homo sapiens
atccatgagagtctggattc

SEQ ID NO: 9082460 - DNA, 22 bp, Homo sapiens
cttagatgaagtcacagaaccc

SEQ ID NO: 9082461 - DNA, 22 bp, Homo sapiens
atccatttgacataatttcagc

SEQ ID NO: 9082462 - DNA, 22 bp, Homo sapiens
atccatttcctccactataaag

SEQ ID NO: 9082463 - DNA, 22 bp, Homo sapiens
cttcctctcaataagatgagaa

SEQ ID NO: 9082464 - DNA, 22 bp, Homo sapiens
cttcctctcaataagatgagaa

SEQ ID NO: 9082465 - DNA, 22 bp, Homo sapiens
cttcctctatgttcaggtagaa

SEQ ID NO: 9082466 - DNA, 22 bp, Homo sapiens
cttcctctatgttcaggtagaa

SEQ ID NO: 9082467 - DNA, 22 bp, Homo sapiens
cttcctctcttgcccataagag

SEQ ID NO: 9082468 - DNA, 22 bp, Homo sapiens
cttcctctcttgcccataagag

SEQ ID NO: 9082469 - DNA, 19 bp, Homo sapiens
cttccttgctccccatgtg

SEQ ID NO: 9082470 - DNA, 19 bp, Homo sapiens
cttccttgctccccatgtg

SEQ ID NO: 9082471 - DNA, 22 bp, Homo sapiens
cttccttgctgtctgctccagg

SEQ ID NO: 9082472 - DNA, 22 bp, Homo sapiens
cttccttgctgtctgctccagg

SEQ ID NO: 9082473 - DNA, 22 bp, Homo sapiens
cttccttgctgtctgctccagg

SEQ ID NO: 9082474 - DNA, 22 bp, Homo sapiens
cttccttgcggcccctgcctag

SEQ ID NO: 9082475 - DNA, 22 bp, Homo sapiens
cttccttgcggcccctgcctag

SEQ ID NO: 9082476 - DNA, 22 bp, Homo sapiens
cttcacaaaatatttcattata

SEQ ID NO: 9082477 - DNA, 22 bp, Homo sapiens
cttcaatacctgcgttgctagt

SEQ ID NO: 9082478 - DNA, 22 bp, Homo sapiens
cttcaataggaactgcatggca

SEQ ID NO: 9082479 - DNA, 22 bp, Homo sapiens
cttcaatacctgcgttgctagt

SEQ ID NO: 9082480 - DNA, 22 bp, Homo sapiens
cttcacaaagctctctttatgt

SEQ ID NO: 9082481 - DNA, 22 bp, Homo sapiens
cttcaagatatttctagaatca

SEQ ID NO: 9082482 - DNA, 22 bp, Homo sapiens
cttcaagaagacagcagagcat

SEQ ID NO: 9082483 - DNA, 22 bp, Homo sapiens
cttcaagagaatgcagggatgt

SEQ ID NO: 9082484 - DNA, 22 bp, Homo sapiens
cttcaagttgtctgagggtggg

SEQ ID NO: 9082485 - DNA, 22 bp, Homo sapiens
cttcaagttgggcggcgggcag

SEQ ID NO: 9082486 - DNA, 22 bp, Homo sapiens
cttcaagtccagctcatgctct

SEQ ID NO: 9082487 - DNA, 22 bp, Homo sapiens
cttattaatggaatcctaatga

SEQ ID NO: 9082488 - DNA, 22 bp, Homo sapiens
cttatcttacttccccttcatg

SEQ ID NO: 9082489 - DNA, 22 bp, Homo sapiens
cttatgtataatgttccacata

SEQ ID NO: 9082490 - DNA, 22 bp, Homo sapiens
cttatgtacacacatatattgt

SEQ ID NO: 9082491 - DNA, 22 bp, Homo sapiens
cttattcagaaggagaaatgga

SEQ ID NO: 9082492 - DNA, 22 bp, Homo sapiens
cttcaaatgtgattttaataac

SEQ ID NO: 9082493 - DNA, 22 bp, Homo sapiens
cttcaaatgtgattttaataac

SEQ ID NO: 9082494 - DNA, 22 bp, Homo sapiens
cttcaacttccctagatgtcat

SEQ ID NO: 9082495 - DNA, 22 bp, Homo sapiens
cttcaactgggcttcgatgtgg

SEQ ID NO: 9082496 - DNA, 22 bp, Homo sapiens
cttcaaattcgaggagtagatg

SEQ ID NO: 9082497 - DNA, 22 bp, Homo sapiens
atataaagagcttagtatagtg

SEQ ID NO: 9082498 - DNA, 22 bp, Homo sapiens
atataaagtgtttagaaagctg

SEQ ID NO: 9082499 - DNA, 22 bp, Homo sapiens
atataaagtgtttagaaagctg

SEQ ID NO: 9082500 - DNA, 22 bp, Homo sapiens
ctggctcttggctagggagagt

SEQ ID NO: 9082501 - DNA, 22 bp, Homo sapiens
ctggctctttcctagctaggct

SEQ ID NO: 9082502 - DNA, 19 bp, Homo sapiens
ctggctcttgggtggagga

SEQ ID NO: 9082503 - DNA, 19 bp, Homo sapiens
ctggctcttgggtggagga

SEQ ID NO: 9082504 - DNA, 22 bp, Homo sapiens
ctggctctttcctagctaggct

SEQ ID NO: 9082505 - DNA, 22 bp, Homo sapiens
atataaagaagtggaaaatgag

SEQ ID NO: 9082506 - DNA, 22 bp, Homo sapiens
atataaagagcttagtatagtg

SEQ ID NO: 9082507 - DNA, 22 bp, Homo sapiens
atagttttatagatattgtgta

SEQ ID NO: 9082508 - DNA, 22 bp, Homo sapiens
atagttttatagatattgtgta

SEQ ID NO: 9082509 - DNA, 22 bp, Homo sapiens
ctggcctttttagaaaacagct

SEQ ID NO: 9082510 - DNA, 22 bp, Homo sapiens
ctggcgagggtcgctggggact

SEQ ID NO: 9082511 - DNA, 22 bp, Homo sapiens
ctggctaaagagcaagaagatg

SEQ ID NO: 9082512 - DNA, 22 bp, Homo sapiens
ctggctaattgtcagttgttac

SEQ ID NO: 9082513 - DNA, 22 bp, Homo sapiens
ctggcctgtgggctgtctccgg

SEQ ID NO: 9082514 - DNA, 22 bp, Homo sapiens
ctggcctcggcagcaggaacag

SEQ ID NO: 9082515 - DNA, 22 bp, Homo sapiens
ctggcctctctgagcagggagc

SEQ ID NO: 9082516 - DNA, 22 bp, Homo sapiens
ctggcctttcgtgagagctggg

SEQ ID NO: 9082517 - DNA, 22 bp, Homo sapiens
ctggcctttagccccagtgtct

SEQ ID NO: 9082518 - DNA, 22 bp, Homo sapiens
ctggcctttcgtgagagctggg

SEQ ID NO: 9082519 - DNA, 19 bp, Homo sapiens
ctggcctgtgtcctgtgct

SEQ ID NO: 9082520 - DNA, 22 bp, Homo sapiens
ctggccttggaagggagcccgt

SEQ ID NO: 9082521 - DNA, 22 bp, Homo sapiens
ctggccttggtgcttgcagaca

SEQ ID NO: 9082522 - DNA, 22 bp, Homo sapiens
ctggccttgaggaggccaccaa

SEQ ID NO: 9082523 - DNA, 22 bp, Homo sapiens
ctggccttgttcctccccaagt

SEQ ID NO: 9082524 - DNA, 22 bp, Homo sapiens
atatacagggagaaacagctta

SEQ ID NO: 9082525 - DNA, 22 bp, Homo sapiens
atatacagggagaaacagctta

SEQ ID NO: 9082526 - DNA, 22 bp, Homo sapiens
atatacaggtggtatgtgtaaa

SEQ ID NO: 9082527 - DNA, 22 bp, Homo sapiens
atatacagtatgtactgtggtt

SEQ ID NO: 9082528 - DNA, 22 bp, Homo sapiens
atatacagtatgtactgtggtt

SEQ ID NO: 9082529 - DNA, 22 bp, Homo sapiens
atatacaggtggtatgtgtaaa

SEQ ID NO: 9082530 - DNA, 22 bp, Homo sapiens
atatacaggtggtatgtgtaaa

SEQ ID NO: 9082531 - DNA, 22 bp, Homo sapiens
atatacaggtggtatgtgtaaa

SEQ ID NO: 9082532 - DNA, 22 bp, Homo sapiens
atatacatgggaatatgtggag

SEQ ID NO: 9082533 - DNA, 22 bp, Homo sapiens
atatacagttttacagggtttc

SEQ ID NO: 9082534 - DNA, 19 bp, Homo sapiens
atatacatactgtgtgcat

SEQ ID NO: 9082535 - DNA, 22 bp, Homo sapiens
atatacttccccattatggggg

SEQ ID NO: 9082536 - DNA, 22 bp, Homo sapiens
atatacttggagactatcattg

SEQ ID NO: 9082537 - DNA, 22 bp, Homo sapiens
atatacctcattctttgagtgc

SEQ ID NO: 9082538 - DNA, 22 bp, Homo sapiens
ctgggagctggaatgggagaag

SEQ ID NO: 9082539 - DNA, 22 bp, Homo sapiens
atatacttggagactatcattg

SEQ ID NO: 9082540 - DNA, 22 bp, Homo sapiens
atatacttggagactatcattg

SEQ ID NO: 9082541 - DNA, 22 bp, Homo sapiens
ctgggagaggaacctcgagggt

SEQ ID NO: 9082542 - DNA, 19 bp, Homo sapiens
atacatgcatttacatgct

SEQ ID NO: 9082543 - DNA, 22 bp, Homo sapiens
atacatgggtctcctgtcttag

SEQ ID NO: 9082544 - DNA, 22 bp, Homo sapiens
atacatggaagatgcttagcac

SEQ ID NO: 9082545 - DNA, 23 bp, Homo sapiens
atacatggccggatatgatgttc

SEQ ID NO: 9082546 - DNA, 22 bp, Homo sapiens
ctggcacataattagtgatcct

SEQ ID NO: 9082547 - DNA, 22 bp, Homo sapiens
atacatgtgggtctaaacatat

SEQ ID NO: 9082548 - DNA, 22 bp, Homo sapiens
ctggcagcttagcactctggtt

SEQ ID NO: 9082549 - DNA, 22 bp, Homo sapiens
ctggcagcttagcactctggtt

SEQ ID NO: 9082550 - DNA, 22 bp, Homo sapiens
ctggcagcttattagaaatgca

SEQ ID NO: 9082551 - DNA, 22 bp, Homo sapiens
atacacattactttctgtctga

SEQ ID NO: 9082552 - DNA, 20 bp, Homo sapiens
atacacattcatagaaaaat

SEQ ID NO: 9082553 - DNA, 20 bp, Homo sapiens
atacacattcatagaaaaat

SEQ ID NO: 9082554 - DNA, 20 bp, Homo sapiens
atacacattcatagaaaaat

SEQ ID NO: 9082555 - DNA, 20 bp, Homo sapiens
atacacatgcagacagatgc

SEQ ID NO: 9082556 - DNA, 20 bp, Homo sapiens
atacacatgcagacagatgc

SEQ ID NO: 9082557 - DNA, 22 bp, Homo sapiens
atacacatgtgtatgtgcatgc

SEQ ID NO: 9082558 - DNA, 22 bp, Homo sapiens
atacacatgttattgtggaagc

SEQ ID NO: 9082559 - DNA, 22 bp, Homo sapiens
atacacatgtgtatgtgcatgc

SEQ ID NO: 9082560 - DNA, 22 bp, Homo sapiens
ctggcaagtggttgggatggat

SEQ ID NO: 9082561 - DNA, 22 bp, Homo sapiens
ctggcacacagtaggcaccaat

SEQ ID NO: 9082562 - DNA, 22 bp, Homo sapiens
ctggccactggtggtcataggc

SEQ ID NO: 9082563 - DNA, 22 bp, Homo sapiens
ctggccactggtggtcataggc

SEQ ID NO: 9082564 - DNA, 22 bp, Homo sapiens
ctggccactggaggtggcaccc

SEQ ID NO: 9082565 - DNA, 22 bp, Homo sapiens
ctggccactgcgggcctctgcc

SEQ ID NO: 9082566 - DNA, 22 bp, Homo sapiens
ctggcaggtttggtgtctggtg

SEQ ID NO: 9082567 - DNA, 22 bp, Homo sapiens
ctggcaggttatagagctgccc

SEQ ID NO: 9082568 - DNA, 22 bp, Homo sapiens
ctggcaggttatagagctgccc

SEQ ID NO: 9082569 - DNA, 22 bp, Homo sapiens
ctggcaggtggaggttgcagtg

SEQ ID NO: 9082570 - DNA, 22 bp, Homo sapiens
ctggcaggtggaggttgcagtg

SEQ ID NO: 9082571 - DNA, 22 bp, Homo sapiens
ctggcaggtccagctggactca

SEQ ID NO: 9082572 - DNA, 22 bp, Homo sapiens
ctggcaggtctcgctgacgtgt

SEQ ID NO: 9082573 - DNA, 22 bp, Homo sapiens
ctggcctcagagggtcatggtg

SEQ ID NO: 9082574 - DNA, 22 bp, Homo sapiens
ctggcctcagagggtcatggtg

SEQ ID NO: 9082575 - DNA, 22 bp, Homo sapiens
ctggcctcacagaggctaagcc

SEQ ID NO: 9082576 - DNA, 22 bp, Homo sapiens
ctggcctcatagccaagctgtg

SEQ ID NO: 9082577 - DNA, 23 bp, Homo sapiens
ctggcctccgacactggccaaga

SEQ ID NO: 9082578 - DNA, 22 bp, Homo sapiens
ctggcctagacagaccctgatc

SEQ ID NO: 9082579 - DNA, 22 bp, Homo sapiens
ctggcctaaaattgcttctgca

SEQ ID NO: 9082580 - DNA, 22 bp, Homo sapiens
ctggcctaaaaatacagaacaa

SEQ ID NO: 9082581 - DNA, 22 bp, Homo sapiens
ctggcctaaaaatacagaacaa

SEQ ID NO: 9082582 - DNA, 22 bp, Homo sapiens
ctggcccttgacttacagcagg

SEQ ID NO: 9082583 - DNA, 20 bp, Homo sapiens
ctggccagaacgcctacaca

SEQ ID NO: 9082584 - DNA, 20 bp, Homo sapiens
ctggccagaacgcctacaca

SEQ ID NO: 9082585 - DNA, 22 bp, Homo sapiens
ctggccagactacacatgtgtg

SEQ ID NO: 9082586 - DNA, 22 bp, Homo sapiens
ctggccagaagcacctttggcg

SEQ ID NO: 9082587 - DNA, 22 bp, Homo sapiens
ctggccctaggcaaacacagat

SEQ ID NO: 9082588 - DNA, 21 bp, Homo sapiens
atacacatacacataaatgtg

SEQ ID NO: 9082589 - DNA, 22 bp, Homo sapiens
atacacatatatacacgtttaa

SEQ ID NO: 9082590 - DNA, 19 bp, Homo sapiens
atacacatacgtaaactga

SEQ ID NO: 9082591 - DNA, 21 bp, Homo sapiens
atacacatacacataaatgtg

SEQ ID NO: 9082592 - DNA, 21 bp, Homo sapiens
atacacatacacataaatgtg

SEQ ID NO: 9082593 - DNA, 15 bp, Homo sapiens
atacacatgagggag

SEQ ID NO: 9082594 - DNA, 22 bp, Homo sapiens
atacacatgcacacatgtgtgt

SEQ ID NO: 9082595 - DNA, 22 bp, Homo sapiens
atacacatgcacacatgtgtgt

SEQ ID NO: 9082596 - DNA, 22 bp, Homo sapiens
atacacatctatttaagagaca

SEQ ID NO: 9082597 - DNA, 22 bp, Homo sapiens
atacacatctatttaagagaca

SEQ ID NO: 9082598 - DNA, 22 bp, Homo sapiens
atacacatatcaggtgtataca

SEQ ID NO: 9082599 - DNA, 22 bp, Homo sapiens
atacacatatgtgtgtatatgt

SEQ ID NO: 9082600 - DNA, 20 bp, Homo sapiens
atacacatattcttgcaact

SEQ ID NO: 9082601 - DNA, 22 bp, Homo sapiens
ctgctggggtcagagcactggg

SEQ ID NO: 9082602 - DNA, 22 bp, Homo sapiens
ctgctgggggacacaggtccgg

SEQ ID NO: 9082603 - DNA, 22 bp, Homo sapiens
ctgctggggtcagagcactggg

SEQ ID NO: 9082604 - DNA, 22 bp, Homo sapiens
ctgctgtgcagacagactctct

SEQ ID NO: 9082605 - DNA, 22 bp, Homo sapiens
ctgctgtgcaggtgcctatgat

SEQ ID NO: 9082606 - DNA, 22 bp, Homo sapiens
ctgctgtgtcagagtccagggg

SEQ ID NO: 9082607 - DNA, 18 bp, Homo sapiens
ctgctgtgtcgtctgggc

SEQ ID NO: 9082608 - DNA, 21 bp, Homo sapiens
ctgctgtggcccccgacatgc

SEQ ID NO: 9082609 - DNA, 22 bp, Homo sapiens
ctgctgtgggttaagacactgt

SEQ ID NO: 9082610 - DNA, 22 bp, Homo sapiens
ctgctagggttcagcagtgcct

SEQ ID NO: 9082611 - DNA, 22 bp, Homo sapiens
ctgctacttccagaagtgtcga

SEQ ID NO: 9082612 - DNA, 22 bp, Homo sapiens
ctgctactcttgtatgtgtatt

SEQ ID NO: 9082613 - DNA, 22 bp, Homo sapiens
ctgctcagcggaaggaagagcg

SEQ ID NO: 9082614 - DNA, 22 bp, Homo sapiens
ctgctcagaggaaggaatgtct

SEQ ID NO: 9082615 - DNA, 19 bp, Homo sapiens
ctgctcagagcagctccag

SEQ ID NO: 9082616 - DNA, 19 bp, Homo sapiens
ctgctcagagcagctccag

SEQ ID NO: 9082617 - DNA, 22 bp, Homo sapiens
ctgctgggggacacaggtccgg

SEQ ID NO: 9082618 - DNA, 22 bp, Homo sapiens
ctgctggggaggcgcctcgacg

SEQ ID NO: 9082619 - DNA, 22 bp, Homo sapiens
ctgctgggctcctcatgtgact

SEQ ID NO: 9082620 - DNA, 22 bp, Homo sapiens
ctgctgggcctggtctctgagg

SEQ ID NO: 9082621 - DNA, 22 bp, Homo sapiens
ctgctgggcagaggctgcatga

SEQ ID NO: 9082622 - DNA, 22 bp, Homo sapiens
ctgcctggtgcggtgcccaccc

SEQ ID NO: 9082623 - DNA, 22 bp, Homo sapiens
ctgcctgtgcatgcagtcagaa

SEQ ID NO: 9082624 - DNA, 22 bp, Homo sapiens
ctgcctgtgatttttctctagt

SEQ ID NO: 9082625 - DNA, 22 bp, Homo sapiens
ctgcctgtgccaccgcctcatt

SEQ ID NO: 9082626 - DNA, 22 bp, Homo sapiens
ctgcctgtgccaatgctccttt

SEQ ID NO: 9082627 - DNA, 22 bp, Homo sapiens
ctgcctgtgccaatgctccttt

SEQ ID NO: 9082628 - DNA, 22 bp, Homo sapiens
ctgctacaccggaatagtgaca

SEQ ID NO: 9082629 - DNA, 22 bp, Homo sapiens
ctgcctggaaggagcaagggga

SEQ ID NO: 9082630 - DNA, 22 bp, Homo sapiens
ctgcctgggttcaagtcctgtt

SEQ ID NO: 9082631 - DNA, 22 bp, Homo sapiens
ctgcctgggttcaagtcctgtt

SEQ ID NO: 9082632 - DNA, 22 bp, Homo sapiens
ctgcctgggttcaagtcctgtt

SEQ ID NO: 9082633 - DNA, 22 bp, Homo sapiens
ctgcctgggttcaagtcctgtt

SEQ ID NO: 9082634 - DNA, 22 bp, Homo sapiens
ctgcctggtctcaggcatgggg

SEQ ID NO: 9082635 - DNA, 22 bp, Homo sapiens
ctgcctggtctcaggcatgggg

SEQ ID NO: 9082636 - DNA, 22 bp, Homo sapiens
agttctctttagctcatatggt

SEQ ID NO: 9082637 - DNA, 22 bp, Homo sapiens
agttctcttctcatcacccagg

SEQ ID NO: 9082638 - DNA, 22 bp, Homo sapiens
agttctcttccacagcctcctc

SEQ ID NO: 9082639 - DNA, 22 bp, Homo sapiens
agttctggtggtttggagatct

SEQ ID NO: 9082640 - DNA, 22 bp, Homo sapiens
agttctggcggctgtcggcact

SEQ ID NO: 9082641 - DNA, 22 bp, Homo sapiens
agttctgtggctgtgccctgta

SEQ ID NO: 9082642 - DNA, 22 bp, Homo sapiens
agttctataattaaaatgaagg

SEQ ID NO: 9082643 - DNA, 22 bp, Homo sapiens
agttctcaagacaattacctgt

SEQ ID NO: 9082644 - DNA, 23 bp, Homo sapiens
agttctcaaaaccagcttgacaa

SEQ ID NO: 9082645 - DNA, 22 bp, Homo sapiens
agttctaagtaaatattttata

SEQ ID NO: 9082646 - DNA, 23 bp, Homo sapiens
agttctcattcatcacggcctat

SEQ ID NO: 9082647 - DNA, 22 bp, Homo sapiens
agttctcagaattgcacctcaa

SEQ ID NO: 9082648 - DNA, 22 bp, Homo sapiens
agttctcagcttagtatgctgt

SEQ ID NO: 9082649 - DNA, 22 bp, Homo sapiens
agttctcaggtcagctgagtct

SEQ ID NO: 9082650 - DNA, 22 bp, Homo sapiens
ataaaacttgggtatgatccct

SEQ ID NO: 9082651 - DNA, 22 bp, Homo sapiens
ataaaagaagttttggtacttg

SEQ ID NO: 9082652 - DNA, 22 bp, Homo sapiens
ataaaagaagttttggtacttg

SEQ ID NO: 9082653 - DNA, 22 bp, Homo sapiens
ataaaacttattagaattgtgt

SEQ ID NO: 9082654 - DNA, 22 bp, Homo sapiens
ataaaacttattagaattgtgt

SEQ ID NO: 9082655 - DNA, 22 bp, Homo sapiens
ataaaagaagttttggtacttg

SEQ ID NO: 9082656 - DNA, 22 bp, Homo sapiens
ctgcaggctcgaagacacggat

SEQ ID NO: 9082657 - DNA, 22 bp, Homo sapiens
ataaaagatcccttctgagctc

SEQ ID NO: 9082658 - DNA, 22 bp, Homo sapiens
ataaaaccaaagcagcagtgtt

SEQ ID NO: 9082659 - DNA, 22 bp, Homo sapiens
ataaaaaggacagatgtggtct

SEQ ID NO: 9082660 - DNA, 22 bp, Homo sapiens
ataaaaaggacagatgtggtct

SEQ ID NO: 9082661 - DNA, 22 bp, Homo sapiens
ataaaaaggacagatgtggtct

SEQ ID NO: 9082662 - DNA, 22 bp, Homo sapiens
agttctgttgtctagggaagcc

SEQ ID NO: 9082663 - DNA, 22 bp, Homo sapiens
agttcttcataaccttactgtg

SEQ ID NO: 9082664 - DNA, 22 bp, Homo sapiens
agttcttcataaccttactgtg

SEQ ID NO: 9082665 - DNA, 22 bp, Homo sapiens
ataaagcatactttgtatgact

SEQ ID NO: 9082666 - DNA, 22 bp, Homo sapiens
ataaagcatctagtctgtcact

SEQ ID NO: 9082667 - DNA, 22 bp, Homo sapiens
ataaagcatttcccctgtgtgg

SEQ ID NO: 9082668 - DNA, 22 bp, Homo sapiens
ataaagcctttctgttttcagg

SEQ ID NO: 9082669 - DNA, 22 bp, Homo sapiens
ataaagcaaataggactattgc

SEQ ID NO: 9082670 - DNA, 22 bp, Homo sapiens
ataaagcaatagattgtgtaat

SEQ ID NO: 9082671 - DNA, 22 bp, Homo sapiens
ataaagcatactttgtatgact

SEQ ID NO: 9082672 - DNA, 22 bp, Homo sapiens
ataaactgggtatcaagaggcc

SEQ ID NO: 9082673 - DNA, 22 bp, Homo sapiens
ataaactggtaggaaaacagta

SEQ ID NO: 9082674 - DNA, 22 bp, Homo sapiens
ataaagacatgcttacttgccc

SEQ ID NO: 9082675 - DNA, 22 bp, Homo sapiens
ataaacttgagtctcagagtat

SEQ ID NO: 9082676 - DNA, 22 bp, Homo sapiens
ataaagagtctgggaggcccac

SEQ ID NO: 9082677 - DNA, 22 bp, Homo sapiens
ataaagaggatgtatttacagc

SEQ ID NO: 9082678 - DNA, 22 bp, Homo sapiens
ataaactttagcggaaggagga

SEQ ID NO: 9082679 - DNA, 22 bp, Homo sapiens
ataaagatttctttttctctac

SEQ ID NO: 9082680 - DNA, 22 bp, Homo sapiens
ataaagatttctttttctctac

SEQ ID NO: 9082681 - DNA, 22 bp, Homo sapiens
ctgcaggctgagcgcctgccgg

SEQ ID NO: 9082682 - DNA, 22 bp, Homo sapiens
ctgcaggctgagcgcctgccgg

SEQ ID NO: 9082683 - DNA, 22 bp, Homo sapiens
ctgcagggaccacaagcaggtt

SEQ ID NO: 9082684 - DNA, 22 bp, Homo sapiens
ataaactgaagggaacactgag

SEQ ID NO: 9082685 - DNA, 22 bp, Homo sapiens
ataaactcatgctgaaaaccca

SEQ ID NO: 9082686 - DNA, 22 bp, Homo sapiens
agtcaagattctggcactagca

SEQ ID NO: 9082687 - DNA, 23 bp, Homo sapiens
agtcaagatgcatctgtgaggaa

SEQ ID NO: 9082688 - DNA, 22 bp, Homo sapiens
agtcaataaaagctttagattc

SEQ ID NO: 9082689 - DNA, 22 bp, Homo sapiens
agtagggagaccggaggccgcc

SEQ ID NO: 9082690 - DNA, 22 bp, Homo sapiens
agtaggcatttaataaacatga

SEQ ID NO: 9082691 - DNA, 22 bp, Homo sapiens
agtaggcatagaaagaagcacc

SEQ ID NO: 9082692 - DNA, 22 bp, Homo sapiens
agtaggcagggaataatacaaa

SEQ ID NO: 9082693 - DNA, 22 bp, Homo sapiens
agtaggcagaagtggcattcgg

SEQ ID NO: 9082694 - DNA, 22 bp, Homo sapiens
agtaggcatcccacagtctcct

SEQ ID NO: 9082695 - DNA, 18 bp, Homo sapiens
agtaggcactgtggggtt

SEQ ID NO: 9082696 - DNA, 22 bp, Homo sapiens
agtagcatgtgcacagtaattt

SEQ ID NO: 9082697 - DNA, 22 bp, Homo sapiens
agtagcataaatagtggtagta

SEQ ID NO: 9082698 - DNA, 20 bp, Homo sapiens
agtagcagtgtgacattgac

SEQ ID NO: 9082699 - DNA, 20 bp, Homo sapiens
agtagcagtaatatggaaga

SEQ ID NO: 9082700 - DNA, 22 bp, Homo sapiens
agtagcagagttggactatgca

SEQ ID NO: 9082701 - DNA, 22 bp, Homo sapiens
agtagcagaaggtcttgaaggg

SEQ ID NO: 9082702 - DNA, 22 bp, Homo sapiens
agtagcagaaggtcttgaaggg

SEQ ID NO: 9082703 - DNA, 22 bp, Homo sapiens
agtagcagaaggtcttgaaggg

SEQ ID NO: 9082704 - DNA, 19 bp, Homo sapiens
agtagcagaaagtgcagtg

SEQ ID NO: 9082705 - DNA, 22 bp, Homo sapiens
agtagaaagttgcaggaggaat

SEQ ID NO: 9082706 - DNA, 22 bp, Homo sapiens
agtagaaagttgcaggaggaat

SEQ ID NO: 9082707 - DNA, 22 bp, Homo sapiens
agtagaaatgtaagaaggatta

SEQ ID NO: 9082708 - DNA, 22 bp, Homo sapiens
agtaacagagcatgggttcaga

SEQ ID NO: 9082709 - DNA, 22 bp, Homo sapiens
agtaacagaaggcctgacttaa

SEQ ID NO: 9082710 - DNA, 22 bp, Homo sapiens
agtaacaagtgccaacgttaga

SEQ ID NO: 9082711 - DNA, 22 bp, Homo sapiens
agtaacaagtgccaacgttaga

SEQ ID NO: 9082712 - DNA, 22 bp, Homo sapiens
agtagataccagttctttgact

SEQ ID NO: 9082713 - DNA, 23 bp, Homo sapiens
agtagcacatacagtacttgttc

SEQ ID NO: 9082714 - DNA, 22 bp, Homo sapiens
agtagaaatgtagtgtagagaa

SEQ ID NO: 9082715 - DNA, 22 bp, Homo sapiens
agtaaacatgtaattgttcatt

SEQ ID NO: 9082716 - DNA, 22 bp, Homo sapiens
agtaaacataatttacctgtag

SEQ ID NO: 9082717 - DNA, 22 bp, Homo sapiens
agtaaacatagaatgttcttcc

SEQ ID NO: 9082718 - DNA, 22 bp, Homo sapiens
agtaaacataatttacctgtag

SEQ ID NO: 9082719 - DNA, 22 bp, Homo sapiens
agtaaacatagaatgttcttcc

SEQ ID NO: 9082720 - DNA, 22 bp, Homo sapiens
agtaaataacagagaaaatggg

SEQ ID NO: 9082721 - DNA, 22 bp, Homo sapiens
agtaaataacagagaaaatggg

SEQ ID NO: 9082722 - DNA, 22 bp, Homo sapiens
agtaaatttctgcatgtgtact

SEQ ID NO: 9082723 - DNA, 18 bp, Homo sapiens
agtaaatgttaaatattg

SEQ ID NO: 9082724 - DNA, 18 bp, Homo sapiens
agtaaatggtttattttc

SEQ ID NO: 9082725 - DNA, 22 bp, Homo sapiens
agtaaatgaaagcaattttaga

SEQ ID NO: 9082726 - DNA, 22 bp, Homo sapiens
agtaaacagtatctttagtgtc

SEQ ID NO: 9082727 - DNA, 22 bp, Homo sapiens
ccttctcctgccttgggttcat

SEQ ID NO: 9082728 - DNA, 22 bp, Homo sapiens
ccttctccctctgagaggaacc

SEQ ID NO: 9082729 - DNA, 22 bp, Homo sapiens
ccttccagtatgttaagatggt

SEQ ID NO: 9082730 - DNA, 22 bp, Homo sapiens
ccttccaggttttggctccatt

SEQ ID NO: 9082731 - DNA, 20 bp, Homo sapiens
ccttctccagcttgttcttg

SEQ ID NO: 9082732 - DNA, 22 bp, Homo sapiens
ctaggaaatttaaaatatgatt

SEQ ID NO: 9082733 - DNA, 22 bp, Homo sapiens
ctaggaaatactgtttcaaggc

SEQ ID NO: 9082734 - DNA, 22 bp, Homo sapiens
ctaggaaatttaaaatatgatt

SEQ ID NO: 9082735 - DNA, 22 bp, Homo sapiens
ctaggaaagtgattcttcaatt

SEQ ID NO: 9082736 - DNA, 22 bp, Homo sapiens
ctaggaaagacacagagagttt

SEQ ID NO: 9082737 - DNA, 22 bp, Homo sapiens
ctagctttttatgacaatcttg

SEQ ID NO: 9082738 - DNA, 22 bp, Homo sapiens
ctaggaaagacacagagagttt

SEQ ID NO: 9082739 - DNA, 22 bp, Homo sapiens
ctaggaccactgtaacaaagta

SEQ ID NO: 9082740 - DNA, 22 bp, Homo sapiens
ctagcctgggatttgaacttat

SEQ ID NO: 9082741 - DNA, 22 bp, Homo sapiens
ctagagaaaactgtgtatcttg

SEQ ID NO: 9082742 - DNA, 22 bp, Homo sapiens
ctagctgtgtaaaccgagctgc

SEQ ID NO: 9082743 - DNA, 22 bp, Homo sapiens
ctagcttcaagtcctggctgtg

SEQ ID NO: 9082744 - DNA, 22 bp, Homo sapiens
ctagctgtaagagggatgtggc

SEQ ID NO: 9082745 - DNA, 22 bp, Homo sapiens
agtcacatggactcaggatgac

SEQ ID NO: 9082746 - DNA, 20 bp, Homo sapiens
agtcacattgagcttttgga

SEQ ID NO: 9082747 - DNA, 21 bp, Homo sapiens
agtcacattgggggtttaggg

SEQ ID NO: 9082748 - DNA, 23 bp, Homo sapiens
ctagaattttgctaaaagactag

SEQ ID NO: 9082749 - DNA, 22 bp, Homo sapiens
agtcacagaatgatggctccag

SEQ ID NO: 9082750 - DNA, 22 bp, Homo sapiens
agtcacagaaacccaggtgtgg

SEQ ID NO: 9082751 - DNA, 22 bp, Homo sapiens
agtcacacttcgtatctctagc

SEQ ID NO: 9082752 - DNA, 19 bp, Homo sapiens
agtcacagggaagaggaac

SEQ ID NO: 9082753 - DNA, 22 bp, Homo sapiens
agtcacatagaagtgggtttaa

SEQ ID NO: 9082754 - DNA, 22 bp, Homo sapiens
agtcacatcgattataaaattt

SEQ ID NO: 9082755 - DNA, 22 bp, Homo sapiens
agtcacatagtgttttggaatc

SEQ ID NO: 9082756 - DNA, 20 bp, Homo sapiens
agtcacatgcatacacaagt

SEQ ID NO: 9082757 - DNA, 22 bp, Homo sapiens
agtcacatgcattttcttcaat

SEQ ID NO: 9082758 - DNA, 22 bp, Homo sapiens
agtcacatgagtttctctttat

SEQ ID NO: 9082759 - DNA, 22 bp, Homo sapiens
ctatattctggaatgtccattt

SEQ ID NO: 9082760 - DNA, 22 bp, Homo sapiens
ctatatttcttggctttaaaca

SEQ ID NO: 9082761 - DNA, 22 bp, Homo sapiens
ctatatttggtgagggatgtct

SEQ ID NO: 9082762 - DNA, 22 bp, Homo sapiens
agtcaggaagctggagctgggg

SEQ ID NO: 9082763 - DNA, 22 bp, Homo sapiens
agtcagcagcctggccaggaga

SEQ ID NO: 9082764 - DNA, 22 bp, Homo sapiens
agtcagcagtgaaagcacagcc

SEQ ID NO: 9082765 - DNA, 22 bp, Homo sapiens
agtcagcagtgaaagcacagcc

SEQ ID NO: 9082766 - DNA, 22 bp, Homo sapiens
agtcagcatctgcactgtgctg

SEQ ID NO: 9082767 - DNA, 22 bp, Homo sapiens
agtcagcatctgcactgtgctg

SEQ ID NO: 9082768 - DNA, 22 bp, Homo sapiens
ctatttatctatttctgaatga

SEQ ID NO: 9082769 - DNA, 22 bp, Homo sapiens
ctatttatctatttctgaatga

SEQ ID NO: 9082770 - DNA, 22 bp, Homo sapiens
ctatttaagaataaaaggggca

SEQ ID NO: 9082771 - DNA, 22 bp, Homo sapiens
ctattgtttctatgctctgagg

SEQ ID NO: 9082772 - DNA, 22 bp, Homo sapiens
ctattgaaagtgtacaattcaa

SEQ ID NO: 9082773 - DNA, 22 bp, Homo sapiens
ctattgaatagcccaaatcatt

SEQ ID NO: 9082774 - DNA, 22 bp, Homo sapiens
ctattgaattaactattaaagt

SEQ ID NO: 9082775 - DNA, 22 bp, Homo sapiens
ctattgcatttgcatcttcatc

SEQ ID NO: 9082776 - DNA, 19 bp, Homo sapiens
ctattgcacatagctgaag

SEQ ID NO: 9082777 - DNA, 22 bp, Homo sapiens
ctattgaggacataaggactct

SEQ ID NO: 9082778 - DNA, 22 bp, Homo sapiens
ctattgcatttgcatcttcatc

SEQ ID NO: 9082779 - DNA, 22 bp, Homo sapiens
ctatgaccccagcatgaataag

SEQ ID NO: 9082780 - DNA, 22 bp, Homo sapiens
ctatgaccccagcatgaataag

SEQ ID NO: 9082781 - DNA, 22 bp, Homo sapiens
ctatgaccccagcatgaataag

SEQ ID NO: 9082782 - DNA, 22 bp, Homo sapiens
ctatgaaatgtcagattctgca

SEQ ID NO: 9082783 - DNA, 22 bp, Homo sapiens
ctattctagattacagtataaa

SEQ ID NO: 9082784 - DNA, 22 bp, Homo sapiens
ctatctcagataacctgcacca

SEQ ID NO: 9082785 - DNA, 22 bp, Homo sapiens
cctgggggccaggaaggtgtga

SEQ ID NO: 9082786 - DNA, 22 bp, Homo sapiens
cctgggggccaggaaggtgtga

SEQ ID NO: 9082787 - DNA, 22 bp, Homo sapiens
cctggggtatataggtgaatat

SEQ ID NO: 9082788 - DNA, 20 bp, Homo sapiens
cctggggtacactggcatgt

SEQ ID NO: 9082789 - DNA, 22 bp, Homo sapiens
cctggggctctgcacagagcag

SEQ ID NO: 9082790 - DNA, 22 bp, Homo sapiens
cctggggctctgcacagagcag

SEQ ID NO: 9082791 - DNA, 22 bp, Homo sapiens
cctggggctctgcacagagcag

SEQ ID NO: 9082792 - DNA, 22 bp, Homo sapiens
cctggggctttctttgtatcat

SEQ ID NO: 9082793 - DNA, 22 bp, Homo sapiens
cctgggctttgagggcaggatg

SEQ ID NO: 9082794 - DNA, 20 bp, Homo sapiens
aggtcctggttctctgggat

SEQ ID NO: 9082795 - DNA, 22 bp, Homo sapiens
aggtcctggtgaccatggagtt

SEQ ID NO: 9082796 - DNA, 22 bp, Homo sapiens
aggtcctggtgaccatggagtt

SEQ ID NO: 9082797 - DNA, 20 bp, Homo sapiens
aggtcctggttctctgggat

SEQ ID NO: 9082798 - DNA, 20 bp, Homo sapiens
aggtcctggttctctgggat

SEQ ID NO: 9082799 - DNA, 22 bp, Homo sapiens
aggtcctggtgaccatggagtt

SEQ ID NO: 9082800 - DNA, 22 bp, Homo sapiens
aggtcctggtcttgagtcttaa

SEQ ID NO: 9082801 - DNA, 22 bp, Homo sapiens
aggtcctgggagttctagtgtg

SEQ ID NO: 9082802 - DNA, 20 bp, Homo sapiens
aggtcctgggactggcagag

SEQ ID NO: 9082803 - DNA, 22 bp, Homo sapiens
aggtcctgggagttctagtgtg

SEQ ID NO: 9082804 - DNA, 22 bp, Homo sapiens
aggtcctggtcttgagtcttaa

SEQ ID NO: 9082805 - DNA, 22 bp, Homo sapiens
aggtcctggactgctcttgtta

SEQ ID NO: 9082806 - DNA, 20 bp, Homo sapiens
aggtcctgggactggcagag

SEQ ID NO: 9082807 - DNA, 20 bp, Homo sapiens
aggtcctgggactggcagag

SEQ ID NO: 9082808 - DNA, 23 bp, Homo sapiens
aggtcctggacatatgtgcatca

SEQ ID NO: 9082809 - DNA, 22 bp, Homo sapiens
aggtcctgatgatctctgagag

SEQ ID NO: 9082810 - DNA, 23 bp, Homo sapiens
aggtcctggacatatgtgcatca

SEQ ID NO: 9082811 - DNA, 22 bp, Homo sapiens
aggtcctgatgatctctgagag

SEQ ID NO: 9082812 - DNA, 19 bp, Homo sapiens
aggtcctgatcagcaagga

SEQ ID NO: 9082813 - DNA, 22 bp, Homo sapiens
cctggggtatataggtgaatat

SEQ ID NO: 9082814 - DNA, 22 bp, Homo sapiens
cctgggtcaccaggcccaggca

SEQ ID NO: 9082815 - DNA, 22 bp, Homo sapiens
cctgggtcactcaggcaggcgg

SEQ ID NO: 9082816 - DNA, 22 bp, Homo sapiens
cctgggtcactcaggcaggcgg

SEQ ID NO: 9082817 - DNA, 22 bp, Homo sapiens
cctgggtccaattctggcttgt

SEQ ID NO: 9082818 - DNA, 22 bp, Homo sapiens
cctgggtccaccctgtgaagta

SEQ ID NO: 9082819 - DNA, 17 bp, Homo sapiens
aggtgcagaggcagagc

SEQ ID NO: 9082820 - DNA, 22 bp, Homo sapiens
aggtgcagcatgagtccaacgg

SEQ ID NO: 9082821 - DNA, 22 bp, Homo sapiens
aggtgcagctgacaccatgtgg

SEQ ID NO: 9082822 - DNA, 22 bp, Homo sapiens
aggtgcagctggtggagtctgg

SEQ ID NO: 9082823 - DNA, 22 bp, Homo sapiens
aggtgcagctggtggagtctgg

SEQ ID NO: 9082824 - DNA, 22 bp, Homo sapiens
aggtgcagctggtggagtctgg

SEQ ID NO: 9082825 - DNA, 22 bp, Homo sapiens
cctgtgggagcccaggcagata

SEQ ID NO: 9082826 - DNA, 22 bp, Homo sapiens
cctgtgggagcccaggcagata

SEQ ID NO: 9082827 - DNA, 22 bp, Homo sapiens
aggtggcagagtgacaggctga

SEQ ID NO: 9082828 - DNA, 22 bp, Homo sapiens
aggtggcagcagaatcagggag

SEQ ID NO: 9082829 - DNA, 22 bp, Homo sapiens
cctgtttggtacaatctgccaa

SEQ ID NO: 9082830 - DNA, 21 bp, Homo sapiens
ccttccaccttctgccatgtg

SEQ ID NO: 9082831 - DNA, 22 bp, Homo sapiens
aggtggcagagctggcccagcg

SEQ ID NO: 9082832 - DNA, 22 bp, Homo sapiens
aggtggcagactaacagaagga

SEQ ID NO: 9082833 - DNA, 22 bp, Homo sapiens
aggtggcagactaacagaagga

SEQ ID NO: 9082834 - DNA, 22 bp, Homo sapiens
cctgtgggcttgagtgtagggt

SEQ ID NO: 9082835 - DNA, 22 bp, Homo sapiens
cctgtggggccatctcagtcac

SEQ ID NO: 9082836 - DNA, 22 bp, Homo sapiens
cctgtggggagagatctcttag

SEQ ID NO: 9082837 - DNA, 22 bp, Homo sapiens
cctgtggggctgaaagaggctt

SEQ ID NO: 9082838 - DNA, 22 bp, Homo sapiens
cctgtgggtacaacagggtcac

SEQ ID NO: 9082839 - DNA, 22 bp, Homo sapiens
cctgtgggccctggacagagac

SEQ ID NO: 9082840 - DNA, 22 bp, Homo sapiens
cctgtgggccctggacagagac

SEQ ID NO: 9082841 - DNA, 22 bp, Homo sapiens
cctgtgggccctggacagagac

SEQ ID NO: 9082842 - DNA, 22 bp, Homo sapiens
cctgtgggccaaggacctgcca

SEQ ID NO: 9082843 - DNA, 22 bp, Homo sapiens
cctgtgggcctgcacgtgggga

SEQ ID NO: 9082844 - DNA, 22 bp, Homo sapiens
cctgtgggctgagaacaagggc

SEQ ID NO: 9082845 - DNA, 22 bp, Homo sapiens
cctgtgggcgcagctggagtca

SEQ ID NO: 9082846 - DNA, 22 bp, Homo sapiens
cctgtgggagggagcggctgga

SEQ ID NO: 9082847 - DNA, 23 bp, Homo sapiens
cctgtgggatggcttaatatttt

SEQ ID NO: 9082848 - DNA, 22 bp, Homo sapiens
cctgtgggaggttctgtgagtc

SEQ ID NO: 9082849 - DNA, 22 bp, Homo sapiens
cctgtgggaggggcctggcgcg

SEQ ID NO: 9082850 - DNA, 22 bp, Homo sapiens
cctgtgggaggggcctggcgcg

SEQ ID NO: 9082851 - DNA, 22 bp, Homo sapiens
aggtcagatgggagatgggatg

SEQ ID NO: 9082852 - DNA, 22 bp, Homo sapiens
aggtcagcatgagtagaaggta

SEQ ID NO: 9082853 - DNA, 22 bp, Homo sapiens
aggtcagccctctctgggcagg

SEQ ID NO: 9082854 - DNA, 22 bp, Homo sapiens
aggtcagctgtgtgtgcatgag

SEQ ID NO: 9082855 - DNA, 22 bp, Homo sapiens
aggtcagacacagtgctgggtg

SEQ ID NO: 9082856 - DNA, 22 bp, Homo sapiens
aggtcagacacagtgctgggtg

SEQ ID NO: 9082857 - DNA, 22 bp, Homo sapiens
aggtcagaaaaggagagcattg

SEQ ID NO: 9082858 - DNA, 22 bp, Homo sapiens
aggtcagaaaaggagagcattg

SEQ ID NO: 9082859 - DNA, 22 bp, Homo sapiens
aggtcagaaaaggagagcattg

SEQ ID NO: 9082860 - DNA, 22 bp, Homo sapiens
aggtcaccatggcatgctccac

SEQ ID NO: 9082861 - DNA, 22 bp, Homo sapiens
aggtcaccatggcatgctccac

SEQ ID NO: 9082862 - DNA, 22 bp, Homo sapiens
aggtcacccgtttgactatcca

SEQ ID NO: 9082863 - DNA, 22 bp, Homo sapiens
aggtcaccatggcatgctccac

SEQ ID NO: 9082864 - DNA, 22 bp, Homo sapiens
cctgggaggctgtgggtctgct

SEQ ID NO: 9082865 - DNA, 22 bp, Homo sapiens
cctgggaggctgtttccagcct

SEQ ID NO: 9082866 - DNA, 22 bp, Homo sapiens
cctgggaggctgtttccagcct

SEQ ID NO: 9082867 - DNA, 22 bp, Homo sapiens
cctgggagggcaagtgctgatg

SEQ ID NO: 9082868 - DNA, 22 bp, Homo sapiens
cctgggagggcaagtgctgatg

SEQ ID NO: 9082869 - DNA, 22 bp, Homo sapiens
cctgggaggtggaggttgcagc

SEQ ID NO: 9082870 - DNA, 22 bp, Homo sapiens
cctgggaggtggaggttgcagc

SEQ ID NO: 9082871 - DNA, 22 bp, Homo sapiens
cctgggaggtggaggttgcagt

SEQ ID NO: 9082872 - DNA, 22 bp, Homo sapiens
cctgggaggtggaggttgcagt

SEQ ID NO: 9082873 - DNA, 22 bp, Homo sapiens
cctgggaggctgaggctgcagt

SEQ ID NO: 9082874 - DNA, 21 bp, Homo sapiens
cctgggagaattgggtgtggc

SEQ ID NO: 9082875 - DNA, 22 bp, Homo sapiens
cctgggaggctgaggctgcagt

SEQ ID NO: 9082876 - DNA, 22 bp, Homo sapiens
aggtaaggtttggaggcagtgg

SEQ ID NO: 9082877 - DNA, 22 bp, Homo sapiens
aggtacagatgaaagtctagtt

SEQ ID NO: 9082878 - DNA, 22 bp, Homo sapiens
aggtaattgtatgttccaagca

SEQ ID NO: 9082879 - DNA, 22 bp, Homo sapiens
aggtaatttctccaaacatgct

SEQ ID NO: 9082880 - DNA, 22 bp, Homo sapiens
aggtaattttgtgttaatgatt

SEQ ID NO: 9082881 - DNA, 22 bp, Homo sapiens
aggtacagcaatataagaggtc

SEQ ID NO: 9082882 - DNA, 22 bp, Homo sapiens
aggtcacacaactgtcagaggc

SEQ ID NO: 9082883 - DNA, 22 bp, Homo sapiens
aggtcacagctttctcgtgagg

SEQ ID NO: 9082884 - DNA, 22 bp, Homo sapiens
aggtaaggaaattgaggcaatt

SEQ ID NO: 9082885 - DNA, 22 bp, Homo sapiens
aggtaagcatggtggctgctgt

SEQ ID NO: 9082886 - DNA, 22 bp, Homo sapiens
aggtaagggtcacagttcatat

SEQ ID NO: 9082887 - DNA, 22 bp, Homo sapiens
aggtaaggctgtaagctaagcc

SEQ ID NO: 9082888 - DNA, 22 bp, Homo sapiens
aggtaacactacttagtatact

SEQ ID NO: 9082889 - DNA, 22 bp, Homo sapiens
aggtaacagcttcagcttcaga

SEQ ID NO: 9082890 - DNA, 22 bp, Homo sapiens
aggtaaaatagatagtatttct

SEQ ID NO: 9082891 - DNA, 22 bp, Homo sapiens
aggtaaaatagatagtatttct

SEQ ID NO: 9082892 - DNA, 19 bp, Homo sapiens
agggttacccgctgccacc

SEQ ID NO: 9082893 - DNA, 20 bp, Homo sapiens
agggttcccttgttcagcag

SEQ ID NO: 9082894 - DNA, 22 bp, Homo sapiens
agggttctgccagtgtcttgag

SEQ ID NO: 9082895 - DNA, 22 bp, Homo sapiens
agggttgaagtctggtcctcat

SEQ ID NO: 9082896 - DNA, 22 bp, Homo sapiens
cctgaggtggctgcagcactgc

SEQ ID NO: 9082897 - DNA, 22 bp, Homo sapiens
agggtgggctagactcttcccc

SEQ ID NO: 9082898 - DNA, 21 bp, Homo sapiens
agtgccaaaacggaaggtggc

SEQ ID NO: 9082899 - DNA, 22 bp, Homo sapiens
agtgccaaacagtacataacat

SEQ ID NO: 9082900 - DNA, 22 bp, Homo sapiens
agtgccaagagtgagccatgag

SEQ ID NO: 9082901 - DNA, 22 bp, Homo sapiens
agtgccaagtagaaatgaattt

SEQ ID NO: 9082902 - DNA, 22 bp, Homo sapiens
agtgatgtgggagagtatagct

SEQ ID NO: 9082903 - DNA, 22 bp, Homo sapiens
agtgatttactaccatattggg

SEQ ID NO: 9082904 - DNA, 22 bp, Homo sapiens
agtgcctggcacatggaaggtg

SEQ ID NO: 9082905 - DNA, 22 bp, Homo sapiens
agtgcctggaccccatgacata

SEQ ID NO: 9082906 - DNA, 22 bp, Homo sapiens
agtgcctcttgtctacggtttt

SEQ ID NO: 9082907 - DNA, 22 bp, Homo sapiens
agtgcgtggtttacagctagtt

SEQ ID NO: 9082908 - DNA, 22 bp, Homo sapiens
agtgctaatgtgcaatatagag

SEQ ID NO: 9082909 - DNA, 22 bp, Homo sapiens
agtgctgggtactgttcccatt

SEQ ID NO: 9082910 - DNA, 22 bp, Homo sapiens
agtgccctgggccttccaggac

SEQ ID NO: 9082911 - DNA, 22 bp, Homo sapiens
agtgccctggcccagctggacc

SEQ ID NO: 9082912 - DNA, 22 bp, Homo sapiens
agtgccctgctggggcaggaga

SEQ ID NO: 9082913 - DNA, 22 bp, Homo sapiens
agtgccaggagcaaggagctcc

SEQ ID NO: 9082914 - DNA, 20 bp, Homo sapiens
agtgccagggcaggtgagag

SEQ ID NO: 9082915 - DNA, 22 bp, Homo sapiens
agtgccatggaggaacagatgc

SEQ ID NO: 9082916 - DNA, 22 bp, Homo sapiens
agtggacccggaacagaggccc

SEQ ID NO: 9082917 - DNA, 22 bp, Homo sapiens
agtgcttttattatatacagga

SEQ ID NO: 9082918 - DNA, 21 bp, Homo sapiens
agtggaacccttagggtcagg

SEQ ID NO: 9082919 - DNA, 22 bp, Homo sapiens
agtggaacactacattgttgtt

SEQ ID NO: 9082920 - DNA, 22 bp, Homo sapiens
agtggaaggtcaggggacagtg

SEQ ID NO: 9082921 - DNA, 22 bp, Homo sapiens
agtggaattgctgattgaaata

SEQ ID NO: 9082922 - DNA, 22 bp, Homo sapiens
agtggcatcaaatcaaggtttg

SEQ ID NO: 9082923 - DNA, 22 bp, Homo sapiens
agtggcatcaactttatctgta

SEQ ID NO: 9082924 - DNA, 22 bp, Homo sapiens
agtggcagtggggcagggccct

SEQ ID NO: 9082925 - DNA, 20 bp, Homo sapiens
agtggccactgcagagatgc

SEQ ID NO: 9082926 - DNA, 22 bp, Homo sapiens
agtggccactgacttggaaatc

SEQ ID NO: 9082927 - DNA, 20 bp, Homo sapiens
agtggcagggaaatggaaag

SEQ ID NO: 9082928 - DNA, 22 bp, Homo sapiens
agtggcaatgggagtggagaca

SEQ ID NO: 9082929 - DNA, 22 bp, Homo sapiens
agtcctgggtctggagaatgga

SEQ ID NO: 9082930 - DNA, 22 bp, Homo sapiens
agtctacaatcttaaatgaact

SEQ ID NO: 9082931 - DNA, 22 bp, Homo sapiens
agtctatactggactgttgtga

SEQ ID NO: 9082932 - DNA, 22 bp, Homo sapiens
agtctagcttaggagcctagct

SEQ ID NO: 9082933 - DNA, 22 bp, Homo sapiens
agtctcagaaaagaagcatgga

SEQ ID NO: 9082934 - DNA, 22 bp, Homo sapiens
agtctcagaaaagaagcatgga

SEQ ID NO: 9082935 - DNA, 19 bp, Homo sapiens
agtctcacccaagcagtct

SEQ ID NO: 9082936 - DNA, 22 bp, Homo sapiens
agtctcacttcttgagctatgc

SEQ ID NO: 9082937 - DNA, 22 bp, Homo sapiens
ctcacagtgtaatattgaaccc

SEQ ID NO: 9082938 - DNA, 20 bp, Homo sapiens
ctcacagtcaatgcagaggt

SEQ ID NO: 9082939 - DNA, 22 bp, Homo sapiens
ctcacagttggctcattaatga

SEQ ID NO: 9082940 - DNA, 22 bp, Homo sapiens
ctcacattcacaggacagaagg

SEQ ID NO: 9082941 - DNA, 22 bp, Homo sapiens
ctcacattccacttgtgccaac

SEQ ID NO: 9082942 - DNA, 22 bp, Homo sapiens
ctcaccacagagcctgtccagc

SEQ ID NO: 9082943 - DNA, 22 bp, Homo sapiens
agtgaaatcaggttttgactgc

SEQ ID NO: 9082944 - DNA, 22 bp, Homo sapiens
agtgaaatagcatttatgaagc

SEQ ID NO: 9082945 - DNA, 22 bp, Homo sapiens
agtgaaaggttgagaatattct

SEQ ID NO: 9082946 - DNA, 22 bp, Homo sapiens
agtgaaaggttgagaatattct

SEQ ID NO: 9082947 - DNA, 22 bp, Homo sapiens
agtgaaaggttgagaatattct

SEQ ID NO: 9082948 - DNA, 22 bp, Homo sapiens
agtgaaaagatgcatttctctg

SEQ ID NO: 9082949 - DNA, 22 bp, Homo sapiens
agtgaaaacctaatcatgcagt

SEQ ID NO: 9082950 - DNA, 22 bp, Homo sapiens
agtgaaaacactagttcttgcc

SEQ ID NO: 9082951 - DNA, 22 bp, Homo sapiens
agtcttttattcaaggctaagt

SEQ ID NO: 9082952 - DNA, 22 bp, Homo sapiens
agtgaaaacactagttcttgcc

SEQ ID NO: 9082953 - DNA, 22 bp, Homo sapiens
agtgaaaacactagttcttgcc

SEQ ID NO: 9082954 - DNA, 22 bp, Homo sapiens
agtctttggttataagagacag

SEQ ID NO: 9082955 - DNA, 22 bp, Homo sapiens
agtgacttctcctaatgtcata

SEQ ID NO: 9082956 - DNA, 22 bp, Homo sapiens
agtgaggctaataggcaatggt

SEQ ID NO: 9082957 - DNA, 22 bp, Homo sapiens
agtgaggctaataggcaatggt

SEQ ID NO: 9082958 - DNA, 22 bp, Homo sapiens
agtgagtggagagctctaggtt

SEQ ID NO: 9082959 - DNA, 22 bp, Homo sapiens
agtgaggggcagctgagtgggc

SEQ ID NO: 9082960 - DNA, 22 bp, Homo sapiens
agtgaggggcagctgagtgggc

SEQ ID NO: 9082961 - DNA, 22 bp, Homo sapiens
agtgaggggattcaggcaaggt

SEQ ID NO: 9082962 - DNA, 22 bp, Homo sapiens
agtgatattagcaaatggttat

SEQ ID NO: 9082963 - DNA, 20 bp, Homo sapiens
agtgagttatcagctacagt

SEQ ID NO: 9082964 - DNA, 22 bp, Homo sapiens
agtgatggcatcgggtccagca

SEQ ID NO: 9082965 - DNA, 22 bp, Homo sapiens
agtgatggggccctgcactgat

SEQ ID NO: 9082966 - DNA, 22 bp, Homo sapiens
agtgatggagcttcctctgcta

SEQ ID NO: 9082967 - DNA, 22 bp, Homo sapiens
agtgggtgataagaccaaggag

SEQ ID NO: 9082968 - DNA, 22 bp, Homo sapiens
agtggcctggagccccgcctgg

SEQ ID NO: 9082969 - DNA, 22 bp, Homo sapiens
agtggcctggagccccgcctgg

SEQ ID NO: 9082970 - DNA, 22 bp, Homo sapiens
agtggctatgcatgactggaat

SEQ ID NO: 9082971 - DNA, 22 bp, Homo sapiens
agtggcctggagccccgcctgg

SEQ ID NO: 9082972 - DNA, 22 bp, Homo sapiens
agtggccagtgctgctctgggg

SEQ ID NO: 9082973 - DNA, 22 bp, Homo sapiens
ctctggagttcccttgatctga

SEQ ID NO: 9082974 - DNA, 22 bp, Homo sapiens
ctctggagttagtgatctgggc

SEQ ID NO: 9082975 - DNA, 22 bp, Homo sapiens
ctctggagtgtctggccagggt

SEQ ID NO: 9082976 - DNA, 22 bp, Homo sapiens
ctctggagtgtctggccagggt

SEQ ID NO: 9082977 - DNA, 21 bp, Homo sapiens
ctctggagtttgaaggctggg

SEQ ID NO: 9082978 - DNA, 22 bp, Homo sapiens
ctctggagttctcatgaggaac

SEQ ID NO: 9082979 - DNA, 22 bp, Homo sapiens
ctctggagttctcatgaggaac

SEQ ID NO: 9082980 - DNA, 22 bp, Homo sapiens
agtgggtgtagtcttcctcctg

SEQ ID NO: 9082981 - DNA, 20 bp, Homo sapiens
agtgggtgtaagttattgcc

SEQ ID NO: 9082982 - DNA, 22 bp, Homo sapiens
agtgggtgggtgtctgacagtt

SEQ ID NO: 9082983 - DNA, 22 bp, Homo sapiens
agtgggtggcgcagaggaggaa

SEQ ID NO: 9082984 - DNA, 22 bp, Homo sapiens
ctctggagtgggtggccgggag

SEQ ID NO: 9082985 - DNA, 22 bp, Homo sapiens
agtggtagaaaatgcagctcga

SEQ ID NO: 9082986 - DNA, 22 bp, Homo sapiens
agtggtaggggccatgccaaca

SEQ ID NO: 9082987 - DNA, 22 bp, Homo sapiens
agtgtgagaacggactaataaa

SEQ ID NO: 9082988 - DNA, 23 bp, Homo sapiens
agtgtgacttttttgactgtcac

SEQ ID NO: 9082989 - DNA, 22 bp, Homo sapiens
agtgtgagatgattgaggagca

SEQ ID NO: 9082990 - DNA, 22 bp, Homo sapiens
agtgtgagatgattgaggagca

SEQ ID NO: 9082991 - DNA, 22 bp, Homo sapiens
agtgtgagtaattcagggaggg

SEQ ID NO: 9082992 - DNA, 22 bp, Homo sapiens
agtgtgagtaattcagggaggg

SEQ ID NO: 9082993 - DNA, 22 bp, Homo sapiens
agtgtgagtaattgagtctgtc

SEQ ID NO: 9082994 - DNA, 22 bp, Homo sapiens
agtgtctgggctcccttggagc

SEQ ID NO: 9082995 - DNA, 20 bp, Homo sapiens
agtgtctgggcctcaggccc

SEQ ID NO: 9082996 - DNA, 22 bp, Homo sapiens
agtgtcctcctctgggagccag

SEQ ID NO: 9082997 - DNA, 22 bp, Homo sapiens
agtgtcccctccaagggcctgg

SEQ ID NO: 9082998 - DNA, 22 bp, Homo sapiens
agtgtcccctccaagggcctgg

SEQ ID NO: 9082999 - DNA, 22 bp, Homo sapiens
agtgtccaactcagcttgtcaa

SEQ ID NO: 9083000 - DNA, 22 bp, Homo sapiens
agtgtcccctacagaggcattc

SEQ ID NO: 9083001 - DNA, 21 bp, Homo sapiens
agtgtcatttgatcattgtta

SEQ ID NO: 9083002 - DNA, 21 bp, Homo sapiens
agtgtcatttgatcattgtta

SEQ ID NO: 9083003 - DNA, 17 bp, Homo sapiens
agtgtcagaagacagtt

SEQ ID NO: 9083004 - DNA, 22 bp, Homo sapiens
agtgtcacagacccaatcagga

SEQ ID NO: 9083005 - DNA, 22 bp, Homo sapiens
agtgtcaatgctctgttaaaaa

SEQ ID NO: 9083006 - DNA, 22 bp, Homo sapiens
agtgtcaactcggaataaggat

SEQ ID NO: 9083007 - DNA, 21 bp, Homo sapiens
agtgtcattcccaagctgtga

SEQ ID NO: 9083008 - DNA, 22 bp, Homo sapiens
agtgtcatgaatcaaagattat

SEQ ID NO: 9083009 - DNA, 22 bp, Homo sapiens
agtgtcaactgtctacagggag

SEQ ID NO: 9083010 - DNA, 22 bp, Homo sapiens
agtgtatttgagcatctcctta

SEQ ID NO: 9083011 - DNA, 22 bp, Homo sapiens
agtgtattgtctcacagttctt

SEQ ID NO: 9083012 - DNA, 22 bp, Homo sapiens
agtgtatttgagcatctcctta

SEQ ID NO: 9083013 - DNA, 22 bp, Homo sapiens
ctgagctatggaggcaagacat

SEQ ID NO: 9083014 - DNA, 22 bp, Homo sapiens
ctgagctatgaactgcagccta

SEQ ID NO: 9083015 - DNA, 22 bp, Homo sapiens
ctgagctatagaattgtcagca

SEQ ID NO: 9083016 - DNA, 22 bp, Homo sapiens
ctgagccagggccacacatgga

SEQ ID NO: 9083017 - DNA, 22 bp, Homo sapiens
ctgagccagggccacacatgga

SEQ ID NO: 9083018 - DNA, 22 bp, Homo sapiens
ctgagccagggccacacatgga

SEQ ID NO: 9083019 - DNA, 22 bp, Homo sapiens
ctgagccagctggcatgtgcta

SEQ ID NO: 9083020 - DNA, 22 bp, Homo sapiens
ctgagccagctggcatgtgcta

SEQ ID NO: 9083021 - DNA, 22 bp, Homo sapiens
ctgagccagctggcatgtgcta

SEQ ID NO: 9083022 - DNA, 22 bp, Homo sapiens
ctgagccagcgggctcactttt

SEQ ID NO: 9083023 - DNA, 22 bp, Homo sapiens
ctgagccagcgggctcactttt

SEQ ID NO: 9083024 - DNA, 22 bp, Homo sapiens
agttaacatttgagctaaaagg

SEQ ID NO: 9083025 - DNA, 22 bp, Homo sapiens
agttaacacatccagaatagag

SEQ ID NO: 9083026 - DNA, 19 bp, Homo sapiens
ctgagcagcggcagcactt

SEQ ID NO: 9083027 - DNA, 22 bp, Homo sapiens
ctgagcagccccaccagccatt

SEQ ID NO: 9083028 - DNA, 22 bp, Homo sapiens
ctgagccactgcttgttcagtg

SEQ ID NO: 9083029 - DNA, 22 bp, Homo sapiens
ctgagccactgcttgttcagtg

SEQ ID NO: 9083030 - DNA, 22 bp, Homo sapiens
ctgagccagagggagtcgggtc

SEQ ID NO: 9083031 - DNA, 22 bp, Homo sapiens
ctgagccagagggagtcgggtc

SEQ ID NO: 9083032 - DNA, 22 bp, Homo sapiens
ctgagccactgcttgttcagtg

SEQ ID NO: 9083033 - DNA, 22 bp, Homo sapiens
ctgagccagcgggctcactttt

SEQ ID NO: 9083034 - DNA, 22 bp, Homo sapiens
ctgagccaaggggacagtgaca

SEQ ID NO: 9083035 - DNA, 22 bp, Homo sapiens
ctgagccaaggggacagtgaca

SEQ ID NO: 9083036 - DNA, 22 bp, Homo sapiens
ctgagccaccggcagggacatc

SEQ ID NO: 9083037 - DNA, 22 bp, Homo sapiens
ctgagccaccggcagggacatc

SEQ ID NO: 9083038 - DNA, 22 bp, Homo sapiens
agttccaccatttaggatctgt

SEQ ID NO: 9083039 - DNA, 22 bp, Homo sapiens
agttccaatcctggcatttatt

SEQ ID NO: 9083040 - DNA, 22 bp, Homo sapiens
agttccaaagcctgtattctta

SEQ ID NO: 9083041 - DNA, 22 bp, Homo sapiens
agttcctggatttggggttgca

SEQ ID NO: 9083042 - DNA, 20 bp, Homo sapiens
ctgagctgagctccatgggt

SEQ ID NO: 9083043 - DNA, 22 bp, Homo sapiens
ctgagctgaaacttgagaggct

SEQ ID NO: 9083044 - DNA, 22 bp, Homo sapiens
ctgagctgacatcttcctcttt

SEQ ID NO: 9083045 - DNA, 22 bp, Homo sapiens
ctgagctgctcccgctgcagcg

SEQ ID NO: 9083046 - DNA, 22 bp, Homo sapiens
ctgagctgctcccgctgcagcg

SEQ ID NO: 9083047 - DNA, 22 bp, Homo sapiens
ctgagctgcggcaggcacctgg

SEQ ID NO: 9083048 - DNA, 22 bp, Homo sapiens
ctgagctgcggcaggcacctgg

SEQ ID NO: 9083049 - DNA, 22 bp, Homo sapiens
agttatttcagtaacataatag

SEQ ID NO: 9083050 - DNA, 22 bp, Homo sapiens
ctgagctgctttgcttttgggg

SEQ ID NO: 9083051 - DNA, 22 bp, Homo sapiens
agtgtttgcatctcattgattt

SEQ ID NO: 9083052 - DNA, 17 bp, Homo sapiens
agtgtttccttatcatt

SEQ ID NO: 9083053 - DNA, 22 bp, Homo sapiens
agttaaatgtcagtagcttaac

SEQ ID NO: 9083054 - DNA, 22 bp, Homo sapiens
agttaaatcattactgacagag

SEQ ID NO: 9083055 - DNA, 21 bp, Homo sapiens
agttaaacctttagagaacta

SEQ ID NO: 9083056 - DNA, 22 bp, Homo sapiens
agtgttttattagaacacagcc

SEQ ID NO: 9083057 - DNA, 17 bp, Homo sapiens
agtgtggccctggttaa

SEQ ID NO: 9083058 - DNA, 22 bp, Homo sapiens
agtgtgagttacaaagtgtgaa

SEQ ID NO: 9083059 - DNA, 20 bp, Homo sapiens
agtgtgcatttagagtctgc

SEQ ID NO: 9083060 - DNA, 22 bp, Homo sapiens
gctctgggtgaacttggagcaa

SEQ ID NO: 9083061 - DNA, 22 bp, Homo sapiens
caaatgaaaatggcgtcttgga

SEQ ID NO: 9083062 - DNA, 15 bp, Homo sapiens
gctctgggtatttga

SEQ ID NO: 9083063 - DNA, 22 bp, Homo sapiens
gctctgggtgaatggcagattg

SEQ ID NO: 9083064 - DNA, 20 bp, Homo sapiens
gctctgggtggtaaatgact

SEQ ID NO: 9083065 - DNA, 22 bp, Homo sapiens
gctctgggtgaagggtaccatt

SEQ ID NO: 9083066 - DNA, 22 bp, Homo sapiens
caaatctccttaaaggtaaaat

SEQ ID NO: 9083067 - DNA, 17 bp, Homo sapiens
caaatcctaggatgtct

SEQ ID NO: 9083068 - DNA, 22 bp, Homo sapiens
caaatctacatgaacccaaaga

SEQ ID NO: 9083069 - DNA, 22 bp, Homo sapiens
caaatcatggaataactagaga

SEQ ID NO: 9083070 - DNA, 20 bp, Homo sapiens
caaatccctgctctgtgctg

SEQ ID NO: 9083071 - DNA, 19 bp, Homo sapiens
gctctgagaggggcatggg

SEQ ID NO: 9083072 - DNA, 22 bp, Homo sapiens
caaatagactctagaatttatt

SEQ ID NO: 9083073 - DNA, 22 bp, Homo sapiens
gctgaggaaaccaatgctcaga

SEQ ID NO: 9083074 - DNA, 22 bp, Homo sapiens
gctgaggaaggtttcttatcaa

SEQ ID NO: 9083075 - DNA, 22 bp, Homo sapiens
gctgaggaagtcaggtggccca

SEQ ID NO: 9083076 - DNA, 22 bp, Homo sapiens
gctgaggaaaggctggaaggga

SEQ ID NO: 9083077 - DNA, 22 bp, Homo sapiens
gctgaggaaaggctggaaggga

SEQ ID NO: 9083078 - DNA, 22 bp, Homo sapiens
gctgaggaagtcaggtggccca

SEQ ID NO: 9083079 - DNA, 22 bp, Homo sapiens
gctgaggacatacacattgtgc

SEQ ID NO: 9083080 - DNA, 20 bp, Homo sapiens
gctgaggagcagtgtggttg

SEQ ID NO: 9083081 - DNA, 22 bp, Homo sapiens
gctgaggacatcatggaaggaa

SEQ ID NO: 9083082 - DNA, 22 bp, Homo sapiens
gctgaggacatcatggaaggaa

SEQ ID NO: 9083083 - DNA, 22 bp, Homo sapiens
gctgagctgctgttcatcctgc

SEQ ID NO: 9083084 - DNA, 22 bp, Homo sapiens
gctgagctgaggcagggctggg

SEQ ID NO: 9083085 - DNA, 22 bp, Homo sapiens
gctgagaaatgcagacatgctg

SEQ ID NO: 9083086 - DNA, 22 bp, Homo sapiens
gctgactttgcctgtctttagc

SEQ ID NO: 9083087 - DNA, 22 bp, Homo sapiens
gctgagctgggacagtcctggg

SEQ ID NO: 9083088 - DNA, 22 bp, Homo sapiens
gctgagctgggacagtcctggg

SEQ ID NO: 9083089 - DNA, 22 bp, Homo sapiens
gctgagctgggacagtcctggg

SEQ ID NO: 9083090 - DNA, 22 bp, Homo sapiens
gctctgggttctgatttatgag

SEQ ID NO: 9083091 - DNA, 22 bp, Homo sapiens
caaatgaatagggagtgtgatg

SEQ ID NO: 9083092 - DNA, 22 bp, Homo sapiens
caaatgaagtccaaagggctta

SEQ ID NO: 9083093 - DNA, 22 bp, Homo sapiens
caaatgaagggagctgaagtct

SEQ ID NO: 9083094 - DNA, 22 bp, Homo sapiens
caaatgaaggtggtgggtcatt

SEQ ID NO: 9083095 - DNA, 22 bp, Homo sapiens
caaatgaaggtggtgggtcatt

SEQ ID NO: 9083096 - DNA, 22 bp, Homo sapiens
gctgaggagcgagaactctgct

SEQ ID NO: 9083097 - DNA, 22 bp, Homo sapiens
gctgaggaggtgtggttaggtg

SEQ ID NO: 9083098 - DNA, 22 bp, Homo sapiens
gctgaggaggtgtggttaggtg

SEQ ID NO: 9083099 - DNA, 22 bp, Homo sapiens
caaatgaagaaccttctcacct

SEQ ID NO: 9083100 - DNA, 22 bp, Homo sapiens
caaatgaagaaccttctcacct

SEQ ID NO: 9083101 - DNA, 22 bp, Homo sapiens
caaatgaagagggcaacttctg

SEQ ID NO: 9083102 - DNA, 22 bp, Homo sapiens
caaatgaagggagctgaagtct

SEQ ID NO: 9083103 - DNA, 22 bp, Homo sapiens
caaatgaatatttccatgggtt

SEQ ID NO: 9083104 - DNA, 22 bp, Homo sapiens
caaatgaatttccctgcaaatg

SEQ ID NO: 9083105 - DNA, 22 bp, Homo sapiens
caaatgaatatttccatgggtt

SEQ ID NO: 9083106 - DNA, 22 bp, Homo sapiens
caaatgaatatttccatgggtt

SEQ ID NO: 9083107 - DNA, 22 bp, Homo sapiens
caaatgaatagggagtgtgatg

SEQ ID NO: 9083108 - DNA, 22 bp, Homo sapiens
caaattcaatgaacatgtttaa

SEQ ID NO: 9083109 - DNA, 22 bp, Homo sapiens
caaattcaatgaacatgtttaa

SEQ ID NO: 9083110 - DNA, 22 bp, Homo sapiens
caaattcaaatttcatcagtgt

SEQ ID NO: 9083111 - DNA, 22 bp, Homo sapiens
caaattcacatgattgcttctg

SEQ ID NO: 9083112 - DNA, 22 bp, Homo sapiens
caaattcacatgattgcttctg

SEQ ID NO: 9083113 - DNA, 22 bp, Homo sapiens
caaattcaatgaacatgtttaa

SEQ ID NO: 9083114 - DNA, 22 bp, Homo sapiens
caaattcaaatttcatcagtgt

SEQ ID NO: 9083115 - DNA, 22 bp, Homo sapiens
caaattaccctcaacatctaga

SEQ ID NO: 9083116 - DNA, 22 bp, Homo sapiens
gctctagtaggaatgtccctct

SEQ ID NO: 9083117 - DNA, 22 bp, Homo sapiens
gctctagaaagaaggatgtggg

SEQ ID NO: 9083118 - DNA, 22 bp, Homo sapiens
gctcgaccgccagaaacttcct

SEQ ID NO: 9083119 - DNA, 22 bp, Homo sapiens
gctccaggctgctctgtcccat

SEQ ID NO: 9083120 - DNA, 22 bp, Homo sapiens
gctcagtctttgtggggtacgg

SEQ ID NO: 9083121 - DNA, 19 bp, Homo sapiens
gctcagtctcctgattgct

SEQ ID NO: 9083122 - DNA, 22 bp, Homo sapiens
gctccaggcagcatagtggatg

SEQ ID NO: 9083123 - DNA, 17 bp, Homo sapiens
gctccaggcgtgagtga

SEQ ID NO: 9083124 - DNA, 22 bp, Homo sapiens
gctccaggcgagctggaccaga

SEQ ID NO: 9083125 - DNA, 23 bp, Homo sapiens
gctcaggtggctcagggactgat

SEQ ID NO: 9083126 - DNA, 18 bp, Homo sapiens
gctcaggtatagacaggg

SEQ ID NO: 9083127 - DNA, 22 bp, Homo sapiens
gctcagggctaaggctgagggg

SEQ ID NO: 9083128 - DNA, 22 bp, Homo sapiens
gctcaggggaatgggctgccgt

SEQ ID NO: 9083129 - DNA, 22 bp, Homo sapiens
gctcagggtcccttggtgctgg

SEQ ID NO: 9083130 - DNA, 22 bp, Homo sapiens
gctcaaagaccagacagaggag

SEQ ID NO: 9083131 - DNA, 22 bp, Homo sapiens
gctcaaaggttgatagctgtgc

SEQ ID NO: 9083132 - DNA, 22 bp, Homo sapiens
gctattcatggagcatgtactg

SEQ ID NO: 9083133 - DNA, 22 bp, Homo sapiens
gctattcatcaattgttctagc

SEQ ID NO: 9083134 - DNA, 22 bp, Homo sapiens
gctatgttcccttttgctataa

SEQ ID NO: 9083135 - DNA, 22 bp, Homo sapiens
gctacacaaaaggagagtgagt

SEQ ID NO: 9083136 - DNA, 22 bp, Homo sapiens
gctacaaagagagcccactcta

SEQ ID NO: 9083137 - DNA, 22 bp, Homo sapiens
gctaatactttggaaagaatgt

SEQ ID NO: 9083138 - DNA, 22 bp, Homo sapiens
gctaatgatagcaagataaaca

SEQ ID NO: 9083139 - DNA, 22 bp, Homo sapiens
gctaaggctcaggttctaagga

SEQ ID NO: 9083140 - DNA, 22 bp, Homo sapiens
gctaaggccttaactcatggag

SEQ ID NO: 9083141 - DNA, 15 bp, Homo sapiens
gctaaggcattggta

SEQ ID NO: 9083142 - DNA, 22 bp, Homo sapiens
gctaaggcacaaatagctttgc

SEQ ID NO: 9083143 - DNA, 23 bp, Homo sapiens
gctaaattgaagtctcaggggaa

SEQ ID NO: 9083144 - DNA, 22 bp, Homo sapiens
gctaaatttaagcctttctcct

SEQ ID NO: 9083145 - DNA, 23 bp, Homo sapiens
gctaaattgaagtctcaggggaa

SEQ ID NO: 9083146 - DNA, 22 bp, Homo sapiens
gctaaatgatgggaaatctggg

SEQ ID NO: 9083147 - DNA, 22 bp, Homo sapiens
gcgtggtgctgccctgcacaca

SEQ ID NO: 9083148 - DNA, 22 bp, Homo sapiens
gcgtgggtccaagaatctgtga

SEQ ID NO: 9083149 - DNA, 22 bp, Homo sapiens
gcgttggggaccccgaagctgg

SEQ ID NO: 9083150 - DNA, 22 bp, Homo sapiens
gcctggctcctaaggactggct

SEQ ID NO: 9083151 - DNA, 21 bp, Homo sapiens
gcctggctctcactggcctgg

SEQ ID NO: 9083152 - DNA, 22 bp, Homo sapiens
attttcttctctccctggctgc

SEQ ID NO: 9083153 - DNA, 22 bp, Homo sapiens
attttctagatagatgatgcat

SEQ ID NO: 9083154 - DNA, 22 bp, Homo sapiens
attttcttctctccctggctgc

SEQ ID NO: 9083155 - DNA, 22 bp, Homo sapiens
attttgaaaccaagttatttcc

SEQ ID NO: 9083156 - DNA, 22 bp, Homo sapiens
attttgaaaccaagttatttcc

SEQ ID NO: 9083157 - DNA, 22 bp, Homo sapiens
attttgaaaagcatttgagtaa

SEQ ID NO: 9083158 - DNA, 22 bp, Homo sapiens
attttgaaaagcatttgagtaa

SEQ ID NO: 9083159 - DNA, 22 bp, Homo sapiens
attttgaaaagcatttgagtaa

SEQ ID NO: 9083160 - DNA, 22 bp, Homo sapiens
gcctggctcacagagcagcctt

SEQ ID NO: 9083161 - DNA, 22 bp, Homo sapiens
gcctggctcacagagcagcctt

SEQ ID NO: 9083162 - DNA, 22 bp, Homo sapiens
gcctggctcctaagagcacaac

SEQ ID NO: 9083163 - DNA, 22 bp, Homo sapiens
attttgaaatacttgaaggaaa

SEQ ID NO: 9083164 - DNA, 18 bp, Homo sapiens
attttgaacaatgctgta

SEQ ID NO: 9083165 - DNA, 18 bp, Homo sapiens
attttgaactgggaatat

SEQ ID NO: 9083166 - DNA, 22 bp, Homo sapiens
attttgaagggaattgaagttc

SEQ ID NO: 9083167 - DNA, 22 bp, Homo sapiens
attttactaagtggatatctgt

SEQ ID NO: 9083168 - DNA, 22 bp, Homo sapiens
gcctgcccacggggctggcata

SEQ ID NO: 9083169 - DNA, 22 bp, Homo sapiens
attttacataaggaaggtttaa

SEQ ID NO: 9083170 - DNA, 23 bp, Homo sapiens
attttacaggtcagttccttgaa

SEQ ID NO: 9083171 - DNA, 23 bp, Homo sapiens
attttacaggtcagttccttgaa

SEQ ID NO: 9083172 - DNA, 22 bp, Homo sapiens
gcctgcctagaattgcagcttt

SEQ ID NO: 9083173 - DNA, 22 bp, Homo sapiens
gcctgcctagaattgcagcttt

SEQ ID NO: 9083174 - DNA, 22 bp, Homo sapiens
attttctagatagatgatgcat

SEQ ID NO: 9083175 - DNA, 22 bp, Homo sapiens
gcctgcctagaattgcagcttt

SEQ ID NO: 9083176 - DNA, 23 bp, Homo sapiens
atttgcatggccggattatggat

SEQ ID NO: 9083177 - DNA, 22 bp, Homo sapiens
atttgcctgtaagacaaggcct

SEQ ID NO: 9083178 - DNA, 22 bp, Homo sapiens
atttgcctctgctttcaaggat

SEQ ID NO: 9083179 - DNA, 22 bp, Homo sapiens
atttgccttgtgatttgtaagt

SEQ ID NO: 9083180 - DNA, 22 bp, Homo sapiens
atttgccttggtgatttgtaaa

SEQ ID NO: 9083181 - DNA, 22 bp, Homo sapiens
atttgccttactgaagaaggag

SEQ ID NO: 9083182 - DNA, 22 bp, Homo sapiens
atttgccttgtgaattggatat

SEQ ID NO: 9083183 - DNA, 22 bp, Homo sapiens
attttaaggcttatttaaaggc

SEQ ID NO: 9083184 - DNA, 22 bp, Homo sapiens
attttaaggcttatttaaaggc

SEQ ID NO: 9083185 - DNA, 22 bp, Homo sapiens
attttaaccctcttatatatac

SEQ ID NO: 9083186 - DNA, 22 bp, Homo sapiens
attttaaccctcttatatatac

SEQ ID NO: 9083187 - DNA, 22 bp, Homo sapiens
atttgcctttcgaatcaacagg

SEQ ID NO: 9083188 - DNA, 22 bp, Homo sapiens
atttgcataatagtgatttgta

SEQ ID NO: 9083189 - DNA, 22 bp, Homo sapiens
atttgcaaagtcgtatctgtga

SEQ ID NO: 9083190 - DNA, 22 bp, Homo sapiens
atttgcaagagtaagaatttct

SEQ ID NO: 9083191 - DNA, 22 bp, Homo sapiens
atttgcaagagtaagaatttct

SEQ ID NO: 9083192 - DNA, 22 bp, Homo sapiens
atttgcaatgatttcagtgctt

SEQ ID NO: 9083193 - DNA, 22 bp, Homo sapiens
atttgcaattactcatgtcatt

SEQ ID NO: 9083194 - DNA, 22 bp, Homo sapiens
atttgcaattttactttgcagt

SEQ ID NO: 9083195 - DNA, 22 bp, Homo sapiens
atttgacattgacacacctatg

SEQ ID NO: 9083196 - DNA, 22 bp, Homo sapiens
atttgacagtgagttgtggatg

SEQ ID NO: 9083197 - DNA, 22 bp, Homo sapiens
atttgacagtgagttgtggatg

SEQ ID NO: 9083198 - DNA, 22 bp, Homo sapiens
atttgacattattctctcagtc

SEQ ID NO: 9083199 - DNA, 22 bp, Homo sapiens
atttgagaaaggagggaacttt

SEQ ID NO: 9083200 - DNA, 22 bp, Homo sapiens
atttgacattgacacacctatg

SEQ ID NO: 9083201 - DNA, 23 bp, Homo sapiens
atttgacagagcatagcatttct

SEQ ID NO: 9083202 - DNA, 22 bp, Homo sapiens
atttgacaacttctggtggcat

SEQ ID NO: 9083203 - DNA, 22 bp, Homo sapiens
atttgacaacttctggtggcat

SEQ ID NO: 9083204 - DNA, 22 bp, Homo sapiens
gcccagccagagctgtgtgatg

SEQ ID NO: 9083205 - DNA, 22 bp, Homo sapiens
gcccagccagagctgtgtgatg

SEQ ID NO: 9083206 - DNA, 22 bp, Homo sapiens
gcccagcccagaaaggttcgga

SEQ ID NO: 9083207 - DNA, 22 bp, Homo sapiens
gcccagcccagaaaggttcgga

SEQ ID NO: 9083208 - DNA, 22 bp, Homo sapiens
gcccagccagagctgtgtgatg

SEQ ID NO: 9083209 - DNA, 22 bp, Homo sapiens
gcccagccacagtcactttcat

SEQ ID NO: 9083210 - DNA, 22 bp, Homo sapiens
gcccagccacagtcactttcat

SEQ ID NO: 9083211 - DNA, 22 bp, Homo sapiens
gcccagcaggggatggcagctc

SEQ ID NO: 9083212 - DNA, 22 bp, Homo sapiens
gcccagcaggggatggcagctc

SEQ ID NO: 9083213 - DNA, 22 bp, Homo sapiens
gcccagcaggacagagtggttt

SEQ ID NO: 9083214 - DNA, 22 bp, Homo sapiens
gcccagcaggacagagtggttt

SEQ ID NO: 9083215 - DNA, 18 bp, Homo sapiens
gccagaggtactactgat

SEQ ID NO: 9083216 - DNA, 22 bp, Homo sapiens
gccagaggggctcgaaggcgcg

SEQ ID NO: 9083217 - DNA, 22 bp, Homo sapiens
gccagaggggctcgaaggcgcg

SEQ ID NO: 9083218 - DNA, 18 bp, Homo sapiens
gccagagggcccaaggtc

SEQ ID NO: 9083219 - DNA, 22 bp, Homo sapiens
gccagagggattcctggtgtgt

SEQ ID NO: 9083220 - DNA, 22 bp, Homo sapiens
gccagaggttcaacaactgtct

SEQ ID NO: 9083221 - DNA, 19 bp, Homo sapiens
gcccacggccctgctctgc

SEQ ID NO: 9083222 - DNA, 18 bp, Homo sapiens
gccagaggtactactgat

SEQ ID NO: 9083223 - DNA, 18 bp, Homo sapiens
gccagaggtactactgat

SEQ ID NO: 9083224 - DNA, 22 bp, Homo sapiens
atttacagaccctcccactaag

SEQ ID NO: 9083225 - DNA, 22 bp, Homo sapiens
atttacagtttagcatttcaag

SEQ ID NO: 9083226 - DNA, 22 bp, Homo sapiens
atttacataatagactttaggt

SEQ ID NO: 9083227 - DNA, 22 bp, Homo sapiens
atttacataatagactttaggt

SEQ ID NO: 9083228 - DNA, 22 bp, Homo sapiens
atttaccagctgtgcactgata

SEQ ID NO: 9083229 - DNA, 22 bp, Homo sapiens
atttaccatatgtactgagtat

SEQ ID NO: 9083230 - DNA, 22 bp, Homo sapiens
atttactaatgtcatatcgcgt

SEQ ID NO: 9083231 - DNA, 18 bp, Homo sapiens
gccagagggaagcaggtg

SEQ ID NO: 9083232 - DNA, 18 bp, Homo sapiens
gccagagggaagcaggtg

SEQ ID NO: 9083233 - DNA, 19 bp, Homo sapiens
gccctcctcactgagctct

SEQ ID NO: 9083234 - DNA, 22 bp, Homo sapiens
gccctcctggcaggcagtgatg

SEQ ID NO: 9083235 - DNA, 22 bp, Homo sapiens
gccctccctacagcctatttct

SEQ ID NO: 9083236 - DNA, 19 bp, Homo sapiens
gccctgcaggaggtggggc

SEQ ID NO: 9083237 - DNA, 22 bp, Homo sapiens
gccctgcagtgcggaggtggca

SEQ ID NO: 9083238 - DNA, 22 bp, Homo sapiens
gcccagcccctgggtggacgtg

SEQ ID NO: 9083239 - DNA, 22 bp, Homo sapiens
gcccagcccctgggtggacgtg

SEQ ID NO: 9083240 - DNA, 22 bp, Homo sapiens
gcccagcccctgggtggacgtg

SEQ ID NO: 9083241 - DNA, 22 bp, Homo sapiens
gcccaggagttgaagggctgac

SEQ ID NO: 9083242 - DNA, 22 bp, Homo sapiens
attgtaaaagtattctaagatt

SEQ ID NO: 9083243 - DNA, 22 bp, Homo sapiens
attgtaaaagtattctaagatt

SEQ ID NO: 9083244 - DNA, 22 bp, Homo sapiens
attgtaaaagtattctaagatt

SEQ ID NO: 9083245 - DNA, 22 bp, Homo sapiens
attgtaaagtactgtgtacaat

SEQ ID NO: 9083246 - DNA, 22 bp, Homo sapiens
attgtaaagtactgtgtacaat

SEQ ID NO: 9083247 - DNA, 22 bp, Homo sapiens
attggttaactctgtgtgtcaa

SEQ ID NO: 9083248 - DNA, 22 bp, Homo sapiens
attggtggtgaggacatgccag

SEQ ID NO: 9083249 - DNA, 22 bp, Homo sapiens
attggttactcaatttgactga

SEQ ID NO: 9083250 - DNA, 22 bp, Homo sapiens
attggttagagtaacacctatt

SEQ ID NO: 9083251 - DNA, 22 bp, Homo sapiens
attggttagaagtagtatgact

SEQ ID NO: 9083252 - DNA, 22 bp, Homo sapiens
attggttacggcttttcaaatt

SEQ ID NO: 9083253 - DNA, 22 bp, Homo sapiens
attggttaagacgcatcatgct

SEQ ID NO: 9083254 - DNA, 22 bp, Homo sapiens
attggttaccactttaaatctt

SEQ ID NO: 9083255 - DNA, 22 bp, Homo sapiens
gcagggtgaaggtcacatagaa

SEQ ID NO: 9083256 - DNA, 22 bp, Homo sapiens
gcagggtgaaggtcacatagaa

SEQ ID NO: 9083257 - DNA, 22 bp, Homo sapiens
gcaggtggatcacctgaggtca

SEQ ID NO: 9083258 - DNA, 22 bp, Homo sapiens
gcaggtggatcacctgaggtca

SEQ ID NO: 9083259 - DNA, 22 bp, Homo sapiens
gcagggtccatggaggcagccc

SEQ ID NO: 9083260 - DNA, 22 bp, Homo sapiens
gcagggtcttgagaggcagcca

SEQ ID NO: 9083261 - DNA, 22 bp, Homo sapiens
gcagggtctgaggccacagagg

SEQ ID NO: 9083262 - DNA, 22 bp, Homo sapiens
gcagggaggtttgctgacctgg

SEQ ID NO: 9083263 - DNA, 22 bp, Homo sapiens
gcagggaggtttgctgacctgg

SEQ ID NO: 9083264 - DNA, 22 bp, Homo sapiens
gcaggggtagagattgctggtg

SEQ ID NO: 9083265 - DNA, 22 bp, Homo sapiens
gcaggatgaaggcagaggctga

SEQ ID NO: 9083266 - DNA, 22 bp, Homo sapiens
gcaggatgagtgagtacattta

SEQ ID NO: 9083267 - DNA, 21 bp, Homo sapiens
gcaggatgcatcttggtgtct

SEQ ID NO: 9083268 - DNA, 22 bp, Homo sapiens
gcaggatgggagcttcactctg

SEQ ID NO: 9083269 - DNA, 22 bp, Homo sapiens
gcaggatgggagcttcactttg

SEQ ID NO: 9083270 - DNA, 22 bp, Homo sapiens
gcaggatggtggaaggcctgct

SEQ ID NO: 9083271 - DNA, 22 bp, Homo sapiens
gcaggcggaggttgcagtgagc

SEQ ID NO: 9083272 - DNA, 22 bp, Homo sapiens
gcaggcgtgtttcacgtgccag

SEQ ID NO: 9083273 - DNA, 22 bp, Homo sapiens
gcaggatgggtgtagcccagca

SEQ ID NO: 9083274 - DNA, 22 bp, Homo sapiens
gcaggatggtgccctttctgcc

SEQ ID NO: 9083275 - DNA, 22 bp, Homo sapiens
gcaggatgaaggcagaggctga

SEQ ID NO: 9083276 - DNA, 22 bp, Homo sapiens
gcaggagccacttcagggatgc

SEQ ID NO: 9083277 - DNA, 22 bp, Homo sapiens
gcaggagcagtcaggggcagct

SEQ ID NO: 9083278 - DNA, 22 bp, Homo sapiens
gcaggagcaaactgcagtgtgg

SEQ ID NO: 9083279 - DNA, 22 bp, Homo sapiens
gcaggagcaatggcctatcaga

SEQ ID NO: 9083280 - DNA, 22 bp, Homo sapiens
gcaggagcagtcaggggcagct

SEQ ID NO: 9083281 - DNA, 22 bp, Homo sapiens
gcagggaggaagagatgcttcc

SEQ ID NO: 9083282 - DNA, 22 bp, Homo sapiens
gcagggagggcctttcatgaca

SEQ ID NO: 9083283 - DNA, 22 bp, Homo sapiens
gcagggaggaagagatgcttcc

SEQ ID NO: 9083284 - DNA, 22 bp, Homo sapiens
gcagggactttggcaacaggtg

SEQ ID NO: 9083285 - DNA, 22 bp, Homo sapiens
gcagggacgccagggacagcaa

SEQ ID NO: 9083286 - DNA, 22 bp, Homo sapiens
gcaggctgtggtatgttgggca

SEQ ID NO: 9083287 - DNA, 22 bp, Homo sapiens
gcaggctgtggtatgttgggca

SEQ ID NO: 9083288 - DNA, 22 bp, Homo sapiens
gcaggctgtgaggctcagatgg

SEQ ID NO: 9083289 - DNA, 22 bp, Homo sapiens
gcaggctgtgaggctcagatgg

SEQ ID NO: 9083290 - DNA, 22 bp, Homo sapiens
gcaggctgtgaggctcagatgg

SEQ ID NO: 9083291 - DNA, 22 bp, Homo sapiens
gcaggctgtagacaccaaacta

SEQ ID NO: 9083292 - DNA, 22 bp, Homo sapiens
gcaggctgtctaaagttagagt

SEQ ID NO: 9083293 - DNA, 22 bp, Homo sapiens
gcaggctgtctaaagttagagt

SEQ ID NO: 9083294 - DNA, 22 bp, Homo sapiens
gcaggctgtctaaagttagagt

SEQ ID NO: 9083295 - DNA, 21 bp, Homo sapiens
attgttctggaggaaaggatt

SEQ ID NO: 9083296 - DNA, 22 bp, Homo sapiens
attgttctggatatttacattg

SEQ ID NO: 9083297 - DNA, 18 bp, Homo sapiens
attgttctgtgacatgtc

SEQ ID NO: 9083298 - DNA, 22 bp, Homo sapiens
attgttgggtctcactcctaga

SEQ ID NO: 9083299 - DNA, 22 bp, Homo sapiens
attgttgtctttacctgtattt

SEQ ID NO: 9083300 - DNA, 22 bp, Homo sapiens
gcattattaactggaggaaaag

SEQ ID NO: 9083301 - DNA, 22 bp, Homo sapiens
gcattattaatagctgcatgag

SEQ ID NO: 9083302 - DNA, 22 bp, Homo sapiens
attgttaatgttgcactaaggt

SEQ ID NO: 9083303 - DNA, 18 bp, Homo sapiens
attgttaatagagtactt

SEQ ID NO: 9083304 - DNA, 22 bp, Homo sapiens
attgttatgaaaataagatgtt

SEQ ID NO: 9083305 - DNA, 22 bp, Homo sapiens
gcagtgctgatcccatggcaga

SEQ ID NO: 9083306 - DNA, 22 bp, Homo sapiens
gcagtgcagtgggacagggcgc

SEQ ID NO: 9083307 - DNA, 22 bp, Homo sapiens
gcagtgcaggacaaatcagtgc

SEQ ID NO: 9083308 - DNA, 18 bp, Homo sapiens
gcagtgcaggaagaagag

SEQ ID NO: 9083309 - DNA, 22 bp, Homo sapiens
gcagtgcaggaacatagcttct

SEQ ID NO: 9083310 - DNA, 22 bp, Homo sapiens
gcagtgcatgtcggaactcatt

SEQ ID NO: 9083311 - DNA, 22 bp, Homo sapiens
gcagtgcattactcacatgttt

SEQ ID NO: 9083312 - DNA, 22 bp, Homo sapiens
gcagtgccttgcttctctgtct

SEQ ID NO: 9083313 - DNA, 18 bp, Homo sapiens
gcagtgccagcctctcct

SEQ ID NO: 9083314 - DNA, 22 bp, Homo sapiens
gcagtgctaaggattctgcctt

SEQ ID NO: 9083315 - DNA, 22 bp, Homo sapiens
gcagtgctaagtagctggccca

SEQ ID NO: 9083316 - DNA, 22 bp, Homo sapiens
gcagtgctagcctcacagggtc

SEQ ID NO: 9083317 - DNA, 20 bp, Homo sapiens
gcagtgctggtgcctctgct

SEQ ID NO: 9083318 - DNA, 22 bp, Homo sapiens
attgtaattttagagaaagtgg

SEQ ID NO: 9083319 - DNA, 22 bp, Homo sapiens
attgtacaatgcctggaacatt

SEQ ID NO: 9083320 - DNA, 22 bp, Homo sapiens
attgtacaatgcctggaacatt

SEQ ID NO: 9083321 - DNA, 22 bp, Homo sapiens
attgtacaatgcctggaacatt

SEQ ID NO: 9083322 - DNA, 22 bp, Homo sapiens
attgtacaatgctgaggtttgg

SEQ ID NO: 9083323 - DNA, 22 bp, Homo sapiens
attgtacaatgcctggaacatt

SEQ ID NO: 9083324 - DNA, 21 bp, Homo sapiens
gcagtgcagcttggagggtag

SEQ ID NO: 9083325 - DNA, 22 bp, Homo sapiens
gccactgtcataccctggcaat

SEQ ID NO: 9083326 - DNA, 22 bp, Homo sapiens
gccactgtactccagcctgcga

SEQ ID NO: 9083327 - DNA, 22 bp, Homo sapiens
attgttttccaaagatgctgct

SEQ ID NO: 9083328 - DNA, 22 bp, Homo sapiens
atttaaatgcttaagagggttt

SEQ ID NO: 9083329 - DNA, 22 bp, Homo sapiens
atttaaattttctgatggagag

SEQ ID NO: 9083330 - DNA, 22 bp, Homo sapiens
atttaaatgcttaagagggttt

SEQ ID NO: 9083331 - DNA, 22 bp, Homo sapiens
gccactattttcccacctttct

SEQ ID NO: 9083332 - DNA, 22 bp, Homo sapiens
gccacagtcaggacggggagag

SEQ ID NO: 9083333 - DNA, 22 bp, Homo sapiens
gccacagtgggctggggccaga

SEQ ID NO: 9083334 - DNA, 22 bp, Homo sapiens
gccacgtagaagtgccgcgaga

SEQ ID NO: 9083335 - DNA, 22 bp, Homo sapiens
gccactgcactccagcccaggc

SEQ ID NO: 9083336 - DNA, 21 bp, Homo sapiens
gccactgcactccagcctggg

SEQ ID NO: 9083337 - DNA, 22 bp, Homo sapiens
gccacagtcactgctgcagggg

SEQ ID NO: 9083338 - DNA, 22 bp, Homo sapiens
gcattcctgagaatgcagagtg

SEQ ID NO: 9083339 - DNA, 22 bp, Homo sapiens
gcattcagggttcacggtcaac

SEQ ID NO: 9083340 - DNA, 22 bp, Homo sapiens
gcattcagggttcacggtcaac

SEQ ID NO: 9083341 - DNA, 22 bp, Homo sapiens
gcagatgccagatcatgcaggg

SEQ ID NO: 9083342 - DNA, 19 bp, Homo sapiens
gcagatgatgaggctggtc

SEQ ID NO: 9083343 - DNA, 22 bp, Homo sapiens
gcagatgatgtagacagacagt

SEQ ID NO: 9083344 - DNA, 22 bp, Homo sapiens
gcagatgatgtagacagacagt

SEQ ID NO: 9083345 - DNA, 19 bp, Homo sapiens
gcagatgatgaggctggtc

SEQ ID NO: 9083346 - DNA, 22 bp, Homo sapiens
gcagccaggggctgtgacctgt

SEQ ID NO: 9083347 - DNA, 22 bp, Homo sapiens
gcagccaggggctgtgacctgt

SEQ ID NO: 9083348 - DNA, 22 bp, Homo sapiens
gcagccagggctaagctgggga

SEQ ID NO: 9083349 - DNA, 19 bp, Homo sapiens
gcagccaggtgctctacct

SEQ ID NO: 9083350 - DNA, 19 bp, Homo sapiens
gcagccaggtgctctacct

SEQ ID NO: 9083351 - DNA, 21 bp, Homo sapiens
gcagccaggactttgggctgg

SEQ ID NO: 9083352 - DNA, 22 bp, Homo sapiens
gcagccaggctacagcgggctt

SEQ ID NO: 9083353 - DNA, 22 bp, Homo sapiens
gcagccttccgtggacctggac

SEQ ID NO: 9083354 - DNA, 22 bp, Homo sapiens
gcagcctgatgatctgggttgt

SEQ ID NO: 9083355 - DNA, 22 bp, Homo sapiens
gcagcctgaggccctttctggc

SEQ ID NO: 9083356 - DNA, 22 bp, Homo sapiens
gcagccaggtttgaggaccact

SEQ ID NO: 9083357 - DNA, 22 bp, Homo sapiens
gcagccaggtttgaggaccact

SEQ ID NO: 9083358 - DNA, 22 bp, Homo sapiens
gcagcctgttgtaccagcctgt

SEQ ID NO: 9083359 - DNA, 22 bp, Homo sapiens
gcagcctgttgtaccagcctgt

SEQ ID NO: 9083360 - DNA, 22 bp, Homo sapiens
gcagcctgggcaacagagtgag

SEQ ID NO: 9083361 - DNA, 22 bp, Homo sapiens
gcagcctgggcaacagagtgag

SEQ ID NO: 9083362 - DNA, 22 bp, Homo sapiens
gcagcctgggcaacagagtgag

SEQ ID NO: 9083363 - DNA, 22 bp, Homo sapiens
gcagcctgatgatctgggttgt

SEQ ID NO: 9083364 - DNA, 22 bp, Homo sapiens
gcagagttctcttccagctaac

SEQ ID NO: 9083365 - DNA, 22 bp, Homo sapiens
gcagaggggaagctgaggaatt

SEQ ID NO: 9083366 - DNA, 22 bp, Homo sapiens
gcagaggggaagctgaggaatt

SEQ ID NO: 9083367 - DNA, 20 bp, Homo sapiens
gcagatgagactcacagagg

SEQ ID NO: 9083368 - DNA, 20 bp, Homo sapiens
gcagatgagactcacagagg

SEQ ID NO: 9083369 - DNA, 22 bp, Homo sapiens
gcagatgaggaagctaatgctg

SEQ ID NO: 9083370 - DNA, 18 bp, Homo sapiens
gcagatgagtagtgtacc

SEQ ID NO: 9083371 - DNA, 22 bp, Homo sapiens
gcagatgaagtttacaggaaac

SEQ ID NO: 9083372 - DNA, 22 bp, Homo sapiens
gcagatgaagtttacaggaaac

SEQ ID NO: 9083373 - DNA, 22 bp, Homo sapiens
gcagatagggtattaggagtaa

SEQ ID NO: 9083374 - DNA, 22 bp, Homo sapiens
gcagaggctgggtgtcccagtc

SEQ ID NO: 9083375 - DNA, 22 bp, Homo sapiens
gcagaggctgggtgtcccagtc

SEQ ID NO: 9083376 - DNA, 22 bp, Homo sapiens
gcagaggctgtagggaaggttg

SEQ ID NO: 9083377 - DNA, 16 bp, Homo sapiens
gcagaggaaaggggag

SEQ ID NO: 9083378 - DNA, 22 bp, Homo sapiens
gcagaggcctgaaggtggcggg

SEQ ID NO: 9083379 - DNA, 22 bp, Homo sapiens
gcagaggcctgaaggtggcggg

SEQ ID NO: 9083380 - DNA, 22 bp, Homo sapiens
gcagaagttaatcgaaggccat

SEQ ID NO: 9083381 - DNA, 22 bp, Homo sapiens
gcagaatgtaggccttcagtgt

SEQ ID NO: 9083382 - DNA, 22 bp, Homo sapiens
gcagaattgaaatgtgtcactt

SEQ ID NO: 9083383 - DNA, 22 bp, Homo sapiens
gcagaggcctaggtggaaggcc

SEQ ID NO: 9083384 - DNA, 22 bp, Homo sapiens
gcagaggcctaggtggaaggcc

SEQ ID NO: 9083385 - DNA, 22 bp, Homo sapiens
gcagaaggtcaaagcaagatgt

SEQ ID NO: 9083386 - DNA, 22 bp, Homo sapiens
gcagaaggtctggcacttcagg

SEQ ID NO: 9083387 - DNA, 22 bp, Homo sapiens
gcagaagtggattctacaattt

SEQ ID NO: 9083388 - DNA, 22 bp, Homo sapiens
gcagaagtcagaccatctgaat

SEQ ID NO: 9083389 - DNA, 22 bp, Homo sapiens
gcagaagtacctcgttctagtt

SEQ ID NO: 9083390 - DNA, 22 bp, Homo sapiens
gcagaagggaataaggagcttt

SEQ ID NO: 9083391 - DNA, 22 bp, Homo sapiens
gcagaagggaataaggagcttt

SEQ ID NO: 9083392 - DNA, 22 bp, Homo sapiens
gcaactgaacatgtgtgtggcc

SEQ ID NO: 9083393 - DNA, 22 bp, Homo sapiens
gcacacagggatttttgaatgg

SEQ ID NO: 9083394 - DNA, 22 bp, Homo sapiens
gcacacaggggagttctcagaa

SEQ ID NO: 9083395 - DNA, 20 bp, Homo sapiens
gcaactagggagacacagct

SEQ ID NO: 9083396 - DNA, 21 bp, Homo sapiens
gcaaccagaccacagggcagt

SEQ ID NO: 9083397 - DNA, 22 bp, Homo sapiens
gcaacattcatgttctgtaacc

SEQ ID NO: 9083398 - DNA, 22 bp, Homo sapiens
gcaacattgcttctgaacatag

SEQ ID NO: 9083399 - DNA, 22 bp, Homo sapiens
gcaacattgagtctaagtacca

SEQ ID NO: 9083400 - DNA, 22 bp, Homo sapiens
gcaacattaaaccaataattgt

SEQ ID NO: 9083401 - DNA, 22 bp, Homo sapiens
gcaacagttggattccagagga

SEQ ID NO: 9083402 - DNA, 18 bp, Homo sapiens
gcaacagtatcagcaggc

SEQ ID NO: 9083403 - DNA, 22 bp, Homo sapiens
gcaacaggcagtttgctcatgt

SEQ ID NO: 9083404 - DNA, 22 bp, Homo sapiens
gcaacagcattctcattgacat

SEQ ID NO: 9083405 - DNA, 22 bp, Homo sapiens
gcaaattcttaactggactgtg

SEQ ID NO: 9083406 - DNA, 22 bp, Homo sapiens
gcaaattgaatccagtaataaa

SEQ ID NO: 9083407 - DNA, 22 bp, Homo sapiens
gcaaattgggctgactcaaggt

SEQ ID NO: 9083408 - DNA, 22 bp, Homo sapiens
gcaaatgttctatatttgctgt

SEQ ID NO: 9083409 - DNA, 22 bp, Homo sapiens
gcaaatgtttttgagtgtttac

SEQ ID NO: 9083410 - DNA, 22 bp, Homo sapiens
gcaaattctaggcccctctcca

SEQ ID NO: 9083411 - DNA, 22 bp, Homo sapiens
gcaaattcaacagcacattctc

SEQ ID NO: 9083412 - DNA, 22 bp, Homo sapiens
gcaaacaagctgcctgaagatt

SEQ ID NO: 9083413 - DNA, 22 bp, Homo sapiens
gcaaacaaggacatacatcctg

SEQ ID NO: 9083414 - DNA, 22 bp, Homo sapiens
gcaaacaaggacatacatcctg

SEQ ID NO: 9083415 - DNA, 22 bp, Homo sapiens
gcaaatgctctccttggtcagg

SEQ ID NO: 9083416 - DNA, 22 bp, Homo sapiens
gcaaatggagtgaagagctgga

SEQ ID NO: 9083417 - DNA, 22 bp, Homo sapiens
gcaaatgtggcttcctttctag

SEQ ID NO: 9083418 - DNA, 22 bp, Homo sapiens
gcaaaaaatgcttgttgcttag

SEQ ID NO: 9083419 - DNA, 22 bp, Homo sapiens
gatttctgtaacacttcagata

SEQ ID NO: 9083420 - DNA, 22 bp, Homo sapiens
atgtttctcactgtttctctat

SEQ ID NO: 9083421 - DNA, 20 bp, Homo sapiens
gcaaaataggctctgttggt

SEQ ID NO: 9083422 - DNA, 22 bp, Homo sapiens
gcaaaagtacagccggatttct

SEQ ID NO: 9083423 - DNA, 22 bp, Homo sapiens
gcaaacaagctgcctgaagatt

SEQ ID NO: 9083424 - DNA, 22 bp, Homo sapiens
gcaaaaaatgcttgttgcttag

SEQ ID NO: 9083425 - DNA, 22 bp, Homo sapiens
gcaaaactcggacatctaatct

SEQ ID NO: 9083426 - DNA, 22 bp, Homo sapiens
gcaaaagtacagccggatttct

SEQ ID NO: 9083427 - DNA, 22 bp, Homo sapiens
gcacagggccctgtgcgtaggt

SEQ ID NO: 9083428 - DNA, 22 bp, Homo sapiens
gcacagggccctgtgcgtaggt

SEQ ID NO: 9083429 - DNA, 22 bp, Homo sapiens
gcacagggaggctggcctggcc

SEQ ID NO: 9083430 - DNA, 22 bp, Homo sapiens
gcactggtttatttaagaacaa

SEQ ID NO: 9083431 - DNA, 22 bp, Homo sapiens
gcactggtgtgaaacagtagat

SEQ ID NO: 9083432 - DNA, 22 bp, Homo sapiens
gcactggtgtgttagtaaggga

SEQ ID NO: 9083433 - DNA, 22 bp, Homo sapiens
gcactggggtcatagcctccag

SEQ ID NO: 9083434 - DNA, 22 bp, Homo sapiens
gcacaggctgttggccttcaga

SEQ ID NO: 9083435 - DNA, 22 bp, Homo sapiens
gcacaggctctcttggggacac

SEQ ID NO: 9083436 - DNA, 22 bp, Homo sapiens
gcacagaggatgaggcagctct

SEQ ID NO: 9083437 - DNA, 22 bp, Homo sapiens
gcacagaggatgaggcagctct

SEQ ID NO: 9083438 - DNA, 22 bp, Homo sapiens
gcacagaggatgaggcagctct

SEQ ID NO: 9083439 - DNA, 22 bp, Homo sapiens
gcacaggctgttggccttcaga

SEQ ID NO: 9083440 - DNA, 22 bp, Homo sapiens
gcacagggagcaggtctctggt

SEQ ID NO: 9083441 - DNA, 22 bp, Homo sapiens
gcacagggagacagccgtggcc

SEQ ID NO: 9083442 - DNA, 22 bp, Homo sapiens
gcacagagctggccctccaggc

SEQ ID NO: 9083443 - DNA, 22 bp, Homo sapiens
gcacagagctggccctccaggc

SEQ ID NO: 9083444 - DNA, 22 bp, Homo sapiens
gcacagaggaagcacagactct

SEQ ID NO: 9083445 - DNA, 22 bp, Homo sapiens
gcacagagcttgtttacatttg

SEQ ID NO: 9083446 - DNA, 23 bp, Homo sapiens
gcacagagcagttaggggaagat

SEQ ID NO: 9083447 - DNA, 22 bp, Homo sapiens
gaccctccactcactgctgtgt

SEQ ID NO: 9083448 - DNA, 22 bp, Homo sapiens
gacccgtggcaggctgcctgct

SEQ ID NO: 9083449 - DNA, 22 bp, Homo sapiens
atgctttatgttctggcatttt

SEQ ID NO: 9083450 - DNA, 21 bp, Homo sapiens
gaccccagaccagcagacaca

SEQ ID NO: 9083451 - DNA, 22 bp, Homo sapiens
gaccctgagcaaaagcagttct

SEQ ID NO: 9083452 - DNA, 22 bp, Homo sapiens
gaccctctagatggaagcactg

SEQ ID NO: 9083453 - DNA, 22 bp, Homo sapiens
gaccctctagatggaagcactg

SEQ ID NO: 9083454 - DNA, 22 bp, Homo sapiens
gaccctgccatgagtgacaggg

SEQ ID NO: 9083455 - DNA, 22 bp, Homo sapiens
gactttctctcctcccaggtgt

SEQ ID NO: 9083456 - DNA, 22 bp, Homo sapiens
gactttccaggtcctgggctat

SEQ ID NO: 9083457 - DNA, 21 bp, Homo sapiens
gactttcttaccagatttttg

SEQ ID NO: 9083458 - DNA, 22 bp, Homo sapiens
gactttgccactgacctccaac

SEQ ID NO: 9083459 - DNA, 22 bp, Homo sapiens
gactttgaacagtgtatcagta

SEQ ID NO: 9083460 - DNA, 19 bp, Homo sapiens
gactttggaaatgctgttt

SEQ ID NO: 9083461 - DNA, 22 bp, Homo sapiens
gactttgccacttgctccagct

SEQ ID NO: 9083462 - DNA, 22 bp, Homo sapiens
gactttgccctaatgaggtctc

SEQ ID NO: 9083463 - DNA, 22 bp, Homo sapiens
gactttgctgtgtcagcttcag

SEQ ID NO: 9083464 - DNA, 17 bp, Homo sapiens
gactttggagtttcata

SEQ ID NO: 9083465 - DNA, 22 bp, Homo sapiens
atgcttttccaggagaaatata

SEQ ID NO: 9083466 - DNA, 22 bp, Homo sapiens
atgcttttccaggagaaatata

SEQ ID NO: 9083467 - DNA, 22 bp, Homo sapiens
atgcttttatgtcacatggtca

SEQ ID NO: 9083468 - DNA, 22 bp, Homo sapiens
atgcttttaactcctttatccc

SEQ ID NO: 9083469 - DNA, 22 bp, Homo sapiens
atgcttttccaggagaaatata

SEQ ID NO: 9083470 - DNA, 20 bp, Homo sapiens
atgctttcttgtgtgctgct

SEQ ID NO: 9083471 - DNA, 22 bp, Homo sapiens
atgctttggccaatgagaagtg

SEQ ID NO: 9083472 - DNA, 22 bp, Homo sapiens
atgctttattgttaggtcatgt

SEQ ID NO: 9083473 - DNA, 22 bp, Homo sapiens
gacagggcatggtgcagagttc

SEQ ID NO: 9083474 - DNA, 22 bp, Homo sapiens
gacagggccaaaccggctgatc

SEQ ID NO: 9083475 - DNA, 22 bp, Homo sapiens
gacagggcgcccagcctgtttc

SEQ ID NO: 9083476 - DNA, 22 bp, Homo sapiens
gacagtttaggttcaaatctca

SEQ ID NO: 9083477 - DNA, 22 bp, Homo sapiens
gacagtttggatgggggtttgc

SEQ ID NO: 9083478 - DNA, 22 bp, Homo sapiens
gacagttaggacaactgacttc

SEQ ID NO: 9083479 - DNA, 23 bp, Homo sapiens
gacagggctgacttggcagctgc

SEQ ID NO: 9083480 - DNA, 23 bp, Homo sapiens
gacagggctgacttggcagctgc

SEQ ID NO: 9083481 - DNA, 22 bp, Homo sapiens
gacagtggttccaaggcagctt

SEQ ID NO: 9083482 - DNA, 22 bp, Homo sapiens
atgctttacgacaaaaaactca

SEQ ID NO: 9083483 - DNA, 22 bp, Homo sapiens
atgctttagttcaaaggactta

SEQ ID NO: 9083484 - DNA, 22 bp, Homo sapiens
atgctttatacaaaacacttaa

SEQ ID NO: 9083485 - DNA, 19 bp, Homo sapiens
atgctttatgttatttctt

SEQ ID NO: 9083486 - DNA, 22 bp, Homo sapiens
atgctttacagttttccaaaca

SEQ ID NO: 9083487 - DNA, 22 bp, Homo sapiens
atgctttaaactataaatccac

SEQ ID NO: 9083488 - DNA, 22 bp, Homo sapiens
atgctttaaaacgtatgtgtaa

SEQ ID NO: 9083489 - DNA, 22 bp, Homo sapiens
gacataaagttcttgcttgaat

SEQ ID NO: 9083490 - DNA, 22 bp, Homo sapiens
atgcttgggactccctgtagca

SEQ ID NO: 9083491 - DNA, 22 bp, Homo sapiens
atgcttggcccctttatagcct

SEQ ID NO: 9083492 - DNA, 22 bp, Homo sapiens
atgcttggcgtttcacttcctg

SEQ ID NO: 9083493 - DNA, 22 bp, Homo sapiens
gacataaaccttgagatattaa

SEQ ID NO: 9083494 - DNA, 22 bp, Homo sapiens
gacataaaattcaataatttgt

SEQ ID NO: 9083495 - DNA, 22 bp, Homo sapiens
gacataaaatggaattctgttg

SEQ ID NO: 9083496 - DNA, 22 bp, Homo sapiens
atgcctgccatttagaagtctt

SEQ ID NO: 9083497 - DNA, 22 bp, Homo sapiens
atgcctggactgacatgcactg

SEQ ID NO: 9083498 - DNA, 22 bp, Homo sapiens
atgcctgcttactccaggtgct

SEQ ID NO: 9083499 - DNA, 22 bp, Homo sapiens
atgcctgcttactccaggtgct

SEQ ID NO: 9083500 - DNA, 22 bp, Homo sapiens
gacaggaaatatgggggttgtt

SEQ ID NO: 9083501 - DNA, 18 bp, Homo sapiens
atgccctgttgacttcag

SEQ ID NO: 9083502 - DNA, 22 bp, Homo sapiens
atgccctgtggttcatgtgaga

SEQ ID NO: 9083503 - DNA, 23 bp, Homo sapiens
atgccctgtagaggctgctgacc

SEQ ID NO: 9083504 - DNA, 23 bp, Homo sapiens
atgccctgtagaggctgctgacc

SEQ ID NO: 9083505 - DNA, 22 bp, Homo sapiens
atgccctggggctacctctgag

SEQ ID NO: 9083506 - DNA, 22 bp, Homo sapiens
atgccctggggctacctctgag

SEQ ID NO: 9083507 - DNA, 22 bp, Homo sapiens
atgccctgggagtgctgtacca

SEQ ID NO: 9083508 - DNA, 22 bp, Homo sapiens
atgccctgggagtgctgtacca

SEQ ID NO: 9083509 - DNA, 22 bp, Homo sapiens
atgccctggacttctagtattc

SEQ ID NO: 9083510 - DNA, 22 bp, Homo sapiens
atgccctgtgactctcctggac

SEQ ID NO: 9083511 - DNA, 20 bp, Homo sapiens
atgccctgtcctcttctgtt

SEQ ID NO: 9083512 - DNA, 23 bp, Homo sapiens
atgccctgtgcagaaatgtggaa

SEQ ID NO: 9083513 - DNA, 22 bp, Homo sapiens
atgccctgtggcagtacatatt

SEQ ID NO: 9083514 - DNA, 22 bp, Homo sapiens
atgccctgtgactctcctggac

SEQ ID NO: 9083515 - DNA, 23 bp, Homo sapiens
atgccctgtgcagaaatgtggaa

SEQ ID NO: 9083516 - DNA, 22 bp, Homo sapiens
atgccctgtgactctcctggac

SEQ ID NO: 9083517 - DNA, 22 bp, Homo sapiens
atgccctgcatcaagtgacact

SEQ ID NO: 9083518 - DNA, 22 bp, Homo sapiens
atgccctgaggaatgtcacgct

SEQ ID NO: 9083519 - DNA, 22 bp, Homo sapiens
atgccctgctctcgggaaggga

SEQ ID NO: 9083520 - DNA, 22 bp, Homo sapiens
atgccctgccaagcaggctaaa

SEQ ID NO: 9083521 - DNA, 22 bp, Homo sapiens
atgccctgcatcaagtgacact

SEQ ID NO: 9083522 - DNA, 22 bp, Homo sapiens
atgccctgccaagcaggctaaa

SEQ ID NO: 9083523 - DNA, 22 bp, Homo sapiens
atgccctgctgctggggcagtg

SEQ ID NO: 9083524 - DNA, 22 bp, Homo sapiens
atgccctgctgccatctggccg

SEQ ID NO: 9083525 - DNA, 22 bp, Homo sapiens
atgccctgctgctggggcagtg

SEQ ID NO: 9083526 - DNA, 22 bp, Homo sapiens
atgccctggactagctatactt

SEQ ID NO: 9083527 - DNA, 22 bp, Homo sapiens
atgccctgctctcgggaaggga

SEQ ID NO: 9083528 - DNA, 22 bp, Homo sapiens
atgccctgctgccatctggccg

SEQ ID NO: 9083529 - DNA, 22 bp, Homo sapiens
atgccctgaaagattcaaaggc

SEQ ID NO: 9083530 - DNA, 22 bp, Homo sapiens
atgccctgagcaggccttcaag

SEQ ID NO: 9083531 - DNA, 22 bp, Homo sapiens
atgccctgagcaggccttcaag

SEQ ID NO: 9083532 - DNA, 22 bp, Homo sapiens
atgccacttcattccagcctcg

SEQ ID NO: 9083533 - DNA, 22 bp, Homo sapiens
atgcccaatgtcacaatttttg

SEQ ID NO: 9083534 - DNA, 22 bp, Homo sapiens
atgccacttcattccagcctcg

SEQ ID NO: 9083535 - DNA, 22 bp, Homo sapiens
atgcatatgcaatgcacaattt

SEQ ID NO: 9083536 - DNA, 22 bp, Homo sapiens
atgcatatgcatctgtgtacat

SEQ ID NO: 9083537 - DNA, 22 bp, Homo sapiens
atgcatatctcctatctcctca

SEQ ID NO: 9083538 - DNA, 22 bp, Homo sapiens
atgcatatctcctatctcctca

SEQ ID NO: 9083539 - DNA, 20 bp, Homo sapiens
atgcatatatgtggtgtctg

SEQ ID NO: 9083540 - DNA, 22 bp, Homo sapiens
atgcatatcacagtctccatgt

SEQ ID NO: 9083541 - DNA, 22 bp, Homo sapiens
atgcatatcagtgattgtttgc

SEQ ID NO: 9083542 - DNA, 22 bp, Homo sapiens
atgcatatcagtgattgtttgc

SEQ ID NO: 9083543 - DNA, 22 bp, Homo sapiens
atgcatatcagtgattgtttgc

SEQ ID NO: 9083544 - DNA, 23 bp, Homo sapiens
atgcacaagccagcaggggacag

SEQ ID NO: 9083545 - DNA, 22 bp, Homo sapiens
gaagcacatggctgtgagcaac

SEQ ID NO: 9083546 - DNA, 22 bp, Homo sapiens
gaagcacaaagtgtagttccga

SEQ ID NO: 9083547 - DNA, 22 bp, Homo sapiens
gaagcagagcctaaggcagaca

SEQ ID NO: 9083548 - DNA, 23 bp, Homo sapiens
gaatcagtggctaacaaggaaac

SEQ ID NO: 9083549 - DNA, 22 bp, Homo sapiens
gaatcaggattcaagatcagct

SEQ ID NO: 9083550 - DNA, 22 bp, Homo sapiens
gaagcagaagtacgatttacta

SEQ ID NO: 9083551 - DNA, 22 bp, Homo sapiens
gaagcagagcctaaggcagaca

SEQ ID NO: 9083552 - DNA, 22 bp, Homo sapiens
atgcataaagaaagctatctgg

SEQ ID NO: 9083553 - DNA, 22 bp, Homo sapiens
atgcatataaggcacatgtatt

SEQ ID NO: 9083554 - DNA, 22 bp, Homo sapiens
atgcatataaggcacatgtatt

SEQ ID NO: 9083555 - DNA, 22 bp, Homo sapiens
atgcatataatggccagaacaa

SEQ ID NO: 9083556 - DNA, 22 bp, Homo sapiens
atgcatatagaacatttgacat

SEQ ID NO: 9083557 - DNA, 22 bp, Homo sapiens
atgcatatatacatacacagtc

SEQ ID NO: 9083558 - DNA, 22 bp, Homo sapiens
atgcatatagaacatttgacat

SEQ ID NO: 9083559 - DNA, 22 bp, Homo sapiens
gaagaaagattggcatgcttca

SEQ ID NO: 9083560 - DNA, 22 bp, Homo sapiens
gaagaaagatcaaatagtttcc

SEQ ID NO: 9083561 - DNA, 22 bp, Homo sapiens
atgcaagagcaatatggtatgc

SEQ ID NO: 9083562 - DNA, 22 bp, Homo sapiens
atgcaaatgcagccattgcaga

SEQ ID NO: 9083563 - DNA, 18 bp, Homo sapiens
atgcaagctatggatttg

SEQ ID NO: 9083564 - DNA, 22 bp, Homo sapiens
atgcaagtcttaatagtttagg

SEQ ID NO: 9083565 - DNA, 22 bp, Homo sapiens
atgcaataccttctgaaaataa

SEQ ID NO: 9083566 - DNA, 22 bp, Homo sapiens
atgcaatagtaattctagtctg

SEQ ID NO: 9083567 - DNA, 22 bp, Homo sapiens
atgcaatatagggaagatagat

SEQ ID NO: 9083568 - DNA, 22 bp, Homo sapiens
atgcacaaacccacaattagtc

SEQ ID NO: 9083569 - DNA, 21 bp, Homo sapiens
atgcacaaaaagactctttct

SEQ ID NO: 9083570 - DNA, 22 bp, Homo sapiens
atgcaatcatatggcatacagc

SEQ ID NO: 9083571 - DNA, 22 bp, Homo sapiens
atgcaatatgtgtttctgttta

SEQ ID NO: 9083572 - DNA, 22 bp, Homo sapiens
atgcaatttactgtacataaat

SEQ ID NO: 9083573 - DNA, 22 bp, Homo sapiens
gaacattattgtacaaatgtct

SEQ ID NO: 9083574 - DNA, 20 bp, Homo sapiens
gaacatggcaggtggagggg

SEQ ID NO: 9083575 - DNA, 22 bp, Homo sapiens
gaacattactgcttgggagagg

SEQ ID NO: 9083576 - DNA, 22 bp, Homo sapiens
gaacattattgtacaaatgtct

SEQ ID NO: 9083577 - DNA, 22 bp, Homo sapiens
gaacatgaaaagtcttacacgc

SEQ ID NO: 9083578 - DNA, 22 bp, Homo sapiens
gaacatcttatccatttcctct

SEQ ID NO: 9083579 - DNA, 22 bp, Homo sapiens
gaacatctgggatcattgctgt

SEQ ID NO: 9083580 - DNA, 22 bp, Homo sapiens
gaacattcttgggcaagttact

SEQ ID NO: 9083581 - DNA, 22 bp, Homo sapiens
gaacattcacagactcaccatt

SEQ ID NO: 9083582 - DNA, 23 bp, Homo sapiens
gaacattcattggttgctttaga

SEQ ID NO: 9083583 - DNA, 22 bp, Homo sapiens
gaacatttgatgatgacattgg

SEQ ID NO: 9083584 - DNA, 22 bp, Homo sapiens
gaactttaccatttaggtaact

SEQ ID NO: 9083585 - DNA, 17 bp, Homo sapiens
gaacttttattaaattc

SEQ ID NO: 9083586 - DNA, 17 bp, Homo sapiens
gaacttttattaaattc

SEQ ID NO: 9083587 - DNA, 22 bp, Homo sapiens
gaaatgaactgattatcattgc

SEQ ID NO: 9083588 - DNA, 22 bp, Homo sapiens
gaaatgaactgattatcattgc

SEQ ID NO: 9083589 - DNA, 22 bp, Homo sapiens
gaaatgaactgattatcattgc

SEQ ID NO: 9083590 - DNA, 22 bp, Homo sapiens
gaaatgaaatagcaccaaggtt

SEQ ID NO: 9083591 - DNA, 22 bp, Homo sapiens
gaaatgaaacaggcttttaagg

SEQ ID NO: 9083592 - DNA, 22 bp, Homo sapiens
gaaatatacattgcaggaagag

SEQ ID NO: 9083593 - DNA, 22 bp, Homo sapiens
gaaaatgtgcctttgggtattg

SEQ ID NO: 9083594 - DNA, 22 bp, Homo sapiens
gaaaatgagcctcagctacatt

SEQ ID NO: 9083595 - DNA, 22 bp, Homo sapiens
gaaaatgtgtcatccctactgt

SEQ ID NO: 9083596 - DNA, 22 bp, Homo sapiens
gaaaatgtgtcatccctactgt

SEQ ID NO: 9083597 - DNA, 22 bp, Homo sapiens
gaacaatgagtcattcaggtga

SEQ ID NO: 9083598 - DNA, 22 bp, Homo sapiens
gaacatacaagaattaagtaca

SEQ ID NO: 9083599 - DNA, 22 bp, Homo sapiens
gaacatagtaaatgtcacattt

SEQ ID NO: 9083600 - DNA, 22 bp, Homo sapiens
atgaggcatgtgaggagaaggg

SEQ ID NO: 9083601 - DNA, 22 bp, Homo sapiens
atgaggcatgtgaggagaaggg

SEQ ID NO: 9083602 - DNA, 22 bp, Homo sapiens
atgaggcagtctggcctgaggg

SEQ ID NO: 9083603 - DNA, 22 bp, Homo sapiens
atgaggcatctgcagtcactag

SEQ ID NO: 9083604 - DNA, 22 bp, Homo sapiens
atcttcaattgaaaactagcct

SEQ ID NO: 9083605 - DNA, 22 bp, Homo sapiens
atcttcaaggaaaaaatacagt

SEQ ID NO: 9083606 - DNA, 22 bp, Homo sapiens
atcttcaactttggggctgcct

SEQ ID NO: 9083607 - DNA, 22 bp, Homo sapiens
atcttcaaagggatgtccatgg

SEQ ID NO: 9083608 - DNA, 22 bp, Homo sapiens
cttgagatgtcatctgctttgg

SEQ ID NO: 9083609 - DNA, 23 bp, Homo sapiens
cttgagctcaggaagagctgagt

SEQ ID NO: 9083610 - DNA, 22 bp, Homo sapiens
cttgagggactctatgacttag

SEQ ID NO: 9083611 - DNA, 22 bp, Homo sapiens
atgaagcagttaaggtgcatga

SEQ ID NO: 9083612 - DNA, 22 bp, Homo sapiens
atgaatcaagtgagaacagcat

SEQ ID NO: 9083613 - DNA, 22 bp, Homo sapiens
atgaatcaaagttcatttgatc

SEQ ID NO: 9083614 - DNA, 23 bp, Homo sapiens
atgaatgaataaggcaggaaagc

SEQ ID NO: 9083615 - DNA, 22 bp, Homo sapiens
atgaataaaacattttaatcag

SEQ ID NO: 9083616 - DNA, 22 bp, Homo sapiens
atgaatatgagactgagagcct

SEQ ID NO: 9083617 - DNA, 22 bp, Homo sapiens
atgaataagtaaactcctttgg

SEQ ID NO: 9083618 - DNA, 22 bp, Homo sapiens
atgaatcaaactgtacactgag

SEQ ID NO: 9083619 - DNA, 22 bp, Homo sapiens
gaaaactaacggaaaagttagg

SEQ ID NO: 9083620 - DNA, 22 bp, Homo sapiens
gaaaactattggcctagaacaa

SEQ ID NO: 9083621 - DNA, 22 bp, Homo sapiens
gaaaactaacggaaaagttagg

SEQ ID NO: 9083622 - DNA, 22 bp, Homo sapiens
gaaaagagaacatctgaggatc

SEQ ID NO: 9083623 - DNA, 22 bp, Homo sapiens
gaaaagagaacatctgaggatc

SEQ ID NO: 9083624 - DNA, 22 bp, Homo sapiens
gaaaagaactgcatgggattaa

SEQ ID NO: 9083625 - DNA, 22 bp, Homo sapiens
gaaaagaactgcatgggattaa

SEQ ID NO: 9083626 - DNA, 22 bp, Homo sapiens
gaaaagaactgcatgggattaa

SEQ ID NO: 9083627 - DNA, 22 bp, Homo sapiens
gaaaacttggatctctagaatg

SEQ ID NO: 9083628 - DNA, 22 bp, Homo sapiens
gaaaatctgcttatattatttt

SEQ ID NO: 9083629 - DNA, 22 bp, Homo sapiens
gaaaatgagcctcagctacatt

SEQ ID NO: 9083630 - DNA, 22 bp, Homo sapiens
gaaaatagcagatagaccaatg

SEQ ID NO: 9083631 - DNA, 22 bp, Homo sapiens
gaaaataggcagatgcattgta

SEQ ID NO: 9083632 - DNA, 20 bp, Homo sapiens
gaaaataggccagccaggta

SEQ ID NO: 9083633 - DNA, 19 bp, Homo sapiens
gaaaacatgggtgagggtc

SEQ ID NO: 9083634 - DNA, 19 bp, Homo sapiens
gaaaacatgggtgagggtc

SEQ ID NO: 9083635 - DNA, 19 bp, Homo sapiens
gaaaacatgggtgagggtc

SEQ ID NO: 9083636 - DNA, 22 bp, Homo sapiens
ctttttccagcttcagggtggg

SEQ ID NO: 9083637 - DNA, 22 bp, Homo sapiens
gaaaacatccagagatagacct

SEQ ID NO: 9083638 - DNA, 19 bp, Homo sapiens
gaaaacatgggtgagggtc

SEQ ID NO: 9083639 - DNA, 22 bp, Homo sapiens
atgaatgtttggtgatcagata

SEQ ID NO: 9083640 - DNA, 22 bp, Homo sapiens
atgaatggatggggtcaagata

SEQ ID NO: 9083641 - DNA, 22 bp, Homo sapiens
atgaatgtaagtggatttcttt

SEQ ID NO: 9083642 - DNA, 22 bp, Homo sapiens
ctttttccagcttcagggtggg

SEQ ID NO: 9083643 - DNA, 19 bp, Homo sapiens
atgaatgagctgtgaggtt

SEQ ID NO: 9083644 - DNA, 22 bp, Homo sapiens
gagcagctagataaagcccttc

SEQ ID NO: 9083645 - DNA, 22 bp, Homo sapiens
gagcagctagataaagcccttc

SEQ ID NO: 9083646 - DNA, 22 bp, Homo sapiens
gagcagctaaaattctcatgca

SEQ ID NO: 9083647 - DNA, 22 bp, Homo sapiens
gagcagctaaaattctcatgca

SEQ ID NO: 9083648 - DNA, 22 bp, Homo sapiens
gagcacagggaatagacagata

SEQ ID NO: 9083649 - DNA, 22 bp, Homo sapiens
gagcacagggaatagacagata

SEQ ID NO: 9083650 - DNA, 22 bp, Homo sapiens
gagcagctcagaggactagtgt

SEQ ID NO: 9083651 - DNA, 22 bp, Homo sapiens
gagcagctcaggcacttagcca

SEQ ID NO: 9083652 - DNA, 22 bp, Homo sapiens
gagcagctcaggcacttagcca

SEQ ID NO: 9083653 - DNA, 22 bp, Homo sapiens
gagcagctccagccgcatgact

SEQ ID NO: 9083654 - DNA, 22 bp, Homo sapiens
gagcagctccagccgcatgact

SEQ ID NO: 9083655 - DNA, 22 bp, Homo sapiens
gagcagctcgagaaggaagcag

SEQ ID NO: 9083656 - DNA, 22 bp, Homo sapiens
gagcagctcgagaaggaagcag

SEQ ID NO: 9083657 - DNA, 22 bp, Homo sapiens
gagaggtggaggttgcagtgag

SEQ ID NO: 9083658 - DNA, 22 bp, Homo sapiens
gagcacagggaatagacagata

SEQ ID NO: 9083659 - DNA, 22 bp, Homo sapiens
gagaggtgtgtttcagataaga

SEQ ID NO: 9083660 - DNA, 22 bp, Homo sapiens
gagaggtggaggttgcagtgag

SEQ ID NO: 9083661 - DNA, 22 bp, Homo sapiens
atgcttttcctaaaatgatgcc

SEQ ID NO: 9083662 - DNA, 22 bp, Homo sapiens
atgctttttaaacttaattgga

SEQ ID NO: 9083663 - DNA, 21 bp, Homo sapiens
atggaaaaacaggtagagcat

SEQ ID NO: 9083664 - DNA, 21 bp, Homo sapiens
atggaaaaacaggtagagcat

SEQ ID NO: 9083665 - DNA, 22 bp, Homo sapiens
gagaggctctgaggactggggt

SEQ ID NO: 9083666 - DNA, 22 bp, Homo sapiens
gagaggaatgaggttaaggact

SEQ ID NO: 9083667 - DNA, 22 bp, Homo sapiens
gagaggtagcagtaagaacagg

SEQ ID NO: 9083668 - DNA, 22 bp, Homo sapiens
gagaggtagaggctctgcttaa

SEQ ID NO: 9083669 - DNA, 22 bp, Homo sapiens
gagaggtagaggctctgcttaa

SEQ ID NO: 9083670 - DNA, 22 bp, Homo sapiens
gagaggctggcagtgccaggtt

SEQ ID NO: 9083671 - DNA, 22 bp, Homo sapiens
gagaggctgactggctgtcctg

SEQ ID NO: 9083672 - DNA, 22 bp, Homo sapiens
gagaggctgactggctgtcctg

SEQ ID NO: 9083673 - DNA, 21 bp, Homo sapiens
gagccttccctctgccctttc

SEQ ID NO: 9083674 - DNA, 22 bp, Homo sapiens
gagcctgtgtttcctgtagcca

SEQ ID NO: 9083675 - DNA, 19 bp, Homo sapiens
gagcgcagagggcagggga

SEQ ID NO: 9083676 - DNA, 22 bp, Homo sapiens
gagcggaggcttggaggccagc

SEQ ID NO: 9083677 - DNA, 23 bp, Homo sapiens
gagctctgcactaggccctggga

SEQ ID NO: 9083678 - DNA, 23 bp, Homo sapiens
gagctctgcactaggccctggga

SEQ ID NO: 9083679 - DNA, 22 bp, Homo sapiens
gagcctggcctcctgcctcagc

SEQ ID NO: 9083680 - DNA, 22 bp, Homo sapiens
gagcctggcctcctgcctcagc

SEQ ID NO: 9083681 - DNA, 22 bp, Homo sapiens
gagcctggcctcctgcctcagc

SEQ ID NO: 9083682 - DNA, 20 bp, Homo sapiens
gagcctgggaagtctaaggt

SEQ ID NO: 9083683 - DNA, 22 bp, Homo sapiens
gagcctgggactgggggtcatg

SEQ ID NO: 9083684 - DNA, 22 bp, Homo sapiens
gagcctgggactgggggtcatg

SEQ ID NO: 9083685 - DNA, 22 bp, Homo sapiens
gagcctgggtccttccctggga

SEQ ID NO: 9083686 - DNA, 22 bp, Homo sapiens
gagcctgggtccttccctggga

SEQ ID NO: 9083687 - DNA, 22 bp, Homo sapiens
gagcctgggtccttccctggga

SEQ ID NO: 9083688 - DNA, 22 bp, Homo sapiens
gagcctggggaccctcctgagt

SEQ ID NO: 9083689 - DNA, 22 bp, Homo sapiens
gagcctgggtccttccctggga

SEQ ID NO: 9083690 - DNA, 22 bp, Homo sapiens
gagcctgggactgggggtcatg

SEQ ID NO: 9083691 - DNA, 22 bp, Homo sapiens
gagcctgggactgggggtcatg

SEQ ID NO: 9083692 - DNA, 22 bp, Homo sapiens
gagcctggggaccctcctgagt

SEQ ID NO: 9083693 - DNA, 22 bp, Homo sapiens
gagcctggggaccctcctgagt

SEQ ID NO: 9083694 - DNA, 22 bp, Homo sapiens
gagcagggagacaactctggtg

SEQ ID NO: 9083695 - DNA, 22 bp, Homo sapiens
gagcagggagacaactctggtg

SEQ ID NO: 9083696 - DNA, 22 bp, Homo sapiens
gagcagggagacaactctggtg

SEQ ID NO: 9083697 - DNA, 22 bp, Homo sapiens
gagcagggagacaactctggtg

SEQ ID NO: 9083698 - DNA, 22 bp, Homo sapiens
gagcagggagacaactctggtg

SEQ ID NO: 9083699 - DNA, 19 bp, Homo sapiens
gagcagctgcacccattga

SEQ ID NO: 9083700 - DNA, 22 bp, Homo sapiens
gagcagctgagctggaatgaga

SEQ ID NO: 9083701 - DNA, 22 bp, Homo sapiens
gagcagctgagctggaatgaga

SEQ ID NO: 9083702 - DNA, 22 bp, Homo sapiens
gagcagctgagctggaatgaga

SEQ ID NO: 9083703 - DNA, 22 bp, Homo sapiens
gagcagctgagctggaatgaga

SEQ ID NO: 9083704 - DNA, 22 bp, Homo sapiens
gagcagctgagctggaatgaga

SEQ ID NO: 9083705 - DNA, 22 bp, Homo sapiens
gagcagctctgggtgacccagt

SEQ ID NO: 9083706 - DNA, 22 bp, Homo sapiens
gagcagctctgtgcctggagac

SEQ ID NO: 9083707 - DNA, 22 bp, Homo sapiens
gagcagggccacttctgtacct

SEQ ID NO: 9083708 - DNA, 22 bp, Homo sapiens
gagcagggccacttctgtacct

SEQ ID NO: 9083709 - DNA, 17 bp, Homo sapiens
gagcagggatgcggttc

SEQ ID NO: 9083710 - DNA, 22 bp, Homo sapiens
gagcagggcttgtcctcctcat

SEQ ID NO: 9083711 - DNA, 22 bp, Homo sapiens
gagcagggcttgtcctcctcat

SEQ ID NO: 9083712 - DNA, 22 bp, Homo sapiens
gagcagggcttgtcctcctcat

SEQ ID NO: 9083713 - DNA, 22 bp, Homo sapiens
gagcagggcttgtcctcctcat

SEQ ID NO: 9083714 - DNA, 22 bp, Homo sapiens
gagcctggattgtcaccgactt

SEQ ID NO: 9083715 - DNA, 22 bp, Homo sapiens
gagcctggattgtcaccgactt

SEQ ID NO: 9083716 - DNA, 22 bp, Homo sapiens
gagccctcttgtctatatggta

SEQ ID NO: 9083717 - DNA, 20 bp, Homo sapiens
gagccctctgcactagcgcc

SEQ ID NO: 9083718 - DNA, 22 bp, Homo sapiens
gagccctcttccctagtgatcg

SEQ ID NO: 9083719 - DNA, 22 bp, Homo sapiens
gagcagtgaagacagaagtaca

SEQ ID NO: 9083720 - DNA, 22 bp, Homo sapiens
gagcagtgaagacagaagtaca

SEQ ID NO: 9083721 - DNA, 22 bp, Homo sapiens
gagcagtaggagaaccctgagc

SEQ ID NO: 9083722 - DNA, 22 bp, Homo sapiens
gagcaggtgcctgtagctctct

SEQ ID NO: 9083723 - DNA, 22 bp, Homo sapiens
gagcagtaggagaaccctgagc

SEQ ID NO: 9083724 - DNA, 22 bp, Homo sapiens
gagcttggtgttatttctgtgg

SEQ ID NO: 9083725 - DNA, 22 bp, Homo sapiens
gagcttggtgctgcctgttgtc

SEQ ID NO: 9083726 - DNA, 22 bp, Homo sapiens
gagcttggtgctgcctgttgtc

SEQ ID NO: 9083727 - DNA, 22 bp, Homo sapiens
gagcttggtgctgcctgttgtc

SEQ ID NO: 9083728 - DNA, 22 bp, Homo sapiens
gagcttggtgcacagtggttaa

SEQ ID NO: 9083729 - DNA, 22 bp, Homo sapiens
gagctggggcggatactcagct

SEQ ID NO: 9083730 - DNA, 22 bp, Homo sapiens
gagcttggctggacctcacgga

SEQ ID NO: 9083731 - DNA, 22 bp, Homo sapiens
gagcttggtgatgcctcctggt

SEQ ID NO: 9083732 - DNA, 22 bp, Homo sapiens
gagcttggtgcacagtggttaa

SEQ ID NO: 9083733 - DNA, 22 bp, Homo sapiens
gagcttggtgatgcctcctggt

SEQ ID NO: 9083734 - DNA, 22 bp, Homo sapiens
gagcttgggtgccatgctgagc

SEQ ID NO: 9083735 - DNA, 22 bp, Homo sapiens
gagcttggggcatatggtgcta

SEQ ID NO: 9083736 - DNA, 22 bp, Homo sapiens
gagctctggcagggcaggtctg

SEQ ID NO: 9083737 - DNA, 22 bp, Homo sapiens
gagctctgcttgggttcttagg

SEQ ID NO: 9083738 - DNA, 22 bp, Homo sapiens
gagctctgtacacagagggtgt

SEQ ID NO: 9083739 - DNA, 22 bp, Homo sapiens
gagctctgggaaacaaagtgta

SEQ ID NO: 9083740 - DNA, 22 bp, Homo sapiens
gagctctggttcatgatctatt

SEQ ID NO: 9083741 - DNA, 22 bp, Homo sapiens
gaggaagcagggcttggctgag

SEQ ID NO: 9083742 - DNA, 22 bp, Homo sapiens
gaggaagatggttgagtggtcc

SEQ ID NO: 9083743 - DNA, 22 bp, Homo sapiens
gaggaagccccattgaagccag

SEQ ID NO: 9083744 - DNA, 22 bp, Homo sapiens
gagctttgctggaagcctgggg

SEQ ID NO: 9083745 - DNA, 22 bp, Homo sapiens
gagctttgctggaagcctgggg

SEQ ID NO: 9083746 - DNA, 22 bp, Homo sapiens
gaggaaggagggaaagcgcgcg

SEQ ID NO: 9083747 - DNA, 22 bp, Homo sapiens
gaggaaggaatgcagtgtatgc

SEQ ID NO: 9083748 - DNA, 22 bp, Homo sapiens
gaggaaggaatgcagtgtatgc

SEQ ID NO: 9083749 - DNA, 22 bp, Homo sapiens
atggttcatattatgcatctga

SEQ ID NO: 9083750 - DNA, 21 bp, Homo sapiens
atgtcaaatgctttattttat

SEQ ID NO: 9083751 - DNA, 18 bp, Homo sapiens
atgtcacagagggctgaa

SEQ ID NO: 9083752 - DNA, 22 bp, Homo sapiens
atgtcacagcaggagtattctt

SEQ ID NO: 9083753 - DNA, 22 bp, Homo sapiens
atgtcacagtctgactcagtga

SEQ ID NO: 9083754 - DNA, 22 bp, Homo sapiens
atgtacaatctagggtttgcat

SEQ ID NO: 9083755 - DNA, 22 bp, Homo sapiens
atgtacaagctgttttactgca

SEQ ID NO: 9083756 - DNA, 22 bp, Homo sapiens
atgtacaagctgttttactgca

SEQ ID NO: 9083757 - DNA, 22 bp, Homo sapiens
atgtacaatctatcacaagaag

SEQ ID NO: 9083758 - DNA, 22 bp, Homo sapiens
atgtacaacctgcatgacagtc

SEQ ID NO: 9083759 - DNA, 22 bp, Homo sapiens
atgtacaacctgcatgacagtc

SEQ ID NO: 9083760 - DNA, 22 bp, Homo sapiens
atgtacaacctgcatgacagtc

SEQ ID NO: 9083761 - DNA, 22 bp, Homo sapiens
atgtacaacctgcatgacagtc

SEQ ID NO: 9083762 - DNA, 22 bp, Homo sapiens
atgtacaagctgttttactgca

SEQ ID NO: 9083763 - DNA, 22 bp, Homo sapiens
atgtacaagctgttttactgca

SEQ ID NO: 9083764 - DNA, 22 bp, Homo sapiens
atgtacaaaatgccactgaatt

SEQ ID NO: 9083765 - DNA, 22 bp, Homo sapiens
atgtacaaaatgttttgaaatg

SEQ ID NO: 9083766 - DNA, 22 bp, Homo sapiens
atgtacaaaatgttttgaaatg

SEQ ID NO: 9083767 - DNA, 22 bp, Homo sapiens
atgtaatttatgttatccataa

SEQ ID NO: 9083768 - DNA, 22 bp, Homo sapiens
atgtaatttatgttatccataa

SEQ ID NO: 9083769 - DNA, 22 bp, Homo sapiens
atgtaatgtagctgtgttagga

SEQ ID NO: 9083770 - DNA, 22 bp, Homo sapiens
atgtaattgtagcaaaatgatg

SEQ ID NO: 9083771 - DNA, 22 bp, Homo sapiens
atgtaagactttaagaacctaa

SEQ ID NO: 9083772 - DNA, 22 bp, Homo sapiens
atgtaagtattcaaaatatttc

SEQ ID NO: 9083773 - DNA, 22 bp, Homo sapiens
atgtaacatatgtgatcgcatt

SEQ ID NO: 9083774 - DNA, 22 bp, Homo sapiens
atgtaacaaatggtatacatgt

SEQ ID NO: 9083775 - DNA, 22 bp, Homo sapiens
atgtaacacccacttttatagc

SEQ ID NO: 9083776 - DNA, 22 bp, Homo sapiens
atgtaaattgtactgacacacg

SEQ ID NO: 9083777 - DNA, 22 bp, Homo sapiens
atgtaaattgtactgacacacg

SEQ ID NO: 9083778 - DNA, 22 bp, Homo sapiens
gaggcatgtctggcctgtccca

SEQ ID NO: 9083779 - DNA, 22 bp, Homo sapiens
gaggccaaggtgggcagatcac

SEQ ID NO: 9083780 - DNA, 17 bp, Homo sapiens
gaggccaaggcaggcgg

SEQ ID NO: 9083781 - DNA, 22 bp, Homo sapiens
gaggccaagggagaagatctct

SEQ ID NO: 9083782 - DNA, 22 bp, Homo sapiens
gaggccacagtcctgaggcatc

SEQ ID NO: 9083783 - DNA, 22 bp, Homo sapiens
gagggatgtgcctgaaggcagg

SEQ ID NO: 9083784 - DNA, 22 bp, Homo sapiens
gagggatgtgcctgaaggcagg

SEQ ID NO: 9083785 - DNA, 22 bp, Homo sapiens
gagggatggtgtgagaggctca

SEQ ID NO: 9083786 - DNA, 22 bp, Homo sapiens
gagggaagaaagaattgatgcg

SEQ ID NO: 9083787 - DNA, 22 bp, Homo sapiens
gagggaagaaagaattgatgcg

SEQ ID NO: 9083788 - DNA, 22 bp, Homo sapiens
gagggaaacagatgggttgtgg

SEQ ID NO: 9083789 - DNA, 23 bp, Homo sapiens
gaggcttgatcagcttcctccac

SEQ ID NO: 9083790 - DNA, 22 bp, Homo sapiens
gaggcttctgtaaccctgtcct

SEQ ID NO: 9083791 - DNA, 22 bp, Homo sapiens
gaggcttctggaaagcctggca

SEQ ID NO: 9083792 - DNA, 22 bp, Homo sapiens
gaggctgtttgtggcagtgatg

SEQ ID NO: 9083793 - DNA, 22 bp, Homo sapiens
gaggcttcccgcccatgctgga

SEQ ID NO: 9083794 - DNA, 22 bp, Homo sapiens
gaggcttcccgcccatgctgga

SEQ ID NO: 9083795 - DNA, 22 bp, Homo sapiens
gaggtagcgagtggacagtgca

SEQ ID NO: 9083796 - DNA, 22 bp, Homo sapiens
gaggtaggaggtaggtattgtg

SEQ ID NO: 9083797 - DNA, 23 bp, Homo sapiens
gaggtacagcaccagtgaatagg

SEQ ID NO: 9083798 - DNA, 22 bp, Homo sapiens
gaggtacagagtgttccaatgt

SEQ ID NO: 9083799 - DNA, 22 bp, Homo sapiens
gaggtacatgaggatacacagg

SEQ ID NO: 9083800 - DNA, 18 bp, Homo sapiens
gaggtagataagattttc

SEQ ID NO: 9083801 - DNA, 22 bp, Homo sapiens
gaggtagacttcttggaagtag

SEQ ID NO: 9083802 - DNA, 18 bp, Homo sapiens
gagtccaggctcttcacc

SEQ ID NO: 9083803 - DNA, 22 bp, Homo sapiens
gagtccagcagaatgagccaag

SEQ ID NO: 9083804 - DNA, 22 bp, Homo sapiens
gaggttggtgaggggacacggt

SEQ ID NO: 9083805 - DNA, 22 bp, Homo sapiens
gaggttggggctgcagtgagct

SEQ ID NO: 9083806 - DNA, 22 bp, Homo sapiens
gaggttggggctgcagtgagct

SEQ ID NO: 9083807 - DNA, 22 bp, Homo sapiens
gaggttggggctgcagtgagct

SEQ ID NO: 9083808 - DNA, 22 bp, Homo sapiens
gagggcaccagaagagccagat

SEQ ID NO: 9083809 - DNA, 22 bp, Homo sapiens
gagggcaccttcagtaatagct

SEQ ID NO: 9083810 - DNA, 20 bp, Homo sapiens
gagggcacattgttccgtgc

SEQ ID NO: 9083811 - DNA, 22 bp, Homo sapiens
gagggcactcgagactacggca

SEQ ID NO: 9083812 - DNA, 19 bp, Homo sapiens
gaggggaggaattgacaag

SEQ ID NO: 9083813 - DNA, 22 bp, Homo sapiens
gagggggcgtgcaaggctccgc

SEQ ID NO: 9083814 - DNA, 22 bp, Homo sapiens
gaggggggcgccctgcagtgca

SEQ ID NO: 9083815 - DNA, 22 bp, Homo sapiens
gagggggctccctgaagccagt

SEQ ID NO: 9083816 - DNA, 22 bp, Homo sapiens
gagggggctagcgcagtgccca

SEQ ID NO: 9083817 - DNA, 22 bp, Homo sapiens
atgtttcaatgcactttagcct

SEQ ID NO: 9083818 - DNA, 21 bp, Homo sapiens
gagtgcaggtctgatgccatc

SEQ ID NO: 9083819 - DNA, 22 bp, Homo sapiens
gagttaaatagcttaggattca

SEQ ID NO: 9083820 - DNA, 22 bp, Homo sapiens
atgtttcatccactggcctttc

SEQ ID NO: 9083821 - DNA, 22 bp, Homo sapiens
gagtgcagatgaacagaagatt

SEQ ID NO: 9083822 - DNA, 22 bp, Homo sapiens
gagtgcagatgaacagaagatt

SEQ ID NO: 9083823 - DNA, 22 bp, Homo sapiens
gagtgcagatgccagccccagt

SEQ ID NO: 9083824 - DNA, 22 bp, Homo sapiens
gagtccagttctttccagcagt

SEQ ID NO: 9083825 - DNA, 22 bp, Homo sapiens
gagtgcagatgccagccccagt

SEQ ID NO: 9083826 - DNA, 21 bp, Homo sapiens
gagtgcagcaaggtagagtct

SEQ ID NO: 9083827 - DNA, 22 bp, Homo sapiens
gagtgcaggcctgagcaccatc

SEQ ID NO: 9083828 - DNA, 22 bp, Homo sapiens
gagtgcaggcctgagcaccatc

SEQ ID NO: 9083829 - DNA, 22 bp, Homo sapiens
gagtccaggctgttgctcatct

SEQ ID NO: 9083830 - DNA, 22 bp, Homo sapiens
gagtccaggctgttgctcatct

SEQ ID NO: 9083831 - DNA, 22 bp, Homo sapiens
gagtccagtagttaggacagag

SEQ ID NO: 9083832 - DNA, 23 bp, Homo sapiens
gagtgcagaatagacatgcagtg

SEQ ID NO: 9083833 - DNA, 22 bp, Homo sapiens
gagtccagttagtgaggctggg

SEQ ID NO: 9083834 - DNA, 22 bp, Homo sapiens
gagtccagttctttccagcagt

SEQ ID NO: 9083835 - DNA, 22 bp, Homo sapiens
gagtccagttagtgaggctggg

SEQ ID NO: 9083836 - DNA, 22 bp, Homo sapiens
gagtccagttagtgaggctggg

SEQ ID NO: 9083837 - DNA, 22 bp, Homo sapiens
atgtttcccataagattttctg

SEQ ID NO: 9083838 - DNA, 22 bp, Homo sapiens
gatctcaaagcagtgtgggttg

SEQ ID NO: 9083839 - DNA, 21 bp, Homo sapiens
gatctctggaatgactctggc

SEQ ID NO: 9083840 - DNA, 22 bp, Homo sapiens
gatctctgggtcctgttggcct

SEQ ID NO: 9083841 - DNA, 22 bp, Homo sapiens
gatctgaaaatgctcttcttct

SEQ ID NO: 9083842 - DNA, 22 bp, Homo sapiens
gatctgaagagcaatgaaatat

SEQ ID NO: 9083843 - DNA, 22 bp, Homo sapiens
gatctgaagagttattttctga

SEQ ID NO: 9083844 - DNA, 22 bp, Homo sapiens
gatctgaagatatgaaatattt

SEQ ID NO: 9083845 - DNA, 22 bp, Homo sapiens
gatctgaatagacttgctaagg

SEQ ID NO: 9083846 - DNA, 22 bp, Homo sapiens
gatctgaatcaatagaataact

SEQ ID NO: 9083847 - DNA, 22 bp, Homo sapiens
gatctggaatctgaaggctgag

SEQ ID NO: 9083848 - DNA, 22 bp, Homo sapiens
gatcgagttgtttgttctgggg

SEQ ID NO: 9083849 - DNA, 22 bp, Homo sapiens
gatcgggtgggttctgccatca

SEQ ID NO: 9083850 - DNA, 22 bp, Homo sapiens
gatcctgtctccgcaccgtgtt

SEQ ID NO: 9083851 - DNA, 22 bp, Homo sapiens
gatcctgtctgtggagtcagca

SEQ ID NO: 9083852 - DNA, 22 bp, Homo sapiens
gatcctgttagaaatgtagact

SEQ ID NO: 9083853 - DNA, 22 bp, Homo sapiens
gatcctgttataatttggatgt

SEQ ID NO: 9083854 - DNA, 22 bp, Homo sapiens
gatcctgacatcctgacatgga

SEQ ID NO: 9083855 - DNA, 22 bp, Homo sapiens
gatatttacaaatttgccaata

SEQ ID NO: 9083856 - DNA, 22 bp, Homo sapiens
gatatttaactctcacaggtcc

SEQ ID NO: 9083857 - DNA, 22 bp, Homo sapiens
gagttacagagaggattatggt

SEQ ID NO: 9083858 - DNA, 22 bp, Homo sapiens
gagttacagagaggattatggt

SEQ ID NO: 9083859 - DNA, 22 bp, Homo sapiens
gagttacatggacattctctcc

SEQ ID NO: 9083860 - DNA, 22 bp, Homo sapiens
gagttacatttggtgacacttc

SEQ ID NO: 9083861 - DNA, 22 bp, Homo sapiens
gagttacatttggtgacacttc

SEQ ID NO: 9083862 - DNA, 22 bp, Homo sapiens
ggctgcggccgcgggtctgtgc

SEQ ID NO: 9083863 - DNA, 22 bp, Homo sapiens
cactgtgctcctaactagctgt

SEQ ID NO: 9083864 - DNA, 22 bp, Homo sapiens
ggctgcagcagagggactcacg

SEQ ID NO: 9083865 - DNA, 22 bp, Homo sapiens
ggctgcagcagagggactcacg

SEQ ID NO: 9083866 - DNA, 19 bp, Homo sapiens
cactgtcctagtcgaggcc

SEQ ID NO: 9083867 - DNA, 22 bp, Homo sapiens
cactgtccctgtttcctggaaa

SEQ ID NO: 9083868 - DNA, 22 bp, Homo sapiens
cactgtccatgcttgctaaccc

SEQ ID NO: 9083869 - DNA, 22 bp, Homo sapiens
cactgtcctagtcttcctggag

SEQ ID NO: 9083870 - DNA, 22 bp, Homo sapiens
cactgtccatgcttgctaaccc

SEQ ID NO: 9083871 - DNA, 22 bp, Homo sapiens
cactgtccaatagatacataat

SEQ ID NO: 9083872 - DNA, 22 bp, Homo sapiens
ggctgcagcggattggggattg

SEQ ID NO: 9083873 - DNA, 22 bp, Homo sapiens
ggctgcagcggattggggattg

SEQ ID NO: 9083874 - DNA, 22 bp, Homo sapiens
ggctgcagattgtagtctgtta

SEQ ID NO: 9083875 - DNA, 22 bp, Homo sapiens
ggctgcagatagccagccacca

SEQ ID NO: 9083876 - DNA, 22 bp, Homo sapiens
cactgcctccccaggctccaca

SEQ ID NO: 9083877 - DNA, 22 bp, Homo sapiens
cactgcctccccaggctccaca

SEQ ID NO: 9083878 - DNA, 22 bp, Homo sapiens
cactgcctccccaggctccaca

SEQ ID NO: 9083879 - DNA, 22 bp, Homo sapiens
ggctgcagaggcgatctgaggt

SEQ ID NO: 9083880 - DNA, 22 bp, Homo sapiens
ggctgaggctcatgccatcttg

SEQ ID NO: 9083881 - DNA, 19 bp, Homo sapiens
ggctcctggggctcagccc

SEQ ID NO: 9083882 - DNA, 22 bp, Homo sapiens
ggctccagtttccccttggggc

SEQ ID NO: 9083883 - DNA, 21 bp, Homo sapiens
cactgaggtcaggggtagggt

SEQ ID NO: 9083884 - DNA, 20 bp, Homo sapiens
cactgaggtgcagctcatgc

SEQ ID NO: 9083885 - DNA, 20 bp, Homo sapiens
cactgaggtgcagctcatgc

SEQ ID NO: 9083886 - DNA, 22 bp, Homo sapiens
cactgagttccctgacatttca

SEQ ID NO: 9083887 - DNA, 22 bp, Homo sapiens
cactgcaaaggggaaagaagca

SEQ ID NO: 9083888 - DNA, 22 bp, Homo sapiens
ggcgctctggacctggctctcg

SEQ ID NO: 9083889 - DNA, 22 bp, Homo sapiens
cactgaggcttccttaggcaat

SEQ ID NO: 9083890 - DNA, 22 bp, Homo sapiens
cactgagggagggtttcttctg

SEQ ID NO: 9083891 - DNA, 22 bp, Homo sapiens
cactgagggggtggtttcagga

SEQ ID NO: 9083892 - DNA, 22 bp, Homo sapiens
cactgagggcggagcccaggga

SEQ ID NO: 9083893 - DNA, 22 bp, Homo sapiens
cactgaggctgggggagaaggt

SEQ ID NO: 9083894 - DNA, 22 bp, Homo sapiens
ggcgccgcactcggtgcagccg

SEQ ID NO: 9083895 - DNA, 22 bp, Homo sapiens
ggctcctgggggtgctcctgcc

SEQ ID NO: 9083896 - DNA, 22 bp, Homo sapiens
ggctcctgtcccctcagctgct

SEQ ID NO: 9083897 - DNA, 22 bp, Homo sapiens
ggctcctgtcccctcagctgct

SEQ ID NO: 9083898 - DNA, 22 bp, Homo sapiens
ggctcctgtcccctcagctgct

SEQ ID NO: 9083899 - DNA, 22 bp, Homo sapiens
ggctcctgtcccctcagctgct

SEQ ID NO: 9083900 - DNA, 22 bp, Homo sapiens
ggctcctgtcctcctggagctc

SEQ ID NO: 9083901 - DNA, 22 bp, Homo sapiens
ggctcctgtggcaagacagctt

SEQ ID NO: 9083902 - DNA, 22 bp, Homo sapiens
cactgcccaggacctgccaccc

SEQ ID NO: 9083903 - DNA, 19 bp, Homo sapiens
ggctcctgtggctgcagcc

SEQ ID NO: 9083904 - DNA, 19 bp, Homo sapiens
ggctcctgtggctgcagcc

SEQ ID NO: 9083905 - DNA, 22 bp, Homo sapiens
ggctcctgggggtgctcctgcc

SEQ ID NO: 9083906 - DNA, 19 bp, Homo sapiens
ggctcctgtggctgcagcc

SEQ ID NO: 9083907 - DNA, 20 bp, Homo sapiens
cactgccctccagcctgagc

SEQ ID NO: 9083908 - DNA, 17 bp, Homo sapiens
ggcttcagggagctggg

SEQ ID NO: 9083909 - DNA, 22 bp, Homo sapiens
ggctgggagctggacaggccgg

SEQ ID NO: 9083910 - DNA, 22 bp, Homo sapiens
ggcttctttttagtaaatgtca

SEQ ID NO: 9083911 - DNA, 20 bp, Homo sapiens
ggcttctttacatctgtgtt

SEQ ID NO: 9083912 - DNA, 23 bp, Homo sapiens
ggcttcttgcctgtcttggtgct

SEQ ID NO: 9083913 - DNA, 22 bp, Homo sapiens
ggcttcttgtgtgtcaggctct

SEQ ID NO: 9083914 - DNA, 22 bp, Homo sapiens
cagaacagacttaacagggctg

SEQ ID NO: 9083915 - DNA, 22 bp, Homo sapiens
cagaacagagcctgaatctctc

SEQ ID NO: 9083916 - DNA, 22 bp, Homo sapiens
ggcttggagtcatactgagaat

SEQ ID NO: 9083917 - DNA, 22 bp, Homo sapiens
ggcttgaatggatataatctgt

SEQ ID NO: 9083918 - DNA, 22 bp, Homo sapiens
cagaacagtacctagcacatag

SEQ ID NO: 9083919 - DNA, 22 bp, Homo sapiens
cagaacaggtcatgcttgctgt

SEQ ID NO: 9083920 - DNA, 19 bp, Homo sapiens
cagaacaggaccaggggcc

SEQ ID NO: 9083921 - DNA, 23 bp, Homo sapiens
cagaacagtaaaagatgccatgg

SEQ ID NO: 9083922 - DNA, 19 bp, Homo sapiens
cagaacaggaccaggggcc

SEQ ID NO: 9083923 - DNA, 19 bp, Homo sapiens
cagaacagaggtcatggcc

SEQ ID NO: 9083924 - DNA, 19 bp, Homo sapiens
cagaacagaggtcatggcc

SEQ ID NO: 9083925 - DNA, 22 bp, Homo sapiens
cagaacattccatgtgccctgc

SEQ ID NO: 9083926 - DNA, 22 bp, Homo sapiens
cagaacattcttgccagtacat

SEQ ID NO: 9083927 - DNA, 22 bp, Homo sapiens
cagaacattccatgtgccctgc

SEQ ID NO: 9083928 - DNA, 22 bp, Homo sapiens
cagaagaggactgggtagctca

SEQ ID NO: 9083929 - DNA, 22 bp, Homo sapiens
cagaagaggactgggtagctca

SEQ ID NO: 9083930 - DNA, 22 bp, Homo sapiens
cagaacagtcgcctgcatggat

SEQ ID NO: 9083931 - DNA, 22 bp, Homo sapiens
cagaacagtcgcctgcatggat

SEQ ID NO: 9083932 - DNA, 20 bp, Homo sapiens
cagaacagtctgagaggcca

SEQ ID NO: 9083933 - DNA, 22 bp, Homo sapiens
cagaacatccccactgctacct

SEQ ID NO: 9083934 - DNA, 20 bp, Homo sapiens
cagaacatgagcatcgagcc

SEQ ID NO: 9083935 - DNA, 22 bp, Homo sapiens
cagaacatgatataaacagaag

SEQ ID NO: 9083936 - DNA, 22 bp, Homo sapiens
cagaacatgatataaacagaag

SEQ ID NO: 9083937 - DNA, 22 bp, Homo sapiens
cagaaatgtgatgtacacacac

SEQ ID NO: 9083938 - DNA, 22 bp, Homo sapiens
cagaaatgtgatgtacacacac

SEQ ID NO: 9083939 - DNA, 22 bp, Homo sapiens
cagaaatgtttatatgtggtgt

SEQ ID NO: 9083940 - DNA, 22 bp, Homo sapiens
cagaaatgtgatgtacacacac

SEQ ID NO: 9083941 - DNA, 22 bp, Homo sapiens
cagaaatgtttatgcttttgaa

SEQ ID NO: 9083942 - DNA, 22 bp, Homo sapiens
cagaaatgtttatgcttttgaa

SEQ ID NO: 9083943 - DNA, 22 bp, Homo sapiens
cagaaattcccatttcagattc

SEQ ID NO: 9083944 - DNA, 22 bp, Homo sapiens
cagaacagaatcgtgtggtgag

SEQ ID NO: 9083945 - DNA, 22 bp, Homo sapiens
cagaacagaatcgtgtggtgag

SEQ ID NO: 9083946 - DNA, 22 bp, Homo sapiens
cagaacagaagtaaaatttacc

SEQ ID NO: 9083947 - DNA, 22 bp, Homo sapiens
cagaacagaaacgttgttccat

SEQ ID NO: 9083948 - DNA, 22 bp, Homo sapiens
cagaacacaggctaaactgaga

SEQ ID NO: 9083949 - DNA, 22 bp, Homo sapiens
ggctggctttctctccgcacct

SEQ ID NO: 9083950 - DNA, 22 bp, Homo sapiens
ggctgggagccccacagagtca

SEQ ID NO: 9083951 - DNA, 23 bp, Homo sapiens
cagaaatgacagtaagcaccctg

SEQ ID NO: 9083952 - DNA, 22 bp, Homo sapiens
cagaaatgcctgcttctctctc

SEQ ID NO: 9083953 - DNA, 22 bp, Homo sapiens
cagaaatgcctgcttctctctc

SEQ ID NO: 9083954 - DNA, 22 bp, Homo sapiens
cagaaatggtctgttcagctta

SEQ ID NO: 9083955 - DNA, 22 bp, Homo sapiens
cagaaatgtactgacatgcagt

SEQ ID NO: 9083956 - DNA, 22 bp, Homo sapiens
cagaaatgtactgacatgcagt

SEQ ID NO: 9083957 - DNA, 22 bp, Homo sapiens
cagaaatggagcccaggaatct

SEQ ID NO: 9083958 - DNA, 22 bp, Homo sapiens
cagaaatgtactgacatgcagt

SEQ ID NO: 9083959 - DNA, 22 bp, Homo sapiens
cagaaatgtactgacatgcagt

SEQ ID NO: 9083960 - DNA, 22 bp, Homo sapiens
cagaaatgtactgacatgcagt

SEQ ID NO: 9083961 - DNA, 22 bp, Homo sapiens
cagaaatggagcccaggaatct

SEQ ID NO: 9083962 - DNA, 22 bp, Homo sapiens
cagaaatggagcccaggaatct

SEQ ID NO: 9083963 - DNA, 22 bp, Homo sapiens
cagaaatggagcccaggaatct

SEQ ID NO: 9083964 - DNA, 22 bp, Homo sapiens
cagaaatggaattttccatcac

SEQ ID NO: 9083965 - DNA, 22 bp, Homo sapiens
cagaaatggaagttctggttta

SEQ ID NO: 9083966 - DNA, 22 bp, Homo sapiens
cagaaatggaagttctggttta

SEQ ID NO: 9083967 - DNA, 20 bp, Homo sapiens
ggctgctggtttggctctgt

SEQ ID NO: 9083968 - DNA, 20 bp, Homo sapiens
ggctgctggtttggctctgt

SEQ ID NO: 9083969 - DNA, 21 bp, Homo sapiens
ggctgctgtcaccgctgtcac

SEQ ID NO: 9083970 - DNA, 22 bp, Homo sapiens
ggctgctgggtcatgatgcaga

SEQ ID NO: 9083971 - DNA, 22 bp, Homo sapiens
ggcgccagcactgcagcgcctc

SEQ ID NO: 9083972 - DNA, 22 bp, Homo sapiens
ggcgccagcccaggccgtcgtg

SEQ ID NO: 9083973 - DNA, 22 bp, Homo sapiens
ggcgcaagcgggggttgtgagc

SEQ ID NO: 9083974 - DNA, 17 bp, Homo sapiens
ggcctgtgtggctgcag

SEQ ID NO: 9083975 - DNA, 22 bp, Homo sapiens
ggcgagggagcagtgcggtggg

SEQ ID NO: 9083976 - DNA, 17 bp, Homo sapiens
ggcctgtgtggctgcag

SEQ ID NO: 9083977 - DNA, 22 bp, Homo sapiens
ggccccagggaagaaggtggtc

SEQ ID NO: 9083978 - DNA, 22 bp, Homo sapiens
ggccccaggcctttggtctggc

SEQ ID NO: 9083979 - DNA, 22 bp, Homo sapiens
ggccccaggacctccacggtcc

SEQ ID NO: 9083980 - DNA, 22 bp, Homo sapiens
ggccccaggcctttggtctggc

SEQ ID NO: 9083981 - DNA, 22 bp, Homo sapiens
ggccccagcctcagtcccctga

SEQ ID NO: 9083982 - DNA, 22 bp, Homo sapiens
ggccccagctgtggtgaataga

SEQ ID NO: 9083983 - DNA, 22 bp, Homo sapiens
ggccccagcttcaaccccgtgg

SEQ ID NO: 9083984 - DNA, 22 bp, Homo sapiens
ggcccagcacagtgcttggggg

SEQ ID NO: 9083985 - DNA, 22 bp, Homo sapiens
ggcccagagtctgcaatggagt

SEQ ID NO: 9083986 - DNA, 21 bp, Homo sapiens
ggccccagcccatgggttctc

SEQ ID NO: 9083987 - DNA, 21 bp, Homo sapiens
ggccccagcccatgggttctc

SEQ ID NO: 9083988 - DNA, 22 bp, Homo sapiens
ggccccagcctcagtcccctga

SEQ ID NO: 9083989 - DNA, 21 bp, Homo sapiens
ggccccagcccatgggttctc

SEQ ID NO: 9083990 - DNA, 19 bp, Homo sapiens
ggccccagccagggtatca

SEQ ID NO: 9083991 - DNA, 19 bp, Homo sapiens
ggccccagccagggtatca

SEQ ID NO: 9083992 - DNA, 22 bp, Homo sapiens
ggccccagcagtgcttgtttat

SEQ ID NO: 9083993 - DNA, 22 bp, Homo sapiens
ggccccagcagaccctcctctg

SEQ ID NO: 9083994 - DNA, 22 bp, Homo sapiens
ggccccagcagaccctcctctg

SEQ ID NO: 9083995 - DNA, 22 bp, Homo sapiens
ggcccagcccgagtcagccttc

SEQ ID NO: 9083996 - DNA, 22 bp, Homo sapiens
cacccagcagcacttaagacta

SEQ ID NO: 9083997 - DNA, 22 bp, Homo sapiens
cacccagccttcacacaggagt

SEQ ID NO: 9083998 - DNA, 22 bp, Homo sapiens
cacccaggctagagtgcagtgg

SEQ ID NO: 9083999 - DNA, 22 bp, Homo sapiens
cacccaggcaggtggctgagaa

SEQ ID NO: 9084000 - DNA, 22 bp, Homo sapiens
cacccaggacaggccagatgtg

SEQ ID NO: 9084001 - DNA, 22 bp, Homo sapiens
cacccaggcaggtggctgagaa

SEQ ID NO: 9084002 - DNA, 22 bp, Homo sapiens
cacccaggcaaggattctgcaa

SEQ ID NO: 9084003 - DNA, 22 bp, Homo sapiens
ggccagcccagtggtcctctct

SEQ ID NO: 9084004 - DNA, 23 bp, Homo sapiens
ggccactttgtgtcagtatgtgc

SEQ ID NO: 9084005 - DNA, 18 bp, Homo sapiens
ggccagccccaggccagc

SEQ ID NO: 9084006 - DNA, 22 bp, Homo sapiens
ggccagcggcacagcctggccc

SEQ ID NO: 9084007 - DNA, 22 bp, Homo sapiens
ggccagcctggggctcccagac

SEQ ID NO: 9084008 - DNA, 22 bp, Homo sapiens
ggccagcctggggctcccagac

SEQ ID NO: 9084009 - DNA, 19 bp, Homo sapiens
cacattttgagtctgagat

SEQ ID NO: 9084010 - DNA, 19 bp, Homo sapiens
cacattttgagtctgagat

SEQ ID NO: 9084011 - DNA, 22 bp, Homo sapiens
cacatttgaaggaattagcatt

SEQ ID NO: 9084012 - DNA, 21 bp, Homo sapiens
cacatttgaacctcacagcaa

SEQ ID NO: 9084013 - DNA, 22 bp, Homo sapiens
cacatttttactgccaacttaa

SEQ ID NO: 9084014 - DNA, 22 bp, Homo sapiens
caccacagcatccactagaagg

SEQ ID NO: 9084015 - DNA, 22 bp, Homo sapiens
cacatgcctattaaccaaacga

SEQ ID NO: 9084016 - DNA, 22 bp, Homo sapiens
ggcaggtgtgagatcgaggcca

SEQ ID NO: 9084017 - DNA, 22 bp, Homo sapiens
ggcaggtgccttctgtgctagc

SEQ ID NO: 9084018 - DNA, 22 bp, Homo sapiens
ggcaggtgtggagtgttatttt

SEQ ID NO: 9084019 - DNA, 22 bp, Homo sapiens
ggcaggtgtgagatcgaggcca

SEQ ID NO: 9084020 - DNA, 22 bp, Homo sapiens
ggcaggtgtgagctgtaaagga

SEQ ID NO: 9084021 - DNA, 22 bp, Homo sapiens
ggcagtagccagggactggcag

SEQ ID NO: 9084022 - DNA, 22 bp, Homo sapiens
ggcagtcaagagggagtctgaa

SEQ ID NO: 9084023 - DNA, 21 bp, Homo sapiens
ggcagtaagatttactttaag

SEQ ID NO: 9084024 - DNA, 21 bp, Homo sapiens
ggcagtaagccaaatccattt

SEQ ID NO: 9084025 - DNA, 22 bp, Homo sapiens
ggcaggtgtggtgaccagagat

SEQ ID NO: 9084026 - DNA, 22 bp, Homo sapiens
ggcaggtgtttttatattaaag

SEQ ID NO: 9084027 - DNA, 19 bp, Homo sapiens
ggcagtcacggtcaggagc

SEQ ID NO: 9084028 - DNA, 22 bp, Homo sapiens
ggcagtcacttttgcttgtgcc

SEQ ID NO: 9084029 - DNA, 19 bp, Homo sapiens
ggcagtcacggtcaggagc

SEQ ID NO: 9084030 - DNA, 22 bp, Homo sapiens
ggcagtcaagagggagtctgaa

SEQ ID NO: 9084031 - DNA, 22 bp, Homo sapiens
ggcagtcacaggggagactggg

SEQ ID NO: 9084032 - DNA, 22 bp, Homo sapiens
cacatgcatcacgacttccttt

SEQ ID NO: 9084033 - DNA, 20 bp, Homo sapiens
ggcaggaccccagtggcatc

SEQ ID NO: 9084034 - DNA, 22 bp, Homo sapiens
ggcaggacattgactacagtga

SEQ ID NO: 9084035 - DNA, 20 bp, Homo sapiens
ggcaggaccccagtggcatc

SEQ ID NO: 9084036 - DNA, 22 bp, Homo sapiens
ggcaggacagtcccagttcaaa

SEQ ID NO: 9084037 - DNA, 22 bp, Homo sapiens
ggcaggaataaattatggactt

SEQ ID NO: 9084038 - DNA, 20 bp, Homo sapiens
ggcaggaccccagtggcatc

SEQ ID NO: 9084039 - DNA, 22 bp, Homo sapiens
cacatgcaggagccaatgtaca

SEQ ID NO: 9084040 - DNA, 22 bp, Homo sapiens
ggcagctgcaaatctgctctgt

SEQ ID NO: 9084041 - DNA, 22 bp, Homo sapiens
ggcagctgcaaatctgctctgt

SEQ ID NO: 9084042 - DNA, 22 bp, Homo sapiens
ggcagctgcaaatctgctctgt

SEQ ID NO: 9084043 - DNA, 22 bp, Homo sapiens
ggcagctgcaaatctgctctgt

SEQ ID NO: 9084044 - DNA, 22 bp, Homo sapiens
ggcagctgcaaatctgctctgt

SEQ ID NO: 9084045 - DNA, 22 bp, Homo sapiens
ggcaggaaatgggataagggct

SEQ ID NO: 9084046 - DNA, 22 bp, Homo sapiens
ggcaggaagtagcagtctgagc

SEQ ID NO: 9084047 - DNA, 22 bp, Homo sapiens
ggcaggaagtagcagtctgagc

SEQ ID NO: 9084048 - DNA, 22 bp, Homo sapiens
ggcaggaagtagcagtctgagc

SEQ ID NO: 9084049 - DNA, 22 bp, Homo sapiens
ggcaggaacacagatggtgccg

SEQ ID NO: 9084050 - DNA, 22 bp, Homo sapiens
ggatatcaaattattaggtaga

SEQ ID NO: 9084051 - DNA, 22 bp, Homo sapiens
ggataagaaaattgtaataact

SEQ ID NO: 9084052 - DNA, 22 bp, Homo sapiens
ggagtgaatcactagatgcaga

SEQ ID NO: 9084053 - DNA, 22 bp, Homo sapiens
ggagtgactctcggggccacta

SEQ ID NO: 9084054 - DNA, 21 bp, Homo sapiens
ggagtttttctggaagggact

SEQ ID NO: 9084055 - DNA, 23 bp, Homo sapiens
ggataaatctcagcttcttccat

SEQ ID NO: 9084056 - DNA, 22 bp, Homo sapiens
ggagtctgcggcagacactgta

SEQ ID NO: 9084057 - DNA, 22 bp, Homo sapiens
ggagtctgcggcagacactgta

SEQ ID NO: 9084058 - DNA, 22 bp, Homo sapiens
ggagtctgctcccagacatgat

SEQ ID NO: 9084059 - DNA, 22 bp, Homo sapiens
ggagtctgctcccagacatgat

SEQ ID NO: 9084060 - DNA, 22 bp, Homo sapiens
ggagtctggagtggggcccaag

SEQ ID NO: 9084061 - DNA, 22 bp, Homo sapiens
ggagtctgtcacctgtttctct

SEQ ID NO: 9084062 - DNA, 21 bp, Homo sapiens
ggagtctgtggatgctgtttc

SEQ ID NO: 9084063 - DNA, 22 bp, Homo sapiens
ggagtcttggcctgctgagaaa

SEQ ID NO: 9084064 - DNA, 22 bp, Homo sapiens
ggagtctgttttacatgcagga

SEQ ID NO: 9084065 - DNA, 22 bp, Homo sapiens
ggagtctgttttacatgcagga

SEQ ID NO: 9084066 - DNA, 22 bp, Homo sapiens
ggaggggatttagtagatgcta

SEQ ID NO: 9084067 - DNA, 22 bp, Homo sapiens
ggaggggcagccatggaactcc

SEQ ID NO: 9084068 - DNA, 22 bp, Homo sapiens
ggaggggcatagttcaccatca

SEQ ID NO: 9084069 - DNA, 22 bp, Homo sapiens
ggaggggccggctgcctgccac

SEQ ID NO: 9084070 - DNA, 22 bp, Homo sapiens
cacaggagaaaggggaagctcg

SEQ ID NO: 9084071 - DNA, 22 bp, Homo sapiens
ggaggggcatagttcaccatca

SEQ ID NO: 9084072 - DNA, 22 bp, Homo sapiens
cacaggagaacccacagattct

SEQ ID NO: 9084073 - DNA, 22 bp, Homo sapiens
cacaggagagctgggaggtgcc

SEQ ID NO: 9084074 - DNA, 22 bp, Homo sapiens
cacaggagagctgggaggtgcc

SEQ ID NO: 9084075 - DNA, 18 bp, Homo sapiens
cacaggagatgacctgac

SEQ ID NO: 9084076 - DNA, 22 bp, Homo sapiens
ggaggggatggtttgaccctgg

SEQ ID NO: 9084077 - DNA, 22 bp, Homo sapiens
cacagctatggggctgtagcct

SEQ ID NO: 9084078 - DNA, 22 bp, Homo sapiens
cacagctagatggatagataga

SEQ ID NO: 9084079 - DNA, 22 bp, Homo sapiens
cacagctgaagtagccatgtgg

SEQ ID NO: 9084080 - DNA, 22 bp, Homo sapiens
ggagggcaacttttcagtaggt

SEQ ID NO: 9084081 - DNA, 22 bp, Homo sapiens
cacagccttgagcgaggacaag

SEQ ID NO: 9084082 - DNA, 22 bp, Homo sapiens
cacagcctcctctggctcacgg

SEQ ID NO: 9084083 - DNA, 22 bp, Homo sapiens
cacagccttactgagatccact

SEQ ID NO: 9084084 - DNA, 22 bp, Homo sapiens
cacagcctccttcagagagcat

SEQ ID NO: 9084085 - DNA, 22 bp, Homo sapiens
cacagcctgctgcactcaagaa

SEQ ID NO: 9084086 - DNA, 22 bp, Homo sapiens
cacagcctcctctggctcacgg

SEQ ID NO: 9084087 - DNA, 22 bp, Homo sapiens
cacagcctccttcagagagcat

SEQ ID NO: 9084088 - DNA, 22 bp, Homo sapiens
cacagctaactttcactgagca

SEQ ID NO: 9084089 - DNA, 22 bp, Homo sapiens
cacagctaatggaagtggaatc

SEQ ID NO: 9084090 - DNA, 22 bp, Homo sapiens
cacagcctttagggtacacaca

SEQ ID NO: 9084091 - DNA, 22 bp, Homo sapiens
ggagcagcttgcatgctcaggg

SEQ ID NO: 9084092 - DNA, 22 bp, Homo sapiens
ggagcagcttgcatgctcaggg

SEQ ID NO: 9084093 - DNA, 22 bp, Homo sapiens
ggagcagcttgcatgctcaggg

SEQ ID NO: 9084094 - DNA, 22 bp, Homo sapiens
ggagcagcttgcatgctcaggg

SEQ ID NO: 9084095 - DNA, 22 bp, Homo sapiens
ggaggagacagtaaaaagcacg

SEQ ID NO: 9084096 - DNA, 22 bp, Homo sapiens
ggaggagacagtaaaaagcacg

SEQ ID NO: 9084097 - DNA, 22 bp, Homo sapiens
ggagctggccgcctatgtgcag

SEQ ID NO: 9084098 - DNA, 22 bp, Homo sapiens
ggagctggccctctgagtttgt

SEQ ID NO: 9084099 - DNA, 22 bp, Homo sapiens
ggaggagcacttctgagctcag

SEQ ID NO: 9084100 - DNA, 22 bp, Homo sapiens
ggaggagcacttgacggggtct

SEQ ID NO: 9084101 - DNA, 22 bp, Homo sapiens
ggaggagattcccctctcactt

SEQ ID NO: 9084102 - DNA, 22 bp, Homo sapiens
ggaggagcacttctgagctcag

SEQ ID NO: 9084103 - DNA, 22 bp, Homo sapiens
ggaggagaccctgtgtcagttt

SEQ ID NO: 9084104 - DNA, 22 bp, Homo sapiens
ggaggagaccctgtgtcagttt

SEQ ID NO: 9084105 - DNA, 22 bp, Homo sapiens
ggaggagagaggttgcaaacac

SEQ ID NO: 9084106 - DNA, 22 bp, Homo sapiens
ggaggagattcccctctcactt

SEQ ID NO: 9084107 - DNA, 22 bp, Homo sapiens
ggaggagagaggttgcaaacac

SEQ ID NO: 9084108 - DNA, 22 bp, Homo sapiens
ggaggagagaggttgcaaacac

SEQ ID NO: 9084109 - DNA, 22 bp, Homo sapiens
ggaggagacggagtgattagtg

SEQ ID NO: 9084110 - DNA, 22 bp, Homo sapiens
ggaggagacggagtgattagtg

SEQ ID NO: 9084111 - DNA, 22 bp, Homo sapiens
ggaggagacggagtgattagtg

SEQ ID NO: 9084112 - DNA, 22 bp, Homo sapiens
ggagcagccacgtctcagggca

SEQ ID NO: 9084113 - DNA, 22 bp, Homo sapiens
ggagcagccgcgtctcagggca

SEQ ID NO: 9084114 - DNA, 22 bp, Homo sapiens
cacagcccccttgacactctgg

SEQ ID NO: 9084115 - DNA, 22 bp, Homo sapiens
cacagccctgcgccccagtttg

SEQ ID NO: 9084116 - DNA, 22 bp, Homo sapiens
cacagcctcctctggctcacgg

SEQ ID NO: 9084117 - DNA, 22 bp, Homo sapiens
cacagcagggatgaatggagtg

SEQ ID NO: 9084118 - DNA, 22 bp, Homo sapiens
cacagcagggatgaatggagtg

SEQ ID NO: 9084119 - DNA, 22 bp, Homo sapiens
cacagcaggcagaacgtgggca

SEQ ID NO: 9084120 - DNA, 22 bp, Homo sapiens
cacagcagtctttcactaaata

SEQ ID NO: 9084121 - DNA, 22 bp, Homo sapiens
cacagcaggtgcttaatgatta

SEQ ID NO: 9084122 - DNA, 22 bp, Homo sapiens
ggaacaggaaaggagggatgct

SEQ ID NO: 9084123 - DNA, 22 bp, Homo sapiens
ggaagagaaatgagtcaagact

SEQ ID NO: 9084124 - DNA, 22 bp, Homo sapiens
ggaagagaaatgagtcaagact

SEQ ID NO: 9084125 - DNA, 22 bp, Homo sapiens
ggaagagagatcccatagatgt

SEQ ID NO: 9084126 - DNA, 22 bp, Homo sapiens
ggaagagagatcccatagatgt

SEQ ID NO: 9084127 - DNA, 22 bp, Homo sapiens
ggaagagagggctgggcctcaa

SEQ ID NO: 9084128 - DNA, 22 bp, Homo sapiens
ggaagagaggttcagccctaag

SEQ ID NO: 9084129 - DNA, 22 bp, Homo sapiens
ggacacaaaagtgaataaaata

SEQ ID NO: 9084130 - DNA, 19 bp, Homo sapiens
ggacacagaaagctgcatt

SEQ ID NO: 9084131 - DNA, 19 bp, Homo sapiens
ggacacagaaagctgcatt

SEQ ID NO: 9084132 - DNA, 23 bp, Homo sapiens
ggacacagagataagtgagacaa

SEQ ID NO: 9084133 - DNA, 19 bp, Homo sapiens
ggacacagaaagctgcatt

SEQ ID NO: 9084134 - DNA, 19 bp, Homo sapiens
ggacacagaaagctgcatt

SEQ ID NO: 9084135 - DNA, 22 bp, Homo sapiens
ggacacagataatcacacagat

SEQ ID NO: 9084136 - DNA, 22 bp, Homo sapiens
ggacagcacagctcttgacaac

SEQ ID NO: 9084137 - DNA, 22 bp, Homo sapiens
ggacacagataatcacacagat

SEQ ID NO: 9084138 - DNA, 22 bp, Homo sapiens
ggacacagataatcacacagat

SEQ ID NO: 9084139 - DNA, 22 bp, Homo sapiens
ggacacagataatcacacagat

SEQ ID NO: 9084140 - DNA, 22 bp, Homo sapiens
ggacagagggttgacagagtat

SEQ ID NO: 9084141 - DNA, 23 bp, Homo sapiens
ggacacagagataagtgagacaa

SEQ ID NO: 9084142 - DNA, 22 bp, Homo sapiens
ggacacagataatcacacagat

SEQ ID NO: 9084143 - DNA, 22 bp, Homo sapiens
ggaaggggccttgagcaaactg

SEQ ID NO: 9084144 - DNA, 22 bp, Homo sapiens
ggacaaagcctggtggcaggtg

SEQ ID NO: 9084145 - DNA, 22 bp, Homo sapiens
ggacaaagctctgctgcctccc

SEQ ID NO: 9084146 - DNA, 22 bp, Homo sapiens
ggacaaaggtagacagtctctg

SEQ ID NO: 9084147 - DNA, 22 bp, Homo sapiens
ggacaaagggtggagcctctga

SEQ ID NO: 9084148 - DNA, 22 bp, Homo sapiens
ggacaaaggtctggggaacctg

SEQ ID NO: 9084149 - DNA, 22 bp, Homo sapiens
ggacaagcctgtgagtgggttt

SEQ ID NO: 9084150 - DNA, 22 bp, Homo sapiens
ggacaagcctgtgagtgggttt

SEQ ID NO: 9084151 - DNA, 22 bp, Homo sapiens
ggacaagcctgtgagtgggttt

SEQ ID NO: 9084152 - DNA, 22 bp, Homo sapiens
ggacaagcctgtgagtgggttt

SEQ ID NO: 9084153 - DNA, 22 bp, Homo sapiens
ggacagctgctttcaggccaca

SEQ ID NO: 9084154 - DNA, 22 bp, Homo sapiens
ggacagctcctgcacttgagta

SEQ ID NO: 9084155 - DNA, 22 bp, Homo sapiens
ggacagcatatcagcagggcag

SEQ ID NO: 9084156 - DNA, 22 bp, Homo sapiens
ggacagcatatcagcagggcag

SEQ ID NO: 9084157 - DNA, 22 bp, Homo sapiens
ggagagtggattccagctgtat

SEQ ID NO: 9084158 - DNA, 22 bp, Homo sapiens
ggagagtggattccagctgtat

SEQ ID NO: 9084159 - DNA, 22 bp, Homo sapiens
ggagagtggattccagctgtat

SEQ ID NO: 9084160 - DNA, 18 bp, Homo sapiens
ggagagtgacagagtcgt

SEQ ID NO: 9084161 - DNA, 22 bp, Homo sapiens
ggagagttgtttttgcctagat

SEQ ID NO: 9084162 - DNA, 22 bp, Homo sapiens
ggagagtctgccgagccagccc

SEQ ID NO: 9084163 - DNA, 22 bp, Homo sapiens
ggagagtctgagcctgctggag

SEQ ID NO: 9084164 - DNA, 22 bp, Homo sapiens
ggagagctgacatcatgatgtt

SEQ ID NO: 9084165 - DNA, 22 bp, Homo sapiens
ggagagctgacatcatgatgtt

SEQ ID NO: 9084166 - DNA, 22 bp, Homo sapiens
ggagaggttatccgtgttatgt

SEQ ID NO: 9084167 - DNA, 22 bp, Homo sapiens
cacagcaaaggcttcggctgat

SEQ ID NO: 9084168 - DNA, 22 bp, Homo sapiens
cacagcaaagacactctcaact

SEQ ID NO: 9084169 - DNA, 22 bp, Homo sapiens
cacagagaattcccatatgtga

SEQ ID NO: 9084170 - DNA, 22 bp, Homo sapiens
ggagataatccagggagggact

SEQ ID NO: 9084171 - DNA, 22 bp, Homo sapiens
ggagatacaaaagtagtgcagg

SEQ ID NO: 9084172 - DNA, 22 bp, Homo sapiens
ggagatactatctttacaattc

SEQ ID NO: 9084173 - DNA, 22 bp, Homo sapiens
cacagagaactgtgggagtgtg

SEQ ID NO: 9084174 - DNA, 22 bp, Homo sapiens
cacagagaatgatgagtcactg

SEQ ID NO: 9084175 - DNA, 22 bp, Homo sapiens
cacagagaactgtgggagtgtg

SEQ ID NO: 9084176 - DNA, 22 bp, Homo sapiens
gctgggagccccgagccagcgc

SEQ ID NO: 9084177 - DNA, 19 bp, Homo sapiens
gctgggagcagaccctccc

SEQ ID NO: 9084178 - DNA, 19 bp, Homo sapiens
gctgggagcagaccctccc

SEQ ID NO: 9084179 - DNA, 22 bp, Homo sapiens
gctgggagccccgagccagcgc

SEQ ID NO: 9084180 - DNA, 22 bp, Homo sapiens
gctgggagccccgagccagcgc

SEQ ID NO: 9084181 - DNA, 22 bp, Homo sapiens
gctgggagccctggtctgctcc

SEQ ID NO: 9084182 - DNA, 22 bp, Homo sapiens
gctggctgtgattttgccaaca

SEQ ID NO: 9084183 - DNA, 22 bp, Homo sapiens
gctgggagcaaagccatgcata

SEQ ID NO: 9084184 - DNA, 22 bp, Homo sapiens
gctgggagcaaagccatgcata

SEQ ID NO: 9084185 - DNA, 22 bp, Homo sapiens
gctggccatggcctgcgccatc

SEQ ID NO: 9084186 - DNA, 22 bp, Homo sapiens
gctggccatatattttgctgtt

SEQ ID NO: 9084187 - DNA, 22 bp, Homo sapiens
gctggccatagaagccaaagag

SEQ ID NO: 9084188 - DNA, 22 bp, Homo sapiens
gctggccagtgtggtgaccacc

SEQ ID NO: 9084189 - DNA, 22 bp, Homo sapiens
gctggccatatattttgctgtt

SEQ ID NO: 9084190 - DNA, 22 bp, Homo sapiens
gctggccattctctttgagatg

SEQ ID NO: 9084191 - DNA, 22 bp, Homo sapiens
gctggccatggggagtgaggag

SEQ ID NO: 9084192 - DNA, 22 bp, Homo sapiens
gctggccatggggagtgaggag

SEQ ID NO: 9084193 - DNA, 22 bp, Homo sapiens
gctggccatggggagtgaggag

SEQ ID NO: 9084194 - DNA, 20 bp, Homo sapiens
gctgggctaccactggccct

SEQ ID NO: 9084195 - DNA, 22 bp, Homo sapiens
gctgggccttccgattctcaag

SEQ ID NO: 9084196 - DNA, 22 bp, Homo sapiens
gctgggagccctggtctgctcc

SEQ ID NO: 9084197 - DNA, 22 bp, Homo sapiens
gctgggagccgtacctgtcacg

SEQ ID NO: 9084198 - DNA, 22 bp, Homo sapiens
gctgggagccgtacctgtcacg

SEQ ID NO: 9084199 - DNA, 22 bp, Homo sapiens
gctgggagccgtacctgtcacg

SEQ ID NO: 9084200 - DNA, 22 bp, Homo sapiens
gctgggccagagcagcagcact

SEQ ID NO: 9084201 - DNA, 19 bp, Homo sapiens
gctggcagatgtggccgtg

SEQ ID NO: 9084202 - DNA, 19 bp, Homo sapiens
gctggcagatgtggccgtg

SEQ ID NO: 9084203 - DNA, 19 bp, Homo sapiens
gctggcagatgtggccgtg

SEQ ID NO: 9084204 - DNA, 22 bp, Homo sapiens
gctggcagcattagaccctggg

SEQ ID NO: 9084205 - DNA, 22 bp, Homo sapiens
gctggccagtgtggtgaccacc

SEQ ID NO: 9084206 - DNA, 16 bp, Homo sapiens
gctggagggaggggtt

SEQ ID NO: 9084207 - DNA, 22 bp, Homo sapiens
gctgaggtggagattgcagtga

SEQ ID NO: 9084208 - DNA, 20 bp, Homo sapiens
gctggcagatgtcttgagat

SEQ ID NO: 9084209 - DNA, 22 bp, Homo sapiens
gctgaggtaggaggttgcagtg

SEQ ID NO: 9084210 - DNA, 22 bp, Homo sapiens
caaatttaggtaacagtctgta

SEQ ID NO: 9084211 - DNA, 22 bp, Homo sapiens
caaatttaggtaacagtctgta

SEQ ID NO: 9084212 - DNA, 22 bp, Homo sapiens
caaatttaggtaacagtctgta

SEQ ID NO: 9084213 - DNA, 22 bp, Homo sapiens
gctgaggtaggaggttgcagtg

SEQ ID NO: 9084214 - DNA, 20 bp, Homo sapiens
gctgaggtcattatgcctca

SEQ ID NO: 9084215 - DNA, 22 bp, Homo sapiens
gctgaggtcaggagctgtgggg

SEQ ID NO: 9084216 - DNA, 22 bp, Homo sapiens
caaattcagaaaattggtagag

SEQ ID NO: 9084217 - DNA, 22 bp, Homo sapiens
caaattcagaaaattggtagag

SEQ ID NO: 9084218 - DNA, 18 bp, Homo sapiens
caaattcagtgctggaag

SEQ ID NO: 9084219 - DNA, 18 bp, Homo sapiens
caaattcagtgctggaag

SEQ ID NO: 9084220 - DNA, 22 bp, Homo sapiens
caaattcaaatttcatcagtgt

SEQ ID NO: 9084221 - DNA, 22 bp, Homo sapiens
caaatttaagttagaaagcaat

SEQ ID NO: 9084222 - DNA, 22 bp, Homo sapiens
caaatttaagtgaggtctttgt

SEQ ID NO: 9084223 - DNA, 22 bp, Homo sapiens
caaattgctaactgtcagacta

SEQ ID NO: 9084224 - DNA, 22 bp, Homo sapiens
gctggtcccaatgtgtttcctt

SEQ ID NO: 9084225 - DNA, 22 bp, Homo sapiens
caagtttaaggcactgataagt

SEQ ID NO: 9084226 - DNA, 17 bp, Homo sapiens
gctggtccttggtaact

SEQ ID NO: 9084227 - DNA, 22 bp, Homo sapiens
gctggtgagcaaaggagaagga

SEQ ID NO: 9084228 - DNA, 22 bp, Homo sapiens
gctggtgagattttatgtttcc

SEQ ID NO: 9084229 - DNA, 22 bp, Homo sapiens
gctggtgagattttatgtttcc

SEQ ID NO: 9084230 - DNA, 22 bp, Homo sapiens
gctggtgcattagctgcagttc

SEQ ID NO: 9084231 - DNA, 22 bp, Homo sapiens
gctggtgattgcctcaggaggc

SEQ ID NO: 9084232 - DNA, 22 bp, Homo sapiens
gctggtgagcaaaggagaagga

SEQ ID NO: 9084233 - DNA, 22 bp, Homo sapiens
gctggtgccttgttgttgttac

SEQ ID NO: 9084234 - DNA, 22 bp, Homo sapiens
gctggtggcagagacatcaggt

SEQ ID NO: 9084235 - DNA, 22 bp, Homo sapiens
gctggtgctctgggccctgagg

SEQ ID NO: 9084236 - DNA, 22 bp, Homo sapiens
gctggtggcagagctccgcggc

SEQ ID NO: 9084237 - DNA, 20 bp, Homo sapiens
gctggtgggggcttgacatg

SEQ ID NO: 9084238 - DNA, 20 bp, Homo sapiens
gctggtgggggcttgacatg

SEQ ID NO: 9084239 - DNA, 22 bp, Homo sapiens
gctggtggtaaggaggaaaaag

SEQ ID NO: 9084240 - DNA, 22 bp, Homo sapiens
gctgtaaagaacattaggaatc

SEQ ID NO: 9084241 - DNA, 22 bp, Homo sapiens
gctggttcttttccgtattata

SEQ ID NO: 9084242 - DNA, 22 bp, Homo sapiens
gctggtggttaccgtgctaatg

SEQ ID NO: 9084243 - DNA, 22 bp, Homo sapiens
gctggtggtgggccagttctgt

SEQ ID NO: 9084244 - DNA, 22 bp, Homo sapiens
caatgcacatggacatcaggct

SEQ ID NO: 9084245 - DNA, 22 bp, Homo sapiens
caatgcacatggacatcaggct

SEQ ID NO: 9084246 - DNA, 22 bp, Homo sapiens
caatcccatcaccatctgctct

SEQ ID NO: 9084247 - DNA, 22 bp, Homo sapiens
caatgcaagcaagatggtcaca

SEQ ID NO: 9084248 - DNA, 22 bp, Homo sapiens
caagtcaatgattataagagtc

SEQ ID NO: 9084249 - DNA, 22 bp, Homo sapiens
caagtcaatgattataagagtc

SEQ ID NO: 9084250 - DNA, 20 bp, Homo sapiens
gctgggctaccactggccct

SEQ ID NO: 9084251 - DNA, 22 bp, Homo sapiens
caagtgcacacacatcctgtgc

SEQ ID NO: 9084252 - DNA, 22 bp, Homo sapiens
caagtgtgactattttttcata

SEQ ID NO: 9084253 - DNA, 22 bp, Homo sapiens
caagtgtctatatcagtgcttg

SEQ ID NO: 9084254 - DNA, 22 bp, Homo sapiens
caagttgctctgcctctgtagg

SEQ ID NO: 9084255 - DNA, 22 bp, Homo sapiens
caagttgtgaatgacagacttc

SEQ ID NO: 9084256 - DNA, 19 bp, Homo sapiens
caagttctggagattaggg

SEQ ID NO: 9084257 - DNA, 21 bp, Homo sapiens
caagttctgctgaatcttctt

SEQ ID NO: 9084258 - DNA, 22 bp, Homo sapiens
caagttcattgtagcattattg

SEQ ID NO: 9084259 - DNA, 22 bp, Homo sapiens
caagttcacttgtctacaaggg

SEQ ID NO: 9084260 - DNA, 21 bp, Homo sapiens
caagttcagaaggttgggctg

SEQ ID NO: 9084261 - DNA, 22 bp, Homo sapiens
caagttcacttgtctacaaggg

SEQ ID NO: 9084262 - DNA, 21 bp, Homo sapiens
caagttcagaaggttgggctg

SEQ ID NO: 9084263 - DNA, 22 bp, Homo sapiens
caagttacattagaaatcatgc

SEQ ID NO: 9084264 - DNA, 22 bp, Homo sapiens
caagttcacatgcatccttgct

SEQ ID NO: 9084265 - DNA, 22 bp, Homo sapiens
caagttcacatgcatccttgct

SEQ ID NO: 9084266 - DNA, 22 bp, Homo sapiens
caagttcaagtcctggctctgc

SEQ ID NO: 9084267 - DNA, 22 bp, Homo sapiens
caagttcaagtcctggctctgc

SEQ ID NO: 9084268 - DNA, 20 bp, Homo sapiens
caagttcaccttctcctctc

SEQ ID NO: 9084269 - DNA, 22 bp, Homo sapiens
caagttcacgttgctttttgag

SEQ ID NO: 9084270 - DNA, 22 bp, Homo sapiens
caagttcacgttgctttttgag

SEQ ID NO: 9084271 - DNA, 22 bp, Homo sapiens
caagttcacgttgctttttgag

SEQ ID NO: 9084272 - DNA, 22 bp, Homo sapiens
caatgcttctcattagccaatg

SEQ ID NO: 9084273 - DNA, 22 bp, Homo sapiens
caatgctgtgctcctcatgagg

SEQ ID NO: 9084274 - DNA, 22 bp, Homo sapiens
caatgcattattctcccacttc

SEQ ID NO: 9084275 - DNA, 22 bp, Homo sapiens
caatgcatgatggaattgcctt

SEQ ID NO: 9084276 - DNA, 22 bp, Homo sapiens
caatggaagaatctgacctgca

SEQ ID NO: 9084277 - DNA, 22 bp, Homo sapiens
caatggcactgcccaaagagaa

SEQ ID NO: 9084278 - DNA, 22 bp, Homo sapiens
gcttccacctactaaatgccac

SEQ ID NO: 9084279 - DNA, 22 bp, Homo sapiens
gcttccagatcccatgctctta

SEQ ID NO: 9084280 - DNA, 20 bp, Homo sapiens
gcttccagaggaggccccgt

SEQ ID NO: 9084281 - DNA, 20 bp, Homo sapiens
gcttccagaggaggccccgt

SEQ ID NO: 9084282 - DNA, 22 bp, Homo sapiens
gcttccagacgatcatgtaaga

SEQ ID NO: 9084283 - DNA, 22 bp, Homo sapiens
gcttccagacgatcatgtaaga

SEQ ID NO: 9084284 - DNA, 22 bp, Homo sapiens
gcttccagagactgagctcttc

SEQ ID NO: 9084285 - DNA, 22 bp, Homo sapiens
ggaacacaaatgggagagctgg

SEQ ID NO: 9084286 - DNA, 17 bp, Homo sapiens
ggaacaaatactatgca

SEQ ID NO: 9084287 - DNA, 20 bp, Homo sapiens
gcttccaggagggctgatat

SEQ ID NO: 9084288 - DNA, 22 bp, Homo sapiens
gcttccagggctcagtcactgc

SEQ ID NO: 9084289 - DNA, 22 bp, Homo sapiens
gcttccaggcttcctacctttg

SEQ ID NO: 9084290 - DNA, 22 bp, Homo sapiens
gcttccagggctcagtcactgc

SEQ ID NO: 9084291 - DNA, 19 bp, Homo sapiens
gcttccagcactgcaggag

SEQ ID NO: 9084292 - DNA, 19 bp, Homo sapiens
gcttccagcactgcaggag

SEQ ID NO: 9084293 - DNA, 19 bp, Homo sapiens
gcttccagcactgcaggag

SEQ ID NO: 9084294 - DNA, 22 bp, Homo sapiens
gcttccagcaaacactggctgc

SEQ ID NO: 9084295 - DNA, 22 bp, Homo sapiens
gcttccagcaccagcagagggg

SEQ ID NO: 9084296 - DNA, 22 bp, Homo sapiens
gcttccagcaccagcagagggg

SEQ ID NO: 9084297 - DNA, 22 bp, Homo sapiens
cagctcctctgttagccctggg

SEQ ID NO: 9084298 - DNA, 22 bp, Homo sapiens
cagctcctagatcggcgaagtg

SEQ ID NO: 9084299 - DNA, 22 bp, Homo sapiens
cagctcccgccatcgggaggca

SEQ ID NO: 9084300 - DNA, 22 bp, Homo sapiens
cagctcccctctgtggggcagt

SEQ ID NO: 9084301 - DNA, 22 bp, Homo sapiens
cagctccctatggtgaggcgac

SEQ ID NO: 9084302 - DNA, 22 bp, Homo sapiens
cagctctgaggaacactccttt

SEQ ID NO: 9084303 - DNA, 22 bp, Homo sapiens
cagctctgatgaaatgtaccag

SEQ ID NO: 9084304 - DNA, 22 bp, Homo sapiens
cagctctgaggaacactccttt

SEQ ID NO: 9084305 - DNA, 22 bp, Homo sapiens
cagctctgaggaacactccttt

SEQ ID NO: 9084306 - DNA, 22 bp, Homo sapiens
cagctcctgaggactgctggga

SEQ ID NO: 9084307 - DNA, 22 bp, Homo sapiens
cagctctgagactgaggctatg

SEQ ID NO: 9084308 - DNA, 22 bp, Homo sapiens
cagctcctgcagctgctgccgt

SEQ ID NO: 9084309 - DNA, 22 bp, Homo sapiens
gtgccctgacacacctggtgtg

SEQ ID NO: 9084310 - DNA, 22 bp, Homo sapiens
gtgcctgggacacagcagatac

SEQ ID NO: 9084311 - DNA, 22 bp, Homo sapiens
gtgccctgaaagagttaattca

SEQ ID NO: 9084312 - DNA, 22 bp, Homo sapiens
gtgcctgggggtaatgtaggat

SEQ ID NO: 9084313 - DNA, 22 bp, Homo sapiens
gtgcctgggcatgagcttgttg

SEQ ID NO: 9084314 - DNA, 19 bp, Homo sapiens
cagcctcaatccctcgggc

SEQ ID NO: 9084315 - DNA, 22 bp, Homo sapiens
gtgcctgggacttgctccggat

SEQ ID NO: 9084316 - DNA, 20 bp, Homo sapiens
cagccctttatcctcctatg

SEQ ID NO: 9084317 - DNA, 22 bp, Homo sapiens
cagccctttccttctcagcttt

SEQ ID NO: 9084318 - DNA, 22 bp, Homo sapiens
cagccctttccttctcagcttt

SEQ ID NO: 9084319 - DNA, 22 bp, Homo sapiens
cagccctttccttctcagcttt

SEQ ID NO: 9084320 - DNA, 22 bp, Homo sapiens
cagcccttttttggtacaaccg

SEQ ID NO: 9084321 - DNA, 22 bp, Homo sapiens
cagcccttggcccagggcacag

SEQ ID NO: 9084322 - DNA, 22 bp, Homo sapiens
cagcccttgggccatcctagaa

SEQ ID NO: 9084323 - DNA, 22 bp, Homo sapiens
cagcccttggctggctccttgc

SEQ ID NO: 9084324 - DNA, 22 bp, Homo sapiens
cagcccttgtttgggaaggatg

SEQ ID NO: 9084325 - DNA, 22 bp, Homo sapiens
cagcccttgtttctaaagctgc

SEQ ID NO: 9084326 - DNA, 20 bp, Homo sapiens
cagccctttatcctcctatg

SEQ ID NO: 9084327 - DNA, 20 bp, Homo sapiens
cagccctttatcctcctatg

SEQ ID NO: 9084328 - DNA, 22 bp, Homo sapiens
cagccctgttgcgcttccggcg

SEQ ID NO: 9084329 - DNA, 22 bp, Homo sapiens
cagcccttaaatagatatacag

SEQ ID NO: 9084330 - DNA, 22 bp, Homo sapiens
cagcccttaagagtcatccctc

SEQ ID NO: 9084331 - DNA, 22 bp, Homo sapiens
cagcccttaagagtcatccctc

SEQ ID NO: 9084332 - DNA, 22 bp, Homo sapiens
cagcccttccaggcagaattct

SEQ ID NO: 9084333 - DNA, 22 bp, Homo sapiens
cagcccttaagagtcatccctc

SEQ ID NO: 9084334 - DNA, 22 bp, Homo sapiens
cagcccttcagggggctgcagg

SEQ ID NO: 9084335 - DNA, 23 bp, Homo sapiens
cagcccttcctgcatgtttttgt

SEQ ID NO: 9084336 - DNA, 22 bp, Homo sapiens
cagcccttccttctgtttatac

SEQ ID NO: 9084337 - DNA, 20 bp, Homo sapiens
cagcccttgatttacaatcc

SEQ ID NO: 9084338 - DNA, 22 bp, Homo sapiens
cagcccttgcgacaccctggct

SEQ ID NO: 9084339 - DNA, 22 bp, Homo sapiens
cagcccttgcgacaccctggct

SEQ ID NO: 9084340 - DNA, 22 bp, Homo sapiens
cagcccttgatgataatttatc

SEQ ID NO: 9084341 - DNA, 22 bp, Homo sapiens
cagcccttcttccaaccagctt

SEQ ID NO: 9084342 - DNA, 22 bp, Homo sapiens
gtgcatattttgcacacagatg

SEQ ID NO: 9084343 - DNA, 22 bp, Homo sapiens
gtgcatatgtgtgtatacaaac

SEQ ID NO: 9084344 - DNA, 22 bp, Homo sapiens
gtgcatggggagggaagcgctc

SEQ ID NO: 9084345 - DNA, 22 bp, Homo sapiens
gtgcatgtgtctttatagtaga

SEQ ID NO: 9084346 - DNA, 23 bp, Homo sapiens
gtgcatgtgtctttacagtagca

SEQ ID NO: 9084347 - DNA, 22 bp, Homo sapiens
gtgcatgtgtctttatagtagc

SEQ ID NO: 9084348 - DNA, 22 bp, Homo sapiens
gtgcatgttaatggtgtacaaa

SEQ ID NO: 9084349 - DNA, 22 bp, Homo sapiens
gtgcatgtgcatccatgtgtac

SEQ ID NO: 9084350 - DNA, 22 bp, Homo sapiens
gtgcatgtcggggtgcatgtca

SEQ ID NO: 9084351 - DNA, 22 bp, Homo sapiens
gtgcatggtaagatgcttcaca

SEQ ID NO: 9084352 - DNA, 22 bp, Homo sapiens
cagccctgtgctaagcaccctc

SEQ ID NO: 9084353 - DNA, 22 bp, Homo sapiens
cagccctgtgcggagggccctg

SEQ ID NO: 9084354 - DNA, 22 bp, Homo sapiens
gtgctgaggagagggggtggtc

SEQ ID NO: 9084355 - DNA, 22 bp, Homo sapiens
gtgctgagcacaccttggagca

SEQ ID NO: 9084356 - DNA, 22 bp, Homo sapiens
gtgctgagcatcatgaggcact

SEQ ID NO: 9084357 - DNA, 22 bp, Homo sapiens
gtgctgagattggagtgagcag

SEQ ID NO: 9084358 - DNA, 22 bp, Homo sapiens
gtgcctggtatgtaggtagcgg

SEQ ID NO: 9084359 - DNA, 22 bp, Homo sapiens
gtgcctggtttggggaatgttc

SEQ ID NO: 9084360 - DNA, 22 bp, Homo sapiens
gtgcctggtttggggagtgttc

SEQ ID NO: 9084361 - DNA, 22 bp, Homo sapiens
gtgcctggtatgtaggtagcgg

SEQ ID NO: 9084362 - DNA, 22 bp, Homo sapiens
gtgcctggggttgagctatgaa

SEQ ID NO: 9084363 - DNA, 22 bp, Homo sapiens
gtgcctggggttgagctatgaa

SEQ ID NO: 9084364 - DNA, 22 bp, Homo sapiens
gtgcctggggttgagctatgaa

SEQ ID NO: 9084365 - DNA, 22 bp, Homo sapiens
gtgcctgtgcggactcagggaa

SEQ ID NO: 9084366 - DNA, 22 bp, Homo sapiens
gtgcctgtgccaggggtgtgct

SEQ ID NO: 9084367 - DNA, 22 bp, Homo sapiens
gtgcctgtgccaggggtgtgct

SEQ ID NO: 9084368 - DNA, 22 bp, Homo sapiens
cagctccagcccaggcagctcc

SEQ ID NO: 9084369 - DNA, 22 bp, Homo sapiens
cagctccagcccaggcagctcc

SEQ ID NO: 9084370 - DNA, 21 bp, Homo sapiens
cagctccactaaagcagctgt

SEQ ID NO: 9084371 - DNA, 21 bp, Homo sapiens
cagctccactaaagcagctgt

SEQ ID NO: 9084372 - DNA, 22 bp, Homo sapiens
gtgctgaggtgggtgggcagcc

SEQ ID NO: 9084373 - DNA, 22 bp, Homo sapiens
cagctcagcttcctgggtgtgt

SEQ ID NO: 9084374 - DNA, 22 bp, Homo sapiens
gtgctgaggtgggtgggcagcc

SEQ ID NO: 9084375 - DNA, 22 bp, Homo sapiens
cagctccatcttgcttatacca

SEQ ID NO: 9084376 - DNA, 22 bp, Homo sapiens
cagctcccagaactgaccatgt

SEQ ID NO: 9084377 - DNA, 22 bp, Homo sapiens
cagctccagctctgggcgcctc

SEQ ID NO: 9084378 - DNA, 23 bp, Homo sapiens
cagctccagtgcactcaggtagc

SEQ ID NO: 9084379 - DNA, 23 bp, Homo sapiens
cagctccagtgcactcaggtagc

SEQ ID NO: 9084380 - DNA, 22 bp, Homo sapiens
cagctcccctctgtggggcagt

SEQ ID NO: 9084381 - DNA, 22 bp, Homo sapiens
cagctccccatggttcctgaag

SEQ ID NO: 9084382 - DNA, 22 bp, Homo sapiens
cagctcccagtggcagctcctt

SEQ ID NO: 9084383 - DNA, 22 bp, Homo sapiens
cagctcccagaactgaccatgt

SEQ ID NO: 9084384 - DNA, 22 bp, Homo sapiens
cagctcccagagtgaccagcag

SEQ ID NO: 9084385 - DNA, 22 bp, Homo sapiens
cagctcccagagtgaccagcag

SEQ ID NO: 9084386 - DNA, 22 bp, Homo sapiens
cagcagtagtctctgtggcttt

SEQ ID NO: 9084387 - DNA, 22 bp, Homo sapiens
cagcagtacttctcagaggtat

SEQ ID NO: 9084388 - DNA, 22 bp, Homo sapiens
cagcagtaattagtgctgcatg

SEQ ID NO: 9084389 - DNA, 22 bp, Homo sapiens
cagcagtaattagtgctgcatg

SEQ ID NO: 9084390 - DNA, 22 bp, Homo sapiens
cagcagtaactcccgtgcagca

SEQ ID NO: 9084391 - DNA, 22 bp, Homo sapiens
cagcaggttaacagaggctggt

SEQ ID NO: 9084392 - DNA, 22 bp, Homo sapiens
cagcaggtggacacactcacct

SEQ ID NO: 9084393 - DNA, 22 bp, Homo sapiens
cagcaggtgcaggtgcggccgc

SEQ ID NO: 9084394 - DNA, 22 bp, Homo sapiens
cagcaggtgcaggtgcggccgc

SEQ ID NO: 9084395 - DNA, 22 bp, Homo sapiens
cagcagtgacaagactaagaag

SEQ ID NO: 9084396 - DNA, 22 bp, Homo sapiens
cagcagtgatgtgtgagggttc

SEQ ID NO: 9084397 - DNA, 22 bp, Homo sapiens
cagcagtgatgtgtgagggttc

SEQ ID NO: 9084398 - DNA, 22 bp, Homo sapiens
cagcagtgcttcagtgtgagat

SEQ ID NO: 9084399 - DNA, 22 bp, Homo sapiens
cagcagtggaactacccaggga

SEQ ID NO: 9084400 - DNA, 20 bp, Homo sapiens
cagcagtggatgagagtttt

SEQ ID NO: 9084401 - DNA, 20 bp, Homo sapiens
cagcagtggatgagagtttt

SEQ ID NO: 9084402 - DNA, 22 bp, Homo sapiens
cagcagtggccatctgtgtggt

SEQ ID NO: 9084403 - DNA, 22 bp, Homo sapiens
cagcagagctgtgtgggaaggg

SEQ ID NO: 9084404 - DNA, 22 bp, Homo sapiens
cagcagggaagctgtgctgttt

SEQ ID NO: 9084405 - DNA, 22 bp, Homo sapiens
cagcagggttaagtgactcacc

SEQ ID NO: 9084406 - DNA, 22 bp, Homo sapiens
cagcagggaagctgtgctgttt

SEQ ID NO: 9084407 - DNA, 22 bp, Homo sapiens
cagcagggaagctgtgctgttt

SEQ ID NO: 9084408 - DNA, 22 bp, Homo sapiens
cagcaggtatgtttgttcagca

SEQ ID NO: 9084409 - DNA, 22 bp, Homo sapiens
cagcaggtcccactgagggccc

SEQ ID NO: 9084410 - DNA, 22 bp, Homo sapiens
cagcaggtctcagcagctcctt

SEQ ID NO: 9084411 - DNA, 22 bp, Homo sapiens
cagcagagcatttggtaggagg

SEQ ID NO: 9084412 - DNA, 22 bp, Homo sapiens
cagcagagacggtaagcagaac

SEQ ID NO: 9084413 - DNA, 22 bp, Homo sapiens
cagcagagacggtaagcagaac

SEQ ID NO: 9084414 - DNA, 22 bp, Homo sapiens
gtcctctgtgtaggctgcagac

SEQ ID NO: 9084415 - DNA, 22 bp, Homo sapiens
gtcctagtgcctggaagctggg

SEQ ID NO: 9084416 - DNA, 23 bp, Homo sapiens
gtcctagtgcttggtgcccaggc

SEQ ID NO: 9084417 - DNA, 22 bp, Homo sapiens
gtcctaccatgaattcactcca

SEQ ID NO: 9084418 - DNA, 22 bp, Homo sapiens
gtcctaatctcttcttataagg

SEQ ID NO: 9084419 - DNA, 22 bp, Homo sapiens
cagcagtgtacaaggtgtcaga

SEQ ID NO: 9084420 - DNA, 22 bp, Homo sapiens
cagcagtggctgcaggcagctg

SEQ ID NO: 9084421 - DNA, 22 bp, Homo sapiens
cagcagtggctgcaggcagctg

SEQ ID NO: 9084422 - DNA, 22 bp, Homo sapiens
gtcctgaatgcctttaggcaga

SEQ ID NO: 9084423 - DNA, 22 bp, Homo sapiens
gtcctgaatgcctttaggcaga

SEQ ID NO: 9084424 - DNA, 22 bp, Homo sapiens
gtcctgagatgtcacaaggttt

SEQ ID NO: 9084425 - DNA, 22 bp, Homo sapiens
gtcctgagagaggctccttgcc

SEQ ID NO: 9084426 - DNA, 18 bp, Homo sapiens
gtcctgagctctgctgta

SEQ ID NO: 9084427 - DNA, 22 bp, Homo sapiens
gtcctgagccctcagcacagca

SEQ ID NO: 9084428 - DNA, 22 bp, Homo sapiens
gtcctgaggcaggatgggtttc

SEQ ID NO: 9084429 - DNA, 22 bp, Homo sapiens
gtcctgagtcaagtgtgggcag

SEQ ID NO: 9084430 - DNA, 22 bp, Homo sapiens
gtcctgagtcaagtgtgggcag

SEQ ID NO: 9084431 - DNA, 22 bp, Homo sapiens
cagcatctttataaaaagtaaa

SEQ ID NO: 9084432 - DNA, 22 bp, Homo sapiens
cagcatctttctcttctggagt

SEQ ID NO: 9084433 - DNA, 18 bp, Homo sapiens
cagcatcttcattaggcc

SEQ ID NO: 9084434 - DNA, 22 bp, Homo sapiens
cagcatgacagtctgcagcaga

SEQ ID NO: 9084435 - DNA, 20 bp, Homo sapiens
gtctcaagtatctcacagtc

SEQ ID NO: 9084436 - DNA, 22 bp, Homo sapiens
gtctcaaactcctaggctaaag

SEQ ID NO: 9084437 - DNA, 22 bp, Homo sapiens
gtctcacacagagtagattttg

SEQ ID NO: 9084438 - DNA, 22 bp, Homo sapiens
gtcctgtggaaagctagccgct

SEQ ID NO: 9084439 - DNA, 22 bp, Homo sapiens
gtctctgtggtacgtttcatcc

SEQ ID NO: 9084440 - DNA, 22 bp, Homo sapiens
gtctctgggttaagcagtgcat

SEQ ID NO: 9084441 - DNA, 22 bp, Homo sapiens
gtctctggctttatgctggttt

SEQ ID NO: 9084442 - DNA, 22 bp, Homo sapiens
gtctctggctttatgctggttt

SEQ ID NO: 9084443 - DNA, 22 bp, Homo sapiens
gtctctgggtgtgtgatgccaa

SEQ ID NO: 9084444 - DNA, 22 bp, Homo sapiens
gtctcagttactctccctggta

SEQ ID NO: 9084445 - DNA, 22 bp, Homo sapiens
gtctcagtgtcacctccagctg

SEQ ID NO: 9084446 - DNA, 22 bp, Homo sapiens
gtctcagttgtatcacctggtt

SEQ ID NO: 9084447 - DNA, 22 bp, Homo sapiens
gtctcagtttgaagtgatgcca

SEQ ID NO: 9084448 - DNA, 22 bp, Homo sapiens
gtctcagtaagaaaggctcctg

SEQ ID NO: 9084449 - DNA, 22 bp, Homo sapiens
gtctcagtgcccaatgccataa

SEQ ID NO: 9084450 - DNA, 22 bp, Homo sapiens
gtcttaccgcacctcatgaact

SEQ ID NO: 9084451 - DNA, 22 bp, Homo sapiens
gtctttctatgcatagagcaga

SEQ ID NO: 9084452 - DNA, 22 bp, Homo sapiens
gtcttaagaatgaatgctgaga

SEQ ID NO: 9084453 - DNA, 22 bp, Homo sapiens
gtctttcttaattcaagtgctt

SEQ ID NO: 9084454 - DNA, 22 bp, Homo sapiens
gtctttggagaggtgccatttc

SEQ ID NO: 9084455 - DNA, 22 bp, Homo sapiens
gtgaagtcaagaatgcaatttg

SEQ ID NO: 9084456 - DNA, 22 bp, Homo sapiens
gtctttggatgtaagataaagt

SEQ ID NO: 9084457 - DNA, 20 bp, Homo sapiens
gtgcagccaagctgagccgc

SEQ ID NO: 9084458 - DNA, 20 bp, Homo sapiens
gtgcagccaagctgagccgc

SEQ ID NO: 9084459 - DNA, 22 bp, Homo sapiens
gtgcagcctgtcgccagtggat

SEQ ID NO: 9084460 - DNA, 22 bp, Homo sapiens
gtgcagcagggggaagacagtg

SEQ ID NO: 9084461 - DNA, 23 bp, Homo sapiens
gtgcagcagtgtctgcagtcatg

SEQ ID NO: 9084462 - DNA, 16 bp, Homo sapiens
gtgcaaaagtgaggag

SEQ ID NO: 9084463 - DNA, 22 bp, Homo sapiens
gtgcaaacatcatagagtgtac

SEQ ID NO: 9084464 - DNA, 22 bp, Homo sapiens
gtgcagctgccgatcagatagg

SEQ ID NO: 9084465 - DNA, 22 bp, Homo sapiens
gtgcagctcagttgaaatgcag

SEQ ID NO: 9084466 - DNA, 22 bp, Homo sapiens
gtgcagctgcaggagtcaggtc

SEQ ID NO: 9084467 - DNA, 22 bp, Homo sapiens
gtgcaggagcaggagccatgtc

SEQ ID NO: 9084468 - DNA, 22 bp, Homo sapiens
gtgcagcttcctggtctcagcc

SEQ ID NO: 9084469 - DNA, 22 bp, Homo sapiens
gtgaatatgatcttatttggaa

SEQ ID NO: 9084470 - DNA, 22 bp, Homo sapiens
gtgaatattctttgtgcagtat

SEQ ID NO: 9084471 - DNA, 22 bp, Homo sapiens
gtgaatggggcaggaaggatgg

SEQ ID NO: 9084472 - DNA, 22 bp, Homo sapiens
gtgaataatattgtttataaaa

SEQ ID NO: 9084473 - DNA, 22 bp, Homo sapiens
gtgaataactttctatgttaat

SEQ ID NO: 9084474 - DNA, 22 bp, Homo sapiens
gtgaataattttttagtataag

SEQ ID NO: 9084475 - DNA, 22 bp, Homo sapiens
gtgaataatcacccttctggat

SEQ ID NO: 9084476 - DNA, 22 bp, Homo sapiens
gtgaataactttctatgttaat

SEQ ID NO: 9084477 - DNA, 22 bp, Homo sapiens
gtgaagttttagtatatgtaga

SEQ ID NO: 9084478 - DNA, 22 bp, Homo sapiens
gtgaagttttagtatatgtaga

SEQ ID NO: 9084479 - DNA, 22 bp, Homo sapiens
gtgaagttgattgttatcgtca

SEQ ID NO: 9084480 - DNA, 22 bp, Homo sapiens
gtgaagttgattgttatcgtca

SEQ ID NO: 9084481 - DNA, 22 bp, Homo sapiens
gtgcaaaagtaattgtggtttt

SEQ ID NO: 9084482 - DNA, 22 bp, Homo sapiens
gtgcaaaagtcattgtggtttt

SEQ ID NO: 9084483 - DNA, 22 bp, Homo sapiens
gtgcaaaagtaattgcagtttt

SEQ ID NO: 9084484 - DNA, 22 bp, Homo sapiens
gtgcaaaagtaattacagtttt

SEQ ID NO: 9084485 - DNA, 22 bp, Homo sapiens
gtgcaaaagtaatggcagtttt

SEQ ID NO: 9084486 - DNA, 22 bp, Homo sapiens
ggtggcagtggtctctgacaga

SEQ ID NO: 9084487 - DNA, 22 bp, Homo sapiens
ggtggctgcaccctggctaact

SEQ ID NO: 9084488 - DNA, 22 bp, Homo sapiens
ggtggctgcttcctcaagagga

SEQ ID NO: 9084489 - DNA, 22 bp, Homo sapiens
ggtggctggaggagctgatgga

SEQ ID NO: 9084490 - DNA, 22 bp, Homo sapiens
ggtggctggaggagctgatgga

SEQ ID NO: 9084491 - DNA, 22 bp, Homo sapiens
ggtggctgggattagtagccca

SEQ ID NO: 9084492 - DNA, 18 bp, Homo sapiens
ggtggctggggacggaca

SEQ ID NO: 9084493 - DNA, 22 bp, Homo sapiens
ggtggctgggattagtagccca

SEQ ID NO: 9084494 - DNA, 22 bp, Homo sapiens
ggtggctggttttataagaggt

SEQ ID NO: 9084495 - DNA, 22 bp, Homo sapiens
ggtggctgtgagcattatgtga

SEQ ID NO: 9084496 - DNA, 22 bp, Homo sapiens
cagcactatgacatttaattct

SEQ ID NO: 9084497 - DNA, 18 bp, Homo sapiens
ggtgggaagccagggcct

SEQ ID NO: 9084498 - DNA, 22 bp, Homo sapiens
ggtgggaaggccactgaaggtt

SEQ ID NO: 9084499 - DNA, 22 bp, Homo sapiens
cagcactgctgctgtacacaca

SEQ ID NO: 9084500 - DNA, 22 bp, Homo sapiens
cagcactgctgctgtacacaca

SEQ ID NO: 9084501 - DNA, 22 bp, Homo sapiens
cagcagaagcaacattcaggct

SEQ ID NO: 9084502 - DNA, 22 bp, Homo sapiens
cagcagaagcaacattcaggct

SEQ ID NO: 9084503 - DNA, 22 bp, Homo sapiens
ggtgctggttcagggtggctgt

SEQ ID NO: 9084504 - DNA, 22 bp, Homo sapiens
cagatggcaacagctctgtgac

SEQ ID NO: 9084505 - DNA, 22 bp, Homo sapiens
ggtggcagtcttaagagatctt

SEQ ID NO: 9084506 - DNA, 22 bp, Homo sapiens
ggtggcagtcttaagagatctt

SEQ ID NO: 9084507 - DNA, 22 bp, Homo sapiens
ggtggcagtcttaagagatctt

SEQ ID NO: 9084508 - DNA, 22 bp, Homo sapiens
ggtggcagtagcactgggcctg

SEQ ID NO: 9084509 - DNA, 18 bp, Homo sapiens
ggtggcaggtcagatgcc

SEQ ID NO: 9084510 - DNA, 18 bp, Homo sapiens
ggtggcaggtcagatgcc

SEQ ID NO: 9084511 - DNA, 22 bp, Homo sapiens
ggtggcagggagtgtccctggg

SEQ ID NO: 9084512 - DNA, 22 bp, Homo sapiens
ggtggcagggagtgtccctggg

SEQ ID NO: 9084513 - DNA, 22 bp, Homo sapiens
ggtggcagggagtgtccctggg

SEQ ID NO: 9084514 - DNA, 18 bp, Homo sapiens
ggtggcaggtcagatgcc

SEQ ID NO: 9084515 - DNA, 18 bp, Homo sapiens
ggtggcaggtcagatgcc

SEQ ID NO: 9084516 - DNA, 22 bp, Homo sapiens
ggtggcagggagtgtccctggg

SEQ ID NO: 9084517 - DNA, 22 bp, Homo sapiens
gtaacattctagaaacttaaca

SEQ ID NO: 9084518 - DNA, 22 bp, Homo sapiens
gtaacatttacagttcctagag

SEQ ID NO: 9084519 - DNA, 22 bp, Homo sapiens
gtaaacatcagccactctattt

SEQ ID NO: 9084520 - DNA, 22 bp, Homo sapiens
ggtgtgactcgccctcagggac

SEQ ID NO: 9084521 - DNA, 22 bp, Homo sapiens
gtaactttggatttagggtacc

SEQ ID NO: 9084522 - DNA, 22 bp, Homo sapiens
gtaagaaaaccttctttctaat

SEQ ID NO: 9084523 - DNA, 22 bp, Homo sapiens
gtaagcattcattgtctgtata

SEQ ID NO: 9084524 - DNA, 22 bp, Homo sapiens
gtaagcagaggttaatgttaac

SEQ ID NO: 9084525 - DNA, 22 bp, Homo sapiens
gtaaggcaatagtaaggagtcc

SEQ ID NO: 9084526 - DNA, 22 bp, Homo sapiens
gtaagcatctgtctcttctgca

SEQ ID NO: 9084527 - DNA, 20 bp, Homo sapiens
cagcagagacccatggggag

SEQ ID NO: 9084528 - DNA, 22 bp, Homo sapiens
cagcagactggagtaggcagtg

SEQ ID NO: 9084529 - DNA, 22 bp, Homo sapiens
cagcagaagtccgactccagtc

SEQ ID NO: 9084530 - DNA, 22 bp, Homo sapiens
cagcagaagtccgactccagtc

SEQ ID NO: 9084531 - DNA, 21 bp, Homo sapiens
cagcagaagcatctatggaag

SEQ ID NO: 9084532 - DNA, 22 bp, Homo sapiens
ggtgtctgatggtggcttctca

SEQ ID NO: 9084533 - DNA, 22 bp, Homo sapiens
ggtgtctgttgcctcctggtta

SEQ ID NO: 9084534 - DNA, 22 bp, Homo sapiens
ggtgtctgtgatggcatataac

SEQ ID NO: 9084535 - DNA, 15 bp, Homo sapiens
ggtgtctgcagtgtg

SEQ ID NO: 9084536 - DNA, 22 bp, Homo sapiens
ggtgtctgattccaaggccaca

SEQ ID NO: 9084537 - DNA, 22 bp, Homo sapiens
ggtgtctggacagtgagccagg

SEQ ID NO: 9084538 - DNA, 22 bp, Homo sapiens
ggtgtctgcttccctccagctg

SEQ ID NO: 9084539 - DNA, 22 bp, Homo sapiens
ggtgtctgcttccctccagctg

SEQ ID NO: 9084540 - DNA, 22 bp, Homo sapiens
cagataaatagatagataaact

SEQ ID NO: 9084541 - DNA, 22 bp, Homo sapiens
cagataaatagatagataaact

SEQ ID NO: 9084542 - DNA, 22 bp, Homo sapiens
cagataaaggcttactagtagt

SEQ ID NO: 9084543 - DNA, 22 bp, Homo sapiens
cagataaaattaatattaccaa

SEQ ID NO: 9084544 - DNA, 22 bp, Homo sapiens
cagatacaggtttttgttagat

SEQ ID NO: 9084545 - DNA, 22 bp, Homo sapiens
cagatagaatgcaagacctctc

SEQ ID NO: 9084546 - DNA, 22 bp, Homo sapiens
cagatactcaagcttagacttt

SEQ ID NO: 9084547 - DNA, 22 bp, Homo sapiens
cagatactgtaaaatttcagta

SEQ ID NO: 9084548 - DNA, 22 bp, Homo sapiens
cagatagcaaatgggtaagcta

SEQ ID NO: 9084549 - DNA, 22 bp, Homo sapiens
cagatagcaatttgggcagggg

SEQ ID NO: 9084550 - DNA, 22 bp, Homo sapiens
cagatagcgtttgagagcataa

SEQ ID NO: 9084551 - DNA, 22 bp, Homo sapiens
ggtgcagctgcagcctgggagc

SEQ ID NO: 9084552 - DNA, 22 bp, Homo sapiens
ggtgcagctgcagcctgggagc

SEQ ID NO: 9084553 - DNA, 22 bp, Homo sapiens
ggtgcaagtggctagggaccag

SEQ ID NO: 9084554 - DNA, 19 bp, Homo sapiens
ggtgcactgggaatgcagc

SEQ ID NO: 9084555 - DNA, 22 bp, Homo sapiens
cagaggctgatgtgggatgggc

SEQ ID NO: 9084556 - DNA, 21 bp, Homo sapiens
cagaggctgagagggcaatct

SEQ ID NO: 9084557 - DNA, 22 bp, Homo sapiens
cagaggcaggataagaactgcg

SEQ ID NO: 9084558 - DNA, 22 bp, Homo sapiens
cagaggcctttctacagtgata

SEQ ID NO: 9084559 - DNA, 22 bp, Homo sapiens
cagaggcctttctacagtgata

SEQ ID NO: 9084560 - DNA, 22 bp, Homo sapiens
cagaggctgctctgggtggcat

SEQ ID NO: 9084561 - DNA, 22 bp, Homo sapiens
ggggtagggtgattgtgaagta

SEQ ID NO: 9084562 - DNA, 22 bp, Homo sapiens
cagaggctgccagccatgtgca

SEQ ID NO: 9084563 - DNA, 22 bp, Homo sapiens
cagaggctgccagccatgtgca

SEQ ID NO: 9084564 - DNA, 22 bp, Homo sapiens
ggggtgagatcaaggaagccct

SEQ ID NO: 9084565 - DNA, 22 bp, Homo sapiens
ggggtgagctgggcctgtgcct

SEQ ID NO: 9084566 - DNA, 22 bp, Homo sapiens
cagagtgaaaactgagctcaaa

SEQ ID NO: 9084567 - DNA, 22 bp, Homo sapiens
ggggtctgggttgctcggcctt

SEQ ID NO: 9084568 - DNA, 22 bp, Homo sapiens
ggggtctgcgccactgtctgcg

SEQ ID NO: 9084569 - DNA, 22 bp, Homo sapiens
ggggtcctggaggccagctgga

SEQ ID NO: 9084570 - DNA, 22 bp, Homo sapiens
ggggtcctcggagcctgggtct

SEQ ID NO: 9084571 - DNA, 22 bp, Homo sapiens
ggggtcctggaggccagctgga

SEQ ID NO: 9084572 - DNA, 22 bp, Homo sapiens
cagagtttcggtaagcatagaa

SEQ ID NO: 9084573 - DNA, 19 bp, Homo sapiens
cagagtttgcaggcagagg

SEQ ID NO: 9084574 - DNA, 19 bp, Homo sapiens
cagagtttgcaggcagagg

SEQ ID NO: 9084575 - DNA, 22 bp, Homo sapiens
cagagttttatgtatgcatgta

SEQ ID NO: 9084576 - DNA, 22 bp, Homo sapiens
cagagttttatgtatgcatgta

SEQ ID NO: 9084577 - DNA, 22 bp, Homo sapiens
cagagttttgtgaacaacttgg

SEQ ID NO: 9084578 - DNA, 22 bp, Homo sapiens
cagagtggtgcaagggcagtgt

SEQ ID NO: 9084579 - DNA, 22 bp, Homo sapiens
cagagtgggctgtcagccacca

SEQ ID NO: 9084580 - DNA, 22 bp, Homo sapiens
cagaggacctgtgtggccagag

SEQ ID NO: 9084581 - DNA, 22 bp, Homo sapiens
cagaggacatgaaaactcgctc

SEQ ID NO: 9084582 - DNA, 22 bp, Homo sapiens
gggggaggtgaatgcaataagg

SEQ ID NO: 9084583 - DNA, 22 bp, Homo sapiens
cagaggaagcagacacatcttg

SEQ ID NO: 9084584 - DNA, 22 bp, Homo sapiens
cagaggaagctgggtgtggagt

SEQ ID NO: 9084585 - DNA, 22 bp, Homo sapiens
cagaggaagctgggtgtggagt

SEQ ID NO: 9084586 - DNA, 22 bp, Homo sapiens
cagaggaagctgggtgtggagt

SEQ ID NO: 9084587 - DNA, 22 bp, Homo sapiens
cagaggaagttccttgatgaga

SEQ ID NO: 9084588 - DNA, 22 bp, Homo sapiens
cagaggaagttccttgatgaga

SEQ ID NO: 9084589 - DNA, 22 bp, Homo sapiens
cagaggaagggtgctgcgaaag

SEQ ID NO: 9084590 - DNA, 22 bp, Homo sapiens
cagaggaaggctctgggaatgt

SEQ ID NO: 9084591 - DNA, 22 bp, Homo sapiens
cagaggaaggctctgggaatgt

SEQ ID NO: 9084592 - DNA, 22 bp, Homo sapiens
gggggcaggtctggaactttga

SEQ ID NO: 9084593 - DNA, 22 bp, Homo sapiens
gggggaggtgaatgcaataagg

SEQ ID NO: 9084594 - DNA, 22 bp, Homo sapiens
gggggcagtaacctcaaagtgt

SEQ ID NO: 9084595 - DNA, 22 bp, Homo sapiens
cagaggcaggaagatgggcagt

SEQ ID NO: 9084596 - DNA, 22 bp, Homo sapiens
cagaggcagaggtcatctctgg

SEQ ID NO: 9084597 - DNA, 22 bp, Homo sapiens
cagagcttggctgtggttgtga

SEQ ID NO: 9084598 - DNA, 22 bp, Homo sapiens
cagagctttctgtcacattagt

SEQ ID NO: 9084599 - DNA, 22 bp, Homo sapiens
cagagctttgtgtcagggctgt

SEQ ID NO: 9084600 - DNA, 22 bp, Homo sapiens
cagaggaaagtatttctggaag

SEQ ID NO: 9084601 - DNA, 22 bp, Homo sapiens
cagagctttttacattaatgat

SEQ ID NO: 9084602 - DNA, 22 bp, Homo sapiens
cagagcttttagatgttgaaca

SEQ ID NO: 9084603 - DNA, 22 bp, Homo sapiens
cagaggaaatgggaaggagata

SEQ ID NO: 9084604 - DNA, 22 bp, Homo sapiens
cagaggaaatgggaaggagata

SEQ ID NO: 9084605 - DNA, 22 bp, Homo sapiens
cagaggaaatgggaaggagata

SEQ ID NO: 9084606 - DNA, 22 bp, Homo sapiens
cagaggaacgtttggattgatt

SEQ ID NO: 9084607 - DNA, 22 bp, Homo sapiens
cagaggaacgtttggattgatt

SEQ ID NO: 9084608 - DNA, 22 bp, Homo sapiens
cagaggaagagatacaagccct

SEQ ID NO: 9084609 - DNA, 22 bp, Homo sapiens
cagaggaagagatacaagccct

SEQ ID NO: 9084610 - DNA, 22 bp, Homo sapiens
gggctctgcgctcagctccagc

SEQ ID NO: 9084611 - DNA, 22 bp, Homo sapiens
cagagcttctgacagctgctgc

SEQ ID NO: 9084612 - DNA, 22 bp, Homo sapiens
cagagcttcctgctgggcttct

SEQ ID NO: 9084613 - DNA, 22 bp, Homo sapiens
gggctcaggtcagggcatcagc

SEQ ID NO: 9084614 - DNA, 22 bp, Homo sapiens
gggctcagtctgcggcgcgcgg

SEQ ID NO: 9084615 - DNA, 22 bp, Homo sapiens
cagagcagcagagcttccatgg

SEQ ID NO: 9084616 - DNA, 22 bp, Homo sapiens
cagagcagagtgattgttctgg

SEQ ID NO: 9084617 - DNA, 18 bp, Homo sapiens
cagagcagaggtggagcg

SEQ ID NO: 9084618 - DNA, 18 bp, Homo sapiens
cagagcagaggtggagcg

SEQ ID NO: 9084619 - DNA, 18 bp, Homo sapiens
gggccctggcgtccgccc

SEQ ID NO: 9084620 - DNA, 22 bp, Homo sapiens
cagagcaggaatagggtgttga

SEQ ID NO: 9084621 - DNA, 21 bp, Homo sapiens
cagagcagcgttctgctgtgg

SEQ ID NO: 9084622 - DNA, 21 bp, Homo sapiens
cagagcagcgttctgctgtgg

SEQ ID NO: 9084623 - DNA, 22 bp, Homo sapiens
cagagcagcctccagggggagc

SEQ ID NO: 9084624 - DNA, 22 bp, Homo sapiens
cagagcagcctccagggggagc

SEQ ID NO: 9084625 - DNA, 22 bp, Homo sapiens
gggccagctctgtgatgtaggg

SEQ ID NO: 9084626 - DNA, 22 bp, Homo sapiens
gggccctggatttaagcatgga

SEQ ID NO: 9084627 - DNA, 22 bp, Homo sapiens
gggccctggacgtggcggcaga

SEQ ID NO: 9084628 - DNA, 22 bp, Homo sapiens
gggccctggacgtggcggcaga

SEQ ID NO: 9084629 - DNA, 22 bp, Homo sapiens
cagagagagtggggtgtggatt

SEQ ID NO: 9084630 - DNA, 22 bp, Homo sapiens
cagagagagtggggtgtggatt

SEQ ID NO: 9084631 - DNA, 22 bp, Homo sapiens
cagagagagtctgtccctgaag

SEQ ID NO: 9084632 - DNA, 21 bp, Homo sapiens
cagagagctagaacttcatga

SEQ ID NO: 9084633 - DNA, 22 bp, Homo sapiens
cagagagcttagtgtgctgcat

SEQ ID NO: 9084634 - DNA, 22 bp, Homo sapiens
cagaagcaagagccggagctag

SEQ ID NO: 9084635 - DNA, 22 bp, Homo sapiens
cagaagcaagggccaaagtctt

SEQ ID NO: 9084636 - DNA, 22 bp, Homo sapiens
cagaagcaagtagtgattcttt

SEQ ID NO: 9084637 - DNA, 22 bp, Homo sapiens
cagaagagtagctgaacaagtt

SEQ ID NO: 9084638 - DNA, 22 bp, Homo sapiens
cagaagagtagctgaacaagtt

SEQ ID NO: 9084639 - DNA, 22 bp, Homo sapiens
cagaagagtagctgaacaagtt

SEQ ID NO: 9084640 - DNA, 22 bp, Homo sapiens
cagaagcaaatgccttgctgag

SEQ ID NO: 9084641 - DNA, 22 bp, Homo sapiens
cagaagatgctttgtaaaatga

SEQ ID NO: 9084642 - DNA, 22 bp, Homo sapiens
cagaagcaaatgccttgctgag

SEQ ID NO: 9084643 - DNA, 22 bp, Homo sapiens
cagaagcaaatgccttgctgag

SEQ ID NO: 9084644 - DNA, 23 bp, Homo sapiens
cagaagcacctgttgactgctgc

SEQ ID NO: 9084645 - DNA, 23 bp, Homo sapiens
cagaagcacctgttgactgctgc

SEQ ID NO: 9084646 - DNA, 22 bp, Homo sapiens
cagaagcactaggaggaaacgt

SEQ ID NO: 9084647 - DNA, 23 bp, Homo sapiens
cagaagcacctgttgactgctgc

SEQ ID NO: 9084648 - DNA, 22 bp, Homo sapiens
cagaagcagattctaaagcaag

SEQ ID NO: 9084649 - DNA, 22 bp, Homo sapiens
cagaagcagattctaaagcaag

SEQ ID NO: 9084650 - DNA, 22 bp, Homo sapiens
cagaagcagattctaaagcaag

SEQ ID NO: 9084651 - DNA, 22 bp, Homo sapiens
cagaagcagattctaaagcaag

SEQ ID NO: 9084652 - DNA, 22 bp, Homo sapiens
cagaagcactaggaggaaacgt

SEQ ID NO: 9084653 - DNA, 22 bp, Homo sapiens
cagaagcagaacactagattta

SEQ ID NO: 9084654 - DNA, 22 bp, Homo sapiens
cagagacagtttcacagggtct

SEQ ID NO: 9084655 - DNA, 20 bp, Homo sapiens
cagagacctgtcttcacaga

SEQ ID NO: 9084656 - DNA, 22 bp, Homo sapiens
cagagacagtttcacagggtct

SEQ ID NO: 9084657 - DNA, 18 bp, Homo sapiens
cagaagcaggcagtgcag

SEQ ID NO: 9084658 - DNA, 18 bp, Homo sapiens
cagaagcaggcagtgcag

SEQ ID NO: 9084659 - DNA, 18 bp, Homo sapiens
cagaagcaggcagtgcag

SEQ ID NO: 9084660 - DNA, 22 bp, Homo sapiens
cagagagaatcttggcagctga

SEQ ID NO: 9084661 - DNA, 22 bp, Homo sapiens
cagagagaatatgtagtatgga

SEQ ID NO: 9084662 - DNA, 19 bp, Homo sapiens
cagagagaccaaggcgcca

SEQ ID NO: 9084663 - DNA, 19 bp, Homo sapiens
cagagagaccaaggcgcca

SEQ ID NO: 9084664 - DNA, 22 bp, Homo sapiens
cagagagaatcttggcagctga

SEQ ID NO: 9084665 - DNA, 22 bp, Homo sapiens
cagagagaggccactgctatta

SEQ ID NO: 9084666 - DNA, 22 bp, Homo sapiens
cagagagagcaggaaacctccg

SEQ ID NO: 9084667 - DNA, 22 bp, Homo sapiens
cagagagagtctgtccctgaag

SEQ ID NO: 9084668 - DNA, 22 bp, Homo sapiens
cagagagagtcaaatctttgct

SEQ ID NO: 9084669 - DNA, 22 bp, Homo sapiens
cagagagaggtgccgataatgg

SEQ ID NO: 9084670 - DNA, 22 bp, Homo sapiens
cagagagagtcaaatctttgct

SEQ ID NO: 9084671 - DNA, 22 bp, Homo sapiens
cagagagagtcaaatctttgct

SEQ ID NO: 9084672 - DNA, 22 bp, Homo sapiens
cagagagaggggctgcctggcc

SEQ ID NO: 9084673 - DNA, 22 bp, Homo sapiens
cagagagaggtgccgataatgg

SEQ ID NO: 9084674 - DNA, 22 bp, Homo sapiens
cagagagaggccactgctatta

SEQ ID NO: 9084675 - DNA, 22 bp, Homo sapiens
cagagagaggggctgcctggcc

SEQ ID NO: 9084676 - DNA, 22 bp, Homo sapiens
tcctggccttagcgaggcggtc

SEQ ID NO: 9084677 - DNA, 22 bp, Homo sapiens
tcctggcctgtctggagtagct

SEQ ID NO: 9084678 - DNA, 22 bp, Homo sapiens
tcctggccttatccccaaactg

SEQ ID NO: 9084679 - DNA, 22 bp, Homo sapiens
ccacaggggtctctgtagctga

SEQ ID NO: 9084680 - DNA, 20 bp, Homo sapiens
tcctggccttctcgggcagt

SEQ ID NO: 9084681 - DNA, 22 bp, Homo sapiens
tcctggccttgctcctgatgcc

SEQ ID NO: 9084682 - DNA, 22 bp, Homo sapiens
tcctggctagttttgctgaaat

SEQ ID NO: 9084683 - DNA, 22 bp, Homo sapiens
ccaccaggacagccctgagggg

SEQ ID NO: 9084684 - DNA, 22 bp, Homo sapiens
ccacaggctgctgcaggtcccg

SEQ ID NO: 9084685 - DNA, 22 bp, Homo sapiens
ccacaggctgctgcaggtcccg

SEQ ID NO: 9084686 - DNA, 22 bp, Homo sapiens
ccacaggctgctgcaggtcccg

SEQ ID NO: 9084687 - DNA, 22 bp, Homo sapiens
ccacaggcggagtggcgggcag

SEQ ID NO: 9084688 - DNA, 22 bp, Homo sapiens
ccacaggcggagtggcgggcag

SEQ ID NO: 9084689 - DNA, 22 bp, Homo sapiens
ccacaggcggagtggcgggcag

SEQ ID NO: 9084690 - DNA, 22 bp, Homo sapiens
ccacaggctgctgcaggtcccg

SEQ ID NO: 9084691 - DNA, 22 bp, Homo sapiens
tcctggagcttccttcatggta

SEQ ID NO: 9084692 - DNA, 22 bp, Homo sapiens
ccacagctgaccgcaggtgagc

SEQ ID NO: 9084693 - DNA, 22 bp, Homo sapiens
ccacagctgacaatggatagac

SEQ ID NO: 9084694 - DNA, 22 bp, Homo sapiens
tcctgccttgcctgggacatca

SEQ ID NO: 9084695 - DNA, 22 bp, Homo sapiens
tcctgccttgcctgggacatca

SEQ ID NO: 9084696 - DNA, 22 bp, Homo sapiens
tcctgccttcatactgctgtat

SEQ ID NO: 9084697 - DNA, 22 bp, Homo sapiens
tcctgccttcatactgctgtat

SEQ ID NO: 9084698 - DNA, 22 bp, Homo sapiens
ccaagaggttgaggctgcagtg

SEQ ID NO: 9084699 - DNA, 22 bp, Homo sapiens
tcctgccttagagcaaggaaaa

SEQ ID NO: 9084700 - DNA, 19 bp, Homo sapiens
tcctgcccaccagccaggg

SEQ ID NO: 9084701 - DNA, 22 bp, Homo sapiens
ccaagaggtatcttgccataaa

SEQ ID NO: 9084702 - DNA, 22 bp, Homo sapiens
ccaagaggggcagagggctgca

SEQ ID NO: 9084703 - DNA, 22 bp, Homo sapiens
ccaagaggcagaatgcagagaa

SEQ ID NO: 9084704 - DNA, 22 bp, Homo sapiens
ccaagaggggaagggccgcagc

SEQ ID NO: 9084705 - DNA, 21 bp, Homo sapiens
tcctgccttagtccagagcag

SEQ ID NO: 9084706 - DNA, 21 bp, Homo sapiens
tcctgccttagtccagagcag

SEQ ID NO: 9084707 - DNA, 21 bp, Homo sapiens
tcctgccttagtccagagcag

SEQ ID NO: 9084708 - DNA, 22 bp, Homo sapiens
tcctgccttagagcaaggaaaa

SEQ ID NO: 9084709 - DNA, 21 bp, Homo sapiens
tcctgccttagtccagagcag

SEQ ID NO: 9084710 - DNA, 22 bp, Homo sapiens
ccaaattctgtgttcaaactca

SEQ ID NO: 9084711 - DNA, 22 bp, Homo sapiens
ccaaattaaatcatacagacag

SEQ ID NO: 9084712 - DNA, 22 bp, Homo sapiens
tcctgaggtggattgagcagag

SEQ ID NO: 9084713 - DNA, 22 bp, Homo sapiens
tcctgaggtggattgagcagag

SEQ ID NO: 9084714 - DNA, 22 bp, Homo sapiens
tcctgaggtggattgagcagag

SEQ ID NO: 9084715 - DNA, 22 bp, Homo sapiens
tcctgaggtgctcagccaggaa

SEQ ID NO: 9084716 - DNA, 22 bp, Homo sapiens
tcctgaggtatatgctttgcag

SEQ ID NO: 9084717 - DNA, 23 bp, Homo sapiens
tcctgagggtttcccagccttgg

SEQ ID NO: 9084718 - DNA, 23 bp, Homo sapiens
tcctgagggtttcccagccttgg

SEQ ID NO: 9084719 - DNA, 22 bp, Homo sapiens
tcctgagggctgcagtcatagg

SEQ ID NO: 9084720 - DNA, 22 bp, Homo sapiens
ccaacaggttgagagtctgaat

SEQ ID NO: 9084721 - DNA, 22 bp, Homo sapiens
ccaacatttctcggtgctctgt

SEQ ID NO: 9084722 - DNA, 21 bp, Homo sapiens
ccaagactcccatctagtggt

SEQ ID NO: 9084723 - DNA, 21 bp, Homo sapiens
ccaagagcaatgctaaggaga

SEQ ID NO: 9084724 - DNA, 20 bp, Homo sapiens
ccaagagcatgcatgaggaa

SEQ ID NO: 9084725 - DNA, 19 bp, Homo sapiens
cattttctcattgtgcccc

SEQ ID NO: 9084726 - DNA, 22 bp, Homo sapiens
cattttggctattgtaaatagt

SEQ ID NO: 9084727 - DNA, 22 bp, Homo sapiens
cattttggctattgtaaatagt

SEQ ID NO: 9084728 - DNA, 22 bp, Homo sapiens
cattttgtaagtctctcttgtt

SEQ ID NO: 9084729 - DNA, 22 bp, Homo sapiens
cattttgtaagtctctcttgtt

SEQ ID NO: 9084730 - DNA, 22 bp, Homo sapiens
cattttctcaatgaaccctctt

SEQ ID NO: 9084731 - DNA, 22 bp, Homo sapiens
cattttctcaatgaaccctctt

SEQ ID NO: 9084732 - DNA, 22 bp, Homo sapiens
ccaaaaagtacatttaggtgtg

SEQ ID NO: 9084733 - DNA, 22 bp, Homo sapiens
ccaaaaagctcagagatatgtt

SEQ ID NO: 9084734 - DNA, 22 bp, Homo sapiens
tcctgagaaggcacagcttgca

SEQ ID NO: 9084735 - DNA, 22 bp, Homo sapiens
tcctgagggactggttcctcgc

SEQ ID NO: 9084736 - DNA, 22 bp, Homo sapiens
tcctgaggctcactttgaatgt

SEQ ID NO: 9084737 - DNA, 22 bp, Homo sapiens
tcctgagggcgattcagcaggt

SEQ ID NO: 9084738 - DNA, 22 bp, Homo sapiens
tcctgagggcgattcagcaggt

SEQ ID NO: 9084739 - DNA, 22 bp, Homo sapiens
tcctgagggctcggggctcatg

SEQ ID NO: 9084740 - DNA, 22 bp, Homo sapiens
tcctgagggactggttcctcgc

SEQ ID NO: 9084741 - DNA, 22 bp, Homo sapiens
tcctgagggcattttggtgact

SEQ ID NO: 9084742 - DNA, 22 bp, Homo sapiens
cattttcagcacccatctgaaa

SEQ ID NO: 9084743 - DNA, 22 bp, Homo sapiens
cattttatgtttatggagtgct

SEQ ID NO: 9084744 - DNA, 22 bp, Homo sapiens
cattttactgactcttgaatta

SEQ ID NO: 9084745 - DNA, 22 bp, Homo sapiens
cattttacgacatagggcaggc

SEQ ID NO: 9084746 - DNA, 22 bp, Homo sapiens
cattttacctagaagctgaaag

SEQ ID NO: 9084747 - DNA, 22 bp, Homo sapiens
cattttacctagaagctgaaag

SEQ ID NO: 9084748 - DNA, 22 bp, Homo sapiens
cattttaaatgatttaagccaa

SEQ ID NO: 9084749 - DNA, 23 bp, Homo sapiens
catttctaggtgtgtttggccat

SEQ ID NO: 9084750 - DNA, 22 bp, Homo sapiens
catttctagggatcataaagta

SEQ ID NO: 9084751 - DNA, 22 bp, Homo sapiens
catttctagggatcataaagta

SEQ ID NO: 9084752 - DNA, 22 bp, Homo sapiens
catttgtcatcactgagctgcc

SEQ ID NO: 9084753 - DNA, 22 bp, Homo sapiens
catttccacttctgaaaactgg

SEQ ID NO: 9084754 - DNA, 22 bp, Homo sapiens
catttctaagaagatctgggta

SEQ ID NO: 9084755 - DNA, 22 bp, Homo sapiens
catttctagagtcccaagaggt

SEQ ID NO: 9084756 - DNA, 22 bp, Homo sapiens
catttctaccaaatgtgactgg

SEQ ID NO: 9084757 - DNA, 22 bp, Homo sapiens
catttctaccaaatgtgactgg

SEQ ID NO: 9084758 - DNA, 22 bp, Homo sapiens
catttctagacaagtcctggag

SEQ ID NO: 9084759 - DNA, 22 bp, Homo sapiens
catttctacagcttcttcagaa

SEQ ID NO: 9084760 - DNA, 22 bp, Homo sapiens
catttctaagaaggctgcacat

SEQ ID NO: 9084761 - DNA, 21 bp, Homo sapiens
catttctaagcctggctatag

SEQ ID NO: 9084762 - DNA, 22 bp, Homo sapiens
catttcactattcactaaaagg

SEQ ID NO: 9084763 - DNA, 21 bp, Homo sapiens
catttcatgattatagaaatg

SEQ ID NO: 9084764 - DNA, 22 bp, Homo sapiens
tccatactcagaaagtattgca

SEQ ID NO: 9084765 - DNA, 22 bp, Homo sapiens
tccatactaacagcatttatca

SEQ ID NO: 9084766 - DNA, 22 bp, Homo sapiens
tccatacatacagatatgcatt

SEQ ID NO: 9084767 - DNA, 22 bp, Homo sapiens
tccatacatacagatatgcatt

SEQ ID NO: 9084768 - DNA, 22 bp, Homo sapiens
tccatacatatccaaagagaag

SEQ ID NO: 9084769 - DNA, 22 bp, Homo sapiens
catttcaccttagagaattatt

SEQ ID NO: 9084770 - DNA, 22 bp, Homo sapiens
catttcaccttagagaattatt

SEQ ID NO: 9084771 - DNA, 22 bp, Homo sapiens
catttcacgcacactcattact

SEQ ID NO: 9084772 - DNA, 22 bp, Homo sapiens
tccaggtccctggggagatttt

SEQ ID NO: 9084773 - DNA, 22 bp, Homo sapiens
tccaggtcctactggcccatag

SEQ ID NO: 9084774 - DNA, 18 bp, Homo sapiens
tccagttttcccagcatc

SEQ ID NO: 9084775 - DNA, 20 bp, Homo sapiens
tccagttttggagacattct

SEQ ID NO: 9084776 - DNA, 22 bp, Homo sapiens
tccataaaccagaaaatcaaga

SEQ ID NO: 9084777 - DNA, 22 bp, Homo sapiens
tccatacataaaatgtttaatg

SEQ ID NO: 9084778 - DNA, 18 bp, Homo sapiens
tctagaaacccagactct

SEQ ID NO: 9084779 - DNA, 22 bp, Homo sapiens
tctagaaagtttgtactgattt

SEQ ID NO: 9084780 - DNA, 22 bp, Homo sapiens
tctagaaagtactagagctggt

SEQ ID NO: 9084781 - DNA, 22 bp, Homo sapiens
tctagaaagtactagagctggt

SEQ ID NO: 9084782 - DNA, 22 bp, Homo sapiens
tctagaaagtttgtactgattt

SEQ ID NO: 9084783 - DNA, 22 bp, Homo sapiens
tcctgtgttactgcctggagcg

SEQ ID NO: 9084784 - DNA, 22 bp, Homo sapiens
tcctgtgttactgcctggagcg

SEQ ID NO: 9084785 - DNA, 22 bp, Homo sapiens
tcctgttgttcgcctgcgatgg

SEQ ID NO: 9084786 - DNA, 22 bp, Homo sapiens
tcctgttgctgtagtggttaag

SEQ ID NO: 9084787 - DNA, 17 bp, Homo sapiens
tcctgtttatcattgat

SEQ ID NO: 9084788 - DNA, 22 bp, Homo sapiens
tctaatgagggtgaaggcccag

SEQ ID NO: 9084789 - DNA, 22 bp, Homo sapiens
tctaatgaggactttatagaga

SEQ ID NO: 9084790 - DNA, 22 bp, Homo sapiens
tctaatgagttagataattttg

SEQ ID NO: 9084791 - DNA, 23 bp, Homo sapiens
tctaatgcaattagaaattaggg

SEQ ID NO: 9084792 - DNA, 21 bp, Homo sapiens
tctaatgacatcctctgacaa

SEQ ID NO: 9084793 - DNA, 22 bp, Homo sapiens
tcctgtttatctgtgtgactcg

SEQ ID NO: 9084794 - DNA, 22 bp, Homo sapiens
ccaccccaaatgaagacctctc

SEQ ID NO: 9084795 - DNA, 22 bp, Homo sapiens
ccaccccaaatgaagacctctc

SEQ ID NO: 9084796 - DNA, 22 bp, Homo sapiens
ccaccccaaatgaagacctctc

SEQ ID NO: 9084797 - DNA, 19 bp, Homo sapiens
ccacccctttgctgggccc

SEQ ID NO: 9084798 - DNA, 20 bp, Homo sapiens
ccaccctccaggaacacata

SEQ ID NO: 9084799 - DNA, 22 bp, Homo sapiens
ccacccctgggtgcagggagcg

SEQ ID NO: 9084800 - DNA, 22 bp, Homo sapiens
tcctgtgtaaatagatctggtt

SEQ ID NO: 9084801 - DNA, 22 bp, Homo sapiens
tcctgtgtctcagcgtgaagca

SEQ ID NO: 9084802 - DNA, 22 bp, Homo sapiens
tcctgtggtcattcttctgccc

SEQ ID NO: 9084803 - DNA, 22 bp, Homo sapiens
tcctgtggtctggaaggaatgg

SEQ ID NO: 9084804 - DNA, 22 bp, Homo sapiens
tcctgtgtgtggcctttcccag

SEQ ID NO: 9084805 - DNA, 22 bp, Homo sapiens
tcctgtgtgggcaggatgagaa

SEQ ID NO: 9084806 - DNA, 22 bp, Homo sapiens
ccaccctgagccgcaagagcag

SEQ ID NO: 9084807 - DNA, 22 bp, Homo sapiens
tctataaatgcagatatgtgtg

SEQ ID NO: 9084808 - DNA, 22 bp, Homo sapiens
tctatacaagtttcactttgac

SEQ ID NO: 9084809 - DNA, 22 bp, Homo sapiens
tctataatcctatttcaactgc

SEQ ID NO: 9084810 - DNA, 22 bp, Homo sapiens
tctatacacacaaagaatgctt

SEQ ID NO: 9084811 - DNA, 22 bp, Homo sapiens
tctcagagaagtgatgagcaat

SEQ ID NO: 9084812 - DNA, 22 bp, Homo sapiens
tctcagctgcctgccctgctcc

SEQ ID NO: 9084813 - DNA, 22 bp, Homo sapiens
tctcaggaatagagtggcagca

SEQ ID NO: 9084814 - DNA, 22 bp, Homo sapiens
tctcagtgtgttgagaggtctg

SEQ ID NO: 9084815 - DNA, 22 bp, Homo sapiens
tctcagtgtggtgcttaggata

SEQ ID NO: 9084816 - DNA, 22 bp, Homo sapiens
tctcagtggtgttttgagtcca

SEQ ID NO: 9084817 - DNA, 22 bp, Homo sapiens
tctcagtggtgttttgagtcca

SEQ ID NO: 9084818 - DNA, 22 bp, Homo sapiens
tctcagtgggttaaaagagaag

SEQ ID NO: 9084819 - DNA, 22 bp, Homo sapiens
tctcagtggtggcattccagac

SEQ ID NO: 9084820 - DNA, 22 bp, Homo sapiens
tctcagtgggaagggcacagtt

SEQ ID NO: 9084821 - DNA, 22 bp, Homo sapiens
tctcagtggcttcctcactttt

SEQ ID NO: 9084822 - DNA, 22 bp, Homo sapiens
tctcagtgttatctatctgcct

SEQ ID NO: 9084823 - DNA, 22 bp, Homo sapiens
tctcagtgttgttctgcagatg

SEQ ID NO: 9084824 - DNA, 22 bp, Homo sapiens
tctcagtgtgttttctctcaga

SEQ ID NO: 9084825 - DNA, 22 bp, Homo sapiens
tctcagtgttgttctgcagatg

SEQ ID NO: 9084826 - DNA, 22 bp, Homo sapiens
tctcagtgtttaaaaagatttc

SEQ ID NO: 9084827 - DNA, 22 bp, Homo sapiens
ccagagaggccttggcaagaca

SEQ ID NO: 9084828 - DNA, 22 bp, Homo sapiens
tctcagtggatctcagaatttt

SEQ ID NO: 9084829 - DNA, 22 bp, Homo sapiens
tctcaggactcctctggccata

SEQ ID NO: 9084830 - DNA, 22 bp, Homo sapiens
ccagagggcaaaatgaagctta

SEQ ID NO: 9084831 - DNA, 22 bp, Homo sapiens
ccagagggcctttggagttatc

SEQ ID NO: 9084832 - DNA, 22 bp, Homo sapiens
ccagaggggcacaaaagtagaa

SEQ ID NO: 9084833 - DNA, 18 bp, Homo sapiens
ccagagggtgcgtcagct

SEQ ID NO: 9084834 - DNA, 22 bp, Homo sapiens
ccagaggggctgagcaggtcac

SEQ ID NO: 9084835 - DNA, 22 bp, Homo sapiens
ccagaggtctcctgcacgggat

SEQ ID NO: 9084836 - DNA, 22 bp, Homo sapiens
ccagaggtctcctgcacgggat

SEQ ID NO: 9084837 - DNA, 22 bp, Homo sapiens
ccagaggtgaacaggaggctgt

SEQ ID NO: 9084838 - DNA, 22 bp, Homo sapiens
ccagaggtgaacaggaggctgt

SEQ ID NO: 9084839 - DNA, 22 bp, Homo sapiens
ccagaggtgagggggattcttg

SEQ ID NO: 9084840 - DNA, 22 bp, Homo sapiens
tctctgggataaactgggccag

SEQ ID NO: 9084841 - DNA, 22 bp, Homo sapiens
ccagaggtcctgctcactggtg

SEQ ID NO: 9084842 - DNA, 22 bp, Homo sapiens
ccagaggtcctgctcactggtg

SEQ ID NO: 9084843 - DNA, 22 bp, Homo sapiens
ccagaggtcctgtgatgctgca

SEQ ID NO: 9084844 - DNA, 22 bp, Homo sapiens
ccagaggtcctgctcactggtg

SEQ ID NO: 9084845 - DNA, 22 bp, Homo sapiens
ccagatgtccctctcaggtttg

SEQ ID NO: 9084846 - DNA, 22 bp, Homo sapiens
ccagattcatagaaactcatag

SEQ ID NO: 9084847 - DNA, 22 bp, Homo sapiens
ccagattcatagaaactcatag

SEQ ID NO: 9084848 - DNA, 22 bp, Homo sapiens
ccagattcatagaaactcatag

SEQ ID NO: 9084849 - DNA, 20 bp, Homo sapiens
ccagcaccctctcagctgaa

SEQ ID NO: 9084850 - DNA, 20 bp, Homo sapiens
ccagcaccctctcagctgaa

SEQ ID NO: 9084851 - DNA, 22 bp, Homo sapiens
ccagcaagtgcagatggccaag

SEQ ID NO: 9084852 - DNA, 22 bp, Homo sapiens
ccagagcagggcagcagggctc

SEQ ID NO: 9084853 - DNA, 20 bp, Homo sapiens
ccagagcagccactgaagtt

SEQ ID NO: 9084854 - DNA, 20 bp, Homo sapiens
ccagagcagccactgaagtt

SEQ ID NO: 9084855 - DNA, 20 bp, Homo sapiens
ccagagcagccactgaagtt

SEQ ID NO: 9084856 - DNA, 22 bp, Homo sapiens
ccagagcagggcagcagggctc

SEQ ID NO: 9084857 - DNA, 22 bp, Homo sapiens
ccagagcccagcacacggtgct

SEQ ID NO: 9084858 - DNA, 22 bp, Homo sapiens
ccagagcccagcacacggtgct

SEQ ID NO: 9084859 - DNA, 22 bp, Homo sapiens
ccagagccagagaggtgcctgc

SEQ ID NO: 9084860 - DNA, 22 bp, Homo sapiens
ccagagcccagggtcatgcagg

SEQ ID NO: 9084861 - DNA, 22 bp, Homo sapiens
ccagagcccagggtcatgcagg

SEQ ID NO: 9084862 - DNA, 22 bp, Homo sapiens
ccagagcccgggacctggactt

SEQ ID NO: 9084863 - DNA, 22 bp, Homo sapiens
ccagaggctgggttcacctcag

SEQ ID NO: 9084864 - DNA, 22 bp, Homo sapiens
ccagagggaagaggaagcgctg

SEQ ID NO: 9084865 - DNA, 22 bp, Homo sapiens
ccagagggaactgggcctcatt

SEQ ID NO: 9084866 - DNA, 22 bp, Homo sapiens
ccagagcctcgcccggagcctc

SEQ ID NO: 9084867 - DNA, 22 bp, Homo sapiens
ccagagcctcaacacaggtcct

SEQ ID NO: 9084868 - DNA, 22 bp, Homo sapiens
ccagaggagttgaggctttggg

SEQ ID NO: 9084869 - DNA, 21 bp, Homo sapiens
ccagagcctgagaggattatg

SEQ ID NO: 9084870 - DNA, 22 bp, Homo sapiens
ccagagcctcaacacaggtcct

SEQ ID NO: 9084871 - DNA, 22 bp, Homo sapiens
ccagagcctcttatgaagatcg

SEQ ID NO: 9084872 - DNA, 22 bp, Homo sapiens
ccagaggatcagtactggctgg

SEQ ID NO: 9084873 - DNA, 22 bp, Homo sapiens
tccagggcatgctcagactcag

SEQ ID NO: 9084874 - DNA, 23 bp, Homo sapiens
tccagggcagtggctgggtctgc

SEQ ID NO: 9084875 - DNA, 22 bp, Homo sapiens
tccaggtcagacttctgtgccc

SEQ ID NO: 9084876 - DNA, 18 bp, Homo sapiens
tccaggtcccaggggaag

SEQ ID NO: 9084877 - DNA, 22 bp, Homo sapiens
tccaggtcccagactgggcagc

SEQ ID NO: 9084878 - DNA, 22 bp, Homo sapiens
tccaggtcatcttggagagctg

SEQ ID NO: 9084879 - DNA, 22 bp, Homo sapiens
tccagggcagtgactacagcgg

SEQ ID NO: 9084880 - DNA, 22 bp, Homo sapiens
tccagggcaggtgctgggctct

SEQ ID NO: 9084881 - DNA, 22 bp, Homo sapiens
cattacaaccccaaattacaaa

SEQ ID NO: 9084882 - DNA, 22 bp, Homo sapiens
cattacaaccccaaattacaaa

SEQ ID NO: 9084883 - DNA, 19 bp, Homo sapiens
cattacaaatttgtaggga

SEQ ID NO: 9084884 - DNA, 22 bp, Homo sapiens
cattacaaagttataaacagtt

SEQ ID NO: 9084885 - DNA, 22 bp, Homo sapiens
cattacaaagttataaacagtt

SEQ ID NO: 9084886 - DNA, 22 bp, Homo sapiens
cattacaaacatgttaagattt

SEQ ID NO: 9084887 - DNA, 22 bp, Homo sapiens
cattaataaacatttcagaaga

SEQ ID NO: 9084888 - DNA, 22 bp, Homo sapiens
tccaggctttggggcaggagcg

SEQ ID NO: 9084889 - DNA, 22 bp, Homo sapiens
tccaggctttttcatgctgtct

SEQ ID NO: 9084890 - DNA, 22 bp, Homo sapiens
catgtgccccgggtcccttggt

SEQ ID NO: 9084891 - DNA, 23 bp, Homo sapiens
catgtgcctgctgtgtggaagcc

SEQ ID NO: 9084892 - DNA, 22 bp, Homo sapiens
catgtggtattgtgagatccac

SEQ ID NO: 9084893 - DNA, 22 bp, Homo sapiens
catgttttctaggctttcacaa

SEQ ID NO: 9084894 - DNA, 22 bp, Homo sapiens
catgtgtcaaatgatgtagctg

SEQ ID NO: 9084895 - DNA, 22 bp, Homo sapiens
catgttttgtgtacagaatatt

SEQ ID NO: 9084896 - DNA, 22 bp, Homo sapiens
catgtacactcatgtaactata

SEQ ID NO: 9084897 - DNA, 22 bp, Homo sapiens
catgtacactcatgtaactata

SEQ ID NO: 9084898 - DNA, 23 bp, Homo sapiens
catgtacagagtttgataaagtg

SEQ ID NO: 9084899 - DNA, 23 bp, Homo sapiens
catgtacagagtttgataaagtg

SEQ ID NO: 9084900 - DNA, 22 bp, Homo sapiens
catgtacagccagggttgagaa

SEQ ID NO: 9084901 - DNA, 22 bp, Homo sapiens
catgtacagccagggttgagaa

SEQ ID NO: 9084902 - DNA, 23 bp, Homo sapiens
catgtacagagtttgataaagtg

SEQ ID NO: 9084903 - DNA, 23 bp, Homo sapiens
catgtacacacagctgtacagtg

SEQ ID NO: 9084904 - DNA, 23 bp, Homo sapiens
catgtacacacagctgtacagtg

SEQ ID NO: 9084905 - DNA, 22 bp, Homo sapiens
catgtacacacaaagggacaat

SEQ ID NO: 9084906 - DNA, 22 bp, Homo sapiens
catgtacacacaaagggacaat

SEQ ID NO: 9084907 - DNA, 22 bp, Homo sapiens
catgtacaaggatgctcagagt

SEQ ID NO: 9084908 - DNA, 22 bp, Homo sapiens
catgtacaaggatgctcagagt

SEQ ID NO: 9084909 - DNA, 22 bp, Homo sapiens
catgtacaaggatgctcagagt

SEQ ID NO: 9084910 - DNA, 22 bp, Homo sapiens
tccaggctgggctgaagggtgc

SEQ ID NO: 9084911 - DNA, 22 bp, Homo sapiens
catgtacatgcatgggcactgt

SEQ ID NO: 9084912 - DNA, 22 bp, Homo sapiens
catgtacagtttttctgtcctg

SEQ ID NO: 9084913 - DNA, 22 bp, Homo sapiens
catgctcacttttatactgtaa

SEQ ID NO: 9084914 - DNA, 22 bp, Homo sapiens
catgctcacttttatactgtaa

SEQ ID NO: 9084915 - DNA, 22 bp, Homo sapiens
catgctctgcagcagacctgtg

SEQ ID NO: 9084916 - DNA, 22 bp, Homo sapiens
catgctgggtaaaggtggtgaa

SEQ ID NO: 9084917 - DNA, 22 bp, Homo sapiens
catgctgtcctgccagggatgg

SEQ ID NO: 9084918 - DNA, 22 bp, Homo sapiens
catgctggtcagccagtggatg

SEQ ID NO: 9084919 - DNA, 22 bp, Homo sapiens
tccaagatctacagcagtttag

SEQ ID NO: 9084920 - DNA, 22 bp, Homo sapiens
tccaagatggttggtgtggtgg

SEQ ID NO: 9084921 - DNA, 22 bp, Homo sapiens
tccaagagtaagaggactcttt

SEQ ID NO: 9084922 - DNA, 22 bp, Homo sapiens
tccaagatcaaggtgttggcag

SEQ ID NO: 9084923 - DNA, 22 bp, Homo sapiens
tccaagcatgtggtcaggagcc

SEQ ID NO: 9084924 - DNA, 22 bp, Homo sapiens
tccaagcactgttaattaaact

SEQ ID NO: 9084925 - DNA, 18 bp, Homo sapiens
tccagagagggagaagtg

SEQ ID NO: 9084926 - DNA, 17 bp, Homo sapiens
tccagagaggcttccct

SEQ ID NO: 9084927 - DNA, 18 bp, Homo sapiens
tccagagagggagaagtg

SEQ ID NO: 9084928 - DNA, 22 bp, Homo sapiens
tccagaggtgaacacccaggca

SEQ ID NO: 9084929 - DNA, 22 bp, Homo sapiens
tccagaggtgaacacccaggca

SEQ ID NO: 9084930 - DNA, 22 bp, Homo sapiens
tccagagttgtaagtgttgaca

SEQ ID NO: 9084931 - DNA, 22 bp, Homo sapiens
tccagaggtgaacacccaggca

SEQ ID NO: 9084932 - DNA, 22 bp, Homo sapiens
tccagagtacggaagagtcatc

SEQ ID NO: 9084933 - DNA, 22 bp, Homo sapiens
catgcttcatgcaaaattctga

SEQ ID NO: 9084934 - DNA, 22 bp, Homo sapiens
catgctgttgaatatgacattg

SEQ ID NO: 9084935 - DNA, 22 bp, Homo sapiens
tccagcactcgcccagggcttg

SEQ ID NO: 9084936 - DNA, 22 bp, Homo sapiens
tccagcagaaaagaggtaggga

SEQ ID NO: 9084937 - DNA, 22 bp, Homo sapiens
tccagcagaaccagagacctgg

SEQ ID NO: 9084938 - DNA, 22 bp, Homo sapiens
tccagcacagaatttcctagct

SEQ ID NO: 9084939 - DNA, 22 bp, Homo sapiens
tccagcacccaatgtggctaag

SEQ ID NO: 9084940 - DNA, 22 bp, Homo sapiens
tccagcacccaatgtggctaag

SEQ ID NO: 9084941 - DNA, 22 bp, Homo sapiens
tccagcaccaccacagggaaga

SEQ ID NO: 9084942 - DNA, 22 bp, Homo sapiens
catgtacaaaaggcaaatgcct

SEQ ID NO: 9084943 - DNA, 22 bp, Homo sapiens
catgtaaagcatccttctaggg

SEQ ID NO: 9084944 - DNA, 22 bp, Homo sapiens
catgtaatgctgggagctgggc

SEQ ID NO: 9084945 - DNA, 22 bp, Homo sapiens
catgtaaaacactcagaacagt

SEQ ID NO: 9084946 - DNA, 22 bp, Homo sapiens
catgtaaaccattgtgagcatc

SEQ ID NO: 9084947 - DNA, 22 bp, Homo sapiens
catgtaaagaatttcacacaag

SEQ ID NO: 9084948 - DNA, 22 bp, Homo sapiens
catgtaaagcacttcataacag

SEQ ID NO: 9084949 - DNA, 22 bp, Homo sapiens
catgtaaagcacttcataacag

SEQ ID NO: 9084950 - DNA, 22 bp, Homo sapiens
catgtaaaaaattaggtcatct

SEQ ID NO: 9084951 - DNA, 22 bp, Homo sapiens
catgtaaaaagaagaatctgga

SEQ ID NO: 9084952 - DNA, 22 bp, Homo sapiens
catgtaaaaaattaggtcatct

SEQ ID NO: 9084953 - DNA, 22 bp, Homo sapiens
catgtaaaaagaagaatctgga

SEQ ID NO: 9084954 - DNA, 22 bp, Homo sapiens
catgtaaaccattgtgagcatc

SEQ ID NO: 9084955 - DNA, 19 bp, Homo sapiens
catggtgaaaccccgtctc

SEQ ID NO: 9084956 - DNA, 22 bp, Homo sapiens
catggaaagcactcagcccagt

SEQ ID NO: 9084957 - DNA, 22 bp, Homo sapiens
catgggctctctgagctccagg

SEQ ID NO: 9084958 - DNA, 23 bp, Homo sapiens
catggaaaactgaaagctgacct

SEQ ID NO: 9084959 - DNA, 23 bp, Homo sapiens
catggaaaactgaaagctgacct

SEQ ID NO: 9084960 - DNA, 20 bp, Homo sapiens
catggtggaggagcagggcc

SEQ ID NO: 9084961 - DNA, 22 bp, Homo sapiens
catggtttcatgagaattaccc

SEQ ID NO: 9084962 - DNA, 22 bp, Homo sapiens
catggtgaggggtgaagggcag

SEQ ID NO: 9084963 - DNA, 22 bp, Homo sapiens
catctaaatttgactccaagga

SEQ ID NO: 9084964 - DNA, 22 bp, Homo sapiens
tcagtgtgtctctgcatttggg

SEQ ID NO: 9084965 - DNA, 22 bp, Homo sapiens
tcagtgtgtagtaaattgtagg

SEQ ID NO: 9084966 - DNA, 22 bp, Homo sapiens
catccctgtctgccactctgaa

SEQ ID NO: 9084967 - DNA, 22 bp, Homo sapiens
catccctgtcgtcaagtctctg

SEQ ID NO: 9084968 - DNA, 22 bp, Homo sapiens
catctaaatttgactccaagga

SEQ ID NO: 9084969 - DNA, 22 bp, Homo sapiens
catctaatacctcatttaatct

SEQ ID NO: 9084970 - DNA, 22 bp, Homo sapiens
catctacaggagaatgtcactg

SEQ ID NO: 9084971 - DNA, 22 bp, Homo sapiens
tcataagattgaaacttggaag

SEQ ID NO: 9084972 - DNA, 22 bp, Homo sapiens
tcataagctagctgcaccatat

SEQ ID NO: 9084973 - DNA, 22 bp, Homo sapiens
tcatacataaataagagtttag

SEQ ID NO: 9084974 - DNA, 20 bp, Homo sapiens
tcatcagataggttagtaca

SEQ ID NO: 9084975 - DNA, 22 bp, Homo sapiens
tcatcagaggcatctggcaagg

SEQ ID NO: 9084976 - DNA, 20 bp, Homo sapiens
tcatacacatgagcatgcag

SEQ ID NO: 9084977 - DNA, 22 bp, Homo sapiens
tcatacaactaagagtttcaga

SEQ ID NO: 9084978 - DNA, 22 bp, Homo sapiens
catcagagtggtggcctggtgt

SEQ ID NO: 9084979 - DNA, 22 bp, Homo sapiens
catcagagtggtggcctggtgt

SEQ ID NO: 9084980 - DNA, 22 bp, Homo sapiens
catcagcaggcaacactcttgg

SEQ ID NO: 9084981 - DNA, 22 bp, Homo sapiens
catcagtgtggcagttcactgt

SEQ ID NO: 9084982 - DNA, 22 bp, Homo sapiens
catcagtgttgatccaccagca

SEQ ID NO: 9084983 - DNA, 22 bp, Homo sapiens
catcagtgagccccttgatgag

SEQ ID NO: 9084984 - DNA, 22 bp, Homo sapiens
catcagtcccacggagcagccc

SEQ ID NO: 9084985 - DNA, 22 bp, Homo sapiens
tcagtgtgcacatggtagcagt

SEQ ID NO: 9084986 - DNA, 23 bp, Homo sapiens
tcagtgtgcaagaatggagaagc

SEQ ID NO: 9084987 - DNA, 23 bp, Homo sapiens
tcagtgtgcaagaatggagaagc

SEQ ID NO: 9084988 - DNA, 22 bp, Homo sapiens
tcagtgtggaaaatcctttggc

SEQ ID NO: 9084989 - DNA, 22 bp, Homo sapiens
tcagtgtgtacactgagcattt

SEQ ID NO: 9084990 - DNA, 22 bp, Homo sapiens
tcagtgtgtaattctttgtttc

SEQ ID NO: 9084991 - DNA, 22 bp, Homo sapiens
tcagtgtgaggggctgggtcct

SEQ ID NO: 9084992 - DNA, 22 bp, Homo sapiens
tcagtgtgaggtcttccacccg

SEQ ID NO: 9084993 - DNA, 19 bp, Homo sapiens
tcagtgtgacttggtcagt

SEQ ID NO: 9084994 - DNA, 22 bp, Homo sapiens
tcagtgtcttgacctgggtgtg

SEQ ID NO: 9084995 - DNA, 22 bp, Homo sapiens
tcagtgtcttgggcttgaatgc

SEQ ID NO: 9084996 - DNA, 22 bp, Homo sapiens
tcagtgtgaattcattttagat

SEQ ID NO: 9084997 - DNA, 22 bp, Homo sapiens
catcataaaattgagataactg

SEQ ID NO: 9084998 - DNA, 22 bp, Homo sapiens
catcagtttggtcaatgatggg

SEQ ID NO: 9084999 - DNA, 22 bp, Homo sapiens
tcagtgtcttgacctgggtgtg

SEQ ID NO: 9085000 - DNA, 22 bp, Homo sapiens
tcagtgtcttctctttcctacc

SEQ ID NO: 9085001 - DNA, 22 bp, Homo sapiens
catcaaagttgatatccaatta

SEQ ID NO: 9085002 - DNA, 22 bp, Homo sapiens
catcaaatctgacttttcttcc

SEQ ID NO: 9085003 - DNA, 22 bp, Homo sapiens
catcaaatggcaagtgaaagct

SEQ ID NO: 9085004 - DNA, 22 bp, Homo sapiens
catcaaatggcaagtgaaagct

SEQ ID NO: 9085005 - DNA, 22 bp, Homo sapiens
catcaaattatgtgtcaaagca

SEQ ID NO: 9085006 - DNA, 22 bp, Homo sapiens
catcaaagcttttttctgtgtt

SEQ ID NO: 9085007 - DNA, 22 bp, Homo sapiens
catcaaagggcctgtggtgcag

SEQ ID NO: 9085008 - DNA, 22 bp, Homo sapiens
tcaggcagaggatggggagcgt

SEQ ID NO: 9085009 - DNA, 22 bp, Homo sapiens
tcaggcagagggagaagccaag

SEQ ID NO: 9085010 - DNA, 19 bp, Homo sapiens
catatttttgggctggcat

SEQ ID NO: 9085011 - DNA, 22 bp, Homo sapiens
tcaggcagaggatggggagcgt

SEQ ID NO: 9085012 - DNA, 22 bp, Homo sapiens
tcaggcagagggagaagccaag

SEQ ID NO: 9085013 - DNA, 22 bp, Homo sapiens
catatgttgacatttaaacctc

SEQ ID NO: 9085014 - DNA, 22 bp, Homo sapiens
tcaggcagaattatcaaaagat

SEQ ID NO: 9085015 - DNA, 22 bp, Homo sapiens
tcaggcagaattatcaaaagat

SEQ ID NO: 9085016 - DNA, 22 bp, Homo sapiens
tcaggcagaccaccgtgggcag

SEQ ID NO: 9085017 - DNA, 22 bp, Homo sapiens
tcaggcagaccaccgtgggcag

SEQ ID NO: 9085018 - DNA, 22 bp, Homo sapiens
tcaggcagagctgtggagctct

SEQ ID NO: 9085019 - DNA, 22 bp, Homo sapiens
tcaggcagagctgtggagctct

SEQ ID NO: 9085020 - DNA, 22 bp, Homo sapiens
catcaagatggaagagcaaata

SEQ ID NO: 9085021 - DNA, 22 bp, Homo sapiens
catcaagagtcttactatcagt

SEQ ID NO: 9085022 - DNA, 22 bp, Homo sapiens
tcaggctgatttcttttgaggg

SEQ ID NO: 9085023 - DNA, 22 bp, Homo sapiens
tcaggctgcagctgtcagcagc

SEQ ID NO: 9085024 - DNA, 22 bp, Homo sapiens
tcaggctgcagtggcaaaagac

SEQ ID NO: 9085025 - DNA, 18 bp, Homo sapiens
tcaggctgccctgtgtct

SEQ ID NO: 9085026 - DNA, 22 bp, Homo sapiens
tcaggctgcccgttcagggctc

SEQ ID NO: 9085027 - DNA, 22 bp, Homo sapiens
tcaggctgcccgttcagggctc

SEQ ID NO: 9085028 - DNA, 22 bp, Homo sapiens
tcaggctgcatctgtaagggtg

SEQ ID NO: 9085029 - DNA, 22 bp, Homo sapiens
tcaggctgcctatcagactgtg

SEQ ID NO: 9085030 - DNA, 22 bp, Homo sapiens
tcaggctgcctatcagactgtg

SEQ ID NO: 9085031 - DNA, 22 bp, Homo sapiens
tcaggctgcctatcagactgtg

SEQ ID NO: 9085032 - DNA, 21 bp, Homo sapiens
catcacattactcaaagtcct

SEQ ID NO: 9085033 - DNA, 21 bp, Homo sapiens
catcacattactcaaagtcct

SEQ ID NO: 9085034 - DNA, 22 bp, Homo sapiens
catcacattagtctcaagagaa

SEQ ID NO: 9085035 - DNA, 22 bp, Homo sapiens
catcagagtcagagctctttct

SEQ ID NO: 9085036 - DNA, 22 bp, Homo sapiens
catcagagtcagagctctttct

SEQ ID NO: 9085037 - DNA, 22 bp, Homo sapiens
cagtgtcctcagccagcagcta

SEQ ID NO: 9085038 - DNA, 22 bp, Homo sapiens
cagtgtcctcagccagcagcta

SEQ ID NO: 9085039 - DNA, 22 bp, Homo sapiens
cagtgtcaccaggcgagtctcc

SEQ ID NO: 9085040 - DNA, 22 bp, Homo sapiens
cagtggtttctgaacagtgtgc

SEQ ID NO: 9085041 - DNA, 22 bp, Homo sapiens
tcacttagatggggatcatcac

SEQ ID NO: 9085042 - DNA, 22 bp, Homo sapiens
tcaggaggcggtgctgcctttg

SEQ ID NO: 9085043 - DNA, 21 bp, Homo sapiens
tcaggaggctcagactcctgc

SEQ ID NO: 9085044 - DNA, 22 bp, Homo sapiens
tcaggcagaaaaatcactaatt

SEQ ID NO: 9085045 - DNA, 22 bp, Homo sapiens
tcaggaggcctgagtagctcta

SEQ ID NO: 9085046 - DNA, 22 bp, Homo sapiens
tcaggaggcctgagtagctcta

SEQ ID NO: 9085047 - DNA, 22 bp, Homo sapiens
caggccaagtcccaagtgcggg

SEQ ID NO: 9085048 - DNA, 22 bp, Homo sapiens
caggccaatatcacatgctatg

SEQ ID NO: 9085049 - DNA, 22 bp, Homo sapiens
caggccaatatcacatgctatg

SEQ ID NO: 9085050 - DNA, 22 bp, Homo sapiens
caggccccattcctcttgggac

SEQ ID NO: 9085051 - DNA, 22 bp, Homo sapiens
caggccctgcacagtggtcctg

SEQ ID NO: 9085052 - DNA, 22 bp, Homo sapiens
caggccctgcactaggccctgg

SEQ ID NO: 9085053 - DNA, 22 bp, Homo sapiens
caggccctgcactaggccctgg

SEQ ID NO: 9085054 - DNA, 22 bp, Homo sapiens
caggccctgcactaggccctgg

SEQ ID NO: 9085055 - DNA, 22 bp, Homo sapiens
caggccctcgtggtgagctggg

SEQ ID NO: 9085056 - DNA, 22 bp, Homo sapiens
caggccctcgcccgcagcgacc

SEQ ID NO: 9085057 - DNA, 22 bp, Homo sapiens
caggccctcgcccgcagcgacc

SEQ ID NO: 9085058 - DNA, 22 bp, Homo sapiens
caggccctcctgtgatctgcct

SEQ ID NO: 9085059 - DNA, 22 bp, Homo sapiens
caggccctcaggcaagggctct

SEQ ID NO: 9085060 - DNA, 22 bp, Homo sapiens
tacactttatggatcctacttt

SEQ ID NO: 9085061 - DNA, 22 bp, Homo sapiens
tacagaccagtagttctcagcg

SEQ ID NO: 9085062 - DNA, 22 bp, Homo sapiens
tacagacatttactccactcct

SEQ ID NO: 9085063 - DNA, 22 bp, Homo sapiens
tacagacattcaattttgaccc

SEQ ID NO: 9085064 - DNA, 22 bp, Homo sapiens
tacagacattcaattttgaccc

SEQ ID NO: 9085065 - DNA, 22 bp, Homo sapiens
caggccctgccttggcatgtgt

SEQ ID NO: 9085066 - DNA, 20 bp, Homo sapiens
gtggagaggctggcgggact

SEQ ID NO: 9085067 - DNA, 22 bp, Homo sapiens
gtggagcaggactagctgagaa

SEQ ID NO: 9085068 - DNA, 23 bp, Homo sapiens
gtggagccacatcacaggctcct

SEQ ID NO: 9085069 - DNA, 22 bp, Homo sapiens
gtggagcaggactagctgagaa

SEQ ID NO: 9085070 - DNA, 22 bp, Homo sapiens
gtggagcatgtgaggactgagt

SEQ ID NO: 9085071 - DNA, 22 bp, Homo sapiens
cagctctgcctctggggctgag

SEQ ID NO: 9085072 - DNA, 22 bp, Homo sapiens
cagctctgctgggaggatgcag

SEQ ID NO: 9085073 - DNA, 22 bp, Homo sapiens
cagctctgccatcatctgcctt

SEQ ID NO: 9085074 - DNA, 22 bp, Homo sapiens
cagctctgccacttcctagcta

SEQ ID NO: 9085075 - DNA, 22 bp, Homo sapiens
tacacagggagagattggaaac

SEQ ID NO: 9085076 - DNA, 22 bp, Homo sapiens
tacacagggtatggcttgagga

SEQ ID NO: 9085077 - DNA, 22 bp, Homo sapiens
tacacaggggagcatggttgac

SEQ ID NO: 9085078 - DNA, 22 bp, Homo sapiens
tacacaggggagcatggttgac

SEQ ID NO: 9085079 - DNA, 22 bp, Homo sapiens
tacacagggaaaggtctcagag

SEQ ID NO: 9085080 - DNA, 22 bp, Homo sapiens
tacacaggctgcctctttgcat

SEQ ID NO: 9085081 - DNA, 22 bp, Homo sapiens
caggccaaaattcaggcattct

SEQ ID NO: 9085082 - DNA, 22 bp, Homo sapiens
caggccaaagatcccattgaca

SEQ ID NO: 9085083 - DNA, 22 bp, Homo sapiens
caggccaagcctccccagctcc

SEQ ID NO: 9085084 - DNA, 22 bp, Homo sapiens
caggccaagcctccccagctcc

SEQ ID NO: 9085085 - DNA, 22 bp, Homo sapiens
caggccaataaatgtgatggcc

SEQ ID NO: 9085086 - DNA, 22 bp, Homo sapiens
tacacagactcttcaattcaga

SEQ ID NO: 9085087 - DNA, 22 bp, Homo sapiens
tacacagatatgtgatcaatca

SEQ ID NO: 9085088 - DNA, 22 bp, Homo sapiens
tacacagatatgtgatcaatca

SEQ ID NO: 9085089 - DNA, 22 bp, Homo sapiens
tacacagaggctgatgtcttag

SEQ ID NO: 9085090 - DNA, 22 bp, Homo sapiens
tacacagaggctgatgtcttag

SEQ ID NO: 9085091 - DNA, 22 bp, Homo sapiens
tacagttatatgtgataagtaa

SEQ ID NO: 9085092 - DNA, 22 bp, Homo sapiens
tacagttcctctcgtggaggtg

SEQ ID NO: 9085093 - DNA, 22 bp, Homo sapiens
tacagttccaggatcatagggt

SEQ ID NO: 9085094 - DNA, 22 bp, Homo sapiens
tacagtttcccagcagatgcaa

SEQ ID NO: 9085095 - DNA, 22 bp, Homo sapiens
tacagtttctgtccttgtggag

SEQ ID NO: 9085096 - DNA, 22 bp, Homo sapiens
tacagtttagaaccatagatgg

SEQ ID NO: 9085097 - DNA, 22 bp, Homo sapiens
caggctcccgaaatcacccatg

SEQ ID NO: 9085098 - DNA, 22 bp, Homo sapiens
caggctcccaccctcctgcagc

SEQ ID NO: 9085099 - DNA, 22 bp, Homo sapiens
caggctccactgtaggcagctc

SEQ ID NO: 9085100 - DNA, 22 bp, Homo sapiens
caggctcaatggccacttgggc

SEQ ID NO: 9085101 - DNA, 22 bp, Homo sapiens
caggctcaaggctgacttccat

SEQ ID NO: 9085102 - DNA, 22 bp, Homo sapiens
caggctccttcccagggatggt

SEQ ID NO: 9085103 - DNA, 22 bp, Homo sapiens
caggctccttcccagggatggt

SEQ ID NO: 9085104 - DNA, 22 bp, Homo sapiens
caggctccttcccagggatggt

SEQ ID NO: 9085105 - DNA, 22 bp, Homo sapiens
caggctctaggttagtaggaga

SEQ ID NO: 9085106 - DNA, 22 bp, Homo sapiens
caggctgaggcagtagggtttg

SEQ ID NO: 9085107 - DNA, 22 bp, Homo sapiens
caggctccttatcttacaactt

SEQ ID NO: 9085108 - DNA, 17 bp, Homo sapiens
caggctccttccagatt

SEQ ID NO: 9085109 - DNA, 20 bp, Homo sapiens
caggctccgcaggactaggg

SEQ ID NO: 9085110 - DNA, 22 bp, Homo sapiens
caggctcccgctccactgggca

SEQ ID NO: 9085111 - DNA, 22 bp, Homo sapiens
caggctccctaagtcagcagcc

SEQ ID NO: 9085112 - DNA, 22 bp, Homo sapiens
caggctccctgggcagtggcag

SEQ ID NO: 9085113 - DNA, 22 bp, Homo sapiens
caggcctgtctgcacatgaggc

SEQ ID NO: 9085114 - DNA, 22 bp, Homo sapiens
caggcctgtctgcacatgaggc

SEQ ID NO: 9085115 - DNA, 22 bp, Homo sapiens
caggcctggagtgcaatggcac

SEQ ID NO: 9085116 - DNA, 22 bp, Homo sapiens
tacagctgagtttaggtacagg

SEQ ID NO: 9085117 - DNA, 22 bp, Homo sapiens
caggcctgtgagttgaggcccc

SEQ ID NO: 9085118 - DNA, 22 bp, Homo sapiens
caggccttaaggactcggagaa

SEQ ID NO: 9085119 - DNA, 22 bp, Homo sapiens
caggccttgcgtcccatggcct

SEQ ID NO: 9085120 - DNA, 22 bp, Homo sapiens
caggccttgcgtcccatggcct

SEQ ID NO: 9085121 - DNA, 22 bp, Homo sapiens
caggccttgggacccagactgg

SEQ ID NO: 9085122 - DNA, 22 bp, Homo sapiens
caggccttgggacacccttcac

SEQ ID NO: 9085123 - DNA, 22 bp, Homo sapiens
caggccttgggacacccttcac

SEQ ID NO: 9085124 - DNA, 22 bp, Homo sapiens
caggccttgagttttgggcttt

SEQ ID NO: 9085125 - DNA, 22 bp, Homo sapiens
caggccttgcagtctgttgtaa

SEQ ID NO: 9085126 - DNA, 22 bp, Homo sapiens
caggccttgggagagggtagat

SEQ ID NO: 9085127 - DNA, 22 bp, Homo sapiens
caggccttgggacccagactgg

SEQ ID NO: 9085128 - DNA, 22 bp, Homo sapiens
caggccttgggagagggtagat

SEQ ID NO: 9085129 - DNA, 22 bp, Homo sapiens
caggccttgaaggcctgcggga

SEQ ID NO: 9085130 - DNA, 22 bp, Homo sapiens
caggccttgaaggcctgcggga

SEQ ID NO: 9085131 - DNA, 22 bp, Homo sapiens
caggccttgagttttgggcttt

SEQ ID NO: 9085132 - DNA, 22 bp, Homo sapiens
caggccttgaaggcctgcggga

SEQ ID NO: 9085133 - DNA, 17 bp, Homo sapiens
caggccttgagccttta

SEQ ID NO: 9085134 - DNA, 17 bp, Homo sapiens
caggccttgagccttta

SEQ ID NO: 9085135 - DNA, 22 bp, Homo sapiens
caggccttagtaggtgctccct

SEQ ID NO: 9085136 - DNA, 22 bp, Homo sapiens
caggccttagtaggtgctccct

SEQ ID NO: 9085137 - DNA, 22 bp, Homo sapiens
caggccttaaggactcggagaa

SEQ ID NO: 9085138 - DNA, 22 bp, Homo sapiens
caggccttatctccaccctgca

SEQ ID NO: 9085139 - DNA, 22 bp, Homo sapiens
caggccttatctccaccctgca

SEQ ID NO: 9085140 - DNA, 20 bp, Homo sapiens
caggccttcaggatggctgg

SEQ ID NO: 9085141 - DNA, 20 bp, Homo sapiens
caggccttcaggatggctgg

SEQ ID NO: 9085142 - DNA, 22 bp, Homo sapiens
caggccttctccctccctcaac

SEQ ID NO: 9085143 - DNA, 22 bp, Homo sapiens
caggccttctccctccctcaac

SEQ ID NO: 9085144 - DNA, 22 bp, Homo sapiens
tacagagaggtgacccttgggc

SEQ ID NO: 9085145 - DNA, 22 bp, Homo sapiens
tacagcagggcgctgtgatgaa

SEQ ID NO: 9085146 - DNA, 22 bp, Homo sapiens
tacagcatatacagaatgaaca

SEQ ID NO: 9085147 - DNA, 22 bp, Homo sapiens
tacagagagataagtgtaaaag

SEQ ID NO: 9085148 - DNA, 22 bp, Homo sapiens
tacagcctcgaactcctgcatt

SEQ ID NO: 9085149 - DNA, 20 bp, Homo sapiens
tacagcccctgcttctgttg

SEQ ID NO: 9085150 - DNA, 22 bp, Homo sapiens
tacagcccaagaagtttatacg

SEQ ID NO: 9085151 - DNA, 22 bp, Homo sapiens
tacagcatgtccttagcaaggc

SEQ ID NO: 9085152 - DNA, 22 bp, Homo sapiens
tacagcattgcattttcctttg

SEQ ID NO: 9085153 - DNA, 22 bp, Homo sapiens
tacagcgaaaatttagcttgat

SEQ ID NO: 9085154 - DNA, 23 bp, Homo sapiens
cagggaggagatactgtgtatct

SEQ ID NO: 9085155 - DNA, 23 bp, Homo sapiens
cagggaggagatactgtgtatct

SEQ ID NO: 9085156 - DNA, 22 bp, Homo sapiens
cagggaggatgggctgttttgc

SEQ ID NO: 9085157 - DNA, 22 bp, Homo sapiens
cagggaggatgggctgttttgc

SEQ ID NO: 9085158 - DNA, 22 bp, Homo sapiens
cagggaggctgtcttatgcctg

SEQ ID NO: 9085159 - DNA, 22 bp, Homo sapiens
cagggagctttgtcttctcatt

SEQ ID NO: 9085160 - DNA, 22 bp, Homo sapiens
cagggagctttcccaggaccct

SEQ ID NO: 9085161 - DNA, 22 bp, Homo sapiens
cagggagcctgaatgttccagg

SEQ ID NO: 9085162 - DNA, 22 bp, Homo sapiens
cagggagggaggaaaatttgct

SEQ ID NO: 9085163 - DNA, 22 bp, Homo sapiens
cagggagggaggaaaatttgct

SEQ ID NO: 9085164 - DNA, 22 bp, Homo sapiens
cagggaggctgtcttatgcctg

SEQ ID NO: 9085165 - DNA, 22 bp, Homo sapiens
cagggagggacaattgtcacct

SEQ ID NO: 9085166 - DNA, 22 bp, Homo sapiens
cagggagggacaattgtcacct

SEQ ID NO: 9085167 - DNA, 22 bp, Homo sapiens
cagggatgaccagagggatgtg

SEQ ID NO: 9085168 - DNA, 22 bp, Homo sapiens
tagcacaaagagtctttcagag

SEQ ID NO: 9085169 - DNA, 22 bp, Homo sapiens
cagggatggcctggcgggccac

SEQ ID NO: 9085170 - DNA, 22 bp, Homo sapiens
tagcagcaattcaggtgtgatg

SEQ ID NO: 9085171 - DNA, 22 bp, Homo sapiens
tagcagcaattcaggtgtgatg

SEQ ID NO: 9085172 - DNA, 22 bp, Homo sapiens
tagcagcaagaatgggatgtgt

SEQ ID NO: 9085173 - DNA, 22 bp, Homo sapiens
tagcagcaatttcagaagtttg

SEQ ID NO: 9085174 - DNA, 22 bp, Homo sapiens
tagcagcaatttcagaagtttg

SEQ ID NO: 9085175 - DNA, 22 bp, Homo sapiens
tagcagcacaaatggactatga

SEQ ID NO: 9085176 - DNA, 22 bp, Homo sapiens
tagcagcacagaaagcctggag

SEQ ID NO: 9085177 - DNA, 22 bp, Homo sapiens
tagcagcacagaaagcctggag

SEQ ID NO: 9085178 - DNA, 22 bp, Homo sapiens
tagcagcacagaaagcctggag

SEQ ID NO: 9085179 - DNA, 22 bp, Homo sapiens
cagggatgagcagatggagcaa

SEQ ID NO: 9085180 - DNA, 22 bp, Homo sapiens
cagggatgctgcttaggcagtt

SEQ ID NO: 9085181 - DNA, 22 bp, Homo sapiens
tagcagtgtgcaaaatctttaa

SEQ ID NO: 9085182 - DNA, 22 bp, Homo sapiens
tagcagtggttcctacgtgttg

SEQ ID NO: 9085183 - DNA, 22 bp, Homo sapiens
tagcagtgtctaggtaggccat

SEQ ID NO: 9085184 - DNA, 22 bp, Homo sapiens
tagcagttaatctgagccaaga

SEQ ID NO: 9085185 - DNA, 22 bp, Homo sapiens
tagcagtgttgccgttggctgc

SEQ ID NO: 9085186 - DNA, 22 bp, Homo sapiens
tagcataacaggtaagagtgag

SEQ ID NO: 9085187 - DNA, 22 bp, Homo sapiens
tagcataacaggtaagagtgag

SEQ ID NO: 9085188 - DNA, 22 bp, Homo sapiens
tagcagcactatttgttgtagt

SEQ ID NO: 9085189 - DNA, 22 bp, Homo sapiens
tagcagcacctttctaatctga

SEQ ID NO: 9085190 - DNA, 18 bp, Homo sapiens
tagcagcactggccgctt

SEQ ID NO: 9085191 - DNA, 18 bp, Homo sapiens
tagcagcactggccgctt

SEQ ID NO: 9085192 - DNA, 22 bp, Homo sapiens
tagcatctgtactgacataatc

SEQ ID NO: 9085193 - DNA, 22 bp, Homo sapiens
tagcatctcaacctcctgaaag

SEQ ID NO: 9085194 - DNA, 22 bp, Homo sapiens
tagcatcatgatcagaactgtt

SEQ ID NO: 9085195 - DNA, 22 bp, Homo sapiens
tagcatatggagggtaagaggg

SEQ ID NO: 9085196 - DNA, 22 bp, Homo sapiens
tagcatcagccacaccttgtac

SEQ ID NO: 9085197 - DNA, 22 bp, Homo sapiens
tagcataggaaagtactgggaa

SEQ ID NO: 9085198 - DNA, 22 bp, Homo sapiens
cagggcagtttgtgcctatgag

SEQ ID NO: 9085199 - DNA, 22 bp, Homo sapiens
cagggcagtgaagaacacacgt

SEQ ID NO: 9085200 - DNA, 22 bp, Homo sapiens
cagggcagtttgtgcctatgag

SEQ ID NO: 9085201 - DNA, 22 bp, Homo sapiens
tagcatggtctggaattctcag

SEQ ID NO: 9085202 - DNA, 22 bp, Homo sapiens
cagggcagtaccgccctctggc

SEQ ID NO: 9085203 - DNA, 22 bp, Homo sapiens
tagaaagcagaaaccatcagag

SEQ ID NO: 9085204 - DNA, 22 bp, Homo sapiens
tagaaagcaaaatcctaccaag

SEQ ID NO: 9085205 - DNA, 22 bp, Homo sapiens
tagaaagactgtccagatttca

SEQ ID NO: 9085206 - DNA, 22 bp, Homo sapiens
tagaaagagcatagtattataa

SEQ ID NO: 9085207 - DNA, 22 bp, Homo sapiens
tacctagaccagttacaatgca

SEQ ID NO: 9085208 - DNA, 22 bp, Homo sapiens
tacctataggtacaattacaag

SEQ ID NO: 9085209 - DNA, 22 bp, Homo sapiens
tacctcaagttccaggaaagcg

SEQ ID NO: 9085210 - DNA, 22 bp, Homo sapiens
tagaaacaagggagaggattct

SEQ ID NO: 9085211 - DNA, 22 bp, Homo sapiens
caggctgcagaggcctttcatg

SEQ ID NO: 9085212 - DNA, 22 bp, Homo sapiens
caggctgattaggcctcgtcca

SEQ ID NO: 9085213 - DNA, 22 bp, Homo sapiens
caggctgattaggcctcgtcca

SEQ ID NO: 9085214 - DNA, 22 bp, Homo sapiens
caggctgcagaggcctttcatg

SEQ ID NO: 9085215 - DNA, 22 bp, Homo sapiens
caggctgcagcagcagtggccc

SEQ ID NO: 9085216 - DNA, 22 bp, Homo sapiens
caggctgatcagggctgggatg

SEQ ID NO: 9085217 - DNA, 22 bp, Homo sapiens
caggctgatcagggctgggatg

SEQ ID NO: 9085218 - DNA, 22 bp, Homo sapiens
caggctgaggcagtagggtttg

SEQ ID NO: 9085219 - DNA, 22 bp, Homo sapiens
caggctgagggttaggccttag

SEQ ID NO: 9085220 - DNA, 22 bp, Homo sapiens
caggctgagggttaggccttag

SEQ ID NO: 9085221 - DNA, 22 bp, Homo sapiens
caggctgaggcagtagggtttg

SEQ ID NO: 9085222 - DNA, 22 bp, Homo sapiens
caggctgatagggtccaaagtt

SEQ ID NO: 9085223 - DNA, 22 bp, Homo sapiens
caggctgagggttaggccttag

SEQ ID NO: 9085224 - DNA, 22 bp, Homo sapiens
tacccagtgccaccctctgagg

SEQ ID NO: 9085225 - DNA, 22 bp, Homo sapiens
tacctacagatgtaaatgaaac

SEQ ID NO: 9085226 - DNA, 22 bp, Homo sapiens
taccccaagagtgtctgccatg

SEQ ID NO: 9085227 - DNA, 22 bp, Homo sapiens
tacccagttccacacactgatg

SEQ ID NO: 9085228 - DNA, 22 bp, Homo sapiens
tacccaggagaaacagcagggc

SEQ ID NO: 9085229 - DNA, 22 bp, Homo sapiens
tagacattaggtaggttcatgg

SEQ ID NO: 9085230 - DNA, 22 bp, Homo sapiens
tagacatttgaatgtgaaatga

SEQ ID NO: 9085231 - DNA, 22 bp, Homo sapiens
tagacatttggagttttatgac

SEQ ID NO: 9085232 - DNA, 22 bp, Homo sapiens
tagacatttggcatggttttca

SEQ ID NO: 9085233 - DNA, 22 bp, Homo sapiens
tagacatttggcatggttttca

SEQ ID NO: 9085234 - DNA, 22 bp, Homo sapiens
tagacatttgtcaagaatgact

SEQ ID NO: 9085235 - DNA, 22 bp, Homo sapiens
tagacattatgtattaagttct

SEQ ID NO: 9085236 - DNA, 22 bp, Homo sapiens
tagacattggccattcctgtgg

SEQ ID NO: 9085237 - DNA, 22 bp, Homo sapiens
cagggagaggcctctgttgccc

SEQ ID NO: 9085238 - DNA, 22 bp, Homo sapiens
cagggagaggctggtggagtaa

SEQ ID NO: 9085239 - DNA, 22 bp, Homo sapiens
cagggagaggcatcatagggaa

SEQ ID NO: 9085240 - DNA, 22 bp, Homo sapiens
cagggagaggctggtggagtaa

SEQ ID NO: 9085241 - DNA, 22 bp, Homo sapiens
cagggagatcttggctcctggt

SEQ ID NO: 9085242 - DNA, 22 bp, Homo sapiens
cagggagaagtctggtcagtcc

SEQ ID NO: 9085243 - DNA, 22 bp, Homo sapiens
cagggagaggcctctgttgccc

SEQ ID NO: 9085244 - DNA, 22 bp, Homo sapiens
tagaaatgttagatgtattgag

SEQ ID NO: 9085245 - DNA, 22 bp, Homo sapiens
tagaaatgttggtattaacatt

SEQ ID NO: 9085246 - DNA, 22 bp, Homo sapiens
tagaaatgtaggcttcctgaca

SEQ ID NO: 9085247 - DNA, 22 bp, Homo sapiens
tagaaatgtgataatagcttaa

SEQ ID NO: 9085248 - DNA, 22 bp, Homo sapiens
tagaaatgtgataatagcttaa

SEQ ID NO: 9085249 - DNA, 22 bp, Homo sapiens
tagaaatgtaggcttcctgaca

SEQ ID NO: 9085250 - DNA, 22 bp, Homo sapiens
tagaaagcagtatctccatttt

SEQ ID NO: 9085251 - DNA, 22 bp, Homo sapiens
cagggagaaatctccaggaggt

SEQ ID NO: 9085252 - DNA, 22 bp, Homo sapiens
tagaacagagggttgcccagat

SEQ ID NO: 9085253 - DNA, 22 bp, Homo sapiens
tagaacagagttccagtgatca

SEQ ID NO: 9085254 - DNA, 22 bp, Homo sapiens
tagaacagagttccagtgatca

SEQ ID NO: 9085255 - DNA, 22 bp, Homo sapiens
tagaacagcatttggctattaa

SEQ ID NO: 9085256 - DNA, 22 bp, Homo sapiens
cagtgcatagatcctgaggcct

SEQ ID NO: 9085257 - DNA, 22 bp, Homo sapiens
cagtgcagtttcccagatgctg

SEQ ID NO: 9085258 - DNA, 22 bp, Homo sapiens
cagtgcaggtggcagaggacag

SEQ ID NO: 9085259 - DNA, 22 bp, Homo sapiens
cagtgcagaggccagggaggat

SEQ ID NO: 9085260 - DNA, 22 bp, Homo sapiens
cagtgcagaggtgcaagcatgt

SEQ ID NO: 9085261 - DNA, 22 bp, Homo sapiens
cagtgcaggtttagggctgggg

SEQ ID NO: 9085262 - DNA, 22 bp, Homo sapiens
cagtgcagtcaaggaagaacca

SEQ ID NO: 9085263 - DNA, 22 bp, Homo sapiens
cagtgcagttggtggcaggggt

SEQ ID NO: 9085264 - DNA, 22 bp, Homo sapiens
cagtgcagttggtggcaggggt

SEQ ID NO: 9085265 - DNA, 22 bp, Homo sapiens
tcacacttagagcgaattgttt

SEQ ID NO: 9085266 - DNA, 22 bp, Homo sapiens
tcacactaagacaaaataattt

SEQ ID NO: 9085267 - DNA, 22 bp, Homo sapiens
tcacacctgtaatcccaggcct

SEQ ID NO: 9085268 - DNA, 22 bp, Homo sapiens
tcacactgtgaagagacaagca

SEQ ID NO: 9085269 - DNA, 22 bp, Homo sapiens
cagtggatgtctcatagtgtga

SEQ ID NO: 9085270 - DNA, 22 bp, Homo sapiens
tcactgcactccagcctgggtg

SEQ ID NO: 9085271 - DNA, 22 bp, Homo sapiens
tcactgcactccagcctgggca

SEQ ID NO: 9085272 - DNA, 22 bp, Homo sapiens
tcactgcagcctctgcctcccg

SEQ ID NO: 9085273 - DNA, 22 bp, Homo sapiens
tcactgcagacaacctcagtca

SEQ ID NO: 9085274 - DNA, 22 bp, Homo sapiens
tcactgcacttcagcttgggca

SEQ ID NO: 9085275 - DNA, 22 bp, Homo sapiens
tcactgcagagacctctagtca

SEQ ID NO: 9085276 - DNA, 22 bp, Homo sapiens
cagtggcacccacgggctgggc

SEQ ID NO: 9085277 - DNA, 22 bp, Homo sapiens
cagtggcagagaacagagacct

SEQ ID NO: 9085278 - DNA, 22 bp, Homo sapiens
cagtggcagagaacagagacct

SEQ ID NO: 9085279 - DNA, 22 bp, Homo sapiens
cagtggttgcttgcatggctcc

SEQ ID NO: 9085280 - DNA, 22 bp, Homo sapiens
cagtgggtgatgagtcctgggg

SEQ ID NO: 9085281 - DNA, 22 bp, Homo sapiens
cagtgggtgaaagatggctaag

SEQ ID NO: 9085282 - DNA, 22 bp, Homo sapiens
cagtgggtcctgcgtctgccag

SEQ ID NO: 9085283 - DNA, 22 bp, Homo sapiens
tcacatgtcagtcttaaacaga

SEQ ID NO: 9085284 - DNA, 18 bp, Homo sapiens
tcacattataatgtaaca

SEQ ID NO: 9085285 - DNA, 22 bp, Homo sapiens
tcacattctagaatgttatcgt

SEQ ID NO: 9085286 - DNA, 19 bp, Homo sapiens
tcacattcagccttgctga

SEQ ID NO: 9085287 - DNA, 22 bp, Homo sapiens
tcactgcaatctctgccttcca

SEQ ID NO: 9085288 - DNA, 22 bp, Homo sapiens
tcactgcaatctcagcctcctg

SEQ ID NO: 9085289 - DNA, 22 bp, Homo sapiens
tcactgcaaggaggcttctcaa

SEQ ID NO: 9085290 - DNA, 22 bp, Homo sapiens
tcactgcaagctcctcctcctg

SEQ ID NO: 9085291 - DNA, 22 bp, Homo sapiens
tcactgcaagctctgccttccg

SEQ ID NO: 9085292 - DNA, 22 bp, Homo sapiens
tcactgcaacctctgcctcttg

SEQ ID NO: 9085293 - DNA, 22 bp, Homo sapiens
tcactgcaacctctgcctgcca

SEQ ID NO: 9085294 - DNA, 22 bp, Homo sapiens
tcactgcaacctctgccttccg

SEQ ID NO: 9085295 - DNA, 22 bp, Homo sapiens
tcactgcaagctcagcctcccg

SEQ ID NO: 9085296 - DNA, 22 bp, Homo sapiens
tcactgcaagctccacctcccg

SEQ ID NO: 9085297 - DNA, 22 bp, Homo sapiens
tcactgcaacctctgcctcccg

SEQ ID NO: 9085298 - DNA, 22 bp, Homo sapiens
tcactgcaacctccgcctgctg

SEQ ID NO: 9085299 - DNA, 22 bp, Homo sapiens
tcactctctaagcatgacagac

SEQ ID NO: 9085300 - DNA, 22 bp, Homo sapiens
tcactctgaatggtactgagga

SEQ ID NO: 9085301 - DNA, 22 bp, Homo sapiens
cagtctggctcagcacaaaggg

SEQ ID NO: 9085302 - DNA, 22 bp, Homo sapiens
cagtctggcacagcacactgaa

SEQ ID NO: 9085303 - DNA, 22 bp, Homo sapiens
cagtctggaggtcagctggctt

SEQ ID NO: 9085304 - DNA, 22 bp, Homo sapiens
cagtccctagtggagctcacag

SEQ ID NO: 9085305 - DNA, 22 bp, Homo sapiens
cagtcccatctcccaggtggct

SEQ ID NO: 9085306 - DNA, 22 bp, Homo sapiens
cagtcccagggttggttcagct

SEQ ID NO: 9085307 - DNA, 22 bp, Homo sapiens
cagtcccagggttggttcagct

SEQ ID NO: 9085308 - DNA, 22 bp, Homo sapiens
cagtcccagctgctcagaaggc

SEQ ID NO: 9085309 - DNA, 22 bp, Homo sapiens
cagtcccagctgctcagaaggc

SEQ ID NO: 9085310 - DNA, 22 bp, Homo sapiens
tcaaattcagtgtgacaacatt

SEQ ID NO: 9085311 - DNA, 22 bp, Homo sapiens
tcaaattagtggaataataatg

SEQ ID NO: 9085312 - DNA, 22 bp, Homo sapiens
tcaaattttaacatgcattaga

SEQ ID NO: 9085313 - DNA, 22 bp, Homo sapiens
tcaaattgtcatcttgataatg

SEQ ID NO: 9085314 - DNA, 22 bp, Homo sapiens
tcaaattagtggaataataatg

SEQ ID NO: 9085315 - DNA, 22 bp, Homo sapiens
tcaaattagtggaataataatg

SEQ ID NO: 9085316 - DNA, 22 bp, Homo sapiens
tcaaatgggtatgctttataat

SEQ ID NO: 9085317 - DNA, 22 bp, Homo sapiens
tcaaatgcttctactcctaaga

SEQ ID NO: 9085318 - DNA, 22 bp, Homo sapiens
tcaaatgctctttgcagagagg

SEQ ID NO: 9085319 - DNA, 22 bp, Homo sapiens
tcaaatgctgcctttgtgtgcc

SEQ ID NO: 9085320 - DNA, 22 bp, Homo sapiens
tcaaatgctgcctttgtgtgcc

SEQ ID NO: 9085321 - DNA, 19 bp, Homo sapiens
tcaaatgccaatgtcacag

SEQ ID NO: 9085322 - DNA, 22 bp, Homo sapiens
cagtcttgctttactgagatgg

SEQ ID NO: 9085323 - DNA, 22 bp, Homo sapiens
tattcccactcctcagcaattt

SEQ ID NO: 9085324 - DNA, 22 bp, Homo sapiens
tattccaacttcactattgtct

SEQ ID NO: 9085325 - DNA, 22 bp, Homo sapiens
tattccaagtcactgtgtcctg

SEQ ID NO: 9085326 - DNA, 22 bp, Homo sapiens
cagtagacacattaatatggaa

SEQ ID NO: 9085327 - DNA, 22 bp, Homo sapiens
cagtacttttctggctttctac

SEQ ID NO: 9085328 - DNA, 22 bp, Homo sapiens
cagtacttgtcctcaggtgtta

SEQ ID NO: 9085329 - DNA, 22 bp, Homo sapiens
cagtacttggggggttctaagt

SEQ ID NO: 9085330 - DNA, 22 bp, Homo sapiens
cagtacttggtcaaggaagcag

SEQ ID NO: 9085331 - DNA, 22 bp, Homo sapiens
cagtactttgaagatattttag

SEQ ID NO: 9085332 - DNA, 22 bp, Homo sapiens
cagtacttttcaaccagtatga

SEQ ID NO: 9085333 - DNA, 22 bp, Homo sapiens
cagtactttgcatcattccact

SEQ ID NO: 9085334 - DNA, 22 bp, Homo sapiens
tattccaactgtcatagtcata

SEQ ID NO: 9085335 - DNA, 23 bp, Homo sapiens
tcaaaggaggcatcgttctgcag

SEQ ID NO: 9085336 - DNA, 22 bp, Homo sapiens
tcaaaggagacacaaggagaaa

SEQ ID NO: 9085337 - DNA, 22 bp, Homo sapiens
tcaaaggataactgagggcagt

SEQ ID NO: 9085338 - DNA, 22 bp, Homo sapiens
tcaaaggagtttaagttactgg

SEQ ID NO: 9085339 - DNA, 22 bp, Homo sapiens
tcaaaggaaacgtggtcctggc

SEQ ID NO: 9085340 - DNA, 22 bp, Homo sapiens
tcaaaggaaacacaagcttctg

SEQ ID NO: 9085341 - DNA, 22 bp, Homo sapiens
tcaaaggaaacacaagcttctg

SEQ ID NO: 9085342 - DNA, 22 bp, Homo sapiens
tcaaaggagacacaaggagaaa

SEQ ID NO: 9085343 - DNA, 22 bp, Homo sapiens
tcaaaggaatttgattttgatg

SEQ ID NO: 9085344 - DNA, 22 bp, Homo sapiens
tcaaaggaatttgattttgatg

SEQ ID NO: 9085345 - DNA, 22 bp, Homo sapiens
tcaaagcagcacattcgcaagc

SEQ ID NO: 9085346 - DNA, 22 bp, Homo sapiens
tcaaagcatcagtcaatttagg

SEQ ID NO: 9085347 - DNA, 22 bp, Homo sapiens
tcaaagcagcacattcgcaagc

SEQ ID NO: 9085348 - DNA, 22 bp, Homo sapiens
tcaaagcatggttttgaaagac

SEQ ID NO: 9085349 - DNA, 22 bp, Homo sapiens
tcaaagcctgtggatagtttgg

SEQ ID NO: 9085350 - DNA, 22 bp, Homo sapiens
tcaaagcatcagtcaatttagg

SEQ ID NO: 9085351 - DNA, 22 bp, Homo sapiens
tcaaagcatggttttgaaagac

SEQ ID NO: 9085352 - DNA, 22 bp, Homo sapiens
tcaaagcatggttttgaaagac

SEQ ID NO: 9085353 - DNA, 22 bp, Homo sapiens
tcaaagcacacttagtggtaga

SEQ ID NO: 9085354 - DNA, 22 bp, Homo sapiens
tcaaagcacacttagtggtaga

SEQ ID NO: 9085355 - DNA, 22 bp, Homo sapiens
tcaaagcaatttcaccagtgcc

SEQ ID NO: 9085356 - DNA, 22 bp, Homo sapiens
tcaaagcaatttcaccagtgcc

SEQ ID NO: 9085357 - DNA, 21 bp, Homo sapiens
tcaaagcacatatttgcacat

SEQ ID NO: 9085358 - DNA, 22 bp, Homo sapiens
tcaaagcagcacattcgcaagc

SEQ ID NO: 9085359 - DNA, 22 bp, Homo sapiens
tcaaagcactggggaaagcctg

SEQ ID NO: 9085360 - DNA, 22 bp, Homo sapiens
tcaaagcactggggaaagcctg

SEQ ID NO: 9085361 - DNA, 22 bp, Homo sapiens
tcaaagcactggggaaagcctg

SEQ ID NO: 9085362 - DNA, 20 bp, Homo sapiens
tcaaagcactgcctgtcatc

SEQ ID NO: 9085363 - DNA, 20 bp, Homo sapiens
tcaaagcactgcctgtcatc

SEQ ID NO: 9085364 - DNA, 22 bp, Homo sapiens
tcaaaactcattttggaagtaa

SEQ ID NO: 9085365 - DNA, 19 bp, Homo sapiens
tcaaagcaagcatgttctg

SEQ ID NO: 9085366 - DNA, 19 bp, Homo sapiens
tcaaagcaagcatgttctg

SEQ ID NO: 9085367 - DNA, 22 bp, Homo sapiens
tcaaaagaaacaccatgttcct

SEQ ID NO: 9085368 - DNA, 22 bp, Homo sapiens
tattccctgatgtacactggca

SEQ ID NO: 9085369 - DNA, 22 bp, Homo sapiens
tatattgtaggtgctatttgaa

SEQ ID NO: 9085370 - DNA, 22 bp, Homo sapiens
tatattctttcaccttcttcct

SEQ ID NO: 9085371 - DNA, 22 bp, Homo sapiens
tatattgaccagtacaattggt

SEQ ID NO: 9085372 - DNA, 22 bp, Homo sapiens
tatattctattgtacctctcct

SEQ ID NO: 9085373 - DNA, 22 bp, Homo sapiens
tatattcattttaaagccatct

SEQ ID NO: 9085374 - DNA, 22 bp, Homo sapiens
tatattcttaccagtgtatgta

SEQ ID NO: 9085375 - DNA, 22 bp, Homo sapiens
tatattctgattccatctgtgt

SEQ ID NO: 9085376 - DNA, 22 bp, Homo sapiens
tatgaagatatatctgatctct

SEQ ID NO: 9085377 - DNA, 22 bp, Homo sapiens
tatgatatgcactttatcagaa

SEQ ID NO: 9085378 - DNA, 22 bp, Homo sapiens
tatgaagatatatctgatctct

SEQ ID NO: 9085379 - DNA, 22 bp, Homo sapiens
tatgatttgtagacatttgatt

SEQ ID NO: 9085380 - DNA, 22 bp, Homo sapiens
tatgcaaacagttcaggtgaca

SEQ ID NO: 9085381 - DNA, 22 bp, Homo sapiens
tatgcaaactaagttgtttcct

SEQ ID NO: 9085382 - DNA, 22 bp, Homo sapiens
tatgcaaagccacccagggacg

SEQ ID NO: 9085383 - DNA, 22 bp, Homo sapiens
tatgcaaatcattagatttcct

SEQ ID NO: 9085384 - DNA, 22 bp, Homo sapiens
tatgcaaatcattagatttcct

SEQ ID NO: 9085385 - DNA, 22 bp, Homo sapiens
tatgcaattctcttaatattct

SEQ ID NO: 9085386 - DNA, 22 bp, Homo sapiens
caggtggcttattagggtcagt

SEQ ID NO: 9085387 - DNA, 22 bp, Homo sapiens
caggtgggctgcctctccagct

SEQ ID NO: 9085388 - DNA, 22 bp, Homo sapiens
caggtggggcagctgtgggagc

SEQ ID NO: 9085389 - DNA, 22 bp, Homo sapiens
tatgtacatcgttgaattcaaa

SEQ ID NO: 9085390 - DNA, 22 bp, Homo sapiens
tatgtacatcgttgaattcaaa

SEQ ID NO: 9085391 - DNA, 22 bp, Homo sapiens
tatgtacatcgttgaattcaaa

SEQ ID NO: 9085392 - DNA, 22 bp, Homo sapiens
caggtggggggcttccgagcct

SEQ ID NO: 9085393 - DNA, 22 bp, Homo sapiens
cagtactgcttgtgggagcaga

SEQ ID NO: 9085394 - DNA, 22 bp, Homo sapiens
cagtactgcttgtgggagcaga

SEQ ID NO: 9085395 - DNA, 22 bp, Homo sapiens
cagtactcccagaacaaaccct

SEQ ID NO: 9085396 - DNA, 22 bp, Homo sapiens
cagtactcttatttgaaatatg

SEQ ID NO: 9085397 - DNA, 22 bp, Homo sapiens
cagtacatttcatatgattcta

SEQ ID NO: 9085398 - DNA, 22 bp, Homo sapiens
cagtacataatgcgcaaaaccg

SEQ ID NO: 9085399 - DNA, 22 bp, Homo sapiens
cagtacttcttggaaactggat

SEQ ID NO: 9085400 - DNA, 22 bp, Homo sapiens
cagtacttatttctatttaggg

SEQ ID NO: 9085401 - DNA, 22 bp, Homo sapiens
cagtacttgggaatgctgggga

SEQ ID NO: 9085402 - DNA, 22 bp, Homo sapiens
cagtacttagttctcatggttt

SEQ ID NO: 9085403 - DNA, 23 bp, Homo sapiens
cagtacttagtgtagcgttaatt

SEQ ID NO: 9085404 - DNA, 22 bp, Homo sapiens
cagtacttaacttataggagag

SEQ ID NO: 9085405 - DNA, 22 bp, Homo sapiens
cagtaaaagatggaaatagaat

SEQ ID NO: 9085406 - DNA, 22 bp, Homo sapiens
cagtaatgggcaagacaatatg

SEQ ID NO: 9085407 - DNA, 22 bp, Homo sapiens
cagtaattccaagtgcttatac

SEQ ID NO: 9085408 - DNA, 22 bp, Homo sapiens
cagtacaattttacaaaggacg

SEQ ID NO: 9085409 - DNA, 22 bp, Homo sapiens
tatgtacatgatttcatttgct

SEQ ID NO: 9085410 - DNA, 22 bp, Homo sapiens
tatgtacatgatttcatttgct

SEQ ID NO: 9085411 - DNA, 22 bp, Homo sapiens
tatgtacatcttgagcaatgaa

SEQ ID NO: 9085412 - DNA, 22 bp, Homo sapiens
tatgtacatggagagcaattga

SEQ ID NO: 9085413 - DNA, 22 bp, Homo sapiens
tatgtacatggagagcaattga

SEQ ID NO: 9085414 - DNA, 22 bp, Homo sapiens
tatgtacatggagagcaattga

SEQ ID NO: 9085415 - DNA, 22 bp, Homo sapiens
cagtaaaaatgttgtcaaggca

SEQ ID NO: 9085416 - DNA, 22 bp, Homo sapiens
cagtaaaagatggaaatagaat

SEQ ID NO: 9085417 - DNA, 22 bp, Homo sapiens
cagggctggatcctccagactc

SEQ ID NO: 9085418 - DNA, 22 bp, Homo sapiens
tagtgattgctgatattccatt

SEQ ID NO: 9085419 - DNA, 23 bp, Homo sapiens
tagtgattggaaaaactagtttt

SEQ ID NO: 9085420 - DNA, 22 bp, Homo sapiens
tagtgattttcatattacatta

SEQ ID NO: 9085421 - DNA, 22 bp, Homo sapiens
tagtgtctagtgagtttgatgc

SEQ ID NO: 9085422 - DNA, 22 bp, Homo sapiens
cagggctgctggccgtgccctc

SEQ ID NO: 9085423 - DNA, 22 bp, Homo sapiens
tagtacagaaaacctcagggtc

SEQ ID NO: 9085424 - DNA, 22 bp, Homo sapiens
tagtaacaacaactagcatttt

SEQ ID NO: 9085425 - DNA, 22 bp, Homo sapiens
tagtaatcagaggtaaacttta

SEQ ID NO: 9085426 - DNA, 22 bp, Homo sapiens
tagtaagttctcgcattgttat

SEQ ID NO: 9085427 - DNA, 22 bp, Homo sapiens
tagtaagtagctaatatttact

SEQ ID NO: 9085428 - DNA, 22 bp, Homo sapiens
tagtaaagtgtcttaacacata

SEQ ID NO: 9085429 - DNA, 22 bp, Homo sapiens
tagtaaatctcagaaaaagatc

SEQ ID NO: 9085430 - DNA, 22 bp, Homo sapiens
tagtaaatctcagaaaaagatc

SEQ ID NO: 9085431 - DNA, 22 bp, Homo sapiens
cagggccaagctgcagcatctg

SEQ ID NO: 9085432 - DNA, 21 bp, Homo sapiens
cagggccaatcctgacctcta

SEQ ID NO: 9085433 - DNA, 20 bp, Homo sapiens
cagggccacgctccaaggca

SEQ ID NO: 9085434 - DNA, 22 bp, Homo sapiens
tagtgttccagaagcaaacaag

SEQ ID NO: 9085435 - DNA, 22 bp, Homo sapiens
tagtgtctcttcctgtttgaaa

SEQ ID NO: 9085436 - DNA, 22 bp, Homo sapiens
tagtgtctgttgcttttgttca

SEQ ID NO: 9085437 - DNA, 22 bp, Homo sapiens
tagtgtcttcaggagatatgag

SEQ ID NO: 9085438 - DNA, 22 bp, Homo sapiens
tagtgtggtaaataaatgtttt

SEQ ID NO: 9085439 - DNA, 22 bp, Homo sapiens
tagttttacttgcgatgataat

SEQ ID NO: 9085440 - DNA, 22 bp, Homo sapiens
tagttttacttgcgatgataat

SEQ ID NO: 9085441 - DNA, 22 bp, Homo sapiens
tagtttgtcaaccactgtcaca

SEQ ID NO: 9085442 - DNA, 22 bp, Homo sapiens
tagtttctgaggattgaaagat

SEQ ID NO: 9085443 - DNA, 22 bp, Homo sapiens
tagtttcttcacctgtaaaatg

SEQ ID NO: 9085444 - DNA, 22 bp, Homo sapiens
tatattcaatgattagtatcag

SEQ ID NO: 9085445 - DNA, 22 bp, Homo sapiens
tatattcacttgtgtccaacca

SEQ ID NO: 9085446 - DNA, 22 bp, Homo sapiens
tatattcatattgttgtctctc

SEQ ID NO: 9085447 - DNA, 22 bp, Homo sapiens
tatataactactattttgctca

SEQ ID NO: 9085448 - DNA, 22 bp, Homo sapiens
tagttttagcagcaatgggatg

SEQ ID NO: 9085449 - DNA, 22 bp, Homo sapiens
tatacatcagtatgtttagata

SEQ ID NO: 9085450 - DNA, 22 bp, Homo sapiens
tatacagtttgagttcttgcat

SEQ ID NO: 9085451 - DNA, 22 bp, Homo sapiens
tatataattttctgccatatcc

SEQ ID NO: 9085452 - DNA, 22 bp, Homo sapiens
tatataattttctgccatatcc

SEQ ID NO: 9085453 - DNA, 22 bp, Homo sapiens
tatataattttctgccatatcc

SEQ ID NO: 9085454 - DNA, 22 bp, Homo sapiens
tatatacaaggtaggtttaggt

SEQ ID NO: 9085455 - DNA, 22 bp, Homo sapiens
ccctggaggttgaggctgcagt

SEQ ID NO: 9085456 - DNA, 22 bp, Homo sapiens
ccctggaggtcagaggcctggg

SEQ ID NO: 9085457 - DNA, 22 bp, Homo sapiens
ccctggagggcagacagatgcc

SEQ ID NO: 9085458 - DNA, 22 bp, Homo sapiens
ccctggagggcagacagatgcc

SEQ ID NO: 9085459 - DNA, 22 bp, Homo sapiens
ccctggagggcagacagatgcc

SEQ ID NO: 9085460 - DNA, 22 bp, Homo sapiens
ccctggagtagcactgggtcgc

SEQ ID NO: 9085461 - DNA, 22 bp, Homo sapiens
ccctggaggttgaggctgcagt

SEQ ID NO: 9085462 - DNA, 22 bp, Homo sapiens
ccctggagtcaggttggcctgg

SEQ ID NO: 9085463 - DNA, 22 bp, Homo sapiens
ccctggagtcctggcagttgat

SEQ ID NO: 9085464 - DNA, 22 bp, Homo sapiens
ccctggagtccggagctcacct

SEQ ID NO: 9085465 - DNA, 22 bp, Homo sapiens
ccctggagtgtgacgaggcatt

SEQ ID NO: 9085466 - DNA, 22 bp, Homo sapiens
ccctggagtgtgacgaggcatt

SEQ ID NO: 9085467 - DNA, 22 bp, Homo sapiens
tggcagaagttcactagtagct

SEQ ID NO: 9085468 - DNA, 22 bp, Homo sapiens
tggcagaagttcactagtagct

SEQ ID NO: 9085469 - DNA, 22 bp, Homo sapiens
tggcagaaagaaccatgtgcaa

SEQ ID NO: 9085470 - DNA, 22 bp, Homo sapiens
tggcagaagtacacaagcatgc

SEQ ID NO: 9085471 - DNA, 22 bp, Homo sapiens
tggcagaagtacacaagcatgc

SEQ ID NO: 9085472 - DNA, 22 bp, Homo sapiens
tggcactttacacccatttggc

SEQ ID NO: 9085473 - DNA, 22 bp, Homo sapiens
ccctggctgccagtcaccagac

SEQ ID NO: 9085474 - DNA, 22 bp, Homo sapiens
tggcagaattttaaagacagat

SEQ ID NO: 9085475 - DNA, 22 bp, Homo sapiens
tggcagaattttaaagacagat

SEQ ID NO: 9085476 - DNA, 22 bp, Homo sapiens
tggcagaatttctagcagattc

SEQ ID NO: 9085477 - DNA, 22 bp, Homo sapiens
tggcagaagttcactagtagct

SEQ ID NO: 9085478 - DNA, 22 bp, Homo sapiens
ccctttagcccctgcagagact

SEQ ID NO: 9085479 - DNA, 22 bp, Homo sapiens
cccttgggtgccagccacaagt

SEQ ID NO: 9085480 - DNA, 22 bp, Homo sapiens
ccctttaagtagaatatattat

SEQ ID NO: 9085481 - DNA, 22 bp, Homo sapiens
cccttggaaggtagctggcagt

SEQ ID NO: 9085482 - DNA, 22 bp, Homo sapiens
cccttgcttgcccagtcacagg

SEQ ID NO: 9085483 - DNA, 22 bp, Homo sapiens
cccttggcaaagctccccagtc

SEQ ID NO: 9085484 - DNA, 22 bp, Homo sapiens
cccttggccactgcgccagtga

SEQ ID NO: 9085485 - DNA, 22 bp, Homo sapiens
cccttggcttctatgggttttc

SEQ ID NO: 9085486 - DNA, 22 bp, Homo sapiens
cccttggctttagtttctaaag

SEQ ID NO: 9085487 - DNA, 22 bp, Homo sapiens
tggcagggaatacagatgttta

SEQ ID NO: 9085488 - DNA, 22 bp, Homo sapiens
tggcagggaatacagatgttta

SEQ ID NO: 9085489 - DNA, 19 bp, Homo sapiens
tggcagggagagtttgaag

SEQ ID NO: 9085490 - DNA, 19 bp, Homo sapiens
tggcagggagagtttgaag

SEQ ID NO: 9085491 - DNA, 22 bp, Homo sapiens
cccttgagcctggaggagctct

SEQ ID NO: 9085492 - DNA, 22 bp, Homo sapiens
ccctgggacccgctgcagaggc

SEQ ID NO: 9085493 - DNA, 22 bp, Homo sapiens
ccctgggagaagttgagggctg

SEQ ID NO: 9085494 - DNA, 22 bp, Homo sapiens
ccctgggaggcttccaggcaga

SEQ ID NO: 9085495 - DNA, 19 bp, Homo sapiens
tggcaggcccaggatggac

SEQ ID NO: 9085496 - DNA, 22 bp, Homo sapiens
tggcaggaaaaacattggagat

SEQ ID NO: 9085497 - DNA, 22 bp, Homo sapiens
tggcaggaaaaacattggagat

SEQ ID NO: 9085498 - DNA, 22 bp, Homo sapiens
ccctgggaggcttccaggcaga

SEQ ID NO: 9085499 - DNA, 22 bp, Homo sapiens
tggcaggctgagttggcctggt

SEQ ID NO: 9085500 - DNA, 22 bp, Homo sapiens
tggagatgaacatggtgatgtt

SEQ ID NO: 9085501 - DNA, 22 bp, Homo sapiens
tggagaatgatattccatcatt

SEQ ID NO: 9085502 - DNA, 22 bp, Homo sapiens
tggaaagaaagtaaaggcgtat

SEQ ID NO: 9085503 - DNA, 22 bp, Homo sapiens
tggagacagagatagccaattg

SEQ ID NO: 9085504 - DNA, 22 bp, Homo sapiens
tggagacatgggcgaatctaag

SEQ ID NO: 9085505 - DNA, 22 bp, Homo sapiens
tggagaattctatgttgagggg

SEQ ID NO: 9085506 - DNA, 22 bp, Homo sapiens
tggagaattctatgttgagggg

SEQ ID NO: 9085507 - DNA, 22 bp, Homo sapiens
ccctccctgaagaagttactct

SEQ ID NO: 9085508 - DNA, 23 bp, Homo sapiens
tggaaacattctgaatgtccatc

SEQ ID NO: 9085509 - DNA, 22 bp, Homo sapiens
ccctcctcaactctggcttcca

SEQ ID NO: 9085510 - DNA, 22 bp, Homo sapiens
ccctcctcaactctggcttcca

SEQ ID NO: 9085511 - DNA, 22 bp, Homo sapiens
tggaaagaaaaacaggccatga

SEQ ID NO: 9085512 - DNA, 22 bp, Homo sapiens
tggaaagaaaaacaggccatga

SEQ ID NO: 9085513 - DNA, 22 bp, Homo sapiens
tggaaactgggagttaaatgta

SEQ ID NO: 9085514 - DNA, 22 bp, Homo sapiens
tggaaactaggatggaagaaat

SEQ ID NO: 9085515 - DNA, 22 bp, Homo sapiens
tggaaacctactgatacaggag

SEQ ID NO: 9085516 - DNA, 16 bp, Homo sapiens
tggaggcatctggccc

SEQ ID NO: 9085517 - DNA, 16 bp, Homo sapiens
tggaggcatctggccc

SEQ ID NO: 9085518 - DNA, 22 bp, Homo sapiens
tggaggcatcagagtgcttggc

SEQ ID NO: 9085519 - DNA, 22 bp, Homo sapiens
ccctggaggaccccaatgtggc

SEQ ID NO: 9085520 - DNA, 22 bp, Homo sapiens
tggaggcattgtgactgctgaa

SEQ ID NO: 9085521 - DNA, 22 bp, Homo sapiens
tggaggcatttgatgttcataa

SEQ ID NO: 9085522 - DNA, 22 bp, Homo sapiens
tggaggcattttaggttgtcac

SEQ ID NO: 9085523 - DNA, 22 bp, Homo sapiens
tggagatgcctggagattaggg

SEQ ID NO: 9085524 - DNA, 18 bp, Homo sapiens
tggagctgagggcaatgc

SEQ ID NO: 9085525 - DNA, 22 bp, Homo sapiens
tggagatgtaaagcaaggctta

SEQ ID NO: 9085526 - DNA, 22 bp, Homo sapiens
tggagctgaggggaatgctgag

SEQ ID NO: 9085527 - DNA, 22 bp, Homo sapiens
tggaggaagttgctggaagtca

SEQ ID NO: 9085528 - DNA, 23 bp, Homo sapiens
tggaggaaacacatcagaagacc

SEQ ID NO: 9085529 - DNA, 23 bp, Homo sapiens
tggaggaaacacatcagaagacc

SEQ ID NO: 9085530 - DNA, 22 bp, Homo sapiens
tggaggacaggactggacagcc

SEQ ID NO: 9085531 - DNA, 22 bp, Homo sapiens
tggaggacaggactggacagcc

SEQ ID NO: 9085532 - DNA, 18 bp, Homo sapiens
tggaggaatcacaatggc

SEQ ID NO: 9085533 - DNA, 18 bp, Homo sapiens
tggaggaatcacaatggc

SEQ ID NO: 9085534 - DNA, 21 bp, Homo sapiens
tggaggaataaagcacagaag

SEQ ID NO: 9085535 - DNA, 22 bp, Homo sapiens
cccagtccagaccatgacctca

SEQ ID NO: 9085536 - DNA, 22 bp, Homo sapiens
cccagtcctaaagcagacgcca

SEQ ID NO: 9085537 - DNA, 22 bp, Homo sapiens
cccagtcctaaagcagacgcca

SEQ ID NO: 9085538 - DNA, 19 bp, Homo sapiens
cccagtccttgtcctgggc

SEQ ID NO: 9085539 - DNA, 19 bp, Homo sapiens
cccagtccttgtcctgggc

SEQ ID NO: 9085540 - DNA, 22 bp, Homo sapiens
cccaggtctcctgcttcccagg

SEQ ID NO: 9085541 - DNA, 22 bp, Homo sapiens
cccagtggaaggagtagaagac

SEQ ID NO: 9085542 - DNA, 22 bp, Homo sapiens
cccagtggctgtccccatgggc

SEQ ID NO: 9085543 - DNA, 22 bp, Homo sapiens
tgctctgaaggggaagggatgg

SEQ ID NO: 9085544 - DNA, 22 bp, Homo sapiens
tgctctgcacatccctcacaaa

SEQ ID NO: 9085545 - DNA, 22 bp, Homo sapiens
tgctctgcaagcaggagcaaga

SEQ ID NO: 9085546 - DNA, 22 bp, Homo sapiens
tgctgccttgtgctgcctttca

SEQ ID NO: 9085547 - DNA, 22 bp, Homo sapiens
tgctgccttgtgctgcctttca

SEQ ID NO: 9085548 - DNA, 22 bp, Homo sapiens
tgctctggaaataaatgattta

SEQ ID NO: 9085549 - DNA, 22 bp, Homo sapiens
tgctctggaatagtcctaggca

SEQ ID NO: 9085550 - DNA, 19 bp, Homo sapiens
tgctctggagccagctctc

SEQ ID NO: 9085551 - DNA, 22 bp, Homo sapiens
tgctctggacgctgagtggttt

SEQ ID NO: 9085552 - DNA, 22 bp, Homo sapiens
tgcaggtgcctcttgagcttgt

SEQ ID NO: 9085553 - DNA, 22 bp, Homo sapiens
tgcaggtgccatcgctgctcat

SEQ ID NO: 9085554 - DNA, 22 bp, Homo sapiens
tgcaggtgcgttttcaagcctc

SEQ ID NO: 9085555 - DNA, 22 bp, Homo sapiens
tgcaggtgctccgggggtgccc

SEQ ID NO: 9085556 - DNA, 22 bp, Homo sapiens
tgccttctcttccctgggagct

SEQ ID NO: 9085557 - DNA, 22 bp, Homo sapiens
tgccttctcccttggaccctga

SEQ ID NO: 9085558 - DNA, 22 bp, Homo sapiens
tgctaaggactgggaggcaggg

SEQ ID NO: 9085559 - DNA, 22 bp, Homo sapiens
tgctacacttaaatcagtcacc

SEQ ID NO: 9085560 - DNA, 22 bp, Homo sapiens
tgctacagagccaggaagagtg

SEQ ID NO: 9085561 - DNA, 22 bp, Homo sapiens
tgctagggatatagtggcgagt

SEQ ID NO: 9085562 - DNA, 22 bp, Homo sapiens
tgctagggatgtagcagtgaag

SEQ ID NO: 9085563 - DNA, 22 bp, Homo sapiens
tgctaggaatacacagagcaat

SEQ ID NO: 9085564 - DNA, 22 bp, Homo sapiens
tgctaggagaggcagcacagcg

SEQ ID NO: 9085565 - DNA, 22 bp, Homo sapiens
tgctagggaagaacgagggaat

SEQ ID NO: 9085566 - DNA, 22 bp, Homo sapiens
tgctagggatatagtggcgagt

SEQ ID NO: 9085567 - DNA, 22 bp, Homo sapiens
tgctagcactgtgcagtctacg

SEQ ID NO: 9085568 - DNA, 22 bp, Homo sapiens
tgctcagggacaatggagaggg

SEQ ID NO: 9085569 - DNA, 22 bp, Homo sapiens
tgctcagggacaatggagaggg

SEQ ID NO: 9085570 - DNA, 22 bp, Homo sapiens
tgctcaggccagccggacagag

SEQ ID NO: 9085571 - DNA, 20 bp, Homo sapiens
tgctcaggatggagaggtgt

SEQ ID NO: 9085572 - DNA, 22 bp, Homo sapiens
tgctcaggaggaggctgtgagg

SEQ ID NO: 9085573 - DNA, 20 bp, Homo sapiens
tgcttgtcatgcactcaggc

SEQ ID NO: 9085574 - DNA, 22 bp, Homo sapiens
tgcttgtccctctttatgatgg

SEQ ID NO: 9085575 - DNA, 22 bp, Homo sapiens
ccctccctatgtagatgatgtt

SEQ ID NO: 9085576 - DNA, 22 bp, Homo sapiens
ccctccccagggtcatattgaa

SEQ ID NO: 9085577 - DNA, 22 bp, Homo sapiens
ccctccccagggtcatattgaa

SEQ ID NO: 9085578 - DNA, 22 bp, Homo sapiens
ccctccccacaaagcttcacac

SEQ ID NO: 9085579 - DNA, 22 bp, Homo sapiens
tgcttgggcggccagcatggcg

SEQ ID NO: 9085580 - DNA, 22 bp, Homo sapiens
tgcttgggaatgtggagtcaga

SEQ ID NO: 9085581 - DNA, 21 bp, Homo sapiens
tgcttgggggcttcaggagct

SEQ ID NO: 9085582 - DNA, 22 bp, Homo sapiens
tgcttgctggaggcagacagaa

SEQ ID NO: 9085583 - DNA, 22 bp, Homo sapiens
tgcttgctggaggcagacagaa

SEQ ID NO: 9085584 - DNA, 22 bp, Homo sapiens
tgcttggctaaaaatggcaaga

SEQ ID NO: 9085585 - DNA, 20 bp, Homo sapiens
tgcttcctggccactgcggg

SEQ ID NO: 9085586 - DNA, 20 bp, Homo sapiens
tgcttcctggccactgcggg

SEQ ID NO: 9085587 - DNA, 22 bp, Homo sapiens
tgcttccttcccgttcttctcc

SEQ ID NO: 9085588 - DNA, 22 bp, Homo sapiens
tgcttcctgctaaggctgcctg

SEQ ID NO: 9085589 - DNA, 20 bp, Homo sapiens
tgcttcctggccactgcggg

SEQ ID NO: 9085590 - DNA, 22 bp, Homo sapiens
tgcttccttgagctctccaatc

SEQ ID NO: 9085591 - DNA, 22 bp, Homo sapiens
tgcttccttgatcattcccaaa

SEQ ID NO: 9085592 - DNA, 22 bp, Homo sapiens
tgcttccttcccgttcttctcc

SEQ ID NO: 9085593 - DNA, 22 bp, Homo sapiens
tgcttccttgagctctccaatc

SEQ ID NO: 9085594 - DNA, 22 bp, Homo sapiens
tgcttcctgctaaggctgcctg

SEQ ID NO: 9085595 - DNA, 22 bp, Homo sapiens
tgcttcctgaggccgtcttctc

SEQ ID NO: 9085596 - DNA, 22 bp, Homo sapiens
tgcttcctgaggccgtcttctc

SEQ ID NO: 9085597 - DNA, 19 bp, Homo sapiens
tgcttcctcaccatctccc

SEQ ID NO: 9085598 - DNA, 22 bp, Homo sapiens
tgcttcctatccacacaatgcc

SEQ ID NO: 9085599 - DNA, 22 bp, Homo sapiens
tgcttcctatccacacaatgcc

SEQ ID NO: 9085600 - DNA, 22 bp, Homo sapiens
ccccaggagatttgggagcaca

SEQ ID NO: 9085601 - DNA, 22 bp, Homo sapiens
tgctgtttgagcttattttcag

SEQ ID NO: 9085602 - DNA, 22 bp, Homo sapiens
ccccagctcagtgcagggacat

SEQ ID NO: 9085603 - DNA, 22 bp, Homo sapiens
ccccagctcagtgcagggacat

SEQ ID NO: 9085604 - DNA, 22 bp, Homo sapiens
ccccagctgcatacttgccaag

SEQ ID NO: 9085605 - DNA, 22 bp, Homo sapiens
ccccagctgcatacttgccaag

SEQ ID NO: 9085606 - DNA, 22 bp, Homo sapiens
ccccagctgcatacttgccaag

SEQ ID NO: 9085607 - DNA, 22 bp, Homo sapiens
ccccagctgagatttgaggaga

SEQ ID NO: 9085608 - DNA, 22 bp, Homo sapiens
ccccagctgagatttgaggaga

SEQ ID NO: 9085609 - DNA, 22 bp, Homo sapiens
ccccagctgagatttgaggaga

SEQ ID NO: 9085610 - DNA, 22 bp, Homo sapiens
cccagtggcttttgcccaggtt

SEQ ID NO: 9085611 - DNA, 22 bp, Homo sapiens
cccagtggggagctgaggttca

SEQ ID NO: 9085612 - DNA, 22 bp, Homo sapiens
cccagtggggaaatagctagct

SEQ ID NO: 9085613 - DNA, 22 bp, Homo sapiens
cccagtggtgctggcatctgtg

SEQ ID NO: 9085614 - DNA, 22 bp, Homo sapiens
cccagtgtctgggcctgcaggg

SEQ ID NO: 9085615 - DNA, 22 bp, Homo sapiens
cccagtgtgcccctcctgcagc

SEQ ID NO: 9085616 - DNA, 22 bp, Homo sapiens
cccagtgtcaccaacaggacac

SEQ ID NO: 9085617 - DNA, 22 bp, Homo sapiens
cccagtgttccttgaggggctg

SEQ ID NO: 9085618 - DNA, 22 bp, Homo sapiens
cccagtgttacgtgacagcctg

SEQ ID NO: 9085619 - DNA, 22 bp, Homo sapiens
cctctcccaggcgcggcggcag

SEQ ID NO: 9085620 - DNA, 22 bp, Homo sapiens
cctctcccaggcgcggcggcag

SEQ ID NO: 9085621 - DNA, 22 bp, Homo sapiens
cctctcccacgtggcagaggct

SEQ ID NO: 9085622 - DNA, 22 bp, Homo sapiens
cctctcccacgtggcagaggct

SEQ ID NO: 9085623 - DNA, 22 bp, Homo sapiens
cctctcccacgtggcagaggct

SEQ ID NO: 9085624 - DNA, 22 bp, Homo sapiens
cctctccagttttaacgtgacc

SEQ ID NO: 9085625 - DNA, 22 bp, Homo sapiens
tggctttacttaaactgaatca

SEQ ID NO: 9085626 - DNA, 22 bp, Homo sapiens
tggctttaggagctatatacct

SEQ ID NO: 9085627 - DNA, 22 bp, Homo sapiens
cctctcccctcccaaggcggga

SEQ ID NO: 9085628 - DNA, 22 bp, Homo sapiens
cctctcccctcccaaggcggga

SEQ ID NO: 9085629 - DNA, 19 bp, Homo sapiens
cctctcccatgcttacctc

SEQ ID NO: 9085630 - DNA, 19 bp, Homo sapiens
cctctcccatgcttacctc

SEQ ID NO: 9085631 - DNA, 22 bp, Homo sapiens
cctctcccagggagagcctgag

SEQ ID NO: 9085632 - DNA, 22 bp, Homo sapiens
cctctcccagggagagcctgag

SEQ ID NO: 9085633 - DNA, 19 bp, Homo sapiens
cctctcccatgcttacctc

SEQ ID NO: 9085634 - DNA, 22 bp, Homo sapiens
cctctcccgggtgccgctgggc

SEQ ID NO: 9085635 - DNA, 22 bp, Homo sapiens
cctctcccgggtgccgctgggc

SEQ ID NO: 9085636 - DNA, 22 bp, Homo sapiens
cctctcccgggtgccgctgggc

SEQ ID NO: 9085637 - DNA, 22 bp, Homo sapiens
cctctcccgggtgccgctgggc

SEQ ID NO: 9085638 - DNA, 22 bp, Homo sapiens
tggcttggctaagatctaagct

SEQ ID NO: 9085639 - DNA, 22 bp, Homo sapiens
tggcttggctaagatctaagct

SEQ ID NO: 9085640 - DNA, 22 bp, Homo sapiens
tggcttggtcctggcccttccc

SEQ ID NO: 9085641 - DNA, 20 bp, Homo sapiens
tggcttgtttctatgggcag

SEQ ID NO: 9085642 - DNA, 20 bp, Homo sapiens
cctcctggtcaggtgtgcag

SEQ ID NO: 9085643 - DNA, 22 bp, Homo sapiens
cctcctgggttcaagcgattct

SEQ ID NO: 9085644 - DNA, 22 bp, Homo sapiens
cctcctggggtgaaggatggga

SEQ ID NO: 9085645 - DNA, 22 bp, Homo sapiens
tggcttctttccactgtcctgt

SEQ ID NO: 9085646 - DNA, 22 bp, Homo sapiens
tggcttcttgtctaatttgtta

SEQ ID NO: 9085647 - DNA, 22 bp, Homo sapiens
cctcctggtccagcatctcttt

SEQ ID NO: 9085648 - DNA, 22 bp, Homo sapiens
tggcttcccatagcttgctagt

SEQ ID NO: 9085649 - DNA, 22 bp, Homo sapiens
tgggacaggaggcctctggaga

SEQ ID NO: 9085650 - DNA, 22 bp, Homo sapiens
tgggacagattataagtctgca

SEQ ID NO: 9085651 - DNA, 22 bp, Homo sapiens
tgggacaggatgaccagaaggt

SEQ ID NO: 9085652 - DNA, 22 bp, Homo sapiens
tgggacaggatgaccagaaggt

SEQ ID NO: 9085653 - DNA, 22 bp, Homo sapiens
tgggacaggaggcctctggaga

SEQ ID NO: 9085654 - DNA, 22 bp, Homo sapiens
tgggagagaattctggtgactg

SEQ ID NO: 9085655 - DNA, 22 bp, Homo sapiens
tgggacagggaatctgatcccc

SEQ ID NO: 9085656 - DNA, 22 bp, Homo sapiens
tgggacagggaatctgatcccc

SEQ ID NO: 9085657 - DNA, 22 bp, Homo sapiens
tgggagagaataatcaataggt

SEQ ID NO: 9085658 - DNA, 22 bp, Homo sapiens
tgggagagaattctggtgactg

SEQ ID NO: 9085659 - DNA, 21 bp, Homo sapiens
tgggatagaaatatggctgct

SEQ ID NO: 9085660 - DNA, 23 bp, Homo sapiens
tgggatagaatttcatggctgct

SEQ ID NO: 9085661 - DNA, 22 bp, Homo sapiens
tgggcactgtagctggtgctgg

SEQ ID NO: 9085662 - DNA, 22 bp, Homo sapiens
tgggcactggaagcctgctgtg

SEQ ID NO: 9085663 - DNA, 21 bp, Homo sapiens
tgggcactgagggtgctgctc

SEQ ID NO: 9085664 - DNA, 22 bp, Homo sapiens
tgggcagacgctgttggaaggc

SEQ ID NO: 9085665 - DNA, 22 bp, Homo sapiens
tgggcagacattgagtttgttc

SEQ ID NO: 9085666 - DNA, 22 bp, Homo sapiens
tgggcagacgggagcttgcctt

SEQ ID NO: 9085667 - DNA, 22 bp, Homo sapiens
tgggcagactaaggtcaaagct

SEQ ID NO: 9085668 - DNA, 22 bp, Homo sapiens
tgggcagaaatcagtatcagat

SEQ ID NO: 9085669 - DNA, 22 bp, Homo sapiens
tgggcagaaggaagagccacct

SEQ ID NO: 9085670 - DNA, 22 bp, Homo sapiens
tgggcagaatgtgggatccaga

SEQ ID NO: 9085671 - DNA, 22 bp, Homo sapiens
tgggcagaattgtggtagttaa

SEQ ID NO: 9085672 - DNA, 22 bp, Homo sapiens
tggcatttgctcccttgtgttc

SEQ ID NO: 9085673 - DNA, 19 bp, Homo sapiens
tggcagtgtggcttccaga

SEQ ID NO: 9085674 - DNA, 22 bp, Homo sapiens
tggcagtgtgggaggaaggtac

SEQ ID NO: 9085675 - DNA, 22 bp, Homo sapiens
tggcagtgtgggaggaaggtac

SEQ ID NO: 9085676 - DNA, 22 bp, Homo sapiens
tggcagtgtgggaggaaggtac

SEQ ID NO: 9085677 - DNA, 22 bp, Homo sapiens
tggcagtgtcctactggttggt

SEQ ID NO: 9085678 - DNA, 22 bp, Homo sapiens
tggcagtgtcctactggttggt

SEQ ID NO: 9085679 - DNA, 22 bp, Homo sapiens
tggcagtgtataggtggctcct

SEQ ID NO: 9085680 - DNA, 22 bp, Homo sapiens
tggcagtgtataggtggctcct

SEQ ID NO: 9085681 - DNA, 22 bp, Homo sapiens
tggcagtgtataggtggctcct

SEQ ID NO: 9085682 - DNA, 22 bp, Homo sapiens
tggcagtgtcttatcaggagtg

SEQ ID NO: 9085683 - DNA, 22 bp, Homo sapiens
tggcagtgtcttatcaggagtg

SEQ ID NO: 9085684 - DNA, 22 bp, Homo sapiens
tggcagtgtcttgctggggcag

SEQ ID NO: 9085685 - DNA, 22 bp, Homo sapiens
tggcagtgtcttgctggggcag

SEQ ID NO: 9085686 - DNA, 22 bp, Homo sapiens
tggcagtgggaagctggaagtc

SEQ ID NO: 9085687 - DNA, 22 bp, Homo sapiens
tggcagtgggaagctggaagtc

SEQ ID NO: 9085688 - DNA, 22 bp, Homo sapiens
tggcagtgggaagctggaagtc

SEQ ID NO: 9085689 - DNA, 22 bp, Homo sapiens
tggcagtggctttgctggtgga

SEQ ID NO: 9085690 - DNA, 22 bp, Homo sapiens
tggcagtggctttgctggtgga

SEQ ID NO: 9085691 - DNA, 22 bp, Homo sapiens
tggcagtgggaagctggaagtc

SEQ ID NO: 9085692 - DNA, 22 bp, Homo sapiens
tggcagtgggaatggacaaaca

SEQ ID NO: 9085693 - DNA, 22 bp, Homo sapiens
tggcagtgggaatggacaaaca

SEQ ID NO: 9085694 - DNA, 22 bp, Homo sapiens
tggcagtggtgtctgcacaggc

SEQ ID NO: 9085695 - DNA, 22 bp, Homo sapiens
tggcagtggtaccggctctcag

SEQ ID NO: 9085696 - DNA, 22 bp, Homo sapiens
tggcatttggcttacttatgtt

SEQ ID NO: 9085697 - DNA, 22 bp, Homo sapiens
tggcattttctcctttgagttt

SEQ ID NO: 9085698 - DNA, 22 bp, Homo sapiens
tggccaagaatgatatgtgaag

SEQ ID NO: 9085699 - DNA, 22 bp, Homo sapiens
tggccaaatttggtgtaacttg

SEQ ID NO: 9085700 - DNA, 22 bp, Homo sapiens
cctccagggcagacggggagca

SEQ ID NO: 9085701 - DNA, 22 bp, Homo sapiens
cctccagggcccctctcactgg

SEQ ID NO: 9085702 - DNA, 22 bp, Homo sapiens
cctccagcgcgatccactccgg

SEQ ID NO: 9085703 - DNA, 22 bp, Homo sapiens
cctcccaccgtatctcagtggc

SEQ ID NO: 9085704 - DNA, 22 bp, Homo sapiens
cctcccacattgaggacatgct

SEQ ID NO: 9085705 - DNA, 22 bp, Homo sapiens
cctcccaccgtatctcagtggc

SEQ ID NO: 9085706 - DNA, 22 bp, Homo sapiens
cctcccacattgaggacatgct

SEQ ID NO: 9085707 - DNA, 22 bp, Homo sapiens
cctcccaccatttagagagagc

SEQ ID NO: 9085708 - DNA, 22 bp, Homo sapiens
cctcccacttcttgctgaggtc

SEQ ID NO: 9085709 - DNA, 19 bp, Homo sapiens
cctcccacggattccttcc

SEQ ID NO: 9085710 - DNA, 23 bp, Homo sapiens
cctcccacctatttcactttctt

SEQ ID NO: 9085711 - DNA, 22 bp, Homo sapiens
cctcccaccgtatctcagtggc

SEQ ID NO: 9085712 - DNA, 22 bp, Homo sapiens
cctccagtcacctggatgagaa

SEQ ID NO: 9085713 - DNA, 22 bp, Homo sapiens
cctcccacatcctagctctgct

SEQ ID NO: 9085714 - DNA, 17 bp, Homo sapiens
cctcccacaccgccctg

SEQ ID NO: 9085715 - DNA, 22 bp, Homo sapiens
cctcctggcttttcccattgaa

SEQ ID NO: 9085716 - DNA, 22 bp, Homo sapiens
cctcctgggacaggctggcaca

SEQ ID NO: 9085717 - DNA, 22 bp, Homo sapiens
cctcctggcctgtgcagagccc

SEQ ID NO: 9085718 - DNA, 22 bp, Homo sapiens
cctcctggccctgggcctggaa

SEQ ID NO: 9085719 - DNA, 22 bp, Homo sapiens
cctcctggccctgggcctggaa

SEQ ID NO: 9085720 - DNA, 23 bp, Homo sapiens
cctcctgggcacaggcctgatgg

SEQ ID NO: 9085721 - DNA, 23 bp, Homo sapiens
cctcctgggcacaggcctgatgg

SEQ ID NO: 9085722 - DNA, 22 bp, Homo sapiens
cctcctgggagagcacggaggg

SEQ ID NO: 9085723 - DNA, 22 bp, Homo sapiens
cctcctgggctcctgtctgcac

SEQ ID NO: 9085724 - DNA, 22 bp, Homo sapiens
cctcctgggccttgctctgtga

SEQ ID NO: 9085725 - DNA, 22 bp, Homo sapiens
cctcctgggccttgctctgtga

SEQ ID NO: 9085726 - DNA, 22 bp, Homo sapiens
cctcctgggccttgctctgtga

SEQ ID NO: 9085727 - DNA, 22 bp, Homo sapiens
cctgcccagcttcacctcaggc

SEQ ID NO: 9085728 - DNA, 22 bp, Homo sapiens
tggtacctgaatgaagggagga

SEQ ID NO: 9085729 - DNA, 22 bp, Homo sapiens
tggtaccatgttgctttgattt

SEQ ID NO: 9085730 - DNA, 22 bp, Homo sapiens
cctgccctgtcactggctaggg

SEQ ID NO: 9085731 - DNA, 22 bp, Homo sapiens
cctgccctgtcactggctaggg

SEQ ID NO: 9085732 - DNA, 22 bp, Homo sapiens
cctgccctgtgtttggggacta

SEQ ID NO: 9085733 - DNA, 22 bp, Homo sapiens
cctgccctgtgtttggggacta

SEQ ID NO: 9085734 - DNA, 22 bp, Homo sapiens
cctgcccttctttccccagcat

SEQ ID NO: 9085735 - DNA, 22 bp, Homo sapiens
cctgcccttctttccccagcat

SEQ ID NO: 9085736 - DNA, 23 bp, Homo sapiens
cctgccggacctggtggggagac

SEQ ID NO: 9085737 - DNA, 22 bp, Homo sapiens
cctgcctcatcaacttgtcgtg

SEQ ID NO: 9085738 - DNA, 22 bp, Homo sapiens
cctgcctatgagacgttttgcc

SEQ ID NO: 9085739 - DNA, 22 bp, Homo sapiens
cctgcctatgtaagtggtttct

SEQ ID NO: 9085740 - DNA, 22 bp, Homo sapiens
cctgcctactgagttttatatt

SEQ ID NO: 9085741 - DNA, 22 bp, Homo sapiens
cctgcctactgagttttatatt

SEQ ID NO: 9085742 - DNA, 22 bp, Homo sapiens
cctgcctatgagacgttttgcc

SEQ ID NO: 9085743 - DNA, 22 bp, Homo sapiens
cctgcctatgagacgttttgcc

SEQ ID NO: 9085744 - DNA, 22 bp, Homo sapiens
cctgcctgacagagaaggttca

SEQ ID NO: 9085745 - DNA, 22 bp, Homo sapiens
cctgcctgacagagaaggttca

SEQ ID NO: 9085746 - DNA, 22 bp, Homo sapiens
cctgcctgacagagaaggttca

SEQ ID NO: 9085747 - DNA, 22 bp, Homo sapiens
cctgcctgaaggtcagccaccc

SEQ ID NO: 9085748 - DNA, 23 bp, Homo sapiens
cctgcctccccatcagttataca

SEQ ID NO: 9085749 - DNA, 22 bp, Homo sapiens
cctgcctgcaaaatgggacaag

SEQ ID NO: 9085750 - DNA, 22 bp, Homo sapiens
cctgcctgcaccttctctgggg

SEQ ID NO: 9085751 - DNA, 22 bp, Homo sapiens
cctgcctgattccaggatggct

SEQ ID NO: 9085752 - DNA, 22 bp, Homo sapiens
cctgcctgattccaggatggct

SEQ ID NO: 9085753 - DNA, 22 bp, Homo sapiens
tggtgggacatctgaggagagg

SEQ ID NO: 9085754 - DNA, 22 bp, Homo sapiens
cctgcctgcagaaagtatctcc

SEQ ID NO: 9085755 - DNA, 22 bp, Homo sapiens
tggttacataagaatagcactg

SEQ ID NO: 9085756 - DNA, 23 bp, Homo sapiens
tggttacaggaacagggtttcgg

SEQ ID NO: 9085757 - DNA, 22 bp, Homo sapiens
tggttacagaacatgaatgttg

SEQ ID NO: 9085758 - DNA, 22 bp, Homo sapiens
tggttacagagatttttaagat

SEQ ID NO: 9085759 - DNA, 22 bp, Homo sapiens
tggttacccagtcgctggagtt

SEQ ID NO: 9085760 - DNA, 22 bp, Homo sapiens
tggttacatatcctttggagcc

SEQ ID NO: 9085761 - DNA, 22 bp, Homo sapiens
tggttacatcatcccattctga

SEQ ID NO: 9085762 - DNA, 23 bp, Homo sapiens
tggttacatagggcagatggcgc

SEQ ID NO: 9085763 - DNA, 22 bp, Homo sapiens
cctgcaggtttcccccggacgg

SEQ ID NO: 9085764 - DNA, 17 bp, Homo sapiens
cctgcagtgcctgtcgg

SEQ ID NO: 9085765 - DNA, 22 bp, Homo sapiens
cctgcaggttgcagaggcggaa

SEQ ID NO: 9085766 - DNA, 22 bp, Homo sapiens
cctgcaggttgcagaggcggaa

SEQ ID NO: 9085767 - DNA, 22 bp, Homo sapiens
cctgcaggtccccggatgcgca

SEQ ID NO: 9085768 - DNA, 22 bp, Homo sapiens
cctgccacttcttgctatggag

SEQ ID NO: 9085769 - DNA, 22 bp, Homo sapiens
cctgcatccgaaagtgatcata

SEQ ID NO: 9085770 - DNA, 22 bp, Homo sapiens
cctgcagggtgctgccacagat

SEQ ID NO: 9085771 - DNA, 22 bp, Homo sapiens
cctgcaggtaaggctaactgcc

SEQ ID NO: 9085772 - DNA, 22 bp, Homo sapiens
cctgcaggtccccggatgcgca

SEQ ID NO: 9085773 - DNA, 22 bp, Homo sapiens
cctgcaggggagagacttctag

SEQ ID NO: 9085774 - DNA, 19 bp, Homo sapiens
cctgcagggatgagaggtt

SEQ ID NO: 9085775 - DNA, 19 bp, Homo sapiens
cctgcagggatgagaggtt

SEQ ID NO: 9085776 - DNA, 22 bp, Homo sapiens
tggtaattataaaatgtttttg

SEQ ID NO: 9085777 - DNA, 21 bp, Homo sapiens
tggtaatgttcagtatccact

SEQ ID NO: 9085778 - DNA, 22 bp, Homo sapiens
tggtacaaaagtaattgcgtga

SEQ ID NO: 9085779 - DNA, 22 bp, Homo sapiens
tggtaattgagatgtcttttct

SEQ ID NO: 9085780 - DNA, 22 bp, Homo sapiens
tggtaatttacgcatttctgta

SEQ ID NO: 9085781 - DNA, 22 bp, Homo sapiens
tggtaatttattttgagagatt

SEQ ID NO: 9085782 - DNA, 22 bp, Homo sapiens
tggtaattatggatacttaaat

SEQ ID NO: 9085783 - DNA, 22 bp, Homo sapiens
tggtacaagcagactcagcaga

SEQ ID NO: 9085784 - DNA, 22 bp, Homo sapiens
tggtacaagcagactcagcaga

SEQ ID NO: 9085785 - DNA, 22 bp, Homo sapiens
tggtacaagatgttctaactga

SEQ ID NO: 9085786 - DNA, 22 bp, Homo sapiens
tggtacaagatgttctaactga

SEQ ID NO: 9085787 - DNA, 22 bp, Homo sapiens
tggtacaactgtattaggcaaa

SEQ ID NO: 9085788 - DNA, 19 bp, Homo sapiens
tggtacaaaccaagagaga

SEQ ID NO: 9085789 - DNA, 22 bp, Homo sapiens
tggtacaagagtatttgcggtt

SEQ ID NO: 9085790 - DNA, 22 bp, Homo sapiens
tggtacaaagcctctttgcctc

SEQ ID NO: 9085791 - DNA, 22 bp, Homo sapiens
tggtacaactgtattaggcaaa

SEQ ID NO: 9085792 - DNA, 22 bp, Homo sapiens
tggtacaagggttgggagacag

SEQ ID NO: 9085793 - DNA, 22 bp, Homo sapiens
tggtacaagttctggcatgtga

SEQ ID NO: 9085794 - DNA, 22 bp, Homo sapiens
tggtacaatcacagctcactgt

SEQ ID NO: 9085795 - DNA, 22 bp, Homo sapiens
tggtacaatcacagctcactgt

SEQ ID NO: 9085796 - DNA, 22 bp, Homo sapiens
tggtacaattaaaataattttg

SEQ ID NO: 9085797 - DNA, 22 bp, Homo sapiens
tggtacaatggcatctatctat

SEQ ID NO: 9085798 - DNA, 22 bp, Homo sapiens
tggtacaatggcatctatctat

SEQ ID NO: 9085799 - DNA, 22 bp, Homo sapiens
tgggtgggagcaccctgtctgg

SEQ ID NO: 9085800 - DNA, 22 bp, Homo sapiens
tgggtgggagcaccctgtctgg

SEQ ID NO: 9085801 - DNA, 22 bp, Homo sapiens
tgggtgggagcaccctgtctgg

SEQ ID NO: 9085802 - DNA, 22 bp, Homo sapiens
tgggtccacaaacatcagatat

SEQ ID NO: 9085803 - DNA, 22 bp, Homo sapiens
tgggtggcacttctggggtcca

SEQ ID NO: 9085804 - DNA, 18 bp, Homo sapiens
tgggtggctagggagttt

SEQ ID NO: 9085805 - DNA, 22 bp, Homo sapiens
tgggtggcacttctggggtcca

SEQ ID NO: 9085806 - DNA, 22 bp, Homo sapiens
tgggcaggataatatctcatgt

SEQ ID NO: 9085807 - DNA, 22 bp, Homo sapiens
tgggcaggataatatctcatgt

SEQ ID NO: 9085808 - DNA, 22 bp, Homo sapiens
tgggcaggataatatctcatgt

SEQ ID NO: 9085809 - DNA, 22 bp, Homo sapiens
tgggcaggagagaagctaaaga

SEQ ID NO: 9085810 - DNA, 22 bp, Homo sapiens
tgggcaggagagaagctaaaga

SEQ ID NO: 9085811 - DNA, 22 bp, Homo sapiens
tgggcaggagagaagctaaaga

SEQ ID NO: 9085812 - DNA, 22 bp, Homo sapiens
tgggcaggcaagtgaatacctt

SEQ ID NO: 9085813 - DNA, 22 bp, Homo sapiens
tgggcaggatgcgttgattctt

SEQ ID NO: 9085814 - DNA, 22 bp, Homo sapiens
tgggcaggatgcgttgattctt

SEQ ID NO: 9085815 - DNA, 22 bp, Homo sapiens
tgggcctggagccctggagagt

SEQ ID NO: 9085816 - DNA, 22 bp, Homo sapiens
tgggcctggagccctggagagt

SEQ ID NO: 9085817 - DNA, 22 bp, Homo sapiens
tgggcctggagtttgtccagag

SEQ ID NO: 9085818 - DNA, 22 bp, Homo sapiens
tgggcctggagtttgtccagag

SEQ ID NO: 9085819 - DNA, 22 bp, Homo sapiens
tgggcctggagtttgtccagag

SEQ ID NO: 9085820 - DNA, 22 bp, Homo sapiens
tgggcctggacaaggccactag

SEQ ID NO: 9085821 - DNA, 22 bp, Homo sapiens
tgggcctggacaaggccactag

SEQ ID NO: 9085822 - DNA, 22 bp, Homo sapiens
tgggcctggacaaggccactag

SEQ ID NO: 9085823 - DNA, 22 bp, Homo sapiens
tgggcctggacaaggccactag

SEQ ID NO: 9085824 - DNA, 22 bp, Homo sapiens
tgggcctggacatctgtatttt

SEQ ID NO: 9085825 - DNA, 22 bp, Homo sapiens
tgggctcatggcccagcactgg

SEQ ID NO: 9085826 - DNA, 22 bp, Homo sapiens
tgggctccagcacctgtgctct

SEQ ID NO: 9085827 - DNA, 22 bp, Homo sapiens
tgggctccagcacctgtgctct

SEQ ID NO: 9085828 - DNA, 22 bp, Homo sapiens
tgggctccagcacctgtgctct

SEQ ID NO: 9085829 - DNA, 22 bp, Homo sapiens
tgggctccagcacctgtgctct

SEQ ID NO: 9085830 - DNA, 22 bp, Homo sapiens
tgggctccgttgcctggggcag

SEQ ID NO: 9085831 - DNA, 22 bp, Homo sapiens
tgggctccggcggcctcaggct

SEQ ID NO: 9085832 - DNA, 22 bp, Homo sapiens
tgggctccgttgcctggggcag

SEQ ID NO: 9085833 - DNA, 22 bp, Homo sapiens
tgggctccgttgcctggggcag

SEQ ID NO: 9085834 - DNA, 22 bp, Homo sapiens
tgggctccggcggcctcaggct

SEQ ID NO: 9085835 - DNA, 22 bp, Homo sapiens
tgggctccggcggcctcaggct

SEQ ID NO: 9085836 - DNA, 22 bp, Homo sapiens
tgggcctgggagggcagacgct

SEQ ID NO: 9085837 - DNA, 22 bp, Homo sapiens
tgggcctgggagggcagacgct

SEQ ID NO: 9085838 - DNA, 22 bp, Homo sapiens
tgggcctgggagggcagacgct

SEQ ID NO: 9085839 - DNA, 22 bp, Homo sapiens
tgggctcatggcccagcactgg

SEQ ID NO: 9085840 - DNA, 22 bp, Homo sapiens
tgggcctggccctgtggaggag

SEQ ID NO: 9085841 - DNA, 23 bp, Homo sapiens
tgggcctggcctcccagtccagc

SEQ ID NO: 9085842 - DNA, 23 bp, Homo sapiens
tgggcctggcctcccagtccagc

SEQ ID NO: 9085843 - DNA, 23 bp, Homo sapiens
tgggcctggcctcccagtccagc

SEQ ID NO: 9085844 - DNA, 22 bp, Homo sapiens
tgggcctggccctgtggaggag

SEQ ID NO: 9085845 - DNA, 22 bp, Homo sapiens
tgggcctggccctgtggaggag

SEQ ID NO: 9085846 - DNA, 22 bp, Homo sapiens
tgggcctggagtttgtccagag

SEQ ID NO: 9085847 - DNA, 22 bp, Homo sapiens
cctgcagggaatcgaggcagaa

SEQ ID NO: 9085848 - DNA, 22 bp, Homo sapiens
cctgcagggaatcgaggcagaa

SEQ ID NO: 9085849 - DNA, 22 bp, Homo sapiens
cctgcaggctgcaggccagttc

SEQ ID NO: 9085850 - DNA, 22 bp, Homo sapiens
cctgcaggctgcaggccagttc

SEQ ID NO: 9085851 - DNA, 22 bp, Homo sapiens
cctgcaggctgcaggccagttc

SEQ ID NO: 9085852 - DNA, 22 bp, Homo sapiens
cctgcagctttgcctcctgaac

SEQ ID NO: 9085853 - DNA, 22 bp, Homo sapiens
cctgcagaccacactcagtcct

SEQ ID NO: 9085854 - DNA, 22 bp, Homo sapiens
cctgcagctgtaggagaaggcg

SEQ ID NO: 9085855 - DNA, 22 bp, Homo sapiens
tggggagcacggtagggaaatg

SEQ ID NO: 9085856 - DNA, 22 bp, Homo sapiens
cctgcagacacttgtccagcaa

SEQ ID NO: 9085857 - DNA, 22 bp, Homo sapiens
cctgcagacacttgtccagcaa

SEQ ID NO: 9085858 - DNA, 23 bp, Homo sapiens
tggggagagttaccctggaagcg

SEQ ID NO: 9085859 - DNA, 23 bp, Homo sapiens
tggggagagttaccctggaagcg

SEQ ID NO: 9085860 - DNA, 22 bp, Homo sapiens
tggggagagttacaaggaatct

SEQ ID NO: 9085861 - DNA, 22 bp, Homo sapiens
tggggagaggaatttgaatgat

SEQ ID NO: 9085862 - DNA, 22 bp, Homo sapiens
tggggagaggtatcattgagat

SEQ ID NO: 9085863 - DNA, 22 bp, Homo sapiens
cctgagtctttcccattgcgct

SEQ ID NO: 9085864 - DNA, 22 bp, Homo sapiens
cctgagtgaattccctcactgt

SEQ ID NO: 9085865 - DNA, 22 bp, Homo sapiens
tgggctcctcgtcactcgctgt

SEQ ID NO: 9085866 - DNA, 22 bp, Homo sapiens
cctgaggtcatggtccagtgtt

SEQ ID NO: 9085867 - DNA, 22 bp, Homo sapiens
cctgagtgacctgaggtctagt

SEQ ID NO: 9085868 - DNA, 22 bp, Homo sapiens
cctgagtgcttccagagtcatg

SEQ ID NO: 9085869 - DNA, 22 bp, Homo sapiens
cctgagtggagggattctgcag

SEQ ID NO: 9085870 - DNA, 22 bp, Homo sapiens
cctgagtggccaggcagctgtg

SEQ ID NO: 9085871 - DNA, 17 bp, Homo sapiens
cctgagtgggagaggaa

SEQ ID NO: 9085872 - DNA, 22 bp, Homo sapiens
cctgagtggtgctaagcagata

SEQ ID NO: 9085873 - DNA, 22 bp, Homo sapiens
tggggagaagcaatagactcta

SEQ ID NO: 9085874 - DNA, 22 bp, Homo sapiens
tggggagaaatgtctttgttcc

SEQ ID NO: 9085875 - DNA, 22 bp, Homo sapiens
tggggagaaatgtctttgttcc

SEQ ID NO: 9085876 - DNA, 22 bp, Homo sapiens
cctgatggagccctgctgcatg

SEQ ID NO: 9085877 - DNA, 22 bp, Homo sapiens
cctgagttagttgctgtgtctc

SEQ ID NO: 9085878 - DNA, 22 bp, Homo sapiens
ccagtgcattgccgtgtctagg

SEQ ID NO: 9085879 - DNA, 22 bp, Homo sapiens
ccagtgcataatcaatacagcc

SEQ ID NO: 9085880 - DNA, 22 bp, Homo sapiens
ccagtgcgagcctgtgctggcc

SEQ ID NO: 9085881 - DNA, 22 bp, Homo sapiens
ccagtgcgcaggcgccacctgt

SEQ ID NO: 9085882 - DNA, 22 bp, Homo sapiens
tgagccatgggactccaaggga

SEQ ID NO: 9085883 - DNA, 22 bp, Homo sapiens
tgagccatgggactccaaggga

SEQ ID NO: 9085884 - DNA, 22 bp, Homo sapiens
tgagccagttcttcagatccat

SEQ ID NO: 9085885 - DNA, 22 bp, Homo sapiens
tgagccagttcttcagatccat

SEQ ID NO: 9085886 - DNA, 22 bp, Homo sapiens
tgagccagtggaagatggcagt

SEQ ID NO: 9085887 - DNA, 22 bp, Homo sapiens
ccagtcccagctctgccatgct

SEQ ID NO: 9085888 - DNA, 22 bp, Homo sapiens
tgagcccaggagttggagaccg

SEQ ID NO: 9085889 - DNA, 22 bp, Homo sapiens
ccagtctgaggcctggtgaggg

SEQ ID NO: 9085890 - DNA, 22 bp, Homo sapiens
tgagcccaggagtatgaggctg

SEQ ID NO: 9085891 - DNA, 22 bp, Homo sapiens
tgagcccaggagtatgaggctg

SEQ ID NO: 9085892 - DNA, 23 bp, Homo sapiens
tgagcccaggaggtcaaggctgc

SEQ ID NO: 9085893 - DNA, 22 bp, Homo sapiens
tgagcccaggagtatgaggctg

SEQ ID NO: 9085894 - DNA, 22 bp, Homo sapiens
ccagtgcaggtgagcaccaggt

SEQ ID NO: 9085895 - DNA, 22 bp, Homo sapiens
ccagtgcagtccccctgaactg

SEQ ID NO: 9085896 - DNA, 22 bp, Homo sapiens
ccagtgcaggtgagcaccaggt

SEQ ID NO: 9085897 - DNA, 22 bp, Homo sapiens
tgagcccagagatctgagctat

SEQ ID NO: 9085898 - DNA, 22 bp, Homo sapiens
tgagcccagagcccttgtaggg

SEQ ID NO: 9085899 - DNA, 22 bp, Homo sapiens
tgagcccagaagcccactcggc

SEQ ID NO: 9085900 - DNA, 23 bp, Homo sapiens
tgagcccaggaggtcaaggctgc

SEQ ID NO: 9085901 - DNA, 23 bp, Homo sapiens
tgagcccaggaggtcaaggctgc

SEQ ID NO: 9085902 - DNA, 22 bp, Homo sapiens
tgagcagtcagacaagcatcac

SEQ ID NO: 9085903 - DNA, 22 bp, Homo sapiens
ccaggtggcttctgcccgatgt

SEQ ID NO: 9085904 - DNA, 22 bp, Homo sapiens
ccagtccacgtcaagaagaggt

SEQ ID NO: 9085905 - DNA, 22 bp, Homo sapiens
ccagtccagtgccatgcatggc

SEQ ID NO: 9085906 - DNA, 20 bp, Homo sapiens
ccagtccacctgagacatgt

SEQ ID NO: 9085907 - DNA, 22 bp, Homo sapiens
ccagtcagttctgattatgtgg

SEQ ID NO: 9085908 - DNA, 22 bp, Homo sapiens
ccagtcagagaaaatgtccact

SEQ ID NO: 9085909 - DNA, 22 bp, Homo sapiens
tgagcagagacgggggcctcca

SEQ ID NO: 9085910 - DNA, 22 bp, Homo sapiens
tgagcagagacgggggcctcca

SEQ ID NO: 9085911 - DNA, 22 bp, Homo sapiens
ccagggctgctgggggagttga

SEQ ID NO: 9085912 - DNA, 22 bp, Homo sapiens
tgagcaggggagagcgaatgtg

SEQ ID NO: 9085913 - DNA, 22 bp, Homo sapiens
ccagggctgcctggccgtgtgt

SEQ ID NO: 9085914 - DNA, 22 bp, Homo sapiens
tgagcagtaggtctgaatagtg

SEQ ID NO: 9085915 - DNA, 21 bp, Homo sapiens
tgagcaggtgcagggaagtgg

SEQ ID NO: 9085916 - DNA, 17 bp, Homo sapiens
tgagcagtagaagatgc

SEQ ID NO: 9085917 - DNA, 22 bp, Homo sapiens
tgagcagtaacagctcacaggg

SEQ ID NO: 9085918 - DNA, 22 bp, Homo sapiens
tgagcagtaacagctcacaggg

SEQ ID NO: 9085919 - DNA, 22 bp, Homo sapiens
ccatcaatgactaataaaatag

SEQ ID NO: 9085920 - DNA, 22 bp, Homo sapiens
ccatcacagtccccatcgtgat

SEQ ID NO: 9085921 - DNA, 18 bp, Homo sapiens
ccatcaccctaactagtg

SEQ ID NO: 9085922 - DNA, 18 bp, Homo sapiens
ccatcaccctaactagtg

SEQ ID NO: 9085923 - DNA, 22 bp, Homo sapiens
ccatcagcatgggagcatgggc

SEQ ID NO: 9085924 - DNA, 22 bp, Homo sapiens
ccatcagagggctgctctgcaa

SEQ ID NO: 9085925 - DNA, 22 bp, Homo sapiens
ccatcagtgaaggagacagatt

SEQ ID NO: 9085926 - DNA, 22 bp, Homo sapiens
tgaggctgagatatcagggagg

SEQ ID NO: 9085927 - DNA, 17 bp, Homo sapiens
ccatactgacatattga

SEQ ID NO: 9085928 - DNA, 21 bp, Homo sapiens
ccatacctacctcacctggtt

SEQ ID NO: 9085929 - DNA, 22 bp, Homo sapiens
ccagttaatcactgagtcctgt

SEQ ID NO: 9085930 - DNA, 22 bp, Homo sapiens
ccatactgaggacacattgtga

SEQ ID NO: 9085931 - DNA, 22 bp, Homo sapiens
tgaggccccgaagctgaggttt

SEQ ID NO: 9085932 - DNA, 22 bp, Homo sapiens
tgaggcccagccgccctgagag

SEQ ID NO: 9085933 - DNA, 22 bp, Homo sapiens
tgaggcccagccgccctgagag

SEQ ID NO: 9085934 - DNA, 22 bp, Homo sapiens
tgaggctgacaaaagatgaggt

SEQ ID NO: 9085935 - DNA, 22 bp, Homo sapiens
tgaggctgacaaaagatgaggt

SEQ ID NO: 9085936 - DNA, 22 bp, Homo sapiens
tgaggctgacaaaagatgaggt

SEQ ID NO: 9085937 - DNA, 22 bp, Homo sapiens
tgaggctgacaaaagatgaggt

SEQ ID NO: 9085938 - DNA, 22 bp, Homo sapiens
tgaggccagtctcatcacaggc

SEQ ID NO: 9085939 - DNA, 22 bp, Homo sapiens
tgaggccagggattccatcatt

SEQ ID NO: 9085940 - DNA, 22 bp, Homo sapiens
tgaggccaggcaaaggcgatct

SEQ ID NO: 9085941 - DNA, 22 bp, Homo sapiens
tgaggccaggcaaaggcgatct

SEQ ID NO: 9085942 - DNA, 22 bp, Homo sapiens
tgaggccaggcaaaggcgatct

SEQ ID NO: 9085943 - DNA, 22 bp, Homo sapiens
tgaggccatggaactagcttgg

SEQ ID NO: 9085944 - DNA, 17 bp, Homo sapiens
tgaggccatggcaccat

SEQ ID NO: 9085945 - DNA, 22 bp, Homo sapiens
tgaggccatgcccgtgccggcc

SEQ ID NO: 9085946 - DNA, 17 bp, Homo sapiens
tgaggccatggcaccat

SEQ ID NO: 9085947 - DNA, 19 bp, Homo sapiens
tgagtttaatgcaaaactg

SEQ ID NO: 9085948 - DNA, 22 bp, Homo sapiens
tgagtttaattggagcctgaat

SEQ ID NO: 9085949 - DNA, 22 bp, Homo sapiens
tgagttcttcacattacctacg

SEQ ID NO: 9085950 - DNA, 22 bp, Homo sapiens
tgagttctttccgttaggtatg

SEQ ID NO: 9085951 - DNA, 22 bp, Homo sapiens
tgagttcttcacattacctacg

SEQ ID NO: 9085952 - DNA, 22 bp, Homo sapiens
tgataaacttagaaagaatgtt

SEQ ID NO: 9085953 - DNA, 22 bp, Homo sapiens
tgataaactggagaggtggagg

SEQ ID NO: 9085954 - DNA, 22 bp, Homo sapiens
tgagttttgtaatattcaagat

SEQ ID NO: 9085955 - DNA, 22 bp, Homo sapiens
tgagttttttcaacatatgaag

SEQ ID NO: 9085956 - DNA, 22 bp, Homo sapiens
tgagtccatagtggatccttca

SEQ ID NO: 9085957 - DNA, 22 bp, Homo sapiens
tgagtcctaaagctgtgccctt

SEQ ID NO: 9085958 - DNA, 22 bp, Homo sapiens
tgagtctgatttttctagcatt

SEQ ID NO: 9085959 - DNA, 22 bp, Homo sapiens
tgagtctgctcctggtagcaga

SEQ ID NO: 9085960 - DNA, 22 bp, Homo sapiens
ccatccagaccagtccatgggt

SEQ ID NO: 9085961 - DNA, 22 bp, Homo sapiens
ccatccatgtggcagggctggc

SEQ ID NO: 9085962 - DNA, 22 bp, Homo sapiens
ccatccctcctccaccagctag

SEQ ID NO: 9085963 - DNA, 22 bp, Homo sapiens
ccatccctcctactcacagtca

SEQ ID NO: 9085964 - DNA, 22 bp, Homo sapiens
ccatccctgagtcacaggaggg

SEQ ID NO: 9085965 - DNA, 22 bp, Homo sapiens
ccatccctgccattatagccca

SEQ ID NO: 9085966 - DNA, 22 bp, Homo sapiens
ccatccctcctccaccagctag

SEQ ID NO: 9085967 - DNA, 22 bp, Homo sapiens
ccatccctgccattatagccca

SEQ ID NO: 9085968 - DNA, 22 bp, Homo sapiens
ccatccctgggccatgtcccct

SEQ ID NO: 9085969 - DNA, 23 bp, Homo sapiens
ccatcccttggaagctggtttta

SEQ ID NO: 9085970 - DNA, 22 bp, Homo sapiens
ccatcccttcaccacagcagta

SEQ ID NO: 9085971 - DNA, 22 bp, Homo sapiens
ccatcccttctctggccagcag

SEQ ID NO: 9085972 - DNA, 22 bp, Homo sapiens
tgagtccaataggggcctggaa

SEQ ID NO: 9085973 - DNA, 22 bp, Homo sapiens
tgagtccaagagccagtgggaa

SEQ ID NO: 9085974 - DNA, 22 bp, Homo sapiens
tgagtccagatgggccagcagg

SEQ ID NO: 9085975 - DNA, 20 bp, Homo sapiens
tgagtcagctgcatgggtgg

SEQ ID NO: 9085976 - DNA, 22 bp, Homo sapiens
tgcaggaatcagaggggaagcg

SEQ ID NO: 9085977 - DNA, 22 bp, Homo sapiens
tgcaggaattttttgcagaaag

SEQ ID NO: 9085978 - DNA, 20 bp, Homo sapiens
tgcaggacagagcctgtgtg

SEQ ID NO: 9085979 - DNA, 22 bp, Homo sapiens
tgcaggaatcagaggggaagcg

SEQ ID NO: 9085980 - DNA, 22 bp, Homo sapiens
tgcaggaatattgatgaactta

SEQ ID NO: 9085981 - DNA, 22 bp, Homo sapiens
tgcaggactggggagcggaagg

SEQ ID NO: 9085982 - DNA, 22 bp, Homo sapiens
tgcaggacttcaggactctgag

SEQ ID NO: 9085983 - DNA, 22 bp, Homo sapiens
tgcaggactcaagggtagcagg

SEQ ID NO: 9085984 - DNA, 22 bp, Homo sapiens
tgcaggacagtttggaagagag

SEQ ID NO: 9085985 - DNA, 22 bp, Homo sapiens
tgcaggacattagttatgaatt

SEQ ID NO: 9085986 - DNA, 22 bp, Homo sapiens
tgcaggaccggaaccatgggat

SEQ ID NO: 9085987 - DNA, 22 bp, Homo sapiens
tgcaggaccttgatcctggact

SEQ ID NO: 9085988 - DNA, 22 bp, Homo sapiens
tgcaggaccttgatcctggact

SEQ ID NO: 9085989 - DNA, 22 bp, Homo sapiens
tgcagctgcaggagggtgggag

SEQ ID NO: 9085990 - DNA, 22 bp, Homo sapiens
tgcagctgcctagggctggctt

SEQ ID NO: 9085991 - DNA, 23 bp, Homo sapiens
tgcagctgcctctggcgggccgg

SEQ ID NO: 9085992 - DNA, 23 bp, Homo sapiens
tgcagctgcctctggcgggccgg

SEQ ID NO: 9085993 - DNA, 23 bp, Homo sapiens
tgcagctgcctctggcgggccgg

SEQ ID NO: 9085994 - DNA, 22 bp, Homo sapiens
tgcagctgcctccttcccttgt

SEQ ID NO: 9085995 - DNA, 22 bp, Homo sapiens
tgcagctgcctagggctggctt

SEQ ID NO: 9085996 - DNA, 22 bp, Homo sapiens
tgcagctgctcattctctcagt

SEQ ID NO: 9085997 - DNA, 22 bp, Homo sapiens
tgcagctgctcattctctcagt

SEQ ID NO: 9085998 - DNA, 22 bp, Homo sapiens
tgcaggaagtttcctgaacttt

SEQ ID NO: 9085999 - DNA, 22 bp, Homo sapiens
tgcaggaatagctacagagctg

SEQ ID NO: 9086000 - DNA, 22 bp, Homo sapiens
tgcaggaatagctacagagctg

SEQ ID NO: 9086001 - DNA, 22 bp, Homo sapiens
tgcagctgattaaagggcagac

SEQ ID NO: 9086002 - DNA, 20 bp, Homo sapiens
tgcagctgcaggagggtggg

SEQ ID NO: 9086003 - DNA, 22 bp, Homo sapiens
tgcagctgcaagtccaggtcag

SEQ ID NO: 9086004 - DNA, 20 bp, Homo sapiens
tgcagctgcaggagggtggg

SEQ ID NO: 9086005 - DNA, 22 bp, Homo sapiens
tgcagctgattaaagggcagac

SEQ ID NO: 9086006 - DNA, 22 bp, Homo sapiens
tgcagctgattaaagggcagac

SEQ ID NO: 9086007 - DNA, 22 bp, Homo sapiens
tgcagctgattaaagggcagac

SEQ ID NO: 9086008 - DNA, 22 bp, Homo sapiens
cccagagggtggaggttgcagt

SEQ ID NO: 9086009 - DNA, 22 bp, Homo sapiens
tgcagccaccacctctgctgaa

SEQ ID NO: 9086010 - DNA, 22 bp, Homo sapiens
tgcagccacatgacctgggtct

SEQ ID NO: 9086011 - DNA, 22 bp, Homo sapiens
tgcagccaattcattcattctt

SEQ ID NO: 9086012 - DNA, 22 bp, Homo sapiens
cccagaggaggcaaagctctgt

SEQ ID NO: 9086013 - DNA, 22 bp, Homo sapiens
cccagaggaggatctcggcccg

SEQ ID NO: 9086014 - DNA, 22 bp, Homo sapiens
cccagaggaggatctcggcccg

SEQ ID NO: 9086015 - DNA, 22 bp, Homo sapiens
cccagagggaagggaatgaggt

SEQ ID NO: 9086016 - DNA, 22 bp, Homo sapiens
cccagagggaagggaatgaggt

SEQ ID NO: 9086017 - DNA, 22 bp, Homo sapiens
cccagagggctgaggatatgaa

SEQ ID NO: 9086018 - DNA, 22 bp, Homo sapiens
cccagaggggtcgtctgagggg

SEQ ID NO: 9086019 - DNA, 22 bp, Homo sapiens
cccagaggggtcgtctgagggg

SEQ ID NO: 9086020 - DNA, 22 bp, Homo sapiens
tgcaggcattggtgagagaagc

SEQ ID NO: 9086021 - DNA, 22 bp, Homo sapiens
tgcaggcataaccgatgttgat

SEQ ID NO: 9086022 - DNA, 22 bp, Homo sapiens
tgcaggcaggggatgagcagcc

SEQ ID NO: 9086023 - DNA, 22 bp, Homo sapiens
tgcaggcaggggatgagcagcc

SEQ ID NO: 9086024 - DNA, 21 bp, Homo sapiens
tgcaggcaggcagagatgctg

SEQ ID NO: 9086025 - DNA, 22 bp, Homo sapiens
tgcaggcagggccagcgtgagg

SEQ ID NO: 9086026 - DNA, 22 bp, Homo sapiens
tgcaggcagggccagcgtgagg

SEQ ID NO: 9086027 - DNA, 21 bp, Homo sapiens
tgcaggcaggcagagatgctg

SEQ ID NO: 9086028 - DNA, 21 bp, Homo sapiens
tgcaggcaggcagagatgctg

SEQ ID NO: 9086029 - DNA, 22 bp, Homo sapiens
cccagcagcttgcacagtgctg

SEQ ID NO: 9086030 - DNA, 22 bp, Homo sapiens
cccagcagcttgcacagtgctg

SEQ ID NO: 9086031 - DNA, 22 bp, Homo sapiens
cccagcagcctggatgttcttt

SEQ ID NO: 9086032 - DNA, 22 bp, Homo sapiens
tgcaggcctcacacctggcacc

SEQ ID NO: 9086033 - DNA, 22 bp, Homo sapiens
tgcaggccggccctaggcctca

SEQ ID NO: 9086034 - DNA, 22 bp, Homo sapiens
tgcaggcctatggtggggcccc

SEQ ID NO: 9086035 - DNA, 22 bp, Homo sapiens
tgcaggcccagtgtagaggctc

SEQ ID NO: 9086036 - DNA, 22 bp, Homo sapiens
tgcaggccggccctaggcctca

SEQ ID NO: 9086037 - DNA, 22 bp, Homo sapiens
cccagcaggcatgttgggagga

SEQ ID NO: 9086038 - DNA, 22 bp, Homo sapiens
cccagcaggcatgttgggagga

SEQ ID NO: 9086039 - DNA, 22 bp, Homo sapiens
cccagcaggcatgttgggagga

SEQ ID NO: 9086040 - DNA, 22 bp, Homo sapiens
cccagcaggtcggtgctgcctg

SEQ ID NO: 9086041 - DNA, 22 bp, Homo sapiens
cccagcagggtctctgtgtcta

SEQ ID NO: 9086042 - DNA, 22 bp, Homo sapiens
tgcactccaggctgggtgacag

SEQ ID NO: 9086043 - DNA, 22 bp, Homo sapiens
tgcactccaggctgggtgacag

SEQ ID NO: 9086044 - DNA, 22 bp, Homo sapiens
tgcactccaggctgggtgacag

SEQ ID NO: 9086045 - DNA, 22 bp, Homo sapiens
tgcacagatgggcttgttcata

SEQ ID NO: 9086046 - DNA, 22 bp, Homo sapiens
tgcactatttcgccatggttgt

SEQ ID NO: 9086047 - DNA, 22 bp, Homo sapiens
cccaagggagtgcctggtcaac

SEQ ID NO: 9086048 - DNA, 22 bp, Homo sapiens
tgcacagatctggtggcaagga

SEQ ID NO: 9086049 - DNA, 22 bp, Homo sapiens
tgcacagatctggtggcaagga

SEQ ID NO: 9086050 - DNA, 22 bp, Homo sapiens
cccaaggaagacgcttgtgata

SEQ ID NO: 9086051 - DNA, 23 bp, Homo sapiens
cccaagcctgtgccctctgactc

SEQ ID NO: 9086052 - DNA, 23 bp, Homo sapiens
cccaagcctgtgccctctgactc

SEQ ID NO: 9086053 - DNA, 21 bp, Homo sapiens
tgcaatccagcctgggcgaca

SEQ ID NO: 9086054 - DNA, 22 bp, Homo sapiens
tgcaatcaggtaccatttgatt

SEQ ID NO: 9086055 - DNA, 22 bp, Homo sapiens
cccaagccagaccctgaccctg

SEQ ID NO: 9086056 - DNA, 22 bp, Homo sapiens
tgatacagaattgatatctgag

SEQ ID NO: 9086057 - DNA, 22 bp, Homo sapiens
tgatacagagaaagcatctttt

SEQ ID NO: 9086058 - DNA, 22 bp, Homo sapiens
tgatacagagcaagcatctttt

SEQ ID NO: 9086059 - DNA, 22 bp, Homo sapiens
tgcaaatattccatgctgttca

SEQ ID NO: 9086060 - DNA, 22 bp, Homo sapiens
tgataatgttcgagaatgaaga

SEQ ID NO: 9086061 - DNA, 22 bp, Homo sapiens
tgataatattttgaatcataag

SEQ ID NO: 9086062 - DNA, 22 bp, Homo sapiens
tgataaatccatgtaaatggta

SEQ ID NO: 9086063 - DNA, 22 bp, Homo sapiens
tgcaaatattgggacagtctag

SEQ ID NO: 9086064 - DNA, 22 bp, Homo sapiens
tgcaatatgttgcattgtatgg

SEQ ID NO: 9086065 - DNA, 22 bp, Homo sapiens
tgcaatatgttgcattgtatgg

SEQ ID NO: 9086066 - DNA, 22 bp, Homo sapiens
tgcaatatttggcactgagatg

SEQ ID NO: 9086067 - DNA, 22 bp, Homo sapiens
tgcaatattttatatccaacaa

SEQ ID NO: 9086068 - DNA, 22 bp, Homo sapiens
tgcaatattttatatccaacaa

SEQ ID NO: 9086069 - DNA, 22 bp, Homo sapiens
tgcaatacatacttagacccag

SEQ ID NO: 9086070 - DNA, 21 bp, Homo sapiens
tgcaatatatatttgcctgaa

SEQ ID NO: 9086071 - DNA, 22 bp, Homo sapiens
tgcaataatgtatgtcactccc

SEQ ID NO: 9086072 - DNA, 22 bp, Homo sapiens
tgcaatactcatcattggagat

SEQ ID NO: 9086073 - DNA, 22 bp, Homo sapiens
tgcaatatcagattcaacacat

SEQ ID NO: 9086074 - DNA, 22 bp, Homo sapiens
tgcaatatgttgcattgtatgg

SEQ ID NO: 9086075 - DNA, 23 bp, Homo sapiens
tgcaatatgtcagtgcaaagtgg

SEQ ID NO: 9086076 - DNA, 22 bp, Homo sapiens
tgcaataaagtgctataaatcc

SEQ ID NO: 9086077 - DNA, 22 bp, Homo sapiens
tgcaataaggagtaatagtaaa

SEQ ID NO: 9086078 - DNA, 22 bp, Homo sapiens
tgcaataaggagtaatagtaaa

SEQ ID NO: 9086079 - DNA, 22 bp, Homo sapiens
tgcaataagttgtgttatcact

SEQ ID NO: 9086080 - DNA, 22 bp, Homo sapiens
tgcaataagtattgcttacatg

SEQ ID NO: 9086081 - DNA, 22 bp, Homo sapiens
tgcagagaagaggacagttcta

SEQ ID NO: 9086082 - DNA, 22 bp, Homo sapiens
tgcactggggtcccagcgcacg

SEQ ID NO: 9086083 - DNA, 22 bp, Homo sapiens
tgcactgctttgcaaagctgag

SEQ ID NO: 9086084 - DNA, 23 bp, Homo sapiens
cccagaggagcagggcgtgagat

SEQ ID NO: 9086085 - DNA, 19 bp, Homo sapiens
cccagaggaatgcctggaa

SEQ ID NO: 9086086 - DNA, 18 bp, Homo sapiens
cccagaggaatgcctgga

SEQ ID NO: 9086087 - DNA, 18 bp, Homo sapiens
cccagaggaatgcctgga

SEQ ID NO: 9086088 - DNA, 22 bp, Homo sapiens
cccagagctgggtgggcagcgg

SEQ ID NO: 9086089 - DNA, 22 bp, Homo sapiens
cccagagctccggtcctgccca

SEQ ID NO: 9086090 - DNA, 22 bp, Homo sapiens
cccagagctgagggggcacgtt

SEQ ID NO: 9086091 - DNA, 17 bp, Homo sapiens
cccagagatgctgcctt

SEQ ID NO: 9086092 - DNA, 22 bp, Homo sapiens
cccagagcctcattctgttggg

SEQ ID NO: 9086093 - DNA, 22 bp, Homo sapiens
cccagagatgtcctgagtgata

SEQ ID NO: 9086094 - DNA, 17 bp, Homo sapiens
cccagagatgctgcctt

SEQ ID NO: 9086095 - DNA, 22 bp, Homo sapiens
cccagagatgggaggtgatcgg

SEQ ID NO: 9086096 - DNA, 22 bp, Homo sapiens
cccagagatgggaggtgatcgg

SEQ ID NO: 9086097 - DNA, 22 bp, Homo sapiens
ccaggagcaggagctggacaga

SEQ ID NO: 9086098 - DNA, 22 bp, Homo sapiens
ccaggagcagggctggctgcac

SEQ ID NO: 9086099 - DNA, 22 bp, Homo sapiens
ccaggagcagggctggctgcac

SEQ ID NO: 9086100 - DNA, 22 bp, Homo sapiens
ccaggagcagggctggctgcac

SEQ ID NO: 9086101 - DNA, 22 bp, Homo sapiens
ccaggagccactcaggcccaca

SEQ ID NO: 9086102 - DNA, 22 bp, Homo sapiens
ccaggagccactcaggcccaca

SEQ ID NO: 9086103 - DNA, 19 bp, Homo sapiens
ccaggagcagtggtgagct

SEQ ID NO: 9086104 - DNA, 22 bp, Homo sapiens
ccaggagcattaagagaacata

SEQ ID NO: 9086105 - DNA, 22 bp, Homo sapiens
ccaggagcagagtaggtgttca

SEQ ID NO: 9086106 - DNA, 22 bp, Homo sapiens
ccaggagcagatatggacataa

SEQ ID NO: 9086107 - DNA, 22 bp, Homo sapiens
ccaggagcagatatggacataa

SEQ ID NO: 9086108 - DNA, 22 bp, Homo sapiens
ccaggagcaccaggcctgtgcc

SEQ ID NO: 9086109 - DNA, 22 bp, Homo sapiens
ccaggagcaccaggcctgtgcc

SEQ ID NO: 9086110 - DNA, 22 bp, Homo sapiens
ccaggagcagccggcccacctg

SEQ ID NO: 9086111 - DNA, 22 bp, Homo sapiens
ccaggagcaggagctgcagctg

SEQ ID NO: 9086112 - DNA, 21 bp, Homo sapiens
tctgtggcggactctaggccc

SEQ ID NO: 9086113 - DNA, 22 bp, Homo sapiens
tctgttcagaagaggtgaaagt

SEQ ID NO: 9086114 - DNA, 19 bp, Homo sapiens
tctgttcacattgtttcgc

SEQ ID NO: 9086115 - DNA, 17 bp, Homo sapiens
tctgttcaagtgagagg

SEQ ID NO: 9086116 - DNA, 22 bp, Homo sapiens
tctgttcaagactgaggtgaca

SEQ ID NO: 9086117 - DNA, 22 bp, Homo sapiens
tctgttcatagtagtgtatatg

SEQ ID NO: 9086118 - DNA, 22 bp, Homo sapiens
tctgttcatacagagtatagta

SEQ ID NO: 9086119 - DNA, 22 bp, Homo sapiens
tctgttcagttgtaccttcccc

SEQ ID NO: 9086120 - DNA, 22 bp, Homo sapiens
tctgttcctggtctctggagct

SEQ ID NO: 9086121 - DNA, 17 bp, Homo sapiens
tctgttcatgcatacct

SEQ ID NO: 9086122 - DNA, 22 bp, Homo sapiens
tctgttcaggtttcagagaact

SEQ ID NO: 9086123 - DNA, 22 bp, Homo sapiens
tctgttcatgaaatatcttttt

SEQ ID NO: 9086124 - DNA, 22 bp, Homo sapiens
tctgttctattggtctatgtgt

SEQ ID NO: 9086125 - DNA, 22 bp, Homo sapiens
tctgttcttcctacattcacat

SEQ ID NO: 9086126 - DNA, 22 bp, Homo sapiens
tctgggctctgcgaagcccttc

SEQ ID NO: 9086127 - DNA, 22 bp, Homo sapiens
tctgggctctgggaattaggga

SEQ ID NO: 9086128 - DNA, 22 bp, Homo sapiens
tctgggctctgggaattaggga

SEQ ID NO: 9086129 - DNA, 22 bp, Homo sapiens
tctgggctatatggtctctgct

SEQ ID NO: 9086130 - DNA, 22 bp, Homo sapiens
tctgggctcacgagtctggaca

SEQ ID NO: 9086131 - DNA, 22 bp, Homo sapiens
tctgggctcacgagtctggaca

SEQ ID NO: 9086132 - DNA, 22 bp, Homo sapiens
tctgggctatatggtctctgct

SEQ ID NO: 9086133 - DNA, 22 bp, Homo sapiens
tctgggcctgtctcagagctgg

SEQ ID NO: 9086134 - DNA, 22 bp, Homo sapiens
ccagcaccttgatcttggagtt

SEQ ID NO: 9086135 - DNA, 22 bp, Homo sapiens
ccagcaccttgatcttggagtt

SEQ ID NO: 9086136 - DNA, 22 bp, Homo sapiens
ccagcaccttgatcttggagtt

SEQ ID NO: 9086137 - DNA, 22 bp, Homo sapiens
tctgggccctaaaccagctcta

SEQ ID NO: 9086138 - DNA, 22 bp, Homo sapiens
tctgggccctgagatgttcttc

SEQ ID NO: 9086139 - DNA, 22 bp, Homo sapiens
ccaggagagcaaaggtcactct

SEQ ID NO: 9086140 - DNA, 22 bp, Homo sapiens
ccaggagcaaagatcactggga

SEQ ID NO: 9086141 - DNA, 22 bp, Homo sapiens
ccaggagagcaaaggtcactct

SEQ ID NO: 9086142 - DNA, 22 bp, Homo sapiens
ccaggagcaacttgaaggcaag

SEQ ID NO: 9086143 - DNA, 22 bp, Homo sapiens
tctggggagtcaaagagacctg

SEQ ID NO: 9086144 - DNA, 22 bp, Homo sapiens
tctggggagtgcctaagtggaa

SEQ ID NO: 9086145 - DNA, 22 bp, Homo sapiens
tctggggatgaggacctagatg

SEQ ID NO: 9086146 - DNA, 22 bp, Homo sapiens
tctgggcttttgcactggccat

SEQ ID NO: 9086147 - DNA, 22 bp, Homo sapiens
tctgggctctgtcagcacctct

SEQ ID NO: 9086148 - DNA, 22 bp, Homo sapiens
tctgggctctgtcagcacctct

SEQ ID NO: 9086149 - DNA, 22 bp, Homo sapiens
tctgggctctgtcagcacctct

SEQ ID NO: 9086150 - DNA, 22 bp, Homo sapiens
tctgggcttttgcactggccat

SEQ ID NO: 9086151 - DNA, 22 bp, Homo sapiens
tctggggaccatggcatctaaa

SEQ ID NO: 9086152 - DNA, 22 bp, Homo sapiens
tctggggaccatggcatctaaa

SEQ ID NO: 9086153 - DNA, 22 bp, Homo sapiens
tctggggagcagccctggtgag

SEQ ID NO: 9086154 - DNA, 22 bp, Homo sapiens
tctggggagggagccacaggtc

SEQ ID NO: 9086155 - DNA, 22 bp, Homo sapiens
tctggggagggagccacaggtc

SEQ ID NO: 9086156 - DNA, 17 bp, Homo sapiens
tcttctcttccagtctt

SEQ ID NO: 9086157 - DNA, 22 bp, Homo sapiens
tcttctggatcgatcacattgt

SEQ ID NO: 9086158 - DNA, 22 bp, Homo sapiens
tcttctctgtggcctggtggtg

SEQ ID NO: 9086159 - DNA, 22 bp, Homo sapiens
tcttctctcctgcttggcagaa

SEQ ID NO: 9086160 - DNA, 22 bp, Homo sapiens
ccaggcagcctgctccattctg

SEQ ID NO: 9086161 - DNA, 22 bp, Homo sapiens
ccaggcagctctgatttatgtc

SEQ ID NO: 9086162 - DNA, 22 bp, Homo sapiens
ccaggcagccaagtgtgtgtgt

SEQ ID NO: 9086163 - DNA, 22 bp, Homo sapiens
ccaggcaggcagcgttctcagg

SEQ ID NO: 9086164 - DNA, 22 bp, Homo sapiens
ccaggcaggcagcgttctcagg

SEQ ID NO: 9086165 - DNA, 22 bp, Homo sapiens
ccaggcaggcgatggtgcagtg

SEQ ID NO: 9086166 - DNA, 22 bp, Homo sapiens
ccaggcctcctgtgagtggacc

SEQ ID NO: 9086167 - DNA, 22 bp, Homo sapiens
ccaggcctcctgtgagtggacc

SEQ ID NO: 9086168 - DNA, 22 bp, Homo sapiens
ccaggcctcctgtgagtggacc

SEQ ID NO: 9086169 - DNA, 22 bp, Homo sapiens
ccaggcctcctgtgagtggacc

SEQ ID NO: 9086170 - DNA, 22 bp, Homo sapiens
ccaggcctcctgtgagtggacc

SEQ ID NO: 9086171 - DNA, 19 bp, Homo sapiens
ccaggcctcctgggaggtc

SEQ ID NO: 9086172 - DNA, 19 bp, Homo sapiens
ccaggcctcctgggaggtc

SEQ ID NO: 9086173 - DNA, 19 bp, Homo sapiens
ccaggcctcctgggaggtc

SEQ ID NO: 9086174 - DNA, 22 bp, Homo sapiens
ccaggcaggcgatggtgcagtg

SEQ ID NO: 9086175 - DNA, 22 bp, Homo sapiens
ccaggcccccgagcagaagaca

SEQ ID NO: 9086176 - DNA, 22 bp, Homo sapiens
ccaggcccccgagcagaagaca

SEQ ID NO: 9086177 - DNA, 22 bp, Homo sapiens
ccaggcctcccttttccagcca

SEQ ID NO: 9086178 - DNA, 22 bp, Homo sapiens
ccaggcctcccttttccagcca

SEQ ID NO: 9086179 - DNA, 22 bp, Homo sapiens
ccaggcctcccttttccagcca

SEQ ID NO: 9086180 - DNA, 22 bp, Homo sapiens
ccaggcctcccttttccagcca

SEQ ID NO: 9086181 - DNA, 22 bp, Homo sapiens
ccaggcagagtgctccagaaag

SEQ ID NO: 9086182 - DNA, 22 bp, Homo sapiens
ccaggcagagtgctccagaaag

SEQ ID NO: 9086183 - DNA, 22 bp, Homo sapiens
ccaggcagagggatccccatcc

SEQ ID NO: 9086184 - DNA, 22 bp, Homo sapiens
tcttaccaggagccctctgagg

SEQ ID NO: 9086185 - DNA, 22 bp, Homo sapiens
tcttacaagaaataagccaatg

SEQ ID NO: 9086186 - DNA, 22 bp, Homo sapiens
tcttaatgctagccaatagaga

SEQ ID NO: 9086187 - DNA, 22 bp, Homo sapiens
ccaggaggcggaggttgcagtg

SEQ ID NO: 9086188 - DNA, 22 bp, Homo sapiens
ccaggaggcggaggttgcagcg

SEQ ID NO: 9086189 - DNA, 22 bp, Homo sapiens
ccaggaggcggaggttgcagtg

SEQ ID NO: 9086190 - DNA, 22 bp, Homo sapiens
ccaggaggcggaggttgcagtg

SEQ ID NO: 9086191 - DNA, 22 bp, Homo sapiens
ccaggaggcggaggttgcagtg

SEQ ID NO: 9086192 - DNA, 21 bp, Homo sapiens
ccaggcagagctgtgagttct

SEQ ID NO: 9086193 - DNA, 22 bp, Homo sapiens
ccaggcagaatgaaacccctgt

SEQ ID NO: 9086194 - DNA, 22 bp, Homo sapiens
ccaggcctgattgggaatcttg

SEQ ID NO: 9086195 - DNA, 19 bp, Homo sapiens
ccaggcctctggggcctgt

SEQ ID NO: 9086196 - DNA, 19 bp, Homo sapiens
ccaggcctctggggcctgt

SEQ ID NO: 9086197 - DNA, 22 bp, Homo sapiens
ccaggcctgattgggaatcttg

SEQ ID NO: 9086198 - DNA, 22 bp, Homo sapiens
ccaggcctgattgggaatcttg

SEQ ID NO: 9086199 - DNA, 22 bp, Homo sapiens
ccaggcctctggctgcttagtc

SEQ ID NO: 9086200 - DNA, 19 bp, Homo sapiens
ccaggcctctggggcctgt

SEQ ID NO: 9086201 - DNA, 22 bp, Homo sapiens
ccaggcctctggctgcttagtc

SEQ ID NO: 9086202 - DNA, 22 bp, Homo sapiens
ccaggcctctggctgcttagtc

SEQ ID NO: 9086203 - DNA, 22 bp, Homo sapiens
ccaggcctctggctgcttagtc

SEQ ID NO: 9086204 - DNA, 23 bp, Homo sapiens
ccaggcctctcagagggtgtgcc

SEQ ID NO: 9086205 - DNA, 23 bp, Homo sapiens
ccaggcctctcagagggtgtgcc

SEQ ID NO: 9086206 - DNA, 22 bp, Homo sapiens
ccaggcctctggctgcttagtc

SEQ ID NO: 9086207 - DNA, 23 bp, Homo sapiens
ccaggcctctcagagggtgtgcc

SEQ ID NO: 9086208 - DNA, 23 bp, Homo sapiens
ccaggcctctcagagggtgtgcc

SEQ ID NO: 9086209 - DNA, 22 bp, Homo sapiens
tcttgcacttcatgaatatgtt

SEQ ID NO: 9086210 - DNA, 19 bp, Homo sapiens
tcttgcagccccagcaggc

SEQ ID NO: 9086211 - DNA, 19 bp, Homo sapiens
tcttgcagccccagcaggc

SEQ ID NO: 9086212 - DNA, 22 bp, Homo sapiens
tcttgcagaggcactgtgtcag

SEQ ID NO: 9086213 - DNA, 22 bp, Homo sapiens
tcttgcagactcacaaggtact

SEQ ID NO: 9086214 - DNA, 22 bp, Homo sapiens
tcttgcatacactatatgtaca

SEQ ID NO: 9086215 - DNA, 22 bp, Homo sapiens
tctttgtaaatgcctagcataa

SEQ ID NO: 9086216 - DNA, 22 bp, Homo sapiens
tctttgtaaatgcctagcataa

SEQ ID NO: 9086217 - DNA, 22 bp, Homo sapiens
tcttttcttgcattattgcact

SEQ ID NO: 9086218 - DNA, 22 bp, Homo sapiens
tcttttcttgcattattgcact

SEQ ID NO: 9086219 - DNA, 22 bp, Homo sapiens
tcttttgggttcttatgattta

SEQ ID NO: 9086220 - DNA, 22 bp, Homo sapiens
tgaaacaaatttggaaaatcta

SEQ ID NO: 9086221 - DNA, 22 bp, Homo sapiens
tgaaacaagtttaagggatcta

SEQ ID NO: 9086222 - DNA, 22 bp, Homo sapiens
tgaaacaagatccacagacttg

SEQ ID NO: 9086223 - DNA, 22 bp, Homo sapiens
tgaaacagagtggatacagtga

SEQ ID NO: 9086224 - DNA, 22 bp, Homo sapiens
tgaaatgacagtcttaagctct

SEQ ID NO: 9086225 - DNA, 22 bp, Homo sapiens
tgaaatgaatgtgattcgatag

SEQ ID NO: 9086226 - DNA, 22 bp, Homo sapiens
ccaggcttcctaatgtgtgcag

SEQ ID NO: 9086227 - DNA, 22 bp, Homo sapiens
ccaggcttcctaatgtgtgcag

SEQ ID NO: 9086228 - DNA, 22 bp, Homo sapiens
ccaggctgtggtttagatagag

SEQ ID NO: 9086229 - DNA, 22 bp, Homo sapiens
ccaggctgtggtttagatagag

SEQ ID NO: 9086230 - DNA, 22 bp, Homo sapiens
ccaggctgtggtttagatagag

SEQ ID NO: 9086231 - DNA, 22 bp, Homo sapiens
ccaggctgtggtttagatagag

SEQ ID NO: 9086232 - DNA, 22 bp, Homo sapiens
ccaggctgttttcaaacttggg

SEQ ID NO: 9086233 - DNA, 22 bp, Homo sapiens
ccaggctgtggtttagatagag

SEQ ID NO: 9086234 - DNA, 22 bp, Homo sapiens
ccaggctgtgcttttcataaat

SEQ ID NO: 9086235 - DNA, 22 bp, Homo sapiens
ccaggctgtgcttttcataaat

SEQ ID NO: 9086236 - DNA, 22 bp, Homo sapiens
ccaggctgtaagagtgatgttg

SEQ ID NO: 9086237 - DNA, 22 bp, Homo sapiens
ccaggctgtaagagtgatgttg

SEQ ID NO: 9086238 - DNA, 21 bp, Homo sapiens
ccaggctgggagggcagttcc

SEQ ID NO: 9086239 - DNA, 22 bp, Homo sapiens
ccagggagggtcctgtggcttc

SEQ ID NO: 9086240 - DNA, 22 bp, Homo sapiens
ccagggagtttccaatctgaga

SEQ ID NO: 9086241 - DNA, 22 bp, Homo sapiens
tgaaatgagcatttattcttta

SEQ ID NO: 9086242 - DNA, 22 bp, Homo sapiens
ccagggaagattagaagccact

SEQ ID NO: 9086243 - DNA, 22 bp, Homo sapiens
ccagggaagattagaagccact

SEQ ID NO: 9086244 - DNA, 22 bp, Homo sapiens
ccagggaagctggtcacgcagg

SEQ ID NO: 9086245 - DNA, 22 bp, Homo sapiens
tgaaatgagataatttaagtgc

SEQ ID NO: 9086246 - DNA, 22 bp, Homo sapiens
tgaaatgagatagataatcagg

SEQ ID NO: 9086247 - DNA, 22 bp, Homo sapiens
ccagggcaacgctgtctcagag

SEQ ID NO: 9086248 - DNA, 22 bp, Homo sapiens
ccagggatgtggcagcaccata

SEQ ID NO: 9086249 - DNA, 22 bp, Homo sapiens
ccagggcaattatttggagggt

SEQ ID NO: 9086250 - DNA, 22 bp, Homo sapiens
ccagggcaacgctgtctcagag

SEQ ID NO: 9086251 - DNA, 22 bp, Homo sapiens
ccagggcacgttgggacagtac

SEQ ID NO: 9086252 - DNA, 22 bp, Homo sapiens
ccagggcaggggctggagttca

SEQ ID NO: 9086253 - DNA, 19 bp, Homo sapiens
tgaagtcctaacctccagt

SEQ ID NO: 9086254 - DNA, 22 bp, Homo sapiens
tgaagtcccaaggaggtttcaa

SEQ ID NO: 9086255 - DNA, 22 bp, Homo sapiens
tgaagtaggcagcatgctgaga

SEQ ID NO: 9086256 - DNA, 22 bp, Homo sapiens
ccagggcatcacatccagtgtt

SEQ ID NO: 9086257 - DNA, 22 bp, Homo sapiens
ccagggcagtgggagaaggtgc

SEQ ID NO: 9086258 - DNA, 22 bp, Homo sapiens
ccagggcagtgggagaaggtgc

SEQ ID NO: 9086259 - DNA, 22 bp, Homo sapiens
tgaaggtgtctttgtgaacatc

SEQ ID NO: 9086260 - DNA, 22 bp, Homo sapiens
tgaagttagaactatgaggata

SEQ ID NO: 9086261 - DNA, 23 bp, Homo sapiens
ccagggcccctacaccactgtcc

SEQ ID NO: 9086262 - DNA, 17 bp, Homo sapiens
tgaagttaggctgcaga

SEQ ID NO: 9086263 - DNA, 22 bp, Homo sapiens
ccagggcctacagcttaagtcc

SEQ ID NO: 9086264 - DNA, 22 bp, Homo sapiens
ccagggctccattgctcatcct

SEQ ID NO: 9086265 - DNA, 22 bp, Homo sapiens
ccagggctccattgctcatcct

SEQ ID NO: 9086266 - DNA, 22 bp, Homo sapiens
ccagggctctatgagggtggag

SEQ ID NO: 9086267 - DNA, 22 bp, Homo sapiens
ccagggctgccgcatccctggt

SEQ ID NO: 9086268 - DNA, 22 bp, Homo sapiens
ccagggctgccgcatccctggt

SEQ ID NO: 9086269 - DNA, 22 bp, Homo sapiens
gaaacacatatgaacagttgat

SEQ ID NO: 9086270 - DNA, 22 bp, Homo sapiens
gaaacacatatgaacagttgat

SEQ ID NO: 9086271 - DNA, 22 bp, Homo sapiens
gaaacaatttttgttgtctaag

SEQ ID NO: 9086272 - DNA, 22 bp, Homo sapiens
gaaacacatgcagctccataga

SEQ ID NO: 9086273 - DNA, 22 bp, Homo sapiens
gaaacagcacgtttggagagat

SEQ ID NO: 9086274 - DNA, 22 bp, Homo sapiens
gaaacagattaacagcatattt

SEQ ID NO: 9086275 - DNA, 22 bp, Homo sapiens
gaaagataatcaattactcctt

SEQ ID NO: 9086276 - DNA, 22 bp, Homo sapiens
gaaagcatgtagcctgtatcca

SEQ ID NO: 9086277 - DNA, 22 bp, Homo sapiens
gaaagcatgtagcctgtatcca

SEQ ID NO: 9086278 - DNA, 22 bp, Homo sapiens
gaaagctaaatgaggtcttaca

SEQ ID NO: 9086279 - DNA, 18 bp, Homo sapiens
gaaagccatgcagcagtg

SEQ ID NO: 9086280 - DNA, 22 bp, Homo sapiens
gaaaatttctgccacatgtgtg

SEQ ID NO: 9086281 - DNA, 22 bp, Homo sapiens
gaaacaatacttgtcctcacta

SEQ ID NO: 9086282 - DNA, 22 bp, Homo sapiens
gaaacaatcatcatgtgatttg

SEQ ID NO: 9086283 - DNA, 22 bp, Homo sapiens
gaaaatttagaactgaacttct

SEQ ID NO: 9086284 - DNA, 22 bp, Homo sapiens
gaaaatttaattctcttctgtg

SEQ ID NO: 9086285 - DNA, 22 bp, Homo sapiens
gaaaatacttcagtgttctggc

SEQ ID NO: 9086286 - DNA, 22 bp, Homo sapiens
gaaaatacttcagtgttctggc

SEQ ID NO: 9086287 - DNA, 22 bp, Homo sapiens
cttttgcaccttttaagtaatg

SEQ ID NO: 9086288 - DNA, 22 bp, Homo sapiens
gaaaattattgaaaatggctct

SEQ ID NO: 9086289 - DNA, 22 bp, Homo sapiens
gaaaattattgaaaatggctct

SEQ ID NO: 9086290 - DNA, 22 bp, Homo sapiens
gaaaatgtttgtccggagctga

SEQ ID NO: 9086291 - DNA, 22 bp, Homo sapiens
gaaaatgtttgtccggagctga

SEQ ID NO: 9086292 - DNA, 22 bp, Homo sapiens
gaaaatgtttcctgttatttgc

SEQ ID NO: 9086293 - DNA, 22 bp, Homo sapiens
cttttcctcaggaggagacgcg

SEQ ID NO: 9086294 - DNA, 22 bp, Homo sapiens
cttttctagagccgcagcccta

SEQ ID NO: 9086295 - DNA, 21 bp, Homo sapiens
cttttctagtcccagccccgc

SEQ ID NO: 9086296 - DNA, 22 bp, Homo sapiens
cttttctgtatcaaaaggatta

SEQ ID NO: 9086297 - DNA, 22 bp, Homo sapiens
cttttcttactcccgcaaggca

SEQ ID NO: 9086298 - DNA, 22 bp, Homo sapiens
cttttcttatgtggacgtacct

SEQ ID NO: 9086299 - DNA, 22 bp, Homo sapiens
cttttcttatgtggacgtacct

SEQ ID NO: 9086300 - DNA, 22 bp, Homo sapiens
cttttcttactcccgcaaggca

SEQ ID NO: 9086301 - DNA, 22 bp, Homo sapiens
cttttcttctcacggctgtcag

SEQ ID NO: 9086302 - DNA, 22 bp, Homo sapiens
cttttcttgtattggatgcccc

SEQ ID NO: 9086303 - DNA, 22 bp, Homo sapiens
cttttcttgtattggatgcccc

SEQ ID NO: 9086304 - DNA, 22 bp, Homo sapiens
ctttgcaaaagttaattgttga

SEQ ID NO: 9086305 - DNA, 23 bp, Homo sapiens
ctttgcaaaaacattagtcagtg

SEQ ID NO: 9086306 - DNA, 23 bp, Homo sapiens
ctttgcaaaaacattagtcagtg

SEQ ID NO: 9086307 - DNA, 22 bp, Homo sapiens
ctttgcaaacgattaccacatg

SEQ ID NO: 9086308 - DNA, 22 bp, Homo sapiens
ctttgcaaacgattaccacatg

SEQ ID NO: 9086309 - DNA, 22 bp, Homo sapiens
ctttgcaaagtctttggcaaga

SEQ ID NO: 9086310 - DNA, 19 bp, Homo sapiens
ctttgcaaagccctgtgta

SEQ ID NO: 9086311 - DNA, 22 bp, Homo sapiens
ctttgcaaactgtcacactttc

SEQ ID NO: 9086312 - DNA, 22 bp, Homo sapiens
ctttgcaagtgctttgtagtcc

SEQ ID NO: 9086313 - DNA, 22 bp, Homo sapiens
ctttgcagaaataaacttgatg

SEQ ID NO: 9086314 - DNA, 22 bp, Homo sapiens
ctttgcaatagaggcacacatg

SEQ ID NO: 9086315 - DNA, 22 bp, Homo sapiens
ctttgcaatagaggcacacatg

SEQ ID NO: 9086316 - DNA, 22 bp, Homo sapiens
ctttgcaagggatttcatgtct

SEQ ID NO: 9086317 - DNA, 22 bp, Homo sapiens
ctttgcaagggatttcatgtct

SEQ ID NO: 9086318 - DNA, 21 bp, Homo sapiens
ctttgcaagatgtctatgaaa

SEQ ID NO: 9086319 - DNA, 17 bp, Homo sapiens
ctttgcagcagacatgt

SEQ ID NO: 9086320 - DNA, 22 bp, Homo sapiens
ctttgcagcaatttctgttaaa

SEQ ID NO: 9086321 - DNA, 22 bp, Homo sapiens
ctttgcagaaataaacttgatg

SEQ ID NO: 9086322 - DNA, 22 bp, Homo sapiens
ctttgcagatttgtttagtgct

SEQ ID NO: 9086323 - DNA, 22 bp, Homo sapiens
ctttgcagaagaaacctacaaa

SEQ ID NO: 9086324 - DNA, 22 bp, Homo sapiens
ctttgcagagggggtgggagct

SEQ ID NO: 9086325 - DNA, 22 bp, Homo sapiens
ctttgcagaagaaacctacaaa

SEQ ID NO: 9086326 - DNA, 21 bp, Homo sapiens
cttttacattcagtcatgatg

SEQ ID NO: 9086327 - DNA, 22 bp, Homo sapiens
ctttgcagttagcctaggattg

SEQ ID NO: 9086328 - DNA, 18 bp, Homo sapiens
ctttgcagttacagggca

SEQ ID NO: 9086329 - DNA, 22 bp, Homo sapiens
ctttgcagttagcctaggattg

SEQ ID NO: 9086330 - DNA, 22 bp, Homo sapiens
ctttgcagtgattgttcttgga

SEQ ID NO: 9086331 - DNA, 22 bp, Homo sapiens
ctttgcagtgaatccataaata

SEQ ID NO: 9086332 - DNA, 19 bp, Homo sapiens
ctttgcaggggatgggtga

SEQ ID NO: 9086333 - DNA, 22 bp, Homo sapiens
ctttgcagtatagcctagtaga

SEQ ID NO: 9086334 - DNA, 20 bp, Homo sapiens
ctttgcaggagaacagagaa

SEQ ID NO: 9086335 - DNA, 17 bp, Homo sapiens
ctttgcagcagacatgt

SEQ ID NO: 9086336 - DNA, 20 bp, Homo sapiens
ctttgcaggagaacagagaa

SEQ ID NO: 9086337 - DNA, 22 bp, Homo sapiens
ctttgcaggagtatgtgataat

SEQ ID NO: 9086338 - DNA, 22 bp, Homo sapiens
ctttgcagctctaggtggaagc

SEQ ID NO: 9086339 - DNA, 17 bp, Homo sapiens
ctttgcagcagacatgt

SEQ ID NO: 9086340 - DNA, 22 bp, Homo sapiens
cttttcattgtttgtacatgca

SEQ ID NO: 9086341 - DNA, 22 bp, Homo sapiens
cttctggcaaaacaggcagaaa

SEQ ID NO: 9086342 - DNA, 19 bp, Homo sapiens
cttctggccctgagccacc

SEQ ID NO: 9086343 - DNA, 22 bp, Homo sapiens
cttctggcgttggaggtctgag

SEQ ID NO: 9086344 - DNA, 22 bp, Homo sapiens
cttctgggatttttgaagactc

SEQ ID NO: 9086345 - DNA, 23 bp, Homo sapiens
cttctggctctatatcagaattc

SEQ ID NO: 9086346 - DNA, 23 bp, Homo sapiens
cttctggctctatatcagaattc

SEQ ID NO: 9086347 - DNA, 22 bp, Homo sapiens
cttctgggcattcagctgcaca

SEQ ID NO: 9086348 - DNA, 22 bp, Homo sapiens
cttctgggcagaagttttgaga

SEQ ID NO: 9086349 - DNA, 22 bp, Homo sapiens
cttctggggatggagcccagaa

SEQ ID NO: 9086350 - DNA, 22 bp, Homo sapiens
cttctgggccatggccttcctc

SEQ ID NO: 9086351 - DNA, 22 bp, Homo sapiens
cttctggcaaaacaggcagaaa

SEQ ID NO: 9086352 - DNA, 22 bp, Homo sapiens
cttctgaagtgtttgatgattg

SEQ ID NO: 9086353 - DNA, 22 bp, Homo sapiens
cttctcttggtagttcttgttg

SEQ ID NO: 9086354 - DNA, 22 bp, Homo sapiens
cttctgggttgcaggtcttggc

SEQ ID NO: 9086355 - DNA, 22 bp, Homo sapiens
cttgtgaaatgccagataatct

SEQ ID NO: 9086356 - DNA, 22 bp, Homo sapiens
cttgtgcaaatcctcgagcaca

SEQ ID NO: 9086357 - DNA, 22 bp, Homo sapiens
cttgtgcatctcttcatgacca

SEQ ID NO: 9086358 - DNA, 22 bp, Homo sapiens
cttctgggtgtggagtgaggac

SEQ ID NO: 9086359 - DNA, 22 bp, Homo sapiens
cttgttttggctagtatgatgt

SEQ ID NO: 9086360 - DNA, 22 bp, Homo sapiens
cttgttttggctagtatgatgt

SEQ ID NO: 9086361 - DNA, 22 bp, Homo sapiens
cttgttttggaacagagtgaat

SEQ ID NO: 9086362 - DNA, 22 bp, Homo sapiens
cttgttttggctagtatgatgt

SEQ ID NO: 9086363 - DNA, 22 bp, Homo sapiens
cttgtttttaagagatgtttac

SEQ ID NO: 9086364 - DNA, 22 bp, Homo sapiens
cttgttttctaaaacatcattt

SEQ ID NO: 9086365 - DNA, 22 bp, Homo sapiens
cttgttttggaacagagtgaat

SEQ ID NO: 9086366 - DNA, 22 bp, Homo sapiens
cttgttttggaacagagtgaat

SEQ ID NO: 9086367 - DNA, 22 bp, Homo sapiens
ctttaattaggaagtataatga

SEQ ID NO: 9086368 - DNA, 22 bp, Homo sapiens
ctttaacagttccattcaattt

SEQ ID NO: 9086369 - DNA, 22 bp, Homo sapiens
ctttaacagttccattcaattt

SEQ ID NO: 9086370 - DNA, 22 bp, Homo sapiens
ctttaacaaatgactcttgtct

SEQ ID NO: 9086371 - DNA, 22 bp, Homo sapiens
ctttacaaatagggagggagtg

SEQ ID NO: 9086372 - DNA, 22 bp, Homo sapiens
ctttacaaatagggagggagtg

SEQ ID NO: 9086373 - DNA, 22 bp, Homo sapiens
ctttacaaatagggagggagtg

SEQ ID NO: 9086374 - DNA, 22 bp, Homo sapiens
ctttacaaatagggagggagtg

SEQ ID NO: 9086375 - DNA, 22 bp, Homo sapiens
ctttacaaatagggagggagtg

SEQ ID NO: 9086376 - DNA, 22 bp, Homo sapiens
ctttacaaattagctctcggga

SEQ ID NO: 9086377 - DNA, 22 bp, Homo sapiens
ctttacaaattagctctcggga

SEQ ID NO: 9086378 - DNA, 22 bp, Homo sapiens
ctttacaaattagctctcggga

SEQ ID NO: 9086379 - DNA, 22 bp, Homo sapiens
ctttacaaattagctctcggga

SEQ ID NO: 9086380 - DNA, 22 bp, Homo sapiens
ctttctcttcactgtcatgatc

SEQ ID NO: 9086381 - DNA, 22 bp, Homo sapiens
ctttacaaactataaagtgcgg

SEQ ID NO: 9086382 - DNA, 22 bp, Homo sapiens
ctttacaaactataaagtgcgg

SEQ ID NO: 9086383 - DNA, 22 bp, Homo sapiens
ctttacaaactataaagtgcgg

SEQ ID NO: 9086384 - DNA, 22 bp, Homo sapiens
ctttacaaagcaattttgtctc

SEQ ID NO: 9086385 - DNA, 22 bp, Homo sapiens
ctttacaaagcaattttgtctc

SEQ ID NO: 9086386 - DNA, 22 bp, Homo sapiens
ctttacaaagcaattttgtctc

SEQ ID NO: 9086387 - DNA, 22 bp, Homo sapiens
ctttacaaagcaattttgtctc

SEQ ID NO: 9086388 - DNA, 22 bp, Homo sapiens
ctttacaaactataaagtgcgg

SEQ ID NO: 9086389 - DNA, 22 bp, Homo sapiens
ctttgaagatggcaaatttaga

SEQ ID NO: 9086390 - DNA, 22 bp, Homo sapiens
ctttgatataagtatacatagt

SEQ ID NO: 9086391 - DNA, 22 bp, Homo sapiens
ctttgactttgtcctcaggaaa

SEQ ID NO: 9086392 - DNA, 22 bp, Homo sapiens
ctttctttgtccaccaacaatg

SEQ ID NO: 9086393 - DNA, 22 bp, Homo sapiens
ctttgaaaacttaaataacagc

SEQ ID NO: 9086394 - DNA, 22 bp, Homo sapiens
ctttgaaaacacacgaatagac

SEQ ID NO: 9086395 - DNA, 22 bp, Homo sapiens
cttcattggcttccatagatgc

SEQ ID NO: 9086396 - DNA, 22 bp, Homo sapiens
cttcattaatgtctataagttt

SEQ ID NO: 9086397 - DNA, 19 bp, Homo sapiens
cttatacagattttctcat

SEQ ID NO: 9086398 - DNA, 22 bp, Homo sapiens
cttcagtgttgccagggcctag

SEQ ID NO: 9086399 - DNA, 22 bp, Homo sapiens
cttatatttgtcaactttacaa

SEQ ID NO: 9086400 - DNA, 22 bp, Homo sapiens
cttatagtatgatgttgagaat

SEQ ID NO: 9086401 - DNA, 22 bp, Homo sapiens
cttatagatggcgatcttcttg

SEQ ID NO: 9086402 - DNA, 22 bp, Homo sapiens
cttccaaaatttatatgttgaa

SEQ ID NO: 9086403 - DNA, 22 bp, Homo sapiens
cttagcagtcactgttctaagt

SEQ ID NO: 9086404 - DNA, 22 bp, Homo sapiens
cttagctagaggcaattatgtt

SEQ ID NO: 9086405 - DNA, 22 bp, Homo sapiens
cttagctttgtcctaggtctct

SEQ ID NO: 9086406 - DNA, 22 bp, Homo sapiens
cttagctagtgctcagctgtca

SEQ ID NO: 9086407 - DNA, 22 bp, Homo sapiens
cttaggaaagttttctgctgca

SEQ ID NO: 9086408 - DNA, 22 bp, Homo sapiens
cttaggaaagtttctgcttatg

SEQ ID NO: 9086409 - DNA, 22 bp, Homo sapiens
cttaggaaagttggctgatttc

SEQ ID NO: 9086410 - DNA, 22 bp, Homo sapiens
cttaggaagcgggacctgtgca

SEQ ID NO: 9086411 - DNA, 22 bp, Homo sapiens
cttaggaacgctctgcctagtg

SEQ ID NO: 9086412 - DNA, 22 bp, Homo sapiens
cttaggaagttgttacacactt

SEQ ID NO: 9086413 - DNA, 22 bp, Homo sapiens
cttaggaatatccacagcaggt

SEQ ID NO: 9086414 - DNA, 22 bp, Homo sapiens
cttaggaatgcgtttcctgggt

SEQ ID NO: 9086415 - DNA, 22 bp, Homo sapiens
cttaggatgagtttttgcgttt

SEQ ID NO: 9086416 - DNA, 22 bp, Homo sapiens
cttataaagtccatctgaacaa

SEQ ID NO: 9086417 - DNA, 22 bp, Homo sapiens
cttataaagtccatctgaacaa

SEQ ID NO: 9086418 - DNA, 22 bp, Homo sapiens
cttctaggcttctcagggggca

SEQ ID NO: 9086419 - DNA, 17 bp, Homo sapiens
cttctagaaggcaaact

SEQ ID NO: 9086420 - DNA, 22 bp, Homo sapiens
cttctattcactggtcacagtt

SEQ ID NO: 9086421 - DNA, 22 bp, Homo sapiens
cttctcagcttaggtatggttt

SEQ ID NO: 9086422 - DNA, 23 bp, Homo sapiens
cttcggaatatgataagggacct

SEQ ID NO: 9086423 - DNA, 20 bp, Homo sapiens
cttccttttccttcgtcaaa

SEQ ID NO: 9086424 - DNA, 22 bp, Homo sapiens
cttccagagttgcgttctcggt

SEQ ID NO: 9086425 - DNA, 22 bp, Homo sapiens
cttccagctgattacaggctat

SEQ ID NO: 9086426 - DNA, 22 bp, Homo sapiens
cttagaaatgcagattctcagg

SEQ ID NO: 9086427 - DNA, 22 bp, Homo sapiens
cttagaaatgcagattctcagg

SEQ ID NO: 9086428 - DNA, 22 bp, Homo sapiens
cttagcagaagcttcagcttca

SEQ ID NO: 9086429 - DNA, 22 bp, Homo sapiens
cttagaaataatggtttcagtt

SEQ ID NO: 9086430 - DNA, 22 bp, Homo sapiens
cttacgtgataacttctcaaaa

SEQ ID NO: 9086431 - DNA, 22 bp, Homo sapiens
cttacatactgagaaaatatcc

SEQ ID NO: 9086432 - DNA, 22 bp, Homo sapiens
cttacagtgaccctgcagattt

SEQ ID NO: 9086433 - DNA, 22 bp, Homo sapiens
cttacagtgatcaacacaaaga

SEQ ID NO: 9086434 - DNA, 22 bp, Homo sapiens
cttacaacttgtatgtgattgt

SEQ ID NO: 9086435 - DNA, 22 bp, Homo sapiens
cttacaagaccaaagaaaggat

SEQ ID NO: 9086436 - DNA, 22 bp, Homo sapiens
cttacagtacttctaatatgat

SEQ ID NO: 9086437 - DNA, 22 bp, Homo sapiens
cttaaattcttaatgccctcat

SEQ ID NO: 9086438 - DNA, 22 bp, Homo sapiens
cttaaattttcatctacaagaa

SEQ ID NO: 9086439 - DNA, 22 bp, Homo sapiens
cttaaattttcatctacaagaa

SEQ ID NO: 9086440 - DNA, 22 bp, Homo sapiens
cttaaattggatgagttaagtt

SEQ ID NO: 9086441 - DNA, 22 bp, Homo sapiens
cttacaaaggagaggagatagg

SEQ ID NO: 9086442 - DNA, 22 bp, Homo sapiens
cttacaaatacacttaggagag

SEQ ID NO: 9086443 - DNA, 22 bp, Homo sapiens
cttacaaatacacttaggagag

SEQ ID NO: 9086444 - DNA, 22 bp, Homo sapiens
cttacaaaggagaggagatagg

SEQ ID NO: 9086445 - DNA, 22 bp, Homo sapiens
ctgtttaatgaggtgtaacaac

SEQ ID NO: 9086446 - DNA, 22 bp, Homo sapiens
ctgtttaatgcaatgaaatgag

SEQ ID NO: 9086447 - DNA, 21 bp, Homo sapiens
ctgtttcttgtgaagtgacac

SEQ ID NO: 9086448 - DNA, 22 bp, Homo sapiens
ctgtttatactcaaaagataca

SEQ ID NO: 9086449 - DNA, 22 bp, Homo sapiens
ctgtgctttcgagatgtgatct

SEQ ID NO: 9086450 - DNA, 21 bp, Homo sapiens
ctgtgctttttaagtgtgatg

SEQ ID NO: 9086451 - DNA, 20 bp, Homo sapiens
ctgtgctttggaacctggaa

SEQ ID NO: 9086452 - DNA, 21 bp, Homo sapiens
ctgtgctttttaagtgtgatg

SEQ ID NO: 9086453 - DNA, 22 bp, Homo sapiens
ctgtgcttgacagtgggaagca

SEQ ID NO: 9086454 - DNA, 22 bp, Homo sapiens
ctgtgcttgcgggtgtggagcc

SEQ ID NO: 9086455 - DNA, 22 bp, Homo sapiens
ctgtgcttgcgggtgtggagcc

SEQ ID NO: 9086456 - DNA, 22 bp, Homo sapiens
ctgtgcttgtgttcattgttaa

SEQ ID NO: 9086457 - DNA, 20 bp, Homo sapiens
ctgtttgctatcatgagctg

SEQ ID NO: 9086458 - DNA, 22 bp, Homo sapiens
ctgtttgttggctattgacagt

SEQ ID NO: 9086459 - DNA, 22 bp, Homo sapiens
ctgttttcaaagagagagaatg

SEQ ID NO: 9086460 - DNA, 22 bp, Homo sapiens
ctgttttatctcaagagttcaa

SEQ ID NO: 9086461 - DNA, 22 bp, Homo sapiens
ctgttttaatggagactgatgt

SEQ ID NO: 9086462 - DNA, 22 bp, Homo sapiens
cttaaactgggcattcagagaa

SEQ ID NO: 9086463 - DNA, 22 bp, Homo sapiens
ctgtttttgtgctgtgtctccc

SEQ ID NO: 9086464 - DNA, 22 bp, Homo sapiens
ctgtttttgtgctgtgtctccc

SEQ ID NO: 9086465 - DNA, 22 bp, Homo sapiens
ctgtacaagtccttcatcaggg

SEQ ID NO: 9086466 - DNA, 22 bp, Homo sapiens
ctgtacaatgttacctatttat

SEQ ID NO: 9086467 - DNA, 22 bp, Homo sapiens
ctgtacagaagctagagcaaat

SEQ ID NO: 9086468 - DNA, 22 bp, Homo sapiens
ctgtagccagaagcagaaggcc

SEQ ID NO: 9086469 - DNA, 22 bp, Homo sapiens
ctgtagccagtttggcctcacc

SEQ ID NO: 9086470 - DNA, 23 bp, Homo sapiens
ctgtagctaaaagctgggatttg

SEQ ID NO: 9086471 - DNA, 22 bp, Homo sapiens
ctggtgagacggttgacaggag

SEQ ID NO: 9086472 - DNA, 22 bp, Homo sapiens
ctggtgagactcagggatgctt

SEQ ID NO: 9086473 - DNA, 19 bp, Homo sapiens
ctggtgagggttattgata

SEQ ID NO: 9086474 - DNA, 22 bp, Homo sapiens
ctggtgagactcagggatgctt

SEQ ID NO: 9086475 - DNA, 22 bp, Homo sapiens
ctggtgcaaaagtaattgtggt

SEQ ID NO: 9086476 - DNA, 22 bp, Homo sapiens
ctggtgcaggaaggagctggca

SEQ ID NO: 9086477 - DNA, 22 bp, Homo sapiens
ctggtgcaggaaggagctggca

SEQ ID NO: 9086478 - DNA, 22 bp, Homo sapiens
ctgtaaaactgcttaagtatgc

SEQ ID NO: 9086479 - DNA, 22 bp, Homo sapiens
ctgtaaaatgaacctagtcatc

SEQ ID NO: 9086480 - DNA, 22 bp, Homo sapiens
ctgtacaaaagaaagttcctat

SEQ ID NO: 9086481 - DNA, 22 bp, Homo sapiens
ctgtacaaagtagctgctggga

SEQ ID NO: 9086482 - DNA, 22 bp, Homo sapiens
ctgtacaaagtagctgctggga

SEQ ID NO: 9086483 - DNA, 22 bp, Homo sapiens
ctgtacaaatggcagttgagtt

SEQ ID NO: 9086484 - DNA, 22 bp, Homo sapiens
ctgtacaaatggcagttgagtt

SEQ ID NO: 9086485 - DNA, 22 bp, Homo sapiens
ctggtgccattctgtggcctag

SEQ ID NO: 9086486 - DNA, 22 bp, Homo sapiens
ctggtgccattctgtggcctag

SEQ ID NO: 9086487 - DNA, 22 bp, Homo sapiens
ctggtgccctgtgtggcaggag

SEQ ID NO: 9086488 - DNA, 22 bp, Homo sapiens
ctgtaaaacactgtagtatctg

SEQ ID NO: 9086489 - DNA, 22 bp, Homo sapiens
ctgtaaaacactgtagtatctg

SEQ ID NO: 9086490 - DNA, 20 bp, Homo sapiens
ctggggagctgctcccacga

SEQ ID NO: 9086491 - DNA, 20 bp, Homo sapiens
ctggggagcctcgcggtggc

SEQ ID NO: 9086492 - DNA, 20 bp, Homo sapiens
ctggggagcctcgcggtggc

SEQ ID NO: 9086493 - DNA, 22 bp, Homo sapiens
ctggtccttgctacccagcaag

SEQ ID NO: 9086494 - DNA, 22 bp, Homo sapiens
ctggtcactggtctcatccagc

SEQ ID NO: 9086495 - DNA, 22 bp, Homo sapiens
ctggtctgcaaggccatataga

SEQ ID NO: 9086496 - DNA, 19 bp, Homo sapiens
ctggtctgctgcttccagg

SEQ ID NO: 9086497 - DNA, 19 bp, Homo sapiens
ctggtctgtcatgctcccc

SEQ ID NO: 9086498 - DNA, 22 bp, Homo sapiens
ctggtctggctacccagcgaat

SEQ ID NO: 9086499 - DNA, 22 bp, Homo sapiens
ctggtctggctagtttaggcca

SEQ ID NO: 9086500 - DNA, 22 bp, Homo sapiens
ctgggcttgtgttagctgacaa

SEQ ID NO: 9086501 - DNA, 22 bp, Homo sapiens
ctgggcttgagttcctgctcgt

SEQ ID NO: 9086502 - DNA, 22 bp, Homo sapiens
ctgggcttaggacctggtgcgg

SEQ ID NO: 9086503 - DNA, 22 bp, Homo sapiens
ctgggcttttgagtcacaaggg

SEQ ID NO: 9086504 - DNA, 22 bp, Homo sapiens
ctgggcttttgagtcacaaggg

SEQ ID NO: 9086505 - DNA, 22 bp, Homo sapiens
ctgggctttgaagccaggctgc

SEQ ID NO: 9086506 - DNA, 21 bp, Homo sapiens
ctgggctttctctcaaagaca

SEQ ID NO: 9086507 - DNA, 21 bp, Homo sapiens
ctgggctttctctcaaagaca

SEQ ID NO: 9086508 - DNA, 22 bp, Homo sapiens
ctggggaacaatttgccacact

SEQ ID NO: 9086509 - DNA, 22 bp, Homo sapiens
ctggggaacgcagcgagcagcg

SEQ ID NO: 9086510 - DNA, 22 bp, Homo sapiens
ctggggaaggcggtgactgcgc

SEQ ID NO: 9086511 - DNA, 22 bp, Homo sapiens
ctggggagaagcgactcggctg

SEQ ID NO: 9086512 - DNA, 22 bp, Homo sapiens
ctggggagaagcgactcggctg

SEQ ID NO: 9086513 - DNA, 22 bp, Homo sapiens
ctggggagacgatcgatgttct

SEQ ID NO: 9086514 - DNA, 22 bp, Homo sapiens
ctggggaaggcggtgactgcgc

SEQ ID NO: 9086515 - DNA, 22 bp, Homo sapiens
ctggggaatagagctggagacc

SEQ ID NO: 9086516 - DNA, 22 bp, Homo sapiens
ctgtatatcatggttttgcagt

SEQ ID NO: 9086517 - DNA, 22 bp, Homo sapiens
ctgtatatggcttactttatat

SEQ ID NO: 9086518 - DNA, 22 bp, Homo sapiens
ctgtatttgtcctctatttatt

SEQ ID NO: 9086519 - DNA, 22 bp, Homo sapiens
ctgtatttgtcctctatttatt

SEQ ID NO: 9086520 - DNA, 20 bp, Homo sapiens
ctgtagggtgcagcaggctc

SEQ ID NO: 9086521 - DNA, 22 bp, Homo sapiens
ctgtataacatcttttgtttcc

SEQ ID NO: 9086522 - DNA, 22 bp, Homo sapiens
ctgtataaacatattttcaagt

SEQ ID NO: 9086523 - DNA, 22 bp, Homo sapiens
ctgtcacactgatatcaggctt

SEQ ID NO: 9086524 - DNA, 22 bp, Homo sapiens
ctgtattttttaagtgatctgg

SEQ ID NO: 9086525 - DNA, 22 bp, Homo sapiens
ctgtattttcatgcctacgtac

SEQ ID NO: 9086526 - DNA, 22 bp, Homo sapiens
ctgtcagagatggggagtcaga

SEQ ID NO: 9086527 - DNA, 22 bp, Homo sapiens
ctgtcagcactctactacagat

SEQ ID NO: 9086528 - DNA, 22 bp, Homo sapiens
ctgtcactgatgggctcaccag

SEQ ID NO: 9086529 - DNA, 22 bp, Homo sapiens
ctgtcacctgttcactgcagca

SEQ ID NO: 9086530 - DNA, 22 bp, Homo sapiens
ctgtcagcttctcctggccaga

SEQ ID NO: 9086531 - DNA, 19 bp, Homo sapiens
ctgtcaggggctggatgtt

SEQ ID NO: 9086532 - DNA, 22 bp, Homo sapiens
ctgtcaggtttcccatctgcaa

SEQ ID NO: 9086533 - DNA, 22 bp, Homo sapiens
ctgtcctgtggacctgaggacg

SEQ ID NO: 9086534 - DNA, 22 bp, Homo sapiens
ctgtcctgtgtcagcctgaaat

SEQ ID NO: 9086535 - DNA, 22 bp, Homo sapiens
ctgtccttactgcttctggctt

SEQ ID NO: 9086536 - DNA, 22 bp, Homo sapiens
ctgtctctgttgcctgtaggtg

SEQ ID NO: 9086537 - DNA, 22 bp, Homo sapiens
ctgtctgaatcctaagcttcct

SEQ ID NO: 9086538 - DNA, 22 bp, Homo sapiens
ctgtctctgttgcctgtaggtg

SEQ ID NO: 9086539 - DNA, 22 bp, Homo sapiens
ctgtctctgttgcctgtaggtg

SEQ ID NO: 9086540 - DNA, 22 bp, Homo sapiens
ctgtccttgctggccaggtatg

SEQ ID NO: 9086541 - DNA, 22 bp, Homo sapiens
ctgtctgccctggccagagccc

SEQ ID NO: 9086542 - DNA, 22 bp, Homo sapiens
ctgtctgccctggccagagccc

SEQ ID NO: 9086543 - DNA, 22 bp, Homo sapiens
ctgtctgccaataatctatggc

SEQ ID NO: 9086544 - DNA, 22 bp, Homo sapiens
ctgtctgcaggatagtaccctc

SEQ ID NO: 9086545 - DNA, 22 bp, Homo sapiens
ctgtctgctatgcttgttgtca

SEQ ID NO: 9086546 - DNA, 22 bp, Homo sapiens
ctgtctgctagaacatctatac

SEQ ID NO: 9086547 - DNA, 19 bp, Homo sapiens
ctgtctgcggggcctgttc

SEQ ID NO: 9086548 - DNA, 17 bp, Homo sapiens
ctgtctgcgcatgaggt

SEQ ID NO: 9086549 - DNA, 17 bp, Homo sapiens
ctgtctgcgcatgaggt

SEQ ID NO: 9086550 - DNA, 22 bp, Homo sapiens
ctgtctgctcataatggagggc

SEQ ID NO: 9086551 - DNA, 17 bp, Homo sapiens
ctgtctgctgcttcctc

SEQ ID NO: 9086552 - DNA, 17 bp, Homo sapiens
ctgtctgctgcttcctc

SEQ ID NO: 9086553 - DNA, 22 bp, Homo sapiens
ctgtctgggtctacatcctctg

SEQ ID NO: 9086554 - DNA, 22 bp, Homo sapiens
ctgtctgtcaagttcatctcca

SEQ ID NO: 9086555 - DNA, 22 bp, Homo sapiens
ctgtctgtcaagttcatctcca

SEQ ID NO: 9086556 - DNA, 22 bp, Homo sapiens
ctgtctgtcccgtcaccgcccc

SEQ ID NO: 9086557 - DNA, 22 bp, Homo sapiens
ctgtctgtacaaatgtggggcc

SEQ ID NO: 9086558 - DNA, 22 bp, Homo sapiens
ctgtctgtactgagagttctgt

SEQ ID NO: 9086559 - DNA, 22 bp, Homo sapiens
ctgtctgtatccctgttggtaa

SEQ ID NO: 9086560 - DNA, 22 bp, Homo sapiens
ctgtgccctggccaggcctctc

SEQ ID NO: 9086561 - DNA, 18 bp, Homo sapiens
ctgtgccctgctcctact

SEQ ID NO: 9086562 - DNA, 22 bp, Homo sapiens
ctgtctgtgcctcttctcccag

SEQ ID NO: 9086563 - DNA, 22 bp, Homo sapiens
ctgtctgtggagcttctgatgt

SEQ ID NO: 9086564 - DNA, 22 bp, Homo sapiens
ctgtctgtggagcttctgatgt

SEQ ID NO: 9086565 - DNA, 22 bp, Homo sapiens
ctgtgctgattcagcacaggcc

SEQ ID NO: 9086566 - DNA, 22 bp, Homo sapiens
ctgtgctctggcatcgctgcaa

SEQ ID NO: 9086567 - DNA, 22 bp, Homo sapiens
ctgtgctgaacaattctgcatt

SEQ ID NO: 9086568 - DNA, 22 bp, Homo sapiens
ctgtgctggagatgggccagag

SEQ ID NO: 9086569 - DNA, 22 bp, Homo sapiens
ctgtgctgattcagcacaggcc

SEQ ID NO: 9086570 - DNA, 22 bp, Homo sapiens
ctgtgcttcagagtcagtgctg

SEQ ID NO: 9086571 - DNA, 22 bp, Homo sapiens
ctgtgcttcagagtcagtgctg

SEQ ID NO: 9086572 - DNA, 22 bp, Homo sapiens
ctgggctggcgcatccgacacg

SEQ ID NO: 9086573 - DNA, 22 bp, Homo sapiens
ctgggcttagcagctcctggtc

SEQ ID NO: 9086574 - DNA, 22 bp, Homo sapiens
ctgggcttagcagctcctggtc

SEQ ID NO: 9086575 - DNA, 22 bp, Homo sapiens
ctgggctggagtgcaatggcgc

SEQ ID NO: 9086576 - DNA, 22 bp, Homo sapiens
ctgggctcaaatcctatctcca

SEQ ID NO: 9086577 - DNA, 22 bp, Homo sapiens
ctgggctagaaggaccaggatg

SEQ ID NO: 9086578 - DNA, 22 bp, Homo sapiens
ctgggcgtgtcttccagctggc

SEQ ID NO: 9086579 - DNA, 22 bp, Homo sapiens
ctgggctacgtgttgacagcat

SEQ ID NO: 9086580 - DNA, 22 bp, Homo sapiens
ctgggctaattaagcacagctg

SEQ ID NO: 9086581 - DNA, 22 bp, Homo sapiens
ctgggctacgtgttgacagcat

SEQ ID NO: 9086582 - DNA, 22 bp, Homo sapiens
ctgggctagaaggaccaggatg

SEQ ID NO: 9086583 - DNA, 22 bp, Homo sapiens
ctgggctagaaggaccaggatg

SEQ ID NO: 9086584 - DNA, 22 bp, Homo sapiens
ctgggccttggattgacactgt

SEQ ID NO: 9086585 - DNA, 22 bp, Homo sapiens
ctgggccttgccttgcccacag

SEQ ID NO: 9086586 - DNA, 22 bp, Homo sapiens
ctgggcctttgcttattaattt

SEQ ID NO: 9086587 - DNA, 22 bp, Homo sapiens
ctgggcctttacctacggagtt

SEQ ID NO: 9086588 - DNA, 18 bp, Homo sapiens
ctgggcctttgtattttt

SEQ ID NO: 9086589 - DNA, 22 bp, Homo sapiens
ctgggcctttgggagttcggtg

SEQ ID NO: 9086590 - DNA, 22 bp, Homo sapiens
ctgggcctggtgtggcacctgc

SEQ ID NO: 9086591 - DNA, 22 bp, Homo sapiens
ctgggcctggtgtggcacctgc

SEQ ID NO: 9086592 - DNA, 22 bp, Homo sapiens
ctgggcctcctctgcccaagct

SEQ ID NO: 9086593 - DNA, 22 bp, Homo sapiens
ctgggcctcctctgcccaagct

SEQ ID NO: 9086594 - DNA, 22 bp, Homo sapiens
ctgggcctcctctgcccaagct

SEQ ID NO: 9086595 - DNA, 22 bp, Homo sapiens
ctgggcctcctctgcccaagct

SEQ ID NO: 9086596 - DNA, 22 bp, Homo sapiens
ctgggcctccagctctgccagc

SEQ ID NO: 9086597 - DNA, 17 bp, Homo sapiens
ctgggcctcccctgtcc

SEQ ID NO: 9086598 - DNA, 17 bp, Homo sapiens
ctgggcctcccctgtcc

SEQ ID NO: 9086599 - DNA, 22 bp, Homo sapiens
ctgggcctgtgggcacacggac

SEQ ID NO: 9086600 - DNA, 22 bp, Homo sapiens
ctgggcctgtgactcccatcct

SEQ ID NO: 9086601 - DNA, 22 bp, Homo sapiens
ctgggcctgtgactcccatcct

SEQ ID NO: 9086602 - DNA, 22 bp, Homo sapiens
ctgggcctggtgtggcacctgc

SEQ ID NO: 9086603 - DNA, 22 bp, Homo sapiens
ctgggcctgtcagggctttttg

SEQ ID NO: 9086604 - DNA, 22 bp, Homo sapiens
ctgggcctgtccctgattgagg

SEQ ID NO: 9086605 - DNA, 22 bp, Homo sapiens
ctgggccttgagaatcatgttt

SEQ ID NO: 9086606 - DNA, 22 bp, Homo sapiens
ctgggccttcattgctctccca

SEQ ID NO: 9086607 - DNA, 22 bp, Homo sapiens
ctgggccttcattgctctccca

SEQ ID NO: 9086608 - DNA, 22 bp, Homo sapiens
ctgggccttagggcactccctt

SEQ ID NO: 9086609 - DNA, 22 bp, Homo sapiens
ctgggccttatgagtacctgga

SEQ ID NO: 9086610 - DNA, 22 bp, Homo sapiens
ctgggccttgccttgcccacag

SEQ ID NO: 9086611 - DNA, 22 bp, Homo sapiens
ctgggccttgccttgcccacag

SEQ ID NO: 9086612 - DNA, 22 bp, Homo sapiens
ctgggccttgccaggggtgtct

SEQ ID NO: 9086613 - DNA, 22 bp, Homo sapiens
ctgggccttgcatcccagagcc

SEQ ID NO: 9086614 - DNA, 22 bp, Homo sapiens
ctgggccttgatcacacaggtg

SEQ ID NO: 9086615 - DNA, 22 bp, Homo sapiens
ctgggccttgatcacacaggtg

SEQ ID NO: 9086616 - DNA, 22 bp, Homo sapiens
ctgggcaaattgtgccagctat

SEQ ID NO: 9086617 - DNA, 22 bp, Homo sapiens
ctgggcacttgctcacagctct

SEQ ID NO: 9086618 - DNA, 22 bp, Homo sapiens
ctgggcactgcagcaggcatca

SEQ ID NO: 9086619 - DNA, 22 bp, Homo sapiens
ctgggagattgctagagatgca

SEQ ID NO: 9086620 - DNA, 22 bp, Homo sapiens
ctgggcagctccataccaccca

SEQ ID NO: 9086621 - DNA, 22 bp, Homo sapiens
ctgggcagctaccaccactgct

SEQ ID NO: 9086622 - DNA, 22 bp, Homo sapiens
ctgggcagctaccaccactgct

SEQ ID NO: 9086623 - DNA, 22 bp, Homo sapiens
ctgggcagaattttaggatggc

SEQ ID NO: 9086624 - DNA, 22 bp, Homo sapiens
ctgggcagagctaacacctgag

SEQ ID NO: 9086625 - DNA, 22 bp, Homo sapiens
ctgggcagcacatcatcgtatc

SEQ ID NO: 9086626 - DNA, 22 bp, Homo sapiens
ctgggcactttggggagcctac

SEQ ID NO: 9086627 - DNA, 22 bp, Homo sapiens
ctgggcagaattttaggatggc

SEQ ID NO: 9086628 - DNA, 22 bp, Homo sapiens
ctgggcagaattttaggatggc

SEQ ID NO: 9086629 - DNA, 22 bp, Homo sapiens
ctgcttccatgcaatggcagtc

SEQ ID NO: 9086630 - DNA, 22 bp, Homo sapiens
ctgcttcatgtcctgggacctg

SEQ ID NO: 9086631 - DNA, 22 bp, Homo sapiens
ctgcttcaccctgcctgagaac

SEQ ID NO: 9086632 - DNA, 22 bp, Homo sapiens
ctgggaagaatccaagggccct

SEQ ID NO: 9086633 - DNA, 22 bp, Homo sapiens
ctgggacacccaaggaaagagc

SEQ ID NO: 9086634 - DNA, 22 bp, Homo sapiens
ctgggaagatggtgacagaatt

SEQ ID NO: 9086635 - DNA, 22 bp, Homo sapiens
ctgggaagatggtgacagaatt

SEQ ID NO: 9086636 - DNA, 20 bp, Homo sapiens
ctgctgtgtgtgcctcagcc

SEQ ID NO: 9086637 - DNA, 22 bp, Homo sapiens
ctgctgtgttcctcctgcatct

SEQ ID NO: 9086638 - DNA, 22 bp, Homo sapiens
ctgctgtgcacccaggaaggct

SEQ ID NO: 9086639 - DNA, 22 bp, Homo sapiens
ctgcttcaaggaaatgaatcgg

SEQ ID NO: 9086640 - DNA, 20 bp, Homo sapiens
ctgcttaagtaagtgacaca

SEQ ID NO: 9086641 - DNA, 22 bp, Homo sapiens
ctgggagaggctgctccgctct

SEQ ID NO: 9086642 - DNA, 22 bp, Homo sapiens
ctgggagatatgaggatctgga

SEQ ID NO: 9086643 - DNA, 22 bp, Homo sapiens
ctgggagattgctagagatgca

SEQ ID NO: 9086644 - DNA, 22 bp, Homo sapiens
ctgggagatgactcagagcagg

SEQ ID NO: 9086645 - DNA, 22 bp, Homo sapiens
ctgggacagctgagacaggaga

SEQ ID NO: 9086646 - DNA, 22 bp, Homo sapiens
ctgggacagctgagacaggaga

SEQ ID NO: 9086647 - DNA, 22 bp, Homo sapiens
ctgggacagctgagacaggaga

SEQ ID NO: 9086648 - DNA, 23 bp, Homo sapiens
ctgggacatggtaggggcacaac

SEQ ID NO: 9086649 - DNA, 22 bp, Homo sapiens
ctgggacatgatagaaacagat

SEQ ID NO: 9086650 - DNA, 22 bp, Homo sapiens
ctgggacccacacctggaatct

SEQ ID NO: 9086651 - DNA, 22 bp, Homo sapiens
ctgggacctcggggtgatcaaa

SEQ ID NO: 9086652 - DNA, 22 bp, Homo sapiens
gagccaggtttgaatctcagtc

SEQ ID NO: 9086653 - DNA, 22 bp, Homo sapiens
gagccagtgatcagacagggag

SEQ ID NO: 9086654 - DNA, 22 bp, Homo sapiens
gagcccagcccagagccatatg

SEQ ID NO: 9086655 - DNA, 22 bp, Homo sapiens
gagcccagctctacctcagact

SEQ ID NO: 9086656 - DNA, 22 bp, Homo sapiens
gagcccagctctacctcagact

SEQ ID NO: 9086657 - DNA, 22 bp, Homo sapiens
gagcccaggaagtggaggctga

SEQ ID NO: 9086658 - DNA, 22 bp, Homo sapiens
gagcccaggagtttgatgctgc

SEQ ID NO: 9086659 - DNA, 22 bp, Homo sapiens
gagcccaggaagtggaggctga

SEQ ID NO: 9086660 - DNA, 22 bp, Homo sapiens
gagcccaggaagtggaggctga

SEQ ID NO: 9086661 - DNA, 22 bp, Homo sapiens
gagcccagcttgcacatggagc

SEQ ID NO: 9086662 - DNA, 22 bp, Homo sapiens
gagcccagctgtccttggcaaa

SEQ ID NO: 9086663 - DNA, 22 bp, Homo sapiens
gagcccagctgcggccctcagc

SEQ ID NO: 9086664 - DNA, 22 bp, Homo sapiens
gagcccagggtgaaatagcagc

SEQ ID NO: 9086665 - DNA, 22 bp, Homo sapiens
gagcccagggcaggcaaggcag

SEQ ID NO: 9086666 - DNA, 22 bp, Homo sapiens
gagcccaggctggggttcagag

SEQ ID NO: 9086667 - DNA, 22 bp, Homo sapiens
gagcccaggcagaggttgcagt

SEQ ID NO: 9086668 - DNA, 22 bp, Homo sapiens
gagcccaggcagaggttgcagt

SEQ ID NO: 9086669 - DNA, 22 bp, Homo sapiens
gagcccaggatggtgtatggct

SEQ ID NO: 9086670 - DNA, 21 bp, Homo sapiens
gagcccaggcatctcattaat

SEQ ID NO: 9086671 - DNA, 21 bp, Homo sapiens
gagcccaggcatctcattaat

SEQ ID NO: 9086672 - DNA, 22 bp, Homo sapiens
gagcccaggcagaggttgcagt

SEQ ID NO: 9086673 - DNA, 22 bp, Homo sapiens
gagccctgaacaacagcaggaa

SEQ ID NO: 9086674 - DNA, 22 bp, Homo sapiens
gagccctgaacaacagcaggaa

SEQ ID NO: 9086675 - DNA, 22 bp, Homo sapiens
gagccctgacactgagggagtt

SEQ ID NO: 9086676 - DNA, 22 bp, Homo sapiens
gagccctgacactgagggagtt

SEQ ID NO: 9086677 - DNA, 22 bp, Homo sapiens
gagccctgagagttgtgaggcc

SEQ ID NO: 9086678 - DNA, 22 bp, Homo sapiens
gagcccagtaggcaaagctgca

SEQ ID NO: 9086679 - DNA, 22 bp, Homo sapiens
gagcccaggttctgcttccagc

SEQ ID NO: 9086680 - DNA, 22 bp, Homo sapiens
gagcccaggttctgcttccagc

SEQ ID NO: 9086681 - DNA, 22 bp, Homo sapiens
gagcccaggttctgcttccagc

SEQ ID NO: 9086682 - DNA, 22 bp, Homo sapiens
gagcccagggtgaaatagcagc

SEQ ID NO: 9086683 - DNA, 22 bp, Homo sapiens
gagcagtgactggagcatgaga

SEQ ID NO: 9086684 - DNA, 22 bp, Homo sapiens
gagcagtgagtgaatgttgcct

SEQ ID NO: 9086685 - DNA, 22 bp, Homo sapiens
gagcagtgggaaggaacagggt

SEQ ID NO: 9086686 - DNA, 22 bp, Homo sapiens
gagcagtgggaaggaacagggt

SEQ ID NO: 9086687 - DNA, 22 bp, Homo sapiens
gagaggtaatttgaagtgcaaa

SEQ ID NO: 9086688 - DNA, 22 bp, Homo sapiens
gagcaggcttgcagagaagggg

SEQ ID NO: 9086689 - DNA, 22 bp, Homo sapiens
gagcaggcttgcagagaagggg

SEQ ID NO: 9086690 - DNA, 22 bp, Homo sapiens
gagcaggcttgcagagaagggg

SEQ ID NO: 9086691 - DNA, 22 bp, Homo sapiens
gagaggggtttgccatcctatg

SEQ ID NO: 9086692 - DNA, 22 bp, Homo sapiens
gagaggggacctgtgtgtctag

SEQ ID NO: 9086693 - DNA, 22 bp, Homo sapiens
gagaggggcgcgcagctcgcga

SEQ ID NO: 9086694 - DNA, 22 bp, Homo sapiens
gagaggggcgcgcagctcgcga

SEQ ID NO: 9086695 - DNA, 22 bp, Homo sapiens
gagaggggcgcgcagctcgcga

SEQ ID NO: 9086696 - DNA, 22 bp, Homo sapiens
gagaggggcccaagccacatag

SEQ ID NO: 9086697 - DNA, 22 bp, Homo sapiens
gagaggggcccaagccacatag

SEQ ID NO: 9086698 - DNA, 22 bp, Homo sapiens
gagaggggcgcgcagctcgcga

SEQ ID NO: 9086699 - DNA, 21 bp, Homo sapiens
gagcatggcttacatcagcag

SEQ ID NO: 9086700 - DNA, 22 bp, Homo sapiens
gagcatgagggaaggcagcaga

SEQ ID NO: 9086701 - DNA, 20 bp, Homo sapiens
gagcatctgtctgctgtgca

SEQ ID NO: 9086702 - DNA, 22 bp, Homo sapiens
gagcatggatagaaggtgggat

SEQ ID NO: 9086703 - DNA, 22 bp, Homo sapiens
gagcagtggtctgatcttctaa

SEQ ID NO: 9086704 - DNA, 22 bp, Homo sapiens
gagcagtgggaaggaacagggt

SEQ ID NO: 9086705 - DNA, 22 bp, Homo sapiens
gagcagtggttgaacagaggca

SEQ ID NO: 9086706 - DNA, 22 bp, Homo sapiens
gagcataggacacagaggtgtg

SEQ ID NO: 9086707 - DNA, 22 bp, Homo sapiens
gagcatcactgtcctctccccg

SEQ ID NO: 9086708 - DNA, 22 bp, Homo sapiens
gagcatctgatgagattggatt

SEQ ID NO: 9086709 - DNA, 22 bp, Homo sapiens
gagcagttgggctctaggaagt

SEQ ID NO: 9086710 - DNA, 22 bp, Homo sapiens
gagctgaggtgatgtggtcgtt

SEQ ID NO: 9086711 - DNA, 22 bp, Homo sapiens
gagctgagtatgaaggatgtga

SEQ ID NO: 9086712 - DNA, 22 bp, Homo sapiens
gagctgagtatgaaggatgtga

SEQ ID NO: 9086713 - DNA, 23 bp, Homo sapiens
gagctgagtgtagggagactagg

SEQ ID NO: 9086714 - DNA, 22 bp, Homo sapiens
gagctgccggcccacagtacta

SEQ ID NO: 9086715 - DNA, 22 bp, Homo sapiens
gagctgcctacattgccaagag

SEQ ID NO: 9086716 - DNA, 22 bp, Homo sapiens
gagctgcctgaacaagcagcag

SEQ ID NO: 9086717 - DNA, 22 bp, Homo sapiens
gagctgagcctgggtggaccgc

SEQ ID NO: 9086718 - DNA, 22 bp, Homo sapiens
gagctgagcctgggtggaccgc

SEQ ID NO: 9086719 - DNA, 22 bp, Homo sapiens
gagctgagatttgaagcaagtt

SEQ ID NO: 9086720 - DNA, 22 bp, Homo sapiens
gagctgagcagggagcctcact

SEQ ID NO: 9086721 - DNA, 22 bp, Homo sapiens
gagctgaggatacatcagtgaa

SEQ ID NO: 9086722 - DNA, 22 bp, Homo sapiens
gagctgagcctgggtggaccgc

SEQ ID NO: 9086723 - DNA, 22 bp, Homo sapiens
gagctgagggtctaggagggtt

SEQ ID NO: 9086724 - DNA, 22 bp, Homo sapiens
gagctgaggccagagtcttctg

SEQ ID NO: 9086725 - DNA, 22 bp, Homo sapiens
gagctgaggctcaggctggcgt

SEQ ID NO: 9086726 - DNA, 22 bp, Homo sapiens
gagctgaggctcaggctggcgt

SEQ ID NO: 9086727 - DNA, 22 bp, Homo sapiens
gagctgaggctcaggctggcgt

SEQ ID NO: 9086728 - DNA, 22 bp, Homo sapiens
gagccctgcgtgtctgggggca

SEQ ID NO: 9086729 - DNA, 22 bp, Homo sapiens
gagccctgctgggccttgtctc

SEQ ID NO: 9086730 - DNA, 22 bp, Homo sapiens
gagccctgcgtgtctgggggca

SEQ ID NO: 9086731 - DNA, 22 bp, Homo sapiens
gagccctggcagtctgggatgg

SEQ ID NO: 9086732 - DNA, 22 bp, Homo sapiens
gagccctggcagtctgggatgg

SEQ ID NO: 9086733 - DNA, 22 bp, Homo sapiens
gagccctgctgggccttgtctc

SEQ ID NO: 9086734 - DNA, 22 bp, Homo sapiens
gagccctgcttccaagggggca

SEQ ID NO: 9086735 - DNA, 22 bp, Homo sapiens
gagccctgcttccaagggggca

SEQ ID NO: 9086736 - DNA, 18 bp, Homo sapiens
gagccctgagtctgcaca

SEQ ID NO: 9086737 - DNA, 22 bp, Homo sapiens
gagccctgagagttgtgaggcc

SEQ ID NO: 9086738 - DNA, 18 bp, Homo sapiens
gagccctgagtctgcaca

SEQ ID NO: 9086739 - DNA, 22 bp, Homo sapiens
gagccctgatttgcagcatttg

SEQ ID NO: 9086740 - DNA, 22 bp, Homo sapiens
gagccctgatttgcagcatttg

SEQ ID NO: 9086741 - DNA, 22 bp, Homo sapiens
gagccctgcccacttgtctgag

SEQ ID NO: 9086742 - DNA, 22 bp, Homo sapiens
gagccctgcccacttgtctgag

SEQ ID NO: 9086743 - DNA, 22 bp, Homo sapiens
gagccctgcggagccccgaggc

SEQ ID NO: 9086744 - DNA, 22 bp, Homo sapiens
gagctgagatttgaagcaagtt

SEQ ID NO: 9086745 - DNA, 22 bp, Homo sapiens
gagctgagatcatgtacactag

SEQ ID NO: 9086746 - DNA, 22 bp, Homo sapiens
gagccctgttcaggcctcctca

SEQ ID NO: 9086747 - DNA, 22 bp, Homo sapiens
gagccctgtgaggaaagagggt

SEQ ID NO: 9086748 - DNA, 22 bp, Homo sapiens
gagccctgtgattctgttgtgt

SEQ ID NO: 9086749 - DNA, 22 bp, Homo sapiens
gagccctgtaggaatctctcaa

SEQ ID NO: 9086750 - DNA, 22 bp, Homo sapiens
gagccctggcagtctgggatgg

SEQ ID NO: 9086751 - DNA, 18 bp, Homo sapiens
gagccctgggagatctct

SEQ ID NO: 9086752 - DNA, 18 bp, Homo sapiens
gagccctgggagatctct

SEQ ID NO: 9086753 - DNA, 18 bp, Homo sapiens
gagccctgggagatctct

SEQ ID NO: 9086754 - DNA, 22 bp, Homo sapiens
gagccctgtagcaagtcatgtc

SEQ ID NO: 9086755 - DNA, 22 bp, Homo sapiens
gagccctgtagcaagtcatgtc

SEQ ID NO: 9086756 - DNA, 22 bp, Homo sapiens
gagccctgtagcaagtcatgtc

SEQ ID NO: 9086757 - DNA, 22 bp, Homo sapiens
gaggaaaatggagtgtaattaa

SEQ ID NO: 9086758 - DNA, 22 bp, Homo sapiens
gaggaaaatggagtgtaattaa

SEQ ID NO: 9086759 - DNA, 19 bp, Homo sapiens
gagctgccttttgaagacc

SEQ ID NO: 9086760 - DNA, 22 bp, Homo sapiens
gagctgcctgttgcatagcaac

SEQ ID NO: 9086761 - DNA, 22 bp, Homo sapiens
gagctgcctgtgtgccatgatg

SEQ ID NO: 9086762 - DNA, 18 bp, Homo sapiens
gaggaaacaaggcagagg

SEQ ID NO: 9086763 - DNA, 22 bp, Homo sapiens
gaggaaagaaccccagtcaata

SEQ ID NO: 9086764 - DNA, 22 bp, Homo sapiens
gaggaaagaaccccagtcaata

SEQ ID NO: 9086765 - DNA, 22 bp, Homo sapiens
gaggaaagaaccccagtcaata

SEQ ID NO: 9086766 - DNA, 22 bp, Homo sapiens
gaggaaagaaccccagtcaata

SEQ ID NO: 9086767 - DNA, 23 bp, Homo sapiens
gaggaaagaatatagatgcaatc

SEQ ID NO: 9086768 - DNA, 23 bp, Homo sapiens
gaggaaagaatatagatgcaatc

SEQ ID NO: 9086769 - DNA, 22 bp, Homo sapiens
gaggaaatcattccagaaaagg

SEQ ID NO: 9086770 - DNA, 22 bp, Homo sapiens
gaggaagaaagcataggtgggg

SEQ ID NO: 9086771 - DNA, 22 bp, Homo sapiens
gaggaacttgggttttggattg

SEQ ID NO: 9086772 - DNA, 22 bp, Homo sapiens
gaggaacttatgatattctact

SEQ ID NO: 9086773 - DNA, 20 bp, Homo sapiens
gaggaaccactgggaggaga

SEQ ID NO: 9086774 - DNA, 21 bp, Homo sapiens
gaggaaatgctctggtgttca

SEQ ID NO: 9086775 - DNA, 22 bp, Homo sapiens
gaggaaatggttgttcaggtgg

SEQ ID NO: 9086776 - DNA, 18 bp, Homo sapiens
gaggaacattcacctcct

SEQ ID NO: 9086777 - DNA, 22 bp, Homo sapiens
gaggaacatgaggtgacctggg

SEQ ID NO: 9086778 - DNA, 22 bp, Homo sapiens
gaggaagaaagcataggtgggg

SEQ ID NO: 9086779 - DNA, 22 bp, Homo sapiens
gaggaagaagcaaaccagctaa

SEQ ID NO: 9086780 - DNA, 22 bp, Homo sapiens
gaggaagaagcaaaccagctaa

SEQ ID NO: 9086781 - DNA, 22 bp, Homo sapiens
gaggaagaatcagggtggtgag

SEQ ID NO: 9086782 - DNA, 22 bp, Homo sapiens
gaggaagaatcagggtggtgag

SEQ ID NO: 9086783 - DNA, 22 bp, Homo sapiens
gaggagagatggtagattgggt

SEQ ID NO: 9086784 - DNA, 22 bp, Homo sapiens
gaggagagagggactgtctgca

SEQ ID NO: 9086785 - DNA, 22 bp, Homo sapiens
gaggggctgggcagtccctgga

SEQ ID NO: 9086786 - DNA, 22 bp, Homo sapiens
gaggggctgccctggtgtcagg

SEQ ID NO: 9086787 - DNA, 22 bp, Homo sapiens
gagggctgctggaaaaatgcag

SEQ ID NO: 9086788 - DNA, 22 bp, Homo sapiens
gagggctgctgccagatatgcc

SEQ ID NO: 9086789 - DNA, 22 bp, Homo sapiens
gagggctgtgaaggagcgggtt

SEQ ID NO: 9086790 - DNA, 22 bp, Homo sapiens
gagggaggtgatactgaacgta

SEQ ID NO: 9086791 - DNA, 22 bp, Homo sapiens
gagggagtaacgtactacagtg

SEQ ID NO: 9086792 - DNA, 22 bp, Homo sapiens
gagggaggtgatactgaacgta

SEQ ID NO: 9086793 - DNA, 22 bp, Homo sapiens
gagggaggtgatactgaacgta

SEQ ID NO: 9086794 - DNA, 22 bp, Homo sapiens
gagggaggtgatactgaacgta

SEQ ID NO: 9086795 - DNA, 22 bp, Homo sapiens
gagggagtgccagagggccagc

SEQ ID NO: 9086796 - DNA, 22 bp, Homo sapiens
gagggctgcaatgagacagaga

SEQ ID NO: 9086797 - DNA, 22 bp, Homo sapiens
gagggctgcaatgagacagaga

SEQ ID NO: 9086798 - DNA, 22 bp, Homo sapiens
gaggctgattcggggaacagca

SEQ ID NO: 9086799 - DNA, 22 bp, Homo sapiens
gaggctgattcggggaacagca

SEQ ID NO: 9086800 - DNA, 22 bp, Homo sapiens
gaggctgattcggggaacagca

SEQ ID NO: 9086801 - DNA, 22 bp, Homo sapiens
gaggctgatgctgcctcacaga

SEQ ID NO: 9086802 - DNA, 22 bp, Homo sapiens
gaggctgagtagctttgtgctc

SEQ ID NO: 9086803 - DNA, 22 bp, Homo sapiens
gaggctgcaggcaatgctgccc

SEQ ID NO: 9086804 - DNA, 22 bp, Homo sapiens
gaggctgaggcggatggatcac

SEQ ID NO: 9086805 - DNA, 22 bp, Homo sapiens
gaggctgaggcaggaggatcac

SEQ ID NO: 9086806 - DNA, 22 bp, Homo sapiens
gaggctgagggttagagagtca

SEQ ID NO: 9086807 - DNA, 22 bp, Homo sapiens
gaggctgagggttagagagtca

SEQ ID NO: 9086808 - DNA, 22 bp, Homo sapiens
gaggctgaggttgcagtgagct

SEQ ID NO: 9086809 - DNA, 22 bp, Homo sapiens
gaggctgaggttgcagtgagct

SEQ ID NO: 9086810 - DNA, 22 bp, Homo sapiens
gaggctgaggttgcagtgagcc

SEQ ID NO: 9086811 - DNA, 22 bp, Homo sapiens
gaggctgaggttgcagtgagcc

SEQ ID NO: 9086812 - DNA, 22 bp, Homo sapiens
gagggaggggagctccaccctc

SEQ ID NO: 9086813 - DNA, 22 bp, Homo sapiens
gagggaggggagctccaccctc

SEQ ID NO: 9086814 - DNA, 22 bp, Homo sapiens
gagggagggccaggtcccaacc

SEQ ID NO: 9086815 - DNA, 22 bp, Homo sapiens
gagggagggccaggtcccaacc

SEQ ID NO: 9086816 - DNA, 22 bp, Homo sapiens
gagggagggccaggtcccaacc

SEQ ID NO: 9086817 - DNA, 22 bp, Homo sapiens
gagggagggactagcattctct

SEQ ID NO: 9086818 - DNA, 22 bp, Homo sapiens
gagggagggaaagtttaacact

SEQ ID NO: 9086819 - DNA, 22 bp, Homo sapiens
gagggagggaaagtttaacact

SEQ ID NO: 9086820 - DNA, 22 bp, Homo sapiens
gagggagggactagcattctct

SEQ ID NO: 9086821 - DNA, 22 bp, Homo sapiens
gagggaggcatcatgaatccag

SEQ ID NO: 9086822 - DNA, 22 bp, Homo sapiens
gagggaggcatcatgaatccag

SEQ ID NO: 9086823 - DNA, 22 bp, Homo sapiens
gagggagaattgcagccagcgt

SEQ ID NO: 9086824 - DNA, 22 bp, Homo sapiens
gaggcaggccctgaatgagtca

SEQ ID NO: 9086825 - DNA, 22 bp, Homo sapiens
gaggcaggccctgaatgagtca

SEQ ID NO: 9086826 - DNA, 22 bp, Homo sapiens
gaggcagggtgttgattacaga

SEQ ID NO: 9086827 - DNA, 22 bp, Homo sapiens
gaggcagggtgttgattacaga

SEQ ID NO: 9086828 - DNA, 22 bp, Homo sapiens
gaggcagtggtctgatgcaagg

SEQ ID NO: 9086829 - DNA, 19 bp, Homo sapiens
gaggcagtagtcaaagctt

SEQ ID NO: 9086830 - DNA, 22 bp, Homo sapiens
gaggcagtatagtcattaagta

SEQ ID NO: 9086831 - DNA, 19 bp, Homo sapiens
gaggcagtagtcaaagctt

SEQ ID NO: 9086832 - DNA, 22 bp, Homo sapiens
gaggctcacctagggagcactg

SEQ ID NO: 9086833 - DNA, 22 bp, Homo sapiens
gaggctcactttcatcctcttc

SEQ ID NO: 9086834 - DNA, 22 bp, Homo sapiens
gaggctcagagaagtcatggta

SEQ ID NO: 9086835 - DNA, 22 bp, Homo sapiens
gaggctcaacccacaggggttg

SEQ ID NO: 9086836 - DNA, 22 bp, Homo sapiens
gaggcagttcctgagtgacaag

SEQ ID NO: 9086837 - DNA, 22 bp, Homo sapiens
gaggctgaagtgtacatgggtg

SEQ ID NO: 9086838 - DNA, 22 bp, Homo sapiens
gaggctgaacaggttctcatga

SEQ ID NO: 9086839 - DNA, 22 bp, Homo sapiens
gaggctcagagaggtccacata

SEQ ID NO: 9086840 - DNA, 22 bp, Homo sapiens
gaggctcagagggagcatggtc

SEQ ID NO: 9086841 - DNA, 20 bp, Homo sapiens
gaggctgaagtgtttttgct

SEQ ID NO: 9086842 - DNA, 22 bp, Homo sapiens
gaggctgaagtgtacatgggtg

SEQ ID NO: 9086843 - DNA, 22 bp, Homo sapiens
gaggctgaagtgtacatgggtg

SEQ ID NO: 9086844 - DNA, 22 bp, Homo sapiens
gaggctgaatggccagaagcca

SEQ ID NO: 9086845 - DNA, 22 bp, Homo sapiens
gaggctgacggcaccatcttct

SEQ ID NO: 9086846 - DNA, 22 bp, Homo sapiens
gaggctgagactctgaattttt

SEQ ID NO: 9086847 - DNA, 22 bp, Homo sapiens
gaggctgaggcaggaggatcac

SEQ ID NO: 9086848 - DNA, 22 bp, Homo sapiens
gaggctgaggcaggaggatcac

SEQ ID NO: 9086849 - DNA, 22 bp, Homo sapiens
gaggctgagagtttgttctact

SEQ ID NO: 9086850 - DNA, 22 bp, Homo sapiens
gaggcagcttggggctgtgggt

SEQ ID NO: 9086851 - DNA, 22 bp, Homo sapiens
gaggcagcttggggctgtgggt

SEQ ID NO: 9086852 - DNA, 22 bp, Homo sapiens
gaggcagcttggggctgtgggt

SEQ ID NO: 9086853 - DNA, 22 bp, Homo sapiens
gaggcagcttagggtactgact

SEQ ID NO: 9086854 - DNA, 22 bp, Homo sapiens
gaggcagcttagggtactgact

SEQ ID NO: 9086855 - DNA, 22 bp, Homo sapiens
gaggcagcttagggtactgact

SEQ ID NO: 9086856 - DNA, 22 bp, Homo sapiens
gaggcagctgggtccggtcggg

SEQ ID NO: 9086857 - DNA, 16 bp, Homo sapiens
gaggagcccctctgcc

SEQ ID NO: 9086858 - DNA, 16 bp, Homo sapiens
gaggagcccctctgcc

SEQ ID NO: 9086859 - DNA, 22 bp, Homo sapiens
gaggagcccccactgggctcac

SEQ ID NO: 9086860 - DNA, 22 bp, Homo sapiens
gaggagccaggaggtctccctg

SEQ ID NO: 9086861 - DNA, 22 bp, Homo sapiens
gaggagccaggaggtctccctg

SEQ ID NO: 9086862 - DNA, 22 bp, Homo sapiens
gaggagcccagcaccatcactt

SEQ ID NO: 9086863 - DNA, 22 bp, Homo sapiens
gaggagcccagcaccatcactt

SEQ ID NO: 9086864 - DNA, 22 bp, Homo sapiens
gaggcaggcagattgcttgagg

SEQ ID NO: 9086865 - DNA, 22 bp, Homo sapiens
gaggcaggccctgaatgagtca

SEQ ID NO: 9086866 - DNA, 22 bp, Homo sapiens
gaggcaggcagattgcttgagg

SEQ ID NO: 9086867 - DNA, 22 bp, Homo sapiens
gaggcaggaggattgcttgagc

SEQ ID NO: 9086868 - DNA, 22 bp, Homo sapiens
gaggcaggaggattgcttgagc

SEQ ID NO: 9086869 - DNA, 22 bp, Homo sapiens
gaggcaggcactgttatcagca

SEQ ID NO: 9086870 - DNA, 22 bp, Homo sapiens
gaggagaggggctcccaagagc

SEQ ID NO: 9086871 - DNA, 22 bp, Homo sapiens
gaggagcaagaaatagtgccca

SEQ ID NO: 9086872 - DNA, 22 bp, Homo sapiens
gaggagaggggctcccaagagc

SEQ ID NO: 9086873 - DNA, 22 bp, Homo sapiens
gaggagcacatgaggctgaggg

SEQ ID NO: 9086874 - DNA, 22 bp, Homo sapiens
gaggagcacatgaggctgaggg

SEQ ID NO: 9086875 - DNA, 22 bp, Homo sapiens
gaggagccaaggtatgtgtgtt

SEQ ID NO: 9086876 - DNA, 20 bp, Homo sapiens
gaggagccaccttgagctgg

SEQ ID NO: 9086877 - DNA, 22 bp, Homo sapiens
gaggagagggctgcgggcccac

SEQ ID NO: 9086878 - DNA, 22 bp, Homo sapiens
gaggagaggccatcgttgttat

SEQ ID NO: 9086879 - DNA, 22 bp, Homo sapiens
gaggagaggctggacgcggtga

SEQ ID NO: 9086880 - DNA, 22 bp, Homo sapiens
gaggagagatggtagattgggt

SEQ ID NO: 9086881 - DNA, 22 bp, Homo sapiens
gaggagagatggtagattgggt

SEQ ID NO: 9086882 - DNA, 22 bp, Homo sapiens
gaggagagcctgcactttgacc

SEQ ID NO: 9086883 - DNA, 22 bp, Homo sapiens
gaggagagcctgcactttgacc

SEQ ID NO: 9086884 - DNA, 22 bp, Homo sapiens
gaggagaggccatcgttgttat

SEQ ID NO: 9086885 - DNA, 22 bp, Homo sapiens
gacatttaatagtattgtggga

SEQ ID NO: 9086886 - DNA, 22 bp, Homo sapiens
gacatttactgaatactgatta

SEQ ID NO: 9086887 - DNA, 19 bp, Homo sapiens
gacattcctgacactggct

SEQ ID NO: 9086888 - DNA, 22 bp, Homo sapiens
gacattcattaagcctttctgt

SEQ ID NO: 9086889 - DNA, 22 bp, Homo sapiens
gacattcattgatgtcttcctc

SEQ ID NO: 9086890 - DNA, 22 bp, Homo sapiens
gacattcagccaattactttct

SEQ ID NO: 9086891 - DNA, 22 bp, Homo sapiens
gacattcaggtgttcaatgcca

SEQ ID NO: 9086892 - DNA, 22 bp, Homo sapiens
gacagcagcatgtttacaggcc

SEQ ID NO: 9086893 - DNA, 22 bp, Homo sapiens
gacagcagataagacctcatca

SEQ ID NO: 9086894 - DNA, 22 bp, Homo sapiens
gacagcagatgaagcctgcaga

SEQ ID NO: 9086895 - DNA, 22 bp, Homo sapiens
gacagcagatgaagcctgcaga

SEQ ID NO: 9086896 - DNA, 22 bp, Homo sapiens
gacagcaagagacagagcatcc

SEQ ID NO: 9086897 - DNA, 22 bp, Homo sapiens
gacagcaagagacagagcatcc

SEQ ID NO: 9086898 - DNA, 22 bp, Homo sapiens
gacagcaatgacggggcagctg

SEQ ID NO: 9086899 - DNA, 22 bp, Homo sapiens
gacagcaagagacagagcatcc

SEQ ID NO: 9086900 - DNA, 22 bp, Homo sapiens
gacagcaagagacagagcatcc

SEQ ID NO: 9086901 - DNA, 21 bp, Homo sapiens
gacagcaactgtagtcctctt

SEQ ID NO: 9086902 - DNA, 22 bp, Homo sapiens
gacagaggagaagatgctgtgg

SEQ ID NO: 9086903 - DNA, 22 bp, Homo sapiens
gacagaggagaagatgctgtgg

SEQ ID NO: 9086904 - DNA, 22 bp, Homo sapiens
gacagcaatgacggggcagctg

SEQ ID NO: 9086905 - DNA, 22 bp, Homo sapiens
gacagcagacaaaccatgtttt

SEQ ID NO: 9086906 - DNA, 22 bp, Homo sapiens
gacagcagagcagactaatgga

SEQ ID NO: 9086907 - DNA, 22 bp, Homo sapiens
gacagcagagcagactaatgga

SEQ ID NO: 9086908 - DNA, 22 bp, Homo sapiens
gacagcagacagcctggcccct

SEQ ID NO: 9086909 - DNA, 22 bp, Homo sapiens
gacagcagacagaactacctgc

SEQ ID NO: 9086910 - DNA, 22 bp, Homo sapiens
gacagcagacagaactacctgc

SEQ ID NO: 9086911 - DNA, 22 bp, Homo sapiens
gacagagccagttggaggtagg

SEQ ID NO: 9086912 - DNA, 22 bp, Homo sapiens
gacagagcagcacccagcccct

SEQ ID NO: 9086913 - DNA, 22 bp, Homo sapiens
gacagagattgaatcaggaaat

SEQ ID NO: 9086914 - DNA, 22 bp, Homo sapiens
gacagagattgaatcaggaaat

SEQ ID NO: 9086915 - DNA, 22 bp, Homo sapiens
gacagagattgaatcaggaaat

SEQ ID NO: 9086916 - DNA, 22 bp, Homo sapiens
gacagagaggctgagcagtaca

SEQ ID NO: 9086917 - DNA, 22 bp, Homo sapiens
gacagacatttcctgatccaat

SEQ ID NO: 9086918 - DNA, 22 bp, Homo sapiens
gacagacaggtgtggtaggcac

SEQ ID NO: 9086919 - DNA, 21 bp, Homo sapiens
gactctctagtgctgtccagt

SEQ ID NO: 9086920 - DNA, 22 bp, Homo sapiens
gactctggttgcgggttctgct

SEQ ID NO: 9086921 - DNA, 22 bp, Homo sapiens
gactgaaggtctcagcatgtga

SEQ ID NO: 9086922 - DNA, 22 bp, Homo sapiens
gactctgtgggaggaggctcag

SEQ ID NO: 9086923 - DNA, 22 bp, Homo sapiens
gactgaggcctttattgagaca

SEQ ID NO: 9086924 - DNA, 22 bp, Homo sapiens
gactgagggacagggcagtgga

SEQ ID NO: 9086925 - DNA, 22 bp, Homo sapiens
gactgaggtattaagatggctt

SEQ ID NO: 9086926 - DNA, 22 bp, Homo sapiens
gacatttagctgttttgcattt

SEQ ID NO: 9086927 - DNA, 22 bp, Homo sapiens
gacatttagaagttagattcaa

SEQ ID NO: 9086928 - DNA, 22 bp, Homo sapiens
gaccacagctacaagggcaagg

SEQ ID NO: 9086929 - DNA, 22 bp, Homo sapiens
gaccacagcagtgcaagaggag

SEQ ID NO: 9086930 - DNA, 22 bp, Homo sapiens
gaccagagaaaggcactggaag

SEQ ID NO: 9086931 - DNA, 22 bp, Homo sapiens
gaccacaggtatgggcttggca

SEQ ID NO: 9086932 - DNA, 22 bp, Homo sapiens
gaccactgaatgcacttctaat

SEQ ID NO: 9086933 - DNA, 22 bp, Homo sapiens
gaccactggcgctgcgagaccc

SEQ ID NO: 9086934 - DNA, 22 bp, Homo sapiens
gaccactgatgacatgaggaga

SEQ ID NO: 9086935 - DNA, 22 bp, Homo sapiens
gactccaggtgcaggaggagcc

SEQ ID NO: 9086936 - DNA, 22 bp, Homo sapiens
gactccaggtgtccaggcctcc

SEQ ID NO: 9086937 - DNA, 22 bp, Homo sapiens
gactccaggtgtccaggcctcc

SEQ ID NO: 9086938 - DNA, 22 bp, Homo sapiens
gactcctcagtcaccctcagct

SEQ ID NO: 9086939 - DNA, 22 bp, Homo sapiens
gaccaggcccaggtgcaaggga

SEQ ID NO: 9086940 - DNA, 22 bp, Homo sapiens
gagacctgcagctgtagtctgc

SEQ ID NO: 9086941 - DNA, 22 bp, Homo sapiens
gagacctggaggatgtggatgg

SEQ ID NO: 9086942 - DNA, 17 bp, Homo sapiens
gagacccccactacacc

SEQ ID NO: 9086943 - DNA, 22 bp, Homo sapiens
gagaccccagctcagcctccag

SEQ ID NO: 9086944 - DNA, 22 bp, Homo sapiens
gagacctcttggtatcgctagg

SEQ ID NO: 9086945 - DNA, 22 bp, Homo sapiens
gagaccccctgagttatggcct

SEQ ID NO: 9086946 - DNA, 22 bp, Homo sapiens
gagactgatggggctcccagaa

SEQ ID NO: 9086947 - DNA, 22 bp, Homo sapiens
gagactgggggcttggcctttt

SEQ ID NO: 9086948 - DNA, 22 bp, Homo sapiens
gagactgtcacttgggacctgt

SEQ ID NO: 9086949 - DNA, 22 bp, Homo sapiens
gagactggtgtttgctgggctg

SEQ ID NO: 9086950 - DNA, 22 bp, Homo sapiens
gagagaaaggcttgcaggctgt

SEQ ID NO: 9086951 - DNA, 18 bp, Homo sapiens
gagagggatccctcagga

SEQ ID NO: 9086952 - DNA, 22 bp, Homo sapiens
gagagggcaaacttgtagctaa

SEQ ID NO: 9086953 - DNA, 22 bp, Homo sapiens
gagagaacacaaagggccagct

SEQ ID NO: 9086954 - DNA, 18 bp, Homo sapiens
gagagggatccctcagga

SEQ ID NO: 9086955 - DNA, 22 bp, Homo sapiens
gagagggccgggggccagctcc

SEQ ID NO: 9086956 - DNA, 22 bp, Homo sapiens
gagagggccgggggccagctcc

SEQ ID NO: 9086957 - DNA, 22 bp, Homo sapiens
gagaaacactgttagtttatta

SEQ ID NO: 9086958 - DNA, 19 bp, Homo sapiens
gagaaaccccgtctttagg

SEQ ID NO: 9086959 - DNA, 22 bp, Homo sapiens
gagaaaccgattctgcatgtca

SEQ ID NO: 9086960 - DNA, 23 bp, Homo sapiens
gagaaacctcggtaagcaggagg

SEQ ID NO: 9086961 - DNA, 22 bp, Homo sapiens
gagaaacaggaattgagtcgct

SEQ ID NO: 9086962 - DNA, 22 bp, Homo sapiens
gactgaggtgacctaggactac

SEQ ID NO: 9086963 - DNA, 22 bp, Homo sapiens
gactgaggtgcccagaggtgac

SEQ ID NO: 9086964 - DNA, 22 bp, Homo sapiens
gactgcaaccttagactagaaa

SEQ ID NO: 9086965 - DNA, 22 bp, Homo sapiens
gactgcattcatttggttggca

SEQ ID NO: 9086966 - DNA, 22 bp, Homo sapiens
gactgcatgatgttccagagga

SEQ ID NO: 9086967 - DNA, 22 bp, Homo sapiens
gactgcataggaccaaatagta

SEQ ID NO: 9086968 - DNA, 22 bp, Homo sapiens
gagaaagatggaatcttacagg

SEQ ID NO: 9086969 - DNA, 22 bp, Homo sapiens
gagaaacttggagttattctgg

SEQ ID NO: 9086970 - DNA, 18 bp, Homo sapiens
gagaaacctgtgaatgct

SEQ ID NO: 9086971 - DNA, 22 bp, Homo sapiens
gagaaacctgtaaggaaggaag

SEQ ID NO: 9086972 - DNA, 22 bp, Homo sapiens
gagaaagattgtccttcagggg

SEQ ID NO: 9086973 - DNA, 22 bp, Homo sapiens
gagaaagctaaataagttgatt

SEQ ID NO: 9086974 - DNA, 23 bp, Homo sapiens
gagaaagccggctatgatcctgg

SEQ ID NO: 9086975 - DNA, 22 bp, Homo sapiens
gagacagatctcggctccatgc

SEQ ID NO: 9086976 - DNA, 22 bp, Homo sapiens
gagaaagcttctttcccacagg

SEQ ID NO: 9086977 - DNA, 22 bp, Homo sapiens
gagacattcttaggaacaatgt

SEQ ID NO: 9086978 - DNA, 22 bp, Homo sapiens
gagacagatgctgctggagcat

SEQ ID NO: 9086979 - DNA, 22 bp, Homo sapiens
gagacagatgctgctggagcat

SEQ ID NO: 9086980 - DNA, 22 bp, Homo sapiens
gaagcaagtgcaaggaagaggc

SEQ ID NO: 9086981 - DNA, 22 bp, Homo sapiens
gaagcaagtgcaaggaagaggc

SEQ ID NO: 9086982 - DNA, 22 bp, Homo sapiens
gaagcaagtggcctgattcaga

SEQ ID NO: 9086983 - DNA, 22 bp, Homo sapiens
gaagcaaagagctagtgccgct

SEQ ID NO: 9086984 - DNA, 22 bp, Homo sapiens
gaaaggcaggcagggtgtccat

SEQ ID NO: 9086985 - DNA, 22 bp, Homo sapiens
gaaaggcaggcagggtgtccat

SEQ ID NO: 9086986 - DNA, 22 bp, Homo sapiens
gaagcagcgaagtggaagggac

SEQ ID NO: 9086987 - DNA, 22 bp, Homo sapiens
gaagcagctaggatcttcattt

SEQ ID NO: 9086988 - DNA, 22 bp, Homo sapiens
gaagcagtatcctgacagcacc

SEQ ID NO: 9086989 - DNA, 22 bp, Homo sapiens
gaagcagtgtgaacccatgtaa

SEQ ID NO: 9086990 - DNA, 22 bp, Homo sapiens
gaagcagggagcagtctttgca

SEQ ID NO: 9086991 - DNA, 22 bp, Homo sapiens
gaagcagtatcctgacagcacc

SEQ ID NO: 9086992 - DNA, 22 bp, Homo sapiens
gaagcagctttctggtgaggag

SEQ ID NO: 9086993 - DNA, 22 bp, Homo sapiens
gaagccaacattccaagtagaa

SEQ ID NO: 9086994 - DNA, 22 bp, Homo sapiens
gaagcatcagcaatggctggaa

SEQ ID NO: 9086995 - DNA, 22 bp, Homo sapiens
gaagccaacattccaagtagaa

SEQ ID NO: 9086996 - DNA, 22 bp, Homo sapiens
gaagccaagtgcaaatgcctta

SEQ ID NO: 9086997 - DNA, 22 bp, Homo sapiens
gaagccaagggctgcttttcct

SEQ ID NO: 9086998 - DNA, 22 bp, Homo sapiens
gaagccaagccagctgatggag

SEQ ID NO: 9086999 - DNA, 22 bp, Homo sapiens
gaagccaagggctgcttttcct

SEQ ID NO: 9087000 - DNA, 22 bp, Homo sapiens
gaagccaagccagctgatggag

SEQ ID NO: 9087001 - DNA, 22 bp, Homo sapiens
gaaaggaaatattctaagcact

SEQ ID NO: 9087002 - DNA, 22 bp, Homo sapiens
gaaagctgggaaataaatatta

SEQ ID NO: 9087003 - DNA, 22 bp, Homo sapiens
gaaagctgtgaaatagtgctct

SEQ ID NO: 9087004 - DNA, 22 bp, Homo sapiens
gaaaggaagaaaggtcatttta

SEQ ID NO: 9087005 - DNA, 18 bp, Homo sapiens
gaaaggagagacagtagg

SEQ ID NO: 9087006 - DNA, 18 bp, Homo sapiens
gaaaggagagacagtagg

SEQ ID NO: 9087007 - DNA, 22 bp, Homo sapiens
gaaaggagggaaacagagcggt

SEQ ID NO: 9087008 - DNA, 22 bp, Homo sapiens
gaaaggagggaaacagagcggt

SEQ ID NO: 9087009 - DNA, 22 bp, Homo sapiens
gaaaggagggaaacagagcggt

SEQ ID NO: 9087010 - DNA, 22 bp, Homo sapiens
gaaaggagggaaacagagcggt

SEQ ID NO: 9087011 - DNA, 22 bp, Homo sapiens
gaaaggagggctcacaaaagtg

SEQ ID NO: 9087012 - DNA, 22 bp, Homo sapiens
gaaaggagtgctttccaggtct

SEQ ID NO: 9087013 - DNA, 22 bp, Homo sapiens
gaaaggagtgctttccaggtct

SEQ ID NO: 9087014 - DNA, 20 bp, Homo sapiens
gaaaggagtgtccctgtgag

SEQ ID NO: 9087015 - DNA, 22 bp, Homo sapiens
gaaaggagtgaatatttgtgac

SEQ ID NO: 9087016 - DNA, 22 bp, Homo sapiens
gaaaggagtcagtcttactgaa

SEQ ID NO: 9087017 - DNA, 22 bp, Homo sapiens
gaaaggagagggttaaggagct

SEQ ID NO: 9087018 - DNA, 22 bp, Homo sapiens
gaaaggagggaaacagagcggt

SEQ ID NO: 9087019 - DNA, 22 bp, Homo sapiens
gaaaggagggaaacagagcggt

SEQ ID NO: 9087020 - DNA, 17 bp, Homo sapiens
gaaaggaggcaacactg

SEQ ID NO: 9087021 - DNA, 17 bp, Homo sapiens
gaaaggaggcaacactg

SEQ ID NO: 9087022 - DNA, 17 bp, Homo sapiens
gaaaggaggcaacactg

SEQ ID NO: 9087023 - DNA, 17 bp, Homo sapiens
gaaaggaggcaacactg

SEQ ID NO: 9087024 - DNA, 16 bp, Homo sapiens
gaaggagattcagaaa

SEQ ID NO: 9087025 - DNA, 22 bp, Homo sapiens
gaaggagctaaagggagccctg

SEQ ID NO: 9087026 - DNA, 22 bp, Homo sapiens
gaaggagctaccaagactgaat

SEQ ID NO: 9087027 - DNA, 22 bp, Homo sapiens
gaaggagctaccaagactgaat

SEQ ID NO: 9087028 - DNA, 22 bp, Homo sapiens
gaaggagctaccaagactgaat

SEQ ID NO: 9087029 - DNA, 22 bp, Homo sapiens
gaaggagagggtcaaggataat

SEQ ID NO: 9087030 - DNA, 22 bp, Homo sapiens
gaagccacgttaaattggctgt

SEQ ID NO: 9087031 - DNA, 22 bp, Homo sapiens
gaagccaagtgcaaatgcctta

SEQ ID NO: 9087032 - DNA, 22 bp, Homo sapiens
gaagccaagggctgcttttcct

SEQ ID NO: 9087033 - DNA, 22 bp, Homo sapiens
gaagccaagtcctcgagtttca

SEQ ID NO: 9087034 - DNA, 22 bp, Homo sapiens
gaagccaagtcctcgagtttca

SEQ ID NO: 9087035 - DNA, 22 bp, Homo sapiens
gaaggcaggcttctgattaggt

SEQ ID NO: 9087036 - DNA, 22 bp, Homo sapiens
gaaggcaggcttctgattaggt

SEQ ID NO: 9087037 - DNA, 22 bp, Homo sapiens
gaaggcagggaatgtggtgcta

SEQ ID NO: 9087038 - DNA, 22 bp, Homo sapiens
gaaggcagggaatgtggtgcta

SEQ ID NO: 9087039 - DNA, 22 bp, Homo sapiens
gaaggcagggaatgtggtgcta

SEQ ID NO: 9087040 - DNA, 22 bp, Homo sapiens
gaaggcaaggagggaagccacc

SEQ ID NO: 9087041 - DNA, 22 bp, Homo sapiens
gaaggcaagctttggatatgag

SEQ ID NO: 9087042 - DNA, 22 bp, Homo sapiens
gaaggcaagctttggatatgag

SEQ ID NO: 9087043 - DNA, 22 bp, Homo sapiens
gaaggcaagtgctccttgggtc

SEQ ID NO: 9087044 - DNA, 22 bp, Homo sapiens
gaaggcaagtgctccttgggtc

SEQ ID NO: 9087045 - DNA, 22 bp, Homo sapiens
gaaggcaagtgagccaagagaa

SEQ ID NO: 9087046 - DNA, 22 bp, Homo sapiens
gaaggcaagtgagccaagagaa

SEQ ID NO: 9087047 - DNA, 22 bp, Homo sapiens
gaaggcaagtgagccaagagaa

SEQ ID NO: 9087048 - DNA, 22 bp, Homo sapiens
gaaggcaagtgagccaagagaa

SEQ ID NO: 9087049 - DNA, 20 bp, Homo sapiens
gaaggcaatggtttggcaca

SEQ ID NO: 9087050 - DNA, 22 bp, Homo sapiens
gaaggcactgaactccttctgg

SEQ ID NO: 9087051 - DNA, 22 bp, Homo sapiens
gaaggcaccctccatcactcac

SEQ ID NO: 9087052 - DNA, 22 bp, Homo sapiens
gaaggcattctattctacatat

SEQ ID NO: 9087053 - DNA, 22 bp, Homo sapiens
gaaggcatcaccaacattgaaa

SEQ ID NO: 9087054 - DNA, 22 bp, Homo sapiens
gaaggcagtaaatggctgtttt

SEQ ID NO: 9087055 - DNA, 22 bp, Homo sapiens
gaaggcagtaaatggctgtttt

SEQ ID NO: 9087056 - DNA, 22 bp, Homo sapiens
gaaggcaggtttttcaaaactg

SEQ ID NO: 9087057 - DNA, 22 bp, Homo sapiens
gaaggcaggtttttcaaaactg

SEQ ID NO: 9087058 - DNA, 22 bp, Homo sapiens
gaaggcatttcagagatctctg

SEQ ID NO: 9087059 - DNA, 22 bp, Homo sapiens
gaaggccaagaggctccaagat

SEQ ID NO: 9087060 - DNA, 22 bp, Homo sapiens
gaaggccaagaggctccaagat

SEQ ID NO: 9087061 - DNA, 22 bp, Homo sapiens
gaaggccacaaaaaatgtcata

SEQ ID NO: 9087062 - DNA, 22 bp, Homo sapiens
gaaggccactttgtgttgagaa

SEQ ID NO: 9087063 - DNA, 22 bp, Homo sapiens
gaaggccacaagagaagttaag

SEQ ID NO: 9087064 - DNA, 22 bp, Homo sapiens
gaaggccacggaatggagctgg

SEQ ID NO: 9087065 - DNA, 22 bp, Homo sapiens
gaagggagaaggttgggtgacg

SEQ ID NO: 9087066 - DNA, 22 bp, Homo sapiens
gaagggagaaggttgggtgacg

SEQ ID NO: 9087067 - DNA, 22 bp, Homo sapiens
gaagggaaggaaagaaccagca

SEQ ID NO: 9087068 - DNA, 22 bp, Homo sapiens
gaaggccattgcgtcctgggat

SEQ ID NO: 9087069 - DNA, 22 bp, Homo sapiens
gaaggccattagagcctgtgcc

SEQ ID NO: 9087070 - DNA, 22 bp, Homo sapiens
gaaggccagttttgagataggt

SEQ ID NO: 9087071 - DNA, 22 bp, Homo sapiens
gaaggccattgcgtcctgggat

SEQ ID NO: 9087072 - DNA, 22 bp, Homo sapiens
gaaggccatttttaggtagaat

SEQ ID NO: 9087073 - DNA, 22 bp, Homo sapiens
gaaggcccagcttgaatgctgc

SEQ ID NO: 9087074 - DNA, 22 bp, Homo sapiens
gaatccagggttgtttgagcta

SEQ ID NO: 9087075 - DNA, 22 bp, Homo sapiens
gaatctcattctaactagtagg

SEQ ID NO: 9087076 - DNA, 22 bp, Homo sapiens
gaatctcagtggaagcaggaag

SEQ ID NO: 9087077 - DNA, 22 bp, Homo sapiens
gaatctcaggaagatctctgca

SEQ ID NO: 9087078 - DNA, 22 bp, Homo sapiens
gaatctcaaattaagaatttta

SEQ ID NO: 9087079 - DNA, 22 bp, Homo sapiens
gaatctagggcctagatcacag

SEQ ID NO: 9087080 - DNA, 22 bp, Homo sapiens
gaatccatcatgcagaacaatg

SEQ ID NO: 9087081 - DNA, 22 bp, Homo sapiens
gaaggtagctgctgagatgaca

SEQ ID NO: 9087082 - DNA, 22 bp, Homo sapiens
gaagggtgtgtgtgagggacac

SEQ ID NO: 9087083 - DNA, 22 bp, Homo sapiens
gaaggtccagcgtggccaagtc

SEQ ID NO: 9087084 - DNA, 22 bp, Homo sapiens
gaaggtgcagtggctggaggct

SEQ ID NO: 9087085 - DNA, 22 bp, Homo sapiens
gaagggtgtgatttgcctgaga

SEQ ID NO: 9087086 - DNA, 22 bp, Homo sapiens
gaagggggttgcagtctagggt

SEQ ID NO: 9087087 - DNA, 22 bp, Homo sapiens
gaagggggagctcttcctaatt

SEQ ID NO: 9087088 - DNA, 18 bp, Homo sapiens
gaagggagctggaatgca

SEQ ID NO: 9087089 - DNA, 18 bp, Homo sapiens
gaagggagctggaatgca

SEQ ID NO: 9087090 - DNA, 22 bp, Homo sapiens
gaagggctgcaggtctgggccc

SEQ ID NO: 9087091 - DNA, 22 bp, Homo sapiens
gaaggggactggcagctgcaga

SEQ ID NO: 9087092 - DNA, 22 bp, Homo sapiens
gaaggggagtggctagtgtgtg

SEQ ID NO: 9087093 - DNA, 22 bp, Homo sapiens
gaagggggaaaatgacaacaga

SEQ ID NO: 9087094 - DNA, 22 bp, Homo sapiens
gaaggggactggcagctgcaga

SEQ ID NO: 9087095 - DNA, 19 bp, Homo sapiens
gaaggggaaggtgggtacc

SEQ ID NO: 9087096 - DNA, 19 bp, Homo sapiens
gaaggggaaggtgggtacc

SEQ ID NO: 9087097 - DNA, 22 bp, Homo sapiens
gaaggggaaagttgagcaaata

SEQ ID NO: 9087098 - DNA, 22 bp, Homo sapiens
gacactttattaagctgttgtt

SEQ ID NO: 9087099 - DNA, 22 bp, Homo sapiens
gacagaaggcatctagggcacg

SEQ ID NO: 9087100 - DNA, 22 bp, Homo sapiens
gacagaaggcatctagggcacg

SEQ ID NO: 9087101 - DNA, 22 bp, Homo sapiens
gacagaagaggaacttggacag

SEQ ID NO: 9087102 - DNA, 22 bp, Homo sapiens
gacagacactgtgtcctcactt

SEQ ID NO: 9087103 - DNA, 22 bp, Homo sapiens
gacagacaggagctcacaggca

SEQ ID NO: 9087104 - DNA, 22 bp, Homo sapiens
gacagacaggagctcacaggca

SEQ ID NO: 9087105 - DNA, 22 bp, Homo sapiens
gacagacaggagctcacaggca

SEQ ID NO: 9087106 - DNA, 22 bp, Homo sapiens
gacagacaggagctcacaggca

SEQ ID NO: 9087107 - DNA, 22 bp, Homo sapiens
gacagacaggtgtggtaggcac

SEQ ID NO: 9087108 - DNA, 22 bp, Homo sapiens
gacagacaggggttctcctgga

SEQ ID NO: 9087109 - DNA, 22 bp, Homo sapiens
gacacagtagccagtgcagtga

SEQ ID NO: 9087110 - DNA, 22 bp, Homo sapiens
gaatgatatattagcagatttt

SEQ ID NO: 9087111 - DNA, 22 bp, Homo sapiens
gaatgaaagatttgcattctat

SEQ ID NO: 9087112 - DNA, 22 bp, Homo sapiens
gaatgaattcagcacatggaat

SEQ ID NO: 9087113 - DNA, 22 bp, Homo sapiens
gaatgacccactatcaagagac

SEQ ID NO: 9087114 - DNA, 22 bp, Homo sapiens
gaatgacattgaaaagacattg

SEQ ID NO: 9087115 - DNA, 22 bp, Homo sapiens
ctgagagatcaagccacaggat

SEQ ID NO: 9087116 - DNA, 22 bp, Homo sapiens
ctgagaggcggaggttgcagtg

SEQ ID NO: 9087117 - DNA, 22 bp, Homo sapiens
ctgaataattttctgttgtatg

SEQ ID NO: 9087118 - DNA, 22 bp, Homo sapiens
ctgaataattttatagttgctg

SEQ ID NO: 9087119 - DNA, 22 bp, Homo sapiens
ctgaataatgttctcttgtatg

SEQ ID NO: 9087120 - DNA, 22 bp, Homo sapiens
ctgaataattttatagttgctg

SEQ ID NO: 9087121 - DNA, 22 bp, Homo sapiens
ctgaataatattccattatgag

SEQ ID NO: 9087122 - DNA, 22 bp, Homo sapiens
ctgaataatattccattatgag

SEQ ID NO: 9087123 - DNA, 22 bp, Homo sapiens
ctgaataaagccctcgcgcgct

SEQ ID NO: 9087124 - DNA, 22 bp, Homo sapiens
ctgaataatacagactagcttc

SEQ ID NO: 9087125 - DNA, 22 bp, Homo sapiens
ctgagaggtgacagcgtgctgg

SEQ ID NO: 9087126 - DNA, 22 bp, Homo sapiens
ctgagaggtaatcacacaaaat

SEQ ID NO: 9087127 - DNA, 22 bp, Homo sapiens
ctgagaggtaagcagcgcagtg

SEQ ID NO: 9087128 - DNA, 22 bp, Homo sapiens
ctgagaggtaagcagcgcagtg

SEQ ID NO: 9087129 - DNA, 22 bp, Homo sapiens
ctgagaggtaagcagcgcagtg

SEQ ID NO: 9087130 - DNA, 22 bp, Homo sapiens
ctgagaggtaagcagcgcagtg

SEQ ID NO: 9087131 - DNA, 22 bp, Homo sapiens
ctgagaggggaccagggtgttt

SEQ ID NO: 9087132 - DNA, 22 bp, Homo sapiens
ctgagaggtgctggtggctgca

SEQ ID NO: 9087133 - DNA, 22 bp, Homo sapiens
ctgagaggtgacagcgtgctgg

SEQ ID NO: 9087134 - DNA, 22 bp, Homo sapiens
ctgagaggtgctggtggctgca

SEQ ID NO: 9087135 - DNA, 22 bp, Homo sapiens
ctgagctgggctctcttgaggg

SEQ ID NO: 9087136 - DNA, 22 bp, Homo sapiens
ctgagctgggagtagagactct

SEQ ID NO: 9087137 - DNA, 22 bp, Homo sapiens
ctgagctgggagtagagactct

SEQ ID NO: 9087138 - DNA, 22 bp, Homo sapiens
ctgagctgggagtagagactct

SEQ ID NO: 9087139 - DNA, 22 bp, Homo sapiens
ctgagctaggagttaggaagct

SEQ ID NO: 9087140 - DNA, 22 bp, Homo sapiens
ctgagcacctgttataggttag

SEQ ID NO: 9087141 - DNA, 22 bp, Homo sapiens
ctgagcacagaaataagatatt

SEQ ID NO: 9087142 - DNA, 22 bp, Homo sapiens
ctgagccttattcaccagccct

SEQ ID NO: 9087143 - DNA, 22 bp, Homo sapiens
ctgagccttgatgtcccttgtc

SEQ ID NO: 9087144 - DNA, 20 bp, Homo sapiens
ctgagcgtctaagaggtgag

SEQ ID NO: 9087145 - DNA, 22 bp, Homo sapiens
ctgagatctttatacgaggcac

SEQ ID NO: 9087146 - DNA, 22 bp, Homo sapiens
ctgagatctttatacgaggcac

SEQ ID NO: 9087147 - DNA, 22 bp, Homo sapiens
ctgagatggtagatggatgtta

SEQ ID NO: 9087148 - DNA, 22 bp, Homo sapiens
ctgagatggtagatggatgtta

SEQ ID NO: 9087149 - DNA, 22 bp, Homo sapiens
ctgagatggtctctttgttact

SEQ ID NO: 9087150 - DNA, 22 bp, Homo sapiens
ctgagatggccactgggtctca

SEQ ID NO: 9087151 - DNA, 22 bp, Homo sapiens
ctgagatggccactgggtctca

SEQ ID NO: 9087152 - DNA, 22 bp, Homo sapiens
ctgagatggagttttgctcttg

SEQ ID NO: 9087153 - DNA, 22 bp, Homo sapiens
ctgagatggagttttgctcttg

SEQ ID NO: 9087154 - DNA, 22 bp, Homo sapiens
ctgagatggagtttcgctcttc

SEQ ID NO: 9087155 - DNA, 22 bp, Homo sapiens
ctgagatggagtttcgctcttc

SEQ ID NO: 9087156 - DNA, 22 bp, Homo sapiens
ctgagctgttactctgtcctcg

SEQ ID NO: 9087157 - DNA, 22 bp, Homo sapiens
ctgagctgttactctgtcctcg

SEQ ID NO: 9087158 - DNA, 22 bp, Homo sapiens
ctgagctgggctctcttgaggg

SEQ ID NO: 9087159 - DNA, 22 bp, Homo sapiens
ctgagctggtctatggacttgg

SEQ ID NO: 9087160 - DNA, 22 bp, Homo sapiens
ctgagctggtggaagcatgcag

SEQ ID NO: 9087161 - DNA, 22 bp, Homo sapiens
ctgagctggtggaagcatgcag

SEQ ID NO: 9087162 - DNA, 22 bp, Homo sapiens
ctgagcttccagttcctccagg

SEQ ID NO: 9087163 - DNA, 22 bp, Homo sapiens
ctgagcttcagtgcactgggag

SEQ ID NO: 9087164 - DNA, 22 bp, Homo sapiens
ctgagcttaaccctgttagcaa

SEQ ID NO: 9087165 - DNA, 22 bp, Homo sapiens
ctgagctgtttaatcccagata

SEQ ID NO: 9087166 - DNA, 22 bp, Homo sapiens
ctgagcttaaccctgttagcaa

SEQ ID NO: 9087167 - DNA, 22 bp, Homo sapiens
ctgaggacattgatgaggcaat

SEQ ID NO: 9087168 - DNA, 22 bp, Homo sapiens
ctgaggctgggcatggggtcca

SEQ ID NO: 9087169 - DNA, 22 bp, Homo sapiens
ctgagggaacttgggcaagtct

SEQ ID NO: 9087170 - DNA, 22 bp, Homo sapiens
ctgaggctgggcatggggtcca

SEQ ID NO: 9087171 - DNA, 18 bp, Homo sapiens
ctgaggctggcaggagcc

SEQ ID NO: 9087172 - DNA, 18 bp, Homo sapiens
ctgaggctggcaggagcc

SEQ ID NO: 9087173 - DNA, 18 bp, Homo sapiens
ctgaggctggcaggagcc

SEQ ID NO: 9087174 - DNA, 22 bp, Homo sapiens
ctgaggctgggcatggggtcca

SEQ ID NO: 9087175 - DNA, 22 bp, Homo sapiens
ctgagggagaagtcacgggcag

SEQ ID NO: 9087176 - DNA, 22 bp, Homo sapiens
ctgagggagaagtcacgggcag

SEQ ID NO: 9087177 - DNA, 18 bp, Homo sapiens
ctgagggcaacagaggct

SEQ ID NO: 9087178 - DNA, 18 bp, Homo sapiens
ctgagggcaacagaggct

SEQ ID NO: 9087179 - DNA, 18 bp, Homo sapiens
ctgagggcaacagaggct

SEQ ID NO: 9087180 - DNA, 22 bp, Homo sapiens
ctgagggcaccgacagagtgga

SEQ ID NO: 9087181 - DNA, 22 bp, Homo sapiens
ctgagggatgggctgggccgcc

SEQ ID NO: 9087182 - DNA, 22 bp, Homo sapiens
ctgagggcagtgatgaaggtga

SEQ ID NO: 9087183 - DNA, 22 bp, Homo sapiens
ctgagggcatgaacattccata

SEQ ID NO: 9087184 - DNA, 22 bp, Homo sapiens
ctgagggcatgaacattccata

SEQ ID NO: 9087185 - DNA, 22 bp, Homo sapiens
ttttctctatattgtctgtgaa

SEQ ID NO: 9087186 - DNA, 22 bp, Homo sapiens
ttttctctacaaaataaccagc

SEQ ID NO: 9087187 - DNA, 22 bp, Homo sapiens
ttttctctacaaaataaccagc

SEQ ID NO: 9087188 - DNA, 22 bp, Homo sapiens
ttttctcctttctaggtcacat

SEQ ID NO: 9087189 - DNA, 22 bp, Homo sapiens
ttttctcctttctaggtcacat

SEQ ID NO: 9087190 - DNA, 22 bp, Homo sapiens
ttttctcctttcaagatagcat

SEQ ID NO: 9087191 - DNA, 22 bp, Homo sapiens
ttttctcctttcaagatagcat

SEQ ID NO: 9087192 - DNA, 22 bp, Homo sapiens
ttttctcccgctggctgctctt

SEQ ID NO: 9087193 - DNA, 22 bp, Homo sapiens
ttttctcccgctggctgctctt

SEQ ID NO: 9087194 - DNA, 22 bp, Homo sapiens
ttttctccagggaacaaggtga

SEQ ID NO: 9087195 - DNA, 22 bp, Homo sapiens
ttttctccagggaacaaggtga

SEQ ID NO: 9087196 - DNA, 22 bp, Homo sapiens
ttttctccccagagaccatcat

SEQ ID NO: 9087197 - DNA, 22 bp, Homo sapiens
ttttctccccagagaccatcat

SEQ ID NO: 9087198 - DNA, 22 bp, Homo sapiens
ttttctcctaagacccttcacc

SEQ ID NO: 9087199 - DNA, 22 bp, Homo sapiens
ttttctcctaagacccttcacc

SEQ ID NO: 9087200 - DNA, 17 bp, Homo sapiens
ttttctcctgcccattc

SEQ ID NO: 9087201 - DNA, 17 bp, Homo sapiens
ttttctcctgcccattc

SEQ ID NO: 9087202 - DNA, 22 bp, Homo sapiens
tttttctctaagtagtcccaaa

SEQ ID NO: 9087203 - DNA, 22 bp, Homo sapiens
tttttctagaccttaaaggcca

SEQ ID NO: 9087204 - DNA, 22 bp, Homo sapiens
tttttctcttctgtaaagtggt

SEQ ID NO: 9087205 - DNA, 22 bp, Homo sapiens
tttttctcttctgtaaagtggt

SEQ ID NO: 9087206 - DNA, 22 bp, Homo sapiens
tttttctcttctgtaaagtggt

SEQ ID NO: 9087207 - DNA, 22 bp, Homo sapiens
ttttcagttgtgctctctagtt

SEQ ID NO: 9087208 - DNA, 22 bp, Homo sapiens
ttttcctctgtatgcgtgagat

SEQ ID NO: 9087209 - DNA, 22 bp, Homo sapiens
ctctggagtgcagcctggtggc

SEQ ID NO: 9087210 - DNA, 22 bp, Homo sapiens
ttttcctctgtatttgaaatgc

SEQ ID NO: 9087211 - DNA, 19 bp, Homo sapiens
ttttcctgcctcattgttt

SEQ ID NO: 9087212 - DNA, 22 bp, Homo sapiens
ttttctcaggtgcttatctaag

SEQ ID NO: 9087213 - DNA, 22 bp, Homo sapiens
ttttccttaacagagggagaaa

SEQ ID NO: 9087214 - DNA, 22 bp, Homo sapiens
ttttctccaactcaaaggaaag

SEQ ID NO: 9087215 - DNA, 21 bp, Homo sapiens
ttttctccagctgtgatttta

SEQ ID NO: 9087216 - DNA, 21 bp, Homo sapiens
ttttctccagctgtgatttta

SEQ ID NO: 9087217 - DNA, 22 bp, Homo sapiens
ttttctccaactcaaaggaaag

SEQ ID NO: 9087218 - DNA, 22 bp, Homo sapiens
ttttctcaggtgcttatctaag

SEQ ID NO: 9087219 - DNA, 22 bp, Homo sapiens
ttttcctgggctttctgtgtaa

SEQ ID NO: 9087220 - DNA, 22 bp, Homo sapiens
ctgaaggcaccaggggtgccag

SEQ ID NO: 9087221 - DNA, 18 bp, Homo sapiens
ctgaaggcaccagggcag

SEQ ID NO: 9087222 - DNA, 22 bp, Homo sapiens
ctgaaggctaaaatggactgaa

SEQ ID NO: 9087223 - DNA, 22 bp, Homo sapiens
ctgaaggctaaaatggactgaa

SEQ ID NO: 9087224 - DNA, 22 bp, Homo sapiens
ctgaagtccctgttttgtttac

SEQ ID NO: 9087225 - DNA, 22 bp, Homo sapiens
ctgaagcaaaggatcgagctaa

SEQ ID NO: 9087226 - DNA, 22 bp, Homo sapiens
ctgaaagcaaagtaattcttaa

SEQ ID NO: 9087227 - DNA, 22 bp, Homo sapiens
ctgaaggattagagagcactta

SEQ ID NO: 9087228 - DNA, 22 bp, Homo sapiens
ctgaaggattcaaaatggcagg

SEQ ID NO: 9087229 - DNA, 20 bp, Homo sapiens
ctgaaagacgtaacagtgca

SEQ ID NO: 9087230 - DNA, 22 bp, Homo sapiens
ctgaaaaacgggatttggctgg

SEQ ID NO: 9087231 - DNA, 22 bp, Homo sapiens
ctgaaaaacgggatttggctgg

SEQ ID NO: 9087232 - DNA, 22 bp, Homo sapiens
ctgaaaaatatgttttggagaa

SEQ ID NO: 9087233 - DNA, 22 bp, Homo sapiens
ctgaaaagctttgaaccgttaa

SEQ ID NO: 9087234 - DNA, 22 bp, Homo sapiens
ctgaaaatgttacacaggaaga

SEQ ID NO: 9087235 - DNA, 22 bp, Homo sapiens
ctgaaaatgttagtgatacgaa

SEQ ID NO: 9087236 - DNA, 22 bp, Homo sapiens
ctgaaaatgttacacaggaaga

SEQ ID NO: 9087237 - DNA, 22 bp, Homo sapiens
ctgaaaatgttacacaggaaga

SEQ ID NO: 9087238 - DNA, 22 bp, Homo sapiens
tttttcttgtgctggatctaat

SEQ ID NO: 9087239 - DNA, 22 bp, Homo sapiens
tttttcttgtgctggatctaat

SEQ ID NO: 9087240 - DNA, 22 bp, Homo sapiens
ttttttgttgggtagaacggaa

SEQ ID NO: 9087241 - DNA, 22 bp, Homo sapiens
tttttcttaaatgtgggttggc

SEQ ID NO: 9087242 - DNA, 22 bp, Homo sapiens
tttttcttgtgctggatctaat

SEQ ID NO: 9087243 - DNA, 22 bp, Homo sapiens
tttttcttgtgctggatctaat

SEQ ID NO: 9087244 - DNA, 22 bp, Homo sapiens
tttttcttaaatgtgggttggc

SEQ ID NO: 9087245 - DNA, 22 bp, Homo sapiens
ctgccctggccactgtgcccag

SEQ ID NO: 9087246 - DNA, 22 bp, Homo sapiens
ctgccctggccactgtgcccag

SEQ ID NO: 9087247 - DNA, 22 bp, Homo sapiens
ctgccctgggatggtctgtgcg

SEQ ID NO: 9087248 - DNA, 22 bp, Homo sapiens
ctgccctgggatggtctgtgcg

SEQ ID NO: 9087249 - DNA, 22 bp, Homo sapiens
ctgccctgggagtacctgtcct

SEQ ID NO: 9087250 - DNA, 22 bp, Homo sapiens
ctgccctgggagtacctgtcct

SEQ ID NO: 9087251 - DNA, 22 bp, Homo sapiens
ctgccctgcttgatgacagcga

SEQ ID NO: 9087252 - DNA, 22 bp, Homo sapiens
ctgccctgcttgatgacagcga

SEQ ID NO: 9087253 - DNA, 22 bp, Homo sapiens
ctgccctgcttgatgacagcga

SEQ ID NO: 9087254 - DNA, 22 bp, Homo sapiens
ctgccctggaaaacgtatctta

SEQ ID NO: 9087255 - DNA, 22 bp, Homo sapiens
ctgccctgcttgtttccagtgg

SEQ ID NO: 9087256 - DNA, 22 bp, Homo sapiens
ctgccctggcagcctaccatgg

SEQ ID NO: 9087257 - DNA, 22 bp, Homo sapiens
ctgccctggcagcctaccatgg

SEQ ID NO: 9087258 - DNA, 22 bp, Homo sapiens
ctgccctgggccaggaagcggc

SEQ ID NO: 9087259 - DNA, 22 bp, Homo sapiens
ctgccctgggatggtctgtgcg

SEQ ID NO: 9087260 - DNA, 22 bp, Homo sapiens
ctgcctctataggagtccacca

SEQ ID NO: 9087261 - DNA, 22 bp, Homo sapiens
ctgcctctataggagtccacca

SEQ ID NO: 9087262 - DNA, 22 bp, Homo sapiens
ctgcctctattcactgaggcag

SEQ ID NO: 9087263 - DNA, 22 bp, Homo sapiens
ctgcctctattcactgaggcag

SEQ ID NO: 9087264 - DNA, 22 bp, Homo sapiens
ctgcctctggcctcaggcccag

SEQ ID NO: 9087265 - DNA, 22 bp, Homo sapiens
ctgcctctggttttggtccctg

SEQ ID NO: 9087266 - DNA, 22 bp, Homo sapiens
ctgcctctgttgggcatggtct

SEQ ID NO: 9087267 - DNA, 22 bp, Homo sapiens
ctgcctctggttttggtccctg

SEQ ID NO: 9087268 - DNA, 22 bp, Homo sapiens
ctgccctgctaatgagttccaa

SEQ ID NO: 9087269 - DNA, 22 bp, Homo sapiens
ctgccctgcctggccagtgtgg

SEQ ID NO: 9087270 - DNA, 22 bp, Homo sapiens
ctgccctgctctccgggatctt

SEQ ID NO: 9087271 - DNA, 22 bp, Homo sapiens
ctgccctgctggagatcacagt

SEQ ID NO: 9087272 - DNA, 22 bp, Homo sapiens
ctgccctgcttctgagggaagc

SEQ ID NO: 9087273 - DNA, 20 bp, Homo sapiens
ctgccctgccctgggtcctg

SEQ ID NO: 9087274 - DNA, 22 bp, Homo sapiens
ctgccctgcctggccagtgtgg

SEQ ID NO: 9087275 - DNA, 22 bp, Homo sapiens
ctgccctgcctggccagtgtgg

SEQ ID NO: 9087276 - DNA, 22 bp, Homo sapiens
ctgccctgcctggccagtgtgg

SEQ ID NO: 9087277 - DNA, 22 bp, Homo sapiens
ctgccctgcccaggccttgggc

SEQ ID NO: 9087278 - DNA, 22 bp, Homo sapiens
ctgccctgcccaggccttgggc

SEQ ID NO: 9087279 - DNA, 22 bp, Homo sapiens
ctgccctgcccaggccttgggc

SEQ ID NO: 9087280 - DNA, 22 bp, Homo sapiens
ctgcccctggtgatggacgcca

SEQ ID NO: 9087281 - DNA, 22 bp, Homo sapiens
ctgccctgagggcctgtgtgtt

SEQ ID NO: 9087282 - DNA, 22 bp, Homo sapiens
ctgccctgagggcctgtgtgtt

SEQ ID NO: 9087283 - DNA, 22 bp, Homo sapiens
ctgcccctggtgatggacgcca

SEQ ID NO: 9087284 - DNA, 22 bp, Homo sapiens
ctgccctgcagctccacggact

SEQ ID NO: 9087285 - DNA, 22 bp, Homo sapiens
ctgccctgcagctccacggact

SEQ ID NO: 9087286 - DNA, 23 bp, Homo sapiens
ctgccctgatcttgatctattgt

SEQ ID NO: 9087287 - DNA, 22 bp, Homo sapiens
ctgccctgagtcatgccagatg

SEQ ID NO: 9087288 - DNA, 22 bp, Homo sapiens
ctgccctgagggcctgtgtgtt

SEQ ID NO: 9087289 - DNA, 22 bp, Homo sapiens
ctgccctgatatgatttagaac

SEQ ID NO: 9087290 - DNA, 22 bp, Homo sapiens
ctgccctgagtcatgccagatg

SEQ ID NO: 9087291 - DNA, 22 bp, Homo sapiens
ctgcaggggcctcgagcacagg

SEQ ID NO: 9087292 - DNA, 21 bp, Homo sapiens
ctgagggctttgaatccagac

SEQ ID NO: 9087293 - DNA, 22 bp, Homo sapiens
ctgcagggtttttcaaggacaa

SEQ ID NO: 9087294 - DNA, 22 bp, Homo sapiens
ctgagggctggagctgaggcct

SEQ ID NO: 9087295 - DNA, 23 bp, Homo sapiens
ctgagggctggtctgaagtctgc

SEQ ID NO: 9087296 - DNA, 22 bp, Homo sapiens
ctgagggctggagctgaggcct

SEQ ID NO: 9087297 - DNA, 22 bp, Homo sapiens
ctgagggctggagctgaggcct

SEQ ID NO: 9087298 - DNA, 22 bp, Homo sapiens
ctgagggctggagctgaggcct

SEQ ID NO: 9087299 - DNA, 22 bp, Homo sapiens
ctgagggcctgaggacctagat

SEQ ID NO: 9087300 - DNA, 22 bp, Homo sapiens
ctgagggcctgaggacctagat

SEQ ID NO: 9087301 - DNA, 21 bp, Homo sapiens
ctgagggccgcagctgggctc

SEQ ID NO: 9087302 - DNA, 22 bp, Homo sapiens
ctgcatatgatagatgccttgc

SEQ ID NO: 9087303 - DNA, 23 bp, Homo sapiens
ctgcatatggaggttagcaactc

SEQ ID NO: 9087304 - DNA, 22 bp, Homo sapiens
ctgcatatgatagatgccttgc

SEQ ID NO: 9087305 - DNA, 22 bp, Homo sapiens
ctgcatatgatagatgccttgc

SEQ ID NO: 9087306 - DNA, 22 bp, Homo sapiens
ctgcatatcaaattactcctgg

SEQ ID NO: 9087307 - DNA, 22 bp, Homo sapiens
ctgcatatgagaataggagaaa

SEQ ID NO: 9087308 - DNA, 22 bp, Homo sapiens
ctgcatatgagaataggagaaa

SEQ ID NO: 9087309 - DNA, 22 bp, Homo sapiens
ctgcagtgttctggaatgcatt

SEQ ID NO: 9087310 - DNA, 22 bp, Homo sapiens
ctgcagttctcaatttctattg

SEQ ID NO: 9087311 - DNA, 22 bp, Homo sapiens
ctgcagtttgaccttgttttct

SEQ ID NO: 9087312 - DNA, 23 bp, Homo sapiens
ctgcagtcgccggcctgggtgcc

SEQ ID NO: 9087313 - DNA, 22 bp, Homo sapiens
ctgcagtgcctgccactgagcc

SEQ ID NO: 9087314 - DNA, 22 bp, Homo sapiens
ctgcagtgcaagcccagatgga

SEQ ID NO: 9087315 - DNA, 22 bp, Homo sapiens
ctgcagtgaaatcaggaagcaa

SEQ ID NO: 9087316 - DNA, 22 bp, Homo sapiens
ctgcagtgaggattcttaggtg

SEQ ID NO: 9087317 - DNA, 22 bp, Homo sapiens
ctgctctaactgcattagtttt

SEQ ID NO: 9087318 - DNA, 22 bp, Homo sapiens
ctgctcggcgcgcatggctgcc

SEQ ID NO: 9087319 - DNA, 22 bp, Homo sapiens
ctgctcggcgcgcatggctgcc

SEQ ID NO: 9087320 - DNA, 22 bp, Homo sapiens
ctgctctaggtattgaggctaa

SEQ ID NO: 9087321 - DNA, 22 bp, Homo sapiens
ctgctctagagagcattagtca

SEQ ID NO: 9087322 - DNA, 22 bp, Homo sapiens
ctgctctaatatcagatagact

SEQ ID NO: 9087323 - DNA, 22 bp, Homo sapiens
ctgctctgaagccaggattctg

SEQ ID NO: 9087324 - DNA, 22 bp, Homo sapiens
ctgctgagccctggcacaggtg

SEQ ID NO: 9087325 - DNA, 20 bp, Homo sapiens
ctgctgccctgtcagcctct

SEQ ID NO: 9087326 - DNA, 22 bp, Homo sapiens
ctgctgccggcgagcctccctt

SEQ ID NO: 9087327 - DNA, 22 bp, Homo sapiens
ctgctggcaagcccagttggag

SEQ ID NO: 9087328 - DNA, 22 bp, Homo sapiens
ctgctggcctagcccatcctct

SEQ ID NO: 9087329 - DNA, 22 bp, Homo sapiens
ctgctggcaccgatgaaagaca

SEQ ID NO: 9087330 - DNA, 22 bp, Homo sapiens
ctgctgcttttgcgggagaaca

SEQ ID NO: 9087331 - DNA, 22 bp, Homo sapiens
ctgctgcttagcatagcagagg

SEQ ID NO: 9087332 - DNA, 22 bp, Homo sapiens
ctgctgctgagagctcagcctg

SEQ ID NO: 9087333 - DNA, 22 bp, Homo sapiens
ctgctgctcttgtgcattagtg

SEQ ID NO: 9087334 - DNA, 22 bp, Homo sapiens
ctgctcctccccatcaggcagc

SEQ ID NO: 9087335 - DNA, 22 bp, Homo sapiens
ctgctcctccccatcaggcagc

SEQ ID NO: 9087336 - DNA, 19 bp, Homo sapiens
ctgctccctccttctggca

SEQ ID NO: 9087337 - DNA, 22 bp, Homo sapiens
ctgctccccagcctgcgccttt

SEQ ID NO: 9087338 - DNA, 22 bp, Homo sapiens
ctgctccccagcctgcgccttt

SEQ ID NO: 9087339 - DNA, 19 bp, Homo sapiens
ctgctccaggagctgggga

SEQ ID NO: 9087340 - DNA, 22 bp, Homo sapiens
ctgcctgcatcccacagtgggg

SEQ ID NO: 9087341 - DNA, 22 bp, Homo sapiens
ctgcctgccacgttcagctgta

SEQ ID NO: 9087342 - DNA, 22 bp, Homo sapiens
ctgcctgcatgctgccatagct

SEQ ID NO: 9087343 - DNA, 22 bp, Homo sapiens
ctgcctgcatgctgccatagct

SEQ ID NO: 9087344 - DNA, 22 bp, Homo sapiens
ctgcctgcctggagacagatgg

SEQ ID NO: 9087345 - DNA, 22 bp, Homo sapiens
ctgcctgcgccaccaccacgtc

SEQ ID NO: 9087346 - DNA, 22 bp, Homo sapiens
ctgcctgccttggcctccagga

SEQ ID NO: 9087347 - DNA, 22 bp, Homo sapiens
ctgcggtgggctgggctgtccc

SEQ ID NO: 9087348 - DNA, 22 bp, Homo sapiens
ctgcctcttgacagatcgtggc

SEQ ID NO: 9087349 - DNA, 22 bp, Homo sapiens
ctgcctcttgacagatcgtggc

SEQ ID NO: 9087350 - DNA, 22 bp, Homo sapiens
ctgcctctgttgggcatggtct

SEQ ID NO: 9087351 - DNA, 22 bp, Homo sapiens
ctgcctctgttgggcatggtct

SEQ ID NO: 9087352 - DNA, 22 bp, Homo sapiens
ctgcctcttaagtggatggagt

SEQ ID NO: 9087353 - DNA, 22 bp, Homo sapiens
ctgcctgcactgcctggctcca

SEQ ID NO: 9087354 - DNA, 22 bp, Homo sapiens
ctgcctgcactgcctggctcca

SEQ ID NO: 9087355 - DNA, 22 bp, Homo sapiens
ctgcctgcaggacacctcgcta

SEQ ID NO: 9087356 - DNA, 22 bp, Homo sapiens
ctgcctgagtacaagtcccaga

SEQ ID NO: 9087357 - DNA, 22 bp, Homo sapiens
ctccctgagtttgtggctaagt

SEQ ID NO: 9087358 - DNA, 23 bp, Homo sapiens
ctccctgaacatgacacaccaga

SEQ ID NO: 9087359 - DNA, 22 bp, Homo sapiens
ctccctctgtcttgtccagaaa

SEQ ID NO: 9087360 - DNA, 22 bp, Homo sapiens
ctccctggaggtgagctggcac

SEQ ID NO: 9087361 - DNA, 22 bp, Homo sapiens
ctccctggaggcccagacctgg

SEQ ID NO: 9087362 - DNA, 22 bp, Homo sapiens
ctccctggaggtgagctggcac

SEQ ID NO: 9087363 - DNA, 22 bp, Homo sapiens
ctccctggcacagcgagaggtt

SEQ ID NO: 9087364 - DNA, 23 bp, Homo sapiens
ctccctggagtttctggaagatg

SEQ ID NO: 9087365 - DNA, 23 bp, Homo sapiens
ctccctggagtttctggaagatg

SEQ ID NO: 9087366 - DNA, 22 bp, Homo sapiens
ctccctggcacagcgagaggtt

SEQ ID NO: 9087367 - DNA, 22 bp, Homo sapiens
ctccctgggcagatgtggctct

SEQ ID NO: 9087368 - DNA, 22 bp, Homo sapiens
ctccctggctttgtcctgaggc

SEQ ID NO: 9087369 - DNA, 22 bp, Homo sapiens
ctccctggtgactcccaaagct

SEQ ID NO: 9087370 - DNA, 22 bp, Homo sapiens
ctccctgtgtcttcacttggcc

SEQ ID NO: 9087371 - DNA, 22 bp, Homo sapiens
ctcctcagctgggaggagtccc

SEQ ID NO: 9087372 - DNA, 22 bp, Homo sapiens
ctcctcagctgggaggagtccc

SEQ ID NO: 9087373 - DNA, 22 bp, Homo sapiens
ctcctcagctgggaggagtccc

SEQ ID NO: 9087374 - DNA, 22 bp, Homo sapiens
ctcctcagctgggaggagtccc

SEQ ID NO: 9087375 - DNA, 19 bp, Homo sapiens
ctcctcagtcccagaggtc

SEQ ID NO: 9087376 - DNA, 22 bp, Homo sapiens
ctcctcagtcaggtctagggtc

SEQ ID NO: 9087377 - DNA, 22 bp, Homo sapiens
ctcctcaggaagtagcatgtgt

SEQ ID NO: 9087378 - DNA, 21 bp, Homo sapiens
ctcctcaggaccagccacagg

SEQ ID NO: 9087379 - DNA, 22 bp, Homo sapiens
ttgtttaatatcgtgaagtact

SEQ ID NO: 9087380 - DNA, 22 bp, Homo sapiens
ttgtttaatgcctcatacatct

SEQ ID NO: 9087381 - DNA, 22 bp, Homo sapiens
ttgtttaatgcctcatacatct

SEQ ID NO: 9087382 - DNA, 22 bp, Homo sapiens
ctccccaggttcaggaggtggg

SEQ ID NO: 9087383 - DNA, 18 bp, Homo sapiens
ctccccagctgcccccag

SEQ ID NO: 9087384 - DNA, 22 bp, Homo sapiens
ctccccagctcgcgggtgacgg

SEQ ID NO: 9087385 - DNA, 22 bp, Homo sapiens
ctccccagcattctgacttcct

SEQ ID NO: 9087386 - DNA, 22 bp, Homo sapiens
ctccccagcattctgacttcct

SEQ ID NO: 9087387 - DNA, 22 bp, Homo sapiens
ttgtttcaaatatttcagaata

SEQ ID NO: 9087388 - DNA, 22 bp, Homo sapiens
ttgtttcagcccagatctttac

SEQ ID NO: 9087389 - DNA, 22 bp, Homo sapiens
ctccccacgcctggactaagag

SEQ ID NO: 9087390 - DNA, 22 bp, Homo sapiens
ctccccacacactaggcctgat

SEQ ID NO: 9087391 - DNA, 22 bp, Homo sapiens
ctccccacacactaggcctgat

SEQ ID NO: 9087392 - DNA, 22 bp, Homo sapiens
ctccccacatttctccctgtct

SEQ ID NO: 9087393 - DNA, 22 bp, Homo sapiens
ctccccaagccttggcttctcc

SEQ ID NO: 9087394 - DNA, 22 bp, Homo sapiens
ctccccaagccttggcttctcc

SEQ ID NO: 9087395 - DNA, 22 bp, Homo sapiens
ctcaggctggtttgggttgttt

SEQ ID NO: 9087396 - DNA, 22 bp, Homo sapiens
ctcaggctgtgatgtgatggca

SEQ ID NO: 9087397 - DNA, 21 bp, Homo sapiens
ctcaggctggcagcaggctag

SEQ ID NO: 9087398 - DNA, 22 bp, Homo sapiens
ctcaggcttgggaggaggccca

SEQ ID NO: 9087399 - DNA, 22 bp, Homo sapiens
ctcaggctgtgccacctgtgtg

SEQ ID NO: 9087400 - DNA, 22 bp, Homo sapiens
ctcaggctgccctgacagcccc

SEQ ID NO: 9087401 - DNA, 22 bp, Homo sapiens
ctcaggctctgtactccctttg

SEQ ID NO: 9087402 - DNA, 22 bp, Homo sapiens
ctcaggctctggccatccaagg

SEQ ID NO: 9087403 - DNA, 22 bp, Homo sapiens
ctcaggctccagacttccgtcc

SEQ ID NO: 9087404 - DNA, 22 bp, Homo sapiens
tttatatgtttgtacaattaag

SEQ ID NO: 9087405 - DNA, 22 bp, Homo sapiens
tttatatgtttgtacaattaag

SEQ ID NO: 9087406 - DNA, 22 bp, Homo sapiens
ctcctggatcttagccagattc

SEQ ID NO: 9087407 - DNA, 22 bp, Homo sapiens
ctcctggacatggagcggagga

SEQ ID NO: 9087408 - DNA, 22 bp, Homo sapiens
ctcctcagttgtcccatggaga

SEQ ID NO: 9087409 - DNA, 22 bp, Homo sapiens
tttacaagtttacagaatgatg

SEQ ID NO: 9087410 - DNA, 22 bp, Homo sapiens
tttacaattctctaccagtgtt

SEQ ID NO: 9087411 - DNA, 20 bp, Homo sapiens
ctcctcagttccatgggagg

SEQ ID NO: 9087412 - DNA, 20 bp, Homo sapiens
ctcctcagttccatgggagg

SEQ ID NO: 9087413 - DNA, 22 bp, Homo sapiens
tttacacaaaagatagcacacc

SEQ ID NO: 9087414 - DNA, 22 bp, Homo sapiens
tttacacaaaagatagcacacc

SEQ ID NO: 9087415 - DNA, 22 bp, Homo sapiens
tttacacaaaatgttagtagat

SEQ ID NO: 9087416 - DNA, 22 bp, Homo sapiens
tttacacatacctctttaaagt

SEQ ID NO: 9087417 - DNA, 22 bp, Homo sapiens
ctcctgagctctgaggaagctt

SEQ ID NO: 9087418 - DNA, 22 bp, Homo sapiens
tttacacagaggacactgggct

SEQ ID NO: 9087419 - DNA, 22 bp, Homo sapiens
ctcctgagctctgaggaagctt

SEQ ID NO: 9087420 - DNA, 22 bp, Homo sapiens
ctcctgagctgcagccttgtgt

SEQ ID NO: 9087421 - DNA, 22 bp, Homo sapiens
tttatattacctggaatagctt

SEQ ID NO: 9087422 - DNA, 22 bp, Homo sapiens
ctcctgtatgttgggcttcaca

SEQ ID NO: 9087423 - DNA, 22 bp, Homo sapiens
ctcctgtcaataggctcctggc

SEQ ID NO: 9087424 - DNA, 22 bp, Homo sapiens
ctcctgtcagaagcatcctgag

SEQ ID NO: 9087425 - DNA, 22 bp, Homo sapiens
ctcctgtcagaagcatcctgag

SEQ ID NO: 9087426 - DNA, 22 bp, Homo sapiens
tttcaaagtcaatatcattacc

SEQ ID NO: 9087427 - DNA, 22 bp, Homo sapiens
tttcaaatagaatctttccaaa

SEQ ID NO: 9087428 - DNA, 22 bp, Homo sapiens
tttcaaatagaatctttccaaa

SEQ ID NO: 9087429 - DNA, 22 bp, Homo sapiens
tttcaaatgcatgtctttcctc

SEQ ID NO: 9087430 - DNA, 22 bp, Homo sapiens
tttcaaataccataaacctaat

SEQ ID NO: 9087431 - DNA, 22 bp, Homo sapiens
ctcgggtaccatgctaggcact

SEQ ID NO: 9087432 - DNA, 22 bp, Homo sapiens
ctcgggtaccatgctaggcact

SEQ ID NO: 9087433 - DNA, 22 bp, Homo sapiens
ctctaaaggcttgttattgcat

SEQ ID NO: 9087434 - DNA, 22 bp, Homo sapiens
ctccttcctggttagcacctta

SEQ ID NO: 9087435 - DNA, 22 bp, Homo sapiens
ctctaatactgaccaagtcacc

SEQ ID NO: 9087436 - DNA, 22 bp, Homo sapiens
ctctaaatccacggtatagttg

SEQ ID NO: 9087437 - DNA, 22 bp, Homo sapiens
ctctaaaggcttgttattgcat

SEQ ID NO: 9087438 - DNA, 22 bp, Homo sapiens
ctctaaatccaaataagtgtcc

SEQ ID NO: 9087439 - DNA, 22 bp, Homo sapiens
ctctaaatccacggtatagttg

SEQ ID NO: 9087440 - DNA, 22 bp, Homo sapiens
ctctaaatccacggtatagttg

SEQ ID NO: 9087441 - DNA, 22 bp, Homo sapiens
ctctaaatccaaataagtgtcc

SEQ ID NO: 9087442 - DNA, 22 bp, Homo sapiens
tttcttcttgatttaaacaggg

SEQ ID NO: 9087443 - DNA, 22 bp, Homo sapiens
tttcttcttgatttaaacaggg

SEQ ID NO: 9087444 - DNA, 22 bp, Homo sapiens
tttcttcttgagtaaccagatt

SEQ ID NO: 9087445 - DNA, 22 bp, Homo sapiens
tttcttgaccactatgttgata

SEQ ID NO: 9087446 - DNA, 22 bp, Homo sapiens
tttcttgaccactatgttgata

SEQ ID NO: 9087447 - DNA, 22 bp, Homo sapiens
tttcttatactatattgtcatc

SEQ ID NO: 9087448 - DNA, 22 bp, Homo sapiens
tttcttatactatattgtcatc

SEQ ID NO: 9087449 - DNA, 22 bp, Homo sapiens
tttcttatattctgtcattgtt

SEQ ID NO: 9087450 - DNA, 22 bp, Homo sapiens
tttcttaaatatttgcaggaca

SEQ ID NO: 9087451 - DNA, 22 bp, Homo sapiens
ctctgctggccatgaagagaga

SEQ ID NO: 9087452 - DNA, 22 bp, Homo sapiens
ctctgctgctttgccagtggaa

SEQ ID NO: 9087453 - DNA, 20 bp, Homo sapiens
ctctgctgcgcatcccactt

SEQ ID NO: 9087454 - DNA, 19 bp, Homo sapiens
ctctgcctctggctgtggc

SEQ ID NO: 9087455 - DNA, 19 bp, Homo sapiens
ctctgcctctggctgtggc

SEQ ID NO: 9087456 - DNA, 19 bp, Homo sapiens
ctctgcctctggctgtggc

SEQ ID NO: 9087457 - DNA, 19 bp, Homo sapiens
ctctgcctctggctgtggc

SEQ ID NO: 9087458 - DNA, 22 bp, Homo sapiens
tttcttgactgcttaggaatgc

SEQ ID NO: 9087459 - DNA, 21 bp, Homo sapiens
ctctgctgtctaccagctgtt

SEQ ID NO: 9087460 - DNA, 21 bp, Homo sapiens
ctctgctgtctaccagctgtt

SEQ ID NO: 9087461 - DNA, 22 bp, Homo sapiens
ctctgctgtctcagatgggcca

SEQ ID NO: 9087462 - DNA, 22 bp, Homo sapiens
ctctgcttcatccaccactggc

SEQ ID NO: 9087463 - DNA, 22 bp, Homo sapiens
ctctgcttcatccaccactggc

SEQ ID NO: 9087464 - DNA, 22 bp, Homo sapiens
ctctggagtaagagctatgaaa

SEQ ID NO: 9087465 - DNA, 19 bp, Homo sapiens
ctctggagtcattgctccc

SEQ ID NO: 9087466 - DNA, 22 bp, Homo sapiens
ctctggaggtcaggtgtggtgg

SEQ ID NO: 9087467 - DNA, 22 bp, Homo sapiens
ctctggaggtggaggttgcagt

SEQ ID NO: 9087468 - DNA, 22 bp, Homo sapiens
ctctggaggtggaggttgcagt

SEQ ID NO: 9087469 - DNA, 22 bp, Homo sapiens
ctctggaggccgttggccctta

SEQ ID NO: 9087470 - DNA, 22 bp, Homo sapiens
ctctggaggcagcaccagccag

SEQ ID NO: 9087471 - DNA, 22 bp, Homo sapiens
ctctggagggaggctgagctgg

SEQ ID NO: 9087472 - DNA, 22 bp, Homo sapiens
ctctggagggaggctgagctgg

SEQ ID NO: 9087473 - DNA, 22 bp, Homo sapiens
ctctggaggcctaaggaagtgg

SEQ ID NO: 9087474 - DNA, 22 bp, Homo sapiens
ctctggaggcctaaggaagtgg

SEQ ID NO: 9087475 - DNA, 19 bp, Homo sapiens
ctctggagcagacactgga

SEQ ID NO: 9087476 - DNA, 22 bp, Homo sapiens
ctctggagcatttcacctacat

SEQ ID NO: 9087477 - DNA, 22 bp, Homo sapiens
tttgaagtgtatgaaaatacag

SEQ ID NO: 9087478 - DNA, 22 bp, Homo sapiens
tttgaataaacggttaatgttc

SEQ ID NO: 9087479 - DNA, 22 bp, Homo sapiens
tttgaagggcacgacaatagtt

SEQ ID NO: 9087480 - DNA, 22 bp, Homo sapiens
tttgaagggcacgacaatagtt

SEQ ID NO: 9087481 - DNA, 22 bp, Homo sapiens
ctctgcttgtgtcaggcatgct

SEQ ID NO: 9087482 - DNA, 22 bp, Homo sapiens
tttctctgctgtgttggcagct

SEQ ID NO: 9087483 - DNA, 22 bp, Homo sapiens
ctctctggaattaaagcccaat

SEQ ID NO: 9087484 - DNA, 20 bp, Homo sapiens
ctctctggaaggtgggagcc

SEQ ID NO: 9087485 - DNA, 22 bp, Homo sapiens
ctctctggacctcaactatttt

SEQ ID NO: 9087486 - DNA, 22 bp, Homo sapiens
ctctctggacttgagtatcagc

SEQ ID NO: 9087487 - DNA, 22 bp, Homo sapiens
tttctctcagcctgtagaaact

SEQ ID NO: 9087488 - DNA, 22 bp, Homo sapiens
tttctctcagcctgtagaaact

SEQ ID NO: 9087489 - DNA, 22 bp, Homo sapiens
ctctaggctgcccaggagctga

SEQ ID NO: 9087490 - DNA, 22 bp, Homo sapiens
ctctagacaacttgctgtgggt

SEQ ID NO: 9087491 - DNA, 22 bp, Homo sapiens
ctctagcaggtgccttgtaaca

SEQ ID NO: 9087492 - DNA, 22 bp, Homo sapiens
ctctagagtacgggctggcatg

SEQ ID NO: 9087493 - DNA, 22 bp, Homo sapiens
ctctactccaaaaggctacaat

SEQ ID NO: 9087494 - DNA, 22 bp, Homo sapiens
ctctactcttaacacagctagg

SEQ ID NO: 9087495 - DNA, 18 bp, Homo sapiens
ctctagaatgggagattt

SEQ ID NO: 9087496 - DNA, 20 bp, Homo sapiens
ctctattattaatttcttaa

SEQ ID NO: 9087497 - DNA, 22 bp, Homo sapiens
ctctcaaatgtcattcctctat

SEQ ID NO: 9087498 - DNA, 22 bp, Homo sapiens
ctctgaggctccatgcaggctt

SEQ ID NO: 9087499 - DNA, 22 bp, Homo sapiens
ctctgagggtctaaggagtcac

SEQ ID NO: 9087500 - DNA, 22 bp, Homo sapiens
ctctgagggctcgagggacgcg

SEQ ID NO: 9087501 - DNA, 22 bp, Homo sapiens
ctctctggcccatcctgttgcc

SEQ ID NO: 9087502 - DNA, 22 bp, Homo sapiens
ctctctggcacttcattgctgt

SEQ ID NO: 9087503 - DNA, 22 bp, Homo sapiens
ctctctggatatttgtatgctg

SEQ ID NO: 9087504 - DNA, 22 bp, Homo sapiens
ctctgagctgaaacatgagcat

SEQ ID NO: 9087505 - DNA, 22 bp, Homo sapiens
ctctgagctgaaacatgagcat

SEQ ID NO: 9087506 - DNA, 22 bp, Homo sapiens
ctctgagctgaaacatgagcat

SEQ ID NO: 9087507 - DNA, 22 bp, Homo sapiens
ctctgagctgaaacatgagcat

SEQ ID NO: 9087508 - DNA, 22 bp, Homo sapiens
ctctgaggtcctacagtgaccc

SEQ ID NO: 9087509 - DNA, 22 bp, Homo sapiens
ctctgaggtccttcccagctct

SEQ ID NO: 9087510 - DNA, 22 bp, Homo sapiens
tttctgcacatttctaaagttg

SEQ ID NO: 9087511 - DNA, 22 bp, Homo sapiens
tttctgcacatttctaaagttg

SEQ ID NO: 9087512 - DNA, 22 bp, Homo sapiens
tttctgcaacgagtctttgact

SEQ ID NO: 9087513 - DNA, 22 bp, Homo sapiens
tttctgcaaacttccacgtctc

SEQ ID NO: 9087514 - DNA, 22 bp, Homo sapiens
tttctgtttagcataaagtggc

SEQ ID NO: 9087515 - DNA, 22 bp, Homo sapiens
tttctgtttagcataaagtggc

SEQ ID NO: 9087516 - DNA, 22 bp, Homo sapiens
tttctgcagtctctcagaagcc

SEQ ID NO: 9087517 - DNA, 22 bp, Homo sapiens
tttctgcaggtattgcataagt

SEQ ID NO: 9087518 - DNA, 19 bp, Homo sapiens
tttctgcagctcagagaag

SEQ ID NO: 9087519 - DNA, 19 bp, Homo sapiens
tttctgcagcccagcagca

SEQ ID NO: 9087520 - DNA, 22 bp, Homo sapiens
ccttcttgaggtagcacattct

SEQ ID NO: 9087521 - DNA, 22 bp, Homo sapiens
ccttctgctccctggccagggc

SEQ ID NO: 9087522 - DNA, 22 bp, Homo sapiens
ttaccaattcagacatctcttc

SEQ ID NO: 9087523 - DNA, 22 bp, Homo sapiens
ttaccatagaaacttccttttt

SEQ ID NO: 9087524 - DNA, 22 bp, Homo sapiens
ttaccataaagtttatctttct

SEQ ID NO: 9087525 - DNA, 22 bp, Homo sapiens
ttaccatagtactatcagttta

SEQ ID NO: 9087526 - DNA, 22 bp, Homo sapiens
ttaccatagaaacttccttttt

SEQ ID NO: 9087527 - DNA, 22 bp, Homo sapiens
ttaccatagtactatcagttta

SEQ ID NO: 9087528 - DNA, 22 bp, Homo sapiens
ttacctaaaatagctcaattta

SEQ ID NO: 9087529 - DNA, 22 bp, Homo sapiens
ttacaatgagaaatggttggca

SEQ ID NO: 9087530 - DNA, 22 bp, Homo sapiens
ttacagaactgtcttgaaattt

SEQ ID NO: 9087531 - DNA, 22 bp, Homo sapiens
ttacagaactgtcttgaaattt

SEQ ID NO: 9087532 - DNA, 22 bp, Homo sapiens
ttacagaactgtcttgaaattt

SEQ ID NO: 9087533 - DNA, 22 bp, Homo sapiens
ttacagaagtattgagagatcc

SEQ ID NO: 9087534 - DNA, 22 bp, Homo sapiens
ttacagaagagtaacttggcaa

SEQ ID NO: 9087535 - DNA, 21 bp, Homo sapiens
ccttctccacagggtctccgg

SEQ ID NO: 9087536 - DNA, 21 bp, Homo sapiens
ccttctccacagggtctccgg

SEQ ID NO: 9087537 - DNA, 21 bp, Homo sapiens
ccttctcttgcttcagcttca

SEQ ID NO: 9087538 - DNA, 20 bp, Homo sapiens
ccttctctggaattgcctcc

SEQ ID NO: 9087539 - DNA, 22 bp, Homo sapiens
ccttggcttgtgggctgcagcc

SEQ ID NO: 9087540 - DNA, 19 bp, Homo sapiens
ccttggctttaactatgaa

SEQ ID NO: 9087541 - DNA, 22 bp, Homo sapiens
ccttgggacagccagcttcaga

SEQ ID NO: 9087542 - DNA, 22 bp, Homo sapiens
ccttgggaccctgctggaggtt

SEQ ID NO: 9087543 - DNA, 22 bp, Homo sapiens
ccttgggcttgggcatagcttt

SEQ ID NO: 9087544 - DNA, 22 bp, Homo sapiens
ccttggggaactggacgtgctg

SEQ ID NO: 9087545 - DNA, 22 bp, Homo sapiens
ccttggctgtgttgcctgccct

SEQ ID NO: 9087546 - DNA, 22 bp, Homo sapiens
ccttggctgtgttgcctgccct

SEQ ID NO: 9087547 - DNA, 20 bp, Homo sapiens
ccttggcttaataataggga

SEQ ID NO: 9087548 - DNA, 21 bp, Homo sapiens
ccttggctggcatctagcacc

SEQ ID NO: 9087549 - DNA, 22 bp, Homo sapiens
ttacgagtttgcaattttaaat

SEQ ID NO: 9087550 - DNA, 22 bp, Homo sapiens
ccttgcctcattgtgcttctcc

SEQ ID NO: 9087551 - DNA, 22 bp, Homo sapiens
ttacgcagctgctccaggaagc

SEQ ID NO: 9087552 - DNA, 22 bp, Homo sapiens
ttacctgcaactcccatggtga

SEQ ID NO: 9087553 - DNA, 22 bp, Homo sapiens
cctttaagtcctcttttatatt

SEQ ID NO: 9087554 - DNA, 22 bp, Homo sapiens
ttatcctggctctctcaggatg

SEQ ID NO: 9087555 - DNA, 22 bp, Homo sapiens
ttatggcatattcctcattgta

SEQ ID NO: 9087556 - DNA, 18 bp, Homo sapiens
ttatggctgtgaaagagt

SEQ ID NO: 9087557 - DNA, 22 bp, Homo sapiens
ccttgtcttgcacagatgcagc

SEQ ID NO: 9087558 - DNA, 23 bp, Homo sapiens
ccttgtctggctggctggacttt

SEQ ID NO: 9087559 - DNA, 23 bp, Homo sapiens
ccttgtctggctggctggacttt

SEQ ID NO: 9087560 - DNA, 22 bp, Homo sapiens
ccttggtgatctgggctggaag

SEQ ID NO: 9087561 - DNA, 22 bp, Homo sapiens
cgcaacagagcaggtttgatga

SEQ ID NO: 9087562 - DNA, 22 bp, Homo sapiens
cgcaacagcgtggcgcccagct

SEQ ID NO: 9087563 - DNA, 22 bp, Homo sapiens
cgcaccactgaattccagcctg

SEQ ID NO: 9087564 - DNA, 22 bp, Homo sapiens
cgcaccactgaattccagcctg

SEQ ID NO: 9087565 - DNA, 22 bp, Homo sapiens
cgatgggggcagtgttacattg

SEQ ID NO: 9087566 - DNA, 22 bp, Homo sapiens
cctttggctgcatagggaaggg

SEQ ID NO: 9087567 - DNA, 22 bp, Homo sapiens
cctttggccgctttatggagga

SEQ ID NO: 9087568 - DNA, 22 bp, Homo sapiens
cctttggagcaactgagagcta

SEQ ID NO: 9087569 - DNA, 22 bp, Homo sapiens
cctttggagcaactgagagcta

SEQ ID NO: 9087570 - DNA, 22 bp, Homo sapiens
cctttggagagtttgttagggg

SEQ ID NO: 9087571 - DNA, 22 bp, Homo sapiens
cctttggaggaagtgtggccct

SEQ ID NO: 9087572 - DNA, 19 bp, Homo sapiens
cctttggatttgtttagtc

SEQ ID NO: 9087573 - DNA, 19 bp, Homo sapiens
cctttgaatcaggacactt

SEQ ID NO: 9087574 - DNA, 19 bp, Homo sapiens
cctttgaatcaggacactt

SEQ ID NO: 9087575 - DNA, 22 bp, Homo sapiens
cctttgcattctagatgtttag

SEQ ID NO: 9087576 - DNA, 22 bp, Homo sapiens
cctttgcattctagatgtttag

SEQ ID NO: 9087577 - DNA, 22 bp, Homo sapiens
cctttgcatttatgtgtccatt

SEQ ID NO: 9087578 - DNA, 18 bp, Homo sapiens
cctttgcaaagggggtta

SEQ ID NO: 9087579 - DNA, 22 bp, Homo sapiens
cctttgcaacagaaagacctga

SEQ ID NO: 9087580 - DNA, 22 bp, Homo sapiens
cctttgcaatcctgtaggcctt

SEQ ID NO: 9087581 - DNA, 22 bp, Homo sapiens
cctttgcaatgaattgttattg

SEQ ID NO: 9087582 - DNA, 22 bp, Homo sapiens
cctttgcattatccttgattga

SEQ ID NO: 9087583 - DNA, 22 bp, Homo sapiens
ttatgtatggatggctgaaagt

SEQ ID NO: 9087584 - DNA, 22 bp, Homo sapiens
ttatgtacaatgttaatgtaaa

SEQ ID NO: 9087585 - DNA, 22 bp, Homo sapiens
ttatgggagcaattggggaggt

SEQ ID NO: 9087586 - DNA, 23 bp, Homo sapiens
ttattttgtcagaagggactttt

SEQ ID NO: 9087587 - DNA, 18 bp, Homo sapiens
ttattcagacgcatatga

SEQ ID NO: 9087588 - DNA, 22 bp, Homo sapiens
ttatttttaaaagttcacacag

SEQ ID NO: 9087589 - DNA, 22 bp, Homo sapiens
ttatttttaaaagttcacacag

SEQ ID NO: 9087590 - DNA, 22 bp, Homo sapiens
ttattcaccgcaggtgcttccc

SEQ ID NO: 9087591 - DNA, 22 bp, Homo sapiens
cgcaccactgaattccagcctg

SEQ ID NO: 9087592 - DNA, 22 bp, Homo sapiens
cgcaccactgaattccagcctg

SEQ ID NO: 9087593 - DNA, 22 bp, Homo sapiens
cgcaccactgaattccagcctg

SEQ ID NO: 9087594 - DNA, 22 bp, Homo sapiens
ttattattttgtgtacagcaaa

SEQ ID NO: 9087595 - DNA, 17 bp, Homo sapiens
ttattttttgggctgag

SEQ ID NO: 9087596 - DNA, 17 bp, Homo sapiens
ttattttttgggctgag

SEQ ID NO: 9087597 - DNA, 22 bp, Homo sapiens
ttatttttaaaagttcacacag

SEQ ID NO: 9087598 - DNA, 22 bp, Homo sapiens
ttatttttaaaagttcacacag

SEQ ID NO: 9087599 - DNA, 17 bp, Homo sapiens
ttattttttgggctgag

SEQ ID NO: 9087600 - DNA, 17 bp, Homo sapiens
ttattttttgggctgag

SEQ ID NO: 9087601 - DNA, 22 bp, Homo sapiens
ttcaaaacaatctgtttgcatt

SEQ ID NO: 9087602 - DNA, 22 bp, Homo sapiens
cgcagaagaggttgtctagtcc

SEQ ID NO: 9087603 - DNA, 22 bp, Homo sapiens
cctgctagagacctggtgtgta

SEQ ID NO: 9087604 - DNA, 22 bp, Homo sapiens
cctgcgtccacggctgggagac

SEQ ID NO: 9087605 - DNA, 22 bp, Homo sapiens
cctgccttcccagcttggcttt

SEQ ID NO: 9087606 - DNA, 23 bp, Homo sapiens
cctgctcaggcgtgtgccctgct

SEQ ID NO: 9087607 - DNA, 22 bp, Homo sapiens
cctgctcatgggtccctggcag

SEQ ID NO: 9087608 - DNA, 22 bp, Homo sapiens
tggttccagttttcaatagagc

SEQ ID NO: 9087609 - DNA, 22 bp, Homo sapiens
tggttccactaacctgagagcc

SEQ ID NO: 9087610 - DNA, 22 bp, Homo sapiens
tggttccactaacctgagagcc

SEQ ID NO: 9087611 - DNA, 22 bp, Homo sapiens
tggttccaatcgcactggctca

SEQ ID NO: 9087612 - DNA, 22 bp, Homo sapiens
tggttcctacgcacattgaatt

SEQ ID NO: 9087613 - DNA, 23 bp, Homo sapiens
tggttcaagtgagaagtaatgtt

SEQ ID NO: 9087614 - DNA, 22 bp, Homo sapiens
tggttcataatttgcactactg

SEQ ID NO: 9087615 - DNA, 22 bp, Homo sapiens
tggttcatgctcatggtgatag

SEQ ID NO: 9087616 - DNA, 22 bp, Homo sapiens
tggttcatagcctcacaggata

SEQ ID NO: 9087617 - DNA, 22 bp, Homo sapiens
tggttccaagatggctgccaca

SEQ ID NO: 9087618 - DNA, 17 bp, Homo sapiens
tggttccaaccatacgc

SEQ ID NO: 9087619 - DNA, 22 bp, Homo sapiens
tgttgattagtgtttagactta

SEQ ID NO: 9087620 - DNA, 22 bp, Homo sapiens
tgttgcagagctggggagggtg

SEQ ID NO: 9087621 - DNA, 22 bp, Homo sapiens
tgttgcagaatctcaaaacagt

SEQ ID NO: 9087622 - DNA, 22 bp, Homo sapiens
tgttgcaggcccctggggtatg

SEQ ID NO: 9087623 - DNA, 22 bp, Homo sapiens
tgttgcagtaaaaatggagagg

SEQ ID NO: 9087624 - DNA, 22 bp, Homo sapiens
tgttgcattgtactgaaaagcc

SEQ ID NO: 9087625 - DNA, 22 bp, Homo sapiens
tgttgcccaggttctctcctgc

SEQ ID NO: 9087626 - DNA, 22 bp, Homo sapiens
tgttgcctggggaagctctgat

SEQ ID NO: 9087627 - DNA, 23 bp, Homo sapiens
tgttgctgcctttctaggatcag

SEQ ID NO: 9087628 - DNA, 22 bp, Homo sapiens
cctggggagaagagcttccccc

SEQ ID NO: 9087629 - DNA, 22 bp, Homo sapiens
cctggggagagaaagcccagcc

SEQ ID NO: 9087630 - DNA, 22 bp, Homo sapiens
cctggggagccgcctgagcccc

SEQ ID NO: 9087631 - DNA, 22 bp, Homo sapiens
cctggggagccgcctgagcccc

SEQ ID NO: 9087632 - DNA, 23 bp, Homo sapiens
cctggggagctgtatccagagtg

SEQ ID NO: 9087633 - DNA, 23 bp, Homo sapiens
cctggggagctgtatccagagtg

SEQ ID NO: 9087634 - DNA, 23 bp, Homo sapiens
cctggggcacttgagtcctcatc

SEQ ID NO: 9087635 - DNA, 23 bp, Homo sapiens
cctggggcacttgagtcctcatc

SEQ ID NO: 9087636 - DNA, 22 bp, Homo sapiens
cctggggccccgagccagaagc

SEQ ID NO: 9087637 - DNA, 22 bp, Homo sapiens
tgtttataatatgcagtgagca

SEQ ID NO: 9087638 - DNA, 22 bp, Homo sapiens
cctggggctcaagatggcgccg

SEQ ID NO: 9087639 - DNA, 22 bp, Homo sapiens
tgtttataatatgcagtgagca

SEQ ID NO: 9087640 - DNA, 22 bp, Homo sapiens
tgtttatacctgcaacctgtca

SEQ ID NO: 9087641 - DNA, 19 bp, Homo sapiens
tgtttcttcctccatctga

SEQ ID NO: 9087642 - DNA, 19 bp, Homo sapiens
tgtttcttcctccatctga

SEQ ID NO: 9087643 - DNA, 19 bp, Homo sapiens
tgtttcttcctccatctga

SEQ ID NO: 9087644 - DNA, 22 bp, Homo sapiens
tgtttcttctcacacaaactca

SEQ ID NO: 9087645 - DNA, 22 bp, Homo sapiens
tgtttcttctcacacaaactca

SEQ ID NO: 9087646 - DNA, 22 bp, Homo sapiens
tgtttcttctcacacaaactca

SEQ ID NO: 9087647 - DNA, 22 bp, Homo sapiens
tgtttcttctcacacaaactca

SEQ ID NO: 9087648 - DNA, 22 bp, Homo sapiens
tgttttcagtcatatagcaggt

SEQ ID NO: 9087649 - DNA, 20 bp, Homo sapiens
tgtttctgacggtaggagag

SEQ ID NO: 9087650 - DNA, 20 bp, Homo sapiens
tgtttctgacggtaggagag

SEQ ID NO: 9087651 - DNA, 22 bp, Homo sapiens
tgtttcttacgtttttagaggc

SEQ ID NO: 9087652 - DNA, 22 bp, Homo sapiens
tgtttcttacgtttttagaggc

SEQ ID NO: 9087653 - DNA, 22 bp, Homo sapiens
tgttttcatcacagaatgtaac

SEQ ID NO: 9087654 - DNA, 22 bp, Homo sapiens
tgttttcatggagatggtggcg

SEQ ID NO: 9087655 - DNA, 22 bp, Homo sapiens
tgttttctagaaacaatgccta

SEQ ID NO: 9087656 - DNA, 22 bp, Homo sapiens
ttaatgacatcataggtgaagt

SEQ ID NO: 9087657 - DNA, 22 bp, Homo sapiens
ttaatgacctagagcagtaatt

SEQ ID NO: 9087658 - DNA, 22 bp, Homo sapiens
ttaatcttatatgtaaaggtaa

SEQ ID NO: 9087659 - DNA, 22 bp, Homo sapiens
ttaatctaagtaatggatgctg

SEQ ID NO: 9087660 - DNA, 23 bp, Homo sapiens
ttaatcagatgagttgaaagaga

SEQ ID NO: 9087661 - DNA, 22 bp, Homo sapiens
cctgtggctgccccgctgttgg

SEQ ID NO: 9087662 - DNA, 22 bp, Homo sapiens
cctgtggctgccacttgggtga

SEQ ID NO: 9087663 - DNA, 22 bp, Homo sapiens
ttacaaagcgttgagacaagta

SEQ ID NO: 9087664 - DNA, 22 bp, Homo sapiens
ttacaagtatttaagatgctgt

SEQ ID NO: 9087665 - DNA, 22 bp, Homo sapiens
ttacaagtactgaatatgattt

SEQ ID NO: 9087666 - DNA, 22 bp, Homo sapiens
cctgtggcgggggccagtgcct

SEQ ID NO: 9087667 - DNA, 22 bp, Homo sapiens
cctgtggcgggggccagtgcct

SEQ ID NO: 9087668 - DNA, 22 bp, Homo sapiens
cctgtggcgggggccagtgcct

SEQ ID NO: 9087669 - DNA, 18 bp, Homo sapiens
cctgtggctcagcccaca

SEQ ID NO: 9087670 - DNA, 23 bp, Homo sapiens
ttacaagttctgaaatttccttc

SEQ ID NO: 9087671 - DNA, 22 bp, Homo sapiens
ttacaagtttctggcttcatcc

SEQ ID NO: 9087672 - DNA, 22 bp, Homo sapiens
ttacaagtttctggcttcatcc

SEQ ID NO: 9087673 - DNA, 22 bp, Homo sapiens
ttacaatagttccttcttttgt

SEQ ID NO: 9087674 - DNA, 22 bp, Homo sapiens
ttacaatagttccttcttttgt

SEQ ID NO: 9087675 - DNA, 22 bp, Homo sapiens
ttacaatagttccttcttttgt

SEQ ID NO: 9087676 - DNA, 22 bp, Homo sapiens
ttaaaatgaatattgattagca

SEQ ID NO: 9087677 - DNA, 22 bp, Homo sapiens
ttaaaagggatgttatctgtaa

SEQ ID NO: 9087678 - DNA, 22 bp, Homo sapiens
ttaaaagggtaagcagcaactt

SEQ ID NO: 9087679 - DNA, 22 bp, Homo sapiens
ttaaaatagccagtgcccctct

SEQ ID NO: 9087680 - DNA, 22 bp, Homo sapiens
ttaaaagagcagcccagcatat

SEQ ID NO: 9087681 - DNA, 22 bp, Homo sapiens
ttaagcatttattatgtgccag

SEQ ID NO: 9087682 - DNA, 22 bp, Homo sapiens
ttaatatacaattttacgggct

SEQ ID NO: 9087683 - DNA, 20 bp, Homo sapiens
ttaagcattattactcccag

SEQ ID NO: 9087684 - DNA, 22 bp, Homo sapiens
ttaatagtgctaaaccattgac

SEQ ID NO: 9087685 - DNA, 22 bp, Homo sapiens
ttccaccattcatgctaatatt

SEQ ID NO: 9087686 - DNA, 21 bp, Homo sapiens
cgggaaggaggttctgaccct

SEQ ID NO: 9087687 - DNA, 22 bp, Homo sapiens
cgggaaggtggaggttgcagtg

SEQ ID NO: 9087688 - DNA, 22 bp, Homo sapiens
cgggagcctctgggtcacactg

SEQ ID NO: 9087689 - DNA, 22 bp, Homo sapiens
cggcttccaacaagctttgctg

SEQ ID NO: 9087690 - DNA, 22 bp, Homo sapiens
cggctggtgtcgggcacagcaa

SEQ ID NO: 9087691 - DNA, 22 bp, Homo sapiens
ttcagtttcttccctgtgaaat

SEQ ID NO: 9087692 - DNA, 22 bp, Homo sapiens
cgcagcagccccgtggtaggtg

SEQ ID NO: 9087693 - DNA, 22 bp, Homo sapiens
cgcagcagccccgtggtaggtg

SEQ ID NO: 9087694 - DNA, 22 bp, Homo sapiens
cgcagcagccccgtggtaggtg

SEQ ID NO: 9087695 - DNA, 20 bp, Homo sapiens
cgcagcagtggaagtggaat

SEQ ID NO: 9087696 - DNA, 22 bp, Homo sapiens
cgcagctgcacggggctgagcc

SEQ ID NO: 9087697 - DNA, 22 bp, Homo sapiens
cgcagctgcaaaggaaacattt

SEQ ID NO: 9087698 - DNA, 21 bp, Homo sapiens
cgcagctgagaaatatacaga

SEQ ID NO: 9087699 - DNA, 22 bp, Homo sapiens
cgcagctgaccttttacaaaac

SEQ ID NO: 9087700 - DNA, 22 bp, Homo sapiens
ttcagggctgacaagcctattg

SEQ ID NO: 9087701 - DNA, 22 bp, Homo sapiens
ttcctctgaaatggcttggaaa

SEQ ID NO: 9087702 - DNA, 21 bp, Homo sapiens
ttcctctgcaactgatgctca

SEQ ID NO: 9087703 - DNA, 21 bp, Homo sapiens
ttcctctgcaactgatgctca

SEQ ID NO: 9087704 - DNA, 22 bp, Homo sapiens
ttcctctggaggctctaggaga

SEQ ID NO: 9087705 - DNA, 22 bp, Homo sapiens
ttcctctggaggctctaggaga

SEQ ID NO: 9087706 - DNA, 21 bp, Homo sapiens
ttcctctgcaactgatgctca

SEQ ID NO: 9087707 - DNA, 22 bp, Homo sapiens
ttcctctctcttgccagaatgt

SEQ ID NO: 9087708 - DNA, 22 bp, Homo sapiens
cgtctggcttctccacggtaaa

SEQ ID NO: 9087709 - DNA, 22 bp, Homo sapiens
ttcctccagcctggagcacttc

SEQ ID NO: 9087710 - DNA, 22 bp, Homo sapiens
ttcctaaaggataggtcagttt

SEQ ID NO: 9087711 - DNA, 22 bp, Homo sapiens
ttcctccagcctggagcacttc

SEQ ID NO: 9087712 - DNA, 22 bp, Homo sapiens
ttcctaacaaacttcagtgaat

SEQ ID NO: 9087713 - DNA, 22 bp, Homo sapiens
ttcctaaaagctgagtagagaa

SEQ ID NO: 9087714 - DNA, 22 bp, Homo sapiens
ttcctccatccttagggagagc

SEQ ID NO: 9087715 - DNA, 22 bp, Homo sapiens
ttcctccatccttagggagagc

SEQ ID NO: 9087716 - DNA, 22 bp, Homo sapiens
ttcctccagtcagagctgtccc

SEQ ID NO: 9087717 - DNA, 22 bp, Homo sapiens
cgtctaggccgtgccctgaggt

SEQ ID NO: 9087718 - DNA, 22 bp, Homo sapiens
cgtctcctgtgttcgagccatt

SEQ ID NO: 9087719 - DNA, 22 bp, Homo sapiens
cgtctcctgtgttcgagccatt

SEQ ID NO: 9087720 - DNA, 22 bp, Homo sapiens
cgtctgcccgactgttcttcac

SEQ ID NO: 9087721 - DNA, 22 bp, Homo sapiens
cgtctgcctaaggactgccttc

SEQ ID NO: 9087722 - DNA, 22 bp, Homo sapiens
cgtcccagttccagccgcgctg

SEQ ID NO: 9087723 - DNA, 22 bp, Homo sapiens
cgtcccagttccagccgcgctg

SEQ ID NO: 9087724 - DNA, 22 bp, Homo sapiens
cgtcccagcagataaatgagga

SEQ ID NO: 9087725 - DNA, 22 bp, Homo sapiens
ttccagaaaacgctttatttag

SEQ ID NO: 9087726 - DNA, 22 bp, Homo sapiens
cgtcccctcgttcccactttgg

SEQ ID NO: 9087727 - DNA, 22 bp, Homo sapiens
ttccactggctttcagtgatct

SEQ ID NO: 9087728 - DNA, 22 bp, Homo sapiens
ttccagaaaactctgcctggta

SEQ ID NO: 9087729 - DNA, 22 bp, Homo sapiens
ttccagaaagttctggaactgg

SEQ ID NO: 9087730 - DNA, 22 bp, Homo sapiens
ttccagaaaaaaatgtatatct

SEQ ID NO: 9087731 - DNA, 22 bp, Homo sapiens
ttccagaaaaaaatgtatatct

SEQ ID NO: 9087732 - DNA, 22 bp, Homo sapiens
ttccagaaaactctgcctggta

SEQ ID NO: 9087733 - DNA, 22 bp, Homo sapiens
ctaactttgtcatcttcccttt

SEQ ID NO: 9087734 - DNA, 22 bp, Homo sapiens
ttccttttgcaaggtcctctag

SEQ ID NO: 9087735 - DNA, 21 bp, Homo sapiens
ctaactttgagtcctggcccc

SEQ ID NO: 9087736 - DNA, 22 bp, Homo sapiens
ctaactttagcttagattatca

SEQ ID NO: 9087737 - DNA, 22 bp, Homo sapiens
ctaactttatttgctaagtaga

SEQ ID NO: 9087738 - DNA, 22 bp, Homo sapiens
ctaactttagcttagattatca

SEQ ID NO: 9087739 - DNA, 22 bp, Homo sapiens
ttctacagaataaatgtttaca

SEQ ID NO: 9087740 - DNA, 22 bp, Homo sapiens
ttctacagaataaatgtttaca

SEQ ID NO: 9087741 - DNA, 21 bp, Homo sapiens
ttctacaggatgaatgaaaac

SEQ ID NO: 9087742 - DNA, 23 bp, Homo sapiens
ttctacagcttcttcagttaagg

SEQ ID NO: 9087743 - DNA, 22 bp, Homo sapiens
ctaacatttggaaggcttatga

SEQ ID NO: 9087744 - DNA, 22 bp, Homo sapiens
ctaaattatttgcacattagag

SEQ ID NO: 9087745 - DNA, 22 bp, Homo sapiens
ctaacatttattgagcacttag

SEQ ID NO: 9087746 - DNA, 22 bp, Homo sapiens
ctaaattatttgcacattagag

SEQ ID NO: 9087747 - DNA, 22 bp, Homo sapiens
ctaaattatcatgagaattatg

SEQ ID NO: 9087748 - DNA, 22 bp, Homo sapiens
ctaaatgcctttcctacctaac

SEQ ID NO: 9087749 - DNA, 22 bp, Homo sapiens
ctaaatgtctcagagggagaca

SEQ ID NO: 9087750 - DNA, 22 bp, Homo sapiens
ctaaatgtcatggagttgtaga

SEQ ID NO: 9087751 - DNA, 22 bp, Homo sapiens
ctaaatgtcatggagttgtaga

SEQ ID NO: 9087752 - DNA, 22 bp, Homo sapiens
ctacataatctggatttgtctg

SEQ ID NO: 9087753 - DNA, 22 bp, Homo sapiens
ctacatagatggatgattgtaa

SEQ ID NO: 9087754 - DNA, 22 bp, Homo sapiens
ctacataaatatttatgtgtct

SEQ ID NO: 9087755 - DNA, 22 bp, Homo sapiens
ctacataaatttatcacagact

SEQ ID NO: 9087756 - DNA, 22 bp, Homo sapiens
ctacattcaacagcagagtttt

SEQ ID NO: 9087757 - DNA, 22 bp, Homo sapiens
ctacattaaattggcttactta

SEQ ID NO: 9087758 - DNA, 22 bp, Homo sapiens
ctacatgaactcttaagtcaca

SEQ ID NO: 9087759 - DNA, 22 bp, Homo sapiens
ctacatctcaccttccaggaca

SEQ ID NO: 9087760 - DNA, 22 bp, Homo sapiens
ctacatggagaagaaaattctt

SEQ ID NO: 9087761 - DNA, 22 bp, Homo sapiens
ttctacctaccctctgcataca

SEQ ID NO: 9087762 - DNA, 22 bp, Homo sapiens
ttctacatgagaaaatgtattt

SEQ ID NO: 9087763 - DNA, 22 bp, Homo sapiens
ttctacatcacttaacatgcta

SEQ ID NO: 9087764 - DNA, 22 bp, Homo sapiens
ttctacatatatttttctcact

SEQ ID NO: 9087765 - DNA, 22 bp, Homo sapiens
ttctacatgagaaaatgtattt

SEQ ID NO: 9087766 - DNA, 22 bp, Homo sapiens
ctagttctgccattcagtgtca

SEQ ID NO: 9087767 - DNA, 22 bp, Homo sapiens
ctagtgcaatgatgaatacaag

SEQ ID NO: 9087768 - DNA, 22 bp, Homo sapiens
ctagtgaacgtggtactatgga

SEQ ID NO: 9087769 - DNA, 18 bp, Homo sapiens
ctagggctgtggctctca

SEQ ID NO: 9087770 - DNA, 22 bp, Homo sapiens
ctagtgtttggaagtcatagcc

SEQ ID NO: 9087771 - DNA, 22 bp, Homo sapiens
ttctccttattcatagttgtct

SEQ ID NO: 9087772 - DNA, 22 bp, Homo sapiens
ttctccttggtttatgggacat

SEQ ID NO: 9087773 - DNA, 22 bp, Homo sapiens
ttctcctttgtaattctcatcc

SEQ ID NO: 9087774 - DNA, 18 bp, Homo sapiens
ctagggctgtggctctca

SEQ ID NO: 9087775 - DNA, 22 bp, Homo sapiens
ttctcatgaaactcgcttcctc

SEQ ID NO: 9087776 - DNA, 22 bp, Homo sapiens
ttctcatgaaactcgcttcctc

SEQ ID NO: 9087777 - DNA, 21 bp, Homo sapiens
ttctcatgggataagtacatg

SEQ ID NO: 9087778 - DNA, 22 bp, Homo sapiens
ttctcctggagtgcttgttggg

SEQ ID NO: 9087779 - DNA, 18 bp, Homo sapiens
ttctcatacctcacttag

SEQ ID NO: 9087780 - DNA, 19 bp, Homo sapiens
ttctcagttcaggagaaga

SEQ ID NO: 9087781 - DNA, 22 bp, Homo sapiens
ttctcagtttcatagctgagca

SEQ ID NO: 9087782 - DNA, 22 bp, Homo sapiens
ttctcagtatgtgacgaggacc

SEQ ID NO: 9087783 - DNA, 23 bp, Homo sapiens
ttctcagtcctgcccagggaggc

SEQ ID NO: 9087784 - DNA, 22 bp, Homo sapiens
ttctcagtagttagcatttgtg

SEQ ID NO: 9087785 - DNA, 22 bp, Homo sapiens
ctacatttacacagttaggctt

SEQ ID NO: 9087786 - DNA, 22 bp, Homo sapiens
ctacatttacacagttaggctt

SEQ ID NO: 9087787 - DNA, 18 bp, Homo sapiens
ctacattcataggaaagg

SEQ ID NO: 9087788 - DNA, 22 bp, Homo sapiens
ctacattctgggaaatcagatg

SEQ ID NO: 9087789 - DNA, 22 bp, Homo sapiens
ttgctgagcagtgtttaattgt

SEQ ID NO: 9087790 - DNA, 16 bp, Homo sapiens
ttgccgcacaggtcgc

SEQ ID NO: 9087791 - DNA, 22 bp, Homo sapiens
ttgcccttgtggagtttacatg

SEQ ID NO: 9087792 - DNA, 22 bp, Homo sapiens
ttgccctgtggggcctccagcc

SEQ ID NO: 9087793 - DNA, 22 bp, Homo sapiens
ttgcactccagcccgagcaaca

SEQ ID NO: 9087794 - DNA, 22 bp, Homo sapiens
ttgcactccagcccgagcaaca

SEQ ID NO: 9087795 - DNA, 21 bp, Homo sapiens
ttgcaccatgataaattcaga

SEQ ID NO: 9087796 - DNA, 22 bp, Homo sapiens
ttgcactagtctcagaggcaaa

SEQ ID NO: 9087797 - DNA, 22 bp, Homo sapiens
ttgcactccagcccgagcaaca

SEQ ID NO: 9087798 - DNA, 22 bp, Homo sapiens
ttgcaccaaatgagttaaaatt

SEQ ID NO: 9087799 - DNA, 22 bp, Homo sapiens
ttgcacatttcctagaatttca

SEQ ID NO: 9087800 - DNA, 22 bp, Homo sapiens
ttgcacagagtggatattcagt

SEQ ID NO: 9087801 - DNA, 18 bp, Homo sapiens
ctcaggcctttccctgtg

SEQ ID NO: 9087802 - DNA, 22 bp, Homo sapiens
ctcaggccttgaagtcttttct

SEQ ID NO: 9087803 - DNA, 22 bp, Homo sapiens
ctcaggcctgagtggcagtccc

SEQ ID NO: 9087804 - DNA, 22 bp, Homo sapiens
ctcaggcctgagtggcagtccc

SEQ ID NO: 9087805 - DNA, 22 bp, Homo sapiens
ttgcacagtggtttagagcctg

SEQ ID NO: 9087806 - DNA, 22 bp, Homo sapiens
ttgcacagatgagggtgatgct

SEQ ID NO: 9087807 - DNA, 23 bp, Homo sapiens
ttgcacagtttcggaaactgagg

SEQ ID NO: 9087808 - DNA, 22 bp, Homo sapiens
ttgctgggtgctattatgaaca

SEQ ID NO: 9087809 - DNA, 22 bp, Homo sapiens
ctcaggctaagaaggccaagtg

SEQ ID NO: 9087810 - DNA, 22 bp, Homo sapiens
ctcaggctaagaaggccaagtg

SEQ ID NO: 9087811 - DNA, 22 bp, Homo sapiens
ttgctggcaatttagagatttc

SEQ ID NO: 9087812 - DNA, 22 bp, Homo sapiens
ttgctgggtcagaagccaggag

SEQ ID NO: 9087813 - DNA, 23 bp, Homo sapiens
ttgctgcctgagccttcctctgg

SEQ ID NO: 9087814 - DNA, 22 bp, Homo sapiens
ttgctgatttgtttctattcca

SEQ ID NO: 9087815 - DNA, 22 bp, Homo sapiens
ttgctgatggtattatgctagt

SEQ ID NO: 9087816 - DNA, 22 bp, Homo sapiens
ttgctgattcatgatttgagaa

SEQ ID NO: 9087817 - DNA, 22 bp, Homo sapiens
ttgctgatctgaaacgttactg

SEQ ID NO: 9087818 - DNA, 22 bp, Homo sapiens
ttgctgatgcccttgtccaggc

SEQ ID NO: 9087819 - DNA, 22 bp, Homo sapiens
ttgctgatctgtgaatcagcca

SEQ ID NO: 9087820 - DNA, 22 bp, Homo sapiens
ctcaggccattcttccagctgc

SEQ ID NO: 9087821 - DNA, 22 bp, Homo sapiens
ctcaggccattcttccagctgc

SEQ ID NO: 9087822 - DNA, 22 bp, Homo sapiens
ctcaggccaggtttctcccaca

SEQ ID NO: 9087823 - DNA, 22 bp, Homo sapiens
ctcaggccaggtttctcccaca

SEQ ID NO: 9087824 - DNA, 22 bp, Homo sapiens
ctcaggccaggtttctcccaca

SEQ ID NO: 9087825 - DNA, 22 bp, Homo sapiens
ctcaggccattcctaccaaggg

SEQ ID NO: 9087826 - DNA, 22 bp, Homo sapiens
ctcaggagtagttcagcagctg

SEQ ID NO: 9087827 - DNA, 22 bp, Homo sapiens
ctcagccatggggtggatcagc

SEQ ID NO: 9087828 - DNA, 22 bp, Homo sapiens
ctcagccatgcaacatgctggg

SEQ ID NO: 9087829 - DNA, 22 bp, Homo sapiens
ctcagcattcaatgtccagtcc

SEQ ID NO: 9087830 - DNA, 22 bp, Homo sapiens
ctcagcatcatggtatctgggg

SEQ ID NO: 9087831 - DNA, 22 bp, Homo sapiens
ttgatcaaatcagctactgagg

SEQ ID NO: 9087832 - DNA, 22 bp, Homo sapiens
ttgatttttccagcttctagag

SEQ ID NO: 9087833 - DNA, 22 bp, Homo sapiens
ttgatttttttctactatgcgc

SEQ ID NO: 9087834 - DNA, 22 bp, Homo sapiens
ttgcaaaaaccacaattacttt

SEQ ID NO: 9087835 - DNA, 22 bp, Homo sapiens
ttgatttttttctactatgcgc

SEQ ID NO: 9087836 - DNA, 22 bp, Homo sapiens
ttgcaaaaaccacaattacttt

SEQ ID NO: 9087837 - DNA, 22 bp, Homo sapiens
ttgcaaaaaccacaattacttt

SEQ ID NO: 9087838 - DNA, 22 bp, Homo sapiens
ttgcaaaaactgcaattacttt

SEQ ID NO: 9087839 - DNA, 22 bp, Homo sapiens
ttgcaaaaccatcctaagtaaa

SEQ ID NO: 9087840 - DNA, 22 bp, Homo sapiens
ttgcaaaaactgcaattacttt

SEQ ID NO: 9087841 - DNA, 22 bp, Homo sapiens
ttgcaaaaactgcaattacttt

SEQ ID NO: 9087842 - DNA, 22 bp, Homo sapiens
ttgcaaaagcaattgcagtttt

SEQ ID NO: 9087843 - DNA, 22 bp, Homo sapiens
ttgcaaaagcaattgcagtttt

SEQ ID NO: 9087844 - DNA, 22 bp, Homo sapiens
ttgcaaaagccgaggcactcca

SEQ ID NO: 9087845 - DNA, 22 bp, Homo sapiens
ttgcaaaagccgaggcactcca

SEQ ID NO: 9087846 - DNA, 22 bp, Homo sapiens
ttgcaaaatcatttctcaggat

SEQ ID NO: 9087847 - DNA, 22 bp, Homo sapiens
ttgcaaaagccgaggcactcca

SEQ ID NO: 9087848 - DNA, 22 bp, Homo sapiens
ttgcaaaatcatttctcaggat

SEQ ID NO: 9087849 - DNA, 23 bp, Homo sapiens
ttgcaaaatgagtcttgagtgaa

SEQ ID NO: 9087850 - DNA, 23 bp, Homo sapiens
ttgcaaaatgcaattgagttaga

SEQ ID NO: 9087851 - DNA, 22 bp, Homo sapiens
ctcagcagtgacaagagagtat

SEQ ID NO: 9087852 - DNA, 22 bp, Homo sapiens
ctcagcagtgacaagagagtat

SEQ ID NO: 9087853 - DNA, 22 bp, Homo sapiens
ctataaatctacccagcattgg

SEQ ID NO: 9087854 - DNA, 22 bp, Homo sapiens
ttctctttttgcatctcaacct

SEQ ID NO: 9087855 - DNA, 23 bp, Homo sapiens
ttctgaaaatagatagtggctcc

SEQ ID NO: 9087856 - DNA, 22 bp, Homo sapiens
ttctgaaaccttcagtatgaag

SEQ ID NO: 9087857 - DNA, 22 bp, Homo sapiens
ttctgaaataggagatagctgt

SEQ ID NO: 9087858 - DNA, 22 bp, Homo sapiens
ttctgaaataggagatagctgt

SEQ ID NO: 9087859 - DNA, 22 bp, Homo sapiens
ttcttaatggcaaaggatttta

SEQ ID NO: 9087860 - DNA, 22 bp, Homo sapiens
ttcttaatcccacaaatcttca

SEQ ID NO: 9087861 - DNA, 22 bp, Homo sapiens
ttcttaatacctattttctacc

SEQ ID NO: 9087862 - DNA, 22 bp, Homo sapiens
ttcttaagagggttaagtgaag

SEQ ID NO: 9087863 - DNA, 22 bp, Homo sapiens
ttcttaagcagtttggcatgtt

SEQ ID NO: 9087864 - DNA, 22 bp, Homo sapiens
ttcttaagcgtatgataatgaa

SEQ ID NO: 9087865 - DNA, 22 bp, Homo sapiens
ttcttaagcgtatgataatgaa

SEQ ID NO: 9087866 - DNA, 22 bp, Homo sapiens
ttcttaagtcagtaagatgcaa

SEQ ID NO: 9087867 - DNA, 22 bp, Homo sapiens
ttcttaaagaggcaaaacacag

SEQ ID NO: 9087868 - DNA, 22 bp, Homo sapiens
ttcttaaagaggcaaaacacag

SEQ ID NO: 9087869 - DNA, 21 bp, Homo sapiens
ttgaaggatcacttctgtacc

SEQ ID NO: 9087870 - DNA, 22 bp, Homo sapiens
ttgaaatatcaagttattagtg

SEQ ID NO: 9087871 - DNA, 22 bp, Homo sapiens
ttgaaatatcaagttattagtg

SEQ ID NO: 9087872 - DNA, 22 bp, Homo sapiens
ttgaagttctgcatttctaata

SEQ ID NO: 9087873 - DNA, 22 bp, Homo sapiens
ttgaagttctaagccccagtac

SEQ ID NO: 9087874 - DNA, 22 bp, Homo sapiens
ttgaagttgcacattataattt

SEQ ID NO: 9087875 - DNA, 21 bp, Homo sapiens
ttcttcagtttaatataaaat

SEQ ID NO: 9087876 - DNA, 22 bp, Homo sapiens
ttcttcccagccagcacagccc

SEQ ID NO: 9087877 - DNA, 22 bp, Homo sapiens
ttcttcattcccttacttccga

SEQ ID NO: 9087878 - DNA, 22 bp, Homo sapiens
ttgaataatgtgtatgttgtta

SEQ ID NO: 9087879 - DNA, 22 bp, Homo sapiens
ttgaataatgtgtatgttgtta

SEQ ID NO: 9087880 - DNA, 22 bp, Homo sapiens
ttgaataatatgcttcgttctc

SEQ ID NO: 9087881 - DNA, 22 bp, Homo sapiens
ttgaatcattacaatagataag

SEQ ID NO: 9087882 - DNA, 22 bp, Homo sapiens
ctcactgcaagctccacctctt

SEQ ID NO: 9087883 - DNA, 22 bp, Homo sapiens
ctcactgtctgtactagctgat

SEQ ID NO: 9087884 - DNA, 22 bp, Homo sapiens
ctcactgccctgaagttgggtt

SEQ ID NO: 9087885 - DNA, 22 bp, Homo sapiens
ctcactggcaagactacaggtg

SEQ ID NO: 9087886 - DNA, 22 bp, Homo sapiens
ctcactgcaagttccacctacc

SEQ ID NO: 9087887 - DNA, 22 bp, Homo sapiens
tattgataaggatggctgcaat

SEQ ID NO: 9087888 - DNA, 22 bp, Homo sapiens
tattgacatttttatagcttga

SEQ ID NO: 9087889 - DNA, 17 bp, Homo sapiens
tattgacctttgtatgt

SEQ ID NO: 9087890 - DNA, 19 bp, Homo sapiens
tattcaggatgatggcaca

SEQ ID NO: 9087891 - DNA, 22 bp, Homo sapiens
tattcaggtcgagctaactgct

SEQ ID NO: 9087892 - DNA, 22 bp, Homo sapiens
tattcagaggtgaagtagggag

SEQ ID NO: 9087893 - DNA, 22 bp, Homo sapiens
tattcagattacttgtgcctgc

SEQ ID NO: 9087894 - DNA, 22 bp, Homo sapiens
tattcagagtgtagcaaataga

SEQ ID NO: 9087895 - DNA, 23 bp, Homo sapiens
tattcagcagtgggatttgttgt

SEQ ID NO: 9087896 - DNA, 22 bp, Homo sapiens
tattcacattctcaggcctggt

SEQ ID NO: 9087897 - DNA, 22 bp, Homo sapiens
tattcacattctcaggcctggt

SEQ ID NO: 9087898 - DNA, 22 bp, Homo sapiens
tattcagaaaataaattggatt

SEQ ID NO: 9087899 - DNA, 22 bp, Homo sapiens
tattcacaggttccggagatta

SEQ ID NO: 9087900 - DNA, 22 bp, Homo sapiens
tattcacaggctggagtgatgt

SEQ ID NO: 9087901 - DNA, 22 bp, Homo sapiens
tattcacaggctggagtgatgt

SEQ ID NO: 9087902 - DNA, 22 bp, Homo sapiens
tattcacaggttctggggatca

SEQ ID NO: 9087903 - DNA, 22 bp, Homo sapiens
tattcacagttgatttacagtt

SEQ ID NO: 9087904 - DNA, 22 bp, Homo sapiens
tattcacatgtacatatgctca

SEQ ID NO: 9087905 - DNA, 22 bp, Homo sapiens
tattcacattaataagtcttca

SEQ ID NO: 9087906 - DNA, 22 bp, Homo sapiens
tattcacatgtacatatgctca

SEQ ID NO: 9087907 - DNA, 22 bp, Homo sapiens
tattcacatgtacatatgctca

SEQ ID NO: 9087908 - DNA, 22 bp, Homo sapiens
tattcacatgaaaacaaatttt

SEQ ID NO: 9087909 - DNA, 22 bp, Homo sapiens
tattcacaggcacgaaatattg

SEQ ID NO: 9087910 - DNA, 22 bp, Homo sapiens
tattcacaaaatgaggtcctca

SEQ ID NO: 9087911 - DNA, 22 bp, Homo sapiens
tattcacagctgccgcactcag

SEQ ID NO: 9087912 - DNA, 22 bp, Homo sapiens
tattcacagctgccgcactcag

SEQ ID NO: 9087913 - DNA, 22 bp, Homo sapiens
tattcacaaaatgaggtcctca

SEQ ID NO: 9087914 - DNA, 22 bp, Homo sapiens
tattcaagattgaactggcaga

SEQ ID NO: 9087915 - DNA, 22 bp, Homo sapiens
tattcaaagtgcgaggtcaggg

SEQ ID NO: 9087916 - DNA, 22 bp, Homo sapiens
tattcaaagtgcgaggtcaggg

SEQ ID NO: 9087917 - DNA, 22 bp, Homo sapiens
tatgtttatactttgatgtact

SEQ ID NO: 9087918 - DNA, 22 bp, Homo sapiens
tattcaaagtaccttcattgcc

SEQ ID NO: 9087919 - DNA, 22 bp, Homo sapiens
tattcaaagtaccttcattgcc

SEQ ID NO: 9087920 - DNA, 22 bp, Homo sapiens
tatgttattttcatacaacaga

SEQ ID NO: 9087921 - DNA, 22 bp, Homo sapiens
tatgttaagtgggataatcaaa

SEQ ID NO: 9087922 - DNA, 22 bp, Homo sapiens
tatgttcatgcttatgcagaat

SEQ ID NO: 9087923 - DNA, 22 bp, Homo sapiens
tatgttctgactctacatggga

SEQ ID NO: 9087924 - DNA, 22 bp, Homo sapiens
tatgttctgtctgtacagattt

SEQ ID NO: 9087925 - DNA, 22 bp, Homo sapiens
tatgttctgtctgtacagattt

SEQ ID NO: 9087926 - DNA, 22 bp, Homo sapiens
tatgttgcaccaacctaataat

SEQ ID NO: 9087927 - DNA, 22 bp, Homo sapiens
tatgtttaaatgtatgtgtatg

SEQ ID NO: 9087928 - DNA, 22 bp, Homo sapiens
tatgtttacgctggtagaatta

SEQ ID NO: 9087929 - DNA, 17 bp, Homo sapiens
tatgtgtgtgtttatac

SEQ ID NO: 9087930 - DNA, 22 bp, Homo sapiens
tatgctgtgctagatacaatat

SEQ ID NO: 9087931 - DNA, 22 bp, Homo sapiens
tatgctgtggaaaatacaaaga

SEQ ID NO: 9087932 - DNA, 22 bp, Homo sapiens
tatgctgagtatataaaacaga

SEQ ID NO: 9087933 - DNA, 22 bp, Homo sapiens
tatgctattcttcagagtgttc

SEQ ID NO: 9087934 - DNA, 22 bp, Homo sapiens
tatgccactgctctccatccta

SEQ ID NO: 9087935 - DNA, 22 bp, Homo sapiens
tattgggtaaagatccagtttt

SEQ ID NO: 9087936 - DNA, 22 bp, Homo sapiens
tattgtacatttcaaaattgct

SEQ ID NO: 9087937 - DNA, 22 bp, Homo sapiens
tattgtacatttccaaattgct

SEQ ID NO: 9087938 - DNA, 22 bp, Homo sapiens
tattgtactgaggaataaagct

SEQ ID NO: 9087939 - DNA, 22 bp, Homo sapiens
tattgtactgaggaataaagct

SEQ ID NO: 9087940 - DNA, 22 bp, Homo sapiens
tattgtacatttcaaagtagct

SEQ ID NO: 9087941 - DNA, 22 bp, Homo sapiens
tattgtacatttcaaagtagct

SEQ ID NO: 9087942 - DNA, 22 bp, Homo sapiens
tattgcagaattcgctggaaca

SEQ ID NO: 9087943 - DNA, 23 bp, Homo sapiens
tattgcacaaagagatgcacagg

SEQ ID NO: 9087944 - DNA, 22 bp, Homo sapiens
tattgcaatttggctaaagaat

SEQ ID NO: 9087945 - DNA, 22 bp, Homo sapiens
tattgcaatttggctaaagaat

SEQ ID NO: 9087946 - DNA, 23 bp, Homo sapiens
tattgcaagctctgcctcccggg

SEQ ID NO: 9087947 - DNA, 22 bp, Homo sapiens
tattgcaagcaattccaaaagg

SEQ ID NO: 9087948 - DNA, 22 bp, Homo sapiens
tattgcaagtggcataaaattt

SEQ ID NO: 9087949 - DNA, 22 bp, Homo sapiens
tattgcaattggcagagtgcta

SEQ ID NO: 9087950 - DNA, 22 bp, Homo sapiens
tatttcaccagtaggaggctgt

SEQ ID NO: 9087951 - DNA, 22 bp, Homo sapiens
tatttcacataccacagagtgt

SEQ ID NO: 9087952 - DNA, 22 bp, Homo sapiens
tatttcaacgtatgaaaagctg

SEQ ID NO: 9087953 - DNA, 22 bp, Homo sapiens
tatttcaacgtatgaaaagctg

SEQ ID NO: 9087954 - DNA, 22 bp, Homo sapiens
tatttcaacgtatgaaaagctg

SEQ ID NO: 9087955 - DNA, 22 bp, Homo sapiens
tatttcaacgtatgaaaagctg

SEQ ID NO: 9087956 - DNA, 22 bp, Homo sapiens
tatttgttgagttgttatgtct

SEQ ID NO: 9087957 - DNA, 22 bp, Homo sapiens
tatttgtctttcttataagaat

SEQ ID NO: 9087958 - DNA, 22 bp, Homo sapiens
tatttgttccagagataaaaat

SEQ ID NO: 9087959 - DNA, 22 bp, Homo sapiens
tatttgttccagagataaaaat

SEQ ID NO: 9087960 - DNA, 20 bp, Homo sapiens
tatttgtatttgggaaagtt

SEQ ID NO: 9087961 - DNA, 22 bp, Homo sapiens
tatttgtatgtgtgtacatata

SEQ ID NO: 9087962 - DNA, 22 bp, Homo sapiens
tatttgtatgtgtgtacatata

SEQ ID NO: 9087963 - DNA, 22 bp, Homo sapiens
tatttgtatttcatgcagtaaa

SEQ ID NO: 9087964 - DNA, 22 bp, Homo sapiens
tatttgtagaatggattaaggg

SEQ ID NO: 9087965 - DNA, 22 bp, Homo sapiens
tatttgtagcttcccaaagctt

SEQ ID NO: 9087966 - DNA, 22 bp, Homo sapiens
tatttgtatgtgtgtacatata

SEQ ID NO: 9087967 - DNA, 22 bp, Homo sapiens
tatttgtatgtgtgtacatata

SEQ ID NO: 9087968 - DNA, 22 bp, Homo sapiens
tatttctaagctgtaagtctga

SEQ ID NO: 9087969 - DNA, 22 bp, Homo sapiens
tatttctaagagatatctgtac

SEQ ID NO: 9087970 - DNA, 22 bp, Homo sapiens
tatttctaagagatatctgtac

SEQ ID NO: 9087971 - DNA, 22 bp, Homo sapiens
tatttcctgtggatacttttag

SEQ ID NO: 9087972 - DNA, 22 bp, Homo sapiens
tatttccagcagtaagaagaca

SEQ ID NO: 9087973 - DNA, 22 bp, Homo sapiens
tatttccatgttagaactaagt

SEQ ID NO: 9087974 - DNA, 22 bp, Homo sapiens
tatctttaacttgcagtattta

SEQ ID NO: 9087975 - DNA, 22 bp, Homo sapiens
tatctttaacttgcagtattta

SEQ ID NO: 9087976 - DNA, 22 bp, Homo sapiens
tatcttggcttgaaagatgctt

SEQ ID NO: 9087977 - DNA, 22 bp, Homo sapiens
tatcttggactctttgcagtgc

SEQ ID NO: 9087978 - DNA, 21 bp, Homo sapiens
tatcttgggctctgtgcttga

SEQ ID NO: 9087979 - DNA, 22 bp, Homo sapiens
tatctttattatgtctatctgc

SEQ ID NO: 9087980 - DNA, 22 bp, Homo sapiens
tatctttagaggaagagaatct

SEQ ID NO: 9087981 - DNA, 22 bp, Homo sapiens
tatcttcacttatatctttctt

SEQ ID NO: 9087982 - DNA, 22 bp, Homo sapiens
tatcttaaatgcatgatagaca

SEQ ID NO: 9087983 - DNA, 22 bp, Homo sapiens
tatgcagaagtagggattggag

SEQ ID NO: 9087984 - DNA, 22 bp, Homo sapiens
tatctttgcaaatatctctaag

SEQ ID NO: 9087985 - DNA, 22 bp, Homo sapiens
tatctttgtatcaatctccatt

SEQ ID NO: 9087986 - DNA, 22 bp, Homo sapiens
tatgcataggtatctatactca

SEQ ID NO: 9087987 - DNA, 22 bp, Homo sapiens
tatgccaaggatcaatatgtat

SEQ ID NO: 9087988 - DNA, 22 bp, Homo sapiens
tatgccaaggatcaatatgtat

SEQ ID NO: 9087989 - DNA, 23 bp, Homo sapiens
tatgccaaaatggaaagtgtata

SEQ ID NO: 9087990 - DNA, 23 bp, Homo sapiens
tatgccaaaatggaaagtgtata

SEQ ID NO: 9087991 - DNA, 22 bp, Homo sapiens
tatgcattttatagtgcaaagc

SEQ ID NO: 9087992 - DNA, 22 bp, Homo sapiens
tatgcatatgtgttcattggag

SEQ ID NO: 9087993 - DNA, 22 bp, Homo sapiens
tatgcatatatcacgtgcatgc

SEQ ID NO: 9087994 - DNA, 17 bp, Homo sapiens
tatctgtgttcctggct

SEQ ID NO: 9087995 - DNA, 22 bp, Homo sapiens
tatctagatttctttctctgtg

SEQ ID NO: 9087996 - DNA, 22 bp, Homo sapiens
tatctataagtactaacatggt

SEQ ID NO: 9087997 - DNA, 22 bp, Homo sapiens
tatcacaattcctatagtttgt

SEQ ID NO: 9087998 - DNA, 22 bp, Homo sapiens
tatcacaattcctatagtttgt

SEQ ID NO: 9087999 - DNA, 22 bp, Homo sapiens
tatctagatatttggataaatg

SEQ ID NO: 9088000 - DNA, 17 bp, Homo sapiens
tatcaagaagtctggcc

SEQ ID NO: 9088001 - DNA, 22 bp, Homo sapiens
tatattttagacaccctcacgc

SEQ ID NO: 9088002 - DNA, 22 bp, Homo sapiens
tatattttagacaccctcacgc

SEQ ID NO: 9088003 - DNA, 20 bp, Homo sapiens
tatattttctctttggcctt

SEQ ID NO: 9088004 - DNA, 22 bp, Homo sapiens
tatattttagacaccctcacgc

SEQ ID NO: 9088005 - DNA, 22 bp, Homo sapiens
tatcaaagttgtcctgtgaagt

SEQ ID NO: 9088006 - DNA, 20 bp, Homo sapiens
tatattttctctttggcctt

SEQ ID NO: 9088007 - DNA, 22 bp, Homo sapiens
tatattcaacaggctaatgtca

SEQ ID NO: 9088008 - DNA, 22 bp, Homo sapiens
tatattcaacaggctaatgtca

SEQ ID NO: 9088009 - DNA, 22 bp, Homo sapiens
tatatttaaatccaggttgaaa

SEQ ID NO: 9088010 - DNA, 22 bp, Homo sapiens
tatatttaaatccaggttgaaa

SEQ ID NO: 9088011 - DNA, 22 bp, Homo sapiens
tatatttaatcctagagccatt

SEQ ID NO: 9088012 - DNA, 22 bp, Homo sapiens
tatatttaatcctagagccatt

SEQ ID NO: 9088013 - DNA, 22 bp, Homo sapiens
tatatttaattagttgctggat

SEQ ID NO: 9088014 - DNA, 18 bp, Homo sapiens
tatatttcacacatattc

SEQ ID NO: 9088015 - DNA, 22 bp, Homo sapiens
tatatttgtgtgtgatttatga

SEQ ID NO: 9088016 - DNA, 22 bp, Homo sapiens
tatatgtagattgtaccaatgt

SEQ ID NO: 9088017 - DNA, 22 bp, Homo sapiens
tatatgcttgggaaatggtaga

SEQ ID NO: 9088018 - DNA, 22 bp, Homo sapiens
tatatggatagtgatcataaga

SEQ ID NO: 9088019 - DNA, 22 bp, Homo sapiens
tatagagctttggcattgatta

SEQ ID NO: 9088020 - DNA, 22 bp, Homo sapiens
tatagcaaaatagtttccacac

SEQ ID NO: 9088021 - DNA, 22 bp, Homo sapiens
tatagcaagctctttgtaacca

SEQ ID NO: 9088022 - DNA, 22 bp, Homo sapiens
tatagcaagcaggacagtctca

SEQ ID NO: 9088023 - DNA, 22 bp, Homo sapiens
tatattacctgcctgatctata

SEQ ID NO: 9088024 - DNA, 22 bp, Homo sapiens
tatattacctgcctgatctata

SEQ ID NO: 9088025 - DNA, 22 bp, Homo sapiens
tatattaacttgtgatcctgga

SEQ ID NO: 9088026 - DNA, 22 bp, Homo sapiens
tatattaacacccacttgcctc

SEQ ID NO: 9088027 - DNA, 22 bp, Homo sapiens
tatattaaccatagggttctag

SEQ ID NO: 9088028 - DNA, 22 bp, Homo sapiens
tatattaaatgaccagttttaa

SEQ ID NO: 9088029 - DNA, 22 bp, Homo sapiens
tatattaaatgaccagttttaa

SEQ ID NO: 9088030 - DNA, 22 bp, Homo sapiens
tatattaaagtgctttgcagtg

SEQ ID NO: 9088031 - DNA, 22 bp, Homo sapiens
tatatgttgatactaattctgg

SEQ ID NO: 9088032 - DNA, 22 bp, Homo sapiens
tatatgtttcttacaaaatatt

SEQ ID NO: 9088033 - DNA, 22 bp, Homo sapiens
tatattaaaccctctctgtagg

SEQ ID NO: 9088034 - DNA, 22 bp, Homo sapiens
tagtgtttagtacatatgcata

SEQ ID NO: 9088035 - DNA, 22 bp, Homo sapiens
tagttaaaataatggagatgtt

SEQ ID NO: 9088036 - DNA, 22 bp, Homo sapiens
tagttaatgctaattaacaaat

SEQ ID NO: 9088037 - DNA, 21 bp, Homo sapiens
tatacagaggggaacaggaga

SEQ ID NO: 9088038 - DNA, 22 bp, Homo sapiens
tagttaaagccctaaattgata

SEQ ID NO: 9088039 - DNA, 22 bp, Homo sapiens
tagttaactcttggtaataggt

SEQ ID NO: 9088040 - DNA, 22 bp, Homo sapiens
tagttaaagccctaaattgata

SEQ ID NO: 9088041 - DNA, 22 bp, Homo sapiens
tagttaaagagatccacattcc

SEQ ID NO: 9088042 - DNA, 22 bp, Homo sapiens
tagttaaaccaccattctggta

SEQ ID NO: 9088043 - DNA, 22 bp, Homo sapiens
tagttaaaataatggagatgtt

SEQ ID NO: 9088044 - DNA, 22 bp, Homo sapiens
tagttaaagattctgttaagag

SEQ ID NO: 9088045 - DNA, 22 bp, Homo sapiens
tagttaaagattctgttaagag

SEQ ID NO: 9088046 - DNA, 22 bp, Homo sapiens
tataccaaaaaaattcttgtct

SEQ ID NO: 9088047 - DNA, 22 bp, Homo sapiens
tataccaaaatatcagaaaggg

SEQ ID NO: 9088048 - DNA, 22 bp, Homo sapiens
tatacagataatgaagaccaag

SEQ ID NO: 9088049 - DNA, 22 bp, Homo sapiens
tatactgagagcaaatacattc

SEQ ID NO: 9088050 - DNA, 22 bp, Homo sapiens
tatactgatttgtctatactct

SEQ ID NO: 9088051 - DNA, 22 bp, Homo sapiens
tatactttcctgcaactttgat

SEQ ID NO: 9088052 - DNA, 22 bp, Homo sapiens
tatagaagagacatgtgcatag

SEQ ID NO: 9088053 - DNA, 22 bp, Homo sapiens
tatagaagtaagcattgtgatg

SEQ ID NO: 9088054 - DNA, 22 bp, Homo sapiens
taggaatgatgtatttttctct

SEQ ID NO: 9088055 - DNA, 22 bp, Homo sapiens
taggaatgaagaagtatgatat

SEQ ID NO: 9088056 - DNA, 22 bp, Homo sapiens
taggaaggtccatgtcttatct

SEQ ID NO: 9088057 - DNA, 22 bp, Homo sapiens
taggaagggctcagggctcggt

SEQ ID NO: 9088058 - DNA, 22 bp, Homo sapiens
taggaaggtgtttttaaggagc

SEQ ID NO: 9088059 - DNA, 22 bp, Homo sapiens
taggaaggtgtttttaaggagc

SEQ ID NO: 9088060 - DNA, 22 bp, Homo sapiens
taggaaggcctgtcactacttg

SEQ ID NO: 9088061 - DNA, 22 bp, Homo sapiens
taggaaggaggccatcttggcg

SEQ ID NO: 9088062 - DNA, 22 bp, Homo sapiens
taggaaggaggccatcttggcg

SEQ ID NO: 9088063 - DNA, 22 bp, Homo sapiens
taggaatggtgctcagcagaaa

SEQ ID NO: 9088064 - DNA, 22 bp, Homo sapiens
taggaatgggcaagacaaagaa

SEQ ID NO: 9088065 - DNA, 22 bp, Homo sapiens
taggaatgggctatcccaagct

SEQ ID NO: 9088066 - DNA, 22 bp, Homo sapiens
taggaattgaaaagtggtctga

SEQ ID NO: 9088067 - DNA, 22 bp, Homo sapiens
taggaattgcccgtggggtcct

SEQ ID NO: 9088068 - DNA, 22 bp, Homo sapiens
taggaattgcccgtggggtcct

SEQ ID NO: 9088069 - DNA, 22 bp, Homo sapiens
taggaattttgcatgggaattt

SEQ ID NO: 9088070 - DNA, 22 bp, Homo sapiens
taggaattttgcatgggaattt

SEQ ID NO: 9088071 - DNA, 22 bp, Homo sapiens
taggaatttttgtaatggtact

SEQ ID NO: 9088072 - DNA, 22 bp, Homo sapiens
taggcgacagcttgatggtgcg

SEQ ID NO: 9088073 - DNA, 22 bp, Homo sapiens
taggctcagaggcagaggctga

SEQ ID NO: 9088074 - DNA, 22 bp, Homo sapiens
taggctcagggtctcagaggct

SEQ ID NO: 9088075 - DNA, 22 bp, Homo sapiens
taggccttagaggaccaggatt

SEQ ID NO: 9088076 - DNA, 22 bp, Homo sapiens
taggccttagaggaccaggatt

SEQ ID NO: 9088077 - DNA, 23 bp, Homo sapiens
taggccttagcgatcactgtcag

SEQ ID NO: 9088078 - DNA, 23 bp, Homo sapiens
taggccttagcgatcactgtcag

SEQ ID NO: 9088079 - DNA, 22 bp, Homo sapiens
taggccttcggtgtgtgcttgg

SEQ ID NO: 9088080 - DNA, 22 bp, Homo sapiens
taggccttcggtgtgtgcttgg

SEQ ID NO: 9088081 - DNA, 22 bp, Homo sapiens
taggccttctgaggtgacctgc

SEQ ID NO: 9088082 - DNA, 22 bp, Homo sapiens
taggccttgaaagtagctctgc

SEQ ID NO: 9088083 - DNA, 22 bp, Homo sapiens
taggccttgaattgagggatgt

SEQ ID NO: 9088084 - DNA, 22 bp, Homo sapiens
taggccttctgaggtgacctgc

SEQ ID NO: 9088085 - DNA, 22 bp, Homo sapiens
taggccttgaaagtagctctgc

SEQ ID NO: 9088086 - DNA, 22 bp, Homo sapiens
taggccttgaattgagggatgt

SEQ ID NO: 9088087 - DNA, 22 bp, Homo sapiens
taggccttgcctggcttcacac

SEQ ID NO: 9088088 - DNA, 22 bp, Homo sapiens
taggccttgcctggcttcacac

SEQ ID NO: 9088089 - DNA, 22 bp, Homo sapiens
taggccttgtcacaggaataca

SEQ ID NO: 9088090 - DNA, 22 bp, Homo sapiens
taggccttttctcgtttctcca

SEQ ID NO: 9088091 - DNA, 22 bp, Homo sapiens
taggccttttgaattggtttcc

SEQ ID NO: 9088092 - DNA, 22 bp, Homo sapiens
taggccttttgcatgcaatgtt

SEQ ID NO: 9088093 - DNA, 22 bp, Homo sapiens
taggccttgtcacaggaataca

SEQ ID NO: 9088094 - DNA, 22 bp, Homo sapiens
taggccttttctcgtttctcca

SEQ ID NO: 9088095 - DNA, 22 bp, Homo sapiens
taggccttttgaattggtttcc

SEQ ID NO: 9088096 - DNA, 22 bp, Homo sapiens
taggccttttgcatgcaatgtt

SEQ ID NO: 9088097 - DNA, 22 bp, Homo sapiens
taggctcattaagtccccaggg

SEQ ID NO: 9088098 - DNA, 22 bp, Homo sapiens
taggctcattttttaagtggtt

SEQ ID NO: 9088099 - DNA, 22 bp, Homo sapiens
taggctcttggtaaacaaaatt

SEQ ID NO: 9088100 - DNA, 22 bp, Homo sapiens
taggctgaaaggagaggtgaag

SEQ ID NO: 9088101 - DNA, 22 bp, Homo sapiens
taggctctccaagcccaggacc

SEQ ID NO: 9088102 - DNA, 23 bp, Homo sapiens
taggcctccctggagcacccagc

SEQ ID NO: 9088103 - DNA, 22 bp, Homo sapiens
taggcctcaggaccccagggct

SEQ ID NO: 9088104 - DNA, 22 bp, Homo sapiens
taggacaggtgaggggctgtgg

SEQ ID NO: 9088105 - DNA, 22 bp, Homo sapiens
taggacaggtgaggggctgtgg

SEQ ID NO: 9088106 - DNA, 20 bp, Homo sapiens
taggacagggcctggcttct

SEQ ID NO: 9088107 - DNA, 20 bp, Homo sapiens
taggacagggcctggcttct

SEQ ID NO: 9088108 - DNA, 22 bp, Homo sapiens
taggacaggatcatgatgctgg

SEQ ID NO: 9088109 - DNA, 21 bp, Homo sapiens
taggacagcccccctgccctc

SEQ ID NO: 9088110 - DNA, 22 bp, Homo sapiens
taggacagagttccctgatggc

SEQ ID NO: 9088111 - DNA, 22 bp, Homo sapiens
taggacaggctaaaagggataa

SEQ ID NO: 9088112 - DNA, 22 bp, Homo sapiens
taggacaggatcatgatgctgg

SEQ ID NO: 9088113 - DNA, 22 bp, Homo sapiens
taggacaggatcatgatgctgg

SEQ ID NO: 9088114 - DNA, 22 bp, Homo sapiens
taggaaataattcactctggct

SEQ ID NO: 9088115 - DNA, 22 bp, Homo sapiens
taggaaataaatacttatggtt

SEQ ID NO: 9088116 - DNA, 22 bp, Homo sapiens
taggaaataaatacttatggtt

SEQ ID NO: 9088117 - DNA, 22 bp, Homo sapiens
taggaaatactgtaagtttggg

SEQ ID NO: 9088118 - DNA, 18 bp, Homo sapiens
taggaaatagggctgtga

SEQ ID NO: 9088119 - DNA, 20 bp, Homo sapiens
taggaaatatgtttttaccc

SEQ ID NO: 9088120 - DNA, 20 bp, Homo sapiens
taggaaatatgtttttaccc

SEQ ID NO: 9088121 - DNA, 18 bp, Homo sapiens
taggaaatagggctgtga

SEQ ID NO: 9088122 - DNA, 22 bp, Homo sapiens
taggaaatatttgaacatagga

SEQ ID NO: 9088123 - DNA, 22 bp, Homo sapiens
taggaaatattgatttcagtca

SEQ ID NO: 9088124 - DNA, 22 bp, Homo sapiens
taggaaatattgatttcagtca

SEQ ID NO: 9088125 - DNA, 22 bp, Homo sapiens
taggaaatatttgaacatagga

SEQ ID NO: 9088126 - DNA, 22 bp, Homo sapiens
taggaaatcagagaaagaggtg

SEQ ID NO: 9088127 - DNA, 22 bp, Homo sapiens
taggaaatatttgaacatagga

SEQ ID NO: 9088128 - DNA, 22 bp, Homo sapiens
taggaaatgaatgcaggctccc

SEQ ID NO: 9088129 - DNA, 22 bp, Homo sapiens
taggaaatgaatgcaggctccc

SEQ ID NO: 9088130 - DNA, 20 bp, Homo sapiens
taggaaatcgaggcagggtg

SEQ ID NO: 9088131 - DNA, 20 bp, Homo sapiens
taggaaatcgaggcagggtg

SEQ ID NO: 9088132 - DNA, 22 bp, Homo sapiens
tagcccagaagagggaagcaac

SEQ ID NO: 9088133 - DNA, 19 bp, Homo sapiens
tagcccagagcctggctac

SEQ ID NO: 9088134 - DNA, 16 bp, Homo sapiens
taggaaactgcatgtg

SEQ ID NO: 9088135 - DNA, 22 bp, Homo sapiens
taggaaactctcagctggtcat

SEQ ID NO: 9088136 - DNA, 22 bp, Homo sapiens
tagcccagagtcccaattccag

SEQ ID NO: 9088137 - DNA, 22 bp, Homo sapiens
taggaaatggctcagttactgc

SEQ ID NO: 9088138 - DNA, 22 bp, Homo sapiens
taggaaatggctcagttactgc

SEQ ID NO: 9088139 - DNA, 22 bp, Homo sapiens
taggaaatgaggccaacatgtg

SEQ ID NO: 9088140 - DNA, 22 bp, Homo sapiens
taggaaatgaatgcaggctccc

SEQ ID NO: 9088141 - DNA, 22 bp, Homo sapiens
taggaaatgccagccttcctcc

SEQ ID NO: 9088142 - DNA, 22 bp, Homo sapiens
taggaaatgaggccaacatgtg

SEQ ID NO: 9088143 - DNA, 22 bp, Homo sapiens
taggaaatgctccattgcataa

SEQ ID NO: 9088144 - DNA, 22 bp, Homo sapiens
taggaaatgctgtcttattgta

SEQ ID NO: 9088145 - DNA, 22 bp, Homo sapiens
taggaaatgctgtcttattgta

SEQ ID NO: 9088146 - DNA, 22 bp, Homo sapiens
taggaaatggctcagttactgc

SEQ ID NO: 9088147 - DNA, 22 bp, Homo sapiens
taggaagctctttgttttgtga

SEQ ID NO: 9088148 - DNA, 18 bp, Homo sapiens
taggaagcttaatgtttt

SEQ ID NO: 9088149 - DNA, 22 bp, Homo sapiens
taggaagcctaaattaagtggt

SEQ ID NO: 9088150 - DNA, 23 bp, Homo sapiens
taggaagacagcaaaagaatgga

SEQ ID NO: 9088151 - DNA, 22 bp, Homo sapiens
tagtgggtagaggccagggacg

SEQ ID NO: 9088152 - DNA, 22 bp, Homo sapiens
tagtgggtggaggccagggatg

SEQ ID NO: 9088153 - DNA, 23 bp, Homo sapiens
tagtgtatatcaacatttgtccc

SEQ ID NO: 9088154 - DNA, 22 bp, Homo sapiens
tagtccagccttgggtgtagcc

SEQ ID NO: 9088155 - DNA, 22 bp, Homo sapiens
tagtcccattttgaggtatttg

SEQ ID NO: 9088156 - DNA, 22 bp, Homo sapiens
tagtcctaaaattcagctatat

SEQ ID NO: 9088157 - DNA, 22 bp, Homo sapiens
tagtcctggattggtggaggca

SEQ ID NO: 9088158 - DNA, 22 bp, Homo sapiens
tagtcctgaccagctggatgtt

SEQ ID NO: 9088159 - DNA, 22 bp, Homo sapiens
tagtcctgaccttgccaccagc

SEQ ID NO: 9088160 - DNA, 22 bp, Homo sapiens
tagtcagatatatgacttacgt

SEQ ID NO: 9088161 - DNA, 22 bp, Homo sapiens
tagtcagagtcttctctgttgt

SEQ ID NO: 9088162 - DNA, 22 bp, Homo sapiens
tagtcagacccaagagagccat

SEQ ID NO: 9088163 - DNA, 22 bp, Homo sapiens
tagtcatctgggtaatgttcaa

SEQ ID NO: 9088164 - DNA, 22 bp, Homo sapiens
tagtcagttgggtctagtggca

SEQ ID NO: 9088165 - DNA, 22 bp, Homo sapiens
tagtcaatcagtatgtattgga

SEQ ID NO: 9088166 - DNA, 22 bp, Homo sapiens
tagtattttagaaaaccatgaa

SEQ ID NO: 9088167 - DNA, 22 bp, Homo sapiens
tagtcaactagtgagcatatgg

SEQ ID NO: 9088168 - DNA, 22 bp, Homo sapiens
tagtatttataatcatgcttaa

SEQ ID NO: 9088169 - DNA, 22 bp, Homo sapiens
tagtatttcctgtaagctatag

SEQ ID NO: 9088170 - DNA, 22 bp, Homo sapiens
tagtatttcctgtaagctatag

SEQ ID NO: 9088171 - DNA, 22 bp, Homo sapiens
tagtatttaatcacttttgtct

SEQ ID NO: 9088172 - DNA, 22 bp, Homo sapiens
tagtaaaaagcaatggtgagta

SEQ ID NO: 9088173 - DNA, 22 bp, Homo sapiens
tagtaaaaggtcttcctttgtt

SEQ ID NO: 9088174 - DNA, 22 bp, Homo sapiens
taggtttcagaggtgccgggaa

SEQ ID NO: 9088175 - DNA, 22 bp, Homo sapiens
taggtttaggagtgaaggtgaa

SEQ ID NO: 9088176 - DNA, 22 bp, Homo sapiens
taggtttaggagtgaaggtgaa

SEQ ID NO: 9088177 - DNA, 22 bp, Homo sapiens
taggtttactgaattagtggaa

SEQ ID NO: 9088178 - DNA, 22 bp, Homo sapiens
tagtaaaaggtcttcctttgtt

SEQ ID NO: 9088179 - DNA, 22 bp, Homo sapiens
tagtaaaagtttagttgaaagt

SEQ ID NO: 9088180 - DNA, 22 bp, Homo sapiens
tagtaaaagtttagttgaaagt

SEQ ID NO: 9088181 - DNA, 22 bp, Homo sapiens
tagtaaaagtttagttgaaagt

SEQ ID NO: 9088182 - DNA, 22 bp, Homo sapiens
tagtatatctttagtacatagt

SEQ ID NO: 9088183 - DNA, 22 bp, Homo sapiens
tagtagcaccagtcatatttga

SEQ ID NO: 9088184 - DNA, 22 bp, Homo sapiens
tagtagcaaaactcatctcttt

SEQ ID NO: 9088185 - DNA, 22 bp, Homo sapiens
tagtagcaggaatctgaaggta

SEQ ID NO: 9088186 - DNA, 22 bp, Homo sapiens
taggtttactgaattagtggaa

SEQ ID NO: 9088187 - DNA, 22 bp, Homo sapiens
taggttcatgaaattttcagga

SEQ ID NO: 9088188 - DNA, 22 bp, Homo sapiens
taggttctctattgcccccaaa

SEQ ID NO: 9088189 - DNA, 22 bp, Homo sapiens
taggttcagagaactgaaaata

SEQ ID NO: 9088190 - DNA, 22 bp, Homo sapiens
taggttcagagaactgaaaata

SEQ ID NO: 9088191 - DNA, 22 bp, Homo sapiens
taggttcagcttccactgccta

SEQ ID NO: 9088192 - DNA, 22 bp, Homo sapiens
taggttcacttagctgtgggaa

SEQ ID NO: 9088193 - DNA, 22 bp, Homo sapiens
taggttcagctttcatcctgaa

SEQ ID NO: 9088194 - DNA, 22 bp, Homo sapiens
taggttcaggagatattgcaca

SEQ ID NO: 9088195 - DNA, 22 bp, Homo sapiens
taggttcatattctagaatcat

SEQ ID NO: 9088196 - DNA, 22 bp, Homo sapiens
taggttcagtgtcttgttctgc

SEQ ID NO: 9088197 - DNA, 22 bp, Homo sapiens
taggttcactgtcttgaggagc

SEQ ID NO: 9088198 - DNA, 22 bp, Homo sapiens
taggttcaagttcaggctctat

SEQ ID NO: 9088199 - DNA, 22 bp, Homo sapiens
taggttcacacatcttccagat

SEQ ID NO: 9088200 - DNA, 22 bp, Homo sapiens
taggctgggagcctgaggctag

SEQ ID NO: 9088201 - DNA, 22 bp, Homo sapiens
taggctgggaagaaagattctc

SEQ ID NO: 9088202 - DNA, 22 bp, Homo sapiens
taggctggaggaagcagtgcct

SEQ ID NO: 9088203 - DNA, 22 bp, Homo sapiens
taggctggaacttaggcagagg

SEQ ID NO: 9088204 - DNA, 22 bp, Homo sapiens
taggctgaggttgatgccaggg

SEQ ID NO: 9088205 - DNA, 22 bp, Homo sapiens
taggctgagcttgtagatcgta

SEQ ID NO: 9088206 - DNA, 22 bp, Homo sapiens
taggctgagctaagagagctta

SEQ ID NO: 9088207 - DNA, 22 bp, Homo sapiens
taggctgacttgtttcataaag

SEQ ID NO: 9088208 - DNA, 22 bp, Homo sapiens
tagatgttttaactcttggtta

SEQ ID NO: 9088209 - DNA, 22 bp, Homo sapiens
tagatgttttaactcttggtta

SEQ ID NO: 9088210 - DNA, 22 bp, Homo sapiens
tagatgttaagcttctagaagg

SEQ ID NO: 9088211 - DNA, 22 bp, Homo sapiens
tagattttaggagattttactg

SEQ ID NO: 9088212 - DNA, 22 bp, Homo sapiens
tagatttgtttccttctctcca

SEQ ID NO: 9088213 - DNA, 22 bp, Homo sapiens
tagatttgtttccttctctcca

SEQ ID NO: 9088214 - DNA, 22 bp, Homo sapiens
tagattaagatgccagttttga

SEQ ID NO: 9088215 - DNA, 22 bp, Homo sapiens
tagattaacagttttgttgaag

SEQ ID NO: 9088216 - DNA, 18 bp, Homo sapiens
tagattaaaattgaattc

SEQ ID NO: 9088217 - DNA, 22 bp, Homo sapiens
tagatgttttgatatttgctga

SEQ ID NO: 9088218 - DNA, 22 bp, Homo sapiens
tagcacaagaagtacacataga

SEQ ID NO: 9088219 - DNA, 22 bp, Homo sapiens
tagcacaagcaactactgaagt

SEQ ID NO: 9088220 - DNA, 22 bp, Homo sapiens
tagcacaagtatctgcttttcc

SEQ ID NO: 9088221 - DNA, 22 bp, Homo sapiens
tagcacacactgcatctacaaa

SEQ ID NO: 9088222 - DNA, 22 bp, Homo sapiens
tagcacacactgcatctacaaa

SEQ ID NO: 9088223 - DNA, 22 bp, Homo sapiens
tagcactgagtctagctttgga

SEQ ID NO: 9088224 - DNA, 21 bp, Homo sapiens
tagcagaaacagttcaggcca

SEQ ID NO: 9088225 - DNA, 22 bp, Homo sapiens
tagcagaaactgttacagaagg

SEQ ID NO: 9088226 - DNA, 22 bp, Homo sapiens
tagcacttgtgttatgccttgt

SEQ ID NO: 9088227 - DNA, 21 bp, Homo sapiens
tagcagaaacagttcaggcca

SEQ ID NO: 9088228 - DNA, 22 bp, Homo sapiens
tagcagaaccagcagtcaattt

SEQ ID NO: 9088229 - DNA, 22 bp, Homo sapiens
tagcagaacaatagtcaatgat

SEQ ID NO: 9088230 - DNA, 22 bp, Homo sapiens
tagcagaaccagcagtcaattt

SEQ ID NO: 9088231 - DNA, 22 bp, Homo sapiens
tagcagtgccctgtggaataag

SEQ ID NO: 9088232 - DNA, 22 bp, Homo sapiens
tagcagtgccaggattttgctg

SEQ ID NO: 9088233 - DNA, 22 bp, Homo sapiens
tagcaccacaatcaagatacag

SEQ ID NO: 9088234 - DNA, 22 bp, Homo sapiens
tagccaaagaaggtatatttgt

SEQ ID NO: 9088235 - DNA, 22 bp, Homo sapiens
tagcattttagctgttttctct

SEQ ID NO: 9088236 - DNA, 22 bp, Homo sapiens
tagcatttcccaaatgcatttg

SEQ ID NO: 9088237 - DNA, 22 bp, Homo sapiens
tagcatttcactgatcttcact

SEQ ID NO: 9088238 - DNA, 22 bp, Homo sapiens
tagcattccttgtggcttctga

SEQ ID NO: 9088239 - DNA, 22 bp, Homo sapiens
tagcagtgccctgtggaataag

SEQ ID NO: 9088240 - DNA, 22 bp, Homo sapiens
tagcagtggaatcttttgtcca

SEQ ID NO: 9088241 - DNA, 22 bp, Homo sapiens
tagccaggcgaggtcagtgtcg

SEQ ID NO: 9088242 - DNA, 22 bp, Homo sapiens
tagaggcacagtctatgtagag

SEQ ID NO: 9088243 - DNA, 22 bp, Homo sapiens
tagagctgctggactgtaacag

SEQ ID NO: 9088244 - DNA, 22 bp, Homo sapiens
tagatggaggctagatgcaggg

SEQ ID NO: 9088245 - DNA, 22 bp, Homo sapiens
tagatgattttcagtcaaagca

SEQ ID NO: 9088246 - DNA, 22 bp, Homo sapiens
tagatgatggaaaaaagcaata

SEQ ID NO: 9088247 - DNA, 22 bp, Homo sapiens
tagatgaccttgtgttaggcaa

SEQ ID NO: 9088248 - DNA, 22 bp, Homo sapiens
tagagctgataatgaggccaag

SEQ ID NO: 9088249 - DNA, 22 bp, Homo sapiens
tagagcagttggcagctgtatt

SEQ ID NO: 9088250 - DNA, 23 bp, Homo sapiens
tagagcagtagatcaccatggga

SEQ ID NO: 9088251 - DNA, 22 bp, Homo sapiens
tagagcagtgggtaccatggca

SEQ ID NO: 9088252 - DNA, 22 bp, Homo sapiens
tagagcagtgttgtccatcaga

SEQ ID NO: 9088253 - DNA, 21 bp, Homo sapiens
tagagatgacgagctctagca

SEQ ID NO: 9088254 - DNA, 22 bp, Homo sapiens
tagagatagcagtattgattcg

SEQ ID NO: 9088255 - DNA, 23 bp, Homo sapiens
tagaatctgtatttctgcagttc

SEQ ID NO: 9088256 - DNA, 22 bp, Homo sapiens
tagaatctggaaggggctattc

SEQ ID NO: 9088257 - DNA, 22 bp, Homo sapiens
tagagcagatagtgaaacagaa

SEQ ID NO: 9088258 - DNA, 22 bp, Homo sapiens
tagagcagaacttgttaacacc

SEQ ID NO: 9088259 - DNA, 23 bp, Homo sapiens
tagagcagggaaatctgtcagag

SEQ ID NO: 9088260 - DNA, 22 bp, Homo sapiens
tagagcagccttcagagcagtt

SEQ ID NO: 9088261 - DNA, 23 bp, Homo sapiens
tagagcagggaaatctgtcagag

SEQ ID NO: 9088262 - DNA, 22 bp, Homo sapiens
tactttctagctctccccagtt

SEQ ID NO: 9088263 - DNA, 22 bp, Homo sapiens
tactttctaagacatacaactt

SEQ ID NO: 9088264 - DNA, 22 bp, Homo sapiens
tactttctttctgatccttatg

SEQ ID NO: 9088265 - DNA, 22 bp, Homo sapiens
tagaagcaccactcatcacgtg

SEQ ID NO: 9088266 - DNA, 19 bp, Homo sapiens
tagaagcactaggcaaact

SEQ ID NO: 9088267 - DNA, 19 bp, Homo sapiens
tagaagcactaggcaaact

SEQ ID NO: 9088268 - DNA, 22 bp, Homo sapiens
tagaagcagcaggagtaaaggc

SEQ ID NO: 9088269 - DNA, 19 bp, Homo sapiens
tagaagcagggaagctgag

SEQ ID NO: 9088270 - DNA, 19 bp, Homo sapiens
tagaagcagggaagctgag

SEQ ID NO: 9088271 - DNA, 22 bp, Homo sapiens
tagaatcagaagatttgactgt

SEQ ID NO: 9088272 - DNA, 22 bp, Homo sapiens
tagaatcattgagaataacagg

SEQ ID NO: 9088273 - DNA, 23 bp, Homo sapiens
tagaatcctctgagatggaatag

SEQ ID NO: 9088274 - DNA, 21 bp, Homo sapiens
tagaatcactaataagatgta

SEQ ID NO: 9088275 - DNA, 22 bp, Homo sapiens
tagaagttgctcaataaatgtt

SEQ ID NO: 9088276 - DNA, 22 bp, Homo sapiens
tagaagtttcaaaagacttcat

SEQ ID NO: 9088277 - DNA, 18 bp, Homo sapiens
tagaagtgtgctatacaa

SEQ ID NO: 9088278 - DNA, 22 bp, Homo sapiens
tagaagtgggaatataaaatat

SEQ ID NO: 9088279 - DNA, 22 bp, Homo sapiens
tagaagttaggaaataggaata

SEQ ID NO: 9088280 - DNA, 22 bp, Homo sapiens
tagaagttcatgcgaattattt

SEQ ID NO: 9088281 - DNA, 22 bp, Homo sapiens
tagaagtggcaacactcagaaa

SEQ ID NO: 9088282 - DNA, 22 bp, Homo sapiens
tagaaggcatttcctttatttt

SEQ ID NO: 9088283 - DNA, 22 bp, Homo sapiens
tagaaggctttgagagatactt

SEQ ID NO: 9088284 - DNA, 22 bp, Homo sapiens
tagaaggcccattcatttgttc

SEQ ID NO: 9088285 - DNA, 22 bp, Homo sapiens
tagaaggcaggtggttggagtt

SEQ ID NO: 9088286 - DNA, 22 bp, Homo sapiens
tagaaggctttgagagatactt

SEQ ID NO: 9088287 - DNA, 22 bp, Homo sapiens
tagaaggcggactctccctctg

SEQ ID NO: 9088288 - DNA, 22 bp, Homo sapiens
tagaaggcaagcttggtacagg

SEQ ID NO: 9088289 - DNA, 22 bp, Homo sapiens
tagaaggaggactggcagtgtt

SEQ ID NO: 9088290 - DNA, 22 bp, Homo sapiens
gttacaaaggtcataaaagtgt

SEQ ID NO: 9088291 - DNA, 22 bp, Homo sapiens
gttacaaatgccaaagctgaga

SEQ ID NO: 9088292 - DNA, 22 bp, Homo sapiens
gttagacatgagtgtgcttaca

SEQ ID NO: 9088293 - DNA, 22 bp, Homo sapiens
gttagacatgcagaatctcagg

SEQ ID NO: 9088294 - DNA, 22 bp, Homo sapiens
gttaggaatttgttactgtgta

SEQ ID NO: 9088295 - DNA, 22 bp, Homo sapiens
gttagagacatctctggtttct

SEQ ID NO: 9088296 - DNA, 22 bp, Homo sapiens
gttaggaacattaatgtgattt

SEQ ID NO: 9088297 - DNA, 22 bp, Homo sapiens
gttataaatacctaataggatt

SEQ ID NO: 9088298 - DNA, 22 bp, Homo sapiens
gttccaaagttagagtgtattg

SEQ ID NO: 9088299 - DNA, 22 bp, Homo sapiens
gttccaattccaaattccaagg

SEQ ID NO: 9088300 - DNA, 22 bp, Homo sapiens
gttccaaatttggatctttagg

SEQ ID NO: 9088301 - DNA, 22 bp, Homo sapiens
gttccaaacaagtcataaagta

SEQ ID NO: 9088302 - DNA, 22 bp, Homo sapiens
gttccaaagcaaaggaggtgag

SEQ ID NO: 9088303 - DNA, 22 bp, Homo sapiens
gttccaaagtctctgagctgag

SEQ ID NO: 9088304 - DNA, 19 bp, Homo sapiens
gttccaaaggccagacctt

SEQ ID NO: 9088305 - DNA, 22 bp, Homo sapiens
gttcatttttccctaatgagta

SEQ ID NO: 9088306 - DNA, 22 bp, Homo sapiens
gttcatttttccctaatgagta

SEQ ID NO: 9088307 - DNA, 22 bp, Homo sapiens
gttcatttttactttgatctac

SEQ ID NO: 9088308 - DNA, 22 bp, Homo sapiens
gttcattttactgtaaatagca

SEQ ID NO: 9088309 - DNA, 22 bp, Homo sapiens
gtgttaaatttctaatttgtga

SEQ ID NO: 9088310 - DNA, 22 bp, Homo sapiens
gtgttaaatgcaatcacatgca

SEQ ID NO: 9088311 - DNA, 22 bp, Homo sapiens
gtgttaaaatgctttatagtag

SEQ ID NO: 9088312 - DNA, 22 bp, Homo sapiens
gtgttaaacatgttcacagcat

SEQ ID NO: 9088313 - DNA, 22 bp, Homo sapiens
gtgttaaaaatcccatgatatg

SEQ ID NO: 9088314 - DNA, 22 bp, Homo sapiens
gtgtgttcagcaagaggtaagg

SEQ ID NO: 9088315 - DNA, 22 bp, Homo sapiens
gtgtgtgttcaataaatttaag

SEQ ID NO: 9088316 - DNA, 22 bp, Homo sapiens
gtgtgtgttcaataaatttaag

SEQ ID NO: 9088317 - DNA, 22 bp, Homo sapiens
gtgtgtgtgcatctcttttatt

SEQ ID NO: 9088318 - DNA, 22 bp, Homo sapiens
gtgtgtgtgcctgcacacacac

SEQ ID NO: 9088319 - DNA, 22 bp, Homo sapiens
gtgtgtgtgcctgcacacacac

SEQ ID NO: 9088320 - DNA, 22 bp, Homo sapiens
gtgtgtgtgtaaaaatccagag

SEQ ID NO: 9088321 - DNA, 22 bp, Homo sapiens
gtgtgtgtgtaaaaatccagag

SEQ ID NO: 9088322 - DNA, 22 bp, Homo sapiens
gtgtgtgtatctgcctatcaca

SEQ ID NO: 9088323 - DNA, 22 bp, Homo sapiens
gtgtgtgtatctgcctatcaca

SEQ ID NO: 9088324 - DNA, 22 bp, Homo sapiens
gtgtgtgtctccgcggccgtag

SEQ ID NO: 9088325 - DNA, 22 bp, Homo sapiens
gtgtgtgtctccgcggccgtag

SEQ ID NO: 9088326 - DNA, 22 bp, Homo sapiens
gtgtgtgtgcatctcttttatt

SEQ ID NO: 9088327 - DNA, 22 bp, Homo sapiens
gtgtgtgtgcatataacatata

SEQ ID NO: 9088328 - DNA, 22 bp, Homo sapiens
gtgtgtgtgcatataacatata

SEQ ID NO: 9088329 - DNA, 22 bp, Homo sapiens
gtgctttccatcctccctgctg

SEQ ID NO: 9088330 - DNA, 22 bp, Homo sapiens
gtgctttccatcctccctgctg

SEQ ID NO: 9088331 - DNA, 22 bp, Homo sapiens
gtgcttttaaaggcaattagta

SEQ ID NO: 9088332 - DNA, 22 bp, Homo sapiens
gtgcttttaattctggtgagta

SEQ ID NO: 9088333 - DNA, 22 bp, Homo sapiens
gtgcttttaacttttgaaagga

SEQ ID NO: 9088334 - DNA, 22 bp, Homo sapiens
gtgcttgggggaagtaacagac

SEQ ID NO: 9088335 - DNA, 22 bp, Homo sapiens
gttccttgtaatttgttaagga

SEQ ID NO: 9088336 - DNA, 22 bp, Homo sapiens
gttcctttcctatttggataag

SEQ ID NO: 9088337 - DNA, 22 bp, Homo sapiens
gttccttgtatttcagacatga

SEQ ID NO: 9088338 - DNA, 22 bp, Homo sapiens
gtttacaaatattttaaatggt

SEQ ID NO: 9088339 - DNA, 22 bp, Homo sapiens
gttcctttgtttagcagagaca

SEQ ID NO: 9088340 - DNA, 22 bp, Homo sapiens
gttccttggaagaacttgaggt

SEQ ID NO: 9088341 - DNA, 22 bp, Homo sapiens
gttccttgggaacaacgctgaa

SEQ ID NO: 9088342 - DNA, 22 bp, Homo sapiens
gttcctggtggtcatggcagct

SEQ ID NO: 9088343 - DNA, 22 bp, Homo sapiens
gttccttagagttgatatggta

SEQ ID NO: 9088344 - DNA, 22 bp, Homo sapiens
gttccacaaaatgtacccagtt

SEQ ID NO: 9088345 - DNA, 22 bp, Homo sapiens
gttccacaaaaggtctagttta

SEQ ID NO: 9088346 - DNA, 22 bp, Homo sapiens
gttccacagagtctcactatga

SEQ ID NO: 9088347 - DNA, 22 bp, Homo sapiens
gtttagactccttggtcttctg

SEQ ID NO: 9088348 - DNA, 22 bp, Homo sapiens
gtttagaccaatcataatttat

SEQ ID NO: 9088349 - DNA, 22 bp, Homo sapiens
gtttagaattctaactttaagg

SEQ ID NO: 9088350 - DNA, 22 bp, Homo sapiens
gtttacaaatattttaaatggt

SEQ ID NO: 9088351 - DNA, 22 bp, Homo sapiens
gtttacaaatattttaaatggt

SEQ ID NO: 9088352 - DNA, 22 bp, Homo sapiens
gtttacaaatattttaaatggt

SEQ ID NO: 9088353 - DNA, 22 bp, Homo sapiens
gtttacattgctgtttgtgtct

SEQ ID NO: 9088354 - DNA, 22 bp, Homo sapiens
gtttagaagccaagatttgggt

SEQ ID NO: 9088355 - DNA, 20 bp, Homo sapiens
gtttatacagaagaccccaa

SEQ ID NO: 9088356 - DNA, 22 bp, Homo sapiens
gtttatatgaacttcataccca

SEQ ID NO: 9088357 - DNA, 22 bp, Homo sapiens
gtttatacagtgcatggtgtta

SEQ ID NO: 9088358 - DNA, 22 bp, Homo sapiens
gtttataaggcccaatatttct

SEQ ID NO: 9088359 - DNA, 22 bp, Homo sapiens
gtttatatgtgtgccactctta

SEQ ID NO: 9088360 - DNA, 22 bp, Homo sapiens
gtttccttttggaattagagct

SEQ ID NO: 9088361 - DNA, 22 bp, Homo sapiens
gtttccttttggaattagagct

SEQ ID NO: 9088362 - DNA, 22 bp, Homo sapiens
gtttcctttgccagtaaatggg

SEQ ID NO: 9088363 - DNA, 22 bp, Homo sapiens
gtttctaagggagagctgccag

SEQ ID NO: 9088364 - DNA, 22 bp, Homo sapiens
gtttctaagcacatgtgagtgt

SEQ ID NO: 9088365 - DNA, 22 bp, Homo sapiens
gtttctaattggaactttgagg

SEQ ID NO: 9088366 - DNA, 22 bp, Homo sapiens
gtttctaagcacatgtgagtgt

SEQ ID NO: 9088367 - DNA, 22 bp, Homo sapiens
gtttctaaatgttctgagtttt

SEQ ID NO: 9088368 - DNA, 22 bp, Homo sapiens
gtttcctttttctgccctcaat

SEQ ID NO: 9088369 - DNA, 22 bp, Homo sapiens
gtttctatggtttatattactg

SEQ ID NO: 9088370 - DNA, 22 bp, Homo sapiens
gtttctatggtttatattactg

SEQ ID NO: 9088371 - DNA, 22 bp, Homo sapiens
gtttctcacttaccaacacatg

SEQ ID NO: 9088372 - DNA, 22 bp, Homo sapiens
gtttctcaagcttgaatgcaca

SEQ ID NO: 9088373 - DNA, 23 bp, Homo sapiens
gttttacaggtgagaaaatggag

SEQ ID NO: 9088374 - DNA, 23 bp, Homo sapiens
gttttacaggtgagaaaatggag

SEQ ID NO: 9088375 - DNA, 22 bp, Homo sapiens
gttttagtgggtggccactgat

SEQ ID NO: 9088376 - DNA, 22 bp, Homo sapiens
gttttacaaggttaatcagcag

SEQ ID NO: 9088377 - DNA, 22 bp, Homo sapiens
gttttacacacctatgaaagac

SEQ ID NO: 9088378 - DNA, 22 bp, Homo sapiens
gtttcttaaatgtagcaggacc

SEQ ID NO: 9088379 - DNA, 22 bp, Homo sapiens
gtttcttaaaagaggagttaga

SEQ ID NO: 9088380 - DNA, 22 bp, Homo sapiens
gtttcttaagttacaaaatctt

SEQ ID NO: 9088381 - DNA, 22 bp, Homo sapiens
gtttcttaccacttggacctct

SEQ ID NO: 9088382 - DNA, 22 bp, Homo sapiens
gtttcttaatagcaggggccaa

SEQ ID NO: 9088383 - DNA, 22 bp, Homo sapiens
gtttctcagtttggtctgcaga

SEQ ID NO: 9088384 - DNA, 22 bp, Homo sapiens
gtttctcagtttggtctgcaga

SEQ ID NO: 9088385 - DNA, 18 bp, Homo sapiens
gtttctcccaggcggggc

SEQ ID NO: 9088386 - DNA, 22 bp, Homo sapiens
gtttctcctctgtgtcttgttt

SEQ ID NO: 9088387 - DNA, 22 bp, Homo sapiens
gtttctgtaagactgaattgac

SEQ ID NO: 9088388 - DNA, 19 bp, Homo sapiens
taactggtgccttcagtca

SEQ ID NO: 9088389 - DNA, 19 bp, Homo sapiens
taactggttaaaaagcttg

SEQ ID NO: 9088390 - DNA, 18 bp, Homo sapiens
taactggtttcttcccat

SEQ ID NO: 9088391 - DNA, 22 bp, Homo sapiens
taacacatggttagtacacaat

SEQ ID NO: 9088392 - DNA, 22 bp, Homo sapiens
taacacatatctacaacatgtg

SEQ ID NO: 9088393 - DNA, 22 bp, Homo sapiens
taacaaactggaaattgacatt

SEQ ID NO: 9088394 - DNA, 22 bp, Homo sapiens
taacaaactggaaattgacatt

SEQ ID NO: 9088395 - DNA, 22 bp, Homo sapiens
taacaatacccattctaattac

SEQ ID NO: 9088396 - DNA, 22 bp, Homo sapiens
taacaatggttttgctgataat

SEQ ID NO: 9088397 - DNA, 22 bp, Homo sapiens
taacaatgggaaggactgatga

SEQ ID NO: 9088398 - DNA, 23 bp, Homo sapiens
taacaatggactcctcttagcta

SEQ ID NO: 9088399 - DNA, 23 bp, Homo sapiens
taacaatggactcctcttagcta

SEQ ID NO: 9088400 - DNA, 22 bp, Homo sapiens
taacaatggagttttgagaaag

SEQ ID NO: 9088401 - DNA, 22 bp, Homo sapiens
taacaatgattagtgactacag

SEQ ID NO: 9088402 - DNA, 22 bp, Homo sapiens
taacaatgcaaaatgaatttag

SEQ ID NO: 9088403 - DNA, 22 bp, Homo sapiens
taacaatgcaaaatgaatttag

SEQ ID NO: 9088404 - DNA, 22 bp, Homo sapiens
taacaatttgcttcatttgttt

SEQ ID NO: 9088405 - DNA, 22 bp, Homo sapiens
taacacagacagccactagtaa

SEQ ID NO: 9088406 - DNA, 22 bp, Homo sapiens
taagatgggggaaagaaatagt

SEQ ID NO: 9088407 - DNA, 22 bp, Homo sapiens
taagatggttgtagatggactg

SEQ ID NO: 9088408 - DNA, 22 bp, Homo sapiens
taagatcagttcaaacatgtgt

SEQ ID NO: 9088409 - DNA, 22 bp, Homo sapiens
taagatgactacttaccactga

SEQ ID NO: 9088410 - DNA, 22 bp, Homo sapiens
taagatagaactctgaggctac

SEQ ID NO: 9088411 - DNA, 22 bp, Homo sapiens
taagataataagtatgtctatg

SEQ ID NO: 9088412 - DNA, 22 bp, Homo sapiens
taagataaggaacattctgtga

SEQ ID NO: 9088413 - DNA, 22 bp, Homo sapiens
taagataaggaacattctgtga

SEQ ID NO: 9088414 - DNA, 22 bp, Homo sapiens
taagagttactggtttagaacc

SEQ ID NO: 9088415 - DNA, 22 bp, Homo sapiens
taagagttagggctagcaatat

SEQ ID NO: 9088416 - DNA, 22 bp, Homo sapiens
taagagttagggctagcaatat

SEQ ID NO: 9088417 - DNA, 22 bp, Homo sapiens
taagagttactggtttagaacc

SEQ ID NO: 9088418 - DNA, 22 bp, Homo sapiens
taagagttgaaggagattttca

SEQ ID NO: 9088419 - DNA, 22 bp, Homo sapiens
taagaggcaaaagatactcaga

SEQ ID NO: 9088420 - DNA, 22 bp, Homo sapiens
taagaggcattagagacatagc

SEQ ID NO: 9088421 - DNA, 22 bp, Homo sapiens
taagaggcaaaagatactcaga

SEQ ID NO: 9088422 - DNA, 22 bp, Homo sapiens
taagaaatttagttatagaatg

SEQ ID NO: 9088423 - DNA, 22 bp, Homo sapiens
taacttctgcacagaaaatttg

SEQ ID NO: 9088424 - DNA, 22 bp, Homo sapiens
taactgttgtgcgggtctctgg

SEQ ID NO: 9088425 - DNA, 22 bp, Homo sapiens
taacttctctgagcctcattcc

SEQ ID NO: 9088426 - DNA, 22 bp, Homo sapiens
taacttcaagtctgtggatcag

SEQ ID NO: 9088427 - DNA, 22 bp, Homo sapiens
taaatacagtcatttgagccat

SEQ ID NO: 9088428 - DNA, 22 bp, Homo sapiens
taaatacagtcatttgagccat

SEQ ID NO: 9088429 - DNA, 17 bp, Homo sapiens
taaatacacaagggtat

SEQ ID NO: 9088430 - DNA, 21 bp, Homo sapiens
taaataataagttgctgagat

SEQ ID NO: 9088431 - DNA, 17 bp, Homo sapiens
taaatacacaagggtat

SEQ ID NO: 9088432 - DNA, 17 bp, Homo sapiens
taaatacacaagggtat

SEQ ID NO: 9088433 - DNA, 21 bp, Homo sapiens
taaataataagttgctgagat

SEQ ID NO: 9088434 - DNA, 22 bp, Homo sapiens
taaagtttggcagacaataaca

SEQ ID NO: 9088435 - DNA, 22 bp, Homo sapiens
taaagttcttagaacaaggcct

SEQ ID NO: 9088436 - DNA, 22 bp, Homo sapiens
taaagttggacctgattttatt

SEQ ID NO: 9088437 - DNA, 19 bp, Homo sapiens
taaagttgaaatcaagtcc

SEQ ID NO: 9088438 - DNA, 22 bp, Homo sapiens
taaagtttggcagacaataaca

SEQ ID NO: 9088439 - DNA, 22 bp, Homo sapiens
taaagacaataggaaagttgtt

SEQ ID NO: 9088440 - DNA, 22 bp, Homo sapiens
taaagacaataggaaagttgtt

SEQ ID NO: 9088441 - DNA, 22 bp, Homo sapiens
taaagacaatttcgagctgtag

SEQ ID NO: 9088442 - DNA, 22 bp, Homo sapiens
taaagacaatttcgagctgtag

SEQ ID NO: 9088443 - DNA, 22 bp, Homo sapiens
taaagacacccagggagggact

SEQ ID NO: 9088444 - DNA, 22 bp, Homo sapiens
taaagtgtggacagtatctata

SEQ ID NO: 9088445 - DNA, 22 bp, Homo sapiens
taaagtgtggatatgattagta

SEQ ID NO: 9088446 - DNA, 22 bp, Homo sapiens
taaagtgtgtatatacatatgg

SEQ ID NO: 9088447 - DNA, 22 bp, Homo sapiens
taaagttataaattacctgtca

SEQ ID NO: 9088448 - DNA, 22 bp, Homo sapiens
taaagtgttgtacaaatgtatg

SEQ ID NO: 9088449 - DNA, 22 bp, Homo sapiens
taaagtgtgtgggttctaaatt

SEQ ID NO: 9088450 - DNA, 22 bp, Homo sapiens
taaagtgtgttttgattacgtc

SEQ ID NO: 9088451 - DNA, 22 bp, Homo sapiens
taaagacaaacccactagggtt

SEQ ID NO: 9088452 - DNA, 22 bp, Homo sapiens
taaagaataatacccatggagc

SEQ ID NO: 9088453 - DNA, 22 bp, Homo sapiens
taaagacaaacccactagggtt

SEQ ID NO: 9088454 - DNA, 22 bp, Homo sapiens
taaagacaaatgacattacggc

SEQ ID NO: 9088455 - DNA, 22 bp, Homo sapiens
taaactgcttctctcagtctgt

SEQ ID NO: 9088456 - DNA, 22 bp, Homo sapiens
taaacatgttgacatcttacct

SEQ ID NO: 9088457 - DNA, 22 bp, Homo sapiens
taaacatctgaatcctgcttcc

SEQ ID NO: 9088458 - DNA, 22 bp, Homo sapiens
taaacatctgtcatgtgtttat

SEQ ID NO: 9088459 - DNA, 22 bp, Homo sapiens
taaacatggctgtttcagttat

SEQ ID NO: 9088460 - DNA, 22 bp, Homo sapiens
taaacaggagttgaagcagtaa

SEQ ID NO: 9088461 - DNA, 22 bp, Homo sapiens
taaacaggccccagggaggttg

SEQ ID NO: 9088462 - DNA, 22 bp, Homo sapiens
taaacagctactgtgtcaaagg

SEQ ID NO: 9088463 - DNA, 22 bp, Homo sapiens
taaacagcctaaaactttcttt

SEQ ID NO: 9088464 - DNA, 22 bp, Homo sapiens
taaacagcctcccctttcactc

SEQ ID NO: 9088465 - DNA, 16 bp, Homo sapiens
taaacagcagacagtt

SEQ ID NO: 9088466 - DNA, 22 bp, Homo sapiens
taaacagagagtgcagttatag

SEQ ID NO: 9088467 - DNA, 22 bp, Homo sapiens
taaacagagtgctagttcacgg

SEQ ID NO: 9088468 - DNA, 22 bp, Homo sapiens
gttttcagccaggagcacattt

SEQ ID NO: 9088469 - DNA, 22 bp, Homo sapiens
gttttattggaacacagccatg

SEQ ID NO: 9088470 - DNA, 22 bp, Homo sapiens
gttttattggaacacagccatg

SEQ ID NO: 9088471 - DNA, 22 bp, Homo sapiens
gttttattggaacacagccatg

SEQ ID NO: 9088472 - DNA, 22 bp, Homo sapiens
gttttatttccatgagagaccg

SEQ ID NO: 9088473 - DNA, 22 bp, Homo sapiens
gttttatttccatgagagaccg

SEQ ID NO: 9088474 - DNA, 22 bp, Homo sapiens
gttttatttccatgagagaccg

SEQ ID NO: 9088475 - DNA, 22 bp, Homo sapiens
gttttataattgcttcataaga

SEQ ID NO: 9088476 - DNA, 22 bp, Homo sapiens
gttttataattgcttcataaga

SEQ ID NO: 9088477 - DNA, 22 bp, Homo sapiens
gttttataggctgttgctatat

SEQ ID NO: 9088478 - DNA, 22 bp, Homo sapiens
gttttataggctgttgctatat

SEQ ID NO: 9088479 - DNA, 22 bp, Homo sapiens
gttttatagttcgggacctgtt

SEQ ID NO: 9088480 - DNA, 22 bp, Homo sapiens
gttttatatgtctctgctgaca

SEQ ID NO: 9088481 - DNA, 22 bp, Homo sapiens
gttttataggtgaaatattact

SEQ ID NO: 9088482 - DNA, 22 bp, Homo sapiens
gttttataggtgaaatattact

SEQ ID NO: 9088483 - DNA, 22 bp, Homo sapiens
gttttataggtgaaatattact

SEQ ID NO: 9088484 - DNA, 22 bp, Homo sapiens
gttttataggtgaaatattact

SEQ ID NO: 9088485 - DNA, 22 bp, Homo sapiens
taatgcaatttagcaaagtttt

SEQ ID NO: 9088486 - DNA, 22 bp, Homo sapiens
taatgcagtaagcaatggtgaa

SEQ ID NO: 9088487 - DNA, 19 bp, Homo sapiens
taatgcacttaacacatgg

SEQ ID NO: 9088488 - DNA, 22 bp, Homo sapiens
taatgcaacgtgagataattaa

SEQ ID NO: 9088489 - DNA, 23 bp, Homo sapiens
taatgagaagctttgtttcctga

SEQ ID NO: 9088490 - DNA, 22 bp, Homo sapiens
taatgagaattctttttgggta

SEQ ID NO: 9088491 - DNA, 22 bp, Homo sapiens
taatgagactcaattgtgtgtg

SEQ ID NO: 9088492 - DNA, 22 bp, Homo sapiens
taatgagatacctcttgctgtc

SEQ ID NO: 9088493 - DNA, 22 bp, Homo sapiens
taatgagaattctttttgggta

SEQ ID NO: 9088494 - DNA, 22 bp, Homo sapiens
taatgagactcaattgtgtgtg

SEQ ID NO: 9088495 - DNA, 22 bp, Homo sapiens
taatgagaagactttgaggctc

SEQ ID NO: 9088496 - DNA, 22 bp, Homo sapiens
taatgagatcatatcttctgag

SEQ ID NO: 9088497 - DNA, 22 bp, Homo sapiens
taatgaggcaagagtcatggct

SEQ ID NO: 9088498 - DNA, 22 bp, Homo sapiens
taatgagatcatatcttctgag

SEQ ID NO: 9088499 - DNA, 22 bp, Homo sapiens
taatgaggaaatagagggaatg

SEQ ID NO: 9088500 - DNA, 22 bp, Homo sapiens
taatgacattgtatccacagag

SEQ ID NO: 9088501 - DNA, 22 bp, Homo sapiens
taatgcttttccttcaaataag

SEQ ID NO: 9088502 - DNA, 22 bp, Homo sapiens
taatgctaacatcatatcactg

SEQ ID NO: 9088503 - DNA, 22 bp, Homo sapiens
taatggaagttaaatatggtat

SEQ ID NO: 9088504 - DNA, 22 bp, Homo sapiens
taatggagcctgccttccaggg

SEQ ID NO: 9088505 - DNA, 22 bp, Homo sapiens
taatttcaccgttgctagaaat

SEQ ID NO: 9088506 - DNA, 22 bp, Homo sapiens
taagttctcaatacattgtagc

SEQ ID NO: 9088507 - DNA, 22 bp, Homo sapiens
taagtttggggaaaatgttaag

SEQ ID NO: 9088508 - DNA, 22 bp, Homo sapiens
taagtttgtgtctctgttactt

SEQ ID NO: 9088509 - DNA, 22 bp, Homo sapiens
taagtttctccaaagcacagaa

SEQ ID NO: 9088510 - DNA, 22 bp, Homo sapiens
taataaatgaaagtgctggcat

SEQ ID NO: 9088511 - DNA, 22 bp, Homo sapiens
taagttttaagcaatctgataa

SEQ ID NO: 9088512 - DNA, 22 bp, Homo sapiens
taataacaattgtaggacatga

SEQ ID NO: 9088513 - DNA, 22 bp, Homo sapiens
taataacaattgtaggacatga

SEQ ID NO: 9088514 - DNA, 22 bp, Homo sapiens
taataaatgaaagtgctggcat

SEQ ID NO: 9088515 - DNA, 22 bp, Homo sapiens
taagcaatgagataatcatggg

SEQ ID NO: 9088516 - DNA, 22 bp, Homo sapiens
taagcactttatatgctttatc

SEQ ID NO: 9088517 - DNA, 22 bp, Homo sapiens
taagttacacttaacttactag

SEQ ID NO: 9088518 - DNA, 22 bp, Homo sapiens
taagttcaagtcttggatataa

SEQ ID NO: 9088519 - DNA, 22 bp, Homo sapiens
taagttcaatgaactcagttct

SEQ ID NO: 9088520 - DNA, 22 bp, Homo sapiens
taagttcagagttctcatttgt

SEQ ID NO: 9088521 - DNA, 22 bp, Homo sapiens
taagttcataagcttattctta

SEQ ID NO: 9088522 - DNA, 21 bp, Homo sapiens
tacacaaagcgtggtccagag

SEQ ID NO: 9088523 - DNA, 22 bp, Homo sapiens
tacacaaaggcactctgttgtt

SEQ ID NO: 9088524 - DNA, 22 bp, Homo sapiens
tacacaaaggcactctgttgtt

SEQ ID NO: 9088525 - DNA, 21 bp, Homo sapiens
tacacaaagcgtggtccagag

SEQ ID NO: 9088526 - DNA, 22 bp, Homo sapiens
tacaatttagtggtgtgtggtt

SEQ ID NO: 9088527 - DNA, 22 bp, Homo sapiens
tacaattctttgtaaggtggtc

SEQ ID NO: 9088528 - DNA, 22 bp, Homo sapiens
tacaatgttcgcattctctctg

SEQ ID NO: 9088529 - DNA, 22 bp, Homo sapiens
tacaatgttggtaaagtatcat

SEQ ID NO: 9088530 - DNA, 22 bp, Homo sapiens
tacaatgttaaggaaagagaga

SEQ ID NO: 9088531 - DNA, 22 bp, Homo sapiens
tacaatgttcctagcaggaaag

SEQ ID NO: 9088532 - DNA, 22 bp, Homo sapiens
tacaatgttcatagctttggca

SEQ ID NO: 9088533 - DNA, 22 bp, Homo sapiens
tacaatgtgtgcttcttgtcac

SEQ ID NO: 9088534 - DNA, 17 bp, Homo sapiens
tacaatgtgattcaatc

SEQ ID NO: 9088535 - DNA, 22 bp, Homo sapiens
tacacatccatgttttgacttt

SEQ ID NO: 9088536 - DNA, 22 bp, Homo sapiens
tacacatatgtgtgtatatgtg

SEQ ID NO: 9088537 - DNA, 22 bp, Homo sapiens
tacacatatgtccattaatcag

SEQ ID NO: 9088538 - DNA, 22 bp, Homo sapiens
tacacccacattgagcatggga

SEQ ID NO: 9088539 - DNA, 22 bp, Homo sapiens
tacacccaggtaccgtgatttc

SEQ ID NO: 9088540 - DNA, 22 bp, Homo sapiens
tacaccattcccaggtggattt

SEQ ID NO: 9088541 - DNA, 22 bp, Homo sapiens
tacacattttgcgggtacatgt

SEQ ID NO: 9088542 - DNA, 22 bp, Homo sapiens
tacacatttctcttagagacac

SEQ ID NO: 9088543 - DNA, 22 bp, Homo sapiens
tacacatgtttggcaagtatgt

SEQ ID NO: 9088544 - DNA, 22 bp, Homo sapiens
taattttatgacagtgtatttt

SEQ ID NO: 9088545 - DNA, 22 bp, Homo sapiens
taattttgctgtgaccattgaa

SEQ ID NO: 9088546 - DNA, 22 bp, Homo sapiens
taattttgtattgccattgtag

SEQ ID NO: 9088547 - DNA, 22 bp, Homo sapiens
taattttgtcacagtgacatgc

SEQ ID NO: 9088548 - DNA, 22 bp, Homo sapiens
taattttgtccccctgcacata

SEQ ID NO: 9088549 - DNA, 22 bp, Homo sapiens
taatttctagggactaaggtgc

SEQ ID NO: 9088550 - DNA, 20 bp, Homo sapiens
taatttgatatctataagtt

SEQ ID NO: 9088551 - DNA, 22 bp, Homo sapiens
taattttaactgtgctgtttgg

SEQ ID NO: 9088552 - DNA, 18 bp, Homo sapiens
taatttgcacagttgcaa

SEQ ID NO: 9088553 - DNA, 22 bp, Homo sapiens
taattttacttcctgagcacct

SEQ ID NO: 9088554 - DNA, 22 bp, Homo sapiens
taattttacttcctgagcacct

SEQ ID NO: 9088555 - DNA, 23 bp, Homo sapiens
taattttagccttacaggaccct

SEQ ID NO: 9088556 - DNA, 22 bp, Homo sapiens
taattttaatagtatgtggcat

SEQ ID NO: 9088557 - DNA, 22 bp, Homo sapiens
taattttaatagtatgtggcat

SEQ ID NO: 9088558 - DNA, 22 bp, Homo sapiens
taattttaactgtgctgtttgg

SEQ ID NO: 9088559 - DNA, 20 bp, Homo sapiens
tacaatattcccactttgct

SEQ ID NO: 9088560 - DNA, 22 bp, Homo sapiens
taatttttccacgtacactggg

SEQ ID NO: 9088561 - DNA, 22 bp, Homo sapiens
taatttttccacgtacactggg

SEQ ID NO: 9088562 - DNA, 22 bp, Homo sapiens
taatttttccacgtacactggg

SEQ ID NO: 9088563 - DNA, 22 bp, Homo sapiens
taatttttccacgtacactggg

SEQ ID NO: 9088564 - DNA, 22 bp, Homo sapiens
taatttttccacgtacactggg

SEQ ID NO: 9088565 - DNA, 22 bp, Homo sapiens
tacaatgagctgagccagaggc

SEQ ID NO: 9088566 - DNA, 22 bp, Homo sapiens
tacaatgactctcagtttggct

SEQ ID NO: 9088567 - DNA, 22 bp, Homo sapiens
tacaatcaggataataatagtg

SEQ ID NO: 9088568 - DNA, 22 bp, Homo sapiens
tacaatcaggataataatagtg

SEQ ID NO: 9088569 - DNA, 22 bp, Homo sapiens
tacaatgctgtgcatgtaatgg

SEQ ID NO: 9088570 - DNA, 22 bp, Homo sapiens
tacaatgctgtgcatgtaatgg

SEQ ID NO: 9088571 - DNA, 22 bp, Homo sapiens
tacaatgtaattctgattatgt

SEQ ID NO: 9088572 - DNA, 22 bp, Homo sapiens
tacaatgtacttccttgcacag

SEQ ID NO: 9088573 - DNA, 16 bp, Homo sapiens
tacaatgtagaaaaca

SEQ ID NO: 9088574 - DNA, 22 bp, Homo sapiens
tacaatgtctctcacctgactt

SEQ ID NO: 9088575 - DNA, 22 bp, Homo sapiens
tacagcacttaattaccttgag

SEQ ID NO: 9088576 - DNA, 22 bp, Homo sapiens
tacagcactgtgcatagtggtt

SEQ ID NO: 9088577 - DNA, 22 bp, Homo sapiens
tacagcttaaaagatgcattta

SEQ ID NO: 9088578 - DNA, 22 bp, Homo sapiens
tacagcttatccagcttgatag

SEQ ID NO: 9088579 - DNA, 22 bp, Homo sapiens
tacagcagagtgggatgcatct

SEQ ID NO: 9088580 - DNA, 18 bp, Homo sapiens
tacagcttgagttgactg

SEQ ID NO: 9088581 - DNA, 22 bp, Homo sapiens
tacagcttgatgagagcgcgag

SEQ ID NO: 9088582 - DNA, 22 bp, Homo sapiens
tacagcttcagtgtgccccagt

SEQ ID NO: 9088583 - DNA, 22 bp, Homo sapiens
tacagcttgacccataatgtct

SEQ ID NO: 9088584 - DNA, 22 bp, Homo sapiens
tacagctttgggaaggccccat

SEQ ID NO: 9088585 - DNA, 22 bp, Homo sapiens
tacagcttttcatatttgtgtt

SEQ ID NO: 9088586 - DNA, 22 bp, Homo sapiens
tacagctttatacccatcaaaa

SEQ ID NO: 9088587 - DNA, 22 bp, Homo sapiens
tacagcttgatgtttgtgtgtt

SEQ ID NO: 9088588 - DNA, 22 bp, Homo sapiens
tacagctttagcaaattaccta

SEQ ID NO: 9088589 - DNA, 22 bp, Homo sapiens
tacagcttttgcagctgttttg

SEQ ID NO: 9088590 - DNA, 22 bp, Homo sapiens
tacaggaaagaaatttgaactc

SEQ ID NO: 9088591 - DNA, 18 bp, Homo sapiens
tacaggaaaagtgttaca

SEQ ID NO: 9088592 - DNA, 22 bp, Homo sapiens
tacaggaagcactcaagaaatg

SEQ ID NO: 9088593 - DNA, 22 bp, Homo sapiens
tacaggaagcactcaagaaatg

SEQ ID NO: 9088594 - DNA, 22 bp, Homo sapiens
tacaggaactgggcaggacatt

SEQ ID NO: 9088595 - DNA, 22 bp, Homo sapiens
tacaggaactgggcaggacatt

SEQ ID NO: 9088596 - DNA, 22 bp, Homo sapiens
tacaggaactgggcaggacatt

SEQ ID NO: 9088597 - DNA, 22 bp, Homo sapiens
tacaggaaccagattgttcagc

SEQ ID NO: 9088598 - DNA, 22 bp, Homo sapiens
tacaggaagtctcagtacagta

SEQ ID NO: 9088599 - DNA, 22 bp, Homo sapiens
tacaggaagtaagtaatgaaat

SEQ ID NO: 9088600 - DNA, 22 bp, Homo sapiens
tacaggaagtaagtaatgaaat

SEQ ID NO: 9088601 - DNA, 18 bp, Homo sapiens
tacaggaaggggttctcg

SEQ ID NO: 9088602 - DNA, 18 bp, Homo sapiens
tacaggaaggggttctcg

SEQ ID NO: 9088603 - DNA, 22 bp, Homo sapiens
tacaggaaggctctggaggtgc

SEQ ID NO: 9088604 - DNA, 22 bp, Homo sapiens
tacaggaaggagcacatcggga

SEQ ID NO: 9088605 - DNA, 22 bp, Homo sapiens
tacataattaatctttaagttc

SEQ ID NO: 9088606 - DNA, 22 bp, Homo sapiens
tacataatgagctagttaagtt

SEQ ID NO: 9088607 - DNA, 22 bp, Homo sapiens
tacataattaatctttaagttc

SEQ ID NO: 9088608 - DNA, 22 bp, Homo sapiens
tacagtttttcactgaagatgt

SEQ ID NO: 9088609 - DNA, 17 bp, Homo sapiens
tacaggagagcaggaac

SEQ ID NO: 9088610 - DNA, 22 bp, Homo sapiens
tacaggaagttacagactatga

SEQ ID NO: 9088611 - DNA, 20 bp, Homo sapiens
tacaggaatcaagactgcat

SEQ ID NO: 9088612 - DNA, 22 bp, Homo sapiens
tacaggacattgtgcatttgtc

SEQ ID NO: 9088613 - DNA, 22 bp, Homo sapiens
tacaggacagatgtttacagga

SEQ ID NO: 9088614 - DNA, 20 bp, Homo sapiens
tacaggaccttctttgtatc

SEQ ID NO: 9088615 - DNA, 22 bp, Homo sapiens
tacagtttgttacattgttagt

SEQ ID NO: 9088616 - DNA, 22 bp, Homo sapiens
tacagttactgttatatgtgct

SEQ ID NO: 9088617 - DNA, 22 bp, Homo sapiens
tacagttactgcatttctaata

SEQ ID NO: 9088618 - DNA, 22 bp, Homo sapiens
tacatacagtggatgctttagg

SEQ ID NO: 9088619 - DNA, 22 bp, Homo sapiens
tacattaaggatatggacatga

SEQ ID NO: 9088620 - DNA, 22 bp, Homo sapiens
tacattaaggatatggacatga

SEQ ID NO: 9088621 - DNA, 22 bp, Homo sapiens
tacatgtttggtaaatgatggc

SEQ ID NO: 9088622 - DNA, 22 bp, Homo sapiens
tacatacagccaagtatgaagt

SEQ ID NO: 9088623 - DNA, 22 bp, Homo sapiens
tacatacacaaatatactgttt

SEQ ID NO: 9088624 - DNA, 22 bp, Homo sapiens
tacatacaagcattcaatttta

SEQ ID NO: 9088625 - DNA, 22 bp, Homo sapiens
tacatacacaaatatactgttt

SEQ ID NO: 9088626 - DNA, 22 bp, Homo sapiens
tacatacacaaatatactgttt

SEQ ID NO: 9088627 - DNA, 22 bp, Homo sapiens
tacatacaagcattcaatttta

SEQ ID NO: 9088628 - DNA, 22 bp, Homo sapiens
tacattcatggtgacttgtatg

SEQ ID NO: 9088629 - DNA, 23 bp, Homo sapiens
tacattcatttgcacagccagta

SEQ ID NO: 9088630 - DNA, 15 bp, Homo sapiens
tacattcatttccac

SEQ ID NO: 9088631 - DNA, 22 bp, Homo sapiens
tacattcagcaaaagaatggtt

SEQ ID NO: 9088632 - DNA, 22 bp, Homo sapiens
tacattcatatgtgtgcataca

SEQ ID NO: 9088633 - DNA, 22 bp, Homo sapiens
tacattcagagaaagtttccat

SEQ ID NO: 9088634 - DNA, 22 bp, Homo sapiens
tacattcagaagaatggacacg

SEQ ID NO: 9088635 - DNA, 22 bp, Homo sapiens
tacattcagaattgggaggcaa

SEQ ID NO: 9088636 - DNA, 22 bp, Homo sapiens
tacattcacagttgttcatctc

SEQ ID NO: 9088637 - DNA, 22 bp, Homo sapiens
tacattcacttgttgaaggtgg

SEQ ID NO: 9088638 - DNA, 20 bp, Homo sapiens
tacattcaaaacaaactctg

SEQ ID NO: 9088639 - DNA, 22 bp, Homo sapiens
tacattcaaacgatttattgat

SEQ ID NO: 9088640 - DNA, 22 bp, Homo sapiens
tacattcaacatgtcactatgt

SEQ ID NO: 9088641 - DNA, 22 bp, Homo sapiens
tacattatcttgttatctttca

SEQ ID NO: 9088642 - DNA, 22 bp, Homo sapiens
taccttcaggctgccctttgat

SEQ ID NO: 9088643 - DNA, 22 bp, Homo sapiens
tacccagcttcaagtcaggact

SEQ ID NO: 9088644 - DNA, 22 bp, Homo sapiens
tacctgcacagccagccatgtg

SEQ ID NO: 9088645 - DNA, 22 bp, Homo sapiens
tacctgcagcgggaatccatta

SEQ ID NO: 9088646 - DNA, 22 bp, Homo sapiens
tacctgagcccagtgcagcata

SEQ ID NO: 9088647 - DNA, 22 bp, Homo sapiens
tacattccatgtgtgtgtattc

SEQ ID NO: 9088648 - DNA, 20 bp, Homo sapiens
tacccaagtgtggccatgtg

SEQ ID NO: 9088649 - DNA, 22 bp, Homo sapiens
tacattccacaagcattgcttt

SEQ ID NO: 9088650 - DNA, 22 bp, Homo sapiens
tacattccaaaggaaactggct

SEQ ID NO: 9088651 - DNA, 22 bp, Homo sapiens
tacattccactagtgactggcg

SEQ ID NO: 9088652 - DNA, 19 bp, Homo sapiens
tacattccacacaatctct

SEQ ID NO: 9088653 - DNA, 22 bp, Homo sapiens
tactgaagcaccattaaagaca

SEQ ID NO: 9088654 - DNA, 22 bp, Homo sapiens
tactgaaatagcactctgatgc

SEQ ID NO: 9088655 - DNA, 22 bp, Homo sapiens
tactgaaagtggtcaacagtgg

SEQ ID NO: 9088656 - DNA, 22 bp, Homo sapiens
tactgaaagaatacataatttc

SEQ ID NO: 9088657 - DNA, 22 bp, Homo sapiens
tactaacaatgagaacaagcca

SEQ ID NO: 9088658 - DNA, 22 bp, Homo sapiens
tactgaaagactgaatatttag

SEQ ID NO: 9088659 - DNA, 22 bp, Homo sapiens
tacgaatcctgtggatgaatgt

SEQ ID NO: 9088660 - DNA, 22 bp, Homo sapiens
tactaaatagcaggttggctat

SEQ ID NO: 9088661 - DNA, 22 bp, Homo sapiens
tactaaatgattaagcaggaat

SEQ ID NO: 9088662 - DNA, 22 bp, Homo sapiens
tactaaatagtttaattcctca

SEQ ID NO: 9088663 - DNA, 22 bp, Homo sapiens
tactaaatgattaagcaggaat

SEQ ID NO: 9088664 - DNA, 22 bp, Homo sapiens
tactaaatgattaagcaggaat

SEQ ID NO: 9088665 - DNA, 22 bp, Homo sapiens
tacgtgtgttcgtgtaagcact

SEQ ID NO: 9088666 - DNA, 22 bp, Homo sapiens
tactgcattatcaaggggaagg

SEQ ID NO: 9088667 - DNA, 22 bp, Homo sapiens
tactgcattaaatttaggttat

SEQ ID NO: 9088668 - DNA, 22 bp, Homo sapiens
tactgcatgtgtttgatgatgg

SEQ ID NO: 9088669 - DNA, 22 bp, Homo sapiens
tactgcatgaaggcacctattt

SEQ ID NO: 9088670 - DNA, 22 bp, Homo sapiens
tactgcatggtggagtggagct

SEQ ID NO: 9088671 - DNA, 22 bp, Homo sapiens
tactgcctggagatgaatcaat

SEQ ID NO: 9088672 - DNA, 22 bp, Homo sapiens
tactgcctgggggagacagctg

SEQ ID NO: 9088673 - DNA, 23 bp, Homo sapiens
tactgcctggggccagagagcgg

SEQ ID NO: 9088674 - DNA, 23 bp, Homo sapiens
tactgccttgttcatgtgtattt

SEQ ID NO: 9088675 - DNA, 22 bp, Homo sapiens
tactgccttggtaggaataacc

SEQ ID NO: 9088676 - DNA, 22 bp, Homo sapiens
tactgcctgggggagacagctg

SEQ ID NO: 9088677 - DNA, 23 bp, Homo sapiens
tactgcctggggccagagagcgg

SEQ ID NO: 9088678 - DNA, 20 bp, Homo sapiens
tactgggcaagcccacagac

SEQ ID NO: 9088679 - DNA, 20 bp, Homo sapiens
tactgggcaagcccacagac

SEQ ID NO: 9088680 - DNA, 22 bp, Homo sapiens
tactggggtatgctcagatata

SEQ ID NO: 9088681 - DNA, 22 bp, Homo sapiens
tactgcataactggcatgtggg

SEQ ID NO: 9088682 - DNA, 22 bp, Homo sapiens
tactgcatgggtgcatgctgct

SEQ ID NO: 9088683 - DNA, 22 bp, Homo sapiens
tactgcatcgaaatgcttttat

SEQ ID NO: 9088684 - DNA, 22 bp, Homo sapiens
tactgcatagacactgggatat

SEQ ID NO: 9088685 - DNA, 22 bp, Homo sapiens
tactgcagatggccttgttctt

SEQ ID NO: 9088686 - DNA, 22 bp, Homo sapiens
tactgaggctgaattcttagca

SEQ ID NO: 9088687 - DNA, 22 bp, Homo sapiens
tactgaggctgaattcttagca

SEQ ID NO: 9088688 - DNA, 22 bp, Homo sapiens
tactgaggccatgagtctcata

SEQ ID NO: 9088689 - DNA, 22 bp, Homo sapiens
tactgaggcaatagataacggc

SEQ ID NO: 9088690 - DNA, 17 bp, Homo sapiens
tactgaggggtctggag

SEQ ID NO: 9088691 - DNA, 22 bp, Homo sapiens
tactgagggcaaagagtgaagc

SEQ ID NO: 9088692 - DNA, 22 bp, Homo sapiens
tactgaggctgggttaagcatc

SEQ ID NO: 9088693 - DNA, 22 bp, Homo sapiens
tactgaggctggcagccccttg

SEQ ID NO: 9088694 - DNA, 22 bp, Homo sapiens
tactgaggttgagaagctgctc

SEQ ID NO: 9088695 - DNA, 22 bp, Homo sapiens
tactgaggtactttacttataa

SEQ ID NO: 9088696 - DNA, 20 bp, Homo sapiens
tactgaggttaggggatgga

SEQ ID NO: 9088697 - DNA, 17 bp, Homo sapiens
tactgaggggtctggag

SEQ ID NO: 9088698 - DNA, 22 bp, Homo sapiens
tactgagggctgtgtatgtatt

SEQ ID NO: 9088699 - DNA, 22 bp, Homo sapiens
tactgagggtgaaaaataaagt

SEQ ID NO: 9088700 - DNA, 22 bp, Homo sapiens
tactgagggtatgaagccaagg

SEQ ID NO: 9088701 - DNA, 22 bp, Homo sapiens
tactgagggtatgaagccaagg

SEQ ID NO: 9088702 - DNA, 22 bp, Homo sapiens
tacttcctgtttccatgtctgt

SEQ ID NO: 9088703 - DNA, 22 bp, Homo sapiens
tacttcctgtttccatgtctgt

SEQ ID NO: 9088704 - DNA, 22 bp, Homo sapiens
tacttcctgtttccatgtctgt

SEQ ID NO: 9088705 - DNA, 22 bp, Homo sapiens
tacttcatacctgctagaatgg

SEQ ID NO: 9088706 - DNA, 22 bp, Homo sapiens
tacttcatgagttaatatgcag

SEQ ID NO: 9088707 - DNA, 22 bp, Homo sapiens
tacttcattcctttgtaaaatg

SEQ ID NO: 9088708 - DNA, 22 bp, Homo sapiens
tacttcattcctttgtaaaatg

SEQ ID NO: 9088709 - DNA, 22 bp, Homo sapiens
tacttagactctatctagagat

SEQ ID NO: 9088710 - DNA, 20 bp, Homo sapiens
tactgggtctgggtcctgga

SEQ ID NO: 9088711 - DNA, 22 bp, Homo sapiens
tactgtaagtcaaatgaaacat

SEQ ID NO: 9088712 - DNA, 22 bp, Homo sapiens
tacttcaattatatgccagtta

SEQ ID NO: 9088713 - DNA, 18 bp, Homo sapiens
tacttcaactcccagggc

SEQ ID NO: 9088714 - DNA, 22 bp, Homo sapiens
tacttcaaccttctctattaga

SEQ ID NO: 9088715 - DNA, 22 bp, Homo sapiens
tacttcaatttgtatatgtgaa

SEQ ID NO: 9088716 - DNA, 22 bp, Homo sapiens
tacttcaaacaatggtacaaac

SEQ ID NO: 9088717 - DNA, 22 bp, Homo sapiens
tacttcaacaccatatggtcct

SEQ ID NO: 9088718 - DNA, 22 bp, Homo sapiens
tacttattgttgaactgaatca

SEQ ID NO: 9088719 - DNA, 19 bp, Homo sapiens
tacttattagaaatatggg

SEQ ID NO: 9088720 - DNA, 22 bp, Homo sapiens
tcctccagaaactgaggcagaa

SEQ ID NO: 9088721 - DNA, 20 bp, Homo sapiens
tcctccaaccagctgctaat

SEQ ID NO: 9088722 - DNA, 23 bp, Homo sapiens
tcctccaaccagcagctgcataa

SEQ ID NO: 9088723 - DNA, 23 bp, Homo sapiens
tcctccaatctcatggcccttaa

SEQ ID NO: 9088724 - DNA, 22 bp, Homo sapiens
tcctccaagcagaggccctgaa

SEQ ID NO: 9088725 - DNA, 22 bp, Homo sapiens
tcctccaagcctttgtgaagtg

SEQ ID NO: 9088726 - DNA, 22 bp, Homo sapiens
tcctccaagcgtgggtgtttga

SEQ ID NO: 9088727 - DNA, 22 bp, Homo sapiens
tcctccaaggcagggggagaga

SEQ ID NO: 9088728 - DNA, 22 bp, Homo sapiens
tcctccagccctctaggaaaat

SEQ ID NO: 9088729 - DNA, 22 bp, Homo sapiens
tcctccaggataaaatgtgttg

SEQ ID NO: 9088730 - DNA, 22 bp, Homo sapiens
tcctccaggataaaatgtgttg

SEQ ID NO: 9088731 - DNA, 22 bp, Homo sapiens
tcctccaggcacctcactggct

SEQ ID NO: 9088732 - DNA, 23 bp, Homo sapiens
tcctcagtatataaaggcagatg

SEQ ID NO: 9088733 - DNA, 22 bp, Homo sapiens
tccgggttttacactcacatca

SEQ ID NO: 9088734 - DNA, 22 bp, Homo sapiens
tccgggggtggtagatttcctt

SEQ ID NO: 9088735 - DNA, 22 bp, Homo sapiens
tcctcagtctctaaggcctcag

SEQ ID NO: 9088736 - DNA, 22 bp, Homo sapiens
tcctcagtcgtttgagccaaaa

SEQ ID NO: 9088737 - DNA, 22 bp, Homo sapiens
tcctcagtattgtggagcagat

SEQ ID NO: 9088738 - DNA, 22 bp, Homo sapiens
tcctcagtcacggtagcacatt

SEQ ID NO: 9088739 - DNA, 22 bp, Homo sapiens
tcctcagtcagctccgttcttg

SEQ ID NO: 9088740 - DNA, 22 bp, Homo sapiens
tcctcagtattgtggagcagat

SEQ ID NO: 9088741 - DNA, 19 bp, Homo sapiens
tcctcagtgacaacctcag

SEQ ID NO: 9088742 - DNA, 22 bp, Homo sapiens
tcctcagtgctagccaactgcc

SEQ ID NO: 9088743 - DNA, 22 bp, Homo sapiens
tcctcagtctctcaaatgaggc

SEQ ID NO: 9088744 - DNA, 22 bp, Homo sapiens
tcctcagtgctagccaactgcc

SEQ ID NO: 9088745 - DNA, 22 bp, Homo sapiens
tcctcagtggggcattcattat

SEQ ID NO: 9088746 - DNA, 22 bp, Homo sapiens
tcctcagttataaataggaaac

SEQ ID NO: 9088747 - DNA, 22 bp, Homo sapiens
tcctcagttttctagtatggca

SEQ ID NO: 9088748 - DNA, 22 bp, Homo sapiens
tcctcagttttctagtatggca

SEQ ID NO: 9088749 - DNA, 22 bp, Homo sapiens
tccctttgatcactaacagaac

SEQ ID NO: 9088750 - DNA, 22 bp, Homo sapiens
tccctttggatccaagcttatg

SEQ ID NO: 9088751 - DNA, 22 bp, Homo sapiens
tccctttggatccaagcttatg

SEQ ID NO: 9088752 - DNA, 22 bp, Homo sapiens
tccgggaggcagaggttgcagt

SEQ ID NO: 9088753 - DNA, 23 bp, Homo sapiens
tccggcaacttcactcctcccgc

SEQ ID NO: 9088754 - DNA, 22 bp, Homo sapiens
tccgggagctgaacgtcttgcg

SEQ ID NO: 9088755 - DNA, 22 bp, Homo sapiens
tcctcctctatcagacagtgcc

SEQ ID NO: 9088756 - DNA, 23 bp, Homo sapiens
tcctcctgacacagcctgagtga

SEQ ID NO: 9088757 - DNA, 22 bp, Homo sapiens
tcctcctcacgctgttgcttgt

SEQ ID NO: 9088758 - DNA, 21 bp, Homo sapiens
tcctcctccactaggctagcc

SEQ ID NO: 9088759 - DNA, 19 bp, Homo sapiens
tcctccctttggtgtcctg

SEQ ID NO: 9088760 - DNA, 23 bp, Homo sapiens
tcctcctgagtgagagtgccagc

SEQ ID NO: 9088761 - DNA, 22 bp, Homo sapiens
tcctccaggtctagggtggctt

SEQ ID NO: 9088762 - DNA, 22 bp, Homo sapiens
tcctccaggtctagggtggctt

SEQ ID NO: 9088763 - DNA, 22 bp, Homo sapiens
tcctcccctgcccatgaggagg

SEQ ID NO: 9088764 - DNA, 22 bp, Homo sapiens
tcctccagtgtctggggccttg

SEQ ID NO: 9088765 - DNA, 22 bp, Homo sapiens
tcctccagtgtctggggccttg

SEQ ID NO: 9088766 - DNA, 22 bp, Homo sapiens
tcctccctgcactcagtgaagt

SEQ ID NO: 9088767 - DNA, 22 bp, Homo sapiens
tcctccctgggagcttctgagt

SEQ ID NO: 9088768 - DNA, 22 bp, Homo sapiens
tcctcccttctcactgggaagg

SEQ ID NO: 9088769 - DNA, 21 bp, Homo sapiens
tcctccctgagctgtggggga

SEQ ID NO: 9088770 - DNA, 22 bp, Homo sapiens
tcctccctgagtggggacagct

SEQ ID NO: 9088771 - DNA, 22 bp, Homo sapiens
tcctccctaaatcctagactgt

SEQ ID NO: 9088772 - DNA, 21 bp, Homo sapiens
tccctgagttctctgagcatc

SEQ ID NO: 9088773 - DNA, 22 bp, Homo sapiens
tccctgatgccaaagaagcatg

SEQ ID NO: 9088774 - DNA, 22 bp, Homo sapiens
tccctgggcatcacgttgcttc

SEQ ID NO: 9088775 - DNA, 22 bp, Homo sapiens
tccctgggcacaatctgctggc

SEQ ID NO: 9088776 - DNA, 22 bp, Homo sapiens
tccctgggccacagctgtgagc

SEQ ID NO: 9088777 - DNA, 22 bp, Homo sapiens
tccctgggccacagctgtgagc

SEQ ID NO: 9088778 - DNA, 23 bp, Homo sapiens
tccctgggcccgtgccagcggtg

SEQ ID NO: 9088779 - DNA, 23 bp, Homo sapiens
tccctgggcccgtgccagcggtg

SEQ ID NO: 9088780 - DNA, 22 bp, Homo sapiens
tccctgggcaagtttactcttc

SEQ ID NO: 9088781 - DNA, 22 bp, Homo sapiens
tccctgagggcagctcaagtcc

SEQ ID NO: 9088782 - DNA, 19 bp, Homo sapiens
tccctgagttccagcccag

SEQ ID NO: 9088783 - DNA, 22 bp, Homo sapiens
tccctgagggcagctcaagtcc

SEQ ID NO: 9088784 - DNA, 22 bp, Homo sapiens
tccctgagggcagctcaagtcc

SEQ ID NO: 9088785 - DNA, 22 bp, Homo sapiens
tccctgagcttcatcaggcttt

SEQ ID NO: 9088786 - DNA, 22 bp, Homo sapiens
tccctgagcttcatcaggcttt

SEQ ID NO: 9088787 - DNA, 22 bp, Homo sapiens
tccctgaggaaggggtgtggtg

SEQ ID NO: 9088788 - DNA, 23 bp, Homo sapiens
tccctgagctggagagactgcac

SEQ ID NO: 9088789 - DNA, 23 bp, Homo sapiens
tccctgagctggagagactgcac

SEQ ID NO: 9088790 - DNA, 22 bp, Homo sapiens
tccctgagctgagctcaacagc

SEQ ID NO: 9088791 - DNA, 21 bp, Homo sapiens
tccctgagcccaaggggctcc

SEQ ID NO: 9088792 - DNA, 22 bp, Homo sapiens
tccctgagctcacatggcagga

SEQ ID NO: 9088793 - DNA, 23 bp, Homo sapiens
tccctgagatgctgctctgtccc

SEQ ID NO: 9088794 - DNA, 22 bp, Homo sapiens
tccctgggcctatcttagctcc

SEQ ID NO: 9088795 - DNA, 22 bp, Homo sapiens
tccctgggcctatcttagctcc

SEQ ID NO: 9088796 - DNA, 22 bp, Homo sapiens
tccctgggcggacattctccca

SEQ ID NO: 9088797 - DNA, 22 bp, Homo sapiens
tccctgggcctcctgctatgca

SEQ ID NO: 9088798 - DNA, 22 bp, Homo sapiens
tccctgggcctcctgctatgca

SEQ ID NO: 9088799 - DNA, 22 bp, Homo sapiens
tccctggggaagggcaagcaag

SEQ ID NO: 9088800 - DNA, 22 bp, Homo sapiens
tccctggggaagggcaagcaag

SEQ ID NO: 9088801 - DNA, 22 bp, Homo sapiens
tccctgggcttctccagacttg

SEQ ID NO: 9088802 - DNA, 22 bp, Homo sapiens
tccctggggatgttggcctgcc

SEQ ID NO: 9088803 - DNA, 22 bp, Homo sapiens
tccctggggatgttggcctgcc

SEQ ID NO: 9088804 - DNA, 22 bp, Homo sapiens
tccctggggatgttggcctgcc

SEQ ID NO: 9088805 - DNA, 22 bp, Homo sapiens
tccctggggcagtggctcggag

SEQ ID NO: 9088806 - DNA, 22 bp, Homo sapiens
tccctgtgagaaatgaagcagg

SEQ ID NO: 9088807 - DNA, 22 bp, Homo sapiens
tccctgtggatatctgcagctg

SEQ ID NO: 9088808 - DNA, 22 bp, Homo sapiens
tccctgtggaagactgccagag

SEQ ID NO: 9088809 - DNA, 22 bp, Homo sapiens
tccctgtaaggttctgagattt

SEQ ID NO: 9088810 - DNA, 22 bp, Homo sapiens
tccctgtagttcgtggtctttg

SEQ ID NO: 9088811 - DNA, 22 bp, Homo sapiens
tccctgtacttacacagcgtcc

SEQ ID NO: 9088812 - DNA, 20 bp, Homo sapiens
tccctggggccctacttcct

SEQ ID NO: 9088813 - DNA, 22 bp, Homo sapiens
tccctgtatatcacaagggcta

SEQ ID NO: 9088814 - DNA, 22 bp, Homo sapiens
tccctgtcctgggcaatcccag

SEQ ID NO: 9088815 - DNA, 22 bp, Homo sapiens
tccctgtccaaagtcttcctat

SEQ ID NO: 9088816 - DNA, 22 bp, Homo sapiens
tccctgtctcccttgagactag

SEQ ID NO: 9088817 - DNA, 22 bp, Homo sapiens
tccctgtccaaagtcttcctat

SEQ ID NO: 9088818 - DNA, 22 bp, Homo sapiens
tccctgtctaatatgccatgaa

SEQ ID NO: 9088819 - DNA, 22 bp, Homo sapiens
tccctgtgtccatgccaggagg

SEQ ID NO: 9088820 - DNA, 22 bp, Homo sapiens
tccctgtgtccatgccaggagg

SEQ ID NO: 9088821 - DNA, 23 bp, Homo sapiens
tccctgtgtacagcctgcatgag

SEQ ID NO: 9088822 - DNA, 22 bp, Homo sapiens
tccctgtgggcagaggctgcct

SEQ ID NO: 9088823 - DNA, 22 bp, Homo sapiens
tccctgtgggatgaggactctg

SEQ ID NO: 9088824 - DNA, 22 bp, Homo sapiens
tccctgtggcacacccaagccc

SEQ ID NO: 9088825 - DNA, 22 bp, Homo sapiens
tccctgtggctaagacatgaca

SEQ ID NO: 9088826 - DNA, 22 bp, Homo sapiens
tccctgtgggatgaggactctg

SEQ ID NO: 9088827 - DNA, 22 bp, Homo sapiens
tcccttcatcagtgagcaagcc

SEQ ID NO: 9088828 - DNA, 22 bp, Homo sapiens
tcccttcacagatgcgatgttt

SEQ ID NO: 9088829 - DNA, 22 bp, Homo sapiens
tcccttcaagatttggggaaat

SEQ ID NO: 9088830 - DNA, 22 bp, Homo sapiens
tcccttcaataattcaacatta

SEQ ID NO: 9088831 - DNA, 22 bp, Homo sapiens
tccctgtgtcttcctcttgccc

SEQ ID NO: 9088832 - DNA, 22 bp, Homo sapiens
tcccttaaaactcatgtgttgt

SEQ ID NO: 9088833 - DNA, 22 bp, Homo sapiens
tcccttcaagatttggggaaat

SEQ ID NO: 9088834 - DNA, 18 bp, Homo sapiens
tcccttctcccttgcctc

SEQ ID NO: 9088835 - DNA, 22 bp, Homo sapiens
tcccttcctcataggcagaagg

SEQ ID NO: 9088836 - DNA, 22 bp, Homo sapiens
tccaccagcagcctgtcagcct

SEQ ID NO: 9088837 - DNA, 22 bp, Homo sapiens
tccaccatgtaacaagctctgt

SEQ ID NO: 9088838 - DNA, 22 bp, Homo sapiens
tccaccatgtaacaagctctgt

SEQ ID NO: 9088839 - DNA, 22 bp, Homo sapiens
tccaccatgtaacaagctctgt

SEQ ID NO: 9088840 - DNA, 22 bp, Homo sapiens
tccaccatgatttagcactggc

SEQ ID NO: 9088841 - DNA, 19 bp, Homo sapiens
tccaccccagccagctctg

SEQ ID NO: 9088842 - DNA, 19 bp, Homo sapiens
tccaccccagccagctctg

SEQ ID NO: 9088843 - DNA, 19 bp, Homo sapiens
tccaccccagccagctctg

SEQ ID NO: 9088844 - DNA, 22 bp, Homo sapiens
tccacccccagacagctggtga

SEQ ID NO: 9088845 - DNA, 23 bp, Homo sapiens
tccaccccagctgaggcttagcc

SEQ ID NO: 9088846 - DNA, 22 bp, Homo sapiens
tccacccccagacagctggtga

SEQ ID NO: 9088847 - DNA, 22 bp, Homo sapiens
tccacccctgggaatgtcaata

SEQ ID NO: 9088848 - DNA, 22 bp, Homo sapiens
tccacccctgggaatgtcaata

SEQ ID NO: 9088849 - DNA, 22 bp, Homo sapiens
tccacctgggcaacagtgcctc

SEQ ID NO: 9088850 - DNA, 22 bp, Homo sapiens
tccacgctgtgtgaccttgggc

SEQ ID NO: 9088851 - DNA, 22 bp, Homo sapiens
tccacctgggcaacagtgcctc

SEQ ID NO: 9088852 - DNA, 22 bp, Homo sapiens
tccacgtgagcttcgtgtgcag

SEQ ID NO: 9088853 - DNA, 22 bp, Homo sapiens
tccagaaaattcagaaattgtt

SEQ ID NO: 9088854 - DNA, 22 bp, Homo sapiens
tccactgcagcttctgatggaa

SEQ ID NO: 9088855 - DNA, 22 bp, Homo sapiens
tccacagatgcctttaggagta

SEQ ID NO: 9088856 - DNA, 22 bp, Homo sapiens
tccacagggatgcctgcggctt

SEQ ID NO: 9088857 - DNA, 22 bp, Homo sapiens
tccacaggctgaggcccttctg

SEQ ID NO: 9088858 - DNA, 22 bp, Homo sapiens
tccacaggaaagcacctcccat

SEQ ID NO: 9088859 - DNA, 22 bp, Homo sapiens
tccacaggcaagtctcttggca

SEQ ID NO: 9088860 - DNA, 22 bp, Homo sapiens
tccacaatggcagagaaatgtc

SEQ ID NO: 9088861 - DNA, 22 bp, Homo sapiens
tcattacaagatttccaatttg

SEQ ID NO: 9088862 - DNA, 22 bp, Homo sapiens
tcattacacagttcagtggaaa

SEQ ID NO: 9088863 - DNA, 22 bp, Homo sapiens
tccacagaatgtaagatccaca

SEQ ID NO: 9088864 - DNA, 22 bp, Homo sapiens
tccacagaccagtatctgcagc

SEQ ID NO: 9088865 - DNA, 22 bp, Homo sapiens
tccacagacgtgttattagttg

SEQ ID NO: 9088866 - DNA, 22 bp, Homo sapiens
tcatggcttttattatgttgag

SEQ ID NO: 9088867 - DNA, 22 bp, Homo sapiens
tcatggctggaagctcagttag

SEQ ID NO: 9088868 - DNA, 20 bp, Homo sapiens
tcatggctgctgagaggttc

SEQ ID NO: 9088869 - DNA, 18 bp, Homo sapiens
tcatggctttagtccctc

SEQ ID NO: 9088870 - DNA, 22 bp, Homo sapiens
tcatggcttgcagatggccacc

SEQ ID NO: 9088871 - DNA, 22 bp, Homo sapiens
tcatgttattgactcataatat

SEQ ID NO: 9088872 - DNA, 22 bp, Homo sapiens
tccagaaaattttacagtgcct

SEQ ID NO: 9088873 - DNA, 22 bp, Homo sapiens
tccagaaactgctgagataaga

SEQ ID NO: 9088874 - DNA, 22 bp, Homo sapiens
tccagaaactgctgagataaga

SEQ ID NO: 9088875 - DNA, 22 bp, Homo sapiens
tccagccaccaccttgattgcc

SEQ ID NO: 9088876 - DNA, 22 bp, Homo sapiens
tccagccacgtattatctcact

SEQ ID NO: 9088877 - DNA, 22 bp, Homo sapiens
tccagccactcagcagggattg

SEQ ID NO: 9088878 - DNA, 22 bp, Homo sapiens
tccagccactcagcagggattg

SEQ ID NO: 9088879 - DNA, 20 bp, Homo sapiens
tccagccacttccgctggtc

SEQ ID NO: 9088880 - DNA, 22 bp, Homo sapiens
tccagcccaggctggagtgtag

SEQ ID NO: 9088881 - DNA, 22 bp, Homo sapiens
tccagcccatccctagcctggg

SEQ ID NO: 9088882 - DNA, 20 bp, Homo sapiens
tccagcccaggtcctgcctg

SEQ ID NO: 9088883 - DNA, 22 bp, Homo sapiens
tccagcccagtttggtgaattg

SEQ ID NO: 9088884 - DNA, 20 bp, Homo sapiens
tccagcccaggtcctgcctg

SEQ ID NO: 9088885 - DNA, 22 bp, Homo sapiens
tccagccccgaggccggcgacg

SEQ ID NO: 9088886 - DNA, 22 bp, Homo sapiens
tccagcccatccctagcctggg

SEQ ID NO: 9088887 - DNA, 22 bp, Homo sapiens
tccagccccggcttccttacag

SEQ ID NO: 9088888 - DNA, 22 bp, Homo sapiens
tccagccccggcttccttacag

SEQ ID NO: 9088889 - DNA, 22 bp, Homo sapiens
tccagccccgggatgttcttca

SEQ ID NO: 9088890 - DNA, 22 bp, Homo sapiens
tccagcccctcctgagccaagc

SEQ ID NO: 9088891 - DNA, 22 bp, Homo sapiens
tccagcccgactgggcctgccg

SEQ ID NO: 9088892 - DNA, 22 bp, Homo sapiens
tccagcccgagggcgctgatga

SEQ ID NO: 9088893 - DNA, 22 bp, Homo sapiens
tccagcccgggggcaggtgacc

SEQ ID NO: 9088894 - DNA, 22 bp, Homo sapiens
tccagccctcagccaagtggaa

SEQ ID NO: 9088895 - DNA, 19 bp, Homo sapiens
tccagcccctctgtgtgtg

SEQ ID NO: 9088896 - DNA, 20 bp, Homo sapiens
tccagcccctgcatgttgct

SEQ ID NO: 9088897 - DNA, 22 bp, Homo sapiens
tccagccccttttactcattca

SEQ ID NO: 9088898 - DNA, 22 bp, Homo sapiens
tccagcccgactgggcctgccg

SEQ ID NO: 9088899 - DNA, 22 bp, Homo sapiens
tccagcccgactgggcctgccg

SEQ ID NO: 9088900 - DNA, 17 bp, Homo sapiens
tccagccctgcccgacg

SEQ ID NO: 9088901 - DNA, 17 bp, Homo sapiens
tccagccctgcccgacg

SEQ ID NO: 9088902 - DNA, 22 bp, Homo sapiens
tccagccctgcttcctgcctca

SEQ ID NO: 9088903 - DNA, 22 bp, Homo sapiens
tccagccctgcccattctctcg

SEQ ID NO: 9088904 - DNA, 22 bp, Homo sapiens
tccagccctgcactgattagat

SEQ ID NO: 9088905 - DNA, 22 bp, Homo sapiens
tccagccctctggcccgcggtg

SEQ ID NO: 9088906 - DNA, 22 bp, Homo sapiens
tccagccctcctgggatcacag

SEQ ID NO: 9088907 - DNA, 22 bp, Homo sapiens
tccagccctcctgggatcacag

SEQ ID NO: 9088908 - DNA, 20 bp, Homo sapiens
tccagccctcatgtcgctca

SEQ ID NO: 9088909 - DNA, 22 bp, Homo sapiens
tccagccctgcttcctgcctca

SEQ ID NO: 9088910 - DNA, 20 bp, Homo sapiens
tccagccctgcttctctctt

SEQ ID NO: 9088911 - DNA, 23 bp, Homo sapiens
tccagcctcttgctctcacatgc

SEQ ID NO: 9088912 - DNA, 23 bp, Homo sapiens
tccagcctcttgctctcacatgc

SEQ ID NO: 9088913 - DNA, 23 bp, Homo sapiens
tccagcctcttgctctcacatgc

SEQ ID NO: 9088914 - DNA, 22 bp, Homo sapiens
tccagcctgaactttgtccaga

SEQ ID NO: 9088915 - DNA, 22 bp, Homo sapiens
tccagcctgaactttgtccaga

SEQ ID NO: 9088916 - DNA, 22 bp, Homo sapiens
tccagcctggttgcgggcatcc

SEQ ID NO: 9088917 - DNA, 19 bp, Homo sapiens
tccagcctgctgtttctct

SEQ ID NO: 9088918 - DNA, 19 bp, Homo sapiens
tccagcctgctgtttctct

SEQ ID NO: 9088919 - DNA, 22 bp, Homo sapiens
tccagccttctcaaggctggct

SEQ ID NO: 9088920 - DNA, 22 bp, Homo sapiens
tccagccttctcaaggctggct

SEQ ID NO: 9088921 - DNA, 22 bp, Homo sapiens
tccagccttccttttcactctc

SEQ ID NO: 9088922 - DNA, 21 bp, Homo sapiens
tccagcctttccctcacttcc

SEQ ID NO: 9088923 - DNA, 21 bp, Homo sapiens
tccagcctttccctcacttcc

SEQ ID NO: 9088924 - DNA, 22 bp, Homo sapiens
tccagccttgccacttttctgt

SEQ ID NO: 9088925 - DNA, 22 bp, Homo sapiens
tccagccttgccacttttctgt

SEQ ID NO: 9088926 - DNA, 22 bp, Homo sapiens
tccaggaatagatcagagattt

SEQ ID NO: 9088927 - DNA, 20 bp, Homo sapiens
tccaggaatggtagaggact

SEQ ID NO: 9088928 - DNA, 22 bp, Homo sapiens
tccaggagaaaactgacggtgg

SEQ ID NO: 9088929 - DNA, 22 bp, Homo sapiens
tccaggagcatccaggtgaagc

SEQ ID NO: 9088930 - DNA, 22 bp, Homo sapiens
tccagggacagcgctggagcta

SEQ ID NO: 9088931 - DNA, 21 bp, Homo sapiens
tccaggcctcaggaagggatg

SEQ ID NO: 9088932 - DNA, 22 bp, Homo sapiens
tccagggagatactggctgcca

SEQ ID NO: 9088933 - DNA, 22 bp, Homo sapiens
tccaggccgcaggggcagcccc

SEQ ID NO: 9088934 - DNA, 22 bp, Homo sapiens
tccaggcctaggccaagtgatt

SEQ ID NO: 9088935 - DNA, 21 bp, Homo sapiens
tccaggcctcaggaagggatg

SEQ ID NO: 9088936 - DNA, 22 bp, Homo sapiens
tccaggccctgggatgggagca

SEQ ID NO: 9088937 - DNA, 22 bp, Homo sapiens
tccaggccgcaggggcagcccc

SEQ ID NO: 9088938 - DNA, 22 bp, Homo sapiens
tccaggccattgactgcatcct

SEQ ID NO: 9088939 - DNA, 22 bp, Homo sapiens
tccaggccattgactgcatcct

SEQ ID NO: 9088940 - DNA, 20 bp, Homo sapiens
tccaggcccactcagctgaa

SEQ ID NO: 9088941 - DNA, 22 bp, Homo sapiens
tccaggcccagacggggtgagg

SEQ ID NO: 9088942 - DNA, 22 bp, Homo sapiens
tccaggcccactcagctgaaat

SEQ ID NO: 9088943 - DNA, 22 bp, Homo sapiens
tccaggcccactcagctgaaat

SEQ ID NO: 9088944 - DNA, 22 bp, Homo sapiens
tccaggccactgcagaggctct

SEQ ID NO: 9088945 - DNA, 22 bp, Homo sapiens
tccaggaggaggaaggctgcca

SEQ ID NO: 9088946 - DNA, 22 bp, Homo sapiens
tccaggccagggtaagaggaga

SEQ ID NO: 9088947 - DNA, 21 bp, Homo sapiens
tccaggccatggtggggaggc

SEQ ID NO: 9088948 - DNA, 22 bp, Homo sapiens
tccagtggaacagatgttgcct

SEQ ID NO: 9088949 - DNA, 22 bp, Homo sapiens
tccagtcctatctgcccttgga

SEQ ID NO: 9088950 - DNA, 22 bp, Homo sapiens
tccagtcctatctgcccttgga

SEQ ID NO: 9088951 - DNA, 18 bp, Homo sapiens
tccagtcccagctctgcc

SEQ ID NO: 9088952 - DNA, 22 bp, Homo sapiens
tccagtcctagaaactggagag

SEQ ID NO: 9088953 - DNA, 22 bp, Homo sapiens
tccagtctggtatgaatcctag

SEQ ID NO: 9088954 - DNA, 22 bp, Homo sapiens
tccagggagttggctggatagt

SEQ ID NO: 9088955 - DNA, 22 bp, Homo sapiens
tccagtccagggaatggctgat

SEQ ID NO: 9088956 - DNA, 18 bp, Homo sapiens
tccagtcccaaggccagc

SEQ ID NO: 9088957 - DNA, 18 bp, Homo sapiens
tccagtcccaaggccagc

SEQ ID NO: 9088958 - DNA, 18 bp, Homo sapiens
tccagtcccagctctgcc

SEQ ID NO: 9088959 - DNA, 22 bp, Homo sapiens
tccagtccatggcctcagtctt

SEQ ID NO: 9088960 - DNA, 21 bp, Homo sapiens
tcccactgccacagcttcagg

SEQ ID NO: 9088961 - DNA, 22 bp, Homo sapiens
tcccagaaaaaggaggctatga

SEQ ID NO: 9088962 - DNA, 22 bp, Homo sapiens
tcccacttaactgtgacttctc

SEQ ID NO: 9088963 - DNA, 22 bp, Homo sapiens
tcccactgtgaatccaaggcct

SEQ ID NO: 9088964 - DNA, 22 bp, Homo sapiens
tcccactgtgaatccaaggcct

SEQ ID NO: 9088965 - DNA, 22 bp, Homo sapiens
tccagtgtggacccctgcagtc

SEQ ID NO: 9088966 - DNA, 22 bp, Homo sapiens
tcccacatgtgaatcctcaggt

SEQ ID NO: 9088967 - DNA, 22 bp, Homo sapiens
tccagttctaggtcactctctg

SEQ ID NO: 9088968 - DNA, 22 bp, Homo sapiens
tcccagagtgtgggcatcaagg

SEQ ID NO: 9088969 - DNA, 21 bp, Homo sapiens
tcccagagtgcttgggactgc

SEQ ID NO: 9088970 - DNA, 22 bp, Homo sapiens
tcccagagtgtgggcatcaagg

SEQ ID NO: 9088971 - DNA, 22 bp, Homo sapiens
tcccagagttcaatgggaaggt

SEQ ID NO: 9088972 - DNA, 22 bp, Homo sapiens
tcccagagtgtgggcatcaagg

SEQ ID NO: 9088973 - DNA, 22 bp, Homo sapiens
tcccagagtcagaggtggggcc

SEQ ID NO: 9088974 - DNA, 19 bp, Homo sapiens
tcccagagtctagaggttg

SEQ ID NO: 9088975 - DNA, 19 bp, Homo sapiens
tcccagagtctagaggttg

SEQ ID NO: 9088976 - DNA, 22 bp, Homo sapiens
tcccagagtcttctcctgtaat

SEQ ID NO: 9088977 - DNA, 22 bp, Homo sapiens
tcccagagtgagccaggggcag

SEQ ID NO: 9088978 - DNA, 22 bp, Homo sapiens
tcccagagaaagtcaaggtctt

SEQ ID NO: 9088979 - DNA, 22 bp, Homo sapiens
tcccagagaaagtcaaggtctt

SEQ ID NO: 9088980 - DNA, 22 bp, Homo sapiens
tcccagacaatcattggccacc

SEQ ID NO: 9088981 - DNA, 22 bp, Homo sapiens
tcccagctgtgtggaggagatg

SEQ ID NO: 9088982 - DNA, 22 bp, Homo sapiens
tcccagctgagattgagcaagg

SEQ ID NO: 9088983 - DNA, 22 bp, Homo sapiens
tcccagctactctagaggctga

SEQ ID NO: 9088984 - DNA, 22 bp, Homo sapiens
tcccagctactctagaggctga

SEQ ID NO: 9088985 - DNA, 22 bp, Homo sapiens
tcccagctcacatatggtaact

SEQ ID NO: 9088986 - DNA, 22 bp, Homo sapiens
tcccaggatctgagggcagaga

SEQ ID NO: 9088987 - DNA, 22 bp, Homo sapiens
tcccaggatgttggcggcaggt

SEQ ID NO: 9088988 - DNA, 22 bp, Homo sapiens
tcccagcagcatagctcagaat

SEQ ID NO: 9088989 - DNA, 22 bp, Homo sapiens
tcccagcagatgagctgaccta

SEQ ID NO: 9088990 - DNA, 22 bp, Homo sapiens
tcccagcagatgagctgaccta

SEQ ID NO: 9088991 - DNA, 22 bp, Homo sapiens
tcccagcagggccgaccagcct

SEQ ID NO: 9088992 - DNA, 22 bp, Homo sapiens
tcccagcaggagtccagttccc

SEQ ID NO: 9088993 - DNA, 22 bp, Homo sapiens
tcccagcagcatagctcagaat

SEQ ID NO: 9088994 - DNA, 22 bp, Homo sapiens
tcccagcctttcttttctgctg

SEQ ID NO: 9088995 - DNA, 22 bp, Homo sapiens
tcccagcctttcttttctgctg

SEQ ID NO: 9088996 - DNA, 22 bp, Homo sapiens
tcccagcctttcttttctgctg

SEQ ID NO: 9088997 - DNA, 22 bp, Homo sapiens
tcccagcagtcagagctatgtg

SEQ ID NO: 9088998 - DNA, 22 bp, Homo sapiens
tcccagcagtcagagctatgtg

SEQ ID NO: 9088999 - DNA, 22 bp, Homo sapiens
tcccagcagggccgaccagcct

SEQ ID NO: 9089000 - DNA, 22 bp, Homo sapiens
tcccagcagagccagcaagccg

SEQ ID NO: 9089001 - DNA, 22 bp, Homo sapiens
tcccagcactgtaattctttgg

SEQ ID NO: 9089002 - DNA, 22 bp, Homo sapiens
tcccagcagagccagcaagccg

SEQ ID NO: 9089003 - DNA, 22 bp, Homo sapiens
tcccagcacagggcagatgtga

SEQ ID NO: 9089004 - DNA, 22 bp, Homo sapiens
tcccagcacgtctgctgtttct

SEQ ID NO: 9089005 - DNA, 22 bp, Homo sapiens
tcccagcaagaaagggggtggc

SEQ ID NO: 9089006 - DNA, 22 bp, Homo sapiens
tcccagagtttcctgtgtccca

SEQ ID NO: 9089007 - DNA, 22 bp, Homo sapiens
tcccagattgttgatggcttaa

SEQ ID NO: 9089008 - DNA, 22 bp, Homo sapiens
tcaattactaaccaaataatgt

SEQ ID NO: 9089009 - DNA, 22 bp, Homo sapiens
tcaattactaaccaaataatgt

SEQ ID NO: 9089010 - DNA, 22 bp, Homo sapiens
tcaattatgccattgcaatatt

SEQ ID NO: 9089011 - DNA, 22 bp, Homo sapiens
tcaattcagtccaacagtaatt

SEQ ID NO: 9089012 - DNA, 22 bp, Homo sapiens
tcaattcagtccaacagtaatt

SEQ ID NO: 9089013 - DNA, 22 bp, Homo sapiens
tcaattctagtggagagagttt

SEQ ID NO: 9089014 - DNA, 22 bp, Homo sapiens
tcaattatttgatatgaaaggg

SEQ ID NO: 9089015 - DNA, 22 bp, Homo sapiens
tcaattcagactgagaaatgat

SEQ ID NO: 9089016 - DNA, 22 bp, Homo sapiens
tcaattcacagctctgctattt

SEQ ID NO: 9089017 - DNA, 22 bp, Homo sapiens
tcaattcaattgaacagttact

SEQ ID NO: 9089018 - DNA, 22 bp, Homo sapiens
tcaattcaacacatgcacattg

SEQ ID NO: 9089019 - DNA, 22 bp, Homo sapiens
tcacacagctagtaagggccga

SEQ ID NO: 9089020 - DNA, 21 bp, Homo sapiens
tcacacacgtttccaagggca

SEQ ID NO: 9089021 - DNA, 22 bp, Homo sapiens
tcacacagctgacagagccttt

SEQ ID NO: 9089022 - DNA, 22 bp, Homo sapiens
tcacacagggtcggaaagagtg

SEQ ID NO: 9089023 - DNA, 23 bp, Homo sapiens
tcacacagctggtcaggtacaga

SEQ ID NO: 9089024 - DNA, 23 bp, Homo sapiens
tcacacagctggtcaggtacaga

SEQ ID NO: 9089025 - DNA, 23 bp, Homo sapiens
tcacacagctggtcaggtacaga

SEQ ID NO: 9089026 - DNA, 21 bp, Homo sapiens
tcacacacgtttccaagggca

SEQ ID NO: 9089027 - DNA, 22 bp, Homo sapiens
tcacacacatggatagtatttt

SEQ ID NO: 9089028 - DNA, 22 bp, Homo sapiens
tcacacacatggatagtatttt

SEQ ID NO: 9089029 - DNA, 22 bp, Homo sapiens
tcacacacatttgctgtctgat

SEQ ID NO: 9089030 - DNA, 22 bp, Homo sapiens
tcacacacatttgctgtctgat

SEQ ID NO: 9089031 - DNA, 22 bp, Homo sapiens
tcacacacataatctaagatta

SEQ ID NO: 9089032 - DNA, 22 bp, Homo sapiens
tcaaaattctagggagaatggt

SEQ ID NO: 9089033 - DNA, 22 bp, Homo sapiens
tcaaaattctagggagaatggt

SEQ ID NO: 9089034 - DNA, 18 bp, Homo sapiens
tcaaaatatttctgtgga

SEQ ID NO: 9089035 - DNA, 22 bp, Homo sapiens
tcaaaattaaaccaacgtccag

SEQ ID NO: 9089036 - DNA, 20 bp, Homo sapiens
tcaaaataggtgtgggcgga

SEQ ID NO: 9089037 - DNA, 18 bp, Homo sapiens
tcaaaatatttctgtgga

SEQ ID NO: 9089038 - DNA, 22 bp, Homo sapiens
tcaaaagtggcctgtaaaatct

SEQ ID NO: 9089039 - DNA, 22 bp, Homo sapiens
tcaaaaatggtctttgagctgc

SEQ ID NO: 9089040 - DNA, 22 bp, Homo sapiens
tcaaaagacacaggaggctagt

SEQ ID NO: 9089041 - DNA, 23 bp, Homo sapiens
tcaaacatattgtgagacacagg

SEQ ID NO: 9089042 - DNA, 22 bp, Homo sapiens
tcaaacagaggaacaattgttt

SEQ ID NO: 9089043 - DNA, 22 bp, Homo sapiens
tcaaacataaaactaaatcgag

SEQ ID NO: 9089044 - DNA, 22 bp, Homo sapiens
tcaatacttaagcttaattcta

SEQ ID NO: 9089045 - DNA, 22 bp, Homo sapiens
tcaatacatacaatgtatagtg

SEQ ID NO: 9089046 - DNA, 22 bp, Homo sapiens
tcaaacctgctgtcttgttcat

SEQ ID NO: 9089047 - DNA, 22 bp, Homo sapiens
tcaatgattagagtttagtgtg

SEQ ID NO: 9089048 - DNA, 22 bp, Homo sapiens
tcaatgcaatcattggacaagt

SEQ ID NO: 9089049 - DNA, 22 bp, Homo sapiens
tcaatgcatgtgacaaagagta

SEQ ID NO: 9089050 - DNA, 19 bp, Homo sapiens
tcaatgcatgaaatcagcc

SEQ ID NO: 9089051 - DNA, 22 bp, Homo sapiens
tcacacagggttctggtctcat

SEQ ID NO: 9089052 - DNA, 22 bp, Homo sapiens
tcacacagtgagcggggctcag

SEQ ID NO: 9089053 - DNA, 22 bp, Homo sapiens
tcacacagtgagaaagtgcgga

SEQ ID NO: 9089054 - DNA, 22 bp, Homo sapiens
tcacacaggtttgcaatgattt

SEQ ID NO: 9089055 - DNA, 22 bp, Homo sapiens
tcacagaatgtctagcataatt

SEQ ID NO: 9089056 - DNA, 22 bp, Homo sapiens
tcacagaatgtcagagttgggg

SEQ ID NO: 9089057 - DNA, 22 bp, Homo sapiens
tcacagaatttttgcttccagt

SEQ ID NO: 9089058 - DNA, 22 bp, Homo sapiens
tcacagaatttttgcttccagt

SEQ ID NO: 9089059 - DNA, 22 bp, Homo sapiens
tcacagaatttttgcttccagt

SEQ ID NO: 9089060 - DNA, 22 bp, Homo sapiens
tcacagaattgacatgggaatc

SEQ ID NO: 9089061 - DNA, 18 bp, Homo sapiens
tcacagaatattgagtgg

SEQ ID NO: 9089062 - DNA, 20 bp, Homo sapiens
tcacagaatgcctgaagaag

SEQ ID NO: 9089063 - DNA, 22 bp, Homo sapiens
tcacagaatctctgataagtct

SEQ ID NO: 9089064 - DNA, 22 bp, Homo sapiens
tcacagaatagcactgtaagcg

SEQ ID NO: 9089065 - DNA, 22 bp, Homo sapiens
tcacagaataaattgagaagac

SEQ ID NO: 9089066 - DNA, 22 bp, Homo sapiens
tcacagacaccttggccacagt

SEQ ID NO: 9089067 - DNA, 18 bp, Homo sapiens
tcacagacagctgtcttt

SEQ ID NO: 9089068 - DNA, 19 bp, Homo sapiens
tcacagacagagcaatcac

SEQ ID NO: 9089069 - DNA, 22 bp, Homo sapiens
tcacagagaactataatccatc

SEQ ID NO: 9089070 - DNA, 22 bp, Homo sapiens
tcacagagaactataatccatc

SEQ ID NO: 9089071 - DNA, 22 bp, Homo sapiens
tcacagagaggttaagcagttg

SEQ ID NO: 9089072 - DNA, 22 bp, Homo sapiens
tcacagagaggttaagcagttg

SEQ ID NO: 9089073 - DNA, 22 bp, Homo sapiens
tcacagagatgaacttttgata

SEQ ID NO: 9089074 - DNA, 22 bp, Homo sapiens
tcacagagagtgacttgttgct

SEQ ID NO: 9089075 - DNA, 22 bp, Homo sapiens
tcacagcaaaagtgtgcagagc

SEQ ID NO: 9089076 - DNA, 22 bp, Homo sapiens
tcacagcaaaagtgtgcagagc

SEQ ID NO: 9089077 - DNA, 22 bp, Homo sapiens
tcacagagttaaaagtttcttt

SEQ ID NO: 9089078 - DNA, 23 bp, Homo sapiens
tcacagagcatactgcattttgc

SEQ ID NO: 9089079 - DNA, 21 bp, Homo sapiens
tcacagagccacagaattggt

SEQ ID NO: 9089080 - DNA, 23 bp, Homo sapiens
tcacagagcatactgcattttgc

SEQ ID NO: 9089081 - DNA, 21 bp, Homo sapiens
tcacagagccacagaattggt

SEQ ID NO: 9089082 - DNA, 23 bp, Homo sapiens
tcacagagcatactgcattttgc

SEQ ID NO: 9089083 - DNA, 22 bp, Homo sapiens
tcacagagcacgtatcatgcct

SEQ ID NO: 9089084 - DNA, 22 bp, Homo sapiens
tcacagagcacgtatcatgcct

SEQ ID NO: 9089085 - DNA, 20 bp, Homo sapiens
tcacagagtagccttgtctg

SEQ ID NO: 9089086 - DNA, 22 bp, Homo sapiens
tcacagagctcacagtttagca

SEQ ID NO: 9089087 - DNA, 21 bp, Homo sapiens
tcacagagccacagaattggt

SEQ ID NO: 9089088 - DNA, 22 bp, Homo sapiens
tcacagcagggtaacaggaaga

SEQ ID NO: 9089089 - DNA, 19 bp, Homo sapiens
tcacagcatctgtctgaac

SEQ ID NO: 9089090 - DNA, 22 bp, Homo sapiens
tcacagcctggacagttgcctg

SEQ ID NO: 9089091 - DNA, 22 bp, Homo sapiens
tcacagcctggtcactctgccc

SEQ ID NO: 9089092 - DNA, 22 bp, Homo sapiens
tcacagcctggtcactctgccc

SEQ ID NO: 9089093 - DNA, 22 bp, Homo sapiens
tcacagcctggacagttgcctg

SEQ ID NO: 9089094 - DNA, 22 bp, Homo sapiens
tcacatcaccctgctcttaatt

SEQ ID NO: 9089095 - DNA, 17 bp, Homo sapiens
tcacatcacacaagcaa

SEQ ID NO: 9089096 - DNA, 22 bp, Homo sapiens
tcacatatttaagaaagttaaa

SEQ ID NO: 9089097 - DNA, 22 bp, Homo sapiens
tcacatctccatgtgttgttca

SEQ ID NO: 9089098 - DNA, 20 bp, Homo sapiens
tcacatcctctcccaacatg

SEQ ID NO: 9089099 - DNA, 20 bp, Homo sapiens
tcacatcctctcccaacatg

SEQ ID NO: 9089100 - DNA, 22 bp, Homo sapiens
tcagagaattctcagatgactc

SEQ ID NO: 9089101 - DNA, 22 bp, Homo sapiens
tcagagacaccagagagctgtg

SEQ ID NO: 9089102 - DNA, 21 bp, Homo sapiens
tcagagaatggcctactctca

SEQ ID NO: 9089103 - DNA, 23 bp, Homo sapiens
tcagagaatggtatgcttttcct

SEQ ID NO: 9089104 - DNA, 22 bp, Homo sapiens
tcagagaatgtccttcttcatt

SEQ ID NO: 9089105 - DNA, 22 bp, Homo sapiens
tcagagaatccgtaagtcacaa

SEQ ID NO: 9089106 - DNA, 22 bp, Homo sapiens
tcagagaatccgtaagtcacaa

SEQ ID NO: 9089107 - DNA, 22 bp, Homo sapiens
tcagagaaggtaagtgacctgc

SEQ ID NO: 9089108 - DNA, 22 bp, Homo sapiens
tcagagaagtaaggtggggtgc

SEQ ID NO: 9089109 - DNA, 23 bp, Homo sapiens
tcagagaagttgtaggctgggga

SEQ ID NO: 9089110 - DNA, 22 bp, Homo sapiens
tcagaagcatgtggggagcctg

SEQ ID NO: 9089111 - DNA, 22 bp, Homo sapiens
tcagaagcaggagtgtgcacaa

SEQ ID NO: 9089112 - DNA, 22 bp, Homo sapiens
tcagaagcagatatttcaaaat

SEQ ID NO: 9089113 - DNA, 22 bp, Homo sapiens
tcagaagagctggtgctgcctg

SEQ ID NO: 9089114 - DNA, 22 bp, Homo sapiens
tcagaagactactaggacacat

SEQ ID NO: 9089115 - DNA, 22 bp, Homo sapiens
tcagaagcaaacatcactctag

SEQ ID NO: 9089116 - DNA, 22 bp, Homo sapiens
tcagaagaagagactccacagc

SEQ ID NO: 9089117 - DNA, 19 bp, Homo sapiens
tcagaactcagaatgtgta

SEQ ID NO: 9089118 - DNA, 22 bp, Homo sapiens
tcagaacattacattttgagct

SEQ ID NO: 9089119 - DNA, 22 bp, Homo sapiens
tcagaacatggcatgttccatc

SEQ ID NO: 9089120 - DNA, 22 bp, Homo sapiens
tcagaacattctcattgactgc

SEQ ID NO: 9089121 - DNA, 22 bp, Homo sapiens
tcagaacatgaaggttaatttg

SEQ ID NO: 9089122 - DNA, 22 bp, Homo sapiens
tcagaacatcctggtttaaaat

SEQ ID NO: 9089123 - DNA, 22 bp, Homo sapiens
tcagaacatttgggactttggg

SEQ ID NO: 9089124 - DNA, 22 bp, Homo sapiens
tcagaaccagcccagcagatga

SEQ ID NO: 9089125 - DNA, 22 bp, Homo sapiens
tcagaacctgcaagtctaacct

SEQ ID NO: 9089126 - DNA, 22 bp, Homo sapiens
tcagaactacatggacatgtta

SEQ ID NO: 9089127 - DNA, 22 bp, Homo sapiens
tcagaacattgacattcttatt

SEQ ID NO: 9089128 - DNA, 21 bp, Homo sapiens
tcagaggcactgagagcaatg

SEQ ID NO: 9089129 - DNA, 22 bp, Homo sapiens
tcagaggcatcattcatagtta

SEQ ID NO: 9089130 - DNA, 22 bp, Homo sapiens
tcagaggcctgaaagaatttgg

SEQ ID NO: 9089131 - DNA, 22 bp, Homo sapiens
tcagaggctacagtctgggagt

SEQ ID NO: 9089132 - DNA, 22 bp, Homo sapiens
tcagaggagaccaaggggaata

SEQ ID NO: 9089133 - DNA, 22 bp, Homo sapiens
tcagaggagaccaaggggaata

SEQ ID NO: 9089134 - DNA, 22 bp, Homo sapiens
tcagaggattgcctcagcgagc

SEQ ID NO: 9089135 - DNA, 19 bp, Homo sapiens
tcagaggatttggctatga

SEQ ID NO: 9089136 - DNA, 19 bp, Homo sapiens
tcagaggatttggctatga

SEQ ID NO: 9089137 - DNA, 19 bp, Homo sapiens
tcagaggatttggctatga

SEQ ID NO: 9089138 - DNA, 22 bp, Homo sapiens
tcagaggaccttactgagaacc

SEQ ID NO: 9089139 - DNA, 22 bp, Homo sapiens
tcagaggactaccttctccagt

SEQ ID NO: 9089140 - DNA, 22 bp, Homo sapiens
tcagaggagaagttgggaaaat

SEQ ID NO: 9089141 - DNA, 22 bp, Homo sapiens
tcagaggacgcactagggttgt

SEQ ID NO: 9089142 - DNA, 22 bp, Homo sapiens
tcagaggactaccttctccagt

SEQ ID NO: 9089143 - DNA, 22 bp, Homo sapiens
tcagaggagaccaaggggaata

SEQ ID NO: 9089144 - DNA, 22 bp, Homo sapiens
tcagaggagaagttgggaaaat

SEQ ID NO: 9089145 - DNA, 22 bp, Homo sapiens
tcagagactggtctgcagatgc

SEQ ID NO: 9089146 - DNA, 18 bp, Homo sapiens
tcagagagaatagtaatt

SEQ ID NO: 9089147 - DNA, 22 bp, Homo sapiens
tcagagactgtaggagcagcct

SEQ ID NO: 9089148 - DNA, 22 bp, Homo sapiens
tcagagagctggtgggcagagg

SEQ ID NO: 9089149 - DNA, 22 bp, Homo sapiens
tcagagagctggtgggcagagg

SEQ ID NO: 9089150 - DNA, 22 bp, Homo sapiens
tcagagagcctcaggcactgcc

SEQ ID NO: 9089151 - DNA, 22 bp, Homo sapiens
tcagagagcctcaggcactgcc

SEQ ID NO: 9089152 - DNA, 18 bp, Homo sapiens
tcagagagcagctttatt

SEQ ID NO: 9089153 - DNA, 20 bp, Homo sapiens
tcagagagagggtgccactt

SEQ ID NO: 9089154 - DNA, 22 bp, Homo sapiens
tcagagaggattttaataagtg

SEQ ID NO: 9089155 - DNA, 23 bp, Homo sapiens
tcagagagctgttgagagctgcc

SEQ ID NO: 9089156 - DNA, 23 bp, Homo sapiens
tcagagagctgttgagagctgcc

SEQ ID NO: 9089157 - DNA, 22 bp, Homo sapiens
tcagaggaataatgctgcattt

SEQ ID NO: 9089158 - DNA, 22 bp, Homo sapiens
tcagaggaataatgctgcattt

SEQ ID NO: 9089159 - DNA, 22 bp, Homo sapiens
tcagaggaagccttggtgggag

SEQ ID NO: 9089160 - DNA, 22 bp, Homo sapiens
tcagaggaagccttggtgggag

SEQ ID NO: 9089161 - DNA, 22 bp, Homo sapiens
tcagaggacaagctccctggtg

SEQ ID NO: 9089162 - DNA, 22 bp, Homo sapiens
tcagaggacagcagctaaataa

SEQ ID NO: 9089163 - DNA, 22 bp, Homo sapiens
tcagaggacaagctccctggtg

SEQ ID NO: 9089164 - DNA, 22 bp, Homo sapiens
tcagaggaccttactgagaacc

SEQ ID NO: 9089165 - DNA, 22 bp, Homo sapiens
tcagaggacagcagctaaataa

SEQ ID NO: 9089166 - DNA, 22 bp, Homo sapiens
tcagaggacagcagctaaataa

SEQ ID NO: 9089167 - DNA, 22 bp, Homo sapiens
tcacatgccctacctaatctta

SEQ ID NO: 9089168 - DNA, 22 bp, Homo sapiens
tcacatgccctacctaatctta

SEQ ID NO: 9089169 - DNA, 22 bp, Homo sapiens
tcacccaggtaatagcagtttg

SEQ ID NO: 9089170 - DNA, 22 bp, Homo sapiens
tcacatgccctgtatttaccag

SEQ ID NO: 9089171 - DNA, 18 bp, Homo sapiens
tcacatgacagctgttgc

SEQ ID NO: 9089172 - DNA, 22 bp, Homo sapiens
tcacctgggagggctgtggtag

SEQ ID NO: 9089173 - DNA, 22 bp, Homo sapiens
tcacctaattgaagtcaggagt

SEQ ID NO: 9089174 - DNA, 21 bp, Homo sapiens
tcacctggcttctgacctggc

SEQ ID NO: 9089175 - DNA, 22 bp, Homo sapiens
tcacctcttttttaacaggctt

SEQ ID NO: 9089176 - DNA, 21 bp, Homo sapiens
tcacgtggtcacatgagcttt

SEQ ID NO: 9089177 - DNA, 21 bp, Homo sapiens
tcacgtggtcacatgagcttt

SEQ ID NO: 9089178 - DNA, 22 bp, Homo sapiens
tcacgtgagggacctgtgtctg

SEQ ID NO: 9089179 - DNA, 22 bp, Homo sapiens
tcaccttgtgatctccctgcct

SEQ ID NO: 9089180 - DNA, 22 bp, Homo sapiens
tcaccccctgtattagtagcta

SEQ ID NO: 9089181 - DNA, 22 bp, Homo sapiens
tcaccgaggctggagtgcagtg

SEQ ID NO: 9089182 - DNA, 22 bp, Homo sapiens
tcaccgaggctggagtgcagtg

SEQ ID NO: 9089183 - DNA, 22 bp, Homo sapiens
tcactggtctttggcttctcag

SEQ ID NO: 9089184 - DNA, 22 bp, Homo sapiens
tcactggtgtgagaggagcaaa

SEQ ID NO: 9089185 - DNA, 22 bp, Homo sapiens
tcactggttagaagaagtaagc

SEQ ID NO: 9089186 - DNA, 22 bp, Homo sapiens
tcactgtaatttgtatctgtgg

SEQ ID NO: 9089187 - DNA, 22 bp, Homo sapiens
tcactgtagcctcaactcttgg

SEQ ID NO: 9089188 - DNA, 22 bp, Homo sapiens
tcactgtagcctcaacctttca

SEQ ID NO: 9089189 - DNA, 22 bp, Homo sapiens
tcactggggcctttggtcagga

SEQ ID NO: 9089190 - DNA, 22 bp, Homo sapiens
tcactggtgtgagaggagcaaa

SEQ ID NO: 9089191 - DNA, 22 bp, Homo sapiens
tcagaacagttcttaatattgc

SEQ ID NO: 9089192 - DNA, 22 bp, Homo sapiens
tcagaacagtgcctggcactaa

SEQ ID NO: 9089193 - DNA, 20 bp, Homo sapiens
tcagaacagtagaggagcta

SEQ ID NO: 9089194 - DNA, 22 bp, Homo sapiens
tcagaacatatattttgtgatg

SEQ ID NO: 9089195 - DNA, 22 bp, Homo sapiens
tcagaacatatattttgtgatg

SEQ ID NO: 9089196 - DNA, 22 bp, Homo sapiens
tcactggaaatgcacagctgta

SEQ ID NO: 9089197 - DNA, 21 bp, Homo sapiens
tcactggacgtgagccagggg

SEQ ID NO: 9089198 - DNA, 22 bp, Homo sapiens
tcactacaaccgctacctgaca

SEQ ID NO: 9089199 - DNA, 22 bp, Homo sapiens
tcactggatcctagctgagcct

SEQ ID NO: 9089200 - DNA, 22 bp, Homo sapiens
tcactgggagatgtgggaaggg

SEQ ID NO: 9089201 - DNA, 22 bp, Homo sapiens
tcactgggagagctgacaagga

SEQ ID NO: 9089202 - DNA, 22 bp, Homo sapiens
tcagagtcaactgttgcctgtt

SEQ ID NO: 9089203 - DNA, 22 bp, Homo sapiens
tcagaggtggtaaaggacagca

SEQ ID NO: 9089204 - DNA, 22 bp, Homo sapiens
tcagagtcctttggcctgacag

SEQ ID NO: 9089205 - DNA, 22 bp, Homo sapiens
tcagagtctgtgcattctgcta

SEQ ID NO: 9089206 - DNA, 22 bp, Homo sapiens
tcagccagggctctggcctcag

SEQ ID NO: 9089207 - DNA, 22 bp, Homo sapiens
tcagccagggctctggcctcag

SEQ ID NO: 9089208 - DNA, 22 bp, Homo sapiens
tcagccaggtaatgtggagatg

SEQ ID NO: 9089209 - DNA, 22 bp, Homo sapiens
tcagccagtatttgagtgctca

SEQ ID NO: 9089210 - DNA, 22 bp, Homo sapiens
tcagagtgcagggagtagcagc

SEQ ID NO: 9089211 - DNA, 22 bp, Homo sapiens
tcagccagggcagagcaggtga

SEQ ID NO: 9089212 - DNA, 17 bp, Homo sapiens
tcagagggatgagcagg

SEQ ID NO: 9089213 - DNA, 22 bp, Homo sapiens
tcagaggcttgaagcccaagcc

SEQ ID NO: 9089214 - DNA, 17 bp, Homo sapiens
tcagagggatgagcagg

SEQ ID NO: 9089215 - DNA, 22 bp, Homo sapiens
tcagaggcttccttcctcggag

SEQ ID NO: 9089216 - DNA, 22 bp, Homo sapiens
tcagaggcttctggccagtctg

SEQ ID NO: 9089217 - DNA, 20 bp, Homo sapiens
tcagaggctgccagctgggg

SEQ ID NO: 9089218 - DNA, 21 bp, Homo sapiens
tcagaggctgggggaatgccc

SEQ ID NO: 9089219 - DNA, 22 bp, Homo sapiens
tcagaggtggtaaaggacagca

SEQ ID NO: 9089220 - DNA, 22 bp, Homo sapiens
tcagaggtccctagcaggagtg

SEQ ID NO: 9089221 - DNA, 22 bp, Homo sapiens
tcagaggtgcaagaagttctga

SEQ ID NO: 9089222 - DNA, 22 bp, Homo sapiens
tcagaggtgcaagaagttctga

SEQ ID NO: 9089223 - DNA, 22 bp, Homo sapiens
tcagaggtaaaaactcactgta

SEQ ID NO: 9089224 - DNA, 22 bp, Homo sapiens
tcagaggtcacacagcaagttt

SEQ ID NO: 9089225 - DNA, 23 bp, Homo sapiens
tcagcttcattgtcttctatggc

SEQ ID NO: 9089226 - DNA, 18 bp, Homo sapiens
tcagcttccagcatgttt

SEQ ID NO: 9089227 - DNA, 23 bp, Homo sapiens
tcagcttcattgtcttctatggc

SEQ ID NO: 9089228 - DNA, 22 bp, Homo sapiens
tcagcttcacccagagttgtag

SEQ ID NO: 9089229 - DNA, 22 bp, Homo sapiens
tcagcttcaaatttggtgaagt

SEQ ID NO: 9089230 - DNA, 22 bp, Homo sapiens
tcagcttcaaatttggtgaagt

SEQ ID NO: 9089231 - DNA, 22 bp, Homo sapiens
tcagcttcagatcagctagaga

SEQ ID NO: 9089232 - DNA, 22 bp, Homo sapiens
tcagcttcagatcagctagaga

SEQ ID NO: 9089233 - DNA, 22 bp, Homo sapiens
tcagcctgcgtcatggtgacac

SEQ ID NO: 9089234 - DNA, 22 bp, Homo sapiens
tcagcttggacagcttggttga

SEQ ID NO: 9089235 - DNA, 22 bp, Homo sapiens
tcagcttggacagcttggttga

SEQ ID NO: 9089236 - DNA, 22 bp, Homo sapiens
tcagcttctttcacttaacatg

SEQ ID NO: 9089237 - DNA, 21 bp, Homo sapiens
tcagcttgaatctagagatag

SEQ ID NO: 9089238 - DNA, 19 bp, Homo sapiens
tcagcttctgtgtattgta

SEQ ID NO: 9089239 - DNA, 22 bp, Homo sapiens
tcagcttctccaagtgacatgg

SEQ ID NO: 9089240 - DNA, 22 bp, Homo sapiens
tcagcttctccaagtgacatgg

SEQ ID NO: 9089241 - DNA, 22 bp, Homo sapiens
tcagcttccctatctgaccata

SEQ ID NO: 9089242 - DNA, 22 bp, Homo sapiens
tcagcttcctctgtggttccag

SEQ ID NO: 9089243 - DNA, 22 bp, Homo sapiens
tcagcttctcaaaatggcttag

SEQ ID NO: 9089244 - DNA, 22 bp, Homo sapiens
tcagcttcctctgtggttccag

SEQ ID NO: 9089245 - DNA, 22 bp, Homo sapiens
tcagcttcgcctgaggtatggg

SEQ ID NO: 9089246 - DNA, 20 bp, Homo sapiens
tcagccattccttacctttc

SEQ ID NO: 9089247 - DNA, 22 bp, Homo sapiens
tcagccagtttgtttattccgg

SEQ ID NO: 9089248 - DNA, 22 bp, Homo sapiens
tcagcctcaggtgttcagattt

SEQ ID NO: 9089249 - DNA, 22 bp, Homo sapiens
tcagcctacactccaacagcat

SEQ ID NO: 9089250 - DNA, 22 bp, Homo sapiens
tcagcccttcctggagctttta

SEQ ID NO: 9089251 - DNA, 22 bp, Homo sapiens
tcagcccttgatgtttgggggt

SEQ ID NO: 9089252 - DNA, 22 bp, Homo sapiens
tcagcctccgaaagtgctggga

SEQ ID NO: 9089253 - DNA, 22 bp, Homo sapiens
tcagcctctctgagtccagacc

SEQ ID NO: 9089254 - DNA, 22 bp, Homo sapiens
tcaggagctgtgaatacaaagg

SEQ ID NO: 9089255 - DNA, 22 bp, Homo sapiens
tcaggagctcaggctgatggaa

SEQ ID NO: 9089256 - DNA, 22 bp, Homo sapiens
tcaggagctatggactgtcaaa

SEQ ID NO: 9089257 - DNA, 22 bp, Homo sapiens
tcaggagctatggactgtcaaa

SEQ ID NO: 9089258 - DNA, 22 bp, Homo sapiens
tcaggagctcttccctggtgtg

SEQ ID NO: 9089259 - DNA, 22 bp, Homo sapiens
tcaggagcagggggaagctctg

SEQ ID NO: 9089260 - DNA, 22 bp, Homo sapiens
tcaggagcagctgtaggaaggg

SEQ ID NO: 9089261 - DNA, 22 bp, Homo sapiens
tcaggagcagggtctgttacca

SEQ ID NO: 9089262 - DNA, 22 bp, Homo sapiens
tcaggagcagggggaagctctg

SEQ ID NO: 9089263 - DNA, 20 bp, Homo sapiens
tcaggagcctaggacatgat

SEQ ID NO: 9089264 - DNA, 22 bp, Homo sapiens
tcaggagggctaagactgtagc

SEQ ID NO: 9089265 - DNA, 22 bp, Homo sapiens
tcaggaggacagataaggatag

SEQ ID NO: 9089266 - DNA, 22 bp, Homo sapiens
tcaggaggatgtcggcaaattt

SEQ ID NO: 9089267 - DNA, 22 bp, Homo sapiens
tcaggaaagcctagaagagaac

SEQ ID NO: 9089268 - DNA, 22 bp, Homo sapiens
tcaggaaagagttagatgatta

SEQ ID NO: 9089269 - DNA, 22 bp, Homo sapiens
tcaggaaagcctagaagagaac

SEQ ID NO: 9089270 - DNA, 22 bp, Homo sapiens
tcaggaaagcctagaagagaac

SEQ ID NO: 9089271 - DNA, 22 bp, Homo sapiens
tcaggaaaggtttgttgaatgg

SEQ ID NO: 9089272 - DNA, 22 bp, Homo sapiens
tcaggaaaggcagagtgtctgt

SEQ ID NO: 9089273 - DNA, 22 bp, Homo sapiens
tcaggaaaggcagagtgtctgt

SEQ ID NO: 9089274 - DNA, 22 bp, Homo sapiens
tcaggaaaggcagagtgtctgt

SEQ ID NO: 9089275 - DNA, 22 bp, Homo sapiens
tcaggaaagctgcggtcacctg

SEQ ID NO: 9089276 - DNA, 22 bp, Homo sapiens
tcaggaaagctgcggtcacctg

SEQ ID NO: 9089277 - DNA, 22 bp, Homo sapiens
tcaggaaaggcagagtgtctgt

SEQ ID NO: 9089278 - DNA, 22 bp, Homo sapiens
tcaggaaatacaagtgacatca

SEQ ID NO: 9089279 - DNA, 22 bp, Homo sapiens
tcaggaaatacaagtgacatca

SEQ ID NO: 9089280 - DNA, 22 bp, Homo sapiens
tcaggaaatacaagtgacatca

SEQ ID NO: 9089281 - DNA, 22 bp, Homo sapiens
tcaggaaatacaagtgacatca

SEQ ID NO: 9089282 - DNA, 22 bp, Homo sapiens
tcaggaaatggaattcttgtgt

SEQ ID NO: 9089283 - DNA, 22 bp, Homo sapiens
tcaggaaagtgttctcagagga

SEQ ID NO: 9089284 - DNA, 22 bp, Homo sapiens
tcaggaaagtgttctcagagga

SEQ ID NO: 9089285 - DNA, 22 bp, Homo sapiens
tcaggaaaggtttgttgaatgg

SEQ ID NO: 9089286 - DNA, 22 bp, Homo sapiens
tcaggaaagtgttctcagagga

SEQ ID NO: 9089287 - DNA, 22 bp, Homo sapiens
tcaggaaagtgttctcagagga

SEQ ID NO: 9089288 - DNA, 22 bp, Homo sapiens
tcaggaaagagtaatgtataca

SEQ ID NO: 9089289 - DNA, 22 bp, Homo sapiens
tcaggaaagagtgtatccatca

SEQ ID NO: 9089290 - DNA, 22 bp, Homo sapiens
tcaggaaagagtgtatccatca

SEQ ID NO: 9089291 - DNA, 22 bp, Homo sapiens
tcaggaaagagttagatgatta

SEQ ID NO: 9089292 - DNA, 22 bp, Homo sapiens
tcaggaaagagttagatgatta

SEQ ID NO: 9089293 - DNA, 22 bp, Homo sapiens
tcaggaaagagttagatgatta

SEQ ID NO: 9089294 - DNA, 22 bp, Homo sapiens
tcaggaaagagttagatgatta

SEQ ID NO: 9089295 - DNA, 22 bp, Homo sapiens
tcaggagcaacatctttgaatc

SEQ ID NO: 9089296 - DNA, 22 bp, Homo sapiens
tcaggagcagcatgggtgagag

SEQ ID NO: 9089297 - DNA, 22 bp, Homo sapiens
tcaggagcagccttggagagcg

SEQ ID NO: 9089298 - DNA, 22 bp, Homo sapiens
tcaggaaattaaacacttgaaa

SEQ ID NO: 9089299 - DNA, 22 bp, Homo sapiens
tcaggaaatgtcccaggttgtg

SEQ ID NO: 9089300 - DNA, 22 bp, Homo sapiens
tcaggagagtgttcagtggagg

SEQ ID NO: 9089301 - DNA, 22 bp, Homo sapiens
tcaggaaattaaacacttgaaa

SEQ ID NO: 9089302 - DNA, 22 bp, Homo sapiens
tcaggaaatggtgatttggttg

SEQ ID NO: 9089303 - DNA, 22 bp, Homo sapiens
tcaggaaatgtcccaggttgtg

SEQ ID NO: 9089304 - DNA, 22 bp, Homo sapiens
tcaggaaatgtcccaggttgtg

SEQ ID NO: 9089305 - DNA, 22 bp, Homo sapiens
tcaggaaatggacatctttgct

SEQ ID NO: 9089306 - DNA, 22 bp, Homo sapiens
tcaggaaatggaattcttgtgt

SEQ ID NO: 9089307 - DNA, 22 bp, Homo sapiens
tcaggaaatggacatctttgct

SEQ ID NO: 9089308 - DNA, 22 bp, Homo sapiens
tcaggaaatggacatctttgct

SEQ ID NO: 9089309 - DNA, 22 bp, Homo sapiens
tcaggaaatggacatctttgct

SEQ ID NO: 9089310 - DNA, 22 bp, Homo sapiens
tcaggaaatggcttcatggttt

SEQ ID NO: 9089311 - DNA, 22 bp, Homo sapiens
tcaggaaatggcttcatggttt

SEQ ID NO: 9089312 - DNA, 22 bp, Homo sapiens
tcaggcaggctcagaggaaaac

SEQ ID NO: 9089313 - DNA, 22 bp, Homo sapiens
tcaggcaggctcagaggaaaac

SEQ ID NO: 9089314 - DNA, 21 bp, Homo sapiens
tcaggcaggcgcagagggaag

SEQ ID NO: 9089315 - DNA, 22 bp, Homo sapiens
tcaggcaggctcagaggaaaac

SEQ ID NO: 9089316 - DNA, 22 bp, Homo sapiens
tcaggcaggctcagaggaaaac

SEQ ID NO: 9089317 - DNA, 21 bp, Homo sapiens
tcaggcaggtcccactgaaca

SEQ ID NO: 9089318 - DNA, 22 bp, Homo sapiens
tcaggcaggtggctggctatgg

SEQ ID NO: 9089319 - DNA, 22 bp, Homo sapiens
tcaggcaggtggctggctatgg

SEQ ID NO: 9089320 - DNA, 22 bp, Homo sapiens
tcaggccttgtcctgacctcct

SEQ ID NO: 9089321 - DNA, 22 bp, Homo sapiens
tcaggcaggttggctgcaggtc

SEQ ID NO: 9089322 - DNA, 22 bp, Homo sapiens
tcaggccttgtcctgacctcct

SEQ ID NO: 9089323 - DNA, 22 bp, Homo sapiens
tcaggccttgtcctgacctcct

SEQ ID NO: 9089324 - DNA, 22 bp, Homo sapiens
tcaggcaggttggctgcaggtc

SEQ ID NO: 9089325 - DNA, 22 bp, Homo sapiens
tcaggcaggatcccagggaagg

SEQ ID NO: 9089326 - DNA, 22 bp, Homo sapiens
tcaggcaggatcccagggaagg

SEQ ID NO: 9089327 - DNA, 22 bp, Homo sapiens
tcaggcaggcagagggcaaatg

SEQ ID NO: 9089328 - DNA, 22 bp, Homo sapiens
tcaggcaggcagagggcaaatg

SEQ ID NO: 9089329 - DNA, 22 bp, Homo sapiens
tcaggcaggatcccagggaagg

SEQ ID NO: 9089330 - DNA, 21 bp, Homo sapiens
tcaggcaggcgcagagggaag

SEQ ID NO: 9089331 - DNA, 21 bp, Homo sapiens
tcaggcaggcgcagagggaag

SEQ ID NO: 9089332 - DNA, 22 bp, Homo sapiens
tcaggcaccctctattttcatc

SEQ ID NO: 9089333 - DNA, 22 bp, Homo sapiens
tcaggcactggctgagtgatgg

SEQ ID NO: 9089334 - DNA, 22 bp, Homo sapiens
tcaggcactgctttctgatatg

SEQ ID NO: 9089335 - DNA, 22 bp, Homo sapiens
tcaggcagatgcagggatggat

SEQ ID NO: 9089336 - DNA, 22 bp, Homo sapiens
tcaggcagatgcagggatggat

SEQ ID NO: 9089337 - DNA, 22 bp, Homo sapiens
tcaggcagatgcagggatggat

SEQ ID NO: 9089338 - DNA, 22 bp, Homo sapiens
tcaggcagcattaaacttcagc

SEQ ID NO: 9089339 - DNA, 22 bp, Homo sapiens
tcaggcagctccaggaatggta

SEQ ID NO: 9089340 - DNA, 22 bp, Homo sapiens
tcaggcagctccaggaatggta

SEQ ID NO: 9089341 - DNA, 22 bp, Homo sapiens
tcaggcaggaagcccctgcaca

SEQ ID NO: 9089342 - DNA, 23 bp, Homo sapiens
tcaggcagctggggtagttggag

SEQ ID NO: 9089343 - DNA, 22 bp, Homo sapiens
tcaggcaccccttgagtagggg

SEQ ID NO: 9089344 - DNA, 22 bp, Homo sapiens
tcaggaggtaggacatactggt

SEQ ID NO: 9089345 - DNA, 22 bp, Homo sapiens
tcaggaggtccgcccgggaggg

SEQ ID NO: 9089346 - DNA, 22 bp, Homo sapiens
tcaggggcttgaggtgcatgtc

SEQ ID NO: 9089347 - DNA, 22 bp, Homo sapiens
tcaggggcttgaggtgcatgtc

SEQ ID NO: 9089348 - DNA, 22 bp, Homo sapiens
tcaggggcagccggggaagcca

SEQ ID NO: 9089349 - DNA, 22 bp, Homo sapiens
tcagggctgccgggcagaccgt

SEQ ID NO: 9089350 - DNA, 22 bp, Homo sapiens
tcaggtcttttgtctcctagaa

SEQ ID NO: 9089351 - DNA, 22 bp, Homo sapiens
tcaggtcttttgtctcctagaa

SEQ ID NO: 9089352 - DNA, 22 bp, Homo sapiens
tcaggtcttgagccatcaggat

SEQ ID NO: 9089353 - DNA, 22 bp, Homo sapiens
tcaggtctgggcacatggtaca

SEQ ID NO: 9089354 - DNA, 22 bp, Homo sapiens
tcaggtctgatgcctcatccat

SEQ ID NO: 9089355 - DNA, 22 bp, Homo sapiens
tcaggtctgtactattgtcttg

SEQ ID NO: 9089356 - DNA, 22 bp, Homo sapiens
tcaggtctgtactattgtcttg

SEQ ID NO: 9089357 - DNA, 22 bp, Homo sapiens
tcaggtctatagaagaggaggg

SEQ ID NO: 9089358 - DNA, 22 bp, Homo sapiens
tcaggtctatactatgagaggc

SEQ ID NO: 9089359 - DNA, 22 bp, Homo sapiens
tcagtgcagtgaaaggtttact

SEQ ID NO: 9089360 - DNA, 22 bp, Homo sapiens
tcagtgcagtgaaaggtttact

SEQ ID NO: 9089361 - DNA, 22 bp, Homo sapiens
tcagtgcatcacagaactttgt

SEQ ID NO: 9089362 - DNA, 22 bp, Homo sapiens
tcagtgcatggacagatttaga

SEQ ID NO: 9089363 - DNA, 22 bp, Homo sapiens
tcagtgcattcatgggtggctg

SEQ ID NO: 9089364 - DNA, 22 bp, Homo sapiens
tcagtgcattaataatatcagt

SEQ ID NO: 9089365 - DNA, 22 bp, Homo sapiens
tcagggtaaaccttcactgtga

SEQ ID NO: 9089366 - DNA, 22 bp, Homo sapiens
tcagggtcaggacccagctgtt

SEQ ID NO: 9089367 - DNA, 22 bp, Homo sapiens
tcagggactgcagagggaagct

SEQ ID NO: 9089368 - DNA, 22 bp, Homo sapiens
tcaggctgaggtcatctgcatc

SEQ ID NO: 9089369 - DNA, 22 bp, Homo sapiens
tcaggctgaggtcatctgcatc

SEQ ID NO: 9089370 - DNA, 22 bp, Homo sapiens
tcaggctgaggtcatctgcatc

SEQ ID NO: 9089371 - DNA, 22 bp, Homo sapiens
tcaggctgaccaggttttgctc

SEQ ID NO: 9089372 - DNA, 22 bp, Homo sapiens
tcaggctgagaaaatctggacc

SEQ ID NO: 9089373 - DNA, 22 bp, Homo sapiens
tcaggctgagaaaatctggacc

SEQ ID NO: 9089374 - DNA, 22 bp, Homo sapiens
tcagggcaagtctcagaaggtt

SEQ ID NO: 9089375 - DNA, 22 bp, Homo sapiens
tcaggctctgccacctagatta

SEQ ID NO: 9089376 - DNA, 22 bp, Homo sapiens
tcaggctctcagaccaacagca

SEQ ID NO: 9089377 - DNA, 22 bp, Homo sapiens
tcaggctgaaaggactccagtt

SEQ ID NO: 9089378 - DNA, 22 bp, Homo sapiens
tcaggctgaaaggactccagtt

SEQ ID NO: 9089379 - DNA, 22 bp, Homo sapiens
tcaggctgaatcatcctagctt

SEQ ID NO: 9089380 - DNA, 22 bp, Homo sapiens
tcaggctgaaggaggcctatct

SEQ ID NO: 9089381 - DNA, 22 bp, Homo sapiens
tcaggcctttcttcagagcttc

SEQ ID NO: 9089382 - DNA, 22 bp, Homo sapiens
tcaggcctttgaacttggagtg

SEQ ID NO: 9089383 - DNA, 22 bp, Homo sapiens
tcaggcctttcttcagagcttc

SEQ ID NO: 9089384 - DNA, 22 bp, Homo sapiens
tcaggctagcccagtgcttggg

SEQ ID NO: 9089385 - DNA, 22 bp, Homo sapiens
tcaggctccctgctgggctctg

SEQ ID NO: 9089386 - DNA, 22 bp, Homo sapiens
tcaggctccctgctgggctctg

SEQ ID NO: 9089387 - DNA, 22 bp, Homo sapiens
tcaggctcaggttaggggccaa

SEQ ID NO: 9089388 - DNA, 20 bp, Homo sapiens
tcatggctgctgagaggttc

SEQ ID NO: 9089389 - DNA, 22 bp, Homo sapiens
tcatctctccccagtgtcttta

SEQ ID NO: 9089390 - DNA, 22 bp, Homo sapiens
tcatctctagacaggaggctgg

SEQ ID NO: 9089391 - DNA, 22 bp, Homo sapiens
tcatctcagagaggtatgttag

SEQ ID NO: 9089392 - DNA, 22 bp, Homo sapiens
tcatccttttgcatgggaaggc

SEQ ID NO: 9089393 - DNA, 22 bp, Homo sapiens
tcatctaagagtcttacattta

SEQ ID NO: 9089394 - DNA, 22 bp, Homo sapiens
tcatcctgaagaacctgcttcc

SEQ ID NO: 9089395 - DNA, 22 bp, Homo sapiens
tcatcatgtttgatttccacag

SEQ ID NO: 9089396 - DNA, 20 bp, Homo sapiens
tcatccaggacaggagtggc

SEQ ID NO: 9089397 - DNA, 20 bp, Homo sapiens
tcatccaggacaggagtggc

SEQ ID NO: 9089398 - DNA, 22 bp, Homo sapiens
tcatccagcctcatcaggagct

SEQ ID NO: 9089399 - DNA, 20 bp, Homo sapiens
tcataaagaggaaataaata

SEQ ID NO: 9089400 - DNA, 22 bp, Homo sapiens
tcataaagatactaagtgagtt

SEQ ID NO: 9089401 - DNA, 22 bp, Homo sapiens
tcataaagctcttccaaatgta

SEQ ID NO: 9089402 - DNA, 22 bp, Homo sapiens
tcataaaatgctcctgatattg

SEQ ID NO: 9089403 - DNA, 22 bp, Homo sapiens
tcataaaatgctcctgatattg

SEQ ID NO: 9089404 - DNA, 22 bp, Homo sapiens
tcataaaatgctcctgatattg

SEQ ID NO: 9089405 - DNA, 22 bp, Homo sapiens
tcagtgcttgcctctggaggag

SEQ ID NO: 9089406 - DNA, 22 bp, Homo sapiens
tcagtgcttttgagaagctcct

SEQ ID NO: 9089407 - DNA, 22 bp, Homo sapiens
tcagtggaactgtctgggtgag

SEQ ID NO: 9089408 - DNA, 22 bp, Homo sapiens
tcagtgcttatattctgagcct

SEQ ID NO: 9089409 - DNA, 22 bp, Homo sapiens
tcagtgcattaataatatcagt

SEQ ID NO: 9089410 - DNA, 22 bp, Homo sapiens
tcagtgcttcggcgagcaccta

SEQ ID NO: 9089411 - DNA, 22 bp, Homo sapiens
tcagtgcttgacagctctggga

SEQ ID NO: 9089412 - DNA, 22 bp, Homo sapiens
tcagttacctgacagtggttat

SEQ ID NO: 9089413 - DNA, 22 bp, Homo sapiens
tcagttagggcctcagaagaca

SEQ ID NO: 9089414 - DNA, 22 bp, Homo sapiens
tcagttttctcatttatgagat

SEQ ID NO: 9089415 - DNA, 22 bp, Homo sapiens
gtaaattatttcaagatcatct

SEQ ID NO: 9089416 - DNA, 22 bp, Homo sapiens
ggtgggcagctcttggcaggca

SEQ ID NO: 9089417 - DNA, 22 bp, Homo sapiens
gtaaatattccctcggttccta

SEQ ID NO: 9089418 - DNA, 22 bp, Homo sapiens
ggtgggcacattcagtctctgt

SEQ ID NO: 9089419 - DNA, 22 bp, Homo sapiens
ggtgggcacccgagactggatc

SEQ ID NO: 9089420 - DNA, 20 bp, Homo sapiens
gtaatgaatgtaaacagtaa

SEQ ID NO: 9089421 - DNA, 22 bp, Homo sapiens
gtaatctcagctacttgggagg

SEQ ID NO: 9089422 - DNA, 22 bp, Homo sapiens
gtaatagtctcaaactcctgga

SEQ ID NO: 9089423 - DNA, 22 bp, Homo sapiens
gtaacattattcatgagataca

SEQ ID NO: 9089424 - DNA, 22 bp, Homo sapiens
gtaacattattcatgagataca

SEQ ID NO: 9089425 - DNA, 22 bp, Homo sapiens
gtaaggttaccaggttttgaga

SEQ ID NO: 9089426 - DNA, 22 bp, Homo sapiens
gtaacaaaggataacttggttt

SEQ ID NO: 9089427 - DNA, 22 bp, Homo sapiens
gtagcttccagaaagtgtcttt

SEQ ID NO: 9089428 - DNA, 22 bp, Homo sapiens
gtaggaagctctgaggctagtt

SEQ ID NO: 9089429 - DNA, 22 bp, Homo sapiens
gtagctgcatattttcttagaa

SEQ ID NO: 9089430 - DNA, 22 bp, Homo sapiens
gtagctgatcctgaggacaggg

SEQ ID NO: 9089431 - DNA, 22 bp, Homo sapiens
gtagcttcaagtactctccctg

SEQ ID NO: 9089432 - DNA, 22 bp, Homo sapiens
gtagctctgtttaaagttcttt

SEQ ID NO: 9089433 - DNA, 22 bp, Homo sapiens
gtagctctgtttaaagttcttt

SEQ ID NO: 9089434 - DNA, 22 bp, Homo sapiens
gtagctccccatgtctgttgca

SEQ ID NO: 9089435 - DNA, 22 bp, Homo sapiens
gtcaacagtattaggacatttg

SEQ ID NO: 9089436 - DNA, 22 bp, Homo sapiens
gtcaacttatctctttatctgt

SEQ ID NO: 9089437 - DNA, 22 bp, Homo sapiens
gtcaacatttactgccctggcc

SEQ ID NO: 9089438 - DNA, 22 bp, Homo sapiens
gtcaacatgttctgggtgaatg

SEQ ID NO: 9089439 - DNA, 22 bp, Homo sapiens
gtcaagatgagaattcttttta

SEQ ID NO: 9089440 - DNA, 22 bp, Homo sapiens
gtcaagcagaagataatttaaa

SEQ ID NO: 9089441 - DNA, 20 bp, Homo sapiens
gtcaagtccctggggcagct

SEQ ID NO: 9089442 - DNA, 22 bp, Homo sapiens
gtcaagtcatgactcaaaggaa

SEQ ID NO: 9089443 - DNA, 22 bp, Homo sapiens
gtcaataattgatagatattgg

SEQ ID NO: 9089444 - DNA, 22 bp, Homo sapiens
gtcaataattttatggagagaa

SEQ ID NO: 9089445 - DNA, 22 bp, Homo sapiens
gtcaataattgatagatattgg

SEQ ID NO: 9089446 - DNA, 22 bp, Homo sapiens
gtagaggggtgattctgtgaga

SEQ ID NO: 9089447 - DNA, 22 bp, Homo sapiens
gtagatgagctcacatgacctt

SEQ ID NO: 9089448 - DNA, 22 bp, Homo sapiens
gtagaggacatttgacatgatg

SEQ ID NO: 9089449 - DNA, 22 bp, Homo sapiens
gtagcagcagagcaggtcctcc

SEQ ID NO: 9089450 - DNA, 22 bp, Homo sapiens
gtagcagctctgagcatgctgc

SEQ ID NO: 9089451 - DNA, 22 bp, Homo sapiens
gtagcagctctccagggttcac

SEQ ID NO: 9089452 - DNA, 22 bp, Homo sapiens
gtagattccagtggtctgtgtc

SEQ ID NO: 9089453 - DNA, 22 bp, Homo sapiens
gtagcaaagggacggctctaga

SEQ ID NO: 9089454 - DNA, 22 bp, Homo sapiens
gtagcagcttcagcccaaatta

SEQ ID NO: 9089455 - DNA, 22 bp, Homo sapiens
gtagccagatctgctgtgtctg

SEQ ID NO: 9089456 - DNA, 22 bp, Homo sapiens
gtagcccacctggggagggcga

SEQ ID NO: 9089457 - DNA, 22 bp, Homo sapiens
gtagcccacctggggagggcga

SEQ ID NO: 9089458 - DNA, 22 bp, Homo sapiens
gtcagtgcttgaagggcagaga

SEQ ID NO: 9089459 - DNA, 20 bp, Homo sapiens
gtcagtgtcttcagtagtga

SEQ ID NO: 9089460 - DNA, 22 bp, Homo sapiens
gtcagtgtcttaacagagatta

SEQ ID NO: 9089461 - DNA, 22 bp, Homo sapiens
gtcaggggccatgggccaagga

SEQ ID NO: 9089462 - DNA, 22 bp, Homo sapiens
gtcagtaggaacctagggtcaa

SEQ ID NO: 9089463 - DNA, 22 bp, Homo sapiens
gtcaggggatgtgctggtggcc

SEQ ID NO: 9089464 - DNA, 22 bp, Homo sapiens
gtcagtgtgagttgattccata

SEQ ID NO: 9089465 - DNA, 22 bp, Homo sapiens
gtcattatttaatgtaggctaa

SEQ ID NO: 9089466 - DNA, 22 bp, Homo sapiens
gtcattattctgggattctata

SEQ ID NO: 9089467 - DNA, 22 bp, Homo sapiens
gtcattcaactgcacattaggt

SEQ ID NO: 9089468 - DNA, 22 bp, Homo sapiens
gtcattcagagatgcaggtaga

SEQ ID NO: 9089469 - DNA, 22 bp, Homo sapiens
gtcacaggtgtggaggtgctgg

SEQ ID NO: 9089470 - DNA, 22 bp, Homo sapiens
gtcaatatattctgtctctttg

SEQ ID NO: 9089471 - DNA, 22 bp, Homo sapiens
gtcaattagtggcaatttcata

SEQ ID NO: 9089472 - DNA, 22 bp, Homo sapiens
gtcaatcagaaatcatgttaca

SEQ ID NO: 9089473 - DNA, 17 bp, Homo sapiens
gtcaatattgttgacag

SEQ ID NO: 9089474 - DNA, 22 bp, Homo sapiens
gtcaattagctaaaatttggta

SEQ ID NO: 9089475 - DNA, 22 bp, Homo sapiens
gtcaatatcttggttgtactat

SEQ ID NO: 9089476 - DNA, 21 bp, Homo sapiens
gtcagggattcaagtgctcac

SEQ ID NO: 9089477 - DNA, 22 bp, Homo sapiens
gtcagggatccactgctcttct

SEQ ID NO: 9089478 - DNA, 22 bp, Homo sapiens
gtcctcagagtgggcaggtcct

SEQ ID NO: 9089479 - DNA, 22 bp, Homo sapiens
gtcctcagagtgggcaggtcct

SEQ ID NO: 9089480 - DNA, 22 bp, Homo sapiens
gtcctcagggagtcccagtcat

SEQ ID NO: 9089481 - DNA, 22 bp, Homo sapiens
gtcctcagtaagagggcctctg

SEQ ID NO: 9089482 - DNA, 22 bp, Homo sapiens
gtcctcagggaatgtggcgggt

SEQ ID NO: 9089483 - DNA, 22 bp, Homo sapiens
gtcctcagggaatgtggcgggt

SEQ ID NO: 9089484 - DNA, 21 bp, Homo sapiens
gtcctcagctgatgggagctg

SEQ ID NO: 9089485 - DNA, 22 bp, Homo sapiens
gtcctcaggcttgagtgtttat

SEQ ID NO: 9089486 - DNA, 22 bp, Homo sapiens
gtccctggatctgggacagctg

SEQ ID NO: 9089487 - DNA, 22 bp, Homo sapiens
gtccctggatctgggacagctg

SEQ ID NO: 9089488 - DNA, 22 bp, Homo sapiens
gtccctggatctgggacagctg

SEQ ID NO: 9089489 - DNA, 22 bp, Homo sapiens
gtccctggagctgagcagtgct

SEQ ID NO: 9089490 - DNA, 22 bp, Homo sapiens
gtccctggatctgggacagctg

SEQ ID NO: 9089491 - DNA, 22 bp, Homo sapiens
gtccctggagctgagcagtgct

SEQ ID NO: 9089492 - DNA, 22 bp, Homo sapiens
gtcctctgatttctaggtatat

SEQ ID NO: 9089493 - DNA, 22 bp, Homo sapiens
gtcctctgactcagccttggga

SEQ ID NO: 9089494 - DNA, 22 bp, Homo sapiens
gtcctctgagggggctgcacgc

SEQ ID NO: 9089495 - DNA, 22 bp, Homo sapiens
gtcctctccaggaggctctgat

SEQ ID NO: 9089496 - DNA, 22 bp, Homo sapiens
gtcctcagtcagtttggtgggg

SEQ ID NO: 9089497 - DNA, 22 bp, Homo sapiens
gtcctcagtcagtttggtgggg

SEQ ID NO: 9089498 - DNA, 22 bp, Homo sapiens
gtcctccatggtcttgaagtaa

SEQ ID NO: 9089499 - DNA, 22 bp, Homo sapiens
gtctcctccagtaggaagtggc

SEQ ID NO: 9089500 - DNA, 22 bp, Homo sapiens
gtctcctccatggagatggtat

SEQ ID NO: 9089501 - DNA, 22 bp, Homo sapiens
gtctcctccctttcattcacct

SEQ ID NO: 9089502 - DNA, 20 bp, Homo sapiens
gtctcctctttgcattccta

SEQ ID NO: 9089503 - DNA, 22 bp, Homo sapiens
gtctcctcttcatatacctgtt

SEQ ID NO: 9089504 - DNA, 22 bp, Homo sapiens
gtctcctaaaccatcctggtac

SEQ ID NO: 9089505 - DNA, 22 bp, Homo sapiens
gtgccctgcatgccccgggtat

SEQ ID NO: 9089506 - DNA, 22 bp, Homo sapiens
gtgccctggaggggttgaaggg

SEQ ID NO: 9089507 - DNA, 22 bp, Homo sapiens
gtgccctggatgactttggtct

SEQ ID NO: 9089508 - DNA, 22 bp, Homo sapiens
gtgccctgatgcaattgtctca

SEQ ID NO: 9089509 - DNA, 22 bp, Homo sapiens
gtgccctgatgcaattgtctca

SEQ ID NO: 9089510 - DNA, 22 bp, Homo sapiens
gtgccctgatcgctaggctccc

SEQ ID NO: 9089511 - DNA, 22 bp, Homo sapiens
gtgccctgatcgctaggctccc

SEQ ID NO: 9089512 - DNA, 22 bp, Homo sapiens
gtgccctgagtgggtaggagag

SEQ ID NO: 9089513 - DNA, 22 bp, Homo sapiens
gtgcacagaaacatacaatgtg

SEQ ID NO: 9089514 - DNA, 22 bp, Homo sapiens
gtgcacagaaacatacaatgtg

SEQ ID NO: 9089515 - DNA, 22 bp, Homo sapiens
gtgccctgagcttatgcattct

SEQ ID NO: 9089516 - DNA, 22 bp, Homo sapiens
gtgccctgagcttatgcattct

SEQ ID NO: 9089517 - DNA, 22 bp, Homo sapiens
gtgccctgaggtcttcactttg

SEQ ID NO: 9089518 - DNA, 22 bp, Homo sapiens
gtgccctgacacacctggtgtg

SEQ ID NO: 9089519 - DNA, 20 bp, Homo sapiens
gtgcaatggcgcaatctcgg

SEQ ID NO: 9089520 - DNA, 20 bp, Homo sapiens
gtgcaatggcaccatctcag

SEQ ID NO: 9089521 - DNA, 22 bp, Homo sapiens
gtgcaactaaaaccattgatca

SEQ ID NO: 9089522 - DNA, 22 bp, Homo sapiens
gtgcaaattccactggaaagct

SEQ ID NO: 9089523 - DNA, 22 bp, Homo sapiens
gtgcaatattgccatgttcttg

SEQ ID NO: 9089524 - DNA, 22 bp, Homo sapiens
gtgcaatagactgtggtattaa

SEQ ID NO: 9089525 - DNA, 22 bp, Homo sapiens
gtgcaataaataaatagattgt

SEQ ID NO: 9089526 - DNA, 22 bp, Homo sapiens
gtgcaagacttcctaagcaata

SEQ ID NO: 9089527 - DNA, 22 bp, Homo sapiens
gtgcaagacttcctaagcaata

SEQ ID NO: 9089528 - DNA, 17 bp, Homo sapiens
gtgcaactactggaaga

SEQ ID NO: 9089529 - DNA, 22 bp, Homo sapiens
gtgcaaaagtaaatgtggtttt

SEQ ID NO: 9089530 - DNA, 22 bp, Homo sapiens
gtgcaaaagtaactgtggtttt

SEQ ID NO: 9089531 - DNA, 22 bp, Homo sapiens
gtgcaaaagcagttgtggtttt

SEQ ID NO: 9089532 - DNA, 22 bp, Homo sapiens
gtgcaaaagcaattgcagtttt

SEQ ID NO: 9089533 - DNA, 22 bp, Homo sapiens
gtgcaaaaggcattgtggtttt

SEQ ID NO: 9089534 - DNA, 22 bp, Homo sapiens
gtgcaaaaataattgtggtttt

SEQ ID NO: 9089535 - DNA, 22 bp, Homo sapiens
gtgccctgtgaactgtaaggaa

SEQ ID NO: 9089536 - DNA, 22 bp, Homo sapiens
gtgccctgtctcttgtctccag

SEQ ID NO: 9089537 - DNA, 20 bp, Homo sapiens
gtgccctgtgggctattttc

SEQ ID NO: 9089538 - DNA, 20 bp, Homo sapiens
gtgccctgtgggctattttc

SEQ ID NO: 9089539 - DNA, 22 bp, Homo sapiens
gtgccctgttcatttctctccc

SEQ ID NO: 9089540 - DNA, 22 bp, Homo sapiens
gtgccctgttgcacacttgagg

SEQ ID NO: 9089541 - DNA, 21 bp, Homo sapiens
gtgccctgttcccacatgccc

SEQ ID NO: 9089542 - DNA, 21 bp, Homo sapiens
gtgccctgttcccacatgccc

SEQ ID NO: 9089543 - DNA, 21 bp, Homo sapiens
gtgccctgttcccacatgccc

SEQ ID NO: 9089544 - DNA, 22 bp, Homo sapiens
gtgccctggggtgaacccctgg

SEQ ID NO: 9089545 - DNA, 22 bp, Homo sapiens
gtgccctggtccccagcatata

SEQ ID NO: 9089546 - DNA, 22 bp, Homo sapiens
gtgccctggtccccagcatata

SEQ ID NO: 9089547 - DNA, 22 bp, Homo sapiens
gtgccctggctcacagtgtctc

SEQ ID NO: 9089548 - DNA, 22 bp, Homo sapiens
gtgccctgggccttcagggcca

SEQ ID NO: 9089549 - DNA, 22 bp, Homo sapiens
gtgcctctgagctctgctacag

SEQ ID NO: 9089550 - DNA, 22 bp, Homo sapiens
gtgcctctcattggctgagccc

SEQ ID NO: 9089551 - DNA, 22 bp, Homo sapiens
gtgcctcagcaccgcctgcagc

SEQ ID NO: 9089552 - DNA, 22 bp, Homo sapiens
gtgctgggtgctgcagacaggt

SEQ ID NO: 9089553 - DNA, 22 bp, Homo sapiens
gtgctgggtgctgcagacaggt

SEQ ID NO: 9089554 - DNA, 23 bp, Homo sapiens
gtgctgtgagccccttggcctcc

SEQ ID NO: 9089555 - DNA, 22 bp, Homo sapiens
gtgctgggccctgagaccaggg

SEQ ID NO: 9089556 - DNA, 22 bp, Homo sapiens
gtgctgggctccaccccagagg

SEQ ID NO: 9089557 - DNA, 22 bp, Homo sapiens
gtgctgggattacaggtgtgag

SEQ ID NO: 9089558 - DNA, 22 bp, Homo sapiens
gtgctggggagataggaagaga

SEQ ID NO: 9089559 - DNA, 22 bp, Homo sapiens
gtgctgggggtttctgtaggtc

SEQ ID NO: 9089560 - DNA, 22 bp, Homo sapiens
gtgctggggagataggaagaga

SEQ ID NO: 9089561 - DNA, 22 bp, Homo sapiens
gtgctggggagataggaagaga

SEQ ID NO: 9089562 - DNA, 22 bp, Homo sapiens
gtgctggggagataggaagaga

SEQ ID NO: 9089563 - DNA, 22 bp, Homo sapiens
gtcttatttaaggacaagaaga

SEQ ID NO: 9089564 - DNA, 21 bp, Homo sapiens
gtcttcaaaggcagtgggcag

SEQ ID NO: 9089565 - DNA, 22 bp, Homo sapiens
gtcttcaacaaatggtagggtc

SEQ ID NO: 9089566 - DNA, 22 bp, Homo sapiens
gtcttcaattgcatttgatggg

SEQ ID NO: 9089567 - DNA, 22 bp, Homo sapiens
gtcttcaacaataactaccact

SEQ ID NO: 9089568 - DNA, 22 bp, Homo sapiens
gtcttcaactggactccaggga

SEQ ID NO: 9089569 - DNA, 22 bp, Homo sapiens
gtcttctgatctggttagccat

SEQ ID NO: 9089570 - DNA, 22 bp, Homo sapiens
gtcttctgcaactgcacctgcc

SEQ ID NO: 9089571 - DNA, 22 bp, Homo sapiens
gtcttctgcccaggcagacgga

SEQ ID NO: 9089572 - DNA, 22 bp, Homo sapiens
gtcttattaggttaaccctgct

SEQ ID NO: 9089573 - DNA, 22 bp, Homo sapiens
gtcttatagtacaatttgaagt

SEQ ID NO: 9089574 - DNA, 22 bp, Homo sapiens
gtctcctggaaatatgcccata

SEQ ID NO: 9089575 - DNA, 22 bp, Homo sapiens
gtctcctggctgcagctaagac

SEQ ID NO: 9089576 - DNA, 22 bp, Homo sapiens
gtctcctggctgcagctaagac

SEQ ID NO: 9089577 - DNA, 22 bp, Homo sapiens
gtctggggtccttttggcttta

SEQ ID NO: 9089578 - DNA, 22 bp, Homo sapiens
gtctctctgctaggcctccagt

SEQ ID NO: 9089579 - DNA, 22 bp, Homo sapiens
gtctctctgactggtccacacc

SEQ ID NO: 9089580 - DNA, 22 bp, Homo sapiens
gtctggggtactttcatctgat

SEQ ID NO: 9089581 - DNA, 22 bp, Homo sapiens
gtgagtgttaacccactgcttc

SEQ ID NO: 9089582 - DNA, 22 bp, Homo sapiens
gtgataaaatagaaacagtggt

SEQ ID NO: 9089583 - DNA, 22 bp, Homo sapiens
gtgagtctgcctagcacatcac

SEQ ID NO: 9089584 - DNA, 22 bp, Homo sapiens
gtgaggtggtacaatattaact

SEQ ID NO: 9089585 - DNA, 22 bp, Homo sapiens
gtgagtctgtggaccgggcact

SEQ ID NO: 9089586 - DNA, 22 bp, Homo sapiens
gtgagtcttaagcaccaccttt

SEQ ID NO: 9089587 - DNA, 22 bp, Homo sapiens
gtgataagacagtaggcacaag

SEQ ID NO: 9089588 - DNA, 22 bp, Homo sapiens
gtgatccgatgtcagtcgcaga

SEQ ID NO: 9089589 - DNA, 22 bp, Homo sapiens
gtgatcctataaagtgagcaca

SEQ ID NO: 9089590 - DNA, 22 bp, Homo sapiens
gtgatgtacttggaaaagtcct

SEQ ID NO: 9089591 - DNA, 22 bp, Homo sapiens
gtcttcttttcagtctgcttgt

SEQ ID NO: 9089592 - DNA, 22 bp, Homo sapiens
gtcttctgtctgtctggcatgt

SEQ ID NO: 9089593 - DNA, 22 bp, Homo sapiens
gtcttctggggccaggcccgct

SEQ ID NO: 9089594 - DNA, 22 bp, Homo sapiens
gtcttctgcctccattagagtt

SEQ ID NO: 9089595 - DNA, 22 bp, Homo sapiens
gtcttctggaagagagccagct

SEQ ID NO: 9089596 - DNA, 22 bp, Homo sapiens
gtgaggtgactagcaggtgggg

SEQ ID NO: 9089597 - DNA, 22 bp, Homo sapiens
gtgaggcagggaaagaggataa

SEQ ID NO: 9089598 - DNA, 22 bp, Homo sapiens
gtgaggcattgaagaccggaat

SEQ ID NO: 9089599 - DNA, 22 bp, Homo sapiens
ggtcaggggctgctctacagag

SEQ ID NO: 9089600 - DNA, 22 bp, Homo sapiens
ggtccagggggtagatatgtga

SEQ ID NO: 9089601 - DNA, 22 bp, Homo sapiens
ggtccaggtatgtggtgtgaat

SEQ ID NO: 9089602 - DNA, 20 bp, Homo sapiens
ggtagctgctgcagttggta

SEQ ID NO: 9089603 - DNA, 22 bp, Homo sapiens
ggtagctgcagcaggctggcaa

SEQ ID NO: 9089604 - DNA, 22 bp, Homo sapiens
ggtagctgcagcaggctggcaa

SEQ ID NO: 9089605 - DNA, 20 bp, Homo sapiens
ggtagcagctgctgtcatcc

SEQ ID NO: 9089606 - DNA, 22 bp, Homo sapiens
ggtagcagggctgtgagtcaga

SEQ ID NO: 9089607 - DNA, 22 bp, Homo sapiens
ggtaggcactggtgggaagaga

SEQ ID NO: 9089608 - DNA, 22 bp, Homo sapiens
ggtaggcagatcactgtctatg

SEQ ID NO: 9089609 - DNA, 22 bp, Homo sapiens
ggtaggcagatcactgtctatg

SEQ ID NO: 9089610 - DNA, 22 bp, Homo sapiens
ggtcagcatctggttgagggca

SEQ ID NO: 9089611 - DNA, 22 bp, Homo sapiens
ggtcaggatccaagtctgtgct

SEQ ID NO: 9089612 - DNA, 22 bp, Homo sapiens
ggtcaggatccaagtctgtgct

SEQ ID NO: 9089613 - DNA, 21 bp, Homo sapiens
ggtcaggcatgtgccctgagc

SEQ ID NO: 9089614 - DNA, 22 bp, Homo sapiens
ggtcagctctttgggctggtgg

SEQ ID NO: 9089615 - DNA, 17 bp, Homo sapiens
ggtacaaacccattttt

SEQ ID NO: 9089616 - DNA, 22 bp, Homo sapiens
ggtacaaagttagatttaactt

SEQ ID NO: 9089617 - DNA, 22 bp, Homo sapiens
ggtacatttttctgtcactttg

SEQ ID NO: 9089618 - DNA, 22 bp, Homo sapiens
ggtaaattttatgtgatgaaac

SEQ ID NO: 9089619 - DNA, 22 bp, Homo sapiens
ggtaaattttatgtgatgaaac

SEQ ID NO: 9089620 - DNA, 22 bp, Homo sapiens
gggtccagatggtgagagttaa

SEQ ID NO: 9089621 - DNA, 22 bp, Homo sapiens
gggtccagcgacagcaggctca

SEQ ID NO: 9089622 - DNA, 22 bp, Homo sapiens
ggtaacacaggtgcagttttaa

SEQ ID NO: 9089623 - DNA, 22 bp, Homo sapiens
gggtccagagttttcccgccct

SEQ ID NO: 9089624 - DNA, 22 bp, Homo sapiens
gggtccagagttgaagaggtta

SEQ ID NO: 9089625 - DNA, 23 bp, Homo sapiens
gggtccagagacaggcatgggtg

SEQ ID NO: 9089626 - DNA, 22 bp, Homo sapiens
gggtccagacactccagaggaa

SEQ ID NO: 9089627 - DNA, 22 bp, Homo sapiens
gggtcaggcctcaaggtgggct

SEQ ID NO: 9089628 - DNA, 22 bp, Homo sapiens
gggtcaggctcagcagggcagc

SEQ ID NO: 9089629 - DNA, 22 bp, Homo sapiens
ggtgggaggcaggctgctccca

SEQ ID NO: 9089630 - DNA, 22 bp, Homo sapiens
ggtgggagagctctgtctccag

SEQ ID NO: 9089631 - DNA, 22 bp, Homo sapiens
ggtgggagagcttgctttgatg

SEQ ID NO: 9089632 - DNA, 23 bp, Homo sapiens
ggtgggagattatccagaattat

SEQ ID NO: 9089633 - DNA, 22 bp, Homo sapiens
ggtggctgcaatggctaacttc

SEQ ID NO: 9089634 - DNA, 22 bp, Homo sapiens
ggtggctgaatcaaatcaggcc

SEQ ID NO: 9089635 - DNA, 22 bp, Homo sapiens
ggtgggcaacatttggcctgag

SEQ ID NO: 9089636 - DNA, 21 bp, Homo sapiens
ggtgggcacaggagagcagag

SEQ ID NO: 9089637 - DNA, 22 bp, Homo sapiens
ggtgggatgcctctggagaagt

SEQ ID NO: 9089638 - DNA, 22 bp, Homo sapiens
ggtgggatcaaagagtcattcg

SEQ ID NO: 9089639 - DNA, 22 bp, Homo sapiens
ggtgccagcctagtgcagtggt

SEQ ID NO: 9089640 - DNA, 22 bp, Homo sapiens
ggtgccagcctagtgcagtggt

SEQ ID NO: 9089641 - DNA, 22 bp, Homo sapiens
ggtgccaagaactacaggattc

SEQ ID NO: 9089642 - DNA, 22 bp, Homo sapiens
ggtgccaggctgtagtcagggt

SEQ ID NO: 9089643 - DNA, 22 bp, Homo sapiens
ggtgccaggctgtagtcagggt

SEQ ID NO: 9089644 - DNA, 22 bp, Homo sapiens
ggtgccaggctcccagctcagg

SEQ ID NO: 9089645 - DNA, 22 bp, Homo sapiens
ggtgccagcctagtgcagtggt

SEQ ID NO: 9089646 - DNA, 22 bp, Homo sapiens
ggtgcccagagccaggaatgag

SEQ ID NO: 9089647 - DNA, 22 bp, Homo sapiens
ggtgcccagagccaggaatgag

SEQ ID NO: 9089648 - DNA, 22 bp, Homo sapiens
ggtgcccacctgtcttcctgga

SEQ ID NO: 9089649 - DNA, 22 bp, Homo sapiens
ggtgcccagcgaagtggctgtg

SEQ ID NO: 9089650 - DNA, 22 bp, Homo sapiens
ggtgcccagcgaagtggctgtg

SEQ ID NO: 9089651 - DNA, 22 bp, Homo sapiens
ggtgcccagcaagctttcaatg

SEQ ID NO: 9089652 - DNA, 22 bp, Homo sapiens
ggtgccctgtaaaagccatgca

SEQ ID NO: 9089653 - DNA, 22 bp, Homo sapiens
ggtgcctgtatttggggcacag

SEQ ID NO: 9089654 - DNA, 22 bp, Homo sapiens
ggtgctcaagagggcatcctct

SEQ ID NO: 9089655 - DNA, 22 bp, Homo sapiens
ggtgctcaagagggcatcctct

SEQ ID NO: 9089656 - DNA, 22 bp, Homo sapiens
ggtggctgaagcagtcttcggg

SEQ ID NO: 9089657 - DNA, 22 bp, Homo sapiens
ggtgaagcgtatttgtggagct

SEQ ID NO: 9089658 - DNA, 22 bp, Homo sapiens
ggtcttttctgctgcaggttgt

SEQ ID NO: 9089659 - DNA, 21 bp, Homo sapiens
ggtcttccaaataaggagaaa

SEQ ID NO: 9089660 - DNA, 22 bp, Homo sapiens
ggtcttctggaaagcagactgt

SEQ ID NO: 9089661 - DNA, 22 bp, Homo sapiens
ggtcttcagctttgcatgtctt

SEQ ID NO: 9089662 - DNA, 22 bp, Homo sapiens
ggtctgtgtgctttgggaagtg

SEQ ID NO: 9089663 - DNA, 22 bp, Homo sapiens
ggtccagtcctgctcaccactt

SEQ ID NO: 9089664 - DNA, 22 bp, Homo sapiens
ggtcccagaattggttagcaca

SEQ ID NO: 9089665 - DNA, 22 bp, Homo sapiens
ggtcccagaattggttagcaca

SEQ ID NO: 9089666 - DNA, 22 bp, Homo sapiens
ggtctggcctcgggcaccccca

SEQ ID NO: 9089667 - DNA, 22 bp, Homo sapiens
ggtctgggcttgagtccttttg

SEQ ID NO: 9089668 - DNA, 22 bp, Homo sapiens
ggtctggcctggcattctatgg

SEQ ID NO: 9089669 - DNA, 22 bp, Homo sapiens
ggtctgtgctctggagcctctg

SEQ ID NO: 9089670 - DNA, 17 bp, Homo sapiens
ggtctggggccattggc

SEQ ID NO: 9089671 - DNA, 17 bp, Homo sapiens
ggtctggggccattggc

SEQ ID NO: 9089672 - DNA, 22 bp, Homo sapiens
ggtgaattctcagcttttacaa

SEQ ID NO: 9089673 - DNA, 22 bp, Homo sapiens
ggtgcagggagaggcaggcccc

SEQ ID NO: 9089674 - DNA, 22 bp, Homo sapiens
ggtgaataagctgaacacttgg

SEQ ID NO: 9089675 - DNA, 22 bp, Homo sapiens
ggtgaagggtgtcatggcattt

SEQ ID NO: 9089676 - DNA, 22 bp, Homo sapiens
ggtgcatgtgagaaagactggg

SEQ ID NO: 9089677 - DNA, 22 bp, Homo sapiens
ggtgcatggaaagagtaagtaa

SEQ ID NO: 9089678 - DNA, 22 bp, Homo sapiens
ggtgcagtggtgtggcaaaggg

SEQ ID NO: 9089679 - DNA, 22 bp, Homo sapiens
ggtgaaggcacaagagggcaag

SEQ ID NO: 9089680 - DNA, 22 bp, Homo sapiens
ggtgaaggcacaagagggcaag

SEQ ID NO: 9089681 - DNA, 22 bp, Homo sapiens
ggtgaaggaggaagctgatgga

SEQ ID NO: 9089682 - DNA, 22 bp, Homo sapiens
ggtgaaggtcagagcaggaaaa

SEQ ID NO: 9089683 - DNA, 22 bp, Homo sapiens
ggtgaagggccttaggagacag

SEQ ID NO: 9089684 - DNA, 22 bp, Homo sapiens
ggtgaaggtggaacgcagagca

SEQ ID NO: 9089685 - DNA, 22 bp, Homo sapiens
gggggagagacgagcggctctg

SEQ ID NO: 9089686 - DNA, 23 bp, Homo sapiens
gggggccgtcctggggattatag

SEQ ID NO: 9089687 - DNA, 23 bp, Homo sapiens
gggggccgtcctggggattatag

SEQ ID NO: 9089688 - DNA, 22 bp, Homo sapiens
gggggccttgttagtggatgga

SEQ ID NO: 9089689 - DNA, 22 bp, Homo sapiens
gggtcaaggctacatggagacc

SEQ ID NO: 9089690 - DNA, 22 bp, Homo sapiens
gggtcaaggctacatggagacc

SEQ ID NO: 9089691 - DNA, 22 bp, Homo sapiens
gggtatgatagggaggtgaaat

SEQ ID NO: 9089692 - DNA, 22 bp, Homo sapiens
gggtatgagatataggtgaata

SEQ ID NO: 9089693 - DNA, 23 bp, Homo sapiens
gggggcgtgtcatggagggccac

SEQ ID NO: 9089694 - DNA, 22 bp, Homo sapiens
gggggctaccgtctctggagct

SEQ ID NO: 9089695 - DNA, 22 bp, Homo sapiens
gggggcggagcacgtgaccacg

SEQ ID NO: 9089696 - DNA, 22 bp, Homo sapiens
gggggacaggatgaatatctgt

SEQ ID NO: 9089697 - DNA, 22 bp, Homo sapiens
gggggactaactggatcctgga

SEQ ID NO: 9089698 - DNA, 22 bp, Homo sapiens
gggggagaagattctgctgctt

SEQ ID NO: 9089699 - DNA, 22 bp, Homo sapiens
gggggagaagattctgctgctt

SEQ ID NO: 9089700 - DNA, 21 bp, Homo sapiens
gggggaagaggagttgctagt

SEQ ID NO: 9089701 - DNA, 22 bp, Homo sapiens
gggggaagactgggctagtgat

SEQ ID NO: 9089702 - DNA, 22 bp, Homo sapiens
ggggctgttgaagttagttgag

SEQ ID NO: 9089703 - DNA, 22 bp, Homo sapiens
ggggcagctcccgagggcagga

SEQ ID NO: 9089704 - DNA, 22 bp, Homo sapiens
ggggcagaaagcccacagagtg

SEQ ID NO: 9089705 - DNA, 22 bp, Homo sapiens
ggggcagaagtagtgcccctga

SEQ ID NO: 9089706 - DNA, 22 bp, Homo sapiens
ggggcaaagggagagtccctac

SEQ ID NO: 9089707 - DNA, 22 bp, Homo sapiens
ggggatggtgggaaggcaatct

SEQ ID NO: 9089708 - DNA, 22 bp, Homo sapiens
ggggcacctcctcttggcaatt

SEQ ID NO: 9089709 - DNA, 22 bp, Homo sapiens
ggggatggtgggaaggcaatct

SEQ ID NO: 9089710 - DNA, 22 bp, Homo sapiens
ggggatggattccgggtccctg

SEQ ID NO: 9089711 - DNA, 22 bp, Homo sapiens
ggggatggaatgtagtagtgat

SEQ ID NO: 9089712 - DNA, 22 bp, Homo sapiens
gggctggggctcaataatttgt

SEQ ID NO: 9089713 - DNA, 22 bp, Homo sapiens
gggctgggcatggtgttccctc

SEQ ID NO: 9089714 - DNA, 22 bp, Homo sapiens
gggctgggattgcttgctgtga

SEQ ID NO: 9089715 - DNA, 22 bp, Homo sapiens
gggctgggatggcttgaagatt

SEQ ID NO: 9089716 - DNA, 22 bp, Homo sapiens
gggctgggaatggctaagtatg

SEQ ID NO: 9089717 - DNA, 22 bp, Homo sapiens
gggctggctctgtctagaaagg

SEQ ID NO: 9089718 - DNA, 22 bp, Homo sapiens
gggctggctgattttcctctct

SEQ ID NO: 9089719 - DNA, 22 bp, Homo sapiens
gggctggctgattttcctctct

SEQ ID NO: 9089720 - DNA, 22 bp, Homo sapiens
gggcctccgtgtgctggtgctc

SEQ ID NO: 9089721 - DNA, 22 bp, Homo sapiens
gggcagtgttgtggttctctat

SEQ ID NO: 9089722 - DNA, 22 bp, Homo sapiens
gggcatcttctgtagccatctc

SEQ ID NO: 9089723 - DNA, 22 bp, Homo sapiens
gggcatgcctgagcctgccact

SEQ ID NO: 9089724 - DNA, 22 bp, Homo sapiens
gggcctgcaggttctgagaggc

SEQ ID NO: 9089725 - DNA, 22 bp, Homo sapiens
gggcctgaggcttccctaatgc

SEQ ID NO: 9089726 - DNA, 22 bp, Homo sapiens
gggcctgaggcccagacactgg

SEQ ID NO: 9089727 - DNA, 22 bp, Homo sapiens
gggcctgactgagagctcctca

SEQ ID NO: 9089728 - DNA, 22 bp, Homo sapiens
gggcctgagctactaggtaggt

SEQ ID NO: 9089729 - DNA, 22 bp, Homo sapiens
gggcctgaggcccagacactgg

SEQ ID NO: 9089730 - DNA, 22 bp, Homo sapiens
gggcctgctccccatcgctgct

SEQ ID NO: 9089731 - DNA, 22 bp, Homo sapiens
gggcctgccattgctgccccag

SEQ ID NO: 9089732 - DNA, 22 bp, Homo sapiens
gggcctggcatgcagccccgtt

SEQ ID NO: 9089733 - DNA, 22 bp, Homo sapiens
gggcctggggacaccaccatga

SEQ ID NO: 9089734 - DNA, 22 bp, Homo sapiens
gggcctggggacaccaccatga

SEQ ID NO: 9089735 - DNA, 22 bp, Homo sapiens
gggcctggggtgacgtacccct

SEQ ID NO: 9089736 - DNA, 22 bp, Homo sapiens
gggcctggggacaccaccatga

SEQ ID NO: 9089737 - DNA, 22 bp, Homo sapiens
gggcctgggaacttgcatttag

SEQ ID NO: 9089738 - DNA, 22 bp, Homo sapiens
gggcctgggaacttgcatttag

SEQ ID NO: 9089739 - DNA, 22 bp, Homo sapiens
gggcctgggaacttgcatttag

SEQ ID NO: 9089740 - DNA, 21 bp, Homo sapiens
gggcctggctgcgcaggacgg

SEQ ID NO: 9089741 - DNA, 21 bp, Homo sapiens
gggcctggctgcgcaggacgg

SEQ ID NO: 9089742 - DNA, 21 bp, Homo sapiens
gggcctggctgcgcaggacgg

SEQ ID NO: 9089743 - DNA, 21 bp, Homo sapiens
gggcctggctgcgcaggacgg

SEQ ID NO: 9089744 - DNA, 21 bp, Homo sapiens
gggcctggctgcgcaggacgg

SEQ ID NO: 9089745 - DNA, 21 bp, Homo sapiens
gggctctcctgaggccatgaa

SEQ ID NO: 9089746 - DNA, 22 bp, Homo sapiens
gggctcctggcagtcatgctca

SEQ ID NO: 9089747 - DNA, 22 bp, Homo sapiens
gggctcctgcctcctggcacct

SEQ ID NO: 9089748 - DNA, 19 bp, Homo sapiens
gggctccttgggcctctct

SEQ ID NO: 9089749 - DNA, 22 bp, Homo sapiens
gggctcctgcctcctggcacct

SEQ ID NO: 9089750 - DNA, 22 bp, Homo sapiens
gggctggctcccaggtgttgaa

SEQ ID NO: 9089751 - DNA, 22 bp, Homo sapiens
gggctggctaagacttttctgt

SEQ ID NO: 9089752 - DNA, 22 bp, Homo sapiens
gggctccatcacaggctccatc

SEQ ID NO: 9089753 - DNA, 22 bp, Homo sapiens
gggctccatcggacttgggttt

SEQ ID NO: 9089754 - DNA, 22 bp, Homo sapiens
gggctccatcacaggctccatc

SEQ ID NO: 9089755 - DNA, 22 bp, Homo sapiens
gggctccagtttggccaggaag

SEQ ID NO: 9089756 - DNA, 22 bp, Homo sapiens
gggctccagtttggccaggaag

SEQ ID NO: 9089757 - DNA, 22 bp, Homo sapiens
gggctccagtttggccaggaag

SEQ ID NO: 9089758 - DNA, 22 bp, Homo sapiens
gggctccagctgtttgccatga

SEQ ID NO: 9089759 - DNA, 20 bp, Homo sapiens
gggctccagctgtgattctt

SEQ ID NO: 9089760 - DNA, 22 bp, Homo sapiens
gggctccagctgtttgccatga

SEQ ID NO: 9089761 - DNA, 22 bp, Homo sapiens
gggctccaggagccctaagaga

SEQ ID NO: 9089762 - DNA, 22 bp, Homo sapiens
gggctccaggcaggcaggaaat

SEQ ID NO: 9089763 - DNA, 22 bp, Homo sapiens
gggctccagttgtccccaggat

SEQ ID NO: 9089764 - DNA, 23 bp, Homo sapiens
gggctccagtctctgctcagttg

SEQ ID NO: 9089765 - DNA, 22 bp, Homo sapiens
gggctccagttgtccccaggat

SEQ ID NO: 9089766 - DNA, 22 bp, Homo sapiens
gggctccagggcccgagtcgtc

SEQ ID NO: 9089767 - DNA, 23 bp, Homo sapiens
gggctccagtctctgctcagttg

SEQ ID NO: 9089768 - DNA, 22 bp, Homo sapiens
gggctccagaggctcaccctgg

SEQ ID NO: 9089769 - DNA, 21 bp, Homo sapiens
gggctccagagatgtagcttc

SEQ ID NO: 9089770 - DNA, 21 bp, Homo sapiens
gggctccagagatgtagcttc

SEQ ID NO: 9089771 - DNA, 22 bp, Homo sapiens
gggctccagagtccatgttctt

SEQ ID NO: 9089772 - DNA, 22 bp, Homo sapiens
gggctccagattgcagcgatca

SEQ ID NO: 9089773 - DNA, 22 bp, Homo sapiens
gggctccagagtccatgttctt

SEQ ID NO: 9089774 - DNA, 22 bp, Homo sapiens
gggctccacctagggacactgg

SEQ ID NO: 9089775 - DNA, 22 bp, Homo sapiens
gggctccacgcacgcgagaggt

SEQ ID NO: 9089776 - DNA, 22 bp, Homo sapiens
gggctccacagcagtgagtgga

SEQ ID NO: 9089777 - DNA, 22 bp, Homo sapiens
gggctccacagcagtgagtgga

SEQ ID NO: 9089778 - DNA, 22 bp, Homo sapiens
gggctccagcccgggaccaggt

SEQ ID NO: 9089779 - DNA, 22 bp, Homo sapiens
gggctccagccaggtgtcccca

SEQ ID NO: 9089780 - DNA, 22 bp, Homo sapiens
gggctccagccaggtgtcccca

SEQ ID NO: 9089781 - DNA, 22 bp, Homo sapiens
gggctccagccagctccttgtg

SEQ ID NO: 9089782 - DNA, 22 bp, Homo sapiens
gggctccagcagaggcagccgg

SEQ ID NO: 9089783 - DNA, 22 bp, Homo sapiens
gggctccagcagaggcagccgg

SEQ ID NO: 9089784 - DNA, 22 bp, Homo sapiens
gggctccagccactggctgagg

SEQ ID NO: 9089785 - DNA, 22 bp, Homo sapiens
gggctccagccactggctgagg

SEQ ID NO: 9089786 - DNA, 22 bp, Homo sapiens
ggagcaagtcccaggcactagt

SEQ ID NO: 9089787 - DNA, 22 bp, Homo sapiens
ggagcaaatgccaagtgggagg

SEQ ID NO: 9089788 - DNA, 22 bp, Homo sapiens
ggagcaagaggtggtgaaaaat

SEQ ID NO: 9089789 - DNA, 22 bp, Homo sapiens
ggagatttatagcacacttcag

SEQ ID NO: 9089790 - DNA, 22 bp, Homo sapiens
ggagatggtggaagctggtgca

SEQ ID NO: 9089791 - DNA, 22 bp, Homo sapiens
ggagatggctggcaggtagatg

SEQ ID NO: 9089792 - DNA, 22 bp, Homo sapiens
ggagatggccaaaaacacaaat

SEQ ID NO: 9089793 - DNA, 22 bp, Homo sapiens
ggagatgggggattttacagcg

SEQ ID NO: 9089794 - DNA, 22 bp, Homo sapiens
ggagatggctggcaggtagatg

SEQ ID NO: 9089795 - DNA, 22 bp, Homo sapiens
ggagatggctggcaggtagatg

SEQ ID NO: 9089796 - DNA, 22 bp, Homo sapiens
ggagatggctggcaggtagatg

SEQ ID NO: 9089797 - DNA, 22 bp, Homo sapiens
ggagatggtctgttctcatatt

SEQ ID NO: 9089798 - DNA, 21 bp, Homo sapiens
ggagatgggtatcgcctgggc

SEQ ID NO: 9089799 - DNA, 21 bp, Homo sapiens
ggagatgggtatcgcctgggc

SEQ ID NO: 9089800 - DNA, 22 bp, Homo sapiens
ggatctggggtagagcagtggg

SEQ ID NO: 9089801 - DNA, 22 bp, Homo sapiens
ggatctgttttgcctctgaggg

SEQ ID NO: 9089802 - DNA, 23 bp, Homo sapiens
ggagttggattgtacttgctgct

SEQ ID NO: 9089803 - DNA, 22 bp, Homo sapiens
ggagttgttctgcaggagagaa

SEQ ID NO: 9089804 - DNA, 22 bp, Homo sapiens
ggatctggggctctgctgctca

SEQ ID NO: 9089805 - DNA, 22 bp, Homo sapiens
ggatgaggaaaccacagtgtcc

SEQ ID NO: 9089806 - DNA, 22 bp, Homo sapiens
ggatgaggaagattactgagaa

SEQ ID NO: 9089807 - DNA, 22 bp, Homo sapiens
ggatgaggaagattactgagaa

SEQ ID NO: 9089808 - DNA, 22 bp, Homo sapiens
ggagcagagctcttcatctgca

SEQ ID NO: 9089809 - DNA, 22 bp, Homo sapiens
ggatgaggtagatgaacaaggg

SEQ ID NO: 9089810 - DNA, 22 bp, Homo sapiens
ggatgaggtagatgaacaaggg

SEQ ID NO: 9089811 - DNA, 19 bp, Homo sapiens
ggatgagggtcaggcatag

SEQ ID NO: 9089812 - DNA, 19 bp, Homo sapiens
ggatgagggtcaggcatag

SEQ ID NO: 9089813 - DNA, 22 bp, Homo sapiens
ggatgcaggacggcatggatgt

SEQ ID NO: 9089814 - DNA, 22 bp, Homo sapiens
ggatgcaggagttgaagaagga

SEQ ID NO: 9089815 - DNA, 22 bp, Homo sapiens
ggatgcaggggcagcagagcct

SEQ ID NO: 9089816 - DNA, 22 bp, Homo sapiens
ggatgctgtctaagctgaggac

SEQ ID NO: 9089817 - DNA, 22 bp, Homo sapiens
ggatgctggggaccaatctctg

SEQ ID NO: 9089818 - DNA, 23 bp, Homo sapiens
ggatggacgtgatgccttagcca

SEQ ID NO: 9089819 - DNA, 22 bp, Homo sapiens
ggatgctgctatcaggcttcga

SEQ ID NO: 9089820 - DNA, 22 bp, Homo sapiens
ggatgctgactttggagcatgg

SEQ ID NO: 9089821 - DNA, 22 bp, Homo sapiens
ggatgctgactttggagcatgg

SEQ ID NO: 9089822 - DNA, 22 bp, Homo sapiens
ggatgctgggagacagcaggca

SEQ ID NO: 9089823 - DNA, 22 bp, Homo sapiens
ggatggaggttctcagatgctc

SEQ ID NO: 9089824 - DNA, 22 bp, Homo sapiens
ggatggcaggacaaggacccag

SEQ ID NO: 9089825 - DNA, 23 bp, Homo sapiens
ggatggagccactttgaaaccac

SEQ ID NO: 9089826 - DNA, 22 bp, Homo sapiens
ggatggagatgaccatggtgac

SEQ ID NO: 9089827 - DNA, 22 bp, Homo sapiens
ggatggaggttctcagatgctc

SEQ ID NO: 9089828 - DNA, 22 bp, Homo sapiens
ggatggagatgaccatggtgac

SEQ ID NO: 9089829 - DNA, 20 bp, Homo sapiens
ggatggccggaccagagcct

SEQ ID NO: 9089830 - DNA, 22 bp, Homo sapiens
ggattcagcgaggcagcctgga

SEQ ID NO: 9089831 - DNA, 22 bp, Homo sapiens
ggattaacagctcctgggtggt

SEQ ID NO: 9089832 - DNA, 22 bp, Homo sapiens
ggatgttgattgaatggccatt

SEQ ID NO: 9089833 - DNA, 22 bp, Homo sapiens
ggattctgccttgttgcttcaa

SEQ ID NO: 9089834 - DNA, 19 bp, Homo sapiens
ggattctgcagttttcaca

SEQ ID NO: 9089835 - DNA, 22 bp, Homo sapiens
ggcagctgttggctctctagga

SEQ ID NO: 9089836 - DNA, 22 bp, Homo sapiens
ggcagctgttggctctctagga

SEQ ID NO: 9089837 - DNA, 22 bp, Homo sapiens
ggcagctgttggctctctagga

SEQ ID NO: 9089838 - DNA, 22 bp, Homo sapiens
ggcagctgttggctctctagga

SEQ ID NO: 9089839 - DNA, 22 bp, Homo sapiens
ggcagctgttggctctctagga

SEQ ID NO: 9089840 - DNA, 22 bp, Homo sapiens
ggcagctgtttgtcctcctgtt

SEQ ID NO: 9089841 - DNA, 22 bp, Homo sapiens
ggcagctgtttgtcctcctgtt

SEQ ID NO: 9089842 - DNA, 22 bp, Homo sapiens
ggcagctgtttgtcctcctgtt

SEQ ID NO: 9089843 - DNA, 22 bp, Homo sapiens
ggcagctgtttgtcctcctgtt

SEQ ID NO: 9089844 - DNA, 22 bp, Homo sapiens
ggcagctgttggctctctagga

SEQ ID NO: 9089845 - DNA, 17 bp, Homo sapiens
ggcagctgtgtgcatgc

SEQ ID NO: 9089846 - DNA, 21 bp, Homo sapiens
ggcagctgtggttaattgaac

SEQ ID NO: 9089847 - DNA, 17 bp, Homo sapiens
ggcagctgtgtgcatgc

SEQ ID NO: 9089848 - DNA, 17 bp, Homo sapiens
ggcagctgtgtgcatgc

SEQ ID NO: 9089849 - DNA, 17 bp, Homo sapiens
ggcagctgtgtgcatgc

SEQ ID NO: 9089850 - DNA, 21 bp, Homo sapiens
ggcagctgtggttaattgaac

SEQ ID NO: 9089851 - DNA, 22 bp, Homo sapiens
ggcagctgtggacgtcgtcatt

SEQ ID NO: 9089852 - DNA, 22 bp, Homo sapiens
ggcagctgtgaagtgcctcaca

SEQ ID NO: 9089853 - DNA, 22 bp, Homo sapiens
ggcagcttcctaggagagggca

SEQ ID NO: 9089854 - DNA, 22 bp, Homo sapiens
ggcagcttaaaccacagacatt

SEQ ID NO: 9089855 - DNA, 22 bp, Homo sapiens
ggcagcttctcccaggctgttt

SEQ ID NO: 9089856 - DNA, 18 bp, Homo sapiens
ggcagcttgactagcaac

SEQ ID NO: 9089857 - DNA, 20 bp, Homo sapiens
ggcagcttgggcagcagtta

SEQ ID NO: 9089858 - DNA, 22 bp, Homo sapiens
ggcagcttggttgcagaccatc

SEQ ID NO: 9089859 - DNA, 22 bp, Homo sapiens
ggcagctttgagtcttagagta

SEQ ID NO: 9089860 - DNA, 22 bp, Homo sapiens
ggcagcagtaggagctaatctt

SEQ ID NO: 9089861 - DNA, 22 bp, Homo sapiens
ggcagcagtaggagctaatctt

SEQ ID NO: 9089862 - DNA, 22 bp, Homo sapiens
ggcagcagggtctagattgatg

SEQ ID NO: 9089863 - DNA, 22 bp, Homo sapiens
ggcagcagggtagccatttctc

SEQ ID NO: 9089864 - DNA, 22 bp, Homo sapiens
ggcagcagggtctagattgatg

SEQ ID NO: 9089865 - DNA, 22 bp, Homo sapiens
ggcagcagggtctagattgatg

SEQ ID NO: 9089866 - DNA, 22 bp, Homo sapiens
ggcagcaggcgacttccctatt

SEQ ID NO: 9089867 - DNA, 20 bp, Homo sapiens
ggcagcaggagtttcctctt

SEQ ID NO: 9089868 - DNA, 20 bp, Homo sapiens
ggcagcaggagtttcctctt

SEQ ID NO: 9089869 - DNA, 22 bp, Homo sapiens
ggcagcaggcgacttccctatt

SEQ ID NO: 9089870 - DNA, 22 bp, Homo sapiens
ggcagcagggctgtctccctac

SEQ ID NO: 9089871 - DNA, 22 bp, Homo sapiens
ggcagcagggctgtctccctac

SEQ ID NO: 9089872 - DNA, 22 bp, Homo sapiens
ggcagccagtagggccagcctg

SEQ ID NO: 9089873 - DNA, 22 bp, Homo sapiens
ggcagccagcaatgagaagttt

SEQ ID NO: 9089874 - DNA, 22 bp, Homo sapiens
ggcagccagagggcagctggat

SEQ ID NO: 9089875 - DNA, 22 bp, Homo sapiens
ggcagcagtccatggcccaagg

SEQ ID NO: 9089876 - DNA, 22 bp, Homo sapiens
ggcagccatggacactggctag

SEQ ID NO: 9089877 - DNA, 22 bp, Homo sapiens
ggcagccatgctccaggtgcag

SEQ ID NO: 9089878 - DNA, 22 bp, Homo sapiens
ggcagccatgcacgctgcctgg

SEQ ID NO: 9089879 - DNA, 22 bp, Homo sapiens
ggcagccatactcagacctggg

SEQ ID NO: 9089880 - DNA, 18 bp, Homo sapiens
ggcactggtgatgcagag

SEQ ID NO: 9089881 - DNA, 22 bp, Homo sapiens
ggcactgggttgtaggaattaa

SEQ ID NO: 9089882 - DNA, 18 bp, Homo sapiens
ggcactggtgatgcagag

SEQ ID NO: 9089883 - DNA, 22 bp, Homo sapiens
ggcactgggtgagggtcactgg

SEQ ID NO: 9089884 - DNA, 19 bp, Homo sapiens
ggcactggggccaggacca

SEQ ID NO: 9089885 - DNA, 21 bp, Homo sapiens
ggattttaaaaactgcacctg

SEQ ID NO: 9089886 - DNA, 22 bp, Homo sapiens
ggattgagagcactggtagctg

SEQ ID NO: 9089887 - DNA, 22 bp, Homo sapiens
ggatttgggcttgcagcagagc

SEQ ID NO: 9089888 - DNA, 22 bp, Homo sapiens
ggatttcttccttcctcagaag

SEQ ID NO: 9089889 - DNA, 22 bp, Homo sapiens
ggcagcagcaaggttggagctg

SEQ ID NO: 9089890 - DNA, 22 bp, Homo sapiens
ggcagcagcaaggttggagctg

SEQ ID NO: 9089891 - DNA, 16 bp, Homo sapiens
ggcagcagctccgtgc

SEQ ID NO: 9089892 - DNA, 16 bp, Homo sapiens
ggcagcagctccgtgc

SEQ ID NO: 9089893 - DNA, 22 bp, Homo sapiens
ggcagcaggagccatctggtag

SEQ ID NO: 9089894 - DNA, 22 bp, Homo sapiens
ggcagcaggagccatctggtag

SEQ ID NO: 9089895 - DNA, 22 bp, Homo sapiens
ggcagcaggagccatctggtag

SEQ ID NO: 9089896 - DNA, 22 bp, Homo sapiens
ggcagcaggagccatctggtag

SEQ ID NO: 9089897 - DNA, 22 bp, Homo sapiens
ggcagcagcaaggttggagctg

SEQ ID NO: 9089898 - DNA, 22 bp, Homo sapiens
ggcagaatgaggcttaggaatg

SEQ ID NO: 9089899 - DNA, 22 bp, Homo sapiens
ggcagaatgagagggaaacatg

SEQ ID NO: 9089900 - DNA, 22 bp, Homo sapiens
ggcagcagacccctaagtctac

SEQ ID NO: 9089901 - DNA, 22 bp, Homo sapiens
ggcagcagacccctaagtctac

SEQ ID NO: 9089902 - DNA, 22 bp, Homo sapiens
ggcagaaggttgaagtaatttg

SEQ ID NO: 9089903 - DNA, 21 bp, Homo sapiens
ggcagaagtagcatggacggg

SEQ ID NO: 9089904 - DNA, 22 bp, Homo sapiens
ggcagaagaaaggctaagtctc

SEQ ID NO: 9089905 - DNA, 22 bp, Homo sapiens
ggcagaagacaggcaaatcatg

SEQ ID NO: 9089906 - DNA, 22 bp, Homo sapiens
ggcagaagataggacagggaat

SEQ ID NO: 9089907 - DNA, 22 bp, Homo sapiens
ggcagaagataggacagggaat

SEQ ID NO: 9089908 - DNA, 19 bp, Homo sapiens
ggcagaaggtgtaggggga

SEQ ID NO: 9089909 - DNA, 19 bp, Homo sapiens
ggcagaaggtgtaggggga

SEQ ID NO: 9089910 - DNA, 22 bp, Homo sapiens
ggcagaaggcaattagagactg

SEQ ID NO: 9089911 - DNA, 22 bp, Homo sapiens
ggcagaaggcaattagagactg

SEQ ID NO: 9089912 - DNA, 22 bp, Homo sapiens
ggcagaaggcctcccagctcct

SEQ ID NO: 9089913 - DNA, 22 bp, Homo sapiens
ggcaggagctctccagtttgcc

SEQ ID NO: 9089914 - DNA, 18 bp, Homo sapiens
ggcaggagcaagaatagg

SEQ ID NO: 9089915 - DNA, 22 bp, Homo sapiens
ggcaggagataaaatattagtt

SEQ ID NO: 9089916 - DNA, 22 bp, Homo sapiens
ggcaggagaatggcgtgaactc

SEQ ID NO: 9089917 - DNA, 22 bp, Homo sapiens
ggcaggggtgaggccactctga

SEQ ID NO: 9089918 - DNA, 22 bp, Homo sapiens
ggcagggtgcctggctcctgtt

SEQ ID NO: 9089919 - DNA, 22 bp, Homo sapiens
ggcagggtctggactgaaagct

SEQ ID NO: 9089920 - DNA, 22 bp, Homo sapiens
ggcagtgggttccccaaggcac

SEQ ID NO: 9089921 - DNA, 22 bp, Homo sapiens
ggcagtgggttccccaaggcac

SEQ ID NO: 9089922 - DNA, 22 bp, Homo sapiens
ggcaggtgagagctctttgaaa

SEQ ID NO: 9089923 - DNA, 22 bp, Homo sapiens
ggcagggtggcagaggctcaga

SEQ ID NO: 9089924 - DNA, 17 bp, Homo sapiens
ggcagggtgctgggtat

SEQ ID NO: 9089925 - DNA, 22 bp, Homo sapiens
ggcatgctgtaggcattcagta

SEQ ID NO: 9089926 - DNA, 22 bp, Homo sapiens
ggcatgcaaaacaactcagaga

SEQ ID NO: 9089927 - DNA, 22 bp, Homo sapiens
ggcatgattttggctcactgca

SEQ ID NO: 9089928 - DNA, 22 bp, Homo sapiens
ggccaggaacttttgggatggg

SEQ ID NO: 9089929 - DNA, 22 bp, Homo sapiens
ggccagcttctctgctgcctgt

SEQ ID NO: 9089930 - DNA, 22 bp, Homo sapiens
ggcatcgtcctgggcataggga

SEQ ID NO: 9089931 - DNA, 22 bp, Homo sapiens
ggcatctcgcattcttgtttct

SEQ ID NO: 9089932 - DNA, 22 bp, Homo sapiens
ggcatcctccatataggtgaat

SEQ ID NO: 9089933 - DNA, 22 bp, Homo sapiens
ggcatccagttctgatcaacaa

SEQ ID NO: 9089934 - DNA, 22 bp, Homo sapiens
ggcatcagtatggccatagggt

SEQ ID NO: 9089935 - DNA, 22 bp, Homo sapiens
ggcatccaaataccaagatgta

SEQ ID NO: 9089936 - DNA, 22 bp, Homo sapiens
ggcatccaaataccaagatgta

SEQ ID NO: 9089937 - DNA, 22 bp, Homo sapiens
ggcagtggtgggaggctcgctc

SEQ ID NO: 9089938 - DNA, 22 bp, Homo sapiens
ggcagtggtgggaggctcgctc

SEQ ID NO: 9089939 - DNA, 22 bp, Homo sapiens
ggcagtggttagaaacatgagc

SEQ ID NO: 9089940 - DNA, 22 bp, Homo sapiens
ggcatcagggtaggaaggtatc

SEQ ID NO: 9089941 - DNA, 22 bp, Homo sapiens
ggcatctgagctgtgtatggtt

SEQ ID NO: 9089942 - DNA, 22 bp, Homo sapiens
ggcatctgtccatctctccagc

SEQ ID NO: 9089943 - DNA, 22 bp, Homo sapiens
ggcatcttgttgctcaaatcta

SEQ ID NO: 9089944 - DNA, 22 bp, Homo sapiens
ggcatctgtggagccttttcca

SEQ ID NO: 9089945 - DNA, 22 bp, Homo sapiens
ggcatcttgttgctcaaatcta

SEQ ID NO: 9089946 - DNA, 20 bp, Homo sapiens
ggcatgagatgtgagggagg

SEQ ID NO: 9089947 - DNA, 22 bp, Homo sapiens
ggcctggcctccagatgtgggc

SEQ ID NO: 9089948 - DNA, 23 bp, Homo sapiens
ggcctggcccagggccctgatga

SEQ ID NO: 9089949 - DNA, 19 bp, Homo sapiens
ggcctggatttagggctcc

SEQ ID NO: 9089950 - DNA, 19 bp, Homo sapiens
ggcctggatttagggctcc

SEQ ID NO: 9089951 - DNA, 22 bp, Homo sapiens
ggcctggagtcagggaaagcaa

SEQ ID NO: 9089952 - DNA, 19 bp, Homo sapiens
ggcctggctatccctgctg

SEQ ID NO: 9089953 - DNA, 22 bp, Homo sapiens
ggcggggtctgagcgccgcgcc

SEQ ID NO: 9089954 - DNA, 22 bp, Homo sapiens
ggcgggtgcacagacccttccc

SEQ ID NO: 9089955 - DNA, 22 bp, Homo sapiens
ggcgggtggcgaggcttctcgg

SEQ ID NO: 9089956 - DNA, 22 bp, Homo sapiens
ggcctgcctcacagtcagcacc

SEQ ID NO: 9089957 - DNA, 22 bp, Homo sapiens
ggcctgctccgggggctgagct

SEQ ID NO: 9089958 - DNA, 22 bp, Homo sapiens
ggcctgctctgcagcctctaca

SEQ ID NO: 9089959 - DNA, 22 bp, Homo sapiens
ggcctggaatgctttcctacca

SEQ ID NO: 9089960 - DNA, 22 bp, Homo sapiens
ggcctggaagaggacagagaaa

SEQ ID NO: 9089961 - DNA, 22 bp, Homo sapiens
ggcctgctgtgtactgatgtca

SEQ ID NO: 9089962 - DNA, 22 bp, Homo sapiens
ggcctgctggggcctcagacac

SEQ ID NO: 9089963 - DNA, 22 bp, Homo sapiens
ggccctgggccctctagcttgt

SEQ ID NO: 9089964 - DNA, 22 bp, Homo sapiens
ggccctgggcagaggagtgggc

SEQ ID NO: 9089965 - DNA, 22 bp, Homo sapiens
ggccctgggccctctagcttgt

SEQ ID NO: 9089966 - DNA, 22 bp, Homo sapiens
ggccctgggatgctcagcagtg

SEQ ID NO: 9089967 - DNA, 22 bp, Homo sapiens
ggccctgggatgctcagcagtg

SEQ ID NO: 9089968 - DNA, 22 bp, Homo sapiens
ggccctgggacacaacaccgaa

SEQ ID NO: 9089969 - DNA, 22 bp, Homo sapiens
ggcctagttttttctggtaggt

SEQ ID NO: 9089970 - DNA, 22 bp, Homo sapiens
ggcctatgagaggcagcatgtt

SEQ ID NO: 9089971 - DNA, 22 bp, Homo sapiens
ggcctagttttttctggtaggt

SEQ ID NO: 9089972 - DNA, 23 bp, Homo sapiens
ggcctatgggcaggcaaggaagc

SEQ ID NO: 9089973 - DNA, 22 bp, Homo sapiens
ggcctcacccatcggtgccttt

SEQ ID NO: 9089974 - DNA, 21 bp, Homo sapiens
ggcctaggggcagatggtgct

SEQ ID NO: 9089975 - DNA, 22 bp, Homo sapiens
ggcctagggagtggccatgcct

SEQ ID NO: 9089976 - DNA, 22 bp, Homo sapiens
ggcctagggagtggccatgcct

SEQ ID NO: 9089977 - DNA, 22 bp, Homo sapiens
ggcctagagcagggctaaggtc

SEQ ID NO: 9089978 - DNA, 22 bp, Homo sapiens
ggcctacgccagtatccccagg

SEQ ID NO: 9089979 - DNA, 22 bp, Homo sapiens
ggccaggcactgtgtgagatat

SEQ ID NO: 9089980 - DNA, 22 bp, Homo sapiens
ggccaggccaagagggttggaa

SEQ ID NO: 9089981 - DNA, 22 bp, Homo sapiens
ggccaggcactgtgtgagatat

SEQ ID NO: 9089982 - DNA, 22 bp, Homo sapiens
ggccaggcgatgacccctccac

SEQ ID NO: 9089983 - DNA, 22 bp, Homo sapiens
ggccaggaagggaagatcagca

SEQ ID NO: 9089984 - DNA, 22 bp, Homo sapiens
ggccaggaagggaagatcagca

SEQ ID NO: 9089985 - DNA, 22 bp, Homo sapiens
ggccaggagcaagccaggctct

SEQ ID NO: 9089986 - DNA, 23 bp, Homo sapiens
ggctggaagaaaacagaattgtt

SEQ ID NO: 9089987 - DNA, 22 bp, Homo sapiens
ggctggaaaagacaaagctatt

SEQ ID NO: 9089988 - DNA, 22 bp, Homo sapiens
ggctgctttatcggctgctgaa

SEQ ID NO: 9089989 - DNA, 22 bp, Homo sapiens
ggctggaaggtagaagatgagg

SEQ ID NO: 9089990 - DNA, 22 bp, Homo sapiens
ggctggaagtccaagatcaaga

SEQ ID NO: 9089991 - DNA, 22 bp, Homo sapiens
ggctggaagtccaagatcaagg

SEQ ID NO: 9089992 - DNA, 22 bp, Homo sapiens
ggctgctgtttcagagactgtt

SEQ ID NO: 9089993 - DNA, 22 bp, Homo sapiens
ggctgcttgctgtttcttggat

SEQ ID NO: 9089994 - DNA, 22 bp, Homo sapiens
ggctgctggggacgtgggagag

SEQ ID NO: 9089995 - DNA, 22 bp, Homo sapiens
ggctgagttgagaggattactt

SEQ ID NO: 9089996 - DNA, 22 bp, Homo sapiens
ggctgctggggacgtgggagag

SEQ ID NO: 9089997 - DNA, 18 bp, Homo sapiens
ggctgaggttgactagaa

SEQ ID NO: 9089998 - DNA, 22 bp, Homo sapiens
ggctgagggttaagatcagaca

SEQ ID NO: 9089999 - DNA, 22 bp, Homo sapiens
ggctgagggccagggctagtct

SEQ ID NO: 9090000 - DNA, 22 bp, Homo sapiens
ggctgagggccagggctagtct

SEQ ID NO: 9090001 - DNA, 22 bp, Homo sapiens
ggctgaggggcccagaggaaca

SEQ ID NO: 9090002 - DNA, 22 bp, Homo sapiens
ggctgaggggcccagaggaaca

SEQ ID NO: 9090003 - DNA, 22 bp, Homo sapiens
ggctgagggtcccagaccctaa

SEQ ID NO: 9090004 - DNA, 22 bp, Homo sapiens
ggctgagggtcccagaccctaa

SEQ ID NO: 9090005 - DNA, 22 bp, Homo sapiens
ggctgagggtatagctgtccca

SEQ ID NO: 9090006 - DNA, 22 bp, Homo sapiens
ggctgagggtatagctgtccca

SEQ ID NO: 9090007 - DNA, 22 bp, Homo sapiens
ggctggactttctgctgggctc

SEQ ID NO: 9090008 - DNA, 19 bp, Homo sapiens
ggctggagaaaggaatcag

SEQ ID NO: 9090009 - DNA, 22 bp, Homo sapiens
ggctgtgagcaggcagaatgct

SEQ ID NO: 9090010 - DNA, 22 bp, Homo sapiens
ggctggtcacaccactgcaggg

SEQ ID NO: 9090011 - DNA, 21 bp, Homo sapiens
ggctggtcgcgtgcatgtctc

SEQ ID NO: 9090012 - DNA, 22 bp, Homo sapiens
ggctccctgttctattccctgg

SEQ ID NO: 9090013 - DNA, 22 bp, Homo sapiens
ggctcctccaagcaactctcag

SEQ ID NO: 9090014 - DNA, 22 bp, Homo sapiens
ggctcctgaaagactatgggaa

SEQ ID NO: 9090015 - DNA, 22 bp, Homo sapiens
ggctcctctctggccgctcccg

SEQ ID NO: 9090016 - DNA, 22 bp, Homo sapiens
ggctcctgaaagactatgggaa

SEQ ID NO: 9090017 - DNA, 22 bp, Homo sapiens
ggctcctgataggagaatgcgg

SEQ ID NO: 9090018 - DNA, 22 bp, Homo sapiens
ggctcctgaggaccaggcacag

SEQ ID NO: 9090019 - DNA, 22 bp, Homo sapiens
ggctcctgaggaccaggcacag

SEQ ID NO: 9090020 - DNA, 22 bp, Homo sapiens
ggctctggggaagctctcttca

SEQ ID NO: 9090021 - DNA, 22 bp, Homo sapiens
ggctctggggaagctctcttca

SEQ ID NO: 9090022 - DNA, 22 bp, Homo sapiens
ggctctggggcctcctcccttg

SEQ ID NO: 9090023 - DNA, 22 bp, Homo sapiens
ggctctggggcctcctcccttg

SEQ ID NO: 9090024 - DNA, 22 bp, Homo sapiens
ggctctggggggaagtctgttg

SEQ ID NO: 9090025 - DNA, 22 bp, Homo sapiens
ggctctgggtctgtggggagcg

SEQ ID NO: 9090026 - DNA, 22 bp, Homo sapiens
ggctcttccgccaccagccaca

SEQ ID NO: 9090027 - DNA, 22 bp, Homo sapiens
ggctcttccgccaccagccaca

SEQ ID NO: 9090028 - DNA, 22 bp, Homo sapiens
ggctctgtggctggccatgatg

SEQ ID NO: 9090029 - DNA, 23 bp, Homo sapiens
ggctctgtgctgggcctgcagga

SEQ ID NO: 9090030 - DNA, 22 bp, Homo sapiens
ggctctggttgaccatgatggc

SEQ ID NO: 9090031 - DNA, 22 bp, Homo sapiens
ggctctgggtctgtggggagcg

SEQ ID NO: 9090032 - DNA, 22 bp, Homo sapiens
ggctctgggtctgtggggagcg

SEQ ID NO: 9090033 - DNA, 17 bp, Homo sapiens
ggctctgggtgtcacat

SEQ ID NO: 9090034 - DNA, 17 bp, Homo sapiens
ggctctgggtgtcacat

SEQ ID NO: 9090035 - DNA, 22 bp, Homo sapiens
ggctctgggtgtgaccttgggt

SEQ ID NO: 9090036 - DNA, 22 bp, Homo sapiens
ggctctggtgtgaagcagcctc

SEQ ID NO: 9090037 - DNA, 22 bp, Homo sapiens
ggctctggtgtgaagcagcctc

SEQ ID NO: 9090038 - DNA, 22 bp, Homo sapiens
ggctctggtgtgaagcagcctc

SEQ ID NO: 9090039 - DNA, 22 bp, Homo sapiens
ggctccagggagtggagagaag

SEQ ID NO: 9090040 - DNA, 22 bp, Homo sapiens
ggctccagggagtggagagaag

SEQ ID NO: 9090041 - DNA, 22 bp, Homo sapiens
ggctccatgctccgcttcttgt

SEQ ID NO: 9090042 - DNA, 22 bp, Homo sapiens
ggctccatgctgagctttgaat

SEQ ID NO: 9090043 - DNA, 22 bp, Homo sapiens
ggctccatgcctagagcaggct

SEQ ID NO: 9090044 - DNA, 22 bp, Homo sapiens
ggctccagtttgtgccttcagc

SEQ ID NO: 9090045 - DNA, 22 bp, Homo sapiens
ggctccatccaaggccttctag

SEQ ID NO: 9090046 - DNA, 22 bp, Homo sapiens
ggctccctagggagagtgggag

SEQ ID NO: 9090047 - DNA, 22 bp, Homo sapiens
ggctccctagggagagtgggag

SEQ ID NO: 9090048 - DNA, 17 bp, Homo sapiens
ggctccctgactatgga

SEQ ID NO: 9090049 - DNA, 22 bp, Homo sapiens
ggctccctggaaatcccgaggc

SEQ ID NO: 9090050 - DNA, 22 bp, Homo sapiens
ggctccctggccctggggacac

SEQ ID NO: 9090051 - DNA, 22 bp, Homo sapiens
ggctccctgcctgtcctcagtc

SEQ ID NO: 9090052 - DNA, 22 bp, Homo sapiens
ggctccctgcctgtcctcagtc

SEQ ID NO: 9090053 - DNA, 22 bp, Homo sapiens
ggctacagaggccgtgagcctg

SEQ ID NO: 9090054 - DNA, 22 bp, Homo sapiens
ggctacagcggggtggagacgg

SEQ ID NO: 9090055 - DNA, 22 bp, Homo sapiens
ggcgtttcaccatgttgaccag

SEQ ID NO: 9090056 - DNA, 22 bp, Homo sapiens
ggcgtggggccttctgcccgct

SEQ ID NO: 9090057 - DNA, 22 bp, Homo sapiens
ggctaaagatgtgttctttgga

SEQ ID NO: 9090058 - DNA, 22 bp, Homo sapiens
ggcgtgggcgaggtgctctatc

SEQ ID NO: 9090059 - DNA, 22 bp, Homo sapiens
ggctagaagtcagaggtcaaga

SEQ ID NO: 9090060 - DNA, 22 bp, Homo sapiens
ggctagaataattgacttcatt

SEQ ID NO: 9090061 - DNA, 22 bp, Homo sapiens
ggctagaaatttttacttaagt

SEQ ID NO: 9090062 - DNA, 22 bp, Homo sapiens
ggctaccagataaattacagag

SEQ ID NO: 9090063 - DNA, 22 bp, Homo sapiens
ggctagatggtatataaggatg

SEQ ID NO: 9090064 - DNA, 22 bp, Homo sapiens
gggagctgagctggaagagaat

SEQ ID NO: 9090065 - DNA, 22 bp, Homo sapiens
gggagctgagctggaagagaat

SEQ ID NO: 9090066 - DNA, 22 bp, Homo sapiens
gggagctgagctctgagccacg

SEQ ID NO: 9090067 - DNA, 21 bp, Homo sapiens
gggagctgacagcagcacggc

SEQ ID NO: 9090068 - DNA, 22 bp, Homo sapiens
gggagctgagggacctctgtgg

SEQ ID NO: 9090069 - DNA, 22 bp, Homo sapiens
gggagctgagggacctctgtgg

SEQ ID NO: 9090070 - DNA, 22 bp, Homo sapiens
gggagctgagctggaagagaat

SEQ ID NO: 9090071 - DNA, 22 bp, Homo sapiens
gggagctgaggagccccgtcgg

SEQ ID NO: 9090072 - DNA, 22 bp, Homo sapiens
gggagctggagctggaagactc

SEQ ID NO: 9090073 - DNA, 19 bp, Homo sapiens
gggagctgaggtctttggt

SEQ ID NO: 9090074 - DNA, 22 bp, Homo sapiens
gggaagtgtgcagagttctctt

SEQ ID NO: 9090075 - DNA, 22 bp, Homo sapiens
gggaagtgtggtttctttacag

SEQ ID NO: 9090076 - DNA, 22 bp, Homo sapiens
gggaagtttgtgggaggaatat

SEQ ID NO: 9090077 - DNA, 17 bp, Homo sapiens
gggaagtggagaaagct

SEQ ID NO: 9090078 - DNA, 23 bp, Homo sapiens
gggaagtggggatttgaagtcat

SEQ ID NO: 9090079 - DNA, 23 bp, Homo sapiens
gggaagtggggatttgaagtcat

SEQ ID NO: 9090080 - DNA, 22 bp, Homo sapiens
gggaagtgccctcttcaggaga

SEQ ID NO: 9090081 - DNA, 22 bp, Homo sapiens
gggaatgaccttaataagtagg

SEQ ID NO: 9090082 - DNA, 22 bp, Homo sapiens
gggaatgagagtcagcccagga

SEQ ID NO: 9090083 - DNA, 23 bp, Homo sapiens
gggaagtgaggagcccctcagcc

SEQ ID NO: 9090084 - DNA, 22 bp, Homo sapiens
gggaagtgaagtgtagctgtct

SEQ ID NO: 9090085 - DNA, 22 bp, Homo sapiens
gggaagtgagctggaatcaagg

SEQ ID NO: 9090086 - DNA, 22 bp, Homo sapiens
gggaagtgatggagccaggatt

SEQ ID NO: 9090087 - DNA, 22 bp, Homo sapiens
gggaagtgatggagccaggatt

SEQ ID NO: 9090088 - DNA, 23 bp, Homo sapiens
gggaagtgaggagcccctctgcc

SEQ ID NO: 9090089 - DNA, 22 bp, Homo sapiens
gggaagtgaggagcccctctgc

SEQ ID NO: 9090090 - DNA, 22 bp, Homo sapiens
ggctttatgcagggatagaaat

SEQ ID NO: 9090091 - DNA, 22 bp, Homo sapiens
ggctttatgcacagcagatggt

SEQ ID NO: 9090092 - DNA, 22 bp, Homo sapiens
ggctttatcaaatgagaccctg

SEQ ID NO: 9090093 - DNA, 22 bp, Homo sapiens
ggctttatagggtagaggatca

SEQ ID NO: 9090094 - DNA, 22 bp, Homo sapiens
ggctttatattgtttgagcaga

SEQ ID NO: 9090095 - DNA, 20 bp, Homo sapiens
ggctgtgcccttccgtggcc

SEQ ID NO: 9090096 - DNA, 22 bp, Homo sapiens
ggctgtgcctcaaggctactca

SEQ ID NO: 9090097 - DNA, 21 bp, Homo sapiens
ggctttatgctcacccagcct

SEQ ID NO: 9090098 - DNA, 22 bp, Homo sapiens
ggctttatgtttttcatgtggt

SEQ ID NO: 9090099 - DNA, 22 bp, Homo sapiens
ggctttattaagcagggtaagt

SEQ ID NO: 9090100 - DNA, 22 bp, Homo sapiens
ggctttattaactcatccgtaa

SEQ ID NO: 9090101 - DNA, 22 bp, Homo sapiens
ggctttatttcactgtaccata

SEQ ID NO: 9090102 - DNA, 22 bp, Homo sapiens
ggctttattatgtggccatgtg

SEQ ID NO: 9090103 - DNA, 22 bp, Homo sapiens
ggctttatttgcagccattgtt

SEQ ID NO: 9090104 - DNA, 22 bp, Homo sapiens
ggctttattttgcatgaatgct

SEQ ID NO: 9090105 - DNA, 22 bp, Homo sapiens
ggctttctgagtcaaacactga

SEQ ID NO: 9090106 - DNA, 22 bp, Homo sapiens
ggctttgacatgctgaattaaa

SEQ ID NO: 9090107 - DNA, 22 bp, Homo sapiens
ggctttgcaaaatcggcttctg

SEQ ID NO: 9090108 - DNA, 22 bp, Homo sapiens
ggctttgcattttgatggaggt

SEQ ID NO: 9090109 - DNA, 22 bp, Homo sapiens
ggctttgcagcctcattgctct

SEQ ID NO: 9090110 - DNA, 22 bp, Homo sapiens
ggctttgccctggactgaggca

SEQ ID NO: 9090111 - DNA, 22 bp, Homo sapiens
gggaaggctgcctgagggatgg

SEQ ID NO: 9090112 - DNA, 22 bp, Homo sapiens
gggaaggctgcctgagggatgg

SEQ ID NO: 9090113 - DNA, 22 bp, Homo sapiens
gggaagggagggacctcagtct

SEQ ID NO: 9090114 - DNA, 22 bp, Homo sapiens
gggaggttgaggctgcagtgag

SEQ ID NO: 9090115 - DNA, 22 bp, Homo sapiens
gggaggttgaggctgcagtgag

SEQ ID NO: 9090116 - DNA, 22 bp, Homo sapiens
gggcacagtactccaatcaact

SEQ ID NO: 9090117 - DNA, 22 bp, Homo sapiens
gggcacaggagaaggatctggc

SEQ ID NO: 9090118 - DNA, 22 bp, Homo sapiens
gggcacaggagaaggatctggc

SEQ ID NO: 9090119 - DNA, 22 bp, Homo sapiens
gggcacaggagaaggatctggc

SEQ ID NO: 9090120 - DNA, 22 bp, Homo sapiens
gggcacaggagaaggatctggc

SEQ ID NO: 9090121 - DNA, 22 bp, Homo sapiens
gggaggttctgttcgcacttga

SEQ ID NO: 9090122 - DNA, 22 bp, Homo sapiens
gggaggtgttctgccaacgcgg

SEQ ID NO: 9090123 - DNA, 21 bp, Homo sapiens
gggagggatggaaatgatgtt

SEQ ID NO: 9090124 - DNA, 22 bp, Homo sapiens
gggagggattagttctgcctgg

SEQ ID NO: 9090125 - DNA, 22 bp, Homo sapiens
gggaggtgatggcaagcagcgg

SEQ ID NO: 9090126 - DNA, 22 bp, Homo sapiens
gggaggtgatggcaagcagcgg

SEQ ID NO: 9090127 - DNA, 22 bp, Homo sapiens
gggaggtgatggcaagcagcgg

SEQ ID NO: 9090128 - DNA, 22 bp, Homo sapiens
gggagggccaggctcacccagg

SEQ ID NO: 9090129 - DNA, 22 bp, Homo sapiens
gggaggtgatggcaagcagcgg

SEQ ID NO: 9090130 - DNA, 22 bp, Homo sapiens
gggagggacacaaagagttccc

SEQ ID NO: 9090131 - DNA, 22 bp, Homo sapiens
gggagggagaggacagttctat

SEQ ID NO: 9090132 - DNA, 22 bp, Homo sapiens
gggagctggcctactattagat

SEQ ID NO: 9090133 - DNA, 22 bp, Homo sapiens
gggagctggagctggaagactc

SEQ ID NO: 9090134 - DNA, 22 bp, Homo sapiens
gggagctggatcgcgcgcccgg

SEQ ID NO: 9090135 - DNA, 22 bp, Homo sapiens
gggagctggagttgtgttgcct

SEQ ID NO: 9090136 - DNA, 22 bp, Homo sapiens
gggagggatctgctaggcaatg

SEQ ID NO: 9090137 - DNA, 16 bp, Homo sapiens
gggagggagttggtgg

SEQ ID NO: 9090138 - DNA, 22 bp, Homo sapiens
gggagggatctgctaggcaatg

SEQ ID NO: 9090139 - DNA, 22 bp, Homo sapiens
gggagggaggtgatgcttggct

SEQ ID NO: 9090140 - DNA, 22 bp, Homo sapiens
gggagggaggtgctggttcacg

SEQ ID NO: 9090141 - DNA, 22 bp, Homo sapiens
gggagggaggtgatgcttggct

SEQ ID NO: 9090142 - DNA, 23 bp, Homo sapiens
gggcaccaggagcaccggacagg

SEQ ID NO: 9090143 - DNA, 22 bp, Homo sapiens
gggcacctggctagtgacagtg

SEQ ID NO: 9090144 - DNA, 22 bp, Homo sapiens
gggcacctggctagtgacagtg

SEQ ID NO: 9090145 - DNA, 22 bp, Homo sapiens
gggcacagtctaaagttgggcc

SEQ ID NO: 9090146 - DNA, 22 bp, Homo sapiens
gggcacagtctgcagcccccca

SEQ ID NO: 9090147 - DNA, 23 bp, Homo sapiens
gggcaccaggagcaccggacagg

SEQ ID NO: 9090148 - DNA, 22 bp, Homo sapiens
gggcaccagcggccgcactgcc

SEQ ID NO: 9090149 - DNA, 22 bp, Homo sapiens
gggcaccagcggccgcactgcc

SEQ ID NO: 9090150 - DNA, 22 bp, Homo sapiens
gggcactggaaggctctcaggc

SEQ ID NO: 9090151 - DNA, 22 bp, Homo sapiens
gggcactgctttgctctgtcac

SEQ ID NO: 9090152 - DNA, 22 bp, Homo sapiens
gggcactgctggaggctccctg

SEQ ID NO: 9090153 - DNA, 22 bp, Homo sapiens
gggcactgctggaggctccctg

SEQ ID NO: 9090154 - DNA, 22 bp, Homo sapiens
gggcactgaatgccaagctagg

SEQ ID NO: 9090155 - DNA, 22 bp, Homo sapiens
gggcactgaatgccaagctagg

SEQ ID NO: 9090156 - DNA, 18 bp, Homo sapiens
gggcactggggactggag

SEQ ID NO: 9090157 - DNA, 22 bp, Homo sapiens
gggcaggttattggagtaggga

SEQ ID NO: 9090158 - DNA, 23 bp, Homo sapiens
gggcaggtttttataggcttcag

SEQ ID NO: 9090159 - DNA, 23 bp, Homo sapiens
gggcaggtttttataggcttcag

SEQ ID NO: 9090160 - DNA, 22 bp, Homo sapiens
gggcagtcacagtgctggagca

SEQ ID NO: 9090161 - DNA, 22 bp, Homo sapiens
gggcagtcacagtgctggagca

SEQ ID NO: 9090162 - DNA, 22 bp, Homo sapiens
gggcagtgaatattggtgggaa

SEQ ID NO: 9090163 - DNA, 22 bp, Homo sapiens
gggcagtgacaaaggggatgaa

SEQ ID NO: 9090164 - DNA, 22 bp, Homo sapiens
gggcagtgattttccttagagg

SEQ ID NO: 9090165 - DNA, 19 bp, Homo sapiens
gggcagtggcactagggag

SEQ ID NO: 9090166 - DNA, 22 bp, Homo sapiens
gggcagtgttgctctcaaagtc

SEQ ID NO: 9090167 - DNA, 19 bp, Homo sapiens
gggcagtggcactagggag

SEQ ID NO: 9090168 - DNA, 22 bp, Homo sapiens
gctcactgcaacctccacctcc

SEQ ID NO: 9090169 - DNA, 18 bp, Homo sapiens
gctcaggccctagtcagt

SEQ ID NO: 9090170 - DNA, 22 bp, Homo sapiens
gctcaggcccagcggctggtgt

SEQ ID NO: 9090171 - DNA, 22 bp, Homo sapiens
gctcaggcatgtatgtggttgc

SEQ ID NO: 9090172 - DNA, 22 bp, Homo sapiens
gctcacagtctgctgagtgcag

SEQ ID NO: 9090173 - DNA, 22 bp, Homo sapiens
gctcacagtctgctgagtgcag

SEQ ID NO: 9090174 - DNA, 22 bp, Homo sapiens
gctcacagtacagtgctggctc

SEQ ID NO: 9090175 - DNA, 22 bp, Homo sapiens
gctcacaggtctgtggctattg

SEQ ID NO: 9090176 - DNA, 23 bp, Homo sapiens
gctcacagggtgtaactcctagt

SEQ ID NO: 9090177 - DNA, 22 bp, Homo sapiens
gctcacagagggtgcttaatac

SEQ ID NO: 9090178 - DNA, 22 bp, Homo sapiens
gctcacagaacttctcttccca

SEQ ID NO: 9090179 - DNA, 22 bp, Homo sapiens
gctcaaggcaggcagacatgag

SEQ ID NO: 9090180 - DNA, 22 bp, Homo sapiens
gctcaagccttctgcccacctc

SEQ ID NO: 9090181 - DNA, 22 bp, Homo sapiens
gctcaatgctcaatgctgcaaa

SEQ ID NO: 9090182 - DNA, 22 bp, Homo sapiens
gctcaagggatgggagtgggtg

SEQ ID NO: 9090183 - DNA, 22 bp, Homo sapiens
gctcaagccttctgcccacctc

SEQ ID NO: 9090184 - DNA, 22 bp, Homo sapiens
gctcaagagagatgcagttctt

SEQ ID NO: 9090185 - DNA, 22 bp, Homo sapiens
gctcaaatttcagactcatgaa

SEQ ID NO: 9090186 - DNA, 22 bp, Homo sapiens
gctcaaatttcagactcatgaa

SEQ ID NO: 9090187 - DNA, 19 bp, Homo sapiens
gctcaacagctcgggtcct

SEQ ID NO: 9090188 - DNA, 22 bp, Homo sapiens
gctcaagaccaagggagcgggg

SEQ ID NO: 9090189 - DNA, 22 bp, Homo sapiens
gcggggcccccggccgagctct

SEQ ID NO: 9090190 - DNA, 22 bp, Homo sapiens
gcggggcccggacccagcctct

SEQ ID NO: 9090191 - DNA, 22 bp, Homo sapiens
gcggggggaggaacatcttgca

SEQ ID NO: 9090192 - DNA, 22 bp, Homo sapiens
gcgggggcggcgcagacctcag

SEQ ID NO: 9090193 - DNA, 22 bp, Homo sapiens
gcggggggcagcagtcgctcag

SEQ ID NO: 9090194 - DNA, 22 bp, Homo sapiens
gcggggggaggaacatcttgca

SEQ ID NO: 9090195 - DNA, 22 bp, Homo sapiens
gcgagaaactaagtgccctttg

SEQ ID NO: 9090196 - DNA, 22 bp, Homo sapiens
gcgccccatctacagtactttt

SEQ ID NO: 9090197 - DNA, 22 bp, Homo sapiens
gccttttttgttgctctgtcac

SEQ ID NO: 9090198 - DNA, 22 bp, Homo sapiens
gccttttttgttgctctgtcac

SEQ ID NO: 9090199 - DNA, 22 bp, Homo sapiens
gccttgatctgctgtgtttgag

SEQ ID NO: 9090200 - DNA, 22 bp, Homo sapiens
gccttgccaaggggcagcagag

SEQ ID NO: 9090201 - DNA, 22 bp, Homo sapiens
gccttctctgtgagctcctagg

SEQ ID NO: 9090202 - DNA, 22 bp, Homo sapiens
gccttctgatatctcttggcat

SEQ ID NO: 9090203 - DNA, 22 bp, Homo sapiens
gccttccacctaggcctctgct

SEQ ID NO: 9090204 - DNA, 22 bp, Homo sapiens
gccttccacctaggcctctgct

SEQ ID NO: 9090205 - DNA, 22 bp, Homo sapiens
gccttctgcgctcgtgtctccg

SEQ ID NO: 9090206 - DNA, 22 bp, Homo sapiens
gccttctgtccaaccccacgat

SEQ ID NO: 9090207 - DNA, 22 bp, Homo sapiens
gccttctgtgctcctggccttt

SEQ ID NO: 9090208 - DNA, 22 bp, Homo sapiens
gccttctgatcgctggactgac

SEQ ID NO: 9090209 - DNA, 22 bp, Homo sapiens
gccttctgattgctggactgac

SEQ ID NO: 9090210 - DNA, 22 bp, Homo sapiens
gcggcaggagtaaaggaggaag

SEQ ID NO: 9090211 - DNA, 22 bp, Homo sapiens
gcggagggcgagcccgcggagc

SEQ ID NO: 9090212 - DNA, 22 bp, Homo sapiens
gcggaggaaactgaggcaagag

SEQ ID NO: 9090213 - DNA, 22 bp, Homo sapiens
gcgctcaggtgccaggcctgcg

SEQ ID NO: 9090214 - DNA, 22 bp, Homo sapiens
gcgctgcgcctcctcttccgca

SEQ ID NO: 9090215 - DNA, 22 bp, Homo sapiens
gcgctgaggctggaggcgcacg

SEQ ID NO: 9090216 - DNA, 22 bp, Homo sapiens
gcggcgcctaagccccgacctc

SEQ ID NO: 9090217 - DNA, 22 bp, Homo sapiens
gcggcctgcgctgctcccgacg

SEQ ID NO: 9090218 - DNA, 22 bp, Homo sapiens
gcggccttgtggcggagcaggc

SEQ ID NO: 9090219 - DNA, 22 bp, Homo sapiens
gcgggcgggggttcccaggtct

SEQ ID NO: 9090220 - DNA, 21 bp, Homo sapiens
gcctggctagaagctcctagc

SEQ ID NO: 9090221 - DNA, 22 bp, Homo sapiens
gcctcagggataggatgagcat

SEQ ID NO: 9090222 - DNA, 22 bp, Homo sapiens
gcctcaggccgccctgctgctc

SEQ ID NO: 9090223 - DNA, 22 bp, Homo sapiens
gcctcaggcctatagctgctgt

SEQ ID NO: 9090224 - DNA, 22 bp, Homo sapiens
gcctggctgctggttctgagga

SEQ ID NO: 9090225 - DNA, 22 bp, Homo sapiens
gcctggctgctagccagaggca

SEQ ID NO: 9090226 - DNA, 22 bp, Homo sapiens
gcctggctagttagtgtcaggt

SEQ ID NO: 9090227 - DNA, 22 bp, Homo sapiens
gcctggctgggcaccaggggag

SEQ ID NO: 9090228 - DNA, 19 bp, Homo sapiens
gcctggctgggatgagccc

SEQ ID NO: 9090229 - DNA, 22 bp, Homo sapiens
gcctggctgtctggcaaggttc

SEQ ID NO: 9090230 - DNA, 22 bp, Homo sapiens
gcctggctgtctggcaaggttc

SEQ ID NO: 9090231 - DNA, 22 bp, Homo sapiens
gcctggggaacttgatcctgtc

SEQ ID NO: 9090232 - DNA, 22 bp, Homo sapiens
gcctggcttgccagccctggcg

SEQ ID NO: 9090233 - DNA, 22 bp, Homo sapiens
gcctggcttcccttggagcatt

SEQ ID NO: 9090234 - DNA, 22 bp, Homo sapiens
gcctggcttcccttggagcatt

SEQ ID NO: 9090235 - DNA, 21 bp, Homo sapiens
gcctggcttcacaggcactga

SEQ ID NO: 9090236 - DNA, 21 bp, Homo sapiens
gcctggcttcacaggcactga

SEQ ID NO: 9090237 - DNA, 22 bp, Homo sapiens
gcctggggtctctgactcacag

SEQ ID NO: 9090238 - DNA, 22 bp, Homo sapiens
gcctggggtctctgactcacag

SEQ ID NO: 9090239 - DNA, 22 bp, Homo sapiens
gcctggggtcccttgttggcac

SEQ ID NO: 9090240 - DNA, 22 bp, Homo sapiens
gcctggtgaaaggcagagagcg

SEQ ID NO: 9090241 - DNA, 22 bp, Homo sapiens
gcctggtgaaaggcagagagcg

SEQ ID NO: 9090242 - DNA, 22 bp, Homo sapiens
gcctggtgataagcagtgacct

SEQ ID NO: 9090243 - DNA, 22 bp, Homo sapiens
gcctgggttccatgatctccag

SEQ ID NO: 9090244 - DNA, 22 bp, Homo sapiens
gcctggtctctttcatgtcagt

SEQ ID NO: 9090245 - DNA, 22 bp, Homo sapiens
gcctgggtgaatttgatcctaa

SEQ ID NO: 9090246 - DNA, 22 bp, Homo sapiens
gcctgggtctcctccgcttccc

SEQ ID NO: 9090247 - DNA, 22 bp, Homo sapiens
gcctgggtccactgatcatgct

SEQ ID NO: 9090248 - DNA, 23 bp, Homo sapiens
gcctgggtctagagataagagcc

SEQ ID NO: 9090249 - DNA, 22 bp, Homo sapiens
gcctgggttccatgatctccag

SEQ ID NO: 9090250 - DNA, 22 bp, Homo sapiens
gcctgggtgtcgatcactagtg

SEQ ID NO: 9090251 - DNA, 22 bp, Homo sapiens
gcctgggtgtcgatcactagtg

SEQ ID NO: 9090252 - DNA, 22 bp, Homo sapiens
gcctgggtgagggtctccttca

SEQ ID NO: 9090253 - DNA, 23 bp, Homo sapiens
gccttcagctcgggaaggctccc

SEQ ID NO: 9090254 - DNA, 23 bp, Homo sapiens
gccttcagctcgggaaggctccc

SEQ ID NO: 9090255 - DNA, 18 bp, Homo sapiens
gccttcagactgcatgct

SEQ ID NO: 9090256 - DNA, 22 bp, Homo sapiens
gccttcagccctgactggccag

SEQ ID NO: 9090257 - DNA, 22 bp, Homo sapiens
gccttcagcggccgctcgctgc

SEQ ID NO: 9090258 - DNA, 22 bp, Homo sapiens
gccttcagcggccgctcgctgc

SEQ ID NO: 9090259 - DNA, 22 bp, Homo sapiens
gccttcaggaaatcagtccttg

SEQ ID NO: 9090260 - DNA, 22 bp, Homo sapiens
gccttcaggaaatcagtccttg

SEQ ID NO: 9090261 - DNA, 22 bp, Homo sapiens
gccttcaggagggttccagaca

SEQ ID NO: 9090262 - DNA, 22 bp, Homo sapiens
gccttcagtagtgtcagctgta

SEQ ID NO: 9090263 - DNA, 22 bp, Homo sapiens
gccttcaggtgctgccaggcta

SEQ ID NO: 9090264 - DNA, 22 bp, Homo sapiens
gccttcaggtgctgccaggcta

SEQ ID NO: 9090265 - DNA, 22 bp, Homo sapiens
gccttcaggagggttccagaca

SEQ ID NO: 9090266 - DNA, 22 bp, Homo sapiens
gccttcagtaactgagacggaa

SEQ ID NO: 9090267 - DNA, 22 bp, Homo sapiens
gccttcagtagtatcctcatga

SEQ ID NO: 9090268 - DNA, 22 bp, Homo sapiens
gcctggtggtatcctggcaaga

SEQ ID NO: 9090269 - DNA, 22 bp, Homo sapiens
gcctggtggtgtgctcaagtgg

SEQ ID NO: 9090270 - DNA, 22 bp, Homo sapiens
gcctggtggtgtgctcaagtgg

SEQ ID NO: 9090271 - DNA, 22 bp, Homo sapiens
gcctggtggacactgggcatca

SEQ ID NO: 9090272 - DNA, 22 bp, Homo sapiens
gcctggtggacactgggcatca

SEQ ID NO: 9090273 - DNA, 22 bp, Homo sapiens
gcctggtgctatgagggccagc

SEQ ID NO: 9090274 - DNA, 22 bp, Homo sapiens
gcctggtgctatgagggccagc

SEQ ID NO: 9090275 - DNA, 21 bp, Homo sapiens
gccttcactcccagagtttgt

SEQ ID NO: 9090276 - DNA, 22 bp, Homo sapiens
gccttattacctgcactttgaa

SEQ ID NO: 9090277 - DNA, 22 bp, Homo sapiens
gccttcagagtaccatgtcctc

SEQ ID NO: 9090278 - DNA, 22 bp, Homo sapiens
gccttcagccctgactggccag

SEQ ID NO: 9090279 - DNA, 22 bp, Homo sapiens
gctgcaggttgggcaacagagt

SEQ ID NO: 9090280 - DNA, 22 bp, Homo sapiens
gctgcagggggtgggcgtctcc

SEQ ID NO: 9090281 - DNA, 22 bp, Homo sapiens
gctgcaggatgaggctctgctc

SEQ ID NO: 9090282 - DNA, 22 bp, Homo sapiens
gctgccacttggtcatgtcatg

SEQ ID NO: 9090283 - DNA, 22 bp, Homo sapiens
gctgccactctgagcttgcttc

SEQ ID NO: 9090284 - DNA, 22 bp, Homo sapiens
gctgcagctttaggatccagtg

SEQ ID NO: 9090285 - DNA, 22 bp, Homo sapiens
gctgcaggagctggagctgtgg

SEQ ID NO: 9090286 - DNA, 22 bp, Homo sapiens
gctgcaggagctggagctgtgg

SEQ ID NO: 9090287 - DNA, 22 bp, Homo sapiens
gctgcagacctcatgcaggtgg

SEQ ID NO: 9090288 - DNA, 22 bp, Homo sapiens
gctgcagacctcatgcaggtgg

SEQ ID NO: 9090289 - DNA, 22 bp, Homo sapiens
gctgcagctgtaggacacaatt

SEQ ID NO: 9090290 - DNA, 23 bp, Homo sapiens
gctgcagctgtggatgttctcag

SEQ ID NO: 9090291 - DNA, 22 bp, Homo sapiens
gctgccagctcactctcctgag

SEQ ID NO: 9090292 - DNA, 22 bp, Homo sapiens
gctgccagtagttggagctcca

SEQ ID NO: 9090293 - DNA, 20 bp, Homo sapiens
gctgccagtgcctgatgctt

SEQ ID NO: 9090294 - DNA, 20 bp, Homo sapiens
gctgccagtgcctgatgctt

SEQ ID NO: 9090295 - DNA, 22 bp, Homo sapiens
gctgccagtgtggcatgatgca

SEQ ID NO: 9090296 - DNA, 22 bp, Homo sapiens
gctgccagttccttcttactcc

SEQ ID NO: 9090297 - DNA, 22 bp, Homo sapiens
gctgaagcccacgtggcttgta

SEQ ID NO: 9090298 - DNA, 22 bp, Homo sapiens
gctgaagcagatccaggtgtgg

SEQ ID NO: 9090299 - DNA, 19 bp, Homo sapiens
gctgaaggcgctcagaagc

SEQ ID NO: 9090300 - DNA, 22 bp, Homo sapiens
gctgaaggcccggaggacaggg

SEQ ID NO: 9090301 - DNA, 22 bp, Homo sapiens
gctgaagctgcagcaggaggaa

SEQ ID NO: 9090302 - DNA, 22 bp, Homo sapiens
gctgaagctgcagcaggaggaa

SEQ ID NO: 9090303 - DNA, 22 bp, Homo sapiens
gctgaaggaggctctggtacta

SEQ ID NO: 9090304 - DNA, 22 bp, Homo sapiens
gctgaaggaggctctggtacta

SEQ ID NO: 9090305 - DNA, 22 bp, Homo sapiens
gctgaagggagtgctgagtctg

SEQ ID NO: 9090306 - DNA, 20 bp, Homo sapiens
gctgaaggggtgggtttgtt

SEQ ID NO: 9090307 - DNA, 22 bp, Homo sapiens
gctgaaggtctctggagaggtc

SEQ ID NO: 9090308 - DNA, 21 bp, Homo sapiens
gctgaaggtgggttgtacagg

SEQ ID NO: 9090309 - DNA, 22 bp, Homo sapiens
gctgaaggtgtgtggagagagg

SEQ ID NO: 9090310 - DNA, 22 bp, Homo sapiens
gctgaagtgcttttgaatttgg

SEQ ID NO: 9090311 - DNA, 22 bp, Homo sapiens
gctgaagtctgagaatttgcaa

SEQ ID NO: 9090312 - DNA, 22 bp, Homo sapiens
gctgaataatgtgtaatgtctc

SEQ ID NO: 9090313 - DNA, 22 bp, Homo sapiens
gctgaataagagtctactttgc

SEQ ID NO: 9090314 - DNA, 22 bp, Homo sapiens
gctgcaaacctgccacctggtg

SEQ ID NO: 9090315 - DNA, 21 bp, Homo sapiens
gctgcaaattctaacaattat

SEQ ID NO: 9090316 - DNA, 22 bp, Homo sapiens
gctgcacatggcagaggccttt

SEQ ID NO: 9090317 - DNA, 19 bp, Homo sapiens
gctgcacacccagcaactg

SEQ ID NO: 9090318 - DNA, 22 bp, Homo sapiens
gctgcacagaacagtcattggc

SEQ ID NO: 9090319 - DNA, 22 bp, Homo sapiens
gctgaataggactgtcatctct

SEQ ID NO: 9090320 - DNA, 22 bp, Homo sapiens
gctgatccttttatgtctagct

SEQ ID NO: 9090321 - DNA, 22 bp, Homo sapiens
gctgaatacagcatgccttatg

SEQ ID NO: 9090322 - DNA, 22 bp, Homo sapiens
gctgaataatgtgtaatgtctc

SEQ ID NO: 9090323 - DNA, 22 bp, Homo sapiens
gctgaataattctttgttgtgg

SEQ ID NO: 9090324 - DNA, 22 bp, Homo sapiens
gctgaatagaagtcttcaaagg

SEQ ID NO: 9090325 - DNA, 22 bp, Homo sapiens
gctgaagagagatgcgtccagc

SEQ ID NO: 9090326 - DNA, 23 bp, Homo sapiens
gctgaagagcaaaccaggcaaaa

SEQ ID NO: 9090327 - DNA, 22 bp, Homo sapiens
gctctggctactgtggctaccg

SEQ ID NO: 9090328 - DNA, 22 bp, Homo sapiens
gctctggctactgtggctaccg

SEQ ID NO: 9090329 - DNA, 22 bp, Homo sapiens
gctctggcccaaaccctttcta

SEQ ID NO: 9090330 - DNA, 21 bp, Homo sapiens
gctctggcctactgttccctc

SEQ ID NO: 9090331 - DNA, 22 bp, Homo sapiens
gctctggccagaccctcagtgg

SEQ ID NO: 9090332 - DNA, 22 bp, Homo sapiens
gctctggccagaccctcagtgg

SEQ ID NO: 9090333 - DNA, 22 bp, Homo sapiens
gctctggctactccaccctgtt

SEQ ID NO: 9090334 - DNA, 22 bp, Homo sapiens
gctctggctactccaccctgtt

SEQ ID NO: 9090335 - DNA, 22 bp, Homo sapiens
gctctgctcttgacttaccagg

SEQ ID NO: 9090336 - DNA, 22 bp, Homo sapiens
gctctgctgcttactagatggt

SEQ ID NO: 9090337 - DNA, 22 bp, Homo sapiens
gctctgctgacagctgggacag

SEQ ID NO: 9090338 - DNA, 23 bp, Homo sapiens
gctctggcagcttgtgtcagcac

SEQ ID NO: 9090339 - DNA, 23 bp, Homo sapiens
gctctggcagcttgtgtcagcac

SEQ ID NO: 9090340 - DNA, 23 bp, Homo sapiens
gctctggcagcttgtgtcagcac

SEQ ID NO: 9090341 - DNA, 22 bp, Homo sapiens
gctctggcactggcgcgggatg

SEQ ID NO: 9090342 - DNA, 22 bp, Homo sapiens
gctctggcagctgatattagga

SEQ ID NO: 9090343 - DNA, 22 bp, Homo sapiens
gctctgctaatattgtagtacc

SEQ ID NO: 9090344 - DNA, 22 bp, Homo sapiens
gctctgctccctcaaatgacat

SEQ ID NO: 9090345 - DNA, 22 bp, Homo sapiens
gctctgctccctcaaatgacat

SEQ ID NO: 9090346 - DNA, 23 bp, Homo sapiens
gctctgctctgtttcatagacag

SEQ ID NO: 9090347 - DNA, 22 bp, Homo sapiens
gctctccaaaccctgtggcttt

SEQ ID NO: 9090348 - DNA, 22 bp, Homo sapiens
gctctcaggtacaaagctgtgt

SEQ ID NO: 9090349 - DNA, 22 bp, Homo sapiens
gctctccactgaccacggggca

SEQ ID NO: 9090350 - DNA, 21 bp, Homo sapiens
gctcctggtgctgcgtggcgc

SEQ ID NO: 9090351 - DNA, 21 bp, Homo sapiens
gctcctggtgctgcgtggcgc

SEQ ID NO: 9090352 - DNA, 22 bp, Homo sapiens
gctcctggtgctgtagagattt

SEQ ID NO: 9090353 - DNA, 22 bp, Homo sapiens
gctctcagatgctccagcagcc

SEQ ID NO: 9090354 - DNA, 22 bp, Homo sapiens
gctctcagatgctccagcagcc

SEQ ID NO: 9090355 - DNA, 22 bp, Homo sapiens
gctctattactttcaataaaaa

SEQ ID NO: 9090356 - DNA, 22 bp, Homo sapiens
gctctcactttaggttggaccg

SEQ ID NO: 9090357 - DNA, 22 bp, Homo sapiens
gctctcagaagagccaggctac

SEQ ID NO: 9090358 - DNA, 22 bp, Homo sapiens
gctcctgttttcttccagaaat

SEQ ID NO: 9090359 - DNA, 22 bp, Homo sapiens
gctccttcaggtggtagctgtt

SEQ ID NO: 9090360 - DNA, 22 bp, Homo sapiens
gctcctggtctggagcttcaag

SEQ ID NO: 9090361 - DNA, 22 bp, Homo sapiens
gctcagggaaagagctcctgtc

SEQ ID NO: 9090362 - DNA, 22 bp, Homo sapiens
gctcagggaactttttgcaggc

SEQ ID NO: 9090363 - DNA, 19 bp, Homo sapiens
gctcaggctgtgtgtgggg

SEQ ID NO: 9090364 - DNA, 21 bp, Homo sapiens
gctcaggctcaggttcaggtt

SEQ ID NO: 9090365 - DNA, 22 bp, Homo sapiens
gctcaggctctcccaggggaat

SEQ ID NO: 9090366 - DNA, 20 bp, Homo sapiens
gctgggggtgtgctgagtga

SEQ ID NO: 9090367 - DNA, 22 bp, Homo sapiens
gctggggtctgtgaggagggct

SEQ ID NO: 9090368 - DNA, 22 bp, Homo sapiens
gctgggtcagaatctccctgtg

SEQ ID NO: 9090369 - DNA, 18 bp, Homo sapiens
gctggggttgagctctcc

SEQ ID NO: 9090370 - DNA, 21 bp, Homo sapiens
gctgggtcagcaggtcctctg

SEQ ID NO: 9090371 - DNA, 22 bp, Homo sapiens
gctgggtccatggtcctcgggt

SEQ ID NO: 9090372 - DNA, 22 bp, Homo sapiens
gctgggtcccaagcctggggag

SEQ ID NO: 9090373 - DNA, 22 bp, Homo sapiens
gctgggtcccaagcctggggag

SEQ ID NO: 9090374 - DNA, 22 bp, Homo sapiens
gctgggagtcgcgtctgtggcc

SEQ ID NO: 9090375 - DNA, 22 bp, Homo sapiens
gctgggagtcgcgtctgtggcc

SEQ ID NO: 9090376 - DNA, 22 bp, Homo sapiens
gctgggaggcagcacctttagc

SEQ ID NO: 9090377 - DNA, 16 bp, Homo sapiens
gctgggagggagaggt

SEQ ID NO: 9090378 - DNA, 22 bp, Homo sapiens
gctgggttttcttccgggccta

SEQ ID NO: 9090379 - DNA, 22 bp, Homo sapiens
gctgggtttccagcaggcagga

SEQ ID NO: 9090380 - DNA, 22 bp, Homo sapiens
gctgggtttccagcaggcagga

SEQ ID NO: 9090381 - DNA, 22 bp, Homo sapiens
gctgggtttccagcaggcagga

SEQ ID NO: 9090382 - DNA, 22 bp, Homo sapiens
gctgggtgtcacggggctcgtg

SEQ ID NO: 9090383 - DNA, 22 bp, Homo sapiens
gctgggttttcttccgggccta

SEQ ID NO: 9090384 - DNA, 22 bp, Homo sapiens
gctgggttttcttccgggccta

SEQ ID NO: 9090385 - DNA, 22 bp, Homo sapiens
gctgggttttcttccgggccta

SEQ ID NO: 9090386 - DNA, 22 bp, Homo sapiens
gctgggttttcttccgggccta

SEQ ID NO: 9090387 - DNA, 22 bp, Homo sapiens
gctgtcttcacttcctggtttc

SEQ ID NO: 9090388 - DNA, 22 bp, Homo sapiens
gctggtcactctgggagctgct

SEQ ID NO: 9090389 - DNA, 22 bp, Homo sapiens
gctggtagacctcactgcactc

SEQ ID NO: 9090390 - DNA, 22 bp, Homo sapiens
gctgggtggatcggaggctctg

SEQ ID NO: 9090391 - DNA, 22 bp, Homo sapiens
gctgggtggatcggaggctctg

SEQ ID NO: 9090392 - DNA, 22 bp, Homo sapiens
gctgggtggatcggaggctctg

SEQ ID NO: 9090393 - DNA, 19 bp, Homo sapiens
gctgggtggggtccacagc

SEQ ID NO: 9090394 - DNA, 22 bp, Homo sapiens
gctgggtcctatgctggtagag

SEQ ID NO: 9090395 - DNA, 22 bp, Homo sapiens
gctgggtctctccctggtcctg

SEQ ID NO: 9090396 - DNA, 22 bp, Homo sapiens
gctgggtctggatgctcaggtg

SEQ ID NO: 9090397 - DNA, 22 bp, Homo sapiens
gctgggtctggctgtgagccgg

SEQ ID NO: 9090398 - DNA, 19 bp, Homo sapiens
gctgtgaatatcatgaggg

SEQ ID NO: 9090399 - DNA, 22 bp, Homo sapiens
gctgtcttgctcactcttgcag

SEQ ID NO: 9090400 - DNA, 22 bp, Homo sapiens
gctgtcttgatgattggatgct

SEQ ID NO: 9090401 - DNA, 22 bp, Homo sapiens
gctgtgagtgagctgcctaggc

SEQ ID NO: 9090402 - DNA, 22 bp, Homo sapiens
gctgtgatccttgagagaaggt

SEQ ID NO: 9090403 - DNA, 22 bp, Homo sapiens
gctgtgcagtctttggtgtgcc

SEQ ID NO: 9090404 - DNA, 22 bp, Homo sapiens
gctgtgcagtagtaggtacagt

SEQ ID NO: 9090405 - DNA, 22 bp, Homo sapiens
gctgtgcagccaagtgcctctg

SEQ ID NO: 9090406 - DNA, 22 bp, Homo sapiens
gctgtgcccagccattctagat

SEQ ID NO: 9090407 - DNA, 22 bp, Homo sapiens
gcttccatgttgctgctggtca

SEQ ID NO: 9090408 - DNA, 23 bp, Homo sapiens
gcttccattctagtttgctgtgc

SEQ ID NO: 9090409 - DNA, 22 bp, Homo sapiens
gcttccagtaagttgctgccat

SEQ ID NO: 9090410 - DNA, 22 bp, Homo sapiens
gcttccagtcctcagaggctgg

SEQ ID NO: 9090411 - DNA, 22 bp, Homo sapiens
gctggcagacttcctctggaac

SEQ ID NO: 9090412 - DNA, 22 bp, Homo sapiens
gctggcagactgggggcagaac

SEQ ID NO: 9090413 - DNA, 22 bp, Homo sapiens
gctggcagaagagctggttcaa

SEQ ID NO: 9090414 - DNA, 22 bp, Homo sapiens
gctggattggagcaatagagtc

SEQ ID NO: 9090415 - DNA, 21 bp, Homo sapiens
gctgcccaaccctgcatctcc

SEQ ID NO: 9090416 - DNA, 22 bp, Homo sapiens
gctgccatgccacagcactcac

SEQ ID NO: 9090417 - DNA, 22 bp, Homo sapiens
gctgccatggtccaggctccag

SEQ ID NO: 9090418 - DNA, 22 bp, Homo sapiens
gctggcacctgcaccaagcagg

SEQ ID NO: 9090419 - DNA, 22 bp, Homo sapiens
gctggcaggatagaagtctaat

SEQ ID NO: 9090420 - DNA, 22 bp, Homo sapiens
gctggcagagacaagaagacta

SEQ ID NO: 9090421 - DNA, 22 bp, Homo sapiens
gctggctcagggggattagcaa

SEQ ID NO: 9090422 - DNA, 22 bp, Homo sapiens
gctggctcccagaggccccagc

SEQ ID NO: 9090423 - DNA, 22 bp, Homo sapiens
gctggctgcacaggggctcact

SEQ ID NO: 9090424 - DNA, 18 bp, Homo sapiens
gctggctgcacttctgct

SEQ ID NO: 9090425 - DNA, 18 bp, Homo sapiens
gctggctgcacttctgct

SEQ ID NO: 9090426 - DNA, 18 bp, Homo sapiens
gctggctgcacttctgct

SEQ ID NO: 9090427 - DNA, 22 bp, Homo sapiens
gctggctgccttactttgtgga

SEQ ID NO: 9090428 - DNA, 22 bp, Homo sapiens
gctggctgccttactttgtgga

SEQ ID NO: 9090429 - DNA, 22 bp, Homo sapiens
gctggctgccttactttgtgga

SEQ ID NO: 9090430 - DNA, 22 bp, Homo sapiens
gctggctgcagattttagaggt

SEQ ID NO: 9090431 - DNA, 22 bp, Homo sapiens
gctggctgccaatttcagagct

SEQ ID NO: 9090432 - DNA, 22 bp, Homo sapiens
gctggctctacatttgaggtca

SEQ ID NO: 9090433 - DNA, 21 bp, Homo sapiens
gctggctctctgacgtgcttt

SEQ ID NO: 9090434 - DNA, 22 bp, Homo sapiens
gctggctcctctgtcctcacgg

SEQ ID NO: 9090435 - DNA, 22 bp, Homo sapiens
gctggctcccagaggccccagc

SEQ ID NO: 9090436 - DNA, 22 bp, Homo sapiens
gctggctctgcacccaggcctc

SEQ ID NO: 9090437 - DNA, 22 bp, Homo sapiens
gctggctctgccccacctgttc

SEQ ID NO: 9090438 - DNA, 22 bp, Homo sapiens
gctggctctgatgggctccagg

SEQ ID NO: 9090439 - DNA, 22 bp, Homo sapiens
gctggctctgatgggctccagg

SEQ ID NO: 9090440 - DNA, 22 bp, Homo sapiens
gctggctctgcacccaggcctc

SEQ ID NO: 9090441 - DNA, 22 bp, Homo sapiens
gctgggaggatctctccctgtc

SEQ ID NO: 9090442 - DNA, 22 bp, Homo sapiens
gctgggaggatctctccctgtc

SEQ ID NO: 9090443 - DNA, 22 bp, Homo sapiens
gctgggagaggccctgaagtga

SEQ ID NO: 9090444 - DNA, 22 bp, Homo sapiens
gctgggagaggccctgaagtga

SEQ ID NO: 9090445 - DNA, 22 bp, Homo sapiens
gctgggagaggcagctttcgga

SEQ ID NO: 9090446 - DNA, 22 bp, Homo sapiens
gctgggactgagacagtgacct

SEQ ID NO: 9090447 - DNA, 22 bp, Homo sapiens
gctgggaagagatgcacatgat

SEQ ID NO: 9090448 - DNA, 22 bp, Homo sapiens
gctgggaaccatgggaaggcag

SEQ ID NO: 9090449 - DNA, 22 bp, Homo sapiens
ggactgaggacatgtgaggcat

SEQ ID NO: 9090450 - DNA, 22 bp, Homo sapiens
ggactgaatgccagtctatgga

SEQ ID NO: 9090451 - DNA, 22 bp, Homo sapiens
ggactgaagtgctgtctagtgt

SEQ ID NO: 9090452 - DNA, 22 bp, Homo sapiens
ggagagagatgccgccttgctc

SEQ ID NO: 9090453 - DNA, 22 bp, Homo sapiens
ggacggggagctggaaagggga

SEQ ID NO: 9090454 - DNA, 22 bp, Homo sapiens
ggaccttcctggctcctggggt

SEQ ID NO: 9090455 - DNA, 22 bp, Homo sapiens
ggacctggcaatttgcatctct

SEQ ID NO: 9090456 - DNA, 22 bp, Homo sapiens
ggagaggacatggctcccacag

SEQ ID NO: 9090457 - DNA, 22 bp, Homo sapiens
ggagaggagctattgggggctc

SEQ ID NO: 9090458 - DNA, 22 bp, Homo sapiens
ggagaggagattgtggcatttt

SEQ ID NO: 9090459 - DNA, 22 bp, Homo sapiens
ggagaggagattgtggcatttt

SEQ ID NO: 9090460 - DNA, 22 bp, Homo sapiens
ggagaggaaatgccagcacttc

SEQ ID NO: 9090461 - DNA, 22 bp, Homo sapiens
ggagaggaaatgccagcacttc

SEQ ID NO: 9090462 - DNA, 22 bp, Homo sapiens
ggagagcttggagtgcgatttt

SEQ ID NO: 9090463 - DNA, 22 bp, Homo sapiens
ggagaggcttccagagtcgtgc

SEQ ID NO: 9090464 - DNA, 22 bp, Homo sapiens
ggagaggcttccagagtcgtgc

SEQ ID NO: 9090465 - DNA, 19 bp, Homo sapiens
ggagaggctggagggatgc

SEQ ID NO: 9090466 - DNA, 19 bp, Homo sapiens
ggagaggctggagggatgc

SEQ ID NO: 9090467 - DNA, 22 bp, Homo sapiens
ggagaggagctattgggggctc

SEQ ID NO: 9090468 - DNA, 22 bp, Homo sapiens
ggagaggatgttttagtaactt

SEQ ID NO: 9090469 - DNA, 22 bp, Homo sapiens
ggagaggcgatgagtcacagcc

SEQ ID NO: 9090470 - DNA, 22 bp, Homo sapiens
ggagaggcgatgagtcacagcc

SEQ ID NO: 9090471 - DNA, 22 bp, Homo sapiens
ggagaggcgatgagtcacagcc

SEQ ID NO: 9090472 - DNA, 22 bp, Homo sapiens
ggacagagagtgaatatgacat

SEQ ID NO: 9090473 - DNA, 22 bp, Homo sapiens
ggacagagccctggtggcctaa

SEQ ID NO: 9090474 - DNA, 22 bp, Homo sapiens
ggacagagccctggtggcctaa

SEQ ID NO: 9090475 - DNA, 22 bp, Homo sapiens
ggacagagcagacgagcagcgg

SEQ ID NO: 9090476 - DNA, 22 bp, Homo sapiens
ggacctgaacataaaacgaggc

SEQ ID NO: 9090477 - DNA, 22 bp, Homo sapiens
ggacctgccagaactcaggcta

SEQ ID NO: 9090478 - DNA, 22 bp, Homo sapiens
ggacctgaacataaaacgaggc

SEQ ID NO: 9090479 - DNA, 23 bp, Homo sapiens
ggaccctgtggagggtgagagtc

SEQ ID NO: 9090480 - DNA, 22 bp, Homo sapiens
ggaccctgggcttgctcctggg

SEQ ID NO: 9090481 - DNA, 22 bp, Homo sapiens
ggaccctggagacccactggga

SEQ ID NO: 9090482 - DNA, 18 bp, Homo sapiens
ggacccagggcctcaccc

SEQ ID NO: 9090483 - DNA, 22 bp, Homo sapiens
ggacccagctctgagaccctgc

SEQ ID NO: 9090484 - DNA, 22 bp, Homo sapiens
ggacccagaggggagtctggca

SEQ ID NO: 9090485 - DNA, 18 bp, Homo sapiens
ggacccagggcctcaccc

SEQ ID NO: 9090486 - DNA, 22 bp, Homo sapiens
ggacccaccaggccgggctcca

SEQ ID NO: 9090487 - DNA, 22 bp, Homo sapiens
ggacagagggcaggagcccaga

SEQ ID NO: 9090488 - DNA, 23 bp, Homo sapiens
ggacccacggtctttgaggctct

SEQ ID NO: 9090489 - DNA, 22 bp, Homo sapiens
ggaaggaagtgaccaggatatc

SEQ ID NO: 9090490 - DNA, 22 bp, Homo sapiens
ggaaggaagtgaccaggatatc

SEQ ID NO: 9090491 - DNA, 22 bp, Homo sapiens
ggacacagtggaagacagcttg

SEQ ID NO: 9090492 - DNA, 22 bp, Homo sapiens
ggaaggaagtaaatgatgctat

SEQ ID NO: 9090493 - DNA, 22 bp, Homo sapiens
ggaaggaagaggaccgagctgg

SEQ ID NO: 9090494 - DNA, 22 bp, Homo sapiens
ggaaggaaagcagcttggccct

SEQ ID NO: 9090495 - DNA, 22 bp, Homo sapiens
ggaaggaaattggggcagttgt

SEQ ID NO: 9090496 - DNA, 22 bp, Homo sapiens
ggaaggaaattggggcagttgt

SEQ ID NO: 9090497 - DNA, 22 bp, Homo sapiens
ggaaggaacaaaccctgtgtgg

SEQ ID NO: 9090498 - DNA, 22 bp, Homo sapiens
ggaaggaacaaaccctgtgtgg

SEQ ID NO: 9090499 - DNA, 22 bp, Homo sapiens
ggaagccccagacccagagtct

SEQ ID NO: 9090500 - DNA, 22 bp, Homo sapiens
ggaagccccagctgtgggatcc

SEQ ID NO: 9090501 - DNA, 22 bp, Homo sapiens
ggaagccccagcatggccttgg

SEQ ID NO: 9090502 - DNA, 17 bp, Homo sapiens
ggaagcccttctgcctg

SEQ ID NO: 9090503 - DNA, 19 bp, Homo sapiens
ggaagccctgggtcagagc

SEQ ID NO: 9090504 - DNA, 19 bp, Homo sapiens
ggaagccctaaaggaccta

SEQ ID NO: 9090505 - DNA, 22 bp, Homo sapiens
ggaagccaggttactgttcaga

SEQ ID NO: 9090506 - DNA, 22 bp, Homo sapiens
ggaagcccagctgtctcctgtc

SEQ ID NO: 9090507 - DNA, 22 bp, Homo sapiens
ggaagctgttcctgtgtggcca

SEQ ID NO: 9090508 - DNA, 22 bp, Homo sapiens
ggaagctgttcctgtgtggcca

SEQ ID NO: 9090509 - DNA, 22 bp, Homo sapiens
ggaagctgttatcatctgtatc

SEQ ID NO: 9090510 - DNA, 21 bp, Homo sapiens
ggaagctgtgtccatgctcct

SEQ ID NO: 9090511 - DNA, 20 bp, Homo sapiens
ggaagctgtgggtccccagg

SEQ ID NO: 9090512 - DNA, 22 bp, Homo sapiens
ggaagctgttgtgagtgcagca

SEQ ID NO: 9090513 - DNA, 22 bp, Homo sapiens
ggaagctgttgtgagtgcagca

SEQ ID NO: 9090514 - DNA, 22 bp, Homo sapiens
ggaacagggatttggcctggtt

SEQ ID NO: 9090515 - DNA, 22 bp, Homo sapiens
ggaacatttaaattcttatttg

SEQ ID NO: 9090516 - DNA, 22 bp, Homo sapiens
ggaacatttcctggcagagagg

SEQ ID NO: 9090517 - DNA, 22 bp, Homo sapiens
ggaacattttttaaggcagaaa

SEQ ID NO: 9090518 - DNA, 22 bp, Homo sapiens
ggaagccagagtgctgggcagg

SEQ ID NO: 9090519 - DNA, 21 bp, Homo sapiens
ggaagcagtggcggcaactcc

SEQ ID NO: 9090520 - DNA, 21 bp, Homo sapiens
ggaagcagtggcggcaactcc

SEQ ID NO: 9090521 - DNA, 22 bp, Homo sapiens
ggaagccaggccaatgagaaca

SEQ ID NO: 9090522 - DNA, 22 bp, Homo sapiens
ggaagccagagtgctgggcagg

SEQ ID NO: 9090523 - DNA, 20 bp, Homo sapiens
ggaagccagggtgcagggga

SEQ ID NO: 9090524 - DNA, 22 bp, Homo sapiens
ggaagccaggctgggggatctg

SEQ ID NO: 9090525 - DNA, 22 bp, Homo sapiens
gcttcctgagagagacagttcc

SEQ ID NO: 9090526 - DNA, 22 bp, Homo sapiens
gcttcctgagaaacaatctgat

SEQ ID NO: 9090527 - DNA, 22 bp, Homo sapiens
gcttcctgagaaacaatctgat

SEQ ID NO: 9090528 - DNA, 22 bp, Homo sapiens
gcttcctgagacaacattgagt

SEQ ID NO: 9090529 - DNA, 22 bp, Homo sapiens
gcttcctgagacaacattgagt

SEQ ID NO: 9090530 - DNA, 22 bp, Homo sapiens
gcttcctgagacaacattgagt

SEQ ID NO: 9090531 - DNA, 18 bp, Homo sapiens
gcttcctgaaagctgccc

SEQ ID NO: 9090532 - DNA, 18 bp, Homo sapiens
gcttcctgaaagctgccc

SEQ ID NO: 9090533 - DNA, 17 bp, Homo sapiens
gcttcctcatgcagttc

SEQ ID NO: 9090534 - DNA, 22 bp, Homo sapiens
gcttcctccctgctgctcacta

SEQ ID NO: 9090535 - DNA, 22 bp, Homo sapiens
gcttcctccctgctgctcacta

SEQ ID NO: 9090536 - DNA, 22 bp, Homo sapiens
gcttcctagatctgtggtactc

SEQ ID NO: 9090537 - DNA, 22 bp, Homo sapiens
gcttcctacatgtgtctgcgag

SEQ ID NO: 9090538 - DNA, 22 bp, Homo sapiens
gcttcctcaccttctcttgcat

SEQ ID NO: 9090539 - DNA, 22 bp, Homo sapiens
gcttcccctccaagcactgcct

SEQ ID NO: 9090540 - DNA, 22 bp, Homo sapiens
gcttcccctccaagcactgcct

SEQ ID NO: 9090541 - DNA, 20 bp, Homo sapiens
gcttcccaattcttgatctg

SEQ ID NO: 9090542 - DNA, 22 bp, Homo sapiens
gcttcccaggcgcctgaccttt

SEQ ID NO: 9090543 - DNA, 19 bp, Homo sapiens
gcttcccaccagccagccc

SEQ ID NO: 9090544 - DNA, 22 bp, Homo sapiens
gcttcctgatattcatactgtt

SEQ ID NO: 9090545 - DNA, 22 bp, Homo sapiens
gcttcctgatattcatactgtt

SEQ ID NO: 9090546 - DNA, 22 bp, Homo sapiens
gcttcctgagtacaccctcatc

SEQ ID NO: 9090547 - DNA, 22 bp, Homo sapiens
gcttcctggaacaactgttgct

SEQ ID NO: 9090548 - DNA, 22 bp, Homo sapiens
ggaaaggagatattggagagtg

SEQ ID NO: 9090549 - DNA, 22 bp, Homo sapiens
ggaaaggagatgaataggatta

SEQ ID NO: 9090550 - DNA, 22 bp, Homo sapiens
ggaaaggcctgggtgtcctggg

SEQ ID NO: 9090551 - DNA, 17 bp, Homo sapiens
ggaaaggtagagtaatc

SEQ ID NO: 9090552 - DNA, 22 bp, Homo sapiens
ggaaatacaaagatacaccact

SEQ ID NO: 9090553 - DNA, 22 bp, Homo sapiens
ggaaagtggtggtggaaagagg

SEQ ID NO: 9090554 - DNA, 22 bp, Homo sapiens
ggaaatcatgggagagttggaa

SEQ ID NO: 9090555 - DNA, 22 bp, Homo sapiens
gcaagcagttgtggcttctgag

SEQ ID NO: 9090556 - DNA, 22 bp, Homo sapiens
gcaagcagttgtggcttctgag

SEQ ID NO: 9090557 - DNA, 22 bp, Homo sapiens
gcaagctgatgtgatagtgaaa

SEQ ID NO: 9090558 - DNA, 22 bp, Homo sapiens
gcaagctctctgcaggcagagc

SEQ ID NO: 9090559 - DNA, 22 bp, Homo sapiens
gcaagctggctgttagaggatg

SEQ ID NO: 9090560 - DNA, 22 bp, Homo sapiens
gcaagctggctgttagaggatg

SEQ ID NO: 9090561 - DNA, 22 bp, Homo sapiens
gcaagctgcttaagctcattgt

SEQ ID NO: 9090562 - DNA, 22 bp, Homo sapiens
gcaagctgcttaagctcattgt

SEQ ID NO: 9090563 - DNA, 22 bp, Homo sapiens
gcaagcagggttccttagggca

SEQ ID NO: 9090564 - DNA, 22 bp, Homo sapiens
gcaagcagggttccttagggca

SEQ ID NO: 9090565 - DNA, 22 bp, Homo sapiens
gcaagcagttgtggcttctgag

SEQ ID NO: 9090566 - DNA, 22 bp, Homo sapiens
gcaagcagttacccaggattcg

SEQ ID NO: 9090567 - DNA, 22 bp, Homo sapiens
gcaagcagcccagaacagctct

SEQ ID NO: 9090568 - DNA, 22 bp, Homo sapiens
gcaagcagcccagaacagctct

SEQ ID NO: 9090569 - DNA, 22 bp, Homo sapiens
gcaagcagatctccggagggaa

SEQ ID NO: 9090570 - DNA, 22 bp, Homo sapiens
gcaagcagacattcaggtaggt

SEQ ID NO: 9090571 - DNA, 22 bp, Homo sapiens
gcaagcagactgggcccctgtg

SEQ ID NO: 9090572 - DNA, 21 bp, Homo sapiens
gcacagcatgagtgttggcat

SEQ ID NO: 9090573 - DNA, 22 bp, Homo sapiens
gcacagccacgtaatgtggtca

SEQ ID NO: 9090574 - DNA, 22 bp, Homo sapiens
gcacagccactgagtgagaacc

SEQ ID NO: 9090575 - DNA, 22 bp, Homo sapiens
gcacagccactgagtgagaacc

SEQ ID NO: 9090576 - DNA, 22 bp, Homo sapiens
gcaaggaacaaatgctctgctt

SEQ ID NO: 9090577 - DNA, 22 bp, Homo sapiens
gcacagcagtggcataaacaat

SEQ ID NO: 9090578 - DNA, 22 bp, Homo sapiens
gcaagctgtgccttctcaggat

SEQ ID NO: 9090579 - DNA, 22 bp, Homo sapiens
gcaagctgtgatttatgtgaat

SEQ ID NO: 9090580 - DNA, 22 bp, Homo sapiens
gcaagctggctgttagaggatg

SEQ ID NO: 9090581 - DNA, 22 bp, Homo sapiens
gcacagccttgccctgtgccct

SEQ ID NO: 9090582 - DNA, 22 bp, Homo sapiens
gcacagcctgtccctgtcctgg

SEQ ID NO: 9090583 - DNA, 22 bp, Homo sapiens
gcacagccggaccgaggaaaag

SEQ ID NO: 9090584 - DNA, 22 bp, Homo sapiens
gcacagccctggtcggggcccc

SEQ ID NO: 9090585 - DNA, 22 bp, Homo sapiens
gcacagccagcatctgagggat

SEQ ID NO: 9090586 - DNA, 22 bp, Homo sapiens
gcacagccagcatctgagggat

SEQ ID NO: 9090587 - DNA, 22 bp, Homo sapiens
gcacagccctgagcgcatgtct

SEQ ID NO: 9090588 - DNA, 22 bp, Homo sapiens
gcacagctcctggtaagctggg

SEQ ID NO: 9090589 - DNA, 22 bp, Homo sapiens
gcacagctcagcatgggaggac

SEQ ID NO: 9090590 - DNA, 18 bp, Homo sapiens
gcacagctaggagggtcc

SEQ ID NO: 9090591 - DNA, 18 bp, Homo sapiens
gcacagctaggagggtcc

SEQ ID NO: 9090592 - DNA, 22 bp, Homo sapiens
gcacaggatgatgggttgaggg

SEQ ID NO: 9090593 - DNA, 19 bp, Homo sapiens
gcacaggacatctgatgga

SEQ ID NO: 9090594 - DNA, 22 bp, Homo sapiens
gcacaggatgatgggttgaggg

SEQ ID NO: 9090595 - DNA, 22 bp, Homo sapiens
gcacaggcaatagatacagcta

SEQ ID NO: 9090596 - DNA, 22 bp, Homo sapiens
gcacaggaaatgactcatgtta

SEQ ID NO: 9090597 - DNA, 22 bp, Homo sapiens
gcacagctctccccaagacgaa

SEQ ID NO: 9090598 - DNA, 22 bp, Homo sapiens
gcacagctcgagctcaggaggg

SEQ ID NO: 9090599 - DNA, 22 bp, Homo sapiens
gcacagctcgagctcaggaggg

SEQ ID NO: 9090600 - DNA, 22 bp, Homo sapiens
gcaagaaaagagccttcagtgg

SEQ ID NO: 9090601 - DNA, 22 bp, Homo sapiens
gcaagacatgtctaaggtttaa

SEQ ID NO: 9090602 - DNA, 22 bp, Homo sapiens
gcaagacaatggagcataaacg

SEQ ID NO: 9090603 - DNA, 22 bp, Homo sapiens
gcaaatgagttgtaacataaaa

SEQ ID NO: 9090604 - DNA, 22 bp, Homo sapiens
gagggtccccatgcagagctca

SEQ ID NO: 9090605 - DNA, 22 bp, Homo sapiens
gagggtcccgagccctgtcaga

SEQ ID NO: 9090606 - DNA, 22 bp, Homo sapiens
gcaaatcaccacctagctggat

SEQ ID NO: 9090607 - DNA, 22 bp, Homo sapiens
gagggtccctgctcagggccag

SEQ ID NO: 9090608 - DNA, 22 bp, Homo sapiens
gcaaatccttctgcgaccaggt

SEQ ID NO: 9090609 - DNA, 22 bp, Homo sapiens
gcaagcaaaatgggagattccc

SEQ ID NO: 9090610 - DNA, 22 bp, Homo sapiens
gcaagattccgctctagagcct

SEQ ID NO: 9090611 - DNA, 22 bp, Homo sapiens
gcaagcaagcaggtagagctga

SEQ ID NO: 9090612 - DNA, 22 bp, Homo sapiens
gcaagagcgctctctttcatta

SEQ ID NO: 9090613 - DNA, 22 bp, Homo sapiens
gcaagatgttaacatagggaga

SEQ ID NO: 9090614 - DNA, 22 bp, Homo sapiens
gcaagatgttaacatagggaga

SEQ ID NO: 9090615 - DNA, 22 bp, Homo sapiens
gcaagacctatctagttgctgt

SEQ ID NO: 9090616 - DNA, 22 bp, Homo sapiens
gcaagagacttttatgtctgcc

SEQ ID NO: 9090617 - DNA, 22 bp, Homo sapiens
gcaagacctatctagttgctgt

SEQ ID NO: 9090618 - DNA, 22 bp, Homo sapiens
gaggggtggcgttggcatttag

SEQ ID NO: 9090619 - DNA, 22 bp, Homo sapiens
gaggggtggccctggcgtgtac

SEQ ID NO: 9090620 - DNA, 22 bp, Homo sapiens
gaggggtgtggagccatcagtt

SEQ ID NO: 9090621 - DNA, 22 bp, Homo sapiens
gaggggctgtggagctctctgg

SEQ ID NO: 9090622 - DNA, 22 bp, Homo sapiens
gaggggctggggttgactccaa

SEQ ID NO: 9090623 - DNA, 22 bp, Homo sapiens
gcactgcctgtgagccctggtt

SEQ ID NO: 9090624 - DNA, 23 bp, Homo sapiens
gcactgccatgtgctctgcaggc

SEQ ID NO: 9090625 - DNA, 22 bp, Homo sapiens
gcactgccatcaatgcatgaca

SEQ ID NO: 9090626 - DNA, 22 bp, Homo sapiens
gcactgcatctactggcaagta

SEQ ID NO: 9090627 - DNA, 22 bp, Homo sapiens
gcactgcaggtgggtggagagg

SEQ ID NO: 9090628 - DNA, 22 bp, Homo sapiens
gcactgccacataatctcagca

SEQ ID NO: 9090629 - DNA, 22 bp, Homo sapiens
gcactgcatctactggcaagta

SEQ ID NO: 9090630 - DNA, 22 bp, Homo sapiens
gcactgatgcaaaaatcactca

SEQ ID NO: 9090631 - DNA, 22 bp, Homo sapiens
gcactgcagcctcagatggtgg

SEQ ID NO: 9090632 - DNA, 22 bp, Homo sapiens
gcactgcaggtgggtggagagg

SEQ ID NO: 9090633 - DNA, 22 bp, Homo sapiens
gcactgagtctgtcatgctgca

SEQ ID NO: 9090634 - DNA, 22 bp, Homo sapiens
gcactgggaatgagggcagctt

SEQ ID NO: 9090635 - DNA, 22 bp, Homo sapiens
gcactggattttgatctgcaag

SEQ ID NO: 9090636 - DNA, 22 bp, Homo sapiens
gcactggagggtgtagttgctg

SEQ ID NO: 9090637 - DNA, 22 bp, Homo sapiens
gcactggagggtgtagttgctg

SEQ ID NO: 9090638 - DNA, 22 bp, Homo sapiens
gcactggatcttgggagacgtg

SEQ ID NO: 9090639 - DNA, 22 bp, Homo sapiens
gcactggagatggggttgtcgg

SEQ ID NO: 9090640 - DNA, 22 bp, Homo sapiens
gcactggagatacagagatgaa

SEQ ID NO: 9090641 - DNA, 22 bp, Homo sapiens
gcactggagaatggctgtattc

SEQ ID NO: 9090642 - DNA, 22 bp, Homo sapiens
gcactggaccccaggatatgga

SEQ ID NO: 9090643 - DNA, 23 bp, Homo sapiens
gcactggaaaaatgaagattact

SEQ ID NO: 9090644 - DNA, 22 bp, Homo sapiens
gcactggaaggagggaatctta

SEQ ID NO: 9090645 - DNA, 22 bp, Homo sapiens
gcactggaaatacctagatgaa

SEQ ID NO: 9090646 - DNA, 22 bp, Homo sapiens
gcactggacaggagtgaaatta

SEQ ID NO: 9090647 - DNA, 22 bp, Homo sapiens
gcactctgtttctcctgtcagc

SEQ ID NO: 9090648 - DNA, 22 bp, Homo sapiens
gcactctgtgatctgcagagcc

SEQ ID NO: 9090649 - DNA, 22 bp, Homo sapiens
gcacaggcatcaggctttttct

SEQ ID NO: 9090650 - DNA, 22 bp, Homo sapiens
gcacaggcacagagggccactg

SEQ ID NO: 9090651 - DNA, 22 bp, Homo sapiens
gcacaggcacagagggccactg

SEQ ID NO: 9090652 - DNA, 22 bp, Homo sapiens
gcacaggcacagagggccactg

SEQ ID NO: 9090653 - DNA, 22 bp, Homo sapiens
gcacctgggacccagaggcacc

SEQ ID NO: 9090654 - DNA, 22 bp, Homo sapiens
gcactgaatgcttttactgtaa

SEQ ID NO: 9090655 - DNA, 22 bp, Homo sapiens
gcactgacatttcaagaacagc

SEQ ID NO: 9090656 - DNA, 19 bp, Homo sapiens
gcactgaagagttggtcac

SEQ ID NO: 9090657 - DNA, 22 bp, Homo sapiens
gcactgaaattatatgcatttg

SEQ ID NO: 9090658 - DNA, 20 bp, Homo sapiens
gcactgaaattcaatgtttg

SEQ ID NO: 9090659 - DNA, 17 bp, Homo sapiens
gcactgaacaatcctgt

SEQ ID NO: 9090660 - DNA, 17 bp, Homo sapiens
gcactgagccacagttt

SEQ ID NO: 9090661 - DNA, 22 bp, Homo sapiens
gcactgagcaccagccacagat

SEQ ID NO: 9090662 - DNA, 22 bp, Homo sapiens
gcactgagcaccagccacagat

SEQ ID NO: 9090663 - DNA, 18 bp, Homo sapiens
gcactgaggaaaacctct

SEQ ID NO: 9090664 - DNA, 22 bp, Homo sapiens
gcagagctgcagcgaggcctgg

SEQ ID NO: 9090665 - DNA, 22 bp, Homo sapiens
gcagagctctgttcttatctcc

SEQ ID NO: 9090666 - DNA, 22 bp, Homo sapiens
gcagaggacacaggagggcaag

SEQ ID NO: 9090667 - DNA, 22 bp, Homo sapiens
gcagaggacacaggagggcaag

SEQ ID NO: 9090668 - DNA, 22 bp, Homo sapiens
gcagaggacacaggagggcaag

SEQ ID NO: 9090669 - DNA, 22 bp, Homo sapiens
gcagaggacacaggagggcaag

SEQ ID NO: 9090670 - DNA, 22 bp, Homo sapiens
gcagaggactcaatcaaggtat

SEQ ID NO: 9090671 - DNA, 22 bp, Homo sapiens
gcagaggagcaagctggacacc

SEQ ID NO: 9090672 - DNA, 22 bp, Homo sapiens
gcagaggagcaagctggacacc

SEQ ID NO: 9090673 - DNA, 22 bp, Homo sapiens
gcagaggagatgaagatacttt

SEQ ID NO: 9090674 - DNA, 22 bp, Homo sapiens
gcagaggagcaagctggacacc

SEQ ID NO: 9090675 - DNA, 22 bp, Homo sapiens
gcagaggagcaagctggacacc

SEQ ID NO: 9090676 - DNA, 22 bp, Homo sapiens
gcacttatgctcaccttgttct

SEQ ID NO: 9090677 - DNA, 22 bp, Homo sapiens
gcactgtgctagaagccagggg

SEQ ID NO: 9090678 - DNA, 22 bp, Homo sapiens
gcacttcatgactttgtcaaat

SEQ ID NO: 9090679 - DNA, 22 bp, Homo sapiens
gcacttcacatgccttttcctg

SEQ ID NO: 9090680 - DNA, 22 bp, Homo sapiens
gcactgggctccaggaaggagg

SEQ ID NO: 9090681 - DNA, 21 bp, Homo sapiens
gcagcatgagaaagccccaaa

SEQ ID NO: 9090682 - DNA, 22 bp, Homo sapiens
gcagcatcaggttcactgcgtg

SEQ ID NO: 9090683 - DNA, 22 bp, Homo sapiens
gcagcatcaatccatgcttctc

SEQ ID NO: 9090684 - DNA, 22 bp, Homo sapiens
gcagcatcaggttcactgcgtg

SEQ ID NO: 9090685 - DNA, 22 bp, Homo sapiens
gcagcatccccaggcagcaggg

SEQ ID NO: 9090686 - DNA, 22 bp, Homo sapiens
gcagcatctgtacatagacgct

SEQ ID NO: 9090687 - DNA, 22 bp, Homo sapiens
gcagcatctagggcactggcct

SEQ ID NO: 9090688 - DNA, 22 bp, Homo sapiens
gcagcatctagggcactggcct

SEQ ID NO: 9090689 - DNA, 22 bp, Homo sapiens
gcagcatccttggcctccaccc

SEQ ID NO: 9090690 - DNA, 22 bp, Homo sapiens
gcagcatcctgggccacagtcc

SEQ ID NO: 9090691 - DNA, 22 bp, Homo sapiens
gcagcagtgcgggcagctacag

SEQ ID NO: 9090692 - DNA, 22 bp, Homo sapiens
gcagcagtgcgggcagctacag

SEQ ID NO: 9090693 - DNA, 19 bp, Homo sapiens
gcagcagtggaaggaaaaa

SEQ ID NO: 9090694 - DNA, 20 bp, Homo sapiens
gcagcagtgcaagtcctctt

SEQ ID NO: 9090695 - DNA, 22 bp, Homo sapiens
gcagcagtaggaaataacacag

SEQ ID NO: 9090696 - DNA, 22 bp, Homo sapiens
gcagcagtggctgcaggtccca

SEQ ID NO: 9090697 - DNA, 22 bp, Homo sapiens
gcagcagtggtctgtagaagga

SEQ ID NO: 9090698 - DNA, 22 bp, Homo sapiens
gcagcagtggtctgtagaagga

SEQ ID NO: 9090699 - DNA, 22 bp, Homo sapiens
gcagcagtgtgggctgaaccta

SEQ ID NO: 9090700 - DNA, 22 bp, Homo sapiens
gcagcatacagggagagtactc

SEQ ID NO: 9090701 - DNA, 21 bp, Homo sapiens
gcagcagtgttctagaatact

SEQ ID NO: 9090702 - DNA, 22 bp, Homo sapiens
gcagctgcaagcacttctggca

SEQ ID NO: 9090703 - DNA, 22 bp, Homo sapiens
gcagctgcagaccctcagtgct

SEQ ID NO: 9090704 - DNA, 22 bp, Homo sapiens
gcagctgcagaccctcagtgct

SEQ ID NO: 9090705 - DNA, 22 bp, Homo sapiens
gcagcatttgtggaatgggccc

SEQ ID NO: 9090706 - DNA, 22 bp, Homo sapiens
gcagcattgcacttttgttctt

SEQ ID NO: 9090707 - DNA, 22 bp, Homo sapiens
gcagctgccccgactgtgagtc

SEQ ID NO: 9090708 - DNA, 22 bp, Homo sapiens
gcagctgccccgactgtgagtc

SEQ ID NO: 9090709 - DNA, 20 bp, Homo sapiens
gcagctgcccccagtccctg

SEQ ID NO: 9090710 - DNA, 22 bp, Homo sapiens
gcagctgccccgactgtgagtc

SEQ ID NO: 9090711 - DNA, 22 bp, Homo sapiens
gcagctgccgtgagctcacgcc

SEQ ID NO: 9090712 - DNA, 22 bp, Homo sapiens
gcagctgccgtgagctcacgcc

SEQ ID NO: 9090713 - DNA, 22 bp, Homo sapiens
gcagctgccgtgagctcacgcc

SEQ ID NO: 9090714 - DNA, 20 bp, Homo sapiens
gcagctgcccccagtccctg

SEQ ID NO: 9090715 - DNA, 18 bp, Homo sapiens
gcagctgcagttgtagct

SEQ ID NO: 9090716 - DNA, 22 bp, Homo sapiens
gcagctgcaggtggtcccatgc

SEQ ID NO: 9090717 - DNA, 22 bp, Homo sapiens
gcagctgcaggcaggcttgctg

SEQ ID NO: 9090718 - DNA, 22 bp, Homo sapiens
gcagcaggcacggtctcgacat

SEQ ID NO: 9090719 - DNA, 22 bp, Homo sapiens
gcagcaggagagtttgtcctgc

SEQ ID NO: 9090720 - DNA, 22 bp, Homo sapiens
gcagcaggcacggtctcgacat

SEQ ID NO: 9090721 - DNA, 22 bp, Homo sapiens
gcagcaggagagtaatagcggt

SEQ ID NO: 9090722 - DNA, 22 bp, Homo sapiens
gcagcaggagagtttgtcctgc

SEQ ID NO: 9090723 - DNA, 22 bp, Homo sapiens
gcagcaggaataggataagcaa

SEQ ID NO: 9090724 - DNA, 22 bp, Homo sapiens
gcagcaggaataggataagcaa

SEQ ID NO: 9090725 - DNA, 22 bp, Homo sapiens
gcagaggaggacccaggaatta

SEQ ID NO: 9090726 - DNA, 22 bp, Homo sapiens
gcagcagcggggcccctgcgcg

SEQ ID NO: 9090727 - DNA, 23 bp, Homo sapiens
gcagaggagcaagctggacacca

SEQ ID NO: 9090728 - DNA, 23 bp, Homo sapiens
gcagaggagcaagctggacacca

SEQ ID NO: 9090729 - DNA, 23 bp, Homo sapiens
gcagaggagcaagctggacacca

SEQ ID NO: 9090730 - DNA, 22 bp, Homo sapiens
gcagcagctctgaatgggcccc

SEQ ID NO: 9090731 - DNA, 22 bp, Homo sapiens
gcagcagctgacagtgggtgcc

SEQ ID NO: 9090732 - DNA, 22 bp, Homo sapiens
gcagcagctccctatccaggct

SEQ ID NO: 9090733 - DNA, 22 bp, Homo sapiens
gcagcagctctgaatgggcccc

SEQ ID NO: 9090734 - DNA, 22 bp, Homo sapiens
gcagcagctcagccgggcactg

SEQ ID NO: 9090735 - DNA, 22 bp, Homo sapiens
gcagcagctcagttctgggagg

SEQ ID NO: 9090736 - DNA, 22 bp, Homo sapiens
gcagcagctcagttctgggagg

SEQ ID NO: 9090737 - DNA, 22 bp, Homo sapiens
gcagcagctcagttctgggagg

SEQ ID NO: 9090738 - DNA, 22 bp, Homo sapiens
gcaggagtgacatggatgtgga

SEQ ID NO: 9090739 - DNA, 22 bp, Homo sapiens
gcaggagtgtggtgggacatcc

SEQ ID NO: 9090740 - DNA, 22 bp, Homo sapiens
gcaggagtgtatttgcatgtaa

SEQ ID NO: 9090741 - DNA, 22 bp, Homo sapiens
gcaggagttaggcgtcgtggat

SEQ ID NO: 9090742 - DNA, 22 bp, Homo sapiens
gcaggcctctaattcaccgcag

SEQ ID NO: 9090743 - DNA, 22 bp, Homo sapiens
gcaggcctctgttgagggcctt

SEQ ID NO: 9090744 - DNA, 22 bp, Homo sapiens
gcaggcctctgttgagggcctt

SEQ ID NO: 9090745 - DNA, 22 bp, Homo sapiens
gcaggagtcactgacttggtcc

SEQ ID NO: 9090746 - DNA, 22 bp, Homo sapiens
gcaggaggttgagccaggactg

SEQ ID NO: 9090747 - DNA, 22 bp, Homo sapiens
gcagctggagcatcttctcatc

SEQ ID NO: 9090748 - DNA, 22 bp, Homo sapiens
gcagctggagccagccagacac

SEQ ID NO: 9090749 - DNA, 22 bp, Homo sapiens
gcagctggatttcaagagggag

SEQ ID NO: 9090750 - DNA, 22 bp, Homo sapiens
gcagctggatttcaagagggag

SEQ ID NO: 9090751 - DNA, 22 bp, Homo sapiens
gcagctggagccagccagacac

SEQ ID NO: 9090752 - DNA, 22 bp, Homo sapiens
gcagctggagccagccagacac

SEQ ID NO: 9090753 - DNA, 22 bp, Homo sapiens
gcagctggagcatcttctcatc

SEQ ID NO: 9090754 - DNA, 22 bp, Homo sapiens
gcagctggagccagccagacac

SEQ ID NO: 9090755 - DNA, 22 bp, Homo sapiens
gcagctggagcatcttctcatc

SEQ ID NO: 9090756 - DNA, 22 bp, Homo sapiens
gcagctggagcatcttctcatc

SEQ ID NO: 9090757 - DNA, 22 bp, Homo sapiens
gcagctggacccacacggctta

SEQ ID NO: 9090758 - DNA, 22 bp, Homo sapiens
gcagctggacccacacggctta

SEQ ID NO: 9090759 - DNA, 22 bp, Homo sapiens
gcagctggagaaataccaccct

SEQ ID NO: 9090760 - DNA, 22 bp, Homo sapiens
gcagctggacccacacggctta

SEQ ID NO: 9090761 - DNA, 22 bp, Homo sapiens
gcagctgcctattcagggcttg

SEQ ID NO: 9090762 - DNA, 22 bp, Homo sapiens
gcagctggacccacacggctta

SEQ ID NO: 9090763 - DNA, 22 bp, Homo sapiens
gcaggagctggaaagtgatgtt

SEQ ID NO: 9090764 - DNA, 22 bp, Homo sapiens
gcagctggccctgacacgcaga

SEQ ID NO: 9090765 - DNA, 22 bp, Homo sapiens
gcagctggccctgacacgcaga

SEQ ID NO: 9090766 - DNA, 22 bp, Homo sapiens
gcagctggcccctttccttgtt

SEQ ID NO: 9090767 - DNA, 22 bp, Homo sapiens
gcagctggcccctttccttgtt

SEQ ID NO: 9090768 - DNA, 22 bp, Homo sapiens
gcaggagctgctctcctgacga

SEQ ID NO: 9090769 - DNA, 22 bp, Homo sapiens
gcaggagctgctctcctgacga

SEQ ID NO: 9090770 - DNA, 22 bp, Homo sapiens
gcaggagctggaaagtgatgtt

SEQ ID NO: 9090771 - DNA, 22 bp, Homo sapiens
gcaggctccaactggaggagtt

SEQ ID NO: 9090772 - DNA, 22 bp, Homo sapiens
gcaggctcaaaagctggtagga

SEQ ID NO: 9090773 - DNA, 19 bp, Homo sapiens
gcaggcctcttgggaatta

SEQ ID NO: 9090774 - DNA, 22 bp, Homo sapiens
gcaggctcccttgcagagcagg

SEQ ID NO: 9090775 - DNA, 22 bp, Homo sapiens
gcaggctccaaggcctgggaga

SEQ ID NO: 9090776 - DNA, 22 bp, Homo sapiens
gcaggctgagttgggaaaccaa

SEQ ID NO: 9090777 - DNA, 22 bp, Homo sapiens
gcaggctgagttgggaaaccaa

SEQ ID NO: 9090778 - DNA, 22 bp, Homo sapiens
gcaggctgagtattaccctagt

SEQ ID NO: 9090779 - DNA, 22 bp, Homo sapiens
gcaggctgagtattaccctagt

SEQ ID NO: 9090780 - DNA, 22 bp, Homo sapiens
gcaggctgagagtccaagaagg

SEQ ID NO: 9090781 - DNA, 22 bp, Homo sapiens
gcaggctgagagtccaagaagg

SEQ ID NO: 9090782 - DNA, 22 bp, Homo sapiens
gcaggctgaaactcggggtcta

SEQ ID NO: 9090783 - DNA, 22 bp, Homo sapiens
gcaggctgatgactggagttgg

SEQ ID NO: 9090784 - DNA, 22 bp, Homo sapiens
gcaggctgatgactggagttgg

SEQ ID NO: 9090785 - DNA, 22 bp, Homo sapiens
gcaggctgatagaggattccat

SEQ ID NO: 9090786 - DNA, 22 bp, Homo sapiens
gcaggctgatagaggattccat

SEQ ID NO: 9090787 - DNA, 22 bp, Homo sapiens
gcaggctgccaccttctgagtt

SEQ ID NO: 9090788 - DNA, 22 bp, Homo sapiens
gcagggccttagcagcggctgc

SEQ ID NO: 9090789 - DNA, 22 bp, Homo sapiens
gcagggctattggaaggagatg

SEQ ID NO: 9090790 - DNA, 22 bp, Homo sapiens
gcagggctaatggggcaagtag

SEQ ID NO: 9090791 - DNA, 22 bp, Homo sapiens
gcagggcggcccagagcaggcc

SEQ ID NO: 9090792 - DNA, 22 bp, Homo sapiens
gcagtccttaggagaggaagta

SEQ ID NO: 9090793 - DNA, 22 bp, Homo sapiens
gcagtcctcctgcctcagcctc

SEQ ID NO: 9090794 - DNA, 22 bp, Homo sapiens
gcagtcctctcattggcctcct

SEQ ID NO: 9090795 - DNA, 22 bp, Homo sapiens
gcagtcatctgagctaactact

SEQ ID NO: 9090796 - DNA, 22 bp, Homo sapiens
gcagtcatcagtcctttaatta

SEQ ID NO: 9090797 - DNA, 21 bp, Homo sapiens
gcagtcatcatcaagctttgg

SEQ ID NO: 9090798 - DNA, 22 bp, Homo sapiens
gcagtcatccagcctttccact

SEQ ID NO: 9090799 - DNA, 22 bp, Homo sapiens
gcagtcatgggtagaactcaag

SEQ ID NO: 9090800 - DNA, 22 bp, Homo sapiens
gcagtcatttaacctctctgtg

SEQ ID NO: 9090801 - DNA, 22 bp, Homo sapiens
gcagtcatggaaaaatgtatac

SEQ ID NO: 9090802 - DNA, 20 bp, Homo sapiens
gcagtctgtcacagagcatg

SEQ ID NO: 9090803 - DNA, 19 bp, Homo sapiens
gcagtctgttgaagggcag

SEQ ID NO: 9090804 - DNA, 22 bp, Homo sapiens
gcagtgaaacaataggatcaaa

SEQ ID NO: 9090805 - DNA, 22 bp, Homo sapiens
gcagtatgagtgttttagacat

SEQ ID NO: 9090806 - DNA, 22 bp, Homo sapiens
gcagtcataactaatattggtt

SEQ ID NO: 9090807 - DNA, 22 bp, Homo sapiens
gcagtcatatcattccaacagg

SEQ ID NO: 9090808 - DNA, 22 bp, Homo sapiens
gcagtcatcacggcttttaggc

SEQ ID NO: 9090809 - DNA, 22 bp, Homo sapiens
gcagtcaggttaaggccttccc

SEQ ID NO: 9090810 - DNA, 22 bp, Homo sapiens
gcagtcagtaaggcagccagaa

SEQ ID NO: 9090811 - DNA, 22 bp, Homo sapiens
gcagtcagacaggaggagctcc

SEQ ID NO: 9090812 - DNA, 22 bp, Homo sapiens
gcagtcagacaggaggagctcc

SEQ ID NO: 9090813 - DNA, 22 bp, Homo sapiens
gcagggctattggaaggagatg

SEQ ID NO: 9090814 - DNA, 22 bp, Homo sapiens
gcagggctcaacaggacacccc

SEQ ID NO: 9090815 - DNA, 22 bp, Homo sapiens
gcagggctcattctagtacaat

SEQ ID NO: 9090816 - DNA, 22 bp, Homo sapiens
gcagggctcattgccaggcatt

SEQ ID NO: 9090817 - DNA, 22 bp, Homo sapiens
gcatttggaacttggttgagat

SEQ ID NO: 9090818 - DNA, 22 bp, Homo sapiens
gcatttccttgatggctaatga

SEQ ID NO: 9090819 - DNA, 22 bp, Homo sapiens
gcatttcatgtagattgagaac

SEQ ID NO: 9090820 - DNA, 22 bp, Homo sapiens
gcatgattaatatgcttactgt

SEQ ID NO: 9090821 - DNA, 22 bp, Homo sapiens
gcatcttcacacaaagccagtg

SEQ ID NO: 9090822 - DNA, 22 bp, Homo sapiens
gcatctgatccaatagatatat

SEQ ID NO: 9090823 - DNA, 22 bp, Homo sapiens
gcatgagactagctcatgagca

SEQ ID NO: 9090824 - DNA, 22 bp, Homo sapiens
gcatgactggttttcttacaaa

SEQ ID NO: 9090825 - DNA, 22 bp, Homo sapiens
gcatccaggctgcccctctgcg

SEQ ID NO: 9090826 - DNA, 22 bp, Homo sapiens
gcatccaggctgcccctctgcg

SEQ ID NO: 9090827 - DNA, 22 bp, Homo sapiens
gcataattaaacaggcaagatt

SEQ ID NO: 9090828 - DNA, 22 bp, Homo sapiens
gcatccagaggtagccactgtg

SEQ ID NO: 9090829 - DNA, 22 bp, Homo sapiens
gcatccaaatgtttcatttctt

SEQ ID NO: 9090830 - DNA, 19 bp, Homo sapiens
gcatccatggaggccgctt

SEQ ID NO: 9090831 - DNA, 22 bp, Homo sapiens
gcatcccaaatctgaaagtcca

SEQ ID NO: 9090832 - DNA, 22 bp, Homo sapiens
gcatctaaggtggataacttct

SEQ ID NO: 9090833 - DNA, 22 bp, Homo sapiens
gcatctaaggtggataacttct

SEQ ID NO: 9090834 - DNA, 22 bp, Homo sapiens
gcatctaaatcactttaatgta

SEQ ID NO: 9090835 - DNA, 22 bp, Homo sapiens
gcatctaaacttgcatcattgt

SEQ ID NO: 9090836 - DNA, 22 bp, Homo sapiens
gccagcagggcccaaatgctgg

SEQ ID NO: 9090837 - DNA, 22 bp, Homo sapiens
gccagcagggcccaaatgctgg

SEQ ID NO: 9090838 - DNA, 20 bp, Homo sapiens
gccagaggccggcaggggct

SEQ ID NO: 9090839 - DNA, 22 bp, Homo sapiens
gccagcagggcggagccatcta

SEQ ID NO: 9090840 - DNA, 22 bp, Homo sapiens
gccagcagggcggagccatcta

SEQ ID NO: 9090841 - DNA, 22 bp, Homo sapiens
gccagcagggcggagccatcta

SEQ ID NO: 9090842 - DNA, 22 bp, Homo sapiens
gccagcaggttgtcaaggagct

SEQ ID NO: 9090843 - DNA, 22 bp, Homo sapiens
gccagcaggtggagagatcaag

SEQ ID NO: 9090844 - DNA, 22 bp, Homo sapiens
gccagcagtatgtcctggcagt

SEQ ID NO: 9090845 - DNA, 22 bp, Homo sapiens
gccagagcttcccccgagtgtg

SEQ ID NO: 9090846 - DNA, 22 bp, Homo sapiens
gccagagctgagtgaggttctt

SEQ ID NO: 9090847 - DNA, 22 bp, Homo sapiens
gccagagctgagacacgagtcc

SEQ ID NO: 9090848 - DNA, 22 bp, Homo sapiens
gccagaggaacgctgcgcgccc

SEQ ID NO: 9090849 - DNA, 22 bp, Homo sapiens
gccagccccttagggctctccc

SEQ ID NO: 9090850 - DNA, 22 bp, Homo sapiens
gccagccccttagggctctccc

SEQ ID NO: 9090851 - DNA, 22 bp, Homo sapiens
gccagccccagacatcctatcg

SEQ ID NO: 9090852 - DNA, 22 bp, Homo sapiens
gccagccccagacatcctatcg

SEQ ID NO: 9090853 - DNA, 22 bp, Homo sapiens
gccagccccagacatcctatcg

SEQ ID NO: 9090854 - DNA, 22 bp, Homo sapiens
gccagcccctccatcctgttca

SEQ ID NO: 9090855 - DNA, 22 bp, Homo sapiens
gccagcccagctccaggggaaa

SEQ ID NO: 9090856 - DNA, 22 bp, Homo sapiens
gccagcccagctccaggggaaa

SEQ ID NO: 9090857 - DNA, 22 bp, Homo sapiens
gccagcccattaacccctgtcc

SEQ ID NO: 9090858 - DNA, 22 bp, Homo sapiens
gccagccataggccagcactgg

SEQ ID NO: 9090859 - DNA, 22 bp, Homo sapiens
gccagcagtcctgctgtgtgcc

SEQ ID NO: 9090860 - DNA, 22 bp, Homo sapiens
gccagcagtcctgctgtgtgcc

SEQ ID NO: 9090861 - DNA, 22 bp, Homo sapiens
gccagcagtccagtccttagtg

SEQ ID NO: 9090862 - DNA, 22 bp, Homo sapiens
gccagcagtccagtccttagtg

SEQ ID NO: 9090863 - DNA, 22 bp, Homo sapiens
gccagcagtatgtcctggcagt

SEQ ID NO: 9090864 - DNA, 22 bp, Homo sapiens
gccagcatcctggtggtggttg

SEQ ID NO: 9090865 - DNA, 22 bp, Homo sapiens
gccagcagtggccaccaccagg

SEQ ID NO: 9090866 - DNA, 22 bp, Homo sapiens
gccagcatagtaagcagtcatc

SEQ ID NO: 9090867 - DNA, 22 bp, Homo sapiens
gcattttaataagattcatagg

SEQ ID NO: 9090868 - DNA, 18 bp, Homo sapiens
gcattttaatctgaggca

SEQ ID NO: 9090869 - DNA, 22 bp, Homo sapiens
gcattttaataagattcatagg

SEQ ID NO: 9090870 - DNA, 22 bp, Homo sapiens
gcatttgtgtggcggaaggatt

SEQ ID NO: 9090871 - DNA, 22 bp, Homo sapiens
gcatttttctctcctataggag

SEQ ID NO: 9090872 - DNA, 22 bp, Homo sapiens
gcatttttcatccctcttgggt

SEQ ID NO: 9090873 - DNA, 22 bp, Homo sapiens
gcatttttctaatcattggcat

SEQ ID NO: 9090874 - DNA, 22 bp, Homo sapiens
gcattttataaagagttatttg

SEQ ID NO: 9090875 - DNA, 22 bp, Homo sapiens
gcattttagaatattggagcaa

SEQ ID NO: 9090876 - DNA, 22 bp, Homo sapiens
gcattttaatgaggtttatgag

SEQ ID NO: 9090877 - DNA, 22 bp, Homo sapiens
gccaagctgtttttcagagacg

SEQ ID NO: 9090878 - DNA, 22 bp, Homo sapiens
gccaagctcaccttctgatgga

SEQ ID NO: 9090879 - DNA, 22 bp, Homo sapiens
gcatttttgatcccactaggat

SEQ ID NO: 9090880 - DNA, 22 bp, Homo sapiens
gccaaggcctctgcaggatgag

SEQ ID NO: 9090881 - DNA, 22 bp, Homo sapiens
gccaaggctgaggccctgggct

SEQ ID NO: 9090882 - DNA, 22 bp, Homo sapiens
gccagagcatgcactgcctgca

SEQ ID NO: 9090883 - DNA, 22 bp, Homo sapiens
gccagagccacttttgggtgat

SEQ ID NO: 9090884 - DNA, 22 bp, Homo sapiens
gccagagccacttttgggtgat

SEQ ID NO: 9090885 - DNA, 22 bp, Homo sapiens
gccagagcagaatagagtggcc

SEQ ID NO: 9090886 - DNA, 22 bp, Homo sapiens
gccagagagactgatacatgct

SEQ ID NO: 9090887 - DNA, 22 bp, Homo sapiens
gccagagagagtccctgggcct

SEQ ID NO: 9090888 - DNA, 22 bp, Homo sapiens
gccagagagactgatacatgct

SEQ ID NO: 9090889 - DNA, 22 bp, Homo sapiens
gccagagcacaggctggtagta

SEQ ID NO: 9090890 - DNA, 22 bp, Homo sapiens
gccagagaggccttagaatcca

SEQ ID NO: 9090891 - DNA, 22 bp, Homo sapiens
gccagagaggcaaatcctagca

SEQ ID NO: 9090892 - DNA, 22 bp, Homo sapiens
gccagagaggccgaggtaccca

SEQ ID NO: 9090893 - DNA, 22 bp, Homo sapiens
gccagagaggcctaaggccata

SEQ ID NO: 9090894 - DNA, 22 bp, Homo sapiens
gccagagagagtccctgggcct

SEQ ID NO: 9090895 - DNA, 22 bp, Homo sapiens
gccagagagatggaaaagctta

SEQ ID NO: 9090896 - DNA, 22 bp, Homo sapiens
gccagagaggcaaatcctagca

SEQ ID NO: 9090897 - DNA, 22 bp, Homo sapiens
gccaggtggtctggctccagag

SEQ ID NO: 9090898 - DNA, 22 bp, Homo sapiens
gccaggtgggagacagacagca

SEQ ID NO: 9090899 - DNA, 22 bp, Homo sapiens
gccaggttctggggaggtacaa

SEQ ID NO: 9090900 - DNA, 22 bp, Homo sapiens
gccaggagttcagatgcatgtt

SEQ ID NO: 9090901 - DNA, 22 bp, Homo sapiens
gccaggcaaattaaggaatgca

SEQ ID NO: 9090902 - DNA, 22 bp, Homo sapiens
gccaggatgactatacaacagc

SEQ ID NO: 9090903 - DNA, 22 bp, Homo sapiens
gccaggagttcagatgcatgtt

SEQ ID NO: 9090904 - DNA, 22 bp, Homo sapiens
gccaggagaatgctagcagagg

SEQ ID NO: 9090905 - DNA, 22 bp, Homo sapiens
gccaggagaatgctagcagagg

SEQ ID NO: 9090906 - DNA, 22 bp, Homo sapiens
gccaggagagctccttcaggtt

SEQ ID NO: 9090907 - DNA, 22 bp, Homo sapiens
gccaggagccagcttcttagca

SEQ ID NO: 9090908 - DNA, 22 bp, Homo sapiens
gccaggagccctgggcaagttc

SEQ ID NO: 9090909 - DNA, 22 bp, Homo sapiens
gccaggaggctgctgtgtaggc

SEQ ID NO: 9090910 - DNA, 22 bp, Homo sapiens
gccaggaatttcaagagccact

SEQ ID NO: 9090911 - DNA, 22 bp, Homo sapiens
gccaggttgctgacgacgatct

SEQ ID NO: 9090912 - DNA, 22 bp, Homo sapiens
gccagtctccctcagtcctctg

SEQ ID NO: 9090913 - DNA, 22 bp, Homo sapiens
gccagtctgataggggagaagt

SEQ ID NO: 9090914 - DNA, 22 bp, Homo sapiens
gccagtgcctcgccgcgctcct

SEQ ID NO: 9090915 - DNA, 18 bp, Homo sapiens
gccagtgccctggctcac

SEQ ID NO: 9090916 - DNA, 21 bp, Homo sapiens
gccagtgctgtctgtgtgatc

SEQ ID NO: 9090917 - DNA, 22 bp, Homo sapiens
gccagtgcttgtggagctggca

SEQ ID NO: 9090918 - DNA, 22 bp, Homo sapiens
gcccacaggggacctggtggct

SEQ ID NO: 9090919 - DNA, 22 bp, Homo sapiens
gcccacaggtcctacctctttc

SEQ ID NO: 9090920 - DNA, 22 bp, Homo sapiens
gcccacaggtcctacctctttc

SEQ ID NO: 9090921 - DNA, 22 bp, Homo sapiens
gcccacagtacgaggctcaggc

SEQ ID NO: 9090922 - DNA, 20 bp, Homo sapiens
gcccactctaatccactgtc

SEQ ID NO: 9090923 - DNA, 22 bp, Homo sapiens
gcccacagtacgaggctcaggc

SEQ ID NO: 9090924 - DNA, 22 bp, Homo sapiens
gcccagagagatgaagtgatgg

SEQ ID NO: 9090925 - DNA, 22 bp, Homo sapiens
gcccagaagttgaggctgcagt

SEQ ID NO: 9090926 - DNA, 22 bp, Homo sapiens
gcccagaaagcatcattgtgga

SEQ ID NO: 9090927 - DNA, 22 bp, Homo sapiens
gcccactgagtgactccctcag

SEQ ID NO: 9090928 - DNA, 22 bp, Homo sapiens
gcccagagggaagaggtgtcat

SEQ ID NO: 9090929 - DNA, 22 bp, Homo sapiens
gcccagagggaagaggtgtcat

SEQ ID NO: 9090930 - DNA, 21 bp, Homo sapiens
gcccagagggagccaagccca

SEQ ID NO: 9090931 - DNA, 23 bp, Homo sapiens
gcccagagaggctcaccaggaat

SEQ ID NO: 9090932 - DNA, 22 bp, Homo sapiens
gcccagagagatgctgtagacc

SEQ ID NO: 9090933 - DNA, 22 bp, Homo sapiens
gcccagagtgagtcctgggccc

SEQ ID NO: 9090934 - DNA, 22 bp, Homo sapiens
gcccagagtgagtcctgggccc

SEQ ID NO: 9090935 - DNA, 22 bp, Homo sapiens
gcccagagtggccacttggctc

SEQ ID NO: 9090936 - DNA, 18 bp, Homo sapiens
gcccagaggtctgggccc

SEQ ID NO: 9090937 - DNA, 22 bp, Homo sapiens
gccctgagactgagcatgggtt

SEQ ID NO: 9090938 - DNA, 22 bp, Homo sapiens
gccctctgttattgcatcctta

SEQ ID NO: 9090939 - DNA, 22 bp, Homo sapiens
gccctgaaatatttccacggcc

SEQ ID NO: 9090940 - DNA, 22 bp, Homo sapiens
gccctgaacgaggggtctggag

SEQ ID NO: 9090941 - DNA, 22 bp, Homo sapiens
gccctgaaggcagaggtggagc

SEQ ID NO: 9090942 - DNA, 22 bp, Homo sapiens
gccctgaagctgagggtgttaa

SEQ ID NO: 9090943 - DNA, 22 bp, Homo sapiens
gccctgaattcctcaggctgtg

SEQ ID NO: 9090944 - DNA, 22 bp, Homo sapiens
gccctgaataatagagtgggga

SEQ ID NO: 9090945 - DNA, 22 bp, Homo sapiens
gccctgagcctatgagcctctc

SEQ ID NO: 9090946 - DNA, 22 bp, Homo sapiens
gccctgagcctatgagcctctc

SEQ ID NO: 9090947 - DNA, 22 bp, Homo sapiens
gccctgagcctatgagcctctc

SEQ ID NO: 9090948 - DNA, 22 bp, Homo sapiens
gccctgagcactgctgctgggg

SEQ ID NO: 9090949 - DNA, 22 bp, Homo sapiens
gcctacagttggctgagggcct

SEQ ID NO: 9090950 - DNA, 22 bp, Homo sapiens
gcctagagaaaaagcctctgca

SEQ ID NO: 9090951 - DNA, 23 bp, Homo sapiens
gcctcagagaaacagctgcacac

SEQ ID NO: 9090952 - DNA, 23 bp, Homo sapiens
gcctcagagaaacagctgcacac

SEQ ID NO: 9090953 - DNA, 22 bp, Homo sapiens
gcctcagccggcggacgccagg

SEQ ID NO: 9090954 - DNA, 22 bp, Homo sapiens
gcctcagctcccagcccaggct

SEQ ID NO: 9090955 - DNA, 20 bp, Homo sapiens
gcctcagagggtttgagttt

SEQ ID NO: 9090956 - DNA, 20 bp, Homo sapiens
gcctcagccaacccatgggg

SEQ ID NO: 9090957 - DNA, 22 bp, Homo sapiens
gcctcagctgttgcaggggccc

SEQ ID NO: 9090958 - DNA, 22 bp, Homo sapiens
gcctcagctgttgcaggggccc

SEQ ID NO: 9090959 - DNA, 22 bp, Homo sapiens
gcctcaggactggcatactcat

SEQ ID NO: 9090960 - DNA, 22 bp, Homo sapiens
gcctcagctcccagcccaggct

SEQ ID NO: 9090961 - DNA, 22 bp, Homo sapiens
gcccatccatggggtcatggcc

SEQ ID NO: 9090962 - DNA, 22 bp, Homo sapiens
gcccatccctgaaccaactggg

SEQ ID NO: 9090963 - DNA, 22 bp, Homo sapiens
gcccatcttctagcagctgtta

SEQ ID NO: 9090964 - DNA, 22 bp, Homo sapiens
gcccagtggtaaaagcaggcct

SEQ ID NO: 9090965 - DNA, 22 bp, Homo sapiens
gcccagtggtaaaagcaggcct

SEQ ID NO: 9090966 - DNA, 22 bp, Homo sapiens
gcccaggggcagcgcatagtgg

SEQ ID NO: 9090967 - DNA, 22 bp, Homo sapiens
gcccaggggcagcgcatagtgg

SEQ ID NO: 9090968 - DNA, 22 bp, Homo sapiens
gcccaggggagtagtcaattta

SEQ ID NO: 9090969 - DNA, 22 bp, Homo sapiens
gcccagggcttcaaagagagaa

SEQ ID NO: 9090970 - DNA, 22 bp, Homo sapiens
gcccatggacacccaagtgcca

SEQ ID NO: 9090971 - DNA, 22 bp, Homo sapiens
gccctctgtgtaacaatccaga

SEQ ID NO: 9090972 - DNA, 22 bp, Homo sapiens
gccctctggtgggtgagccccg

SEQ ID NO: 9090973 - DNA, 22 bp, Homo sapiens
gccctctgtgtaacaatccaga

SEQ ID NO: 9090974 - DNA, 22 bp, Homo sapiens
gcccaggctggagtgcagtggt

SEQ ID NO: 9090975 - DNA, 22 bp, Homo sapiens
gcccaggctggagtgcagtggt

SEQ ID NO: 9090976 - DNA, 22 bp, Homo sapiens
gcccagcaaggaccaagggccg

SEQ ID NO: 9090977 - DNA, 22 bp, Homo sapiens
gcccagcaaggaccaagggccg

SEQ ID NO: 9090978 - DNA, 21 bp, Homo sapiens
gcccagagttaagcccaccca

SEQ ID NO: 9090979 - DNA, 22 bp, Homo sapiens
gcccagagtggccacttggctc

SEQ ID NO: 9090980 - DNA, 22 bp, Homo sapiens
gcccagagtggccacttggctc

SEQ ID NO: 9090981 - DNA, 22 bp, Homo sapiens
gcccagagttcaaggctgcagt

SEQ ID NO: 9090982 - DNA, 22 bp, Homo sapiens
gcccagagttcaaggctgcagt

SEQ ID NO: 9090983 - DNA, 22 bp, Homo sapiens
gcccagggcagggcaagagtga

SEQ ID NO: 9090984 - DNA, 22 bp, Homo sapiens
gcccagggcagggcaagagtga

SEQ ID NO: 9090985 - DNA, 22 bp, Homo sapiens
gcccaggctggagttcagtggt

SEQ ID NO: 9090986 - DNA, 23 bp, Homo sapiens
gcccagggactgggaatcagtgg

SEQ ID NO: 9090987 - DNA, 22 bp, Homo sapiens
gcccagggctgcaagtggacgc

SEQ ID NO: 9090988 - DNA, 22 bp, Homo sapiens
gcccagggcgatggtcggggcc

SEQ ID NO: 9090989 - DNA, 18 bp, Homo sapiens
tttgagaatgcatgactg

SEQ ID NO: 9090990 - DNA, 21 bp, Homo sapiens
tttgagaattggtcagagtgc

SEQ ID NO: 9090991 - DNA, 20 bp, Homo sapiens
tttgagaccagtctgcccaa

SEQ ID NO: 9090992 - DNA, 20 bp, Homo sapiens
tttgagaccagtctgcccaa

SEQ ID NO: 9090993 - DNA, 22 bp, Homo sapiens
tttgagctatgggcttggattt

SEQ ID NO: 9090994 - DNA, 22 bp, Homo sapiens
tttgcagtgtcagcttctgtgt

SEQ ID NO: 9090995 - DNA, 22 bp, Homo sapiens
tttgcatgggaggtagtaatca

SEQ ID NO: 9090996 - DNA, 22 bp, Homo sapiens
tttgcataggatggacatttta

SEQ ID NO: 9090997 - DNA, 22 bp, Homo sapiens
tttgcataggatggacatttta

SEQ ID NO: 9090998 - DNA, 22 bp, Homo sapiens
tttgcagttcatctgagaaaaa

SEQ ID NO: 9090999 - DNA, 22 bp, Homo sapiens
tttgcagttcatgttggaaaat

SEQ ID NO: 9091000 - DNA, 22 bp, Homo sapiens
tttgcagtttgttcagctcttt

SEQ ID NO: 9091001 - DNA, 22 bp, Homo sapiens
tttgcattgtaatatttagttc

SEQ ID NO: 9091002 - DNA, 22 bp, Homo sapiens
tttgcattgcctctgacttatg

SEQ ID NO: 9091003 - DNA, 22 bp, Homo sapiens
tttgcattgcagtggtttacag

SEQ ID NO: 9091004 - DNA, 18 bp, Homo sapiens
tttgctgatgagcatcat

SEQ ID NO: 9091005 - DNA, 22 bp, Homo sapiens
tttgctgactggatgcagttgg

SEQ ID NO: 9091006 - DNA, 22 bp, Homo sapiens
tttgcttaactggtagaatgcg

SEQ ID NO: 9091007 - DNA, 22 bp, Homo sapiens
tttgcttaaaagcggagcaaga

SEQ ID NO: 9091008 - DNA, 22 bp, Homo sapiens
tttgcttaaagttctttctggt

SEQ ID NO: 9091009 - DNA, 22 bp, Homo sapiens
tttgcttcacaagtatggttct

SEQ ID NO: 9091010 - DNA, 22 bp, Homo sapiens
tttggggatgtctgagttgttg

SEQ ID NO: 9091011 - DNA, 22 bp, Homo sapiens
tttgggttaagagatggtacca

SEQ ID NO: 9091012 - DNA, 22 bp, Homo sapiens
tttggggctcagcaggctgttt

SEQ ID NO: 9091013 - DNA, 22 bp, Homo sapiens
tttgggttcagacatgattaca

SEQ ID NO: 9091014 - DNA, 22 bp, Homo sapiens
tttggggactgttagagaaaat

SEQ ID NO: 9091015 - DNA, 22 bp, Homo sapiens
tttgggcaggcttttccctaga

SEQ ID NO: 9091016 - DNA, 22 bp, Homo sapiens
tttgggcagtagatgtatcact

SEQ ID NO: 9091017 - DNA, 22 bp, Homo sapiens
tttgggcagtgggcttagcggc

SEQ ID NO: 9091018 - DNA, 22 bp, Homo sapiens
tttgggcagtcctggaatttgt

SEQ ID NO: 9091019 - DNA, 22 bp, Homo sapiens
tttgggcattagtaagttaagc

SEQ ID NO: 9091020 - DNA, 22 bp, Homo sapiens
tttgggcatgttgtggccagct

SEQ ID NO: 9091021 - DNA, 22 bp, Homo sapiens
tttgggcatatagctgttccct

SEQ ID NO: 9091022 - DNA, 22 bp, Homo sapiens
tttgggcattagaatattcttt

SEQ ID NO: 9091023 - DNA, 22 bp, Homo sapiens
tttgtcatttccctgattaaag

SEQ ID NO: 9091024 - DNA, 22 bp, Homo sapiens
tttgtcctctccatgtacaata

SEQ ID NO: 9091025 - DNA, 22 bp, Homo sapiens
tttgtccagtgcaccagcctca

SEQ ID NO: 9091026 - DNA, 22 bp, Homo sapiens
tttgtcataactctgctgcaag

SEQ ID NO: 9091027 - DNA, 18 bp, Homo sapiens
tttggccatgacctggct

SEQ ID NO: 9091028 - DNA, 18 bp, Homo sapiens
tttggccatgacctggct

SEQ ID NO: 9091029 - DNA, 22 bp, Homo sapiens
tttggccatgctcaagggtata

SEQ ID NO: 9091030 - DNA, 22 bp, Homo sapiens
tttggccatgctcaagggtata

SEQ ID NO: 9091031 - DNA, 22 bp, Homo sapiens
tttggccttagtccagaagaag

SEQ ID NO: 9091032 - DNA, 22 bp, Homo sapiens
tttggcctcgtttagaaatggc

SEQ ID NO: 9091033 - DNA, 22 bp, Homo sapiens
tttggcctcatgaatttcttgc

SEQ ID NO: 9091034 - DNA, 22 bp, Homo sapiens
tttggcctcatgaatttcttgc

SEQ ID NO: 9091035 - DNA, 22 bp, Homo sapiens
tttggctaactgcaaaaagtac

SEQ ID NO: 9091036 - DNA, 22 bp, Homo sapiens
tttggcggggcaattctgaagc

SEQ ID NO: 9091037 - DNA, 22 bp, Homo sapiens
tttggcggactgagaacgcggg

SEQ ID NO: 9091038 - DNA, 22 bp, Homo sapiens
tttggctaattaggtgctgatt

SEQ ID NO: 9091039 - DNA, 22 bp, Homo sapiens
tttggctaagttgtaatgtaaa

SEQ ID NO: 9091040 - DNA, 22 bp, Homo sapiens
tttggctaaggggcttctcaac

SEQ ID NO: 9091041 - DNA, 22 bp, Homo sapiens
tttggctaaggaaaaggagcta

SEQ ID NO: 9091042 - DNA, 22 bp, Homo sapiens
tttggctacttgatattctgaa

SEQ ID NO: 9091043 - DNA, 22 bp, Homo sapiens
tttggctactgtacagaaagcc

SEQ ID NO: 9091044 - DNA, 22 bp, Homo sapiens
tttggccacttgggagtccagg

SEQ ID NO: 9091045 - DNA, 22 bp, Homo sapiens
tttggccacttcatagatcatt

SEQ ID NO: 9091046 - DNA, 22 bp, Homo sapiens
tttggccacagatccttggggg

SEQ ID NO: 9091047 - DNA, 22 bp, Homo sapiens
tttggccaagaaagttctgtgg

SEQ ID NO: 9091048 - DNA, 22 bp, Homo sapiens
tttggccaacaacatggaagct

SEQ ID NO: 9091049 - DNA, 22 bp, Homo sapiens
tttggcatagctctttgttcct

SEQ ID NO: 9091050 - DNA, 23 bp, Homo sapiens
tttggcatgttaacttcacttac

SEQ ID NO: 9091051 - DNA, 22 bp, Homo sapiens
tttggctctcacttgcactcag

SEQ ID NO: 9091052 - DNA, 22 bp, Homo sapiens
tttggctctgcgtcttcaccca

SEQ ID NO: 9091053 - DNA, 22 bp, Homo sapiens
tttggctctagtaaatataacc

SEQ ID NO: 9091054 - DNA, 22 bp, Homo sapiens
tttggctctgtgtctccaccca

SEQ ID NO: 9091055 - DNA, 22 bp, Homo sapiens
tttggctctgtgtcttcaccca

SEQ ID NO: 9091056 - DNA, 22 bp, Homo sapiens
tttggctcggctgctgatggtg

SEQ ID NO: 9091057 - DNA, 22 bp, Homo sapiens
tttggctcggctgctgatggtg

SEQ ID NO: 9091058 - DNA, 22 bp, Homo sapiens
tttggcggggcaattctgaagc

SEQ ID NO: 9091059 - DNA, 22 bp, Homo sapiens
tttggctcagctcacagatccc

SEQ ID NO: 9091060 - DNA, 22 bp, Homo sapiens
tttggctatgtgatacatgtca

SEQ ID NO: 9091061 - DNA, 22 bp, Homo sapiens
tttggctagccaagaaacaaaa

SEQ ID NO: 9091062 - DNA, 22 bp, Homo sapiens
tttggctaggttaagactggga

SEQ ID NO: 9091063 - DNA, 22 bp, Homo sapiens
tttggctgagaagttgtgcttt

SEQ ID NO: 9091064 - DNA, 22 bp, Homo sapiens
tttggcttaacttacatgatat

SEQ ID NO: 9091065 - DNA, 18 bp, Homo sapiens
tttggctgttcaagagca

SEQ ID NO: 9091066 - DNA, 22 bp, Homo sapiens
tttctattgatctaataaacat

SEQ ID NO: 9091067 - DNA, 22 bp, Homo sapiens
tttctattgatctaataaacat

SEQ ID NO: 9091068 - DNA, 22 bp, Homo sapiens
tttctatatgaggagctaaagt

SEQ ID NO: 9091069 - DNA, 22 bp, Homo sapiens
tttctattgatctaataaacat

SEQ ID NO: 9091070 - DNA, 22 bp, Homo sapiens
tttgaaaggtgtcgagatgtgt

SEQ ID NO: 9091071 - DNA, 22 bp, Homo sapiens
tttgaaagtgtttacttgggaa

SEQ ID NO: 9091072 - DNA, 22 bp, Homo sapiens
tttgaaatatgaggcattatga

SEQ ID NO: 9091073 - DNA, 22 bp, Homo sapiens
tttgaaatgtatcagtataggt

SEQ ID NO: 9091074 - DNA, 22 bp, Homo sapiens
tttgaaattaagatattgtcca

SEQ ID NO: 9091075 - DNA, 22 bp, Homo sapiens
tttctataaaaagtgctaggat

SEQ ID NO: 9091076 - DNA, 22 bp, Homo sapiens
tttctataactggactggattg

SEQ ID NO: 9091077 - DNA, 22 bp, Homo sapiens
tttctatagctttcttgggagt

SEQ ID NO: 9091078 - DNA, 22 bp, Homo sapiens
tttctagttctaccacagtaat

SEQ ID NO: 9091079 - DNA, 22 bp, Homo sapiens
tttctagttctctgccaaaaaa

SEQ ID NO: 9091080 - DNA, 22 bp, Homo sapiens
tttctagtcttccctacctccc

SEQ ID NO: 9091081 - DNA, 22 bp, Homo sapiens
tttctagtaatcaatataaagt

SEQ ID NO: 9091082 - DNA, 22 bp, Homo sapiens
tttctagtaaaagctaattacc

SEQ ID NO: 9091083 - DNA, 22 bp, Homo sapiens
tttctagtatataactagatct

SEQ ID NO: 9091084 - DNA, 22 bp, Homo sapiens
tttctagtatataactagatct

SEQ ID NO: 9091085 - DNA, 22 bp, Homo sapiens
tttctaggatgtgatgacctgc

SEQ ID NO: 9091086 - DNA, 22 bp, Homo sapiens
tttctaggtcttccatactgcc

SEQ ID NO: 9091087 - DNA, 22 bp, Homo sapiens
tttctaggacatgataggatat

SEQ ID NO: 9091088 - DNA, 22 bp, Homo sapiens
tttgacatgaagtagcttataa

SEQ ID NO: 9091089 - DNA, 22 bp, Homo sapiens
tttgacatctaagaattcttac

SEQ ID NO: 9091090 - DNA, 22 bp, Homo sapiens
tttgacatggaataactcattt

SEQ ID NO: 9091091 - DNA, 22 bp, Homo sapiens
tttgacagcttgttacaaagtt

SEQ ID NO: 9091092 - DNA, 22 bp, Homo sapiens
tttgacaggactaacatatggc

SEQ ID NO: 9091093 - DNA, 22 bp, Homo sapiens
tttgacagtgacgcctgtatga

SEQ ID NO: 9091094 - DNA, 22 bp, Homo sapiens
tttgacagtcccctgatgtttg

SEQ ID NO: 9091095 - DNA, 22 bp, Homo sapiens
tttgaagactactgggagtgaa

SEQ ID NO: 9091096 - DNA, 22 bp, Homo sapiens
tttgaagacatttgaatacttt

SEQ ID NO: 9091097 - DNA, 22 bp, Homo sapiens
tttgaacatgctgcatgataat

SEQ ID NO: 9091098 - DNA, 22 bp, Homo sapiens
tttgaacatgctgcatgataat

SEQ ID NO: 9091099 - DNA, 22 bp, Homo sapiens
tttgaacattcaacagacccag

SEQ ID NO: 9091100 - DNA, 22 bp, Homo sapiens
tttgaacaggagtatctatagt

SEQ ID NO: 9091101 - DNA, 22 bp, Homo sapiens
tttgaaattggctcattggttt

SEQ ID NO: 9091102 - DNA, 22 bp, Homo sapiens
ttttcaaagactggaggctgat

SEQ ID NO: 9091103 - DNA, 16 bp, Homo sapiens
ttttattgtgacagcc

SEQ ID NO: 9091104 - DNA, 22 bp, Homo sapiens
ttttattgtcaatgaagacaga

SEQ ID NO: 9091105 - DNA, 22 bp, Homo sapiens
ttttagaaatactgatttagtg

SEQ ID NO: 9091106 - DNA, 22 bp, Homo sapiens
ttttacattgggaaatgcctct

SEQ ID NO: 9091107 - DNA, 22 bp, Homo sapiens
ttttacattgggaaatgcctct

SEQ ID NO: 9091108 - DNA, 22 bp, Homo sapiens
ttttattggtaatgataaaagt

SEQ ID NO: 9091109 - DNA, 22 bp, Homo sapiens
ttttattggtaatgataaaagt

SEQ ID NO: 9091110 - DNA, 22 bp, Homo sapiens
ttttattgggagtcctctactg

SEQ ID NO: 9091111 - DNA, 19 bp, Homo sapiens
tttgtctctgaataatatt

SEQ ID NO: 9091112 - DNA, 20 bp, Homo sapiens
tttgtctgttaagtgtttct

SEQ ID NO: 9091113 - DNA, 18 bp, Homo sapiens
tttgtcctgtggcagctg

SEQ ID NO: 9091114 - DNA, 22 bp, Homo sapiens
tttgtcttatccaatctctcag

SEQ ID NO: 9091115 - DNA, 22 bp, Homo sapiens
tttgtcttatccaatctctcag

SEQ ID NO: 9091116 - DNA, 22 bp, Homo sapiens
tttgtcttaaatcttgttactg

SEQ ID NO: 9091117 - DNA, 22 bp, Homo sapiens
tttgtcttaaatcttgttactg

SEQ ID NO: 9091118 - DNA, 22 bp, Homo sapiens
tttgtcttaaatcttgttactg

SEQ ID NO: 9091119 - DNA, 22 bp, Homo sapiens
tttgtcttccccctttaatcag

SEQ ID NO: 9091120 - DNA, 22 bp, Homo sapiens
tttgtcttccccctttaatcag

SEQ ID NO: 9091121 - DNA, 22 bp, Homo sapiens
tttgtgatctcctccctctaga

SEQ ID NO: 9091122 - DNA, 22 bp, Homo sapiens
tttgtgcaggtataggcggaga

SEQ ID NO: 9091123 - DNA, 22 bp, Homo sapiens
ttttacaggtcataggtatagt

SEQ ID NO: 9091124 - DNA, 22 bp, Homo sapiens
tttgtgtaccttgtacatttgt

SEQ ID NO: 9091125 - DNA, 23 bp, Homo sapiens
ttttaatttggacataagaagat

SEQ ID NO: 9091126 - DNA, 22 bp, Homo sapiens
ttttacaagctgagtcgttaaa

SEQ ID NO: 9091127 - DNA, 22 bp, Homo sapiens
ttttacaagctgagtcgttaaa

SEQ ID NO: 9091128 - DNA, 22 bp, Homo sapiens
ttttacaagctgagtcgttaaa

SEQ ID NO: 9091129 - DNA, 22 bp, Homo sapiens
ttttacaagctgagtcgttaaa

SEQ ID NO: 9091130 - DNA, 22 bp, Homo sapiens
ttttacaaatgaggagctggag

SEQ ID NO: 9091131 - DNA, 22 bp, Homo sapiens
ttttacaaatgaggagctggag

SEQ ID NO: 9091132 - DNA, 22 bp, Homo sapiens
ttttacaaatgaggagctggag

SEQ ID NO: 9091133 - DNA, 22 bp, Homo sapiens
ttttacaaatgaggagctggag

SEQ ID NO: 9091134 - DNA, 22 bp, Homo sapiens
ttttgtatagtcaaagacaaga

SEQ ID NO: 9091135 - DNA, 22 bp, Homo sapiens
ttttgtatgagaagtgctttac

SEQ ID NO: 9091136 - DNA, 22 bp, Homo sapiens
ttttgtcagtgagaacagagtt

SEQ ID NO: 9091137 - DNA, 22 bp, Homo sapiens
ttttgtctaagaactttgcaaa

SEQ ID NO: 9091138 - DNA, 22 bp, Homo sapiens
ttttgtctaagaactttgcaaa

SEQ ID NO: 9091139 - DNA, 22 bp, Homo sapiens
ttttgtgacagaaagattaagt

SEQ ID NO: 9091140 - DNA, 22 bp, Homo sapiens
ttttgtgttgtaatgtcagcta

SEQ ID NO: 9091141 - DNA, 22 bp, Homo sapiens
tttttgtagtcattagaagagg

SEQ ID NO: 9091142 - DNA, 22 bp, Homo sapiens
tttttgtatagaaatgaactaa

SEQ ID NO: 9091143 - DNA, 22 bp, Homo sapiens
tttttgtatagaaatgaactaa

SEQ ID NO: 9091144 - DNA, 19 bp, Homo sapiens
ttttgtgtagctgctggtt

SEQ ID NO: 9091145 - DNA, 23 bp, Homo sapiens
ttttgtgtgacttaatatctctt

SEQ ID NO: 9091146 - DNA, 22 bp, Homo sapiens
ttttgtgtccttcacatcatgt

SEQ ID NO: 9091147 - DNA, 22 bp, Homo sapiens
ttttgtgttgccatgttaagca

SEQ ID NO: 9091148 - DNA, 22 bp, Homo sapiens
ttttgtgttgccatgttaagca

SEQ ID NO: 9091149 - DNA, 22 bp, Homo sapiens
ttttttatctatggtagtacca

SEQ ID NO: 9091150 - DNA, 22 bp, Homo sapiens
ttttttatagcaatgaacccac

SEQ ID NO: 9091151 - DNA, 22 bp, Homo sapiens
ttttttatatcaactgaagtct

SEQ ID NO: 9091152 - DNA, 22 bp, Homo sapiens
tttttgttcccagagaatttgt

SEQ ID NO: 9091153 - DNA, 22 bp, Homo sapiens
tttttgttgcagagaggccact

SEQ ID NO: 9091154 - DNA, 22 bp, Homo sapiens
tttttgtatagaaatgaactaa

SEQ ID NO: 9091155 - DNA, 22 bp, Homo sapiens
tttttgtctagcgtctctagtt

SEQ ID NO: 9091156 - DNA, 22 bp, Homo sapiens
ttttccttcatatcccttatgt

SEQ ID NO: 9091157 - DNA, 22 bp, Homo sapiens
ttttccttagcttctctgcgag

SEQ ID NO: 9091158 - DNA, 22 bp, Homo sapiens
ttttccttcacctcttgagcct

SEQ ID NO: 9091159 - DNA, 22 bp, Homo sapiens
ttttcctctgcagagcagttag

SEQ ID NO: 9091160 - DNA, 22 bp, Homo sapiens
ttttcctcaggaatgctaagct

SEQ ID NO: 9091161 - DNA, 20 bp, Homo sapiens
ttttcctcgtgtttgttcta

SEQ ID NO: 9091162 - DNA, 22 bp, Homo sapiens
ttttcctcacctaactcaaggt

SEQ ID NO: 9091163 - DNA, 22 bp, Homo sapiens
ttttcctcacctaactcaaggt

SEQ ID NO: 9091164 - DNA, 18 bp, Homo sapiens
ttttccttccaccttgaa

SEQ ID NO: 9091165 - DNA, 18 bp, Homo sapiens
ttttccttccaccttgaa

SEQ ID NO: 9091166 - DNA, 22 bp, Homo sapiens
ttttccttctagagcagatttc

SEQ ID NO: 9091167 - DNA, 22 bp, Homo sapiens
ttttccttctagagcagatttc

SEQ ID NO: 9091168 - DNA, 22 bp, Homo sapiens
ttttccttctagagcagatttc

SEQ ID NO: 9091169 - DNA, 19 bp, Homo sapiens
ttttccttctatatgtttc

SEQ ID NO: 9091170 - DNA, 22 bp, Homo sapiens
ttttggctctgtctgtatcttt

SEQ ID NO: 9091171 - DNA, 22 bp, Homo sapiens
ttttggctctgtctgtatcttt

SEQ ID NO: 9091172 - DNA, 22 bp, Homo sapiens
ttttggctgtagctggaaatct

SEQ ID NO: 9091173 - DNA, 22 bp, Homo sapiens
ttttggcttaaagagaatgtat

SEQ ID NO: 9091174 - DNA, 19 bp, Homo sapiens
ttttggctggagtgatctg

SEQ ID NO: 9091175 - DNA, 22 bp, Homo sapiens
ttttggctcttggtaggtcaga

SEQ ID NO: 9091176 - DNA, 22 bp, Homo sapiens
ttttgggtgaatttgccagtta

SEQ ID NO: 9091177 - DNA, 22 bp, Homo sapiens
ttttggcttttcctcagcaagc

SEQ ID NO: 9091178 - DNA, 22 bp, Homo sapiens
ttttggtttcccttcttatggt

SEQ ID NO: 9091179 - DNA, 22 bp, Homo sapiens
ttttgtaagaaactgccaagcc

SEQ ID NO: 9091180 - DNA, 22 bp, Homo sapiens
ttttggttctgggatacagaga

SEQ ID NO: 9091181 - DNA, 22 bp, Homo sapiens
ttttggttctgggatacagaga

SEQ ID NO: 9091182 - DNA, 22 bp, Homo sapiens
ttttggtagcttatgtgcagtt

SEQ ID NO: 9091183 - DNA, 22 bp, Homo sapiens
ttttggtagaatcaacaatgta

SEQ ID NO: 9091184 - DNA, 22 bp, Homo sapiens
ttttggtacatgcaatagcaat

SEQ ID NO: 9091185 - DNA, 22 bp, Homo sapiens
ttttttccagcttctagaggcc

SEQ ID NO: 9091186 - DNA, 22 bp, Homo sapiens
ttttttccaggaagccactgga

SEQ ID NO: 9091187 - DNA, 22 bp, Homo sapiens
ttttttccagcttctagaggcc

SEQ ID NO: 9091188 - DNA, 22 bp, Homo sapiens
ttttttgcacactctgctaaat

SEQ ID NO: 9091189 - DNA, 21 bp, Homo sapiens
ttttttcttgcgtgaggcctg

SEQ ID NO: 9091190 - DNA, 21 bp, Homo sapiens
ttttttcttgcgtgaggcctg

SEQ ID NO: 9091191 - DNA, 21 bp, Homo sapiens
ttttttcttgcgtgaggcctg

SEQ ID NO: 9091192 - DNA, 22 bp, Homo sapiens
ttttttggataataaacgatct

SEQ ID NO: 9091193 - DNA, 22 bp, Homo sapiens
ttttttgtagcaagcgcagata

SEQ ID NO: 9091194 - DNA, 22 bp, Homo sapiens
tttacactgacagcacataagg

SEQ ID NO: 9091195 - DNA, 22 bp, Homo sapiens
tttacactcctggaaatgatat

SEQ ID NO: 9091196 - DNA, 22 bp, Homo sapiens
tttacacattattttcagtgtg

SEQ ID NO: 9091197 - DNA, 22 bp, Homo sapiens
tttacacattattttcagtgtg

SEQ ID NO: 9091198 - DNA, 22 bp, Homo sapiens
tttacaagtttacagaatgatg

SEQ ID NO: 9091199 - DNA, 22 bp, Homo sapiens
tttacaagtctgttgatcccaa

SEQ ID NO: 9091200 - DNA, 22 bp, Homo sapiens
tttacaagtcagggactgttct

SEQ ID NO: 9091201 - DNA, 19 bp, Homo sapiens
tttacaagttctttgtatg

SEQ ID NO: 9091202 - DNA, 19 bp, Homo sapiens
tttacaagttctttgtatg

SEQ ID NO: 9091203 - DNA, 22 bp, Homo sapiens
tttaagacttaggaaagaggat

SEQ ID NO: 9091204 - DNA, 22 bp, Homo sapiens
tttaagacttagatttattggg

SEQ ID NO: 9091205 - DNA, 22 bp, Homo sapiens
tttaagactcttgtagtacaca

SEQ ID NO: 9091206 - DNA, 22 bp, Homo sapiens
tttaagacagtgcaagctgaat

SEQ ID NO: 9091207 - DNA, 22 bp, Homo sapiens
tttaagagctagtatgtcattt

SEQ ID NO: 9091208 - DNA, 22 bp, Homo sapiens
tttaagagcctgtacaaatatt

SEQ ID NO: 9091209 - DNA, 22 bp, Homo sapiens
tttacagacaacttaatagggg

SEQ ID NO: 9091210 - DNA, 22 bp, Homo sapiens
tttacagagaatgtacataaag

SEQ ID NO: 9091211 - DNA, 22 bp, Homo sapiens
tttacagatgtggaaagtgagc

SEQ ID NO: 9091212 - DNA, 22 bp, Homo sapiens
tttacagctactgtcctatttc

SEQ ID NO: 9091213 - DNA, 22 bp, Homo sapiens
tttacagctagacatacctgag

SEQ ID NO: 9091214 - DNA, 22 bp, Homo sapiens
tttacagcagcatgatttataa

SEQ ID NO: 9091215 - DNA, 22 bp, Homo sapiens
tttacagatgaggatactgagg

SEQ ID NO: 9091216 - DNA, 22 bp, Homo sapiens
tttacagatgaggatactgagg

SEQ ID NO: 9091217 - DNA, 22 bp, Homo sapiens
tttaacagatgtgaaattttca

SEQ ID NO: 9091218 - DNA, 22 bp, Homo sapiens
tttaacagatgtgaaattttca

SEQ ID NO: 9091219 - DNA, 22 bp, Homo sapiens
tttaacatgtgaattttggaag

SEQ ID NO: 9091220 - DNA, 22 bp, Homo sapiens
tttaacatgtaattgctgcttt

SEQ ID NO: 9091221 - DNA, 22 bp, Homo sapiens
tttaacatgtgaattttggaag

SEQ ID NO: 9091222 - DNA, 22 bp, Homo sapiens
tttaacatgtgaattttggaag

SEQ ID NO: 9091223 - DNA, 22 bp, Homo sapiens
tttaacatgttcaagaaacata

SEQ ID NO: 9091224 - DNA, 22 bp, Homo sapiens
tttaaattatagttaatgtctg

SEQ ID NO: 9091225 - DNA, 22 bp, Homo sapiens
tttaaattatagttaatgtctg

SEQ ID NO: 9091226 - DNA, 22 bp, Homo sapiens
tttaaattatagttaatgtctg

SEQ ID NO: 9091227 - DNA, 22 bp, Homo sapiens
ttgtttaaaatgtagcaagaaa

SEQ ID NO: 9091228 - DNA, 22 bp, Homo sapiens
tttaacccaaataaccacagga

SEQ ID NO: 9091229 - DNA, 23 bp, Homo sapiens
tttaaccttggtcaagaatttcc

SEQ ID NO: 9091230 - DNA, 22 bp, Homo sapiens
tttaacctgtcaatttgcatgc

SEQ ID NO: 9091231 - DNA, 23 bp, Homo sapiens
tttaacatttgaacatgtggcca

SEQ ID NO: 9091232 - DNA, 22 bp, Homo sapiens
tttaacatgttcaagaaacata

SEQ ID NO: 9091233 - DNA, 22 bp, Homo sapiens
tttaacttagaagagatatcct

SEQ ID NO: 9091234 - DNA, 22 bp, Homo sapiens
tttaactctgtcattctcttta

SEQ ID NO: 9091235 - DNA, 22 bp, Homo sapiens
tttaacttaatctgcttgatga

SEQ ID NO: 9091236 - DNA, 23 bp, Homo sapiens
tttaactttccaataattcattg

SEQ ID NO: 9091237 - DNA, 22 bp, Homo sapiens
tttaacttgatcagtagagcat

SEQ ID NO: 9091238 - DNA, 23 bp, Homo sapiens
tttaactttccaataattcattg

SEQ ID NO: 9091239 - DNA, 22 bp, Homo sapiens
ttgtttaaaagaaatcatagaa

SEQ ID NO: 9091240 - DNA, 22 bp, Homo sapiens
ttgttgttggagccaatatgca

SEQ ID NO: 9091241 - DNA, 22 bp, Homo sapiens
ttgttgttataggtggtacaag

SEQ ID NO: 9091242 - DNA, 22 bp, Homo sapiens
ttgttgctcttgttgccacatg

SEQ ID NO: 9091243 - DNA, 22 bp, Homo sapiens
ttgttcttgccaagacatgaag

SEQ ID NO: 9091244 - DNA, 22 bp, Homo sapiens
ttgttcttggagcaggcagaga

SEQ ID NO: 9091245 - DNA, 22 bp, Homo sapiens
ttgttcttggagcaggcagaga

SEQ ID NO: 9091246 - DNA, 22 bp, Homo sapiens
ttgttcttagtatgcattgttt

SEQ ID NO: 9091247 - DNA, 22 bp, Homo sapiens
ttgttcttacttaagagtgaat

SEQ ID NO: 9091248 - DNA, 22 bp, Homo sapiens
ttgttctttatcctggaagcct

SEQ ID NO: 9091249 - DNA, 22 bp, Homo sapiens
ttgttcttttgcttagacagat

SEQ ID NO: 9091250 - DNA, 22 bp, Homo sapiens
tttaggagtcaaatgttttagg

SEQ ID NO: 9091251 - DNA, 22 bp, Homo sapiens
tttaggatattaatgttcagag

SEQ ID NO: 9091252 - DNA, 22 bp, Homo sapiens
tttaggatctctcttgttacat

SEQ ID NO: 9091253 - DNA, 22 bp, Homo sapiens
tttaggatattaatgttcagag

SEQ ID NO: 9091254 - DNA, 22 bp, Homo sapiens
tttaggaagagttgagtaaatt

SEQ ID NO: 9091255 - DNA, 22 bp, Homo sapiens
tttaggaagatctgaaggaaga

SEQ ID NO: 9091256 - DNA, 21 bp, Homo sapiens
tttagcatttacatatttcca

SEQ ID NO: 9091257 - DNA, 22 bp, Homo sapiens
tttagcatgttcctttcataga

SEQ ID NO: 9091258 - DNA, 22 bp, Homo sapiens
tttagcatcgaagtaaatttag

SEQ ID NO: 9091259 - DNA, 22 bp, Homo sapiens
tttagcatcgaagtaaatttag

SEQ ID NO: 9091260 - DNA, 22 bp, Homo sapiens
tttatctgcattctgaccatct

SEQ ID NO: 9091261 - DNA, 22 bp, Homo sapiens
tttatctggactgtgatataaa

SEQ ID NO: 9091262 - DNA, 22 bp, Homo sapiens
tttatctgtcatttcccatatc

SEQ ID NO: 9091263 - DNA, 22 bp, Homo sapiens
tttatctttaggactttgcaga

SEQ ID NO: 9091264 - DNA, 22 bp, Homo sapiens
tttatctttaggactttgcaga

SEQ ID NO: 9091265 - DNA, 22 bp, Homo sapiens
tttagtgtagcctaagcagaat

SEQ ID NO: 9091266 - DNA, 22 bp, Homo sapiens
tttagtgtaagcataaagaaca

SEQ ID NO: 9091267 - DNA, 22 bp, Homo sapiens
tttattgtgttgaaactgaatt

SEQ ID NO: 9091268 - DNA, 22 bp, Homo sapiens
tttattgtcttcgtggtgccta

SEQ ID NO: 9091269 - DNA, 22 bp, Homo sapiens
tttattgtcttcgtggtgccta

SEQ ID NO: 9091270 - DNA, 22 bp, Homo sapiens
tttattgtgttgaaactgaatt

SEQ ID NO: 9091271 - DNA, 22 bp, Homo sapiens
tttattgtgttgaaactgaatt

SEQ ID NO: 9091272 - DNA, 22 bp, Homo sapiens
tttattgtcaatctattcccag

SEQ ID NO: 9091273 - DNA, 22 bp, Homo sapiens
tttattgtctatgaactgcttg

SEQ ID NO: 9091274 - DNA, 22 bp, Homo sapiens
tttattgggcctggaggatcta

SEQ ID NO: 9091275 - DNA, 22 bp, Homo sapiens
tttatgaactacagatataact

SEQ ID NO: 9091276 - DNA, 22 bp, Homo sapiens
tttatctttggatcttcagaaa

SEQ ID NO: 9091277 - DNA, 22 bp, Homo sapiens
tttatctttggatcttcagaaa

SEQ ID NO: 9091278 - DNA, 22 bp, Homo sapiens
tttatgtaatttcataggtgtg

SEQ ID NO: 9091279 - DNA, 22 bp, Homo sapiens
tttattgcatacacaaatgtca

SEQ ID NO: 9091280 - DNA, 22 bp, Homo sapiens
tttatgtttgacaatgatctgg

SEQ ID NO: 9091281 - DNA, 22 bp, Homo sapiens
tttatgtttgacaatgatctgg

SEQ ID NO: 9091282 - DNA, 22 bp, Homo sapiens
tttatgtagttacggactatca

SEQ ID NO: 9091283 - DNA, 22 bp, Homo sapiens
tttcataatactgtacatgaaa

SEQ ID NO: 9091284 - DNA, 22 bp, Homo sapiens
tttcataatactgtacatgaaa

SEQ ID NO: 9091285 - DNA, 22 bp, Homo sapiens
tttcataatactgtacatgaaa

SEQ ID NO: 9091286 - DNA, 22 bp, Homo sapiens
tttcatattgtccagtcagcgc

SEQ ID NO: 9091287 - DNA, 23 bp, Homo sapiens
tttcatatggtgtggatgaagaa

SEQ ID NO: 9091288 - DNA, 22 bp, Homo sapiens
tttcatatgggcattggcaata

SEQ ID NO: 9091289 - DNA, 22 bp, Homo sapiens
tttcatagtcaagtgtgtatga

SEQ ID NO: 9091290 - DNA, 22 bp, Homo sapiens
tttcatagctgaaaatgttgaa

SEQ ID NO: 9091291 - DNA, 22 bp, Homo sapiens
tttcatcatgttggcagattgg

SEQ ID NO: 9091292 - DNA, 22 bp, Homo sapiens
tttccaaataaggtcacactca

SEQ ID NO: 9091293 - DNA, 22 bp, Homo sapiens
tttccaggcagaggagttgtga

SEQ ID NO: 9091294 - DNA, 22 bp, Homo sapiens
tttccaggagaaagagagcctt

SEQ ID NO: 9091295 - DNA, 22 bp, Homo sapiens
tttccaggaagtaaggataatc

SEQ ID NO: 9091296 - DNA, 22 bp, Homo sapiens
tttccagatgctaggttgaaag

SEQ ID NO: 9091297 - DNA, 22 bp, Homo sapiens
tttccaaataaggtcacattct

SEQ ID NO: 9091298 - DNA, 22 bp, Homo sapiens
tttccagtctcagccctgtaac

SEQ ID NO: 9091299 - DNA, 22 bp, Homo sapiens
tttccagtccctggatttaacc

SEQ ID NO: 9091300 - DNA, 22 bp, Homo sapiens
tttccaggtattaatactgtat

SEQ ID NO: 9091301 - DNA, 22 bp, Homo sapiens
tttccaggtgcatagaaaacag

SEQ ID NO: 9091302 - DNA, 22 bp, Homo sapiens
tttccaggtatcaagcttcagg

SEQ ID NO: 9091303 - DNA, 22 bp, Homo sapiens
tttcctttgtgcaggccttggg

SEQ ID NO: 9091304 - DNA, 22 bp, Homo sapiens
tttcctttgggagcatgaattt

SEQ ID NO: 9091305 - DNA, 22 bp, Homo sapiens
tttcctttgcccaatacatgtc

SEQ ID NO: 9091306 - DNA, 22 bp, Homo sapiens
tttccttgcacattggtttcca

SEQ ID NO: 9091307 - DNA, 22 bp, Homo sapiens
tttcccaattgagaggttctgt

SEQ ID NO: 9091308 - DNA, 22 bp, Homo sapiens
tttccttgcacattggtttcca

SEQ ID NO: 9091309 - DNA, 22 bp, Homo sapiens
tttcccaacagtctctctcaaa

SEQ ID NO: 9091310 - DNA, 22 bp, Homo sapiens
tttccagttgttctagaaagct

SEQ ID NO: 9091311 - DNA, 22 bp, Homo sapiens
tttccatgtgtactggccagaa

SEQ ID NO: 9091312 - DNA, 22 bp, Homo sapiens
tttccatgttggtgaaatgagg

SEQ ID NO: 9091313 - DNA, 22 bp, Homo sapiens
tttcccaaagcctggggtgagt

SEQ ID NO: 9091314 - DNA, 22 bp, Homo sapiens
tttccatgttatcttgcagact

SEQ ID NO: 9091315 - DNA, 22 bp, Homo sapiens
tttccttttaagcagtcggcct

SEQ ID NO: 9091316 - DNA, 22 bp, Homo sapiens
tttccttttataaggcttgagg

SEQ ID NO: 9091317 - DNA, 22 bp, Homo sapiens
tttcgagggccttaagtattcc

SEQ ID NO: 9091318 - DNA, 22 bp, Homo sapiens
tttctaaacaaagggagtttgg

SEQ ID NO: 9091319 - DNA, 22 bp, Homo sapiens
tttctaaaatagattttatggt

SEQ ID NO: 9091320 - DNA, 22 bp, Homo sapiens
tttctaaactggattcagcctg

SEQ ID NO: 9091321 - DNA, 22 bp, Homo sapiens
tttctaaactggattcagcctg

SEQ ID NO: 9091322 - DNA, 22 bp, Homo sapiens
tttctaaacaaagggagtttgg

SEQ ID NO: 9091323 - DNA, 22 bp, Homo sapiens
tttctaaaatagattttatggt

SEQ ID NO: 9091324 - DNA, 22 bp, Homo sapiens
tttctaaatggtggctgcattg

SEQ ID NO: 9091325 - DNA, 22 bp, Homo sapiens
tttctaaagggtagatttggcc

SEQ ID NO: 9091326 - DNA, 22 bp, Homo sapiens
tttctaaagggtagatttggcc

SEQ ID NO: 9091327 - DNA, 22 bp, Homo sapiens
tttctaagaatattgctcttaa

SEQ ID NO: 9091328 - DNA, 22 bp, Homo sapiens
tttctaagacatttgtcatctt

SEQ ID NO: 9091329 - DNA, 22 bp, Homo sapiens
tttctaagaaagtaatggttat

SEQ ID NO: 9091330 - DNA, 22 bp, Homo sapiens
tttctaagaaagtaatggttat

SEQ ID NO: 9091331 - DNA, 21 bp, Homo sapiens
tttctaaggaggaagaaaaga

SEQ ID NO: 9091332 - DNA, 21 bp, Homo sapiens
tttctaaggaggaagaaaaga

SEQ ID NO: 9091333 - DNA, 21 bp, Homo sapiens
tttctaaggaggaagaaaaga

SEQ ID NO: 9091334 - DNA, 22 bp, Homo sapiens
tttctaaggtgaggtagaaaat

SEQ ID NO: 9091335 - DNA, 22 bp, Homo sapiens
tttctaaggtgaggtagaaaat

SEQ ID NO: 9091336 - DNA, 22 bp, Homo sapiens
tttctaaggctaggtcttaagg

SEQ ID NO: 9091337 - DNA, 22 bp, Homo sapiens
tttctaaggctaggtcttaagg

SEQ ID NO: 9091338 - DNA, 22 bp, Homo sapiens
tttctaagcttagtatgaggca

SEQ ID NO: 9091339 - DNA, 22 bp, Homo sapiens
tttctaagatgtggtttcaagg

SEQ ID NO: 9091340 - DNA, 22 bp, Homo sapiens
tttctaagatgtggtttcaagg

SEQ ID NO: 9091341 - DNA, 19 bp, Homo sapiens
tttctaagctaaatgcttc

SEQ ID NO: 9091342 - DNA, 19 bp, Homo sapiens
tttctaagctaaatgcttc

SEQ ID NO: 9091343 - DNA, 19 bp, Homo sapiens
tttctaagctaaatgcttc

SEQ ID NO: 9091344 - DNA, 22 bp, Homo sapiens
tttcacatttaggcgtgaattg

SEQ ID NO: 9091345 - DNA, 23 bp, Homo sapiens
tttcacatttactgttagatggc

SEQ ID NO: 9091346 - DNA, 21 bp, Homo sapiens
tttcagtgtatgacagtgaaa

SEQ ID NO: 9091347 - DNA, 23 bp, Homo sapiens
tttcacattaatgtttagcagga

SEQ ID NO: 9091348 - DNA, 22 bp, Homo sapiens
tttcacattggcttctatttct

SEQ ID NO: 9091349 - DNA, 22 bp, Homo sapiens
tttcacattcttctgaatctac

SEQ ID NO: 9091350 - DNA, 22 bp, Homo sapiens
tttcacatgtggaatgccaggt

SEQ ID NO: 9091351 - DNA, 22 bp, Homo sapiens
tttcacatcagaggtagattag

SEQ ID NO: 9091352 - DNA, 22 bp, Homo sapiens
tttcacatatggttgttgattg

SEQ ID NO: 9091353 - DNA, 22 bp, Homo sapiens
tttcacaggggcaacctccatg

SEQ ID NO: 9091354 - DNA, 23 bp, Homo sapiens
tttcacagcttttattctgcatc

SEQ ID NO: 9091355 - DNA, 23 bp, Homo sapiens
tttcacagcttttattctgcatc

SEQ ID NO: 9091356 - DNA, 22 bp, Homo sapiens
tttcacaggagttgtaccattt

SEQ ID NO: 9091357 - DNA, 22 bp, Homo sapiens
tttcacaacgttgtggtgagag

SEQ ID NO: 9091358 - DNA, 18 bp, Homo sapiens
tttcacaacctccagagg

SEQ ID NO: 9091359 - DNA, 22 bp, Homo sapiens
tttcacaactgcttatttgaga

SEQ ID NO: 9091360 - DNA, 22 bp, Homo sapiens
tttcacaacgttgtggtgagag

SEQ ID NO: 9091361 - DNA, 22 bp, Homo sapiens
tttcaagttgttgcattaaatg

SEQ ID NO: 9091362 - DNA, 22 bp, Homo sapiens
tttcaatcaccataaagcaact

SEQ ID NO: 9091363 - DNA, 22 bp, Homo sapiens
tttcaataacaaagctcatttt

SEQ ID NO: 9091364 - DNA, 23 bp, Homo sapiens
tttatttatttaggctgagggat

SEQ ID NO: 9091365 - DNA, 22 bp, Homo sapiens
tttatttatccttctggattgc

SEQ ID NO: 9091366 - DNA, 22 bp, Homo sapiens
tttatttatccttctggattgc

SEQ ID NO: 9091367 - DNA, 21 bp, Homo sapiens
tttatttatataggacacatg

SEQ ID NO: 9091368 - DNA, 22 bp, Homo sapiens
tttatttataagccacttgctg

SEQ ID NO: 9091369 - DNA, 22 bp, Homo sapiens
tttcaagcataactgggaagag

SEQ ID NO: 9091370 - DNA, 22 bp, Homo sapiens
tttcaaggatgttatataaatg

SEQ ID NO: 9091371 - DNA, 22 bp, Homo sapiens
tttcaaggatgttatataaatg

SEQ ID NO: 9091372 - DNA, 17 bp, Homo sapiens
tttcaaggttacgttcc

SEQ ID NO: 9091373 - DNA, 22 bp, Homo sapiens
tttcaaggtgcaggagggtttt

SEQ ID NO: 9091374 - DNA, 22 bp, Homo sapiens
tttcaaggctagttttaattag

SEQ ID NO: 9091375 - DNA, 22 bp, Homo sapiens
tttcaaggctagttttaattag

SEQ ID NO: 9091376 - DNA, 22 bp, Homo sapiens
tttcaaggtgcaggagggtttt

SEQ ID NO: 9091377 - DNA, 22 bp, Homo sapiens
ttgccaggagacaaagtgggcc

SEQ ID NO: 9091378 - DNA, 22 bp, Homo sapiens
ttgccaggagacatctggagcc

SEQ ID NO: 9091379 - DNA, 22 bp, Homo sapiens
ttgccaggctctggttccagcc

SEQ ID NO: 9091380 - DNA, 22 bp, Homo sapiens
ttgccaggcttgtttctaggct

SEQ ID NO: 9091381 - DNA, 22 bp, Homo sapiens
ttgccagggaacagggagaggc

SEQ ID NO: 9091382 - DNA, 22 bp, Homo sapiens
ttgccagggctttggtggcatc

SEQ ID NO: 9091383 - DNA, 22 bp, Homo sapiens
ttgccagggccagtgggggtgt

SEQ ID NO: 9091384 - DNA, 22 bp, Homo sapiens
ttgccagggtcaggatgagatc

SEQ ID NO: 9091385 - DNA, 22 bp, Homo sapiens
ttgccaggggacatctggagcc

SEQ ID NO: 9091386 - DNA, 22 bp, Homo sapiens
ttgcattttggttgtaaatatg

SEQ ID NO: 9091387 - DNA, 22 bp, Homo sapiens
ttgcatttgctcatttgatatg

SEQ ID NO: 9091388 - DNA, 22 bp, Homo sapiens
ttgagggtctggatctgctgct

SEQ ID NO: 9091389 - DNA, 22 bp, Homo sapiens
ttgagtcagtaattccatttct

SEQ ID NO: 9091390 - DNA, 22 bp, Homo sapiens
ttgagtcatagattccacaatg

SEQ ID NO: 9091391 - DNA, 22 bp, Homo sapiens
ttgcatttcccattgagtaatg

SEQ ID NO: 9091392 - DNA, 19 bp, Homo sapiens
ttgcatttcatgtttgatt

SEQ ID NO: 9091393 - DNA, 22 bp, Homo sapiens
ttgcatttgagaaagttctcct

SEQ ID NO: 9091394 - DNA, 22 bp, Homo sapiens
ttgctataaatggtttcatatt

SEQ ID NO: 9091395 - DNA, 22 bp, Homo sapiens
ttgctagctggtgtatgcattg

SEQ ID NO: 9091396 - DNA, 22 bp, Homo sapiens
ttgctaatgccctagaagtatt

SEQ ID NO: 9091397 - DNA, 22 bp, Homo sapiens
ttgctaaaaatggaattatagg

SEQ ID NO: 9091398 - DNA, 22 bp, Homo sapiens
ttgctcatatttgcatgtgttt

SEQ ID NO: 9091399 - DNA, 22 bp, Homo sapiens
ttgctcagtggcagggctggta

SEQ ID NO: 9091400 - DNA, 19 bp, Homo sapiens
ttgcttcaggctgtgtgct

SEQ ID NO: 9091401 - DNA, 19 bp, Homo sapiens
ttgcttcaggctgtgtgct

SEQ ID NO: 9091402 - DNA, 22 bp, Homo sapiens
ttgcttcattttgggactctag

SEQ ID NO: 9091403 - DNA, 22 bp, Homo sapiens
ttgcttcattttgggtgtgcag

SEQ ID NO: 9091404 - DNA, 22 bp, Homo sapiens
ttgcttcattttgggactctag

SEQ ID NO: 9091405 - DNA, 22 bp, Homo sapiens
ttgcttcctctagtttcttgaa

SEQ ID NO: 9091406 - DNA, 22 bp, Homo sapiens
ttgcttcatttcctcaggcttt

SEQ ID NO: 9091407 - DNA, 22 bp, Homo sapiens
ttgcttcatatttgtggcttgc

SEQ ID NO: 9091408 - DNA, 22 bp, Homo sapiens
ttgcttcagtcagtgctgccca

SEQ ID NO: 9091409 - DNA, 22 bp, Homo sapiens
ttgccttatagtgctctgcatt

SEQ ID NO: 9091410 - DNA, 22 bp, Homo sapiens
ttgccttactgcattcagtaaa

SEQ ID NO: 9091411 - DNA, 22 bp, Homo sapiens
ttgcctttaagtataactgctg

SEQ ID NO: 9091412 - DNA, 22 bp, Homo sapiens
ttgcctttgacggtgcagcagt

SEQ ID NO: 9091413 - DNA, 22 bp, Homo sapiens
ttgcctgtttgagagctgtgtt

SEQ ID NO: 9091414 - DNA, 22 bp, Homo sapiens
ttgcctgtgtcagcaggtggaa

SEQ ID NO: 9091415 - DNA, 22 bp, Homo sapiens
ttgcctgtgaacgctgagtcct

SEQ ID NO: 9091416 - DNA, 22 bp, Homo sapiens
ttgcctgtgaggattctggttg

SEQ ID NO: 9091417 - DNA, 22 bp, Homo sapiens
ttgcccaccttagtcttcagac

SEQ ID NO: 9091418 - DNA, 22 bp, Homo sapiens
ttgcccaccatccaataaaatg

SEQ ID NO: 9091419 - DNA, 22 bp, Homo sapiens
ttgcccactcagccctgtggag

SEQ ID NO: 9091420 - DNA, 22 bp, Homo sapiens
ttgcccaccttcttttcgtgcc

SEQ ID NO: 9091421 - DNA, 22 bp, Homo sapiens
ttgccatttatactgcaagtca

SEQ ID NO: 9091422 - DNA, 22 bp, Homo sapiens
ttgcctgctacggtcttcactg

SEQ ID NO: 9091423 - DNA, 16 bp, Homo sapiens
ttgcccacttgttcat

SEQ ID NO: 9091424 - DNA, 22 bp, Homo sapiens
ttgcccactggctgttggtcag

SEQ ID NO: 9091425 - DNA, 22 bp, Homo sapiens
ttgcccactcatgcttttgata

SEQ ID NO: 9091426 - DNA, 22 bp, Homo sapiens
ttgcccactctgtttcccaaga

SEQ ID NO: 9091427 - DNA, 23 bp, Homo sapiens
ttgcttctgtgcaattcagtact

SEQ ID NO: 9091428 - DNA, 23 bp, Homo sapiens
ttgcttctgtgcaattcagtact

SEQ ID NO: 9091429 - DNA, 23 bp, Homo sapiens
ttgcttctgtgcaattcagtact

SEQ ID NO: 9091430 - DNA, 23 bp, Homo sapiens
ttgcttgagcccaggaagtggag

SEQ ID NO: 9091431 - DNA, 22 bp, Homo sapiens
ttgcttgcagacttagcaaatt

SEQ ID NO: 9091432 - DNA, 22 bp, Homo sapiens
ttgcttgccctgcagcatactt

SEQ ID NO: 9091433 - DNA, 22 bp, Homo sapiens
ttgctttaatgagattttgcca

SEQ ID NO: 9091434 - DNA, 22 bp, Homo sapiens
ttgctttactttgccattcgtt

SEQ ID NO: 9091435 - DNA, 22 bp, Homo sapiens
ttgctttacaaaaattgatggt

SEQ ID NO: 9091436 - DNA, 22 bp, Homo sapiens
ttgctttattcacatctatatt

SEQ ID NO: 9091437 - DNA, 22 bp, Homo sapiens
ttgctttatgtgtatgacttga

SEQ ID NO: 9091438 - DNA, 22 bp, Homo sapiens
ttgctttattcacatctatatt

SEQ ID NO: 9091439 - DNA, 22 bp, Homo sapiens
ttgctttaggtatagaatccat

SEQ ID NO: 9091440 - DNA, 22 bp, Homo sapiens
ttgctttagggcaaatatttca

SEQ ID NO: 9091441 - DNA, 22 bp, Homo sapiens
ttggaacagtgtgaaaaggtta

SEQ ID NO: 9091442 - DNA, 22 bp, Homo sapiens
ttggaagacaatgctgattctc

SEQ ID NO: 9091443 - DNA, 22 bp, Homo sapiens
ttggaagaaatatcaatagtgt

SEQ ID NO: 9091444 - DNA, 22 bp, Homo sapiens
ttggcaattagttatatctgca

SEQ ID NO: 9091445 - DNA, 22 bp, Homo sapiens
ttggcaatgtctaaacacattt

SEQ ID NO: 9091446 - DNA, 22 bp, Homo sapiens
ttggcaactctattggcaaata

SEQ ID NO: 9091447 - DNA, 22 bp, Homo sapiens
ttggattcctgggaaccatgca

SEQ ID NO: 9091448 - DNA, 22 bp, Homo sapiens
ttggcacagagctgcagcctgg

SEQ ID NO: 9091449 - DNA, 22 bp, Homo sapiens
ttggcacttcacgagacagcta

SEQ ID NO: 9091450 - DNA, 22 bp, Homo sapiens
ttggcacttcacgagacagcta

SEQ ID NO: 9091451 - DNA, 21 bp, Homo sapiens
ttggatgtatttatgttttag

SEQ ID NO: 9091452 - DNA, 21 bp, Homo sapiens
ttggatgtatttatgttttag

SEQ ID NO: 9091453 - DNA, 20 bp, Homo sapiens
ttggatgtgcatggccgtgc

SEQ ID NO: 9091454 - DNA, 18 bp, Homo sapiens
ttggaggatgtccatgaa

SEQ ID NO: 9091455 - DNA, 22 bp, Homo sapiens
ttggaattcagcttgcttataa

SEQ ID NO: 9091456 - DNA, 22 bp, Homo sapiens
ttggaagaggaaaatgagccta

SEQ ID NO: 9091457 - DNA, 21 bp, Homo sapiens
ttggaagataatgcttatgat

SEQ ID NO: 9091458 - DNA, 22 bp, Homo sapiens
ttggaagtaatgaagaggtggg

SEQ ID NO: 9091459 - DNA, 22 bp, Homo sapiens
ttggaagttcttagccttttca

SEQ ID NO: 9091460 - DNA, 22 bp, Homo sapiens
ttggaagagagccacagttaat

SEQ ID NO: 9091461 - DNA, 22 bp, Homo sapiens
ttggaagacattaaagagagtg

SEQ ID NO: 9091462 - DNA, 22 bp, Homo sapiens
ttggaagacagtgaaacagcac

SEQ ID NO: 9091463 - DNA, 22 bp, Homo sapiens
ttggctgctggtctttggatat

SEQ ID NO: 9091464 - DNA, 22 bp, Homo sapiens
ttggctgtatgtacatctgtta

SEQ ID NO: 9091465 - DNA, 22 bp, Homo sapiens
ttggctggttttgagtatgtgc

SEQ ID NO: 9091466 - DNA, 22 bp, Homo sapiens
ttggctggtttcaagaaggcat

SEQ ID NO: 9091467 - DNA, 22 bp, Homo sapiens
ttggctggtaagccaaatgaaa

SEQ ID NO: 9091468 - DNA, 22 bp, Homo sapiens
ttggctgggcacagtgtctcat

SEQ ID NO: 9091469 - DNA, 22 bp, Homo sapiens
ttggctcaggacccctgtgact

SEQ ID NO: 9091470 - DNA, 22 bp, Homo sapiens
ttggctcaggacccctgtgact

SEQ ID NO: 9091471 - DNA, 22 bp, Homo sapiens
ttggctcacctggagcctgttg

SEQ ID NO: 9091472 - DNA, 22 bp, Homo sapiens
ttggctaacctgggttatcagc

SEQ ID NO: 9091473 - DNA, 22 bp, Homo sapiens
ttggctaacacgcgttttgttc

SEQ ID NO: 9091474 - DNA, 21 bp, Homo sapiens
ttggcctttgtctcagacact

SEQ ID NO: 9091475 - DNA, 22 bp, Homo sapiens
ttggcctttgtcatcaagatca

SEQ ID NO: 9091476 - DNA, 22 bp, Homo sapiens
ttggccctttatgggatgggca

SEQ ID NO: 9091477 - DNA, 21 bp, Homo sapiens
ttggcctgatatcttggagca

SEQ ID NO: 9091478 - DNA, 21 bp, Homo sapiens
ttggcctgatatcttggagca

SEQ ID NO: 9091479 - DNA, 17 bp, Homo sapiens
ttggccttctagcctct

SEQ ID NO: 9091480 - DNA, 22 bp, Homo sapiens
ttggccttctggtgttcatttt

SEQ ID NO: 9091481 - DNA, 22 bp, Homo sapiens
ttggccttgtacatcatattaa

SEQ ID NO: 9091482 - DNA, 22 bp, Homo sapiens
ttggccttcttccccctgcact

SEQ ID NO: 9091483 - DNA, 22 bp, Homo sapiens
ttggccttgttaaggaggccct

SEQ ID NO: 9091484 - DNA, 22 bp, Homo sapiens
ttgggctcaggagtttgagacc

SEQ ID NO: 9091485 - DNA, 22 bp, Homo sapiens
ttgggctcaggagtttgagacc

SEQ ID NO: 9091486 - DNA, 22 bp, Homo sapiens
ttgggctatgttatataatgtt

SEQ ID NO: 9091487 - DNA, 22 bp, Homo sapiens
ttgggctgaaccctgcagctga

SEQ ID NO: 9091488 - DNA, 22 bp, Homo sapiens
ttgggctcaggagtttgagacc

SEQ ID NO: 9091489 - DNA, 22 bp, Homo sapiens
ttgggctcaggagtttgagacc

SEQ ID NO: 9091490 - DNA, 22 bp, Homo sapiens
ttgggctttaattccagagagg

SEQ ID NO: 9091491 - DNA, 22 bp, Homo sapiens
ttgggctggcagaggtggtctt

SEQ ID NO: 9091492 - DNA, 22 bp, Homo sapiens
ttgggctggcccttgtctctgg

SEQ ID NO: 9091493 - DNA, 22 bp, Homo sapiens
ttggggagaaatgaaatgaagt

SEQ ID NO: 9091494 - DNA, 22 bp, Homo sapiens
ttggggaggttgccacattcca

SEQ ID NO: 9091495 - DNA, 22 bp, Homo sapiens
ttggggagttaatgccaaagat

SEQ ID NO: 9091496 - DNA, 22 bp, Homo sapiens
ttggggagttaatgccaaagat

SEQ ID NO: 9091497 - DNA, 22 bp, Homo sapiens
ttggggcacctccccagcattt

SEQ ID NO: 9091498 - DNA, 22 bp, Homo sapiens
ttggcttcaatgtcagagacag

SEQ ID NO: 9091499 - DNA, 22 bp, Homo sapiens
ttggcttccaggggcttttaca

SEQ ID NO: 9091500 - DNA, 22 bp, Homo sapiens
ttggcttcccagagcttacgct

SEQ ID NO: 9091501 - DNA, 22 bp, Homo sapiens
ttggcttctgatgtattcctga

SEQ ID NO: 9091502 - DNA, 22 bp, Homo sapiens
ttggcttcctgcacttgagttt

SEQ ID NO: 9091503 - DNA, 22 bp, Homo sapiens
ttggcttcctgcacttgagttt

SEQ ID NO: 9091504 - DNA, 22 bp, Homo sapiens
ttggcttggagagttgaaatgt

SEQ ID NO: 9091505 - DNA, 22 bp, Homo sapiens
ttggcttgttaaaaatgcaatt

SEQ ID NO: 9091506 - DNA, 22 bp, Homo sapiens
ttggcttctttagtcagtttgg

SEQ ID NO: 9091507 - DNA, 18 bp, Homo sapiens
ttggctttgagaactggt

SEQ ID NO: 9091508 - DNA, 18 bp, Homo sapiens
ttggctttgagaactggt

SEQ ID NO: 9091509 - DNA, 22 bp, Homo sapiens
ttggcttttatgcagcttaggt

SEQ ID NO: 9091510 - DNA, 22 bp, Homo sapiens
ttggctttcaggctggaaatct

SEQ ID NO: 9091511 - DNA, 22 bp, Homo sapiens
ttggctttagacctgagactgt

SEQ ID NO: 9091512 - DNA, 22 bp, Homo sapiens
ttggctttagacctgagactgt

SEQ ID NO: 9091513 - DNA, 22 bp, Homo sapiens
ttggctttacaagcagtggcac

SEQ ID NO: 9091514 - DNA, 22 bp, Homo sapiens
ttggctttagacctgagactgt

SEQ ID NO: 9091515 - DNA, 22 bp, Homo sapiens
ttgggaagaaacatgtccatca

SEQ ID NO: 9091516 - DNA, 22 bp, Homo sapiens
ttgggaaagaatgagaaggtga

SEQ ID NO: 9091517 - DNA, 22 bp, Homo sapiens
ttgggaaagaatgagaaggtga

SEQ ID NO: 9091518 - DNA, 22 bp, Homo sapiens
ttgttcatccaacacaaggttg

SEQ ID NO: 9091519 - DNA, 22 bp, Homo sapiens
ttgtggaactcatctgcctggt

SEQ ID NO: 9091520 - DNA, 22 bp, Homo sapiens
ttgtggaatgtggctgtcaatt

SEQ ID NO: 9091521 - DNA, 22 bp, Homo sapiens
ttgtggaagccctatgagagac

SEQ ID NO: 9091522 - DNA, 22 bp, Homo sapiens
ttgtgcttgccctggaggtgcg

SEQ ID NO: 9091523 - DNA, 22 bp, Homo sapiens
ttgtgctcctgtgagaatctag

SEQ ID NO: 9091524 - DNA, 22 bp, Homo sapiens
ttgtgctcctgtgagaatctag

SEQ ID NO: 9091525 - DNA, 22 bp, Homo sapiens
ttgtgctcctatgagaatctaa

SEQ ID NO: 9091526 - DNA, 22 bp, Homo sapiens
ttgtgctcctatgagaatctaa

SEQ ID NO: 9091527 - DNA, 19 bp, Homo sapiens
ttgtgagctgaagaacagg

SEQ ID NO: 9091528 - DNA, 22 bp, Homo sapiens
ttgtgagcatgtttacttgatt

SEQ ID NO: 9091529 - DNA, 22 bp, Homo sapiens
ttgtgagcaggctgcacaaacc

SEQ ID NO: 9091530 - DNA, 22 bp, Homo sapiens
ttgtgagagccaaacatgtaag

SEQ ID NO: 9091531 - DNA, 22 bp, Homo sapiens
ttgtgagagccaaacatgtaag

SEQ ID NO: 9091532 - DNA, 22 bp, Homo sapiens
ttgtatttcctataacctttct

SEQ ID NO: 9091533 - DNA, 22 bp, Homo sapiens
ttgtatttcctataacctttct

SEQ ID NO: 9091534 - DNA, 22 bp, Homo sapiens
ttgtgatctgtgttgatggcct

SEQ ID NO: 9091535 - DNA, 22 bp, Homo sapiens
ttgtgcaaagggggttaatcat

SEQ ID NO: 9091536 - DNA, 22 bp, Homo sapiens
ttgtgagtagtgccgcaataaa

SEQ ID NO: 9091537 - DNA, 22 bp, Homo sapiens
ttgtgatactgagcttggcatt

SEQ ID NO: 9091538 - DNA, 22 bp, Homo sapiens
ttgtgcatttctctgagtgtgt

SEQ ID NO: 9091539 - DNA, 22 bp, Homo sapiens
ttgtgccaagaacatggaattt

SEQ ID NO: 9091540 - DNA, 22 bp, Homo sapiens
ttgtgccagagaaagcacaaga

SEQ ID NO: 9091541 - DNA, 19 bp, Homo sapiens
ttgtgccaagggtcagaag

SEQ ID NO: 9091542 - DNA, 22 bp, Homo sapiens
ttgtgccatgaactgtatgaag

SEQ ID NO: 9091543 - DNA, 22 bp, Homo sapiens
ttgtgccataaccaccctgact

SEQ ID NO: 9091544 - DNA, 22 bp, Homo sapiens
ttgtgccataaccaccctgact

SEQ ID NO: 9091545 - DNA, 22 bp, Homo sapiens
ttgtgccattaataaggagttg

SEQ ID NO: 9091546 - DNA, 22 bp, Homo sapiens
ttgtatttatattgaatagctt

SEQ ID NO: 9091547 - DNA, 22 bp, Homo sapiens
ttgtattaaaatgtgtttctgt

SEQ ID NO: 9091548 - DNA, 22 bp, Homo sapiens
ttgtatgtttctgtgcacatga

SEQ ID NO: 9091549 - DNA, 22 bp, Homo sapiens
ttgtattaattgaaatgaatgc

SEQ ID NO: 9091550 - DNA, 22 bp, Homo sapiens
ttgtattaattgaaatgaatgc

SEQ ID NO: 9091551 - DNA, 22 bp, Homo sapiens
ttgtatcagtgcctataaaatg

SEQ ID NO: 9091552 - DNA, 22 bp, Homo sapiens
ttgtatatattcttaaagatgt

SEQ ID NO: 9091553 - DNA, 22 bp, Homo sapiens
ttgtataagaagttggcagata

SEQ ID NO: 9091554 - DNA, 22 bp, Homo sapiens
ttgtatcagtgcctataaaatg

SEQ ID NO: 9091555 - DNA, 22 bp, Homo sapiens
ttgtactatgtctaagtcactg

SEQ ID NO: 9091556 - DNA, 22 bp, Homo sapiens
ttggggggttgaggagtagata

SEQ ID NO: 9091557 - DNA, 22 bp, Homo sapiens
ttggggtcccacaggctgcctg

SEQ ID NO: 9091558 - DNA, 22 bp, Homo sapiens
ttggggtacgcaggtctgggag

SEQ ID NO: 9091559 - DNA, 22 bp, Homo sapiens
ttgggggcatattgagtagtgg

SEQ ID NO: 9091560 - DNA, 22 bp, Homo sapiens
ttgggggcagagggagcatctg

SEQ ID NO: 9091561 - DNA, 22 bp, Homo sapiens
ttgtagaaaattagatgcatgg

SEQ ID NO: 9091562 - DNA, 22 bp, Homo sapiens
ttgtactttggggaaatgttga

SEQ ID NO: 9091563 - DNA, 22 bp, Homo sapiens
ttgtagaacatgcagcacaatg

SEQ ID NO: 9091564 - DNA, 22 bp, Homo sapiens
ttgtagaacatgcagcacaatg

SEQ ID NO: 9091565 - DNA, 22 bp, Homo sapiens
ttgtagaatcattatttctagt

SEQ ID NO: 9091566 - DNA, 22 bp, Homo sapiens
ttgtagacatctgtatcatttt

SEQ ID NO: 9091567 - DNA, 22 bp, Homo sapiens
ttatgttttatggctatatcat

SEQ ID NO: 9091568 - DNA, 22 bp, Homo sapiens
ttatgttttatggctatatcat

SEQ ID NO: 9091569 - DNA, 22 bp, Homo sapiens
ttatgttcagcatctgctttat

SEQ ID NO: 9091570 - DNA, 22 bp, Homo sapiens
ttatgtttgagtatatgactca

SEQ ID NO: 9091571 - DNA, 22 bp, Homo sapiens
ttatgtttgagtatatgactca

SEQ ID NO: 9091572 - DNA, 22 bp, Homo sapiens
ttattaaaatgcggatttggct

SEQ ID NO: 9091573 - DNA, 22 bp, Homo sapiens
ttattgttagtgagactgtaga

SEQ ID NO: 9091574 - DNA, 22 bp, Homo sapiens
ttattgtttgggtataatttga

SEQ ID NO: 9091575 - DNA, 22 bp, Homo sapiens
ttattgtttaaagccatgtaaa

SEQ ID NO: 9091576 - DNA, 22 bp, Homo sapiens
ttatttaaaagtggtaagattc

SEQ ID NO: 9091577 - DNA, 22 bp, Homo sapiens
ttatttaaaagtggtaagattc

SEQ ID NO: 9091578 - DNA, 22 bp, Homo sapiens
ttatttaaaagtggtaagattc

SEQ ID NO: 9091579 - DNA, 22 bp, Homo sapiens
ttattgtttgggtataatttga

SEQ ID NO: 9091580 - DNA, 22 bp, Homo sapiens
ttatttaaaagtggtaagattc

SEQ ID NO: 9091581 - DNA, 22 bp, Homo sapiens
ttatttaaaagtggtaagattc

SEQ ID NO: 9091582 - DNA, 22 bp, Homo sapiens
ttatttaatgtgatctgaagag

SEQ ID NO: 9091583 - DNA, 22 bp, Homo sapiens
ttatttaaaatgtaggttggga

SEQ ID NO: 9091584 - DNA, 22 bp, Homo sapiens
ttatttatggcactgttggtgg

SEQ ID NO: 9091585 - DNA, 22 bp, Homo sapiens
ttatttatatctctgcagttta

SEQ ID NO: 9091586 - DNA, 22 bp, Homo sapiens
ttatttatatctctgcagttta

SEQ ID NO: 9091587 - DNA, 18 bp, Homo sapiens
ttatttgttacagcacat

SEQ ID NO: 9091588 - DNA, 20 bp, Homo sapiens
ttatttgtttactttggtcc

SEQ ID NO: 9091589 - DNA, 22 bp, Homo sapiens
ttatttgttttctgagaagtat

SEQ ID NO: 9091590 - DNA, 22 bp, Homo sapiens
ttatttgtggcatatgagacga

SEQ ID NO: 9091591 - DNA, 22 bp, Homo sapiens
ttatttgtggcatatgagacga

SEQ ID NO: 9091592 - DNA, 22 bp, Homo sapiens
ttatttgtggcatatgagacga

SEQ ID NO: 9091593 - DNA, 22 bp, Homo sapiens
ttatttgtggcatccatgttgg

SEQ ID NO: 9091594 - DNA, 22 bp, Homo sapiens
ttatttacaactcttctcttcc

SEQ ID NO: 9091595 - DNA, 22 bp, Homo sapiens
ttatttactggatggccttggg

SEQ ID NO: 9091596 - DNA, 22 bp, Homo sapiens
ttatttacaactcttctcttcc

SEQ ID NO: 9091597 - DNA, 22 bp, Homo sapiens
ttatttactggatggccttggg

SEQ ID NO: 9091598 - DNA, 22 bp, Homo sapiens
ttatttaatgtgatctgaagag

SEQ ID NO: 9091599 - DNA, 22 bp, Homo sapiens
ttatttaattttctcactcaga

SEQ ID NO: 9091600 - DNA, 22 bp, Homo sapiens
ttatttacaactcttctcttcc

SEQ ID NO: 9091601 - DNA, 22 bp, Homo sapiens
ttatttaattttctcactcaga

SEQ ID NO: 9091602 - DNA, 22 bp, Homo sapiens
ttatttaattttctcactcaga

SEQ ID NO: 9091603 - DNA, 22 bp, Homo sapiens
ttcaaggagattggagtctact

SEQ ID NO: 9091604 - DNA, 22 bp, Homo sapiens
ttcaaggcaagtactttaattt

SEQ ID NO: 9091605 - DNA, 22 bp, Homo sapiens
ttcaagcagagatatttcaaga

SEQ ID NO: 9091606 - DNA, 22 bp, Homo sapiens
ttcaagcagagatatttcaaga

SEQ ID NO: 9091607 - DNA, 22 bp, Homo sapiens
ttcaagcagggattggtgatgg

SEQ ID NO: 9091608 - DNA, 22 bp, Homo sapiens
ttcaagatcgagtttaaagtga

SEQ ID NO: 9091609 - DNA, 22 bp, Homo sapiens
ttcaagaaggtacatttacatc

SEQ ID NO: 9091610 - DNA, 23 bp, Homo sapiens
ttcaagagccatgctcttcttat

SEQ ID NO: 9091611 - DNA, 22 bp, Homo sapiens
ttcaagaggcttaattctggat

SEQ ID NO: 9091612 - DNA, 18 bp, Homo sapiens
ttcaagagtttctctagg

SEQ ID NO: 9091613 - DNA, 18 bp, Homo sapiens
ttcaagagtttctctagg

SEQ ID NO: 9091614 - DNA, 17 bp, Homo sapiens
ttcaagatattgaaatg

SEQ ID NO: 9091615 - DNA, 23 bp, Homo sapiens
ttcaagatacggtttccaggctg

SEQ ID NO: 9091616 - DNA, 22 bp, Homo sapiens
ttcaaaattgttctaagctctg

SEQ ID NO: 9091617 - DNA, 22 bp, Homo sapiens
ttcaaaattgttctaagctctg

SEQ ID NO: 9091618 - DNA, 22 bp, Homo sapiens
ttcaaaattgttctaagctctg

SEQ ID NO: 9091619 - DNA, 22 bp, Homo sapiens
ttattttgccacaggtgacctt

SEQ ID NO: 9091620 - DNA, 22 bp, Homo sapiens
ttattttgagagaatgtgtgct

SEQ ID NO: 9091621 - DNA, 22 bp, Homo sapiens
ttattttaccttcctctgagct

SEQ ID NO: 9091622 - DNA, 22 bp, Homo sapiens
ttattttggtaaatgtttgcct

SEQ ID NO: 9091623 - DNA, 22 bp, Homo sapiens
ttattttgtagctctgatcttt

SEQ ID NO: 9091624 - DNA, 22 bp, Homo sapiens
ttcaaaagtaatcagtattaga

SEQ ID NO: 9091625 - DNA, 22 bp, Homo sapiens
ttcaaaagtaatcagtattaga

SEQ ID NO: 9091626 - DNA, 22 bp, Homo sapiens
ttcaaaagcggtccaggaagat

SEQ ID NO: 9091627 - DNA, 22 bp, Homo sapiens
tcctctggaacctcacccttgc

SEQ ID NO: 9091628 - DNA, 22 bp, Homo sapiens
tcctctggatataagcctcacc

SEQ ID NO: 9091629 - DNA, 22 bp, Homo sapiens
tcctctggatataagcctcacc

SEQ ID NO: 9091630 - DNA, 22 bp, Homo sapiens
tcctctggatataagcctcacc

SEQ ID NO: 9091631 - DNA, 22 bp, Homo sapiens
tcctctggcccagctgcctctg

SEQ ID NO: 9091632 - DNA, 22 bp, Homo sapiens
ttagtgtcttcttcatcctctg

SEQ ID NO: 9091633 - DNA, 22 bp, Homo sapiens
tcctcctgtttctcaggcctgg

SEQ ID NO: 9091634 - DNA, 21 bp, Homo sapiens
tcctcctgtagagggtcctgg

SEQ ID NO: 9091635 - DNA, 22 bp, Homo sapiens
tcctctgctccaggctggactt

SEQ ID NO: 9091636 - DNA, 22 bp, Homo sapiens
tcctctgctcagcattcctcac

SEQ ID NO: 9091637 - DNA, 22 bp, Homo sapiens
tcctctccagcaaactggctat

SEQ ID NO: 9091638 - DNA, 22 bp, Homo sapiens
tcctcggctgggccccaggctt

SEQ ID NO: 9091639 - DNA, 23 bp, Homo sapiens
tcctcgcaggagggagatgatgc

SEQ ID NO: 9091640 - DNA, 22 bp, Homo sapiens
ttataattgcttattagaccca

SEQ ID NO: 9091641 - DNA, 22 bp, Homo sapiens
ttataattctggcataggctgt

SEQ ID NO: 9091642 - DNA, 22 bp, Homo sapiens
ttatacagcattgctagtgatg

SEQ ID NO: 9091643 - DNA, 22 bp, Homo sapiens
ttatacagcattgctagtgatg

SEQ ID NO: 9091644 - DNA, 22 bp, Homo sapiens
ttatgcaaggacttattacagt

SEQ ID NO: 9091645 - DNA, 22 bp, Homo sapiens
ttatgcaaggacttattacagt

SEQ ID NO: 9091646 - DNA, 22 bp, Homo sapiens
ttatacagggagtttccctgca

SEQ ID NO: 9091647 - DNA, 22 bp, Homo sapiens
ttatacagggagtttccctgca

SEQ ID NO: 9091648 - DNA, 22 bp, Homo sapiens
ttatacagtttatacttagaat

SEQ ID NO: 9091649 - DNA, 22 bp, Homo sapiens
ttatacaggagattccttactt

SEQ ID NO: 9091650 - DNA, 22 bp, Homo sapiens
ttatacaggagattccttactt

SEQ ID NO: 9091651 - DNA, 22 bp, Homo sapiens
ttatacagcattgctagtgatg

SEQ ID NO: 9091652 - DNA, 22 bp, Homo sapiens
ttagttgctcactacaaggtta

SEQ ID NO: 9091653 - DNA, 22 bp, Homo sapiens
ttataattctggcataggctgt

SEQ ID NO: 9091654 - DNA, 22 bp, Homo sapiens
ttataattctggcataggctgt

SEQ ID NO: 9091655 - DNA, 22 bp, Homo sapiens
ttagttagaataatacaagtaa

SEQ ID NO: 9091656 - DNA, 22 bp, Homo sapiens
ttagttatactactgaatggag

SEQ ID NO: 9091657 - DNA, 22 bp, Homo sapiens
ttagttgatagccaaaatttat

SEQ ID NO: 9091658 - DNA, 22 bp, Homo sapiens
ttagttgatcattcaacatggg

SEQ ID NO: 9091659 - DNA, 22 bp, Homo sapiens
ttagttctcatgaattttaagt

SEQ ID NO: 9091660 - DNA, 22 bp, Homo sapiens
ttatgtgagatgtttacattgg

SEQ ID NO: 9091661 - DNA, 22 bp, Homo sapiens
ttatgtgtacctcaatctgagg

SEQ ID NO: 9091662 - DNA, 22 bp, Homo sapiens
ttatgtgtgtacatgcatatgt

SEQ ID NO: 9091663 - DNA, 21 bp, Homo sapiens
ttatggagaaggaaagtaagg

SEQ ID NO: 9091664 - DNA, 22 bp, Homo sapiens
ttatggagcagacagctggtca

SEQ ID NO: 9091665 - DNA, 22 bp, Homo sapiens
ttatggaatttgcaaaaggtta

SEQ ID NO: 9091666 - DNA, 22 bp, Homo sapiens
ttatggaatacttatgctgcag

SEQ ID NO: 9091667 - DNA, 22 bp, Homo sapiens
ttatggaataacctttctgaaa

SEQ ID NO: 9091668 - DNA, 22 bp, Homo sapiens
ttatggaatggagaaagtctgc

SEQ ID NO: 9091669 - DNA, 22 bp, Homo sapiens
ttatgcatgagataaaaattgg

SEQ ID NO: 9091670 - DNA, 22 bp, Homo sapiens
ttatgcagtcgacatctgatca

SEQ ID NO: 9091671 - DNA, 22 bp, Homo sapiens
ttatggaaatgaaattttattg

SEQ ID NO: 9091672 - DNA, 22 bp, Homo sapiens
ttatggaagtgcaaattgtgtg

SEQ ID NO: 9091673 - DNA, 22 bp, Homo sapiens
ttccatgggtctgggggctcca

SEQ ID NO: 9091674 - DNA, 22 bp, Homo sapiens
ttcccagacctgtaggatcaga

SEQ ID NO: 9091675 - DNA, 22 bp, Homo sapiens
ttcccagactccacactgaggc

SEQ ID NO: 9091676 - DNA, 19 bp, Homo sapiens
ttcccagagccatgagtga

SEQ ID NO: 9091677 - DNA, 19 bp, Homo sapiens
ttcccagagccatgagtga

SEQ ID NO: 9091678 - DNA, 22 bp, Homo sapiens
ttcccagaggagatttgcttat

SEQ ID NO: 9091679 - DNA, 22 bp, Homo sapiens
ttcccagagataagacgtctta

SEQ ID NO: 9091680 - DNA, 22 bp, Homo sapiens
ttcccagactccacactgaggc

SEQ ID NO: 9091681 - DNA, 22 bp, Homo sapiens
ttcccagagaaggatgaaaaag

SEQ ID NO: 9091682 - DNA, 22 bp, Homo sapiens
ttccatctgagagctgtgaaga

SEQ ID NO: 9091683 - DNA, 22 bp, Homo sapiens
ttccatgaaagtgaaatggagc

SEQ ID NO: 9091684 - DNA, 22 bp, Homo sapiens
ttccatgagtagcagtatttcc

SEQ ID NO: 9091685 - DNA, 22 bp, Homo sapiens
ttccatgagctctgagttcaca

SEQ ID NO: 9091686 - DNA, 18 bp, Homo sapiens
ttccatgattcctttcac

SEQ ID NO: 9091687 - DNA, 22 bp, Homo sapiens
ttccatgaagggcagcctctca

SEQ ID NO: 9091688 - DNA, 22 bp, Homo sapiens
ttccatgacaccgagggaagtc

SEQ ID NO: 9091689 - DNA, 22 bp, Homo sapiens
ttccatgaagggcagcctctca

SEQ ID NO: 9091690 - DNA, 22 bp, Homo sapiens
ttccatgaaggagactgagaag

SEQ ID NO: 9091691 - DNA, 22 bp, Homo sapiens
ttccatgactgaagcaggggcg

SEQ ID NO: 9091692 - DNA, 22 bp, Homo sapiens
ttccatgaaatgtgttatgctt

SEQ ID NO: 9091693 - DNA, 22 bp, Homo sapiens
ttccatctttcagctttgttgg

SEQ ID NO: 9091694 - DNA, 22 bp, Homo sapiens
ttccatgaaatgtgttatgctt

SEQ ID NO: 9091695 - DNA, 22 bp, Homo sapiens
ttcccatttgtggtagtgaatt

SEQ ID NO: 9091696 - DNA, 22 bp, Homo sapiens
ttccccaggctggagtgcagtg

SEQ ID NO: 9091697 - DNA, 22 bp, Homo sapiens
ttccccaggcggctttttcagc

SEQ ID NO: 9091698 - DNA, 22 bp, Homo sapiens
ttcccagtgaggaagcaatgca

SEQ ID NO: 9091699 - DNA, 22 bp, Homo sapiens
ttcccagtgaggaagcaatgca

SEQ ID NO: 9091700 - DNA, 22 bp, Homo sapiens
ttcccctgtcacagtggttctc

SEQ ID NO: 9091701 - DNA, 22 bp, Homo sapiens
ttccccttataagtctggcttc

SEQ ID NO: 9091702 - DNA, 22 bp, Homo sapiens
ttccccttatcaccagcctgtc

SEQ ID NO: 9091703 - DNA, 22 bp, Homo sapiens
ttccccttgataagcagggttg

SEQ ID NO: 9091704 - DNA, 22 bp, Homo sapiens
ttccccttgataatgcagtaag

SEQ ID NO: 9091705 - DNA, 22 bp, Homo sapiens
ttccccttgcactatcaccctg

SEQ ID NO: 9091706 - DNA, 22 bp, Homo sapiens
ttccccttgggctgtggaggag

SEQ ID NO: 9091707 - DNA, 22 bp, Homo sapiens
ttccccaggggctcctgccttt

SEQ ID NO: 9091708 - DNA, 22 bp, Homo sapiens
ttccccaggctggagtgcagtg

SEQ ID NO: 9091709 - DNA, 22 bp, Homo sapiens
ttccccagggaagctcctgcgc

SEQ ID NO: 9091710 - DNA, 22 bp, Homo sapiens
ttccccagtagtgacaatcaaa

SEQ ID NO: 9091711 - DNA, 22 bp, Homo sapiens
ttccccaggctggagtgcagtg

SEQ ID NO: 9091712 - DNA, 22 bp, Homo sapiens
ttccccagtaacatacatgtga

SEQ ID NO: 9091713 - DNA, 22 bp, Homo sapiens
ttccataatcaccttattcttt

SEQ ID NO: 9091714 - DNA, 20 bp, Homo sapiens
ttccatagcaccctgtgggt

SEQ ID NO: 9091715 - DNA, 22 bp, Homo sapiens
ttccatacgactgaggtctcgg

SEQ ID NO: 9091716 - DNA, 22 bp, Homo sapiens
ttccaattgcagatcagataca

SEQ ID NO: 9091717 - DNA, 22 bp, Homo sapiens
ttccataaaggtgatagtatac

SEQ ID NO: 9091718 - DNA, 22 bp, Homo sapiens
ttccaagtgttgagattagagg

SEQ ID NO: 9091719 - DNA, 22 bp, Homo sapiens
ttccaagtgtcagatcagattt

SEQ ID NO: 9091720 - DNA, 22 bp, Homo sapiens
ttccaagtgcccatatttcatc

SEQ ID NO: 9091721 - DNA, 22 bp, Homo sapiens
ttccaagtgcccatatttcatc

SEQ ID NO: 9091722 - DNA, 22 bp, Homo sapiens
ttccaaaacagtatggcatgtg

SEQ ID NO: 9091723 - DNA, 22 bp, Homo sapiens
ttccaaaacagtatggcatgtg

SEQ ID NO: 9091724 - DNA, 19 bp, Homo sapiens
ttccaaaatcaggatttga

SEQ ID NO: 9091725 - DNA, 22 bp, Homo sapiens
ttcatcaggcatcatgctcaag

SEQ ID NO: 9091726 - DNA, 22 bp, Homo sapiens
ttcatcaggcatcatgctcaag

SEQ ID NO: 9091727 - DNA, 22 bp, Homo sapiens
ttccaaaacaatattctgtgaa

SEQ ID NO: 9091728 - DNA, 21 bp, Homo sapiens
ttcatcagccagaaatcaagc

SEQ ID NO: 9091729 - DNA, 20 bp, Homo sapiens
ttcatcagcaaagcacagca

SEQ ID NO: 9091730 - DNA, 21 bp, Homo sapiens
ttcatcagccagaaatcaagc

SEQ ID NO: 9091731 - DNA, 22 bp, Homo sapiens
ttccaactttgtcatatattat

SEQ ID NO: 9091732 - DNA, 22 bp, Homo sapiens
ttccaagagctttaattgttga

SEQ ID NO: 9091733 - DNA, 17 bp, Homo sapiens
ttccaaggagcatttga

SEQ ID NO: 9091734 - DNA, 20 bp, Homo sapiens
ttcatcagcaaagcacagca

SEQ ID NO: 9091735 - DNA, 22 bp, Homo sapiens
ttcatcaccttggtagcactcc

SEQ ID NO: 9091736 - DNA, 22 bp, Homo sapiens
ttcatcaccttggtagcactcc

SEQ ID NO: 9091737 - DNA, 22 bp, Homo sapiens
ttcatatgcagattaacaaata

SEQ ID NO: 9091738 - DNA, 23 bp, Homo sapiens
ttcatatgttgctgaaaacagca

SEQ ID NO: 9091739 - DNA, 22 bp, Homo sapiens
ttcatatatatgcactacgtac

SEQ ID NO: 9091740 - DNA, 22 bp, Homo sapiens
ttcatataaatggaatcagaat

SEQ ID NO: 9091741 - DNA, 22 bp, Homo sapiens
ttcatagtgtttccttccagtg

SEQ ID NO: 9091742 - DNA, 22 bp, Homo sapiens
ttcatagtgcttaatttgataa

SEQ ID NO: 9091743 - DNA, 22 bp, Homo sapiens
ttcatagttcagcaaaagagaa

SEQ ID NO: 9091744 - DNA, 22 bp, Homo sapiens
ttcatactcactccaataactg

SEQ ID NO: 9091745 - DNA, 22 bp, Homo sapiens
ttcatactaaagtgtaagatgt

SEQ ID NO: 9091746 - DNA, 22 bp, Homo sapiens
ttcatacatttttactaacagc

SEQ ID NO: 9091747 - DNA, 22 bp, Homo sapiens
ttcatactcactccaataactg

SEQ ID NO: 9091748 - DNA, 22 bp, Homo sapiens
ttcatactcttccctgggcaaa

SEQ ID NO: 9091749 - DNA, 22 bp, Homo sapiens
ttcatactgtttaagttctgtt

SEQ ID NO: 9091750 - DNA, 22 bp, Homo sapiens
ttcatacatgagactagatgca

SEQ ID NO: 9091751 - DNA, 22 bp, Homo sapiens
ttcatacatgtgtactgttcca

SEQ ID NO: 9091752 - DNA, 23 bp, Homo sapiens
ttcatacagaaacatcacttcat

SEQ ID NO: 9091753 - DNA, 23 bp, Homo sapiens
ttcatacagaaacatcacttcat

SEQ ID NO: 9091754 - DNA, 22 bp, Homo sapiens
ttcagaatatttgttttacatg

SEQ ID NO: 9091755 - DNA, 22 bp, Homo sapiens
ttcagaatctatgtgccagctc

SEQ ID NO: 9091756 - DNA, 22 bp, Homo sapiens
ttcagaatgacttatgtaaggc

SEQ ID NO: 9091757 - DNA, 22 bp, Homo sapiens
ttcagaatctatgtgccagctc

SEQ ID NO: 9091758 - DNA, 22 bp, Homo sapiens
ttcagaatgagaatggatgggt

SEQ ID NO: 9091759 - DNA, 22 bp, Homo sapiens
ttcagaatgacttatgtaaggc

SEQ ID NO: 9091760 - DNA, 22 bp, Homo sapiens
ttcagaatgagaatggatgggt

SEQ ID NO: 9091761 - DNA, 22 bp, Homo sapiens
ttcagaatgtactgatagaaca

SEQ ID NO: 9091762 - DNA, 22 bp, Homo sapiens
ttcagaatgctatttctgaaat

SEQ ID NO: 9091763 - DNA, 22 bp, Homo sapiens
ttcagaatgatttcagcgagca

SEQ ID NO: 9091764 - DNA, 22 bp, Homo sapiens
ttcagaatgattacattctggt

SEQ ID NO: 9091765 - DNA, 22 bp, Homo sapiens
ttcagaatgattacattctggt

SEQ ID NO: 9091766 - DNA, 22 bp, Homo sapiens
ttcagaatgatttcagcgagca

SEQ ID NO: 9091767 - DNA, 22 bp, Homo sapiens
ttcagaatgctatttctgaaat

SEQ ID NO: 9091768 - DNA, 22 bp, Homo sapiens
ttcagaatgctatttctgaaat

SEQ ID NO: 9091769 - DNA, 22 bp, Homo sapiens
ttcagaatgtgaccttatttgg

SEQ ID NO: 9091770 - DNA, 22 bp, Homo sapiens
ttcagaatgtgaccttatttgg

SEQ ID NO: 9091771 - DNA, 22 bp, Homo sapiens
ttcagaatgtactgatagaaca

SEQ ID NO: 9091772 - DNA, 19 bp, Homo sapiens
ttcagaattgggaggtgat

SEQ ID NO: 9091773 - DNA, 16 bp, Homo sapiens
ttcagaatttgtagaa

SEQ ID NO: 9091774 - DNA, 19 bp, Homo sapiens
ttcagaattgggaggtgat

SEQ ID NO: 9091775 - DNA, 16 bp, Homo sapiens
ttcagaatttgtagaa

SEQ ID NO: 9091776 - DNA, 22 bp, Homo sapiens
ttcagaaatccctcttctaccc

SEQ ID NO: 9091777 - DNA, 22 bp, Homo sapiens
ttcagaaatgaatattggtatt

SEQ ID NO: 9091778 - DNA, 22 bp, Homo sapiens
ttcagaataactttttattgaa

SEQ ID NO: 9091779 - DNA, 22 bp, Homo sapiens
ttcagaataactttttattgaa

SEQ ID NO: 9091780 - DNA, 22 bp, Homo sapiens
ttcagaataatgtgttagagaa

SEQ ID NO: 9091781 - DNA, 22 bp, Homo sapiens
ttcagaatattattttaaaggc

SEQ ID NO: 9091782 - DNA, 22 bp, Homo sapiens
ttcagaatatccgtttaagttt

SEQ ID NO: 9091783 - DNA, 22 bp, Homo sapiens
ttcagaataatgtgttagagaa

SEQ ID NO: 9091784 - DNA, 22 bp, Homo sapiens
ttcagaatatccgtttaagttt

SEQ ID NO: 9091785 - DNA, 22 bp, Homo sapiens
ttcagaatatttgttttacatg

SEQ ID NO: 9091786 - DNA, 22 bp, Homo sapiens
ttcagaatattattttaaaggc

SEQ ID NO: 9091787 - DNA, 22 bp, Homo sapiens
ttcagaaggatgacaccagttg

SEQ ID NO: 9091788 - DNA, 17 bp, Homo sapiens
ttcagaagcattttggc

SEQ ID NO: 9091789 - DNA, 22 bp, Homo sapiens
ttcagaagtagctaagcagtca

SEQ ID NO: 9091790 - DNA, 22 bp, Homo sapiens
ttcagaaggtaggaatgtccct

SEQ ID NO: 9091791 - DNA, 21 bp, Homo sapiens
ttcaagtctctaggacttctc

SEQ ID NO: 9091792 - DNA, 22 bp, Homo sapiens
ttcaagtcctttggaaggcctg

SEQ ID NO: 9091793 - DNA, 22 bp, Homo sapiens
ttcaagtcatgttaactgcttc

SEQ ID NO: 9091794 - DNA, 22 bp, Homo sapiens
ttcaatatctctaagaatgagg

SEQ ID NO: 9091795 - DNA, 22 bp, Homo sapiens
ttcaagtcaatttttgaatgac

SEQ ID NO: 9091796 - DNA, 22 bp, Homo sapiens
ttcaagtcagagcaagccaagt

SEQ ID NO: 9091797 - DNA, 22 bp, Homo sapiens
ttcaagtatgagaaaggggact

SEQ ID NO: 9091798 - DNA, 22 bp, Homo sapiens
ttcaagtcaaggaaagaggtct

SEQ ID NO: 9091799 - DNA, 22 bp, Homo sapiens
ttcaagtagtcacacatgatat

SEQ ID NO: 9091800 - DNA, 22 bp, Homo sapiens
ttcaagtatatttaacatcgta

SEQ ID NO: 9091801 - DNA, 22 bp, Homo sapiens
ttcaagtatatttaacatcgta

SEQ ID NO: 9091802 - DNA, 22 bp, Homo sapiens
ttcaagtaggccagctgcatgg

SEQ ID NO: 9091803 - DNA, 22 bp, Homo sapiens
ttcaagtagctaaattagctgc

SEQ ID NO: 9091804 - DNA, 22 bp, Homo sapiens
ttcaagtactgtagatttcagg

SEQ ID NO: 9091805 - DNA, 22 bp, Homo sapiens
ttcaagtagaaagtattgatga

SEQ ID NO: 9091806 - DNA, 22 bp, Homo sapiens
ttcaagtagctaaattagctgc

SEQ ID NO: 9091807 - DNA, 22 bp, Homo sapiens
ttcaagtaatgctactcctatg

SEQ ID NO: 9091808 - DNA, 22 bp, Homo sapiens
ttcaagtaatgctactcctatg

SEQ ID NO: 9091809 - DNA, 22 bp, Homo sapiens
ttcaagtacattgtgttttcct

SEQ ID NO: 9091810 - DNA, 22 bp, Homo sapiens
ttcaagtactgtagatttcagg

SEQ ID NO: 9091811 - DNA, 19 bp, Homo sapiens
ttcaagtaaactattatta

SEQ ID NO: 9091812 - DNA, 22 bp, Homo sapiens
ttcaagtaaatcactttttgtc

SEQ ID NO: 9091813 - DNA, 22 bp, Homo sapiens
ttcaagtaacacaaatgcaccc

SEQ ID NO: 9091814 - DNA, 22 bp, Homo sapiens
ttcaaggtatggtagctggtca

SEQ ID NO: 9091815 - DNA, 22 bp, Homo sapiens
ttcaatcatttttacatagtcc

SEQ ID NO: 9091816 - DNA, 22 bp, Homo sapiens
ttcaatcatttttacatagtcc

SEQ ID NO: 9091817 - DNA, 21 bp, Homo sapiens
ttcaatgaaaacaaagtgagg

SEQ ID NO: 9091818 - DNA, 22 bp, Homo sapiens
ttcaatcattgcaaagtaatgg

SEQ ID NO: 9091819 - DNA, 22 bp, Homo sapiens
ttcaatcattgcaaagtaatgg

SEQ ID NO: 9091820 - DNA, 22 bp, Homo sapiens
ttcaatgagcccggggccatag

SEQ ID NO: 9091821 - DNA, 17 bp, Homo sapiens
ttcaatgattaatgcat

SEQ ID NO: 9091822 - DNA, 22 bp, Homo sapiens
ttcaatatctctaagaatgagg

SEQ ID NO: 9091823 - DNA, 22 bp, Homo sapiens
ttcaatcattccaacactttaa

SEQ ID NO: 9091824 - DNA, 22 bp, Homo sapiens
ttcaatcattagaatctcaggc

SEQ ID NO: 9091825 - DNA, 22 bp, Homo sapiens
ttctttcttctcaggctgggta

SEQ ID NO: 9091826 - DNA, 22 bp, Homo sapiens
ttctttcttggggaacacactc

SEQ ID NO: 9091827 - DNA, 22 bp, Homo sapiens
ttctttgcccatgtttcctaag

SEQ ID NO: 9091828 - DNA, 22 bp, Homo sapiens
ttctttggaataagtcaagctg

SEQ ID NO: 9091829 - DNA, 22 bp, Homo sapiens
ttctttgcccttaatgaaataa

SEQ ID NO: 9091830 - DNA, 23 bp, Homo sapiens
ttctttggaattgggctgcaagg

SEQ ID NO: 9091831 - DNA, 22 bp, Homo sapiens
ttctttggcatttcctgtatgt

SEQ ID NO: 9091832 - DNA, 22 bp, Homo sapiens
ttctttggggtctccagcatag

SEQ ID NO: 9091833 - DNA, 22 bp, Homo sapiens
ttctttggggaatattctggtt

SEQ ID NO: 9091834 - DNA, 22 bp, Homo sapiens
ttctttgggctcagagagggag

SEQ ID NO: 9091835 - DNA, 22 bp, Homo sapiens
ttctttgggctcagagagggag

SEQ ID NO: 9091836 - DNA, 22 bp, Homo sapiens
ttctttgggcaattgctggccc

SEQ ID NO: 9091837 - DNA, 22 bp, Homo sapiens
ttctttgggattgtagctgtct

SEQ ID NO: 9091838 - DNA, 22 bp, Homo sapiens
ttctttggctgccagtctggag

SEQ ID NO: 9091839 - DNA, 22 bp, Homo sapiens
ttctttggcttacgtctggcct

SEQ ID NO: 9091840 - DNA, 22 bp, Homo sapiens
ttcttcttgaaactttaggttg

SEQ ID NO: 9091841 - DNA, 22 bp, Homo sapiens
ttctttcttagcaatctatggt

SEQ ID NO: 9091842 - DNA, 22 bp, Homo sapiens
ttctttctcagtgggcagatac

SEQ ID NO: 9091843 - DNA, 22 bp, Homo sapiens
ttctttctcagtgggcagatac

SEQ ID NO: 9091844 - DNA, 21 bp, Homo sapiens
ttcttcttggactgttttggc

SEQ ID NO: 9091845 - DNA, 22 bp, Homo sapiens
ttctttctcactctttaggaag

SEQ ID NO: 9091846 - DNA, 22 bp, Homo sapiens
ttcttctgcctcccacctgata

SEQ ID NO: 9091847 - DNA, 22 bp, Homo sapiens
ttcttcctctgtaaaaggtgac

SEQ ID NO: 9091848 - DNA, 22 bp, Homo sapiens
ttcttccttggtttcctggata

SEQ ID NO: 9091849 - DNA, 22 bp, Homo sapiens
ttcttctacagtgattaatagt

SEQ ID NO: 9091850 - DNA, 19 bp, Homo sapiens
ttcttctacctctaccact

SEQ ID NO: 9091851 - DNA, 22 bp, Homo sapiens
ttcttcagatggtgagacctcc

SEQ ID NO: 9091852 - DNA, 22 bp, Homo sapiens
ttcttcctcagcagggctgcct

SEQ ID NO: 9091853 - DNA, 22 bp, Homo sapiens
ttcttcagagagtagaagcaag

SEQ ID NO: 9091854 - DNA, 22 bp, Homo sapiens
ttctgggaacaaagtggagtgg

SEQ ID NO: 9091855 - DNA, 22 bp, Homo sapiens
ttctggctttggagaggatagc

SEQ ID NO: 9091856 - DNA, 22 bp, Homo sapiens
ttctggcttttcatgttccagt

SEQ ID NO: 9091857 - DNA, 22 bp, Homo sapiens
ttctgggacatctggacagttt

SEQ ID NO: 9091858 - DNA, 22 bp, Homo sapiens
ttctggatataacattcagtcc

SEQ ID NO: 9091859 - DNA, 22 bp, Homo sapiens
ttctggataggggtatggagct

SEQ ID NO: 9091860 - DNA, 22 bp, Homo sapiens
ttctggagttgtgacctcaggg

SEQ ID NO: 9091861 - DNA, 22 bp, Homo sapiens
ttctggagtcccacagccaggg

SEQ ID NO: 9091862 - DNA, 22 bp, Homo sapiens
ttctggagtcattggggctgat

SEQ ID NO: 9091863 - DNA, 22 bp, Homo sapiens
ttgagggtctggatctgctgct

SEQ ID NO: 9091864 - DNA, 22 bp, Homo sapiens
ttgaggctgcacagtacaggct

SEQ ID NO: 9091865 - DNA, 19 bp, Homo sapiens
ttgagggcattctggtgtt

SEQ ID NO: 9091866 - DNA, 22 bp, Homo sapiens
ttgagggtctggatctgctgct

SEQ ID NO: 9091867 - DNA, 22 bp, Homo sapiens
ttgaggcctgctggaaggtgtt

SEQ ID NO: 9091868 - DNA, 22 bp, Homo sapiens
ttgaggcccggcaggccgagcg

SEQ ID NO: 9091869 - DNA, 22 bp, Homo sapiens
ttgagaatggaactttctgaca

SEQ ID NO: 9091870 - DNA, 22 bp, Homo sapiens
ttgagacacaaggcacagtaag

SEQ ID NO: 9091871 - DNA, 22 bp, Homo sapiens
ttgagacacaaggcacagtaag

SEQ ID NO: 9091872 - DNA, 22 bp, Homo sapiens
ttgagacagtggggtgttgccg

SEQ ID NO: 9091873 - DNA, 22 bp, Homo sapiens
ttgagacactttgggcatcact

SEQ ID NO: 9091874 - DNA, 22 bp, Homo sapiens
ttgagacactttgggcatcact

SEQ ID NO: 9091875 - DNA, 22 bp, Homo sapiens
ttgagaaggtggtcatttgcaa

SEQ ID NO: 9091876 - DNA, 22 bp, Homo sapiens
ttgagaagcacagggcctgtgc

SEQ ID NO: 9091877 - DNA, 22 bp, Homo sapiens
ttgagaagaaatagtttgcaat

SEQ ID NO: 9091878 - DNA, 19 bp, Homo sapiens
ttgagaacaccaagtactg

SEQ ID NO: 9091879 - DNA, 18 bp, Homo sapiens
ttgagaaataagcactaa

SEQ ID NO: 9091880 - DNA, 22 bp, Homo sapiens
ttgagaaaggggtcaatatctc

SEQ ID NO: 9091881 - DNA, 22 bp, Homo sapiens
ttgagaaaggggtcaatatctc

SEQ ID NO: 9091882 - DNA, 22 bp, Homo sapiens
ttgacccaaggccctggaattg

SEQ ID NO: 9091883 - DNA, 22 bp, Homo sapiens
ttgagaaataagcatgtctaga

SEQ ID NO: 9091884 - DNA, 22 bp, Homo sapiens
ttgagaaataagcatgtctaga

SEQ ID NO: 9091885 - DNA, 19 bp, Homo sapiens
ttgagaaatgggaaaagca

SEQ ID NO: 9091886 - DNA, 22 bp, Homo sapiens
ttgaaaacagcgtagattcaca

SEQ ID NO: 9091887 - DNA, 22 bp, Homo sapiens
ttgaaaactttctagaccaaga

SEQ ID NO: 9091888 - DNA, 22 bp, Homo sapiens
ttgaaaaccgtgggaggctgaa

SEQ ID NO: 9091889 - DNA, 22 bp, Homo sapiens
ttgaaaacatttatattagaat

SEQ ID NO: 9091890 - DNA, 22 bp, Homo sapiens
ttgaaaaaattggtagaggatg

SEQ ID NO: 9091891 - DNA, 22 bp, Homo sapiens
ttgaaaaaattggtagaggatg

SEQ ID NO: 9091892 - DNA, 22 bp, Homo sapiens
ttgaaaaaattggtagaggatg

SEQ ID NO: 9091893 - DNA, 22 bp, Homo sapiens
ttgaaaaaattggtagaggatg

SEQ ID NO: 9091894 - DNA, 23 bp, Homo sapiens
ttgaaaaatatagtcccattgtc

SEQ ID NO: 9091895 - DNA, 23 bp, Homo sapiens
ttgaaaaatatagtcccattgtc

SEQ ID NO: 9091896 - DNA, 22 bp, Homo sapiens
ttctttttggatagctgatgaa

SEQ ID NO: 9091897 - DNA, 22 bp, Homo sapiens
ttctttttatcttcccataaga

SEQ ID NO: 9091898 - DNA, 22 bp, Homo sapiens
ttctttggtgggagattgaggt

SEQ ID NO: 9091899 - DNA, 22 bp, Homo sapiens
ttctttttatcttcccataaga

SEQ ID NO: 9091900 - DNA, 22 bp, Homo sapiens
ttctttttatcttcccataaga

SEQ ID NO: 9091901 - DNA, 22 bp, Homo sapiens
ttctttttggatagctgatgaa

SEQ ID NO: 9091902 - DNA, 22 bp, Homo sapiens
ttgaaaaaattggtagaggatg

SEQ ID NO: 9091903 - DNA, 19 bp, Homo sapiens
ttgaaaatatggatctgag

SEQ ID NO: 9091904 - DNA, 22 bp, Homo sapiens
ttgaaaatatcacaggagcagc

SEQ ID NO: 9091905 - DNA, 17 bp, Homo sapiens
ttgaaaagtaagctccc

SEQ ID NO: 9091906 - DNA, 22 bp, Homo sapiens
ttgaaacagtagctcatagacc

SEQ ID NO: 9091907 - DNA, 22 bp, Homo sapiens
ttgaaacagtagctcatagacc

SEQ ID NO: 9091908 - DNA, 22 bp, Homo sapiens
ttgaaacagacaagtaaatgtc

SEQ ID NO: 9091909 - DNA, 20 bp, Homo sapiens
ttgaaaatgcattgtgcagt

SEQ ID NO: 9091910 - DNA, 20 bp, Homo sapiens
ttgaaaatgcattgtgcagt

SEQ ID NO: 9091911 - DNA, 22 bp, Homo sapiens
ttgaaagatatgttaatctttc

SEQ ID NO: 9091912 - DNA, 22 bp, Homo sapiens
ttgaaagatatgttaatctttc

SEQ ID NO: 9091913 - DNA, 22 bp, Homo sapiens
ttgaaagctccatattgtagag

SEQ ID NO: 9091914 - DNA, 23 bp, Homo sapiens
ttgaaagattgctaagtaaaaat

SEQ ID NO: 9091915 - DNA, 23 bp, Homo sapiens
ttgaaagattgctaagtaaaaat

SEQ ID NO: 9091916 - DNA, 20 bp, Homo sapiens
ttctgcctagggttagcctg

SEQ ID NO: 9091917 - DNA, 20 bp, Homo sapiens
ttctggaggctacaagtctg

SEQ ID NO: 9091918 - DNA, 22 bp, Homo sapiens
ttctgccaaaggctttgttttg

SEQ ID NO: 9091919 - DNA, 22 bp, Homo sapiens
ttctgcagcatgaggctggagc

SEQ ID NO: 9091920 - DNA, 22 bp, Homo sapiens
ttctgcagcatgaggctggagc

SEQ ID NO: 9091921 - DNA, 22 bp, Homo sapiens
ttctcttttagaggctccatga

SEQ ID NO: 9091922 - DNA, 22 bp, Homo sapiens
ttctgagctgcaacactaacat

SEQ ID NO: 9091923 - DNA, 20 bp, Homo sapiens
ttctctttgggtccagagaa

SEQ ID NO: 9091924 - DNA, 22 bp, Homo sapiens
ttctgaggcatagaggatgaga

SEQ ID NO: 9091925 - DNA, 22 bp, Homo sapiens
ttctctttgacattattcaggt

SEQ ID NO: 9091926 - DNA, 22 bp, Homo sapiens
ttctctttctgctgggctggaa

SEQ ID NO: 9091927 - DNA, 22 bp, Homo sapiens
ttctctttatgtatttagtggg

SEQ ID NO: 9091928 - DNA, 22 bp, Homo sapiens
ttctctttctacagtgtgattg

SEQ ID NO: 9091929 - DNA, 22 bp, Homo sapiens
ttctgatgatggcggctggagc

SEQ ID NO: 9091930 - DNA, 23 bp, Homo sapiens
ttctctttagatttacattactc

SEQ ID NO: 9091931 - DNA, 23 bp, Homo sapiens
ttctctttagatttacattactc

SEQ ID NO: 9091932 - DNA, 22 bp, Homo sapiens
ttctcttgtgccaagttgttgc

SEQ ID NO: 9091933 - DNA, 22 bp, Homo sapiens
ttctcttctgttcagtgcccaa

SEQ ID NO: 9091934 - DNA, 22 bp, Homo sapiens
ttctcttcccactttctgtatt

SEQ ID NO: 9091935 - DNA, 17 bp, Homo sapiens
ttctcttcctggatagt

SEQ ID NO: 9091936 - DNA, 22 bp, Homo sapiens
ttctcttcccactttctgtatt

SEQ ID NO: 9091937 - DNA, 22 bp, Homo sapiens
ttctctgtagttgcctggtgga

SEQ ID NO: 9091938 - DNA, 22 bp, Homo sapiens
ttctctggtttgctgtttctga

SEQ ID NO: 9091939 - DNA, 22 bp, Homo sapiens
ttctcttatctggcattattgg

SEQ ID NO: 9091940 - DNA, 18 bp, Homo sapiens
ttctctggtggatgttat

SEQ ID NO: 9091941 - DNA, 21 bp, Homo sapiens
ttctcctccaagttgctcctg

SEQ ID NO: 9091942 - DNA, 17 bp, Homo sapiens
ttctcctctgtgtcctt

SEQ ID NO: 9091943 - DNA, 22 bp, Homo sapiens
ttctccgctaagttctctgcag

SEQ ID NO: 9091944 - DNA, 22 bp, Homo sapiens
ttctcccagaccaaaggcagca

SEQ ID NO: 9091945 - DNA, 22 bp, Homo sapiens
ttctcccagaccaaaggcagca

SEQ ID NO: 9091946 - DNA, 22 bp, Homo sapiens
ttctcccatctcagtcttacat

SEQ ID NO: 9091947 - DNA, 22 bp, Homo sapiens
ttctcccactccgtgcttcagt

SEQ ID NO: 9091948 - DNA, 22 bp, Homo sapiens
ttctccatttaacttccttatg

SEQ ID NO: 9091949 - DNA, 22 bp, Homo sapiens
ttctccagtttctcccttcagt

SEQ ID NO: 9091950 - DNA, 22 bp, Homo sapiens
ttcctttagtgtcatatacttt

SEQ ID NO: 9091951 - DNA, 22 bp, Homo sapiens
ttcctttagtgtcatatacttt

SEQ ID NO: 9091952 - DNA, 22 bp, Homo sapiens
ttcctttagggaaatcgtctca

SEQ ID NO: 9091953 - DNA, 20 bp, Homo sapiens
ttcgctgggagtggccaggc

SEQ ID NO: 9091954 - DNA, 20 bp, Homo sapiens
ttcgctgggagtggccaggc

SEQ ID NO: 9091955 - DNA, 22 bp, Homo sapiens
ttccctctgcgcattgaatttc

SEQ ID NO: 9091956 - DNA, 22 bp, Homo sapiens
ttccctctttcactgtgatttt

SEQ ID NO: 9091957 - DNA, 22 bp, Homo sapiens
ttccctcttttccaacagttgt

SEQ ID NO: 9091958 - DNA, 22 bp, Homo sapiens
ttccctctccaggagccctgag

SEQ ID NO: 9091959 - DNA, 22 bp, Homo sapiens
ttccctctcacttaaagcttgg

SEQ ID NO: 9091960 - DNA, 22 bp, Homo sapiens
ttcccctttttgtgtgcagctg

SEQ ID NO: 9091961 - DNA, 22 bp, Homo sapiens
ttccctaagcattgcaatggcg

SEQ ID NO: 9091962 - DNA, 22 bp, Homo sapiens
ttctaaattttggaagatgcag

SEQ ID NO: 9091963 - DNA, 22 bp, Homo sapiens
ttctaaatgtaaatagtatgat

SEQ ID NO: 9091964 - DNA, 18 bp, Homo sapiens
ttctaaattctgttttta

SEQ ID NO: 9091965 - DNA, 22 bp, Homo sapiens
ttctaaatggggatcctttctg

SEQ ID NO: 9091966 - DNA, 22 bp, Homo sapiens
ttctaaagtgcaatctgacaga

SEQ ID NO: 9091967 - DNA, 22 bp, Homo sapiens
ttctaaagtgcaatctgacaga

SEQ ID NO: 9091968 - DNA, 22 bp, Homo sapiens
ttctaaagtgcaatctgacaga

SEQ ID NO: 9091969 - DNA, 22 bp, Homo sapiens
ttctaaagcctgtcctatcaga

SEQ ID NO: 9091970 - DNA, 22 bp, Homo sapiens
ttctaaagcctgtcctatcaga

SEQ ID NO: 9091971 - DNA, 22 bp, Homo sapiens
ttctaactctgttatgtgtttc

SEQ ID NO: 9091972 - DNA, 22 bp, Homo sapiens
ttctaaattttggaagatgcag

SEQ ID NO: 9091973 - DNA, 22 bp, Homo sapiens
ttctaacaagtggcttgttagt

SEQ ID NO: 9091974 - DNA, 22 bp, Homo sapiens
ttctaactaattggaaatggaa

SEQ ID NO: 9091975 - DNA, 22 bp, Homo sapiens
ttcggagtattgacatgtgaag

SEQ ID NO: 9091976 - DNA, 22 bp, Homo sapiens
ttcgttttctaggaccaacaga

SEQ ID NO: 9091977 - DNA, 22 bp, Homo sapiens
ttcgttgctttaagccactacg

SEQ ID NO: 9091978 - DNA, 22 bp, Homo sapiens
ttctaaagactcatggaagtgg

SEQ ID NO: 9091979 - DNA, 22 bp, Homo sapiens
ttctaaagagaatgcgtttctg

SEQ ID NO: 9091980 - DNA, 22 bp, Homo sapiens
ttctaaagagaatgcgtttctg

SEQ ID NO: 9091981 - DNA, 22 bp, Homo sapiens
ttctaaagactcatggaagtgg

SEQ ID NO: 9091982 - DNA, 22 bp, Homo sapiens
ttctaaaataagtttatctggt

SEQ ID NO: 9091983 - DNA, 22 bp, Homo sapiens
ttctaaaataagtttatctggt

SEQ ID NO: 9091984 - DNA, 21 bp, Homo sapiens
ttctcagagtctattacagtt

SEQ ID NO: 9091985 - DNA, 19 bp, Homo sapiens
ttctccagcctgacctgag

SEQ ID NO: 9091986 - DNA, 21 bp, Homo sapiens
ttctccaggcaaccatttcag

SEQ ID NO: 9091987 - DNA, 22 bp, Homo sapiens
ttctcacagtacctaacatgta

SEQ ID NO: 9091988 - DNA, 22 bp, Homo sapiens
ttctcacaggctggaatgatga

SEQ ID NO: 9091989 - DNA, 22 bp, Homo sapiens
ttctcagaattgactgggagca

SEQ ID NO: 9091990 - DNA, 22 bp, Homo sapiens
ttctcacactttccactgaggt

SEQ ID NO: 9091991 - DNA, 22 bp, Homo sapiens
ttctcacaattcttgtatttgc

SEQ ID NO: 9091992 - DNA, 22 bp, Homo sapiens
ttctcacaggaagtaggacttt

SEQ ID NO: 9091993 - DNA, 22 bp, Homo sapiens
ttctcaaagaaagctgtcatta

SEQ ID NO: 9091994 - DNA, 22 bp, Homo sapiens
ttctcaaggacaaaatgacatg

SEQ ID NO: 9091995 - DNA, 22 bp, Homo sapiens
ttctcaagaacatatgtagggt

SEQ ID NO: 9091996 - DNA, 22 bp, Homo sapiens
ttctaacttttgaggcaatgtg

SEQ ID NO: 9091997 - DNA, 22 bp, Homo sapiens
ttctaactggtgcagtgctgca

SEQ ID NO: 9091998 - DNA, 22 bp, Homo sapiens
ttctaactggcttgacagtttc

SEQ ID NO: 9091999 - DNA, 22 bp, Homo sapiens
ttctaactggcttgacagtttc

SEQ ID NO: 9092000 - DNA, 22 bp, Homo sapiens
atttccttcatcagcctatcct

SEQ ID NO: 9092001 - DNA, 22 bp, Homo sapiens
atttccttcagtgtttaatact

SEQ ID NO: 9092002 - DNA, 22 bp, Homo sapiens
atttctctcattgttagctagg

SEQ ID NO: 9092003 - DNA, 22 bp, Homo sapiens
atttctctcattgttagctagg

SEQ ID NO: 9092004 - DNA, 22 bp, Homo sapiens
atttctccttgttgcaatgcag

SEQ ID NO: 9092005 - DNA, 22 bp, Homo sapiens
atttctcctccagatggtggtt

SEQ ID NO: 9092006 - DNA, 22 bp, Homo sapiens
atttgcttttactatgttaaaa

SEQ ID NO: 9092007 - DNA, 19 bp, Homo sapiens
agatactggtctgtggtac

SEQ ID NO: 9092008 - DNA, 22 bp, Homo sapiens
agatactggaggttcctacaac

SEQ ID NO: 9092009 - DNA, 19 bp, Homo sapiens
agataggctgtcttagagt

SEQ ID NO: 9092010 - DNA, 22 bp, Homo sapiens
agatacattgttctaagcattg

SEQ ID NO: 9092011 - DNA, 22 bp, Homo sapiens
atttccagcagcatatttgtct

SEQ ID NO: 9092012 - DNA, 17 bp, Homo sapiens
atttcctcagggctgag

SEQ ID NO: 9092013 - DNA, 22 bp, Homo sapiens
atttccttcagtgtttaatact

SEQ ID NO: 9092014 - DNA, 22 bp, Homo sapiens
atttgtctttggacctgtgaga

SEQ ID NO: 9092015 - DNA, 22 bp, Homo sapiens
atttggctgtagtaactggatc

SEQ ID NO: 9092016 - DNA, 22 bp, Homo sapiens
atttggctaattaaatttggag

SEQ ID NO: 9092017 - DNA, 22 bp, Homo sapiens
atttggctagcttatggttata

SEQ ID NO: 9092018 - DNA, 22 bp, Homo sapiens
atttggctaccatgaggatggg

SEQ ID NO: 9092019 - DNA, 22 bp, Homo sapiens
atttggctattgaattattcct

SEQ ID NO: 9092020 - DNA, 22 bp, Homo sapiens
atttggctgactcactaattgt

SEQ ID NO: 9092021 - DNA, 22 bp, Homo sapiens
atttggctgggtgttagaaaga

SEQ ID NO: 9092022 - DNA, 22 bp, Homo sapiens
atttggcaacattaattgaatc

SEQ ID NO: 9092023 - DNA, 20 bp, Homo sapiens
atttggcatgaagtattgat

SEQ ID NO: 9092024 - DNA, 20 bp, Homo sapiens
atttggcatgaagtattgat

SEQ ID NO: 9092025 - DNA, 22 bp, Homo sapiens
caaaagtaatgtatgctcatcg

SEQ ID NO: 9092026 - DNA, 22 bp, Homo sapiens
caaaagtaatggcggtttttac

SEQ ID NO: 9092027 - DNA, 22 bp, Homo sapiens
caaaagtaattatggtttttgc

SEQ ID NO: 9092028 - DNA, 22 bp, Homo sapiens
caaaagtaattgcagtttttgc

SEQ ID NO: 9092029 - DNA, 22 bp, Homo sapiens
caaaagtaattgcagtttttgc

SEQ ID NO: 9092030 - DNA, 22 bp, Homo sapiens
caaaagtaattgtggttttcac

SEQ ID NO: 9092031 - DNA, 22 bp, Homo sapiens
caaaagtaattgcggtttttgc

SEQ ID NO: 9092032 - DNA, 22 bp, Homo sapiens
caaaagtaccttgtgtgctttg

SEQ ID NO: 9092033 - DNA, 22 bp, Homo sapiens
caaaagtagtgaagttgtacat

SEQ ID NO: 9092034 - DNA, 22 bp, Homo sapiens
caaaagtaattgtggtttttgc

SEQ ID NO: 9092035 - DNA, 22 bp, Homo sapiens
caaaagtaccttgtgtgctttg

SEQ ID NO: 9092036 - DNA, 22 bp, Homo sapiens
caaaagtaccttgtgtgctttg

SEQ ID NO: 9092037 - DNA, 22 bp, Homo sapiens
atttgtttatcgtcgattgtag

SEQ ID NO: 9092038 - DNA, 22 bp, Homo sapiens
atttgtttatcgtcgattgtag

SEQ ID NO: 9092039 - DNA, 22 bp, Homo sapiens
atttgtttatcgtcgattgtag

SEQ ID NO: 9092040 - DNA, 22 bp, Homo sapiens
atttgtttatcgtcgattgtag

SEQ ID NO: 9092041 - DNA, 22 bp, Homo sapiens
atttgtttatcgtcgattgtag

SEQ ID NO: 9092042 - DNA, 20 bp, Homo sapiens
atttgtttctactctctgac

SEQ ID NO: 9092043 - DNA, 20 bp, Homo sapiens
atttgtttctactctctgac

SEQ ID NO: 9092044 - DNA, 22 bp, Homo sapiens
atttgtttcagggccttggtat

SEQ ID NO: 9092045 - DNA, 22 bp, Homo sapiens
atttgtttcagggccttggtat

SEQ ID NO: 9092046 - DNA, 22 bp, Homo sapiens
caaaaaacacagatgtctgtgt

SEQ ID NO: 9092047 - DNA, 22 bp, Homo sapiens
caaaaaacacagatgtctgtgt

SEQ ID NO: 9092048 - DNA, 21 bp, Homo sapiens
caaaaggataggaaattaggg

SEQ ID NO: 9092049 - DNA, 22 bp, Homo sapiens
attgctgaaagtattttatgac

SEQ ID NO: 9092050 - DNA, 22 bp, Homo sapiens
attgcccttgcccattgagagt

SEQ ID NO: 9092051 - DNA, 22 bp, Homo sapiens
attgccctctggctgacaggct

SEQ ID NO: 9092052 - DNA, 22 bp, Homo sapiens
attgcccaataataaaatggta

SEQ ID NO: 9092053 - DNA, 22 bp, Homo sapiens
attgccctagggctaagcagga

SEQ ID NO: 9092054 - DNA, 22 bp, Homo sapiens
agaggtcagagcaggaaaggca

SEQ ID NO: 9092055 - DNA, 22 bp, Homo sapiens
agaggtcagaggtcgccaggtc

SEQ ID NO: 9092056 - DNA, 22 bp, Homo sapiens
agaggtctgactcagcagatta

SEQ ID NO: 9092057 - DNA, 22 bp, Homo sapiens
agaggtccccagatgattccag

SEQ ID NO: 9092058 - DNA, 22 bp, Homo sapiens
agaggtattagatttgcatagg

SEQ ID NO: 9092059 - DNA, 22 bp, Homo sapiens
agaggtattaggtaattcagta

SEQ ID NO: 9092060 - DNA, 22 bp, Homo sapiens
agaggtatgtgtcagtgcttat

SEQ ID NO: 9092061 - DNA, 22 bp, Homo sapiens
agagttggccaaaaggggcatt

SEQ ID NO: 9092062 - DNA, 22 bp, Homo sapiens
agagttggcccacgtgtaggcg

SEQ ID NO: 9092063 - DNA, 22 bp, Homo sapiens
agagttgctaccaagatgctag

SEQ ID NO: 9092064 - DNA, 22 bp, Homo sapiens
agagttgctatagaaggatgga

SEQ ID NO: 9092065 - DNA, 22 bp, Homo sapiens
agagtttacagaaataagctgt

SEQ ID NO: 9092066 - DNA, 22 bp, Homo sapiens
agagtttcttgtgagcactgac

SEQ ID NO: 9092067 - DNA, 22 bp, Homo sapiens
agagtttcttgtgagcactgac

SEQ ID NO: 9092068 - DNA, 22 bp, Homo sapiens
agagttctgctcttctcagtga

SEQ ID NO: 9092069 - DNA, 22 bp, Homo sapiens
agagttctgtctgccacacgaa

SEQ ID NO: 9092070 - DNA, 22 bp, Homo sapiens
agagtgggtgatctctgttgtc

SEQ ID NO: 9092071 - DNA, 22 bp, Homo sapiens
agaggtgaaagaatttggctct

SEQ ID NO: 9092072 - DNA, 22 bp, Homo sapiens
agaggtcttttggtctgcagaa

SEQ ID NO: 9092073 - DNA, 22 bp, Homo sapiens
agaggtctgagcaatctcaagc

SEQ ID NO: 9092074 - DNA, 22 bp, Homo sapiens
atttcacatctatctcagattt

SEQ ID NO: 9092075 - DNA, 22 bp, Homo sapiens
atttcacagctgtcagtgttac

SEQ ID NO: 9092076 - DNA, 22 bp, Homo sapiens
atttcactctccctgccactta

SEQ ID NO: 9092077 - DNA, 22 bp, Homo sapiens
agatacagcttttttgtcagtc

SEQ ID NO: 9092078 - DNA, 20 bp, Homo sapiens
agatacagtggtttctttag

SEQ ID NO: 9092079 - DNA, 22 bp, Homo sapiens
agatacagtgttacatttttat

SEQ ID NO: 9092080 - DNA, 22 bp, Homo sapiens
agatacagtgttacatttttat

SEQ ID NO: 9092081 - DNA, 17 bp, Homo sapiens
atttcacttagcatgag

SEQ ID NO: 9092082 - DNA, 22 bp, Homo sapiens
atttcacaaagaacagatgcag

SEQ ID NO: 9092083 - DNA, 22 bp, Homo sapiens
atttcacaaagaacagatgcag

SEQ ID NO: 9092084 - DNA, 22 bp, Homo sapiens
atttcacagcgtggttgactgc

SEQ ID NO: 9092085 - DNA, 22 bp, Homo sapiens
agataaaatggttcaaaggcta

SEQ ID NO: 9092086 - DNA, 22 bp, Homo sapiens
agataaaatggttcaaaggcta

SEQ ID NO: 9092087 - DNA, 17 bp, Homo sapiens
agagttttaagaaattt

SEQ ID NO: 9092088 - DNA, 22 bp, Homo sapiens
agataaaatgattttctggatc

SEQ ID NO: 9092089 - DNA, 22 bp, Homo sapiens
agagtttggtgaagcaatttga

SEQ ID NO: 9092090 - DNA, 22 bp, Homo sapiens
agagtttgtatttttcagtgaa

SEQ ID NO: 9092091 - DNA, 22 bp, Homo sapiens
agaggcagcagtcatactacag

SEQ ID NO: 9092092 - DNA, 22 bp, Homo sapiens
agaggcagcagtcatactacag

SEQ ID NO: 9092093 - DNA, 22 bp, Homo sapiens
agaggcagcagtcatactacag

SEQ ID NO: 9092094 - DNA, 17 bp, Homo sapiens
agaggcagatacttgga

SEQ ID NO: 9092095 - DNA, 17 bp, Homo sapiens
agaggcagatacttgga

SEQ ID NO: 9092096 - DNA, 17 bp, Homo sapiens
agaggcagatacttgga

SEQ ID NO: 9092097 - DNA, 17 bp, Homo sapiens
agaggcagatacttgga

SEQ ID NO: 9092098 - DNA, 22 bp, Homo sapiens
agaggcaggaggttgacttgag

SEQ ID NO: 9092099 - DNA, 22 bp, Homo sapiens
agaggcaggaagagctgatttt

SEQ ID NO: 9092100 - DNA, 22 bp, Homo sapiens
agaggcaggaggttgacttgag

SEQ ID NO: 9092101 - DNA, 22 bp, Homo sapiens
agaggcaggaagagctgatttt

SEQ ID NO: 9092102 - DNA, 22 bp, Homo sapiens
agaggcaggaagagctgatttt

SEQ ID NO: 9092103 - DNA, 22 bp, Homo sapiens
agaggcaggaagagctgatttt

SEQ ID NO: 9092104 - DNA, 22 bp, Homo sapiens
agaggcaggaagagctgatttt

SEQ ID NO: 9092105 - DNA, 22 bp, Homo sapiens
agaggcagccgtatttcaaagg

SEQ ID NO: 9092106 - DNA, 22 bp, Homo sapiens
agaggcagccgtatttcaaagg

SEQ ID NO: 9092107 - DNA, 22 bp, Homo sapiens
attcattagccactaactagca

SEQ ID NO: 9092108 - DNA, 22 bp, Homo sapiens
attcatttaggtattcacttac

SEQ ID NO: 9092109 - DNA, 22 bp, Homo sapiens
attcatttgctattgtgtatgg

SEQ ID NO: 9092110 - DNA, 22 bp, Homo sapiens
agaggcctgtgtgctccagtgg

SEQ ID NO: 9092111 - DNA, 22 bp, Homo sapiens
agaggctccaccttctctgtcc

SEQ ID NO: 9092112 - DNA, 22 bp, Homo sapiens
agaggctcagaggcctggtcct

SEQ ID NO: 9092113 - DNA, 22 bp, Homo sapiens
attgcagctcagggtgatgact

SEQ ID NO: 9092114 - DNA, 22 bp, Homo sapiens
attgagtagtaggaaaataact

SEQ ID NO: 9092115 - DNA, 22 bp, Homo sapiens
attgagtattgtaaataaaaca

SEQ ID NO: 9092116 - DNA, 22 bp, Homo sapiens
attgagtacctccagattcata

SEQ ID NO: 9092117 - DNA, 22 bp, Homo sapiens
attccagttagtggcagcttat

SEQ ID NO: 9092118 - DNA, 22 bp, Homo sapiens
agagggagaaaagaatcagttg

SEQ ID NO: 9092119 - DNA, 22 bp, Homo sapiens
agagggagaagctaaaataact

SEQ ID NO: 9092120 - DNA, 22 bp, Homo sapiens
agagggagaagctaaaataact

SEQ ID NO: 9092121 - DNA, 21 bp, Homo sapiens
agagggagagtggcccttcca

SEQ ID NO: 9092122 - DNA, 22 bp, Homo sapiens
agagggagaaaagaatcagttg

SEQ ID NO: 9092123 - DNA, 22 bp, Homo sapiens
attccagagaggttctggaggt

SEQ ID NO: 9092124 - DNA, 22 bp, Homo sapiens
attccagagaaaggcctggctg

SEQ ID NO: 9092125 - DNA, 18 bp, Homo sapiens
agagggaaagcaggctga

SEQ ID NO: 9092126 - DNA, 17 bp, Homo sapiens
agagggaaaatgcggtt

SEQ ID NO: 9092127 - DNA, 22 bp, Homo sapiens
agagggaaaaactcatgtcatt

SEQ ID NO: 9092128 - DNA, 22 bp, Homo sapiens
agagctgtttggacatctgagt

SEQ ID NO: 9092129 - DNA, 22 bp, Homo sapiens
agagctgttcagcagccaggtt

SEQ ID NO: 9092130 - DNA, 22 bp, Homo sapiens
agagctgttcagcagccaggtt

SEQ ID NO: 9092131 - DNA, 22 bp, Homo sapiens
agagctgttcaacgtagcaatg

SEQ ID NO: 9092132 - DNA, 22 bp, Homo sapiens
agagctgttaattttgcactgg

SEQ ID NO: 9092133 - DNA, 22 bp, Homo sapiens
agagctgttaattttgcactgg

SEQ ID NO: 9092134 - DNA, 22 bp, Homo sapiens
agagctgtagcttcctagagcc

SEQ ID NO: 9092135 - DNA, 22 bp, Homo sapiens
agagctggtttactcaggaatt

SEQ ID NO: 9092136 - DNA, 22 bp, Homo sapiens
agagctgtgctttgcaccacgt

SEQ ID NO: 9092137 - DNA, 22 bp, Homo sapiens
agagctgtggatagtcctggat

SEQ ID NO: 9092138 - DNA, 22 bp, Homo sapiens
agagctgtgctttgcaccacgt

SEQ ID NO: 9092139 - DNA, 21 bp, Homo sapiens
agagctgggacttgcctgaga

SEQ ID NO: 9092140 - DNA, 21 bp, Homo sapiens
agagctgggacttgcctgaga

SEQ ID NO: 9092141 - DNA, 22 bp, Homo sapiens
agagctggtgcatattcagaaa

SEQ ID NO: 9092142 - DNA, 22 bp, Homo sapiens
agagctggtttactcaggaatt

SEQ ID NO: 9092143 - DNA, 22 bp, Homo sapiens
atgtttagtcattcagctcctt

SEQ ID NO: 9092144 - DNA, 22 bp, Homo sapiens
atgtttactggtttatagaata

SEQ ID NO: 9092145 - DNA, 22 bp, Homo sapiens
atgtttactgaaaagatttcaa

SEQ ID NO: 9092146 - DNA, 22 bp, Homo sapiens
atgtttacaattcagtattaca

SEQ ID NO: 9092147 - DNA, 19 bp, Homo sapiens
atgtttacactcaggggct

SEQ ID NO: 9092148 - DNA, 22 bp, Homo sapiens
atgtttacaaaaaggaggcttg

SEQ ID NO: 9092149 - DNA, 22 bp, Homo sapiens
agagctgtttggacatctgagt

SEQ ID NO: 9092150 - DNA, 22 bp, Homo sapiens
atgtttatggagcaggtattag

SEQ ID NO: 9092151 - DNA, 22 bp, Homo sapiens
agaggaagccattgcttactga

SEQ ID NO: 9092152 - DNA, 22 bp, Homo sapiens
agaggaagctgagatgcctctt

SEQ ID NO: 9092153 - DNA, 22 bp, Homo sapiens
agaggagctgggaggccctcgt

SEQ ID NO: 9092154 - DNA, 22 bp, Homo sapiens
agaggagctgggaggccctcgt

SEQ ID NO: 9092155 - DNA, 22 bp, Homo sapiens
agaggagcttttggaaaaggcc

SEQ ID NO: 9092156 - DNA, 22 bp, Homo sapiens
agaggacaggttttccatgggc

SEQ ID NO: 9092157 - DNA, 22 bp, Homo sapiens
agaggaggctctgggatcgtcc

SEQ ID NO: 9092158 - DNA, 22 bp, Homo sapiens
agaggaggctctgggatcgtcc

SEQ ID NO: 9092159 - DNA, 22 bp, Homo sapiens
attataggcttgagccaccgtg

SEQ ID NO: 9092160 - DNA, 22 bp, Homo sapiens
attataggcttgagccaccgtg

SEQ ID NO: 9092161 - DNA, 22 bp, Homo sapiens
attataggcttgagccaccgtg

SEQ ID NO: 9092162 - DNA, 22 bp, Homo sapiens
attattatatagggaaagtccc

SEQ ID NO: 9092163 - DNA, 22 bp, Homo sapiens
attattagtgatgttgttactg

SEQ ID NO: 9092164 - DNA, 22 bp, Homo sapiens
attattattttagagagaggcc

SEQ ID NO: 9092165 - DNA, 22 bp, Homo sapiens
attattattgttgatgttaggg

SEQ ID NO: 9092166 - DNA, 22 bp, Homo sapiens
attattatggttgctcttttcc

SEQ ID NO: 9092167 - DNA, 22 bp, Homo sapiens
agaggcactgttcttagcgact

SEQ ID NO: 9092168 - DNA, 22 bp, Homo sapiens
agaggcagaagtgttcaaaccc

SEQ ID NO: 9092169 - DNA, 22 bp, Homo sapiens
agaggcagaagtgttcaaaccc

SEQ ID NO: 9092170 - DNA, 22 bp, Homo sapiens
agacatttggaagatacacata

SEQ ID NO: 9092171 - DNA, 22 bp, Homo sapiens
agacagctgctcgcagagctat

SEQ ID NO: 9092172 - DNA, 22 bp, Homo sapiens
agacagctgttccttcatgttt

SEQ ID NO: 9092173 - DNA, 21 bp, Homo sapiens
agacagctttaaagacacagg

SEQ ID NO: 9092174 - DNA, 22 bp, Homo sapiens
agacaggacacaagctgcataa

SEQ ID NO: 9092175 - DNA, 21 bp, Homo sapiens
agacagctttaaagacacagg

SEQ ID NO: 9092176 - DNA, 22 bp, Homo sapiens
agacaggcagaggctgcagagg

SEQ ID NO: 9092177 - DNA, 22 bp, Homo sapiens
agacaggcagaggctgcagagg

SEQ ID NO: 9092178 - DNA, 22 bp, Homo sapiens
agacagcatggagctgataaca

SEQ ID NO: 9092179 - DNA, 22 bp, Homo sapiens
agacagcatgatacatgatgct

SEQ ID NO: 9092180 - DNA, 22 bp, Homo sapiens
agacagcatgatacatgatgct

SEQ ID NO: 9092181 - DNA, 22 bp, Homo sapiens
agacagcatgatacatgatgct

SEQ ID NO: 9092182 - DNA, 22 bp, Homo sapiens
agacagcatgatacatgatgct

SEQ ID NO: 9092183 - DNA, 22 bp, Homo sapiens
agacagcatttctagcaccagg

SEQ ID NO: 9092184 - DNA, 22 bp, Homo sapiens
agacagctagggctgcagggac

SEQ ID NO: 9092185 - DNA, 22 bp, Homo sapiens
agacagctctgggttccacact

SEQ ID NO: 9092186 - DNA, 22 bp, Homo sapiens
agacagctgcctccaccacagc

SEQ ID NO: 9092187 - DNA, 21 bp, Homo sapiens
agacagcagatagtcgaaagg

SEQ ID NO: 9092188 - DNA, 22 bp, Homo sapiens
agacagcagcagaggggctccc

SEQ ID NO: 9092189 - DNA, 21 bp, Homo sapiens
agacagcagatagtcgaaagg

SEQ ID NO: 9092190 - DNA, 22 bp, Homo sapiens
agacagcagaaactagagcact

SEQ ID NO: 9092191 - DNA, 22 bp, Homo sapiens
agacagcatgagcctgctgatg

SEQ ID NO: 9092192 - DNA, 22 bp, Homo sapiens
agacagcatgagcctgctgatg

SEQ ID NO: 9092193 - DNA, 21 bp, Homo sapiens
agacagcagtctccaaacccc

SEQ ID NO: 9092194 - DNA, 22 bp, Homo sapiens
atgcacatgaggcaagcaaaat

SEQ ID NO: 9092195 - DNA, 17 bp, Homo sapiens
agacagacctctgcatc

SEQ ID NO: 9092196 - DNA, 21 bp, Homo sapiens
agacagactgcctgacccacg

SEQ ID NO: 9092197 - DNA, 22 bp, Homo sapiens
agacagacattctagagccacc

SEQ ID NO: 9092198 - DNA, 22 bp, Homo sapiens
agacagaccatggctattcaga

SEQ ID NO: 9092199 - DNA, 22 bp, Homo sapiens
atgacaaaggctgaaagggaaa

SEQ ID NO: 9092200 - DNA, 23 bp, Homo sapiens
atgacaaacaggacatcttgtgc

SEQ ID NO: 9092201 - DNA, 22 bp, Homo sapiens
atgacaaacccaggatgtaaca

SEQ ID NO: 9092202 - DNA, 22 bp, Homo sapiens
atgacaaaagaagacatgaggt

SEQ ID NO: 9092203 - DNA, 22 bp, Homo sapiens
atgacaaaagaagacatgaggt

SEQ ID NO: 9092204 - DNA, 22 bp, Homo sapiens
atgcaacatacattctgaagct

SEQ ID NO: 9092205 - DNA, 22 bp, Homo sapiens
atgaaagtgtttaagtttatgt

SEQ ID NO: 9092206 - DNA, 22 bp, Homo sapiens
atgaaagtacctgtaatatgtt

SEQ ID NO: 9092207 - DNA, 22 bp, Homo sapiens
atgaaagtagggtaaaatcaca

SEQ ID NO: 9092208 - DNA, 22 bp, Homo sapiens
atgaaagcaggaattgttctgt

SEQ ID NO: 9092209 - DNA, 22 bp, Homo sapiens
atgaaagctcagtgcactgaca

SEQ ID NO: 9092210 - DNA, 22 bp, Homo sapiens
atgaaattttaattatacctct

SEQ ID NO: 9092211 - DNA, 22 bp, Homo sapiens
atgaaattttaattatacctct

SEQ ID NO: 9092212 - DNA, 22 bp, Homo sapiens
atgaaattgatcttgaactttt

SEQ ID NO: 9092213 - DNA, 22 bp, Homo sapiens
atgaaatttgaccaattattta

SEQ ID NO: 9092214 - DNA, 23 bp, Homo sapiens
atgaaagttcttaaaatgtcatg

SEQ ID NO: 9092215 - DNA, 23 bp, Homo sapiens
atgaaagttcttaaaatgtcatg

SEQ ID NO: 9092216 - DNA, 22 bp, Homo sapiens
agacaaaccttgttttatgatg

SEQ ID NO: 9092217 - DNA, 18 bp, Homo sapiens
agacaaacttcttctgcc

SEQ ID NO: 9092218 - DNA, 23 bp, Homo sapiens
agacaaacttccttcactgcacc

SEQ ID NO: 9092219 - DNA, 22 bp, Homo sapiens
agacaaagaaaccgtagaagca

SEQ ID NO: 9092220 - DNA, 22 bp, Homo sapiens
agacaaagacagcatctcaggt

SEQ ID NO: 9092221 - DNA, 22 bp, Homo sapiens
agacaaagacagcatctcaggt

SEQ ID NO: 9092222 - DNA, 22 bp, Homo sapiens
agacaaaggattaatgatgatg

SEQ ID NO: 9092223 - DNA, 22 bp, Homo sapiens
agacaaataactttttatgtcc

SEQ ID NO: 9092224 - DNA, 22 bp, Homo sapiens
agacaaataactttttatgtcc

SEQ ID NO: 9092225 - DNA, 22 bp, Homo sapiens
agacaaataagtgctgggattt

SEQ ID NO: 9092226 - DNA, 22 bp, Homo sapiens
agacaaataactttttatgtcc

SEQ ID NO: 9092227 - DNA, 22 bp, Homo sapiens
agacaaataagtgctgggattt

SEQ ID NO: 9092228 - DNA, 22 bp, Homo sapiens
agacaaattgggacattgtgtt

SEQ ID NO: 9092229 - DNA, 22 bp, Homo sapiens
agacaaatgaacaaatatgtga

SEQ ID NO: 9092230 - DNA, 22 bp, Homo sapiens
agacaaatggagtatgagcaac

SEQ ID NO: 9092231 - DNA, 22 bp, Homo sapiens
agacaaatggagtatgagcaac

SEQ ID NO: 9092232 - DNA, 22 bp, Homo sapiens
agacaaatggtaattatgtcta

SEQ ID NO: 9092233 - DNA, 22 bp, Homo sapiens
atgaaacatgctttgtggatga

SEQ ID NO: 9092234 - DNA, 22 bp, Homo sapiens
atctttgttgctctcatttctg

SEQ ID NO: 9092235 - DNA, 22 bp, Homo sapiens
agaagtttggtcctataaactc

SEQ ID NO: 9092236 - DNA, 22 bp, Homo sapiens
agaagtttgaaattaggagaaa

SEQ ID NO: 9092237 - DNA, 22 bp, Homo sapiens
agaagtggtctgtcttccagat

SEQ ID NO: 9092238 - DNA, 22 bp, Homo sapiens
agaagtggtctgtcttccagat

SEQ ID NO: 9092239 - DNA, 20 bp, Homo sapiens
agaagtggctgcagacacta

SEQ ID NO: 9092240 - DNA, 22 bp, Homo sapiens
agaagttaccacatacttctct

SEQ ID NO: 9092241 - DNA, 22 bp, Homo sapiens
agaagttaattcctgaaattct

SEQ ID NO: 9092242 - DNA, 19 bp, Homo sapiens
agaagttagacattgcaat

SEQ ID NO: 9092243 - DNA, 22 bp, Homo sapiens
agaagttaccacatacttctct

SEQ ID NO: 9092244 - DNA, 22 bp, Homo sapiens
agaagtcaatgatgagagtgct

SEQ ID NO: 9092245 - DNA, 22 bp, Homo sapiens
agaagtcagccacagtgggaga

SEQ ID NO: 9092246 - DNA, 20 bp, Homo sapiens
agaagtcagctcagaagtga

SEQ ID NO: 9092247 - DNA, 20 bp, Homo sapiens
agaagtcagctcagaagtga

SEQ ID NO: 9092248 - DNA, 22 bp, Homo sapiens
agaagtccagtgtgtatcaggg

SEQ ID NO: 9092249 - DNA, 22 bp, Homo sapiens
agaagtgccatactgtggtcca

SEQ ID NO: 9092250 - DNA, 19 bp, Homo sapiens
agaagtgcatggtctagag

SEQ ID NO: 9092251 - DNA, 22 bp, Homo sapiens
agaagtgagttgtgactatggg

SEQ ID NO: 9092252 - DNA, 22 bp, Homo sapiens
agaaggctggccctgggtggcc

SEQ ID NO: 9092253 - DNA, 22 bp, Homo sapiens
agaagtattctgcatgtactga

SEQ ID NO: 9092254 - DNA, 22 bp, Homo sapiens
agaagtcaatgatgagagtgct

SEQ ID NO: 9092255 - DNA, 22 bp, Homo sapiens
agaagtatttggctaaaagaca

SEQ ID NO: 9092256 - DNA, 19 bp, Homo sapiens
agagaccacagagctgcct

SEQ ID NO: 9092257 - DNA, 22 bp, Homo sapiens
agagaccaagggaatagtctca

SEQ ID NO: 9092258 - DNA, 21 bp, Homo sapiens
agagaccagctgttactccca

SEQ ID NO: 9092259 - DNA, 22 bp, Homo sapiens
agagacccagactgatcattgc

SEQ ID NO: 9092260 - DNA, 22 bp, Homo sapiens
agagaccagaatccagctgcct

SEQ ID NO: 9092261 - DNA, 22 bp, Homo sapiens
agagaccctggagttcttcact

SEQ ID NO: 9092262 - DNA, 22 bp, Homo sapiens
agagacccgcagcctcggagct

SEQ ID NO: 9092263 - DNA, 22 bp, Homo sapiens
agagacccgcagcctcggagct

SEQ ID NO: 9092264 - DNA, 22 bp, Homo sapiens
agagacagggttttgtcgtgtt

SEQ ID NO: 9092265 - DNA, 22 bp, Homo sapiens
agagacagggttttgtcgtgtt

SEQ ID NO: 9092266 - DNA, 22 bp, Homo sapiens
agagacagaggcaatatagctt

SEQ ID NO: 9092267 - DNA, 22 bp, Homo sapiens
agagacagggttttgtcgtgtt

SEQ ID NO: 9092268 - DNA, 22 bp, Homo sapiens
agagaagattcttatatgtctt

SEQ ID NO: 9092269 - DNA, 22 bp, Homo sapiens
agagaagcattcttctcagggc

SEQ ID NO: 9092270 - DNA, 22 bp, Homo sapiens
agagaagcattcttctcagggc

SEQ ID NO: 9092271 - DNA, 22 bp, Homo sapiens
agagaagagtcttgtcaaatta

SEQ ID NO: 9092272 - DNA, 22 bp, Homo sapiens
agagaagattcttatatgtctt

SEQ ID NO: 9092273 - DNA, 22 bp, Homo sapiens
agagaagagtcttgtcaaatta

SEQ ID NO: 9092274 - DNA, 22 bp, Homo sapiens
agagaaggaaagctgacatggg

SEQ ID NO: 9092275 - DNA, 21 bp, Homo sapiens
agagacagagaaagtaacatt

SEQ ID NO: 9092276 - DNA, 22 bp, Homo sapiens
agagaaggaaagctgacatggg

SEQ ID NO: 9092277 - DNA, 22 bp, Homo sapiens
agagaaggaaagctgacatggg

SEQ ID NO: 9092278 - DNA, 22 bp, Homo sapiens
agagaagagtcttgtcaaatta

SEQ ID NO: 9092279 - DNA, 22 bp, Homo sapiens
atggcctccgacccatgacgtg

SEQ ID NO: 9092280 - DNA, 22 bp, Homo sapiens
atggcctctagctgagaccaat

SEQ ID NO: 9092281 - DNA, 22 bp, Homo sapiens
atggcctctagctgagaccaat

SEQ ID NO: 9092282 - DNA, 22 bp, Homo sapiens
atggcctgggcccgcttcagat

SEQ ID NO: 9092283 - DNA, 22 bp, Homo sapiens
atggcctggccagagctctgct

SEQ ID NO: 9092284 - DNA, 22 bp, Homo sapiens
atggcctggccagagctctgct

SEQ ID NO: 9092285 - DNA, 22 bp, Homo sapiens
agagagttgaggaagcaacact

SEQ ID NO: 9092286 - DNA, 22 bp, Homo sapiens
agagagttgtaccacactcata

SEQ ID NO: 9092287 - DNA, 22 bp, Homo sapiens
agagagttgtaccacactcata

SEQ ID NO: 9092288 - DNA, 22 bp, Homo sapiens
agagatgaagggcattccccag

SEQ ID NO: 9092289 - DNA, 22 bp, Homo sapiens
agagatgaacataaaacaagga

SEQ ID NO: 9092290 - DNA, 17 bp, Homo sapiens
atggctcacctgtgggc

SEQ ID NO: 9092291 - DNA, 22 bp, Homo sapiens
atggccttattatggcacccga

SEQ ID NO: 9092292 - DNA, 22 bp, Homo sapiens
atggccttagtgatgattaata

SEQ ID NO: 9092293 - DNA, 20 bp, Homo sapiens
atggccttcctctctgtcca

SEQ ID NO: 9092294 - DNA, 22 bp, Homo sapiens
atggccttgatagcctaaaaca

SEQ ID NO: 9092295 - DNA, 22 bp, Homo sapiens
atggctaaacctgaactggtct

SEQ ID NO: 9092296 - DNA, 22 bp, Homo sapiens
atggctaatacgccactggaca

SEQ ID NO: 9092297 - DNA, 22 bp, Homo sapiens
atggctaaacctgaactggtct

SEQ ID NO: 9092298 - DNA, 22 bp, Homo sapiens
atggccttggctgcagagacat

SEQ ID NO: 9092299 - DNA, 22 bp, Homo sapiens
agagaagacttacagccacagt

SEQ ID NO: 9092300 - DNA, 22 bp, Homo sapiens
agagaagacttacagccacagt

SEQ ID NO: 9092301 - DNA, 22 bp, Homo sapiens
agagaagagcaatgataaattt

SEQ ID NO: 9092302 - DNA, 21 bp, Homo sapiens
agagaagaggactttctcaca

SEQ ID NO: 9092303 - DNA, 21 bp, Homo sapiens
agagaagaggactttctcaca

SEQ ID NO: 9092304 - DNA, 18 bp, Homo sapiens
agagaagaggtgttagtc

SEQ ID NO: 9092305 - DNA, 21 bp, Homo sapiens
agagaagaggactttctcaca

SEQ ID NO: 9092306 - DNA, 21 bp, Homo sapiens
agagaagaggactttctcaca

SEQ ID NO: 9092307 - DNA, 22 bp, Homo sapiens
agagaagagcaatgataaattt

SEQ ID NO: 9092308 - DNA, 22 bp, Homo sapiens
agagaagagcaatgataaattt

SEQ ID NO: 9092309 - DNA, 22 bp, Homo sapiens
atggccagctcagagcactcag

SEQ ID NO: 9092310 - DNA, 22 bp, Homo sapiens
atggccagcaaggtagggcaat

SEQ ID NO: 9092311 - DNA, 22 bp, Homo sapiens
atggcagcctgagcagaggaat

SEQ ID NO: 9092312 - DNA, 23 bp, Homo sapiens
agacccagagactggctctgctc

SEQ ID NO: 9092313 - DNA, 22 bp, Homo sapiens
agaccatgggctcctgggacat

SEQ ID NO: 9092314 - DNA, 22 bp, Homo sapiens
agacccacactttgagtagcaa

SEQ ID NO: 9092315 - DNA, 22 bp, Homo sapiens
agacccagaaagcagctgcatt

SEQ ID NO: 9092316 - DNA, 22 bp, Homo sapiens
agaccagctgcctcccagggcc

SEQ ID NO: 9092317 - DNA, 22 bp, Homo sapiens
agaccagctgcctcccagggcc

SEQ ID NO: 9092318 - DNA, 22 bp, Homo sapiens
agaccaaagaaaacacatctgg

SEQ ID NO: 9092319 - DNA, 22 bp, Homo sapiens
agaccacagtcaggctcctggt

SEQ ID NO: 9092320 - DNA, 22 bp, Homo sapiens
agaccactaaaactttctctat

SEQ ID NO: 9092321 - DNA, 22 bp, Homo sapiens
agaccactaaaactttctctat

SEQ ID NO: 9092322 - DNA, 22 bp, Homo sapiens
agacattttacattcttccatt

SEQ ID NO: 9092323 - DNA, 22 bp, Homo sapiens
agagatggagagcactggggct

SEQ ID NO: 9092324 - DNA, 22 bp, Homo sapiens
agagatggagagcactggggct

SEQ ID NO: 9092325 - DNA, 19 bp, Homo sapiens
agagatgctaagagtcttt

SEQ ID NO: 9092326 - DNA, 22 bp, Homo sapiens
agagatgctgacgtttacattt

SEQ ID NO: 9092327 - DNA, 22 bp, Homo sapiens
agagatgcattcagcatggatg

SEQ ID NO: 9092328 - DNA, 22 bp, Homo sapiens
agagatgccacctttttgctgt

SEQ ID NO: 9092329 - DNA, 22 bp, Homo sapiens
agagatgaatcttgagactctg

SEQ ID NO: 9092330 - DNA, 22 bp, Homo sapiens
agagatgaatcttgagactctg

SEQ ID NO: 9092331 - DNA, 22 bp, Homo sapiens
agagatgacatgagggacttaa

SEQ ID NO: 9092332 - DNA, 22 bp, Homo sapiens
agagatgactgatggctgatta

SEQ ID NO: 9092333 - DNA, 22 bp, Homo sapiens
agagatgacatgagggacttaa

SEQ ID NO: 9092334 - DNA, 22 bp, Homo sapiens
agagatgagaacatgcttggat

SEQ ID NO: 9092335 - DNA, 22 bp, Homo sapiens
agagatgactgatggctgatta

SEQ ID NO: 9092336 - DNA, 22 bp, Homo sapiens
agagatggccttaggtgggaat

SEQ ID NO: 9092337 - DNA, 22 bp, Homo sapiens
agagatggccttaggtgggaat

SEQ ID NO: 9092338 - DNA, 22 bp, Homo sapiens
atgggggcctgaacaggcaaaa

SEQ ID NO: 9092339 - DNA, 22 bp, Homo sapiens
atggggtgagactaggattaaa

SEQ ID NO: 9092340 - DNA, 22 bp, Homo sapiens
atggggtgcatgcagattggga

SEQ ID NO: 9092341 - DNA, 22 bp, Homo sapiens
atggggggatgaaggagtccaa

SEQ ID NO: 9092342 - DNA, 22 bp, Homo sapiens
atgggggcggctgaagcccagg

SEQ ID NO: 9092343 - DNA, 22 bp, Homo sapiens
atgggtccctggccgccctcgg

SEQ ID NO: 9092344 - DNA, 22 bp, Homo sapiens
agagcagtgctgaagagtaggg

SEQ ID NO: 9092345 - DNA, 22 bp, Homo sapiens
agagcagcctgtgatgatgcac

SEQ ID NO: 9092346 - DNA, 17 bp, Homo sapiens
agagcatgtgtaggagc

SEQ ID NO: 9092347 - DNA, 22 bp, Homo sapiens
agagccaaggctgagagctatt

SEQ ID NO: 9092348 - DNA, 22 bp, Homo sapiens
agagccaaggcctcagtctcaa

SEQ ID NO: 9092349 - DNA, 22 bp, Homo sapiens
agagccagaccattgccgtgca

SEQ ID NO: 9092350 - DNA, 19 bp, Homo sapiens
agagccagacagcatagga

SEQ ID NO: 9092351 - DNA, 22 bp, Homo sapiens
agagcctgtacttttctgtgaa

SEQ ID NO: 9092352 - DNA, 22 bp, Homo sapiens
agagcctgtaacatctttctta

SEQ ID NO: 9092353 - DNA, 22 bp, Homo sapiens
agagcctggtctgagataggac

SEQ ID NO: 9092354 - DNA, 22 bp, Homo sapiens
agagcctggtctgagataggac

SEQ ID NO: 9092355 - DNA, 22 bp, Homo sapiens
agagcctggggattggcaaggg

SEQ ID NO: 9092356 - DNA, 22 bp, Homo sapiens
agagcctgtgattgtcatcacc

SEQ ID NO: 9092357 - DNA, 22 bp, Homo sapiens
agagcctgtgattgtcatcacc

SEQ ID NO: 9092358 - DNA, 22 bp, Homo sapiens
agagcctgtgattgtcatcacc

SEQ ID NO: 9092359 - DNA, 22 bp, Homo sapiens
agagcctgtgggagatgcagct

SEQ ID NO: 9092360 - DNA, 22 bp, Homo sapiens
atgtggggactctgagagaatt

SEQ ID NO: 9092361 - DNA, 22 bp, Homo sapiens
atgtggggacaaaatgatggcc

SEQ ID NO: 9092362 - DNA, 22 bp, Homo sapiens
atgtgggccgtgcgggtgtcct

SEQ ID NO: 9092363 - DNA, 22 bp, Homo sapiens
atgtgggccgtgcgggtgtcct

SEQ ID NO: 9092364 - DNA, 22 bp, Homo sapiens
atgtgggccgtgcgggtgtcct

SEQ ID NO: 9092365 - DNA, 22 bp, Homo sapiens
atgtgggagatttcaggaggtg

SEQ ID NO: 9092366 - DNA, 22 bp, Homo sapiens
atgtgggaaatacaagctaaaa

SEQ ID NO: 9092367 - DNA, 22 bp, Homo sapiens
atgtggttttggattattcatg

SEQ ID NO: 9092368 - DNA, 22 bp, Homo sapiens
atgtatttgcttgttatggatt

SEQ ID NO: 9092369 - DNA, 22 bp, Homo sapiens
atgtatttgcgtatggacatac

SEQ ID NO: 9092370 - DNA, 22 bp, Homo sapiens
atgtatttgcgtatggacatac

SEQ ID NO: 9092371 - DNA, 22 bp, Homo sapiens
agagccagcaactctagccctg

SEQ ID NO: 9092372 - DNA, 22 bp, Homo sapiens
agagccagagacctgggttcac

SEQ ID NO: 9092373 - DNA, 22 bp, Homo sapiens
agagccagatggagccgtgtgt

SEQ ID NO: 9092374 - DNA, 22 bp, Homo sapiens
agagcctgggaatttgcatgtt

SEQ ID NO: 9092375 - DNA, 22 bp, Homo sapiens
atgtcaaatcagttttatcaga

SEQ ID NO: 9092376 - DNA, 22 bp, Homo sapiens
agagcctgggcagctcctctgg

SEQ ID NO: 9092377 - DNA, 22 bp, Homo sapiens
agagcctggggattggcaaggg

SEQ ID NO: 9092378 - DNA, 22 bp, Homo sapiens
atgtcaaatcagttttatcaga

SEQ ID NO: 9092379 - DNA, 22 bp, Homo sapiens
atgtcaaacacaacaccagtgg

SEQ ID NO: 9092380 - DNA, 22 bp, Homo sapiens
atgtcaaacacaacaccagtgg

SEQ ID NO: 9092381 - DNA, 22 bp, Homo sapiens
atgtcaaagcagactgagagcg

SEQ ID NO: 9092382 - DNA, 22 bp, Homo sapiens
atgtcaaagcagactgagagcg

SEQ ID NO: 9092383 - DNA, 22 bp, Homo sapiens
atgtattttaagatttgcctca

SEQ ID NO: 9092384 - DNA, 22 bp, Homo sapiens
caagacaatgggtaagtgtaac

SEQ ID NO: 9092385 - DNA, 21 bp, Homo sapiens
caagacatatgagtactctgg

SEQ ID NO: 9092386 - DNA, 22 bp, Homo sapiens
caagacatgcaattgccacttt

SEQ ID NO: 9092387 - DNA, 22 bp, Homo sapiens
caagacattgattttgtacaga

SEQ ID NO: 9092388 - DNA, 22 bp, Homo sapiens
caagacctcaaaatgagagggg

SEQ ID NO: 9092389 - DNA, 22 bp, Homo sapiens
caagacttcaccgctctgtgct

SEQ ID NO: 9092390 - DNA, 22 bp, Homo sapiens
caagacttagagcatcttgaaa

SEQ ID NO: 9092391 - DNA, 22 bp, Homo sapiens
caacttggctctctggctatcc

SEQ ID NO: 9092392 - DNA, 22 bp, Homo sapiens
agcaccagagctatgggcctgc

SEQ ID NO: 9092393 - DNA, 22 bp, Homo sapiens
agcaccagagctatgggcctgc

SEQ ID NO: 9092394 - DNA, 22 bp, Homo sapiens
agcacattttatttaagaaaat

SEQ ID NO: 9092395 - DNA, 22 bp, Homo sapiens
agcacatttaagtatgaaatat

SEQ ID NO: 9092396 - DNA, 22 bp, Homo sapiens
agcaccagctcaaggtgcacct

SEQ ID NO: 9092397 - DNA, 23 bp, Homo sapiens
agcaccaggaacagtgtggtcct

SEQ ID NO: 9092398 - DNA, 22 bp, Homo sapiens
agcaccagcaactatgggctgc

SEQ ID NO: 9092399 - DNA, 22 bp, Homo sapiens
caaatattccaggtacatccct

SEQ ID NO: 9092400 - DNA, 22 bp, Homo sapiens
caaatagtgtcacattgtgagg

SEQ ID NO: 9092401 - DNA, 22 bp, Homo sapiens
caacagaaggtgtactactgaa

SEQ ID NO: 9092402 - DNA, 22 bp, Homo sapiens
caacagaaggaagcagggtcag

SEQ ID NO: 9092403 - DNA, 20 bp, Homo sapiens
caacactgcccattgtttgc

SEQ ID NO: 9092404 - DNA, 23 bp, Homo sapiens
caacactgccttcaggtgaagaa

SEQ ID NO: 9092405 - DNA, 22 bp, Homo sapiens
agcacattaagtgagttcatgt

SEQ ID NO: 9092406 - DNA, 22 bp, Homo sapiens
caacagctttagaaacactttc

SEQ ID NO: 9092407 - DNA, 22 bp, Homo sapiens
caacagctttagaaacactttc

SEQ ID NO: 9092408 - DNA, 22 bp, Homo sapiens
caacaggctttatgtttaaagt

SEQ ID NO: 9092409 - DNA, 22 bp, Homo sapiens
caacagctcagacacgggacct

SEQ ID NO: 9092410 - DNA, 22 bp, Homo sapiens
caacagctgatctttgatgaag

SEQ ID NO: 9092411 - DNA, 23 bp, Homo sapiens
caacagctgttagatatgggctt

SEQ ID NO: 9092412 - DNA, 22 bp, Homo sapiens
caacagctggaggcttggcccg

SEQ ID NO: 9092413 - DNA, 22 bp, Homo sapiens
caacagagagaccagaaacagg

SEQ ID NO: 9092414 - DNA, 22 bp, Homo sapiens
caacagagcagttgatcaggaa

SEQ ID NO: 9092415 - DNA, 20 bp, Homo sapiens
caacagaggggtctggagta

SEQ ID NO: 9092416 - DNA, 20 bp, Homo sapiens
caacagaggggtctggagta

SEQ ID NO: 9092417 - DNA, 22 bp, Homo sapiens
caacagagggaatggatctcat

SEQ ID NO: 9092418 - DNA, 22 bp, Homo sapiens
caacagaaggtgtactactgaa

SEQ ID NO: 9092419 - DNA, 22 bp, Homo sapiens
caaatagacttcaatctcttga

SEQ ID NO: 9092420 - DNA, 20 bp, Homo sapiens
agcacattaaacatactcct

SEQ ID NO: 9092421 - DNA, 22 bp, Homo sapiens
caaatagattgttcaatcctga

SEQ ID NO: 9092422 - DNA, 22 bp, Homo sapiens
caaatagattgttcaatcctga

SEQ ID NO: 9092423 - DNA, 22 bp, Homo sapiens
agcacaggtgaaacagtcaggt

SEQ ID NO: 9092424 - DNA, 19 bp, Homo sapiens
agcacagtttccacatgca

SEQ ID NO: 9092425 - DNA, 22 bp, Homo sapiens
agcacagtttcttttccttgtc

SEQ ID NO: 9092426 - DNA, 22 bp, Homo sapiens
agcacagtggcttctatgtcta

SEQ ID NO: 9092427 - DNA, 22 bp, Homo sapiens
caaaagtaccttgtgtgctttg

SEQ ID NO: 9092428 - DNA, 22 bp, Homo sapiens
caaaagtctgtcctttaacttc

SEQ ID NO: 9092429 - DNA, 22 bp, Homo sapiens
caaaagtcttcctattctctta

SEQ ID NO: 9092430 - DNA, 22 bp, Homo sapiens
caaaataccacgacttgtttta

SEQ ID NO: 9092431 - DNA, 22 bp, Homo sapiens
agcaaagacagggacgaccaag

SEQ ID NO: 9092432 - DNA, 22 bp, Homo sapiens
agcaaagaagacacaggcttca

SEQ ID NO: 9092433 - DNA, 21 bp, Homo sapiens
agcacagctttaagccatgtg

SEQ ID NO: 9092434 - DNA, 21 bp, Homo sapiens
agcacagctttaagccatgtg

SEQ ID NO: 9092435 - DNA, 22 bp, Homo sapiens
agcaaagctaccaattattgag

SEQ ID NO: 9092436 - DNA, 22 bp, Homo sapiens
agcaaagccgagacagccagtg

SEQ ID NO: 9092437 - DNA, 20 bp, Homo sapiens
agcaaagcctttagagtttg

SEQ ID NO: 9092438 - DNA, 20 bp, Homo sapiens
agcaaagcctttagagtttg

SEQ ID NO: 9092439 - DNA, 18 bp, Homo sapiens
agcaaagcaagagatcac

SEQ ID NO: 9092440 - DNA, 22 bp, Homo sapiens
agcaaagcaccatatggcagtt

SEQ ID NO: 9092441 - DNA, 22 bp, Homo sapiens
agcaaagatgtccggggcaagc

SEQ ID NO: 9092442 - DNA, 18 bp, Homo sapiens
agcaaagcaagagatcac

SEQ ID NO: 9092443 - DNA, 22 bp, Homo sapiens
agcaaagcatcactccaatctg

SEQ ID NO: 9092444 - DNA, 22 bp, Homo sapiens
agcaaagcagtggctaagctga

SEQ ID NO: 9092445 - DNA, 21 bp, Homo sapiens
agcagcagggaagcctcatcc

SEQ ID NO: 9092446 - DNA, 22 bp, Homo sapiens
agcagcaggcttaaggaaaagt

SEQ ID NO: 9092447 - DNA, 22 bp, Homo sapiens
agcagcaggcttaaggaaaagt

SEQ ID NO: 9092448 - DNA, 22 bp, Homo sapiens
agcagcaggcttaaggaaaagt

SEQ ID NO: 9092449 - DNA, 22 bp, Homo sapiens
agcagcaggcttaaggaaaagt

SEQ ID NO: 9092450 - DNA, 22 bp, Homo sapiens
agcagcagggctctgcccgtgc

SEQ ID NO: 9092451 - DNA, 22 bp, Homo sapiens
agcagcagggcatgtcttactc

SEQ ID NO: 9092452 - DNA, 22 bp, Homo sapiens
agcagcagggacaaaggaacag

SEQ ID NO: 9092453 - DNA, 22 bp, Homo sapiens
agcagcagggacaaaggaacag

SEQ ID NO: 9092454 - DNA, 22 bp, Homo sapiens
agcagcagggacaaaggaacag

SEQ ID NO: 9092455 - DNA, 22 bp, Homo sapiens
caattttttccatgctcttaca

SEQ ID NO: 9092456 - DNA, 22 bp, Homo sapiens
agcagcagggtgatagtgccca

SEQ ID NO: 9092457 - DNA, 22 bp, Homo sapiens
agcagcagggtgatagtgccca

SEQ ID NO: 9092458 - DNA, 22 bp, Homo sapiens
agcagcagggtcattgctcttt

SEQ ID NO: 9092459 - DNA, 22 bp, Homo sapiens
agcagcagggtcattgctcttt

SEQ ID NO: 9092460 - DNA, 21 bp, Homo sapiens
cacaagacacatagggtgttt

SEQ ID NO: 9092461 - DNA, 22 bp, Homo sapiens
cacaagacttatttgtgtagaa

SEQ ID NO: 9092462 - DNA, 22 bp, Homo sapiens
cacaagagagtgcgcgttgcaa

SEQ ID NO: 9092463 - DNA, 22 bp, Homo sapiens
cacaagatggtcacataagtgc

SEQ ID NO: 9092464 - DNA, 22 bp, Homo sapiens
cacaaggaggtcctgaggaagc

SEQ ID NO: 9092465 - DNA, 22 bp, Homo sapiens
cacaaggaggtcctgaggaagc

SEQ ID NO: 9092466 - DNA, 22 bp, Homo sapiens
cacaaggactggatggagtggg

SEQ ID NO: 9092467 - DNA, 22 bp, Homo sapiens
cacaaggacctcagatggatga

SEQ ID NO: 9092468 - DNA, 22 bp, Homo sapiens
cacaaggctttcatctggcata

SEQ ID NO: 9092469 - DNA, 22 bp, Homo sapiens
agcagccacccagctgctcatt

SEQ ID NO: 9092470 - DNA, 22 bp, Homo sapiens
agcagctccctcctcagccacc

SEQ ID NO: 9092471 - DNA, 22 bp, Homo sapiens
agcagccacagtctgggacagg

SEQ ID NO: 9092472 - DNA, 22 bp, Homo sapiens
caagcaatgccctggtatatta

SEQ ID NO: 9092473 - DNA, 22 bp, Homo sapiens
caagcagacagtaggcctagaa

SEQ ID NO: 9092474 - DNA, 19 bp, Homo sapiens
caagatttgttcacacatg

SEQ ID NO: 9092475 - DNA, 22 bp, Homo sapiens
caagatttatattttcacacaa

SEQ ID NO: 9092476 - DNA, 22 bp, Homo sapiens
caagagagatgcagctcactca

SEQ ID NO: 9092477 - DNA, 22 bp, Homo sapiens
caagagcatttagttagctggt

SEQ ID NO: 9092478 - DNA, 22 bp, Homo sapiens
caagagctagaaattggttaga

SEQ ID NO: 9092479 - DNA, 22 bp, Homo sapiens
caagcagagactagatagctgt

SEQ ID NO: 9092480 - DNA, 22 bp, Homo sapiens
caagcagagaagtctctaggct

SEQ ID NO: 9092481 - DNA, 22 bp, Homo sapiens
caagcagagaggtcaactaata

SEQ ID NO: 9092482 - DNA, 22 bp, Homo sapiens
agcagcagctctgttgccctac

SEQ ID NO: 9092483 - DNA, 20 bp, Homo sapiens
agcagcagatgttggaggtg

SEQ ID NO: 9092484 - DNA, 20 bp, Homo sapiens
agcagcagatgttggaggtg

SEQ ID NO: 9092485 - DNA, 22 bp, Homo sapiens
agcagcaggaggccattgtctt

SEQ ID NO: 9092486 - DNA, 22 bp, Homo sapiens
agcagcaggaggctgtccacca

SEQ ID NO: 9092487 - DNA, 22 bp, Homo sapiens
agcagcaggaggctgtccacca

SEQ ID NO: 9092488 - DNA, 22 bp, Homo sapiens
agcagcaggagccgtggggtga

SEQ ID NO: 9092489 - DNA, 22 bp, Homo sapiens
agcagcaggagccgtggggtga

SEQ ID NO: 9092490 - DNA, 22 bp, Homo sapiens
agcagcaggaggccattgtctt

SEQ ID NO: 9092491 - DNA, 22 bp, Homo sapiens
agcagcaggctagggaactgct

SEQ ID NO: 9092492 - DNA, 22 bp, Homo sapiens
agcagcaggctagggaactgct

SEQ ID NO: 9092493 - DNA, 22 bp, Homo sapiens
agcagcaggctagggaactgct

SEQ ID NO: 9092494 - DNA, 22 bp, Homo sapiens
agcagcaggattttcgttggga

SEQ ID NO: 9092495 - DNA, 23 bp, Homo sapiens
agcagcaggaggtattgataagg

SEQ ID NO: 9092496 - DNA, 22 bp, Homo sapiens
agcagcaggctgggatgagtct

SEQ ID NO: 9092497 - DNA, 22 bp, Homo sapiens
agcagcaggctgggatgagtct

SEQ ID NO: 9092498 - DNA, 22 bp, Homo sapiens
agcagcaggctgtgtggactga

SEQ ID NO: 9092499 - DNA, 22 bp, Homo sapiens
agcagcaggctgtgtggactga

SEQ ID NO: 9092500 - DNA, 22 bp, Homo sapiens
agcagcaggctgtgtggactga

SEQ ID NO: 9092501 - DNA, 22 bp, Homo sapiens
agcagcaggctgtgtggactga

SEQ ID NO: 9092502 - DNA, 22 bp, Homo sapiens
agcagcaggctgtgtggactga

SEQ ID NO: 9092503 - DNA, 22 bp, Homo sapiens
cactgcttggccctgagggcag

SEQ ID NO: 9092504 - DNA, 22 bp, Homo sapiens
agcatacttgacacttctctat

SEQ ID NO: 9092505 - DNA, 22 bp, Homo sapiens
agcatagagaatctagatgcct

SEQ ID NO: 9092506 - DNA, 22 bp, Homo sapiens
cactgccttcacctgccctatc

SEQ ID NO: 9092507 - DNA, 23 bp, Homo sapiens
cactgccttcagttgcttcacct

SEQ ID NO: 9092508 - DNA, 22 bp, Homo sapiens
cactgctcgctgcagcatggcc

SEQ ID NO: 9092509 - DNA, 22 bp, Homo sapiens
cactgctgatttcataggcagg

SEQ ID NO: 9092510 - DNA, 22 bp, Homo sapiens
cacctctttgatttgaggcaag

SEQ ID NO: 9092511 - DNA, 22 bp, Homo sapiens
cacctctttgatttgaggcaag

SEQ ID NO: 9092512 - DNA, 22 bp, Homo sapiens
cacctctgcctcaagcttccca

SEQ ID NO: 9092513 - DNA, 22 bp, Homo sapiens
cactgcagatcagaggctgaga

SEQ ID NO: 9092514 - DNA, 22 bp, Homo sapiens
cactgcctgtgagctgtgtgcc

SEQ ID NO: 9092515 - DNA, 22 bp, Homo sapiens
cacctagggtttcgcctttctt

SEQ ID NO: 9092516 - DNA, 22 bp, Homo sapiens
caccgcggagtgatggagaaac

SEQ ID NO: 9092517 - DNA, 22 bp, Homo sapiens
cacccaggctggagtgcagtgg

SEQ ID NO: 9092518 - DNA, 22 bp, Homo sapiens
cacccaggctggagtgcattgg

SEQ ID NO: 9092519 - DNA, 22 bp, Homo sapiens
cacccaggctggagtgcagtgg

SEQ ID NO: 9092520 - DNA, 22 bp, Homo sapiens
cacccagggctgtgcctgccca

SEQ ID NO: 9092521 - DNA, 22 bp, Homo sapiens
agcaggggtctctgctaatgaa

SEQ ID NO: 9092522 - DNA, 22 bp, Homo sapiens
agcaggggtctctgctaatgaa

SEQ ID NO: 9092523 - DNA, 22 bp, Homo sapiens
agcaggggtggaaggtagcttt

SEQ ID NO: 9092524 - DNA, 22 bp, Homo sapiens
agcagggttccaggagttgcag

SEQ ID NO: 9092525 - DNA, 22 bp, Homo sapiens
cacccaggctggagagcagtgg

SEQ ID NO: 9092526 - DNA, 22 bp, Homo sapiens
cacccaggctggagagcagtgg

SEQ ID NO: 9092527 - DNA, 22 bp, Homo sapiens
cacccaggctggagtgcagtga

SEQ ID NO: 9092528 - DNA, 22 bp, Homo sapiens
cacccaggctggagtgcagtga

SEQ ID NO: 9092529 - DNA, 22 bp, Homo sapiens
cacccaggctggagtgcagggg

SEQ ID NO: 9092530 - DNA, 22 bp, Homo sapiens
agcaggggtaacagaaggaaag

SEQ ID NO: 9092531 - DNA, 22 bp, Homo sapiens
agcagggggccacagtcacagc

SEQ ID NO: 9092532 - DNA, 22 bp, Homo sapiens
agcagggggagttagactagat

SEQ ID NO: 9092533 - DNA, 22 bp, Homo sapiens
agcagggggcatccttgccctt

SEQ ID NO: 9092534 - DNA, 22 bp, Homo sapiens
agcaggggcagggttttgtgct

SEQ ID NO: 9092535 - DNA, 23 bp, Homo sapiens
agcaggctgcttctccacagctg

SEQ ID NO: 9092536 - DNA, 22 bp, Homo sapiens
agcaggctgctggcgttgaagt

SEQ ID NO: 9092537 - DNA, 20 bp, Homo sapiens
agcaggctgcagggtgaaat

SEQ ID NO: 9092538 - DNA, 22 bp, Homo sapiens
agcaggctgccttccaaagcct

SEQ ID NO: 9092539 - DNA, 22 bp, Homo sapiens
cacagtttggtatagaagtgat

SEQ ID NO: 9092540 - DNA, 22 bp, Homo sapiens
cacagtttgcataggaaaaaca

SEQ ID NO: 9092541 - DNA, 22 bp, Homo sapiens
cacagtttctataggtcagaat

SEQ ID NO: 9092542 - DNA, 22 bp, Homo sapiens
cacagttatatgttcacaagga

SEQ ID NO: 9092543 - DNA, 22 bp, Homo sapiens
cacagtttcaataattattctt

SEQ ID NO: 9092544 - DNA, 22 bp, Homo sapiens
agcaggctgatgggcatgcttg

SEQ ID NO: 9092545 - DNA, 17 bp, Homo sapiens
agcaggctgcagaggcc

SEQ ID NO: 9092546 - DNA, 22 bp, Homo sapiens
agcaggctccaggctggccatc

SEQ ID NO: 9092547 - DNA, 22 bp, Homo sapiens
agcaggctccttccttctctgg

SEQ ID NO: 9092548 - DNA, 22 bp, Homo sapiens
agcaggctccttccttctctgg

SEQ ID NO: 9092549 - DNA, 22 bp, Homo sapiens
agcaggctgagcacccaggggg

SEQ ID NO: 9092550 - DNA, 22 bp, Homo sapiens
agcaggcaggaaggcagcactg

SEQ ID NO: 9092551 - DNA, 22 bp, Homo sapiens
agcaggcaggaatggtggaaca

SEQ ID NO: 9092552 - DNA, 22 bp, Homo sapiens
agcaggcaggaggctactaagg

SEQ ID NO: 9092553 - DNA, 22 bp, Homo sapiens
agcaggcactatgccaggatct

SEQ ID NO: 9092554 - DNA, 22 bp, Homo sapiens
agcaggcagccatttggaaggc

SEQ ID NO: 9092555 - DNA, 22 bp, Homo sapiens
agcaggcagcatgggaccctcc

SEQ ID NO: 9092556 - DNA, 22 bp, Homo sapiens
agcaggcaggaaggcagcactg

SEQ ID NO: 9092557 - DNA, 22 bp, Homo sapiens
agcaggcagctgggggagttga

SEQ ID NO: 9092558 - DNA, 22 bp, Homo sapiens
agcaggcagctgggggagttga

SEQ ID NO: 9092559 - DNA, 22 bp, Homo sapiens
agcaggcagcctaggaagtgaa

SEQ ID NO: 9092560 - DNA, 22 bp, Homo sapiens
agcaggcagcctaggaagtgaa

SEQ ID NO: 9092561 - DNA, 22 bp, Homo sapiens
agcaggcagcctaggaagtgaa

SEQ ID NO: 9092562 - DNA, 22 bp, Homo sapiens
agcaggcagccatttggaaggc

SEQ ID NO: 9092563 - DNA, 22 bp, Homo sapiens
agcagctgctccacttgcttaa

SEQ ID NO: 9092564 - DNA, 22 bp, Homo sapiens
agcagctgctccacttgcttaa

SEQ ID NO: 9092565 - DNA, 22 bp, Homo sapiens
cacacacagttttgtattctgt

SEQ ID NO: 9092566 - DNA, 22 bp, Homo sapiens
cacacaaatattctggaggcaa

SEQ ID NO: 9092567 - DNA, 22 bp, Homo sapiens
cacacaaatattctggaggcaa

SEQ ID NO: 9092568 - DNA, 22 bp, Homo sapiens
cacacaaatattctggaggcaa

SEQ ID NO: 9092569 - DNA, 22 bp, Homo sapiens
agcagctgccagagagagttcc

SEQ ID NO: 9092570 - DNA, 22 bp, Homo sapiens
agcagctgccagagagagttcc

SEQ ID NO: 9092571 - DNA, 22 bp, Homo sapiens
agcagctgccactggaatagga

SEQ ID NO: 9092572 - DNA, 22 bp, Homo sapiens
agcagctgccactggaatagga

SEQ ID NO: 9092573 - DNA, 21 bp, Homo sapiens
agcagctgcagtttctatctg

SEQ ID NO: 9092574 - DNA, 21 bp, Homo sapiens
agcagctgcagtttctatctg

SEQ ID NO: 9092575 - DNA, 21 bp, Homo sapiens
agcagctgcagtttctatctg

SEQ ID NO: 9092576 - DNA, 22 bp, Homo sapiens
agcagctgccactggaatagga

SEQ ID NO: 9092577 - DNA, 22 bp, Homo sapiens
agcagctgccactggaatagga

SEQ ID NO: 9092578 - DNA, 22 bp, Homo sapiens
agcagctgatcaaagcacttat

SEQ ID NO: 9092579 - DNA, 22 bp, Homo sapiens
agcagctgatcaaagcacttat

SEQ ID NO: 9092580 - DNA, 22 bp, Homo sapiens
agcagctgatcaaagcacttat

SEQ ID NO: 9092581 - DNA, 22 bp, Homo sapiens
agcagctgagccccagctgtga

SEQ ID NO: 9092582 - DNA, 22 bp, Homo sapiens
agcagctgatcaaagcacttat

SEQ ID NO: 9092583 - DNA, 22 bp, Homo sapiens
agcagctgatggggaaggagtt

SEQ ID NO: 9092584 - DNA, 22 bp, Homo sapiens
agcagctgatggggaaggagtt

SEQ ID NO: 9092585 - DNA, 22 bp, Homo sapiens
agcagctgatggggaaggagtt

SEQ ID NO: 9092586 - DNA, 22 bp, Homo sapiens
agcagctgatggggaaggagtt

SEQ ID NO: 9092587 - DNA, 22 bp, Homo sapiens
agcagctgcagagggctccccc

SEQ ID NO: 9092588 - DNA, 22 bp, Homo sapiens
agcagctgcagagggctccccc

SEQ ID NO: 9092589 - DNA, 22 bp, Homo sapiens
agcagctgcagagggctccccc

SEQ ID NO: 9092590 - DNA, 22 bp, Homo sapiens
agcagctgatggggaaggagtt

SEQ ID NO: 9092591 - DNA, 22 bp, Homo sapiens
agcagctgcagagggctccccc

SEQ ID NO: 9092592 - DNA, 22 bp, Homo sapiens
agcagctgcagagggctccccc

SEQ ID NO: 9092593 - DNA, 22 bp, Homo sapiens
agcagctgcagggagggtctgc

SEQ ID NO: 9092594 - DNA, 22 bp, Homo sapiens
agcagctgcagggagggtctgc

SEQ ID NO: 9092595 - DNA, 22 bp, Homo sapiens
agcagctgcagggagggtctgc

SEQ ID NO: 9092596 - DNA, 22 bp, Homo sapiens
agcagctgcagggagggtctgc

SEQ ID NO: 9092597 - DNA, 22 bp, Homo sapiens
agcagctgcagggagggtctgc

SEQ ID NO: 9092598 - DNA, 17 bp, Homo sapiens
agcaggcacgtcagcac

SEQ ID NO: 9092599 - DNA, 17 bp, Homo sapiens
agcaggcacgtcagcac

SEQ ID NO: 9092600 - DNA, 22 bp, Homo sapiens
agcaggcacgctccctgcgcga

SEQ ID NO: 9092601 - DNA, 22 bp, Homo sapiens
agcaggcacgctccctgcgcga

SEQ ID NO: 9092602 - DNA, 22 bp, Homo sapiens
agcaggcaccagggctcgtcct

SEQ ID NO: 9092603 - DNA, 22 bp, Homo sapiens
agcaggcaccagggctcgtcct

SEQ ID NO: 9092604 - DNA, 22 bp, Homo sapiens
agcaggcacaagaaagggaggt

SEQ ID NO: 9092605 - DNA, 22 bp, Homo sapiens
agcaggcacaagaaagggaggt

SEQ ID NO: 9092606 - DNA, 22 bp, Homo sapiens
agcaggcacaagaaagggaggt

SEQ ID NO: 9092607 - DNA, 21 bp, Homo sapiens
agcaggcaaaggtgaagtctt

SEQ ID NO: 9092608 - DNA, 22 bp, Homo sapiens
agcaggcaagcgtgagttctct

SEQ ID NO: 9092609 - DNA, 22 bp, Homo sapiens
agcaggcaagcgtgagttctct

SEQ ID NO: 9092610 - DNA, 21 bp, Homo sapiens
agcaggcaaaggtgaagtctt

SEQ ID NO: 9092611 - DNA, 21 bp, Homo sapiens
agcaggcaaaggtgaagtctt

SEQ ID NO: 9092612 - DNA, 22 bp, Homo sapiens
cacacaccaatcaaatgtcaga

SEQ ID NO: 9092613 - DNA, 22 bp, Homo sapiens
cacacacagttttgtattctgt

SEQ ID NO: 9092614 - DNA, 22 bp, Homo sapiens
agcaggagtttgatgcttttat

SEQ ID NO: 9092615 - DNA, 22 bp, Homo sapiens
cagccctgcacgctgcctccgc

SEQ ID NO: 9092616 - DNA, 22 bp, Homo sapiens
cagccctgcacgctgcctccgc

SEQ ID NO: 9092617 - DNA, 22 bp, Homo sapiens
cagccctgcacgctgcctccgc

SEQ ID NO: 9092618 - DNA, 22 bp, Homo sapiens
cagccctgcacgctgcctccgc

SEQ ID NO: 9092619 - DNA, 22 bp, Homo sapiens
cagccctgcagagggcgctcct

SEQ ID NO: 9092620 - DNA, 22 bp, Homo sapiens
cagccctgcagagggcgctcct

SEQ ID NO: 9092621 - DNA, 22 bp, Homo sapiens
cagccctgcagagggcgctcct

SEQ ID NO: 9092622 - DNA, 22 bp, Homo sapiens
cagccctgcagagggcgctcct

SEQ ID NO: 9092623 - DNA, 16 bp, Homo sapiens
cagccctgaggaagaa

SEQ ID NO: 9092624 - DNA, 22 bp, Homo sapiens
cagccctgagcaaggcttttaa

SEQ ID NO: 9092625 - DNA, 16 bp, Homo sapiens
cagccctgaggaagaa

SEQ ID NO: 9092626 - DNA, 22 bp, Homo sapiens
cagccctgagttagcccacgga

SEQ ID NO: 9092627 - DNA, 22 bp, Homo sapiens
cagccctgagttagcccacgga

SEQ ID NO: 9092628 - DNA, 22 bp, Homo sapiens
cagccctgcacgctgcctccgc

SEQ ID NO: 9092629 - DNA, 23 bp, Homo sapiens
cagccctgaaatcgaggtgacac

SEQ ID NO: 9092630 - DNA, 23 bp, Homo sapiens
cagccctgaaatcgaggtgacac

SEQ ID NO: 9092631 - DNA, 22 bp, Homo sapiens
cagccctgagaaggaggatctc

SEQ ID NO: 9092632 - DNA, 22 bp, Homo sapiens
cagccctgagagaaccatctat

SEQ ID NO: 9092633 - DNA, 22 bp, Homo sapiens
cagccctgagagaaccatctat

SEQ ID NO: 9092634 - DNA, 22 bp, Homo sapiens
cagccctgagagaaccatctat

SEQ ID NO: 9092635 - DNA, 22 bp, Homo sapiens
cagccctgagcaaggcttttaa

SEQ ID NO: 9092636 - DNA, 22 bp, Homo sapiens
cagccctgagagaaccatctat

SEQ ID NO: 9092637 - DNA, 22 bp, Homo sapiens
cagccctgagagaaccatctat

SEQ ID NO: 9092638 - DNA, 22 bp, Homo sapiens
cagcatcaacattctcagctct

SEQ ID NO: 9092639 - DNA, 22 bp, Homo sapiens
cagccccagcacttagctgagt

SEQ ID NO: 9092640 - DNA, 23 bp, Homo sapiens
cagccctgaaatcgaggtgacac

SEQ ID NO: 9092641 - DNA, 22 bp, Homo sapiens
cagcagggtaggttgtatcagt

SEQ ID NO: 9092642 - DNA, 22 bp, Homo sapiens
cagcagtgtctccagcatcaca

SEQ ID NO: 9092643 - DNA, 22 bp, Homo sapiens
cagcagtgtgcaggtgtgctgg

SEQ ID NO: 9092644 - DNA, 22 bp, Homo sapiens
cagcagtgtctccagcatcaca

SEQ ID NO: 9092645 - DNA, 22 bp, Homo sapiens
cagcagggtaggttgtatcagt

SEQ ID NO: 9092646 - DNA, 22 bp, Homo sapiens
cagcagggggcagcgcagatca

SEQ ID NO: 9092647 - DNA, 22 bp, Homo sapiens
cagcaggggaactgtgggccag

SEQ ID NO: 9092648 - DNA, 22 bp, Homo sapiens
cagcagttttgaagtgtggaga

SEQ ID NO: 9092649 - DNA, 22 bp, Homo sapiens
cagcataaaataaatctacatg

SEQ ID NO: 9092650 - DNA, 22 bp, Homo sapiens
cagcataggatgtggagccagg

SEQ ID NO: 9092651 - DNA, 22 bp, Homo sapiens
cagcatagctgattaaggcaaa

SEQ ID NO: 9092652 - DNA, 22 bp, Homo sapiens
cagcagtgtggaagctgagggg

SEQ ID NO: 9092653 - DNA, 22 bp, Homo sapiens
cagcagtgtggaagctgagggg

SEQ ID NO: 9092654 - DNA, 21 bp, Homo sapiens
cagcagtgtgtctgagctaga

SEQ ID NO: 9092655 - DNA, 21 bp, Homo sapiens
cagcagtgtgtctgagctaga

SEQ ID NO: 9092656 - DNA, 22 bp, Homo sapiens
cagcagttatgagtagaatagt

SEQ ID NO: 9092657 - DNA, 22 bp, Homo sapiens
cagcagttatgagtagaatagt

SEQ ID NO: 9092658 - DNA, 22 bp, Homo sapiens
cagcagttcaatccagtgcacg

SEQ ID NO: 9092659 - DNA, 22 bp, Homo sapiens
cagctcagtgatgccttcacag

SEQ ID NO: 9092660 - DNA, 22 bp, Homo sapiens
cagctcagtcttgaagcactgg

SEQ ID NO: 9092661 - DNA, 19 bp, Homo sapiens
cagctcagtttgattctct

SEQ ID NO: 9092662 - DNA, 22 bp, Homo sapiens
cagctccaaagccccactgtcc

SEQ ID NO: 9092663 - DNA, 22 bp, Homo sapiens
cagctcagtctggagagatgca

SEQ ID NO: 9092664 - DNA, 22 bp, Homo sapiens
agctcctgaaaatccagactgg

SEQ ID NO: 9092665 - DNA, 22 bp, Homo sapiens
cagctctgacacagtacaaaat

SEQ ID NO: 9092666 - DNA, 22 bp, Homo sapiens
agctcctgatacatgcaggaat

SEQ ID NO: 9092667 - DNA, 22 bp, Homo sapiens
agctcctgatacatgcaggaat

SEQ ID NO: 9092668 - DNA, 22 bp, Homo sapiens
agctcctgattctcagagatag

SEQ ID NO: 9092669 - DNA, 22 bp, Homo sapiens
agctcctgatacatgcaggaat

SEQ ID NO: 9092670 - DNA, 23 bp, Homo sapiens
agctcctgaggccagcctctcct

SEQ ID NO: 9092671 - DNA, 22 bp, Homo sapiens
cagctcaggaaggaaggccggc

SEQ ID NO: 9092672 - DNA, 22 bp, Homo sapiens
cagctcaggctctccatgctcc

SEQ ID NO: 9092673 - DNA, 22 bp, Homo sapiens
cagctcaggctctccatgctcc

SEQ ID NO: 9092674 - DNA, 22 bp, Homo sapiens
agctcagccctcctgtgcagct

SEQ ID NO: 9092675 - DNA, 21 bp, Homo sapiens
agctcagccgggcacagtggc

SEQ ID NO: 9092676 - DNA, 22 bp, Homo sapiens
agctcagcttcctctccatgct

SEQ ID NO: 9092677 - DNA, 22 bp, Homo sapiens
agctcagagctcgggaggatgg

SEQ ID NO: 9092678 - DNA, 22 bp, Homo sapiens
agctcagagataatcaagagac

SEQ ID NO: 9092679 - DNA, 22 bp, Homo sapiens
agcctctgcttatgcaaaggta

SEQ ID NO: 9092680 - DNA, 18 bp, Homo sapiens
agcctctggcagagagaa

SEQ ID NO: 9092681 - DNA, 18 bp, Homo sapiens
agcctctggcagagagaa

SEQ ID NO: 9092682 - DNA, 22 bp, Homo sapiens
agcctctgctggccctggcact

SEQ ID NO: 9092683 - DNA, 22 bp, Homo sapiens
agcctctgctggccctggcact

SEQ ID NO: 9092684 - DNA, 22 bp, Homo sapiens
agcctctgcacgggcacgggtg

SEQ ID NO: 9092685 - DNA, 22 bp, Homo sapiens
agcctctgatggctcccaagga

SEQ ID NO: 9092686 - DNA, 20 bp, Homo sapiens
agcctctgcccttcccactg

SEQ ID NO: 9092687 - DNA, 20 bp, Homo sapiens
agcctctgcccttcccactg

SEQ ID NO: 9092688 - DNA, 22 bp, Homo sapiens
agcctctgcacttcttacaggt

SEQ ID NO: 9092689 - DNA, 22 bp, Homo sapiens
agcctctgtcaagcttttcaaa

SEQ ID NO: 9092690 - DNA, 22 bp, Homo sapiens
agcctctgtcaagcttttcaaa

SEQ ID NO: 9092691 - DNA, 22 bp, Homo sapiens
agcctctgtagaaagcagtgtg

SEQ ID NO: 9092692 - DNA, 22 bp, Homo sapiens
agcctctgtagaaagcagtgtg

SEQ ID NO: 9092693 - DNA, 22 bp, Homo sapiens
agcctctgggggagctgggagc

SEQ ID NO: 9092694 - DNA, 22 bp, Homo sapiens
agcctctggtcctccctcagct

SEQ ID NO: 9092695 - DNA, 22 bp, Homo sapiens
agcctctggccctagactgctt

SEQ ID NO: 9092696 - DNA, 22 bp, Homo sapiens
cagaggtcaagatctgaagtga

SEQ ID NO: 9092697 - DNA, 22 bp, Homo sapiens
cagaggtccctgttcttaagga

SEQ ID NO: 9092698 - DNA, 22 bp, Homo sapiens
cagaggtccctgttcttaagga

SEQ ID NO: 9092699 - DNA, 22 bp, Homo sapiens
cagagggatcatcttcctgaag

SEQ ID NO: 9092700 - DNA, 22 bp, Homo sapiens
cagagggagtttctgaggttgc

SEQ ID NO: 9092701 - DNA, 22 bp, Homo sapiens
cagagggccatctctatcttca

SEQ ID NO: 9092702 - DNA, 22 bp, Homo sapiens
cagaggtattttgataaacgcc

SEQ ID NO: 9092703 - DNA, 22 bp, Homo sapiens
cagaggtattgcaaaagcctag

SEQ ID NO: 9092704 - DNA, 22 bp, Homo sapiens
cagagggccccctggccacagt

SEQ ID NO: 9092705 - DNA, 22 bp, Homo sapiens
agcctgagctgcctgccgcctc

SEQ ID NO: 9092706 - DNA, 22 bp, Homo sapiens
agcctgagccccatccagctga

SEQ ID NO: 9092707 - DNA, 22 bp, Homo sapiens
agcctgagccccatccagctga

SEQ ID NO: 9092708 - DNA, 22 bp, Homo sapiens
cagcagcattgctctggattcc

SEQ ID NO: 9092709 - DNA, 22 bp, Homo sapiens
cagcagcattgctctggattcc

SEQ ID NO: 9092710 - DNA, 22 bp, Homo sapiens
cagcagcattgctctggattcc

SEQ ID NO: 9092711 - DNA, 22 bp, Homo sapiens
cagcagctcactcaggtggctc

SEQ ID NO: 9092712 - DNA, 22 bp, Homo sapiens
cagcagctcactgaataatgac

SEQ ID NO: 9092713 - DNA, 22 bp, Homo sapiens
cagcagctcactcaggtggctc

SEQ ID NO: 9092714 - DNA, 23 bp, Homo sapiens
agcctcttttctcctgccctgca

SEQ ID NO: 9092715 - DNA, 22 bp, Homo sapiens
agcctcttccagctcctttcta

SEQ ID NO: 9092716 - DNA, 22 bp, Homo sapiens
agcctcttattctccaggactt

SEQ ID NO: 9092717 - DNA, 22 bp, Homo sapiens
agcctgagagccaagctgtgca

SEQ ID NO: 9092718 - DNA, 22 bp, Homo sapiens
agcctgagccccatccagctga

SEQ ID NO: 9092719 - DNA, 22 bp, Homo sapiens
agcctgagagccaagctgtgca

SEQ ID NO: 9092720 - DNA, 22 bp, Homo sapiens
agcctgagagccaagctgtgca

SEQ ID NO: 9092721 - DNA, 22 bp, Homo sapiens
agcctgagagccaagctgtgca

SEQ ID NO: 9092722 - DNA, 22 bp, Homo sapiens
agcctgagagccaagctgtgca

SEQ ID NO: 9092723 - DNA, 22 bp, Homo sapiens
agcctgagagccaagctgtgca

SEQ ID NO: 9092724 - DNA, 22 bp, Homo sapiens
cagcagctcaggctgcttccca

SEQ ID NO: 9092725 - DNA, 22 bp, Homo sapiens
cagcagctcaggctccttccca

SEQ ID NO: 9092726 - DNA, 22 bp, Homo sapiens
cagcagctcagtctctcagtag

SEQ ID NO: 9092727 - DNA, 22 bp, Homo sapiens
cagcagctcagtctctcagtag

SEQ ID NO: 9092728 - DNA, 22 bp, Homo sapiens
cagcagctccaaagaatagcca

SEQ ID NO: 9092729 - DNA, 22 bp, Homo sapiens
cagcagctcccatccgctgagc

SEQ ID NO: 9092730 - DNA, 22 bp, Homo sapiens
cagcagctcccatccgctgagc

SEQ ID NO: 9092731 - DNA, 22 bp, Homo sapiens
cagcagctgactccaagagagc

SEQ ID NO: 9092732 - DNA, 22 bp, Homo sapiens
cagcagctgactccaagagagc

SEQ ID NO: 9092733 - DNA, 22 bp, Homo sapiens
cagcagctcctctgcggctatg

SEQ ID NO: 9092734 - DNA, 22 bp, Homo sapiens
agcctggattcgtgcatccaca

SEQ ID NO: 9092735 - DNA, 22 bp, Homo sapiens
agcctggattcgtgcatccaca

SEQ ID NO: 9092736 - DNA, 22 bp, Homo sapiens
agcctggatcctaggctcagct

SEQ ID NO: 9092737 - DNA, 22 bp, Homo sapiens
agcctggatcctaggctcagct

SEQ ID NO: 9092738 - DNA, 22 bp, Homo sapiens
agcctggatcctaggctcagct

SEQ ID NO: 9092739 - DNA, 22 bp, Homo sapiens
agcctggaggtaatgaggaaac

SEQ ID NO: 9092740 - DNA, 22 bp, Homo sapiens
cagcagctgaggcgctggcgtg

SEQ ID NO: 9092741 - DNA, 22 bp, Homo sapiens
agcctggagttcccaggagaag

SEQ ID NO: 9092742 - DNA, 22 bp, Homo sapiens
agcctggagttcccaggagaag

SEQ ID NO: 9092743 - DNA, 22 bp, Homo sapiens
agcctggatccatgtggctacc

SEQ ID NO: 9092744 - DNA, 22 bp, Homo sapiens
agcctggcactgaggcagggcg

SEQ ID NO: 9092745 - DNA, 22 bp, Homo sapiens
cagcaggatatggtggagagag

SEQ ID NO: 9092746 - DNA, 22 bp, Homo sapiens
cagcaggatatggtggagagag

SEQ ID NO: 9092747 - DNA, 22 bp, Homo sapiens
cagcagggcccccgggtgcgcc

SEQ ID NO: 9092748 - DNA, 22 bp, Homo sapiens
cagaaatatcagttgaaagtgc

SEQ ID NO: 9092749 - DNA, 22 bp, Homo sapiens
cagaaatatgtgccatgcctta

SEQ ID NO: 9092750 - DNA, 22 bp, Homo sapiens
cagaaatctccatgtcagacat

SEQ ID NO: 9092751 - DNA, 22 bp, Homo sapiens
agccacccattcccgagcccta

SEQ ID NO: 9092752 - DNA, 22 bp, Homo sapiens
agccacctcctgctctgctcac

SEQ ID NO: 9092753 - DNA, 22 bp, Homo sapiens
agccacagtgcaagagagaaaa

SEQ ID NO: 9092754 - DNA, 22 bp, Homo sapiens
agccacagtgcaagagagaaaa

SEQ ID NO: 9092755 - DNA, 22 bp, Homo sapiens
agccacagtgggctaccagctc

SEQ ID NO: 9092756 - DNA, 22 bp, Homo sapiens
agccacagtgcaagagagaaaa

SEQ ID NO: 9092757 - DNA, 22 bp, Homo sapiens
agccacagtctgtagccagctt

SEQ ID NO: 9092758 - DNA, 22 bp, Homo sapiens
agccacagtctgtagccagctt

SEQ ID NO: 9092759 - DNA, 22 bp, Homo sapiens
agccacaggaaacagagacagc

SEQ ID NO: 9092760 - DNA, 22 bp, Homo sapiens
agcataggcggtggtaggaccc

SEQ ID NO: 9092761 - DNA, 22 bp, Homo sapiens
agcatatacaaactcatataca

SEQ ID NO: 9092762 - DNA, 22 bp, Homo sapiens
agcatatacaaactcatataca

SEQ ID NO: 9092763 - DNA, 22 bp, Homo sapiens
agccagacatggctcctgctcc

SEQ ID NO: 9092764 - DNA, 20 bp, Homo sapiens
agccagaagaaggctggaga

SEQ ID NO: 9092765 - DNA, 20 bp, Homo sapiens
agccagaagaaggctggaga

SEQ ID NO: 9092766 - DNA, 22 bp, Homo sapiens
agccagagaacagcaggaaatg

SEQ ID NO: 9092767 - DNA, 22 bp, Homo sapiens
agccagagactttacctgtgca

SEQ ID NO: 9092768 - DNA, 22 bp, Homo sapiens
agccagagactgtgtctgtaat

SEQ ID NO: 9092769 - DNA, 22 bp, Homo sapiens
cagacaggaagttcagaagaaa

SEQ ID NO: 9092770 - DNA, 22 bp, Homo sapiens
agccagagagccccaggttcta

SEQ ID NO: 9092771 - DNA, 22 bp, Homo sapiens
cagacagggtgggtttctgggc

SEQ ID NO: 9092772 - DNA, 22 bp, Homo sapiens
cagacaggtagggacagaacat

SEQ ID NO: 9092773 - DNA, 22 bp, Homo sapiens
cagacaggtagggacagaacat

SEQ ID NO: 9092774 - DNA, 22 bp, Homo sapiens
cagacaggtagggacagaacat

SEQ ID NO: 9092775 - DNA, 22 bp, Homo sapiens
cagacagtgttagagtcaagct

SEQ ID NO: 9092776 - DNA, 21 bp, Homo sapiens
cagacatgagtctcagctttg

SEQ ID NO: 9092777 - DNA, 22 bp, Homo sapiens
cagacatgatgtaagcagaggc

SEQ ID NO: 9092778 - DNA, 21 bp, Homo sapiens
cagacatgagtctcagctttg

SEQ ID NO: 9092779 - DNA, 22 bp, Homo sapiens
cagacatgagatacagctgcta

SEQ ID NO: 9092780 - DNA, 22 bp, Homo sapiens
cagacatcacactcagattgca

SEQ ID NO: 9092781 - DNA, 22 bp, Homo sapiens
cagacatccaggtacgagcttt

SEQ ID NO: 9092782 - DNA, 20 bp, Homo sapiens
cagacatctccaaatctgtg

SEQ ID NO: 9092783 - DNA, 19 bp, Homo sapiens
agccagaactagtgtttct

SEQ ID NO: 9092784 - DNA, 22 bp, Homo sapiens
agccagaaaggggcattatctg

SEQ ID NO: 9092785 - DNA, 22 bp, Homo sapiens
agccagaaaaacaccaagagga

SEQ ID NO: 9092786 - DNA, 22 bp, Homo sapiens
cagaatgtattctcataaagcc

SEQ ID NO: 9092787 - DNA, 22 bp, Homo sapiens
cagaatgtatatgatctaaggt

SEQ ID NO: 9092788 - DNA, 22 bp, Homo sapiens
cagaatccacaacagaagttga

SEQ ID NO: 9092789 - DNA, 22 bp, Homo sapiens
cagaatccatgacagacgttga

SEQ ID NO: 9092790 - DNA, 21 bp, Homo sapiens
cagaatccagtctcttattac

SEQ ID NO: 9092791 - DNA, 22 bp, Homo sapiens
cagaatcagtgacacatgtata

SEQ ID NO: 9092792 - DNA, 22 bp, Homo sapiens
cagaatgcattgcttctgatgg

SEQ ID NO: 9092793 - DNA, 22 bp, Homo sapiens
cagaatgagtagcatcttcacc

SEQ ID NO: 9092794 - DNA, 22 bp, Homo sapiens
cagaatgcaaattttataatat

SEQ ID NO: 9092795 - DNA, 22 bp, Homo sapiens
cagaatgagtagcatcttcacc

SEQ ID NO: 9092796 - DNA, 22 bp, Homo sapiens
cagaatgagataacccagattg

SEQ ID NO: 9092797 - DNA, 22 bp, Homo sapiens
cagaatgaaatgtaagaacacc

SEQ ID NO: 9092798 - DNA, 22 bp, Homo sapiens
agcccagccggattcccagttc

SEQ ID NO: 9092799 - DNA, 21 bp, Homo sapiens
cagaggcaggctctgtgtgtg

SEQ ID NO: 9092800 - DNA, 22 bp, Homo sapiens
cagaggcagtggggttgctcct

SEQ ID NO: 9092801 - DNA, 21 bp, Homo sapiens
cagaggcaggtcctgggacgg

SEQ ID NO: 9092802 - DNA, 22 bp, Homo sapiens
cagaggcatactcccagtcttg

SEQ ID NO: 9092803 - DNA, 22 bp, Homo sapiens
cagaggcatataattgctgggg

SEQ ID NO: 9092804 - DNA, 23 bp, Homo sapiens
cagaggcatcggattcaacatca

SEQ ID NO: 9092805 - DNA, 22 bp, Homo sapiens
cagaggcattactgaaaaggtg

SEQ ID NO: 9092806 - DNA, 22 bp, Homo sapiens
cagaggctcttcctcactgccc

SEQ ID NO: 9092807 - DNA, 22 bp, Homo sapiens
cagaggctcttcctcactgccc

SEQ ID NO: 9092808 - DNA, 22 bp, Homo sapiens
agcccagggaaccaggaagtgg

SEQ ID NO: 9092809 - DNA, 22 bp, Homo sapiens
cagagggagtttctgaggttgc

SEQ ID NO: 9092810 - DNA, 22 bp, Homo sapiens
cagagggagccctccaggagca

SEQ ID NO: 9092811 - DNA, 22 bp, Homo sapiens
cagagggaccagaacatactgt

SEQ ID NO: 9092812 - DNA, 22 bp, Homo sapiens
cagagggacagtgtaatgcata

SEQ ID NO: 9092813 - DNA, 22 bp, Homo sapiens
agcccaggctggagtgcagtgg

SEQ ID NO: 9092814 - DNA, 22 bp, Homo sapiens
agcccaggctggagtgcagtgg

SEQ ID NO: 9092815 - DNA, 20 bp, Homo sapiens
agcccaggcctgtgtgagtc

SEQ ID NO: 9092816 - DNA, 22 bp, Homo sapiens
cagagaaactcagatagctgat

SEQ ID NO: 9092817 - DNA, 22 bp, Homo sapiens
cagagaaactcagatagctgat

SEQ ID NO: 9092818 - DNA, 22 bp, Homo sapiens
cagagaaaaaatcctgctctca

SEQ ID NO: 9092819 - DNA, 22 bp, Homo sapiens
cagactttctgactcccttgcc

SEQ ID NO: 9092820 - DNA, 22 bp, Homo sapiens
cagacatggaaatttagtgtta

SEQ ID NO: 9092821 - DNA, 22 bp, Homo sapiens
cagacatgatgtaagcagaggc

SEQ ID NO: 9092822 - DNA, 22 bp, Homo sapiens
cagacatgatgtaagcagaggc

SEQ ID NO: 9092823 - DNA, 22 bp, Homo sapiens
cagacatggaaatttagtgtta

SEQ ID NO: 9092824 - DNA, 22 bp, Homo sapiens
cagagaaaaaatcctgctctca

SEQ ID NO: 9092825 - DNA, 22 bp, Homo sapiens
agcccaagctatgaggtgacct

SEQ ID NO: 9092826 - DNA, 22 bp, Homo sapiens
agcccaagcataggagggaggc

SEQ ID NO: 9092827 - DNA, 22 bp, Homo sapiens
cagagaaagggtgaattccttc

SEQ ID NO: 9092828 - DNA, 22 bp, Homo sapiens
cagagaaagaagcccattcatt

SEQ ID NO: 9092829 - DNA, 22 bp, Homo sapiens
agcccagaggctgggcgtgcat

SEQ ID NO: 9092830 - DNA, 22 bp, Homo sapiens
agcccaaggcttccctgctggc

SEQ ID NO: 9092831 - DNA, 22 bp, Homo sapiens
agcccaatcctagcactttgag

SEQ ID NO: 9092832 - DNA, 22 bp, Homo sapiens
agcccaaggcttccctgctggc

SEQ ID NO: 9092833 - DNA, 23 bp, Homo sapiens
agcccagcagagaacctaggtcc

SEQ ID NO: 9092834 - DNA, 22 bp, Homo sapiens
agcccagcactgggggcccagc

SEQ ID NO: 9092835 - DNA, 22 bp, Homo sapiens
agcccagcagaaagtccagcct

SEQ ID NO: 9092836 - DNA, 22 bp, Homo sapiens
actcttcaccgctactgaaata

SEQ ID NO: 9092837 - DNA, 22 bp, Homo sapiens
agtgcaatagcaaagaacaaca

SEQ ID NO: 9092838 - DNA, 22 bp, Homo sapiens
actcttcacacttgtctccagg

SEQ ID NO: 9092839 - DNA, 22 bp, Homo sapiens
agtgcagtggttaggagccagg

SEQ ID NO: 9092840 - DNA, 22 bp, Homo sapiens
agtgcagggggaaagggtgtct

SEQ ID NO: 9092841 - DNA, 22 bp, Homo sapiens
actctgtgttttggtggcagca

SEQ ID NO: 9092842 - DNA, 22 bp, Homo sapiens
actctgtgctggggacctcatc

SEQ ID NO: 9092843 - DNA, 22 bp, Homo sapiens
actctgtgtgagtagagcctgt

SEQ ID NO: 9092844 - DNA, 22 bp, Homo sapiens
actctgtgtgagtagagcctgt

SEQ ID NO: 9092845 - DNA, 22 bp, Homo sapiens
actctgtgaagatgcaggcttg

SEQ ID NO: 9092846 - DNA, 20 bp, Homo sapiens
actgagctgcatggagagga

SEQ ID NO: 9092847 - DNA, 22 bp, Homo sapiens
actgaggctagattgctgttct

SEQ ID NO: 9092848 - DNA, 22 bp, Homo sapiens
actgagggccaaaggcactgag

SEQ ID NO: 9092849 - DNA, 20 bp, Homo sapiens
agtgcatggagggagagggc

SEQ ID NO: 9092850 - DNA, 22 bp, Homo sapiens
agtgcatgcgcttgggaggggt

SEQ ID NO: 9092851 - DNA, 22 bp, Homo sapiens
actcctgtgggcatggcacccc

SEQ ID NO: 9092852 - DNA, 22 bp, Homo sapiens
agtcccagttcggttcttcctc

SEQ ID NO: 9092853 - DNA, 22 bp, Homo sapiens
agtcccagtgagatgagccacg

SEQ ID NO: 9092854 - DNA, 22 bp, Homo sapiens
agtcccagtgagatgaaccagg

SEQ ID NO: 9092855 - DNA, 22 bp, Homo sapiens
agtcccagtgacttggccagaa

SEQ ID NO: 9092856 - DNA, 22 bp, Homo sapiens
agtcccagtgagatgagccacg

SEQ ID NO: 9092857 - DNA, 22 bp, Homo sapiens
agtcccagtgagatgagccacg

SEQ ID NO: 9092858 - DNA, 22 bp, Homo sapiens
agtcccagtgacttggccagaa

SEQ ID NO: 9092859 - DNA, 22 bp, Homo sapiens
agtcccagcttcccccatgcag

SEQ ID NO: 9092860 - DNA, 22 bp, Homo sapiens
agtcccagcttcccccatgcag

SEQ ID NO: 9092861 - DNA, 22 bp, Homo sapiens
agtcccaggcagccgagccggt

SEQ ID NO: 9092862 - DNA, 22 bp, Homo sapiens
agtcccaggcagccgagccggt

SEQ ID NO: 9092863 - DNA, 22 bp, Homo sapiens
agtcttctgtttttcagcagct

SEQ ID NO: 9092864 - DNA, 22 bp, Homo sapiens
agtctgtctaatattattcagg

SEQ ID NO: 9092865 - DNA, 23 bp, Homo sapiens
actcgtggaattctctgcgatcg

SEQ ID NO: 9092866 - DNA, 23 bp, Homo sapiens
actcgtggaattctctgcgatcg

SEQ ID NO: 9092867 - DNA, 23 bp, Homo sapiens
actcgtggaattctctgcgatcg

SEQ ID NO: 9092868 - DNA, 22 bp, Homo sapiens
agtcttgtcttattttaataga

SEQ ID NO: 9092869 - DNA, 22 bp, Homo sapiens
agtcttgtcttattttaataga

SEQ ID NO: 9092870 - DNA, 22 bp, Homo sapiens
agtcttggtccaggctcatttc

SEQ ID NO: 9092871 - DNA, 19 bp, Homo sapiens
agtcttgtatttttcaagc

SEQ ID NO: 9092872 - DNA, 22 bp, Homo sapiens
actgcagcaaagcccgtgtctt

SEQ ID NO: 9092873 - DNA, 22 bp, Homo sapiens
actgcacttcagcctgggtgtc

SEQ ID NO: 9092874 - DNA, 22 bp, Homo sapiens
actgcacttcagcctgggtgtc

SEQ ID NO: 9092875 - DNA, 22 bp, Homo sapiens
actgcacttcagcctgggtgtc

SEQ ID NO: 9092876 - DNA, 22 bp, Homo sapiens
actgcacttcagcctgggtgtc

SEQ ID NO: 9092877 - DNA, 22 bp, Homo sapiens
actgcacttcagcctgggtgtc

SEQ ID NO: 9092878 - DNA, 22 bp, Homo sapiens
agtgtacatcagaacatatcaa

SEQ ID NO: 9092879 - DNA, 20 bp, Homo sapiens
agtgtacagacactagaaat

SEQ ID NO: 9092880 - DNA, 22 bp, Homo sapiens
agtggcagggctggctgctgca

SEQ ID NO: 9092881 - DNA, 22 bp, Homo sapiens
agtggcagggctggctgctgca

SEQ ID NO: 9092882 - DNA, 22 bp, Homo sapiens
agtggcagtaacattccacaat

SEQ ID NO: 9092883 - DNA, 22 bp, Homo sapiens
agtggcagagccagggttggga

SEQ ID NO: 9092884 - DNA, 22 bp, Homo sapiens
agtggcagagccagggttggga

SEQ ID NO: 9092885 - DNA, 21 bp, Homo sapiens
actgagggccagagaggacct

SEQ ID NO: 9092886 - DNA, 22 bp, Homo sapiens
agtggcagtggctgggcagagc

SEQ ID NO: 9092887 - DNA, 22 bp, Homo sapiens
actgcacttcagcctgggtgac

SEQ ID NO: 9092888 - DNA, 22 bp, Homo sapiens
actgcacttcagcctgggtgac

SEQ ID NO: 9092889 - DNA, 22 bp, Homo sapiens
actgcacttcagcctgggtgac

SEQ ID NO: 9092890 - DNA, 22 bp, Homo sapiens
actgcacttcagcctgggtgac

SEQ ID NO: 9092891 - DNA, 22 bp, Homo sapiens
agtggcagtagatgagctggtt

SEQ ID NO: 9092892 - DNA, 22 bp, Homo sapiens
agtggcagtggaaagcacacgg

SEQ ID NO: 9092893 - DNA, 21 bp, Homo sapiens
actggaagtgggtcaggaagt

SEQ ID NO: 9092894 - DNA, 22 bp, Homo sapiens
agtgtgtgaccttttaatttaa

SEQ ID NO: 9092895 - DNA, 22 bp, Homo sapiens
actgctttatctgagaagtcct

SEQ ID NO: 9092896 - DNA, 23 bp, Homo sapiens
actgctttattcatgaggctctc

SEQ ID NO: 9092897 - DNA, 21 bp, Homo sapiens
agtgtgtgataggcaggaaga

SEQ ID NO: 9092898 - DNA, 23 bp, Homo sapiens
agtgttggttgggaagccaagca

SEQ ID NO: 9092899 - DNA, 22 bp, Homo sapiens
agtgtttaaactgaagtgatga

SEQ ID NO: 9092900 - DNA, 22 bp, Homo sapiens
agtgttgtatgggatgactgct

SEQ ID NO: 9092901 - DNA, 22 bp, Homo sapiens
agtgttgtcaaacggctcagca

SEQ ID NO: 9092902 - DNA, 22 bp, Homo sapiens
actggctttgcctctgcctctc

SEQ ID NO: 9092903 - DNA, 22 bp, Homo sapiens
actggctttgagggaatagcta

SEQ ID NO: 9092904 - DNA, 20 bp, Homo sapiens
agtgtttagaatactattat

SEQ ID NO: 9092905 - DNA, 22 bp, Homo sapiens
agtgtttaccccaatcagttta

SEQ ID NO: 9092906 - DNA, 22 bp, Homo sapiens
aggtcctgtctatcaccctcgc

SEQ ID NO: 9092907 - DNA, 22 bp, Homo sapiens
aggtcctgtctatcaccctcgc

SEQ ID NO: 9092908 - DNA, 22 bp, Homo sapiens
aggtcctgtcttatctctgtaa

SEQ ID NO: 9092909 - DNA, 22 bp, Homo sapiens
aggtcctgtcttatctctgtaa

SEQ ID NO: 9092910 - DNA, 22 bp, Homo sapiens
aggtcctgtggtttgggtaaaa

SEQ ID NO: 9092911 - DNA, 22 bp, Homo sapiens
aggtcctgtgtccaggggcctg

SEQ ID NO: 9092912 - DNA, 20 bp, Homo sapiens
aggtcctgttccttgtctcc

SEQ ID NO: 9092913 - DNA, 20 bp, Homo sapiens
aggtcctgttccttgtctcc

SEQ ID NO: 9092914 - DNA, 22 bp, Homo sapiens
aggtcgagtttcggggctactt

SEQ ID NO: 9092915 - DNA, 22 bp, Homo sapiens
aggtccttggttgtctgaagaa

SEQ ID NO: 9092916 - DNA, 22 bp, Homo sapiens
aggtcctgtttcttccctgggg

SEQ ID NO: 9092917 - DNA, 22 bp, Homo sapiens
aggtcctgtttcttccctgggg

SEQ ID NO: 9092918 - DNA, 22 bp, Homo sapiens
aggtccttaacatagtgatatc

SEQ ID NO: 9092919 - DNA, 19 bp, Homo sapiens
aggtccttggctggaagtt

SEQ ID NO: 9092920 - DNA, 19 bp, Homo sapiens
aggtctaatcataagacaa

SEQ ID NO: 9092921 - DNA, 22 bp, Homo sapiens
aggtctctgagtactgctggac

SEQ ID NO: 9092922 - DNA, 22 bp, Homo sapiens
acctggagtcatttgaggagta

SEQ ID NO: 9092923 - DNA, 22 bp, Homo sapiens
acctggagtcatttgaggagta

SEQ ID NO: 9092924 - DNA, 22 bp, Homo sapiens
acctggcataagggcttgagtc

SEQ ID NO: 9092925 - DNA, 22 bp, Homo sapiens
aggtggctatgaggatgcagtc

SEQ ID NO: 9092926 - DNA, 22 bp, Homo sapiens
aggtggccggtgccagccgggc

SEQ ID NO: 9092927 - DNA, 22 bp, Homo sapiens
aggtggcatttacaccatggga

SEQ ID NO: 9092928 - DNA, 22 bp, Homo sapiens
aggtggcatgcctgagacataa

SEQ ID NO: 9092929 - DNA, 22 bp, Homo sapiens
acctgccagaatgctagtcctg

SEQ ID NO: 9092930 - DNA, 22 bp, Homo sapiens
acctgcaggcacaggtgtgcgc

SEQ ID NO: 9092931 - DNA, 22 bp, Homo sapiens
acctgcagctgagaaaatgact

SEQ ID NO: 9092932 - DNA, 22 bp, Homo sapiens
acctgcagccacttctctcctt

SEQ ID NO: 9092933 - DNA, 22 bp, Homo sapiens
acctgcagctaaagatgtaggg

SEQ ID NO: 9092934 - DNA, 22 bp, Homo sapiens
acctgcaggggtgctctctggg

SEQ ID NO: 9092935 - DNA, 22 bp, Homo sapiens
acctgcaggtgtttccacactt

SEQ ID NO: 9092936 - DNA, 19 bp, Homo sapiens
acctgcagtaataattcct

SEQ ID NO: 9092937 - DNA, 22 bp, Homo sapiens
acctgcagtggccactcctaat

SEQ ID NO: 9092938 - DNA, 22 bp, Homo sapiens
acctgagacttgggatgggaat

SEQ ID NO: 9092939 - DNA, 22 bp, Homo sapiens
acctgagcatgccaggagagtg

SEQ ID NO: 9092940 - DNA, 22 bp, Homo sapiens
acctgagcatgccaggagagtg

SEQ ID NO: 9092941 - DNA, 22 bp, Homo sapiens
acctgagacctaatctgactgt

SEQ ID NO: 9092942 - DNA, 22 bp, Homo sapiens
acctgagacttgggatgggaat

SEQ ID NO: 9092943 - DNA, 22 bp, Homo sapiens
acctgagcctagggaggttgag

SEQ ID NO: 9092944 - DNA, 21 bp, Homo sapiens
acctgagctccacctcctgcc

SEQ ID NO: 9092945 - DNA, 22 bp, Homo sapiens
acctgagcctagggaggttgag

SEQ ID NO: 9092946 - DNA, 22 bp, Homo sapiens
acctgaggaagggcgagaagct

SEQ ID NO: 9092947 - DNA, 22 bp, Homo sapiens
acctgaggcctccccagcagac

SEQ ID NO: 9092948 - DNA, 22 bp, Homo sapiens
acctgaggactggatggtagaa

SEQ ID NO: 9092949 - DNA, 22 bp, Homo sapiens
acctgaggcctccccagcagac

SEQ ID NO: 9092950 - DNA, 22 bp, Homo sapiens
acctgaggcctccccagcagac

SEQ ID NO: 9092951 - DNA, 22 bp, Homo sapiens
acctgaggctgttagtctaggt

SEQ ID NO: 9092952 - DNA, 22 bp, Homo sapiens
acctgagggagattaggcctga

SEQ ID NO: 9092953 - DNA, 22 bp, Homo sapiens
acctgaggctgttagtctaggt

SEQ ID NO: 9092954 - DNA, 22 bp, Homo sapiens
acctgaggctgttagtctaggt

SEQ ID NO: 9092955 - DNA, 22 bp, Homo sapiens
acctgaggctgttagtctaggt

SEQ ID NO: 9092956 - DNA, 20 bp, Homo sapiens
acctgaggtccctatggtct

SEQ ID NO: 9092957 - DNA, 22 bp, Homo sapiens
acctgagggcccaaacttggta

SEQ ID NO: 9092958 - DNA, 22 bp, Homo sapiens
acctgagggcccaaacttggta

SEQ ID NO: 9092959 - DNA, 22 bp, Homo sapiens
accctcccatttccatgtagca

SEQ ID NO: 9092960 - DNA, 19 bp, Homo sapiens
accctctcagtgcctgagg

SEQ ID NO: 9092961 - DNA, 22 bp, Homo sapiens
accctctgagaggcacactttg

SEQ ID NO: 9092962 - DNA, 19 bp, Homo sapiens
accctctgccacaagcctc

SEQ ID NO: 9092963 - DNA, 19 bp, Homo sapiens
accctctcagtgcctgagg

SEQ ID NO: 9092964 - DNA, 22 bp, Homo sapiens
acctgaaaccaacttgtgtact

SEQ ID NO: 9092965 - DNA, 22 bp, Homo sapiens
acctgagaatgggggcatgtgt

SEQ ID NO: 9092966 - DNA, 22 bp, Homo sapiens
acctctgtatagttgcctgtgg

SEQ ID NO: 9092967 - DNA, 22 bp, Homo sapiens
acctcttaatattgcaccttct

SEQ ID NO: 9092968 - DNA, 22 bp, Homo sapiens
acctctttgaacctcagtgtga

SEQ ID NO: 9092969 - DNA, 22 bp, Homo sapiens
acctctggccttcaggcatcat

SEQ ID NO: 9092970 - DNA, 22 bp, Homo sapiens
acctctgggaaaagtatggaaa

SEQ ID NO: 9092971 - DNA, 22 bp, Homo sapiens
actaggagaaaacttacactga

SEQ ID NO: 9092972 - DNA, 22 bp, Homo sapiens
actaggggctcaggcccaggga

SEQ ID NO: 9092973 - DNA, 22 bp, Homo sapiens
actaggaacggggtttgcactc

SEQ ID NO: 9092974 - DNA, 22 bp, Homo sapiens
actaggaaggcatatgggcaga

SEQ ID NO: 9092975 - DNA, 22 bp, Homo sapiens
actaggaagtggcaaaactgga

SEQ ID NO: 9092976 - DNA, 22 bp, Homo sapiens
actaggaattcaagtagacaga

SEQ ID NO: 9092977 - DNA, 22 bp, Homo sapiens
actaggaattcaagtagacaga

SEQ ID NO: 9092978 - DNA, 22 bp, Homo sapiens
actaggggctcaggcccaggga

SEQ ID NO: 9092979 - DNA, 22 bp, Homo sapiens
agtatactgaaagtaaatatga

SEQ ID NO: 9092980 - DNA, 22 bp, Homo sapiens
agtatttgatacagtcttctag

SEQ ID NO: 9092981 - DNA, 22 bp, Homo sapiens
agtatttgtggatttgtattgg

SEQ ID NO: 9092982 - DNA, 22 bp, Homo sapiens
agtattttcgccatcacaagaa

SEQ ID NO: 9092983 - DNA, 22 bp, Homo sapiens
agtattttcgccatcacaagaa

SEQ ID NO: 9092984 - DNA, 22 bp, Homo sapiens
actcaggcttcaggcacagctg

SEQ ID NO: 9092985 - DNA, 22 bp, Homo sapiens
actcaggctacaggggcagaag

SEQ ID NO: 9092986 - DNA, 22 bp, Homo sapiens
agtcccagctctgccacttact

SEQ ID NO: 9092987 - DNA, 22 bp, Homo sapiens
agtcccagctcagaaccactag

SEQ ID NO: 9092988 - DNA, 22 bp, Homo sapiens
agtcccagctactcaagaggct

SEQ ID NO: 9092989 - DNA, 22 bp, Homo sapiens
actcaggcactcagccctcgcc

SEQ ID NO: 9092990 - DNA, 22 bp, Homo sapiens
agtcaaataagactgtcataag

SEQ ID NO: 9092991 - DNA, 22 bp, Homo sapiens
agtcaacagagtggccgcagcg

SEQ ID NO: 9092992 - DNA, 22 bp, Homo sapiens
agtcaacacctggttctattac

SEQ ID NO: 9092993 - DNA, 22 bp, Homo sapiens
agtaaacactgtctttatatat

SEQ ID NO: 9092994 - DNA, 22 bp, Homo sapiens
actagattttggccattataca

SEQ ID NO: 9092995 - DNA, 22 bp, Homo sapiens
agtaaaacagagaaatcactca

SEQ ID NO: 9092996 - DNA, 22 bp, Homo sapiens
agtaaaatcaccatctctttgt

SEQ ID NO: 9092997 - DNA, 22 bp, Homo sapiens
agtaaaatcttaagcacagtgg

SEQ ID NO: 9092998 - DNA, 22 bp, Homo sapiens
agtaaaatttctgctgaggaga

SEQ ID NO: 9092999 - DNA, 22 bp, Homo sapiens
agtaaaattgtattggaaaaca

SEQ ID NO: 9093000 - DNA, 22 bp, Homo sapiens
agtaaacacgtggggtttcttt

SEQ ID NO: 9093001 - DNA, 22 bp, Homo sapiens
agtaaacacgtggggtttcttt

SEQ ID NO: 9093002 - DNA, 22 bp, Homo sapiens
agtaaacactaaaatgactgcg

SEQ ID NO: 9093003 - DNA, 22 bp, Homo sapiens
agtaaacactaaaatgactgcg

SEQ ID NO: 9093004 - DNA, 22 bp, Homo sapiens
acggaatgagtcttgaaaagtg

SEQ ID NO: 9093005 - DNA, 22 bp, Homo sapiens
acgcctgtaatcccagcacttt

SEQ ID NO: 9093006 - DNA, 22 bp, Homo sapiens
acgcctgtaatcccagcacttt

SEQ ID NO: 9093007 - DNA, 22 bp, Homo sapiens
aggttcttggtgtccagatttc

SEQ ID NO: 9093008 - DNA, 22 bp, Homo sapiens
aggttcttttggccaacctcat

SEQ ID NO: 9093009 - DNA, 22 bp, Homo sapiens
acggcttcttgactgtgggttg

SEQ ID NO: 9093010 - DNA, 22 bp, Homo sapiens
agtaaaaattgaggtgcaaaat

SEQ ID NO: 9093011 - DNA, 22 bp, Homo sapiens
agtaaaaattgaggtgcaaaat

SEQ ID NO: 9093012 - DNA, 22 bp, Homo sapiens
aggttgaacccccaagacctat

SEQ ID NO: 9093013 - DNA, 22 bp, Homo sapiens
agtaaaaattgaggtgcaaaat

SEQ ID NO: 9093014 - DNA, 22 bp, Homo sapiens
aggtggctcctcccatggctgg

SEQ ID NO: 9093015 - DNA, 20 bp, Homo sapiens
aggtggctcctgctgggggt

SEQ ID NO: 9093016 - DNA, 22 bp, Homo sapiens
acgatgtggcctgaatcaggca

SEQ ID NO: 9093017 - DNA, 22 bp, Homo sapiens
acgcagaagggcctggcgtgcc

SEQ ID NO: 9093018 - DNA, 22 bp, Homo sapiens
acgcctgtaatcccagcacttt

SEQ ID NO: 9093019 - DNA, 22 bp, Homo sapiens
acgcccagactcccatactttg

SEQ ID NO: 9093020 - DNA, 22 bp, Homo sapiens
acgcagtttgtggacatttttt

SEQ ID NO: 9093021 - DNA, 19 bp, Homo sapiens
agaacagctttttgtgaca

SEQ ID NO: 9093022 - DNA, 18 bp, Homo sapiens
atcctgggagcagacagc

SEQ ID NO: 9093023 - DNA, 22 bp, Homo sapiens
atcggcaagccccacaccgtcc

SEQ ID NO: 9093024 - DNA, 22 bp, Homo sapiens
atcgaataattgcattctataa

SEQ ID NO: 9093025 - DNA, 22 bp, Homo sapiens
atcgagatgaaacgcatgtttt

SEQ ID NO: 9093026 - DNA, 22 bp, Homo sapiens
atcatcttaaatctagaatgtg

SEQ ID NO: 9093027 - DNA, 22 bp, Homo sapiens
atcatcttcgaaaaaagtcaga

SEQ ID NO: 9093028 - DNA, 22 bp, Homo sapiens
atcatcttgaaagtctatgttt

SEQ ID NO: 9093029 - DNA, 22 bp, Homo sapiens
atcatcttaaggtatctcaagc

SEQ ID NO: 9093030 - DNA, 22 bp, Homo sapiens
atctaattttcactcatttgct

SEQ ID NO: 9093031 - DNA, 23 bp, Homo sapiens
atctaatttctccaaatctctac

SEQ ID NO: 9093032 - DNA, 22 bp, Homo sapiens
atctaagattttgctaagatca

SEQ ID NO: 9093033 - DNA, 16 bp, Homo sapiens
atctaagatgtgcatt

SEQ ID NO: 9093034 - DNA, 22 bp, Homo sapiens
atctaagatgtattgagcactt

SEQ ID NO: 9093035 - DNA, 22 bp, Homo sapiens
atctcaaagcatggagcagaat

SEQ ID NO: 9093036 - DNA, 22 bp, Homo sapiens
atctcaaagcatggagcagaat

SEQ ID NO: 9093037 - DNA, 21 bp, Homo sapiens
atctcacagcccagagaagcc

SEQ ID NO: 9093038 - DNA, 22 bp, Homo sapiens
atctcacatcctcagtagtgca

SEQ ID NO: 9093039 - DNA, 22 bp, Homo sapiens
atctaaaaggagctctttatct

SEQ ID NO: 9093040 - DNA, 22 bp, Homo sapiens
atctaaaaggagctctttatct

SEQ ID NO: 9093041 - DNA, 22 bp, Homo sapiens
atctaagagagagagcatgtct

SEQ ID NO: 9093042 - DNA, 22 bp, Homo sapiens
atctaagaggatggttggaaat

SEQ ID NO: 9093043 - DNA, 16 bp, Homo sapiens
atctaagaatgtagag

SEQ ID NO: 9093044 - DNA, 22 bp, Homo sapiens
atctaactgggctattttattg

SEQ ID NO: 9093045 - DNA, 22 bp, Homo sapiens
atctaacttatgttttaccaaa

SEQ ID NO: 9093046 - DNA, 22 bp, Homo sapiens
atctaaagtgtttcatgaaaga

SEQ ID NO: 9093047 - DNA, 22 bp, Homo sapiens
atctaaactgtttactctctgc

SEQ ID NO: 9093048 - DNA, 22 bp, Homo sapiens
atctaaagtgtcataagtagct

SEQ ID NO: 9093049 - DNA, 23 bp, Homo sapiens
atctaaagtgttaaatagctggg

SEQ ID NO: 9093050 - DNA, 22 bp, Homo sapiens
agaacagccaataaaagagggg

SEQ ID NO: 9093051 - DNA, 22 bp, Homo sapiens
agaacagcagttatggttcatt

SEQ ID NO: 9093052 - DNA, 22 bp, Homo sapiens
agaacagcagcacgtcaagctg

SEQ ID NO: 9093053 - DNA, 22 bp, Homo sapiens
agaacagaagggaggaaggcct

SEQ ID NO: 9093054 - DNA, 22 bp, Homo sapiens
agaacagcaacatcagacaaag

SEQ ID NO: 9093055 - DNA, 22 bp, Homo sapiens
agaaagtttgagaactgtagat

SEQ ID NO: 9093056 - DNA, 22 bp, Homo sapiens
agaaagggttctctgaggtgct

SEQ ID NO: 9093057 - DNA, 22 bp, Homo sapiens
agaaagggttctctgaggtgct

SEQ ID NO: 9093058 - DNA, 22 bp, Homo sapiens
agaaagtacagatgagacactt

SEQ ID NO: 9093059 - DNA, 22 bp, Homo sapiens
agaaagggtcactgaaagagga

SEQ ID NO: 9093060 - DNA, 22 bp, Homo sapiens
agaaagctggaagagctgggat

SEQ ID NO: 9093061 - DNA, 22 bp, Homo sapiens
agaaagttagcagactcttggc

SEQ ID NO: 9093062 - DNA, 22 bp, Homo sapiens
agaaagtgtgtcatactaagtg

SEQ ID NO: 9093063 - DNA, 18 bp, Homo sapiens
atatgcttgagctaagga

SEQ ID NO: 9093064 - DNA, 20 bp, Homo sapiens
actttctcggtttctcacct

SEQ ID NO: 9093065 - DNA, 22 bp, Homo sapiens
actttctcccacccacccgtct

SEQ ID NO: 9093066 - DNA, 22 bp, Homo sapiens
actttctcaggaattcacagac

SEQ ID NO: 9093067 - DNA, 22 bp, Homo sapiens
actttctccagaaaaccaagga

SEQ ID NO: 9093068 - DNA, 19 bp, Homo sapiens
actttctccaggacctgtt

SEQ ID NO: 9093069 - DNA, 22 bp, Homo sapiens
agaaaaggttgaaagtaggatt

SEQ ID NO: 9093070 - DNA, 22 bp, Homo sapiens
agaaaaggttgaaagtaggatt

SEQ ID NO: 9093071 - DNA, 22 bp, Homo sapiens
atatggaatggtaatctacaat

SEQ ID NO: 9093072 - DNA, 22 bp, Homo sapiens
atatggatgagataatgagcca

SEQ ID NO: 9093073 - DNA, 22 bp, Homo sapiens
atatggaagttacctgacttca

SEQ ID NO: 9093074 - DNA, 18 bp, Homo sapiens
atatggaatgcctggcta

SEQ ID NO: 9093075 - DNA, 22 bp, Homo sapiens
atatggaactattctgtgtaga

SEQ ID NO: 9093076 - DNA, 22 bp, Homo sapiens
atatggaaatagcaatatggtt

SEQ ID NO: 9093077 - DNA, 22 bp, Homo sapiens
atatggaactattctgtgtaga

SEQ ID NO: 9093078 - DNA, 22 bp, Homo sapiens
atatggaaatagcaatatggtt

SEQ ID NO: 9093079 - DNA, 22 bp, Homo sapiens
atatgctttgggattagatcat

SEQ ID NO: 9093080 - DNA, 22 bp, Homo sapiens
actttcctagacttcagtgaca

SEQ ID NO: 9093081 - DNA, 22 bp, Homo sapiens
actttcctggccctgtcctctg

SEQ ID NO: 9093082 - DNA, 22 bp, Homo sapiens
actttctatggcttattatgag

SEQ ID NO: 9093083 - DNA, 22 bp, Homo sapiens
actttctatggcttattatgag

SEQ ID NO: 9093084 - DNA, 22 bp, Homo sapiens
actttctattcccacagagata

SEQ ID NO: 9093085 - DNA, 22 bp, Homo sapiens
actttctaggtgctattgtgat

SEQ ID NO: 9093086 - DNA, 22 bp, Homo sapiens
actttctattgtttagattctg

SEQ ID NO: 9093087 - DNA, 22 bp, Homo sapiens
actttctcaaatcagactttaa

SEQ ID NO: 9093088 - DNA, 22 bp, Homo sapiens
actttcagaattgtacagagtc

SEQ ID NO: 9093089 - DNA, 22 bp, Homo sapiens
actttcaagaacttctttaatg

SEQ ID NO: 9093090 - DNA, 22 bp, Homo sapiens
atatttataagcaagcaggact

SEQ ID NO: 9093091 - DNA, 22 bp, Homo sapiens
atatttataagcaagcaggact

SEQ ID NO: 9093092 - DNA, 22 bp, Homo sapiens
atatttataaggcaggcaagta

SEQ ID NO: 9093093 - DNA, 22 bp, Homo sapiens
atatttataagcaagcaggact

SEQ ID NO: 9093094 - DNA, 22 bp, Homo sapiens
atatttataagcaagcaggact

SEQ ID NO: 9093095 - DNA, 22 bp, Homo sapiens
atattcttccaaaacatcattt

SEQ ID NO: 9093096 - DNA, 22 bp, Homo sapiens
atattcttatccttttctctgt

SEQ ID NO: 9093097 - DNA, 22 bp, Homo sapiens
atatttataaggcaggcaagta

SEQ ID NO: 9093098 - DNA, 21 bp, Homo sapiens
atatttctcataaggttatgg

SEQ ID NO: 9093099 - DNA, 21 bp, Homo sapiens
atatttctcataaggttatgg

SEQ ID NO: 9093100 - DNA, 22 bp, Homo sapiens
atatttcatggggttccatact

SEQ ID NO: 9093101 - DNA, 17 bp, Homo sapiens
atattccaagggcttgg

SEQ ID NO: 9093102 - DNA, 22 bp, Homo sapiens
atattcattgaacacctactac

SEQ ID NO: 9093103 - DNA, 22 bp, Homo sapiens
atattctctgctgcttttgtgt

SEQ ID NO: 9093104 - DNA, 22 bp, Homo sapiens
atattctctgctgcttttgtgt

SEQ ID NO: 9093105 - DNA, 22 bp, Homo sapiens
atattctagccaaagtgtgagc

SEQ ID NO: 9093106 - DNA, 22 bp, Homo sapiens
agaaaagttttctgagactgac

SEQ ID NO: 9093107 - DNA, 22 bp, Homo sapiens
agaaaagtttaaatcttggcac

SEQ ID NO: 9093108 - DNA, 22 bp, Homo sapiens
agaaaagtgctctagtgagagc

SEQ ID NO: 9093109 - DNA, 21 bp, Homo sapiens
agaaaagtatttgaatcaaga

SEQ ID NO: 9093110 - DNA, 22 bp, Homo sapiens
actgtatttccaacagacaaat

SEQ ID NO: 9093111 - DNA, 22 bp, Homo sapiens
actgtatttggatataagatct

SEQ ID NO: 9093112 - DNA, 22 bp, Homo sapiens
actgtattggaaatatagcaaa

SEQ ID NO: 9093113 - DNA, 22 bp, Homo sapiens
actgtattttgggtgtattttc

SEQ ID NO: 9093114 - DNA, 22 bp, Homo sapiens
actgtattctagtcatgtttgt

SEQ ID NO: 9093115 - DNA, 22 bp, Homo sapiens
actgtattcctactagaatcta

SEQ ID NO: 9093116 - DNA, 22 bp, Homo sapiens
actgtcactgacagaatcaaca

SEQ ID NO: 9093117 - DNA, 22 bp, Homo sapiens
actgtcactccaactgagtcgt

SEQ ID NO: 9093118 - DNA, 22 bp, Homo sapiens
actgtcaccatcagagcgggaa

SEQ ID NO: 9093119 - DNA, 22 bp, Homo sapiens
actgtactttcccaagcacaca

SEQ ID NO: 9093120 - DNA, 22 bp, Homo sapiens
actgtaaattttggttgcaggt

SEQ ID NO: 9093121 - DNA, 22 bp, Homo sapiens
actgtgcatttgtcatggggtt

SEQ ID NO: 9093122 - DNA, 22 bp, Homo sapiens
actgtgcatgaaccgaaacaaa

SEQ ID NO: 9093123 - DNA, 22 bp, Homo sapiens
actgtgcatttcatgtcttttc

SEQ ID NO: 9093124 - DNA, 22 bp, Homo sapiens
actgtgcaggggaagagagaaa

SEQ ID NO: 9093125 - DNA, 21 bp, Homo sapiens
actgtgcagcctgaggatgtg

SEQ ID NO: 9093126 - DNA, 22 bp, Homo sapiens
actgtgcaccctggacagtgtc

SEQ ID NO: 9093127 - DNA, 22 bp, Homo sapiens
ataatgcacctttgagtatggc

SEQ ID NO: 9093128 - DNA, 22 bp, Homo sapiens
ataatgagaatacagtaactat

SEQ ID NO: 9093129 - DNA, 22 bp, Homo sapiens
ataatgagcttttgaatactga

SEQ ID NO: 9093130 - DNA, 22 bp, Homo sapiens
ataatgaggatttgcatattag

SEQ ID NO: 9093131 - DNA, 22 bp, Homo sapiens
ataatgaatgcagagttatttt

SEQ ID NO: 9093132 - DNA, 22 bp, Homo sapiens
ataatgaatgcagagttatttt

SEQ ID NO: 9093133 - DNA, 22 bp, Homo sapiens
ataatctgagctatttcatgag

SEQ ID NO: 9093134 - DNA, 22 bp, Homo sapiens
ataatctggtctttgtatgagt

SEQ ID NO: 9093135 - DNA, 22 bp, Homo sapiens
ataatcttgtatttcctaaagt

SEQ ID NO: 9093136 - DNA, 22 bp, Homo sapiens
actgtgatgcagttgccatcca

SEQ ID NO: 9093137 - DNA, 22 bp, Homo sapiens
actgtgcaagtcaaagatgggc

SEQ ID NO: 9093138 - DNA, 22 bp, Homo sapiens
actgtgatgtttgtgatcatct

SEQ ID NO: 9093139 - DNA, 22 bp, Homo sapiens
ataaacaagactggccaacttt

SEQ ID NO: 9093140 - DNA, 22 bp, Homo sapiens
ataaacaagactggccaacttt

SEQ ID NO: 9093141 - DNA, 22 bp, Homo sapiens
ataaaatttgctactgttaaat

SEQ ID NO: 9093142 - DNA, 22 bp, Homo sapiens
ataaaatttgctactgttaaat

SEQ ID NO: 9093143 - DNA, 22 bp, Homo sapiens
ataaaatttgctactgttaaat

SEQ ID NO: 9093144 - DNA, 22 bp, Homo sapiens
ataaaatttgctactgttaaat

SEQ ID NO: 9093145 - DNA, 22 bp, Homo sapiens
atacagcctattcttaccattg

SEQ ID NO: 9093146 - DNA, 22 bp, Homo sapiens
atacagcagtgaataagataaa

SEQ ID NO: 9093147 - DNA, 22 bp, Homo sapiens
atacagcagtgaataagataaa

SEQ ID NO: 9093148 - DNA, 22 bp, Homo sapiens
atacagcagcccttgctttgca

SEQ ID NO: 9093149 - DNA, 22 bp, Homo sapiens
atacagcagtgaataagataaa

SEQ ID NO: 9093150 - DNA, 22 bp, Homo sapiens
atacagattgctatacttacaa

SEQ ID NO: 9093151 - DNA, 22 bp, Homo sapiens
atacagggacatccagtttttc

SEQ ID NO: 9093152 - DNA, 22 bp, Homo sapiens
acttctcttcataggtggcaat

SEQ ID NO: 9093153 - DNA, 22 bp, Homo sapiens
acttctctttagtactaaatgt

SEQ ID NO: 9093154 - DNA, 22 bp, Homo sapiens
atacacttgtacattttttaat

SEQ ID NO: 9093155 - DNA, 22 bp, Homo sapiens
atacagatgttaaagcaatttc

SEQ ID NO: 9093156 - DNA, 22 bp, Homo sapiens
atacagatgttaaagcaatttc

SEQ ID NO: 9093157 - DNA, 19 bp, Homo sapiens
acttaatccctatctcttg

SEQ ID NO: 9093158 - DNA, 22 bp, Homo sapiens
acttaccagagaggatccgccc

SEQ ID NO: 9093159 - DNA, 22 bp, Homo sapiens
ataatgcatttagaataattca

SEQ ID NO: 9093160 - DNA, 22 bp, Homo sapiens
ataatggcatgacagttatata

SEQ ID NO: 9093161 - DNA, 22 bp, Homo sapiens
ataatggactcagtaatagtga

SEQ ID NO: 9093162 - DNA, 21 bp, Homo sapiens
acttaaattccttgatattta

SEQ ID NO: 9093163 - DNA, 23 bp, Homo sapiens
acttaaatggttctttatctcag

SEQ ID NO: 9093164 - DNA, 22 bp, Homo sapiens
acttaacagacattatttacct

SEQ ID NO: 9093165 - DNA, 22 bp, Homo sapiens
acttaacagacattatttacct

SEQ ID NO: 9093166 - DNA, 22 bp, Homo sapiens
atactgtatcacttgtgagtga

SEQ ID NO: 9093167 - DNA, 22 bp, Homo sapiens
actttatttcctattgcatcca

SEQ ID NO: 9093168 - DNA, 22 bp, Homo sapiens
actttatcaggaatcacacagc

SEQ ID NO: 9093169 - DNA, 22 bp, Homo sapiens
acttcttgggaccctggcaccg

SEQ ID NO: 9093170 - DNA, 22 bp, Homo sapiens
atacatgttcgtgtacatgttc

SEQ ID NO: 9093171 - DNA, 22 bp, Homo sapiens
acttctggtgtcatactgcatt

SEQ ID NO: 9093172 - DNA, 22 bp, Homo sapiens
atacattagaatctggtactca

SEQ ID NO: 9093173 - DNA, 22 bp, Homo sapiens
atacattagctcatatgattaa

SEQ ID NO: 9093174 - DNA, 22 bp, Homo sapiens
atacattagctcatatgattaa

SEQ ID NO: 9093175 - DNA, 22 bp, Homo sapiens
atacattagtgaacaaaagaga

SEQ ID NO: 9093176 - DNA, 22 bp, Homo sapiens
acaggagaaatctggtcaaaag

SEQ ID NO: 9093177 - DNA, 22 bp, Homo sapiens
acaggaggggcatgaaagacgg

SEQ ID NO: 9093178 - DNA, 22 bp, Homo sapiens
acaggagtgaatctggcactta

SEQ ID NO: 9093179 - DNA, 22 bp, Homo sapiens
agctggattccagtgcagtcac

SEQ ID NO: 9093180 - DNA, 19 bp, Homo sapiens
agctggcactagaatccag

SEQ ID NO: 9093181 - DNA, 22 bp, Homo sapiens
agctggtggattatgctgtaca

SEQ ID NO: 9093182 - DNA, 22 bp, Homo sapiens
agctggtggagcctttctgttt

SEQ ID NO: 9093183 - DNA, 22 bp, Homo sapiens
agctggtggattatgctgtaca

SEQ ID NO: 9093184 - DNA, 22 bp, Homo sapiens
agctggtggggaagctgcaggt

SEQ ID NO: 9093185 - DNA, 18 bp, Homo sapiens
agctggtggggagacagc

SEQ ID NO: 9093186 - DNA, 22 bp, Homo sapiens
acaggagtttctgacagagaca

SEQ ID NO: 9093187 - DNA, 22 bp, Homo sapiens
agctggtggagaagcagacctc

SEQ ID NO: 9093188 - DNA, 22 bp, Homo sapiens
acaggagtttaagaaatatttc

SEQ ID NO: 9093189 - DNA, 22 bp, Homo sapiens
agctggtgtcctcctggagctg

SEQ ID NO: 9093190 - DNA, 22 bp, Homo sapiens
agctggtgtcctcctggagctg

SEQ ID NO: 9093191 - DNA, 22 bp, Homo sapiens
agctggtgtcctcctggagctg

SEQ ID NO: 9093192 - DNA, 22 bp, Homo sapiens
agctggtgtcctcctggagctg

SEQ ID NO: 9093193 - DNA, 22 bp, Homo sapiens
agctggtgtcctcctggagctg

SEQ ID NO: 9093194 - DNA, 22 bp, Homo sapiens
agctggtgtgccactgttgggg

SEQ ID NO: 9093195 - DNA, 22 bp, Homo sapiens
agctggtgtgccactgttgggg

SEQ ID NO: 9093196 - DNA, 21 bp, Homo sapiens
agctggtgtcagagctctggg

SEQ ID NO: 9093197 - DNA, 22 bp, Homo sapiens
agctggtgtcacctccagtcca

SEQ ID NO: 9093198 - DNA, 21 bp, Homo sapiens
agctggtgtcagagctctggg

SEQ ID NO: 9093199 - DNA, 22 bp, Homo sapiens
agctggtgtgccagttccagtt

SEQ ID NO: 9093200 - DNA, 22 bp, Homo sapiens
agctggtgtgccagttccagtt

SEQ ID NO: 9093201 - DNA, 22 bp, Homo sapiens
agctggtgtgctctggaatcct

SEQ ID NO: 9093202 - DNA, 22 bp, Homo sapiens
acaggcagagtcaggttgggtt

SEQ ID NO: 9093203 - DNA, 22 bp, Homo sapiens
acaggcacctccaggggtatgt

SEQ ID NO: 9093204 - DNA, 22 bp, Homo sapiens
agctgaagctcagcccagtagt

SEQ ID NO: 9093205 - DNA, 22 bp, Homo sapiens
agctgaaggctagaacagctgg

SEQ ID NO: 9093206 - DNA, 22 bp, Homo sapiens
agctgaaggctagaacagctgg

SEQ ID NO: 9093207 - DNA, 22 bp, Homo sapiens
agctgaagcagtcagttcagct

SEQ ID NO: 9093208 - DNA, 22 bp, Homo sapiens
agctgagagcccctgccctgtg

SEQ ID NO: 9093209 - DNA, 22 bp, Homo sapiens
agctgagacacttgagagacta

SEQ ID NO: 9093210 - DNA, 22 bp, Homo sapiens
agctgaagggaggatatgtaca

SEQ ID NO: 9093211 - DNA, 22 bp, Homo sapiens
agctgacagtgcatggagggac

SEQ ID NO: 9093212 - DNA, 22 bp, Homo sapiens
agctgagaggtggcaagctgta

SEQ ID NO: 9093213 - DNA, 22 bp, Homo sapiens
acagctggcaggggggcatgaa

SEQ ID NO: 9093214 - DNA, 22 bp, Homo sapiens
acagctggcaggggggcatgaa

SEQ ID NO: 9093215 - DNA, 22 bp, Homo sapiens
acagctgggaatcagctgggga

SEQ ID NO: 9093216 - DNA, 22 bp, Homo sapiens
acagctggccgaggctcaggga

SEQ ID NO: 9093217 - DNA, 22 bp, Homo sapiens
acagctggccgaggctcaggga

SEQ ID NO: 9093218 - DNA, 21 bp, Homo sapiens
acagctggccgcgcgggtcgg

SEQ ID NO: 9093219 - DNA, 22 bp, Homo sapiens
agctggaggggccagcaggtgt

SEQ ID NO: 9093220 - DNA, 22 bp, Homo sapiens
agctggaggggccagcaggtgt

SEQ ID NO: 9093221 - DNA, 22 bp, Homo sapiens
acagctggtgaatgttctctgt

SEQ ID NO: 9093222 - DNA, 22 bp, Homo sapiens
acagctgtatccccagagctca

SEQ ID NO: 9093223 - DNA, 21 bp, Homo sapiens
acagctggtgcagggcgggga

SEQ ID NO: 9093224 - DNA, 22 bp, Homo sapiens
acagctgggtgctgctcagagc

SEQ ID NO: 9093225 - DNA, 22 bp, Homo sapiens
acagctgggtgtcccacttctg

SEQ ID NO: 9093226 - DNA, 22 bp, Homo sapiens
acagctgggtgtcccacttctg

SEQ ID NO: 9093227 - DNA, 22 bp, Homo sapiens
acagggagatgggtgaaagcgg

SEQ ID NO: 9093228 - DNA, 22 bp, Homo sapiens
acagggaagttctgcaacagga

SEQ ID NO: 9093229 - DNA, 22 bp, Homo sapiens
acagggaaggagcatagaaaaa

SEQ ID NO: 9093230 - DNA, 22 bp, Homo sapiens
acaggcaggcttcggccagagc

SEQ ID NO: 9093231 - DNA, 22 bp, Homo sapiens
acaggcagggacctcttgagtt

SEQ ID NO: 9093232 - DNA, 22 bp, Homo sapiens
acaggcagggacctcttgagtt

SEQ ID NO: 9093233 - DNA, 22 bp, Homo sapiens
acagggaagctcaggggctctg

SEQ ID NO: 9093234 - DNA, 22 bp, Homo sapiens
acaggcagggaccttggctaag

SEQ ID NO: 9093235 - DNA, 22 bp, Homo sapiens
acaggctgttggggtccagggt

SEQ ID NO: 9093236 - DNA, 22 bp, Homo sapiens
acaggcagattaagggtaggca

SEQ ID NO: 9093237 - DNA, 22 bp, Homo sapiens
acaggcagcactaatctctggt

SEQ ID NO: 9093238 - DNA, 22 bp, Homo sapiens
acaggcagcaaaatcagcctca

SEQ ID NO: 9093239 - DNA, 22 bp, Homo sapiens
acaggcagcgtcattgctgctc

SEQ ID NO: 9093240 - DNA, 22 bp, Homo sapiens
acaggcaggagctccccattcc

SEQ ID NO: 9093241 - DNA, 22 bp, Homo sapiens
acaggcaggcgggacagcccga

SEQ ID NO: 9093242 - DNA, 21 bp, Homo sapiens
aggaagaaaggttggaggttg

SEQ ID NO: 9093243 - DNA, 22 bp, Homo sapiens
aggaagaaatgtgacttcaaac

SEQ ID NO: 9093244 - DNA, 22 bp, Homo sapiens
aggaagaatgtttacatatcaa

SEQ ID NO: 9093245 - DNA, 22 bp, Homo sapiens
aggaagaatgtttacatatcaa

SEQ ID NO: 9093246 - DNA, 22 bp, Homo sapiens
aggaagacaatctgtgtgctgt

SEQ ID NO: 9093247 - DNA, 22 bp, Homo sapiens
aggacacacaaagagtgagaac

SEQ ID NO: 9093248 - DNA, 19 bp, Homo sapiens
acaggggcctttccagggt

SEQ ID NO: 9093249 - DNA, 19 bp, Homo sapiens
acaggggctagcggaagca

SEQ ID NO: 9093250 - DNA, 22 bp, Homo sapiens
aggacacaccaggtccagctgt

SEQ ID NO: 9093251 - DNA, 22 bp, Homo sapiens
aggacacaccaggtccagctgt

SEQ ID NO: 9093252 - DNA, 22 bp, Homo sapiens
aggacacacccagctcacgggg

SEQ ID NO: 9093253 - DNA, 22 bp, Homo sapiens
aggacacactgttctcacgtaa

SEQ ID NO: 9093254 - DNA, 22 bp, Homo sapiens
aggacacacttctgaggtcttt

SEQ ID NO: 9093255 - DNA, 22 bp, Homo sapiens
aggcagctaagatggataatga

SEQ ID NO: 9093256 - DNA, 22 bp, Homo sapiens
acatagtaagtgctcagtaaat

SEQ ID NO: 9093257 - DNA, 17 bp, Homo sapiens
aggcagctcagaacatc

SEQ ID NO: 9093258 - DNA, 17 bp, Homo sapiens
aggcagctcagaacatc

SEQ ID NO: 9093259 - DNA, 22 bp, Homo sapiens
aggcagctaagatggataatga

SEQ ID NO: 9093260 - DNA, 22 bp, Homo sapiens
aggcagctagagagtgaaactg

SEQ ID NO: 9093261 - DNA, 22 bp, Homo sapiens
acatagcataaagaatgactct

SEQ ID NO: 9093262 - DNA, 22 bp, Homo sapiens
acatagcacgtctcaatttgga

SEQ ID NO: 9093263 - DNA, 22 bp, Homo sapiens
acatagaacttcccagtgagca

SEQ ID NO: 9093264 - DNA, 22 bp, Homo sapiens
acatagaacttcccagtgagca

SEQ ID NO: 9093265 - DNA, 22 bp, Homo sapiens
acatagaaggaagagtagtagg

SEQ ID NO: 9093266 - DNA, 22 bp, Homo sapiens
acatagaacttcccagtgagca

SEQ ID NO: 9093267 - DNA, 22 bp, Homo sapiens
acatagaacttcgatgtctttt

SEQ ID NO: 9093268 - DNA, 22 bp, Homo sapiens
acatagaacttcgatgtctttt

SEQ ID NO: 9093269 - DNA, 22 bp, Homo sapiens
acatagagttcaattttcagtc

SEQ ID NO: 9093270 - DNA, 22 bp, Homo sapiens
acatagagttcaattttcagtc

SEQ ID NO: 9093271 - DNA, 20 bp, Homo sapiens
acatagatcagtgattgaca

SEQ ID NO: 9093272 - DNA, 22 bp, Homo sapiens
acatagagatgtgtttctatac

SEQ ID NO: 9093273 - DNA, 22 bp, Homo sapiens
acatagatctgtgattcattct

SEQ ID NO: 9093274 - DNA, 22 bp, Homo sapiens
acatagatctgtgattcattct

SEQ ID NO: 9093275 - DNA, 22 bp, Homo sapiens
acatatctgtgaggttttgttg

SEQ ID NO: 9093276 - DNA, 22 bp, Homo sapiens
acatatgttgtaaacattccaa

SEQ ID NO: 9093277 - DNA, 22 bp, Homo sapiens
aggcagctggacataactaacc

SEQ ID NO: 9093278 - DNA, 22 bp, Homo sapiens
aggcagctggacataactaacc

SEQ ID NO: 9093279 - DNA, 22 bp, Homo sapiens
acatattgagctctaaaagtac

SEQ ID NO: 9093280 - DNA, 22 bp, Homo sapiens
acatattgagctctaaaagtac

SEQ ID NO: 9093281 - DNA, 22 bp, Homo sapiens
acatatttccatgcagcatgtc

SEQ ID NO: 9093282 - DNA, 17 bp, Homo sapiens
aggcagctcagaacatc

SEQ ID NO: 9093283 - DNA, 21 bp, Homo sapiens
aggcagctcaggcccagagag

SEQ ID NO: 9093284 - DNA, 21 bp, Homo sapiens
aggcagctcaggcccagagag

SEQ ID NO: 9093285 - DNA, 22 bp, Homo sapiens
aggcagctgaccacagtatgat

SEQ ID NO: 9093286 - DNA, 22 bp, Homo sapiens
aggcagctctgtggcctcccag

SEQ ID NO: 9093287 - DNA, 22 bp, Homo sapiens
aggcagctctgtggcctcccag

SEQ ID NO: 9093288 - DNA, 22 bp, Homo sapiens
aggcagctgaccacagtatgat

SEQ ID NO: 9093289 - DNA, 21 bp, Homo sapiens
aggcagctggaaggcctggct

SEQ ID NO: 9093290 - DNA, 21 bp, Homo sapiens
aggcagctggaaggcctggct

SEQ ID NO: 9093291 - DNA, 22 bp, Homo sapiens
aggcagctggaaaactccaggc

SEQ ID NO: 9093292 - DNA, 22 bp, Homo sapiens
aggcagctgccctctccttcct

SEQ ID NO: 9093293 - DNA, 22 bp, Homo sapiens
aggcagctgccctctccttcct

SEQ ID NO: 9093294 - DNA, 22 bp, Homo sapiens
aggcagctgaggtctggcgccc

SEQ ID NO: 9093295 - DNA, 22 bp, Homo sapiens
aggcagctgaggtctggcgccc

SEQ ID NO: 9093296 - DNA, 22 bp, Homo sapiens
aggcagctgaggtctggcgccc

SEQ ID NO: 9093297 - DNA, 22 bp, Homo sapiens
aggatgagagatacatggagca

SEQ ID NO: 9093298 - DNA, 22 bp, Homo sapiens
aggatgagagatacatggagca

SEQ ID NO: 9093299 - DNA, 22 bp, Homo sapiens
acagtgtgttggaggagactgt

SEQ ID NO: 9093300 - DNA, 22 bp, Homo sapiens
acagtgtgttggaggagactgt

SEQ ID NO: 9093301 - DNA, 22 bp, Homo sapiens
acagtgtgttctgggacctcca

SEQ ID NO: 9093302 - DNA, 22 bp, Homo sapiens
aggatgagattccagggtcaat

SEQ ID NO: 9093303 - DNA, 22 bp, Homo sapiens
aggatgagattgctgtgttgta

SEQ ID NO: 9093304 - DNA, 22 bp, Homo sapiens
aggatgagattgctgtgttgta

SEQ ID NO: 9093305 - DNA, 22 bp, Homo sapiens
aggatgaggctggacacttctt

SEQ ID NO: 9093306 - DNA, 22 bp, Homo sapiens
aggatgaggctggacacttctt

SEQ ID NO: 9093307 - DNA, 22 bp, Homo sapiens
aggatgagccgcgcaagctgac

SEQ ID NO: 9093308 - DNA, 22 bp, Homo sapiens
aggatgagccgcgcaagctgac

SEQ ID NO: 9093309 - DNA, 22 bp, Homo sapiens
aggatgaggctggcaggtcttg

SEQ ID NO: 9093310 - DNA, 22 bp, Homo sapiens
aggatgaggctggcaggtcttg

SEQ ID NO: 9093311 - DNA, 21 bp, Homo sapiens
acagttcatgataactccatc

SEQ ID NO: 9093312 - DNA, 22 bp, Homo sapiens
acagtttaggatgagagaacac

SEQ ID NO: 9093313 - DNA, 22 bp, Homo sapiens
acagtttagagcatgatgacca

SEQ ID NO: 9093314 - DNA, 22 bp, Homo sapiens
acagtttagagcatgatgacca

SEQ ID NO: 9093315 - DNA, 22 bp, Homo sapiens
acagtttataaaaataatgagg

SEQ ID NO: 9093316 - DNA, 20 bp, Homo sapiens
acagtttatccagttagcag

SEQ ID NO: 9093317 - DNA, 22 bp, Homo sapiens
aggcactgggggatgagcaagg

SEQ ID NO: 9093318 - DNA, 22 bp, Homo sapiens
aggcactgggtaattagtagct

SEQ ID NO: 9093319 - DNA, 20 bp, Homo sapiens
aggcactggggataggtaag

SEQ ID NO: 9093320 - DNA, 22 bp, Homo sapiens
aggcactgggaatatgctgagg

SEQ ID NO: 9093321 - DNA, 20 bp, Homo sapiens
aggcactggatttcttatat

SEQ ID NO: 9093322 - DNA, 22 bp, Homo sapiens
aggcactgcttctaagtaggaa

SEQ ID NO: 9093323 - DNA, 18 bp, Homo sapiens
aggcactggaattaaggg

SEQ ID NO: 9093324 - DNA, 22 bp, Homo sapiens
acagtttattgcacaggtaacc

SEQ ID NO: 9093325 - DNA, 20 bp, Homo sapiens
acagtttattttacttggtt

SEQ ID NO: 9093326 - DNA, 22 bp, Homo sapiens
acagtttgaataatttagatag

SEQ ID NO: 9093327 - DNA, 22 bp, Homo sapiens
acagtttgcactgttcatcaaa

SEQ ID NO: 9093328 - DNA, 21 bp, Homo sapiens
acagtttattagagtaagtgc

SEQ ID NO: 9093329 - DNA, 22 bp, Homo sapiens
acagtttatggtgttttatata

SEQ ID NO: 9093330 - DNA, 21 bp, Homo sapiens
acagtttattagagtaagtgc

SEQ ID NO: 9093331 - DNA, 21 bp, Homo sapiens
acagtttattagagtaagtgc

SEQ ID NO: 9093332 - DNA, 21 bp, Homo sapiens
acagtttattagagtaagtgc

SEQ ID NO: 9093333 - DNA, 20 bp, Homo sapiens
acaggttcattctgtgtgac

SEQ ID NO: 9093334 - DNA, 22 bp, Homo sapiens
aggacacagctgctctgcagag

SEQ ID NO: 9093335 - DNA, 22 bp, Homo sapiens
aggacacagctgctctgcagag

SEQ ID NO: 9093336 - DNA, 22 bp, Homo sapiens
aggacacagactgattgcagca

SEQ ID NO: 9093337 - DNA, 22 bp, Homo sapiens
aggacacagactgattgcagca

SEQ ID NO: 9093338 - DNA, 22 bp, Homo sapiens
aggagcagaccgtagtcctgca

SEQ ID NO: 9093339 - DNA, 22 bp, Homo sapiens
acagtacaccactgtgtacagt

SEQ ID NO: 9093340 - DNA, 22 bp, Homo sapiens
aggagcagaccgtagtcctgca

SEQ ID NO: 9093341 - DNA, 22 bp, Homo sapiens
acagtatatatagtctaaaagc

SEQ ID NO: 9093342 - DNA, 22 bp, Homo sapiens
acagtatgaatgcagaatgtag

SEQ ID NO: 9093343 - DNA, 22 bp, Homo sapiens
aggagcaaatgatgagacagca

SEQ ID NO: 9093344 - DNA, 22 bp, Homo sapiens
aggagcagaactgttgtggagg

SEQ ID NO: 9093345 - DNA, 22 bp, Homo sapiens
aggagcactaattcctgcagag

SEQ ID NO: 9093346 - DNA, 22 bp, Homo sapiens
aggagcactgagccagcatggg

SEQ ID NO: 9093347 - DNA, 19 bp, Homo sapiens
aggagcactgccagcacca

SEQ ID NO: 9093348 - DNA, 22 bp, Homo sapiens
acagtgtctgacacattgtagc

SEQ ID NO: 9093349 - DNA, 20 bp, Homo sapiens
acagtgggtggggagcactg

SEQ ID NO: 9093350 - DNA, 22 bp, Homo sapiens
acagtgtctcctggtacccagt

SEQ ID NO: 9093351 - DNA, 22 bp, Homo sapiens
acagtctgagaattactgctct

SEQ ID NO: 9093352 - DNA, 22 bp, Homo sapiens
acagtctgcaggcaagttctac

SEQ ID NO: 9093353 - DNA, 22 bp, Homo sapiens
acagtctgcagggtgaacatgt

SEQ ID NO: 9093354 - DNA, 22 bp, Homo sapiens
acagtctgcatatgacctgtag

SEQ ID NO: 9093355 - DNA, 22 bp, Homo sapiens
acagtctgcttgtctccatggt

SEQ ID NO: 9093356 - DNA, 22 bp, Homo sapiens
acagtctgcttgtctccatggt

SEQ ID NO: 9093357 - DNA, 22 bp, Homo sapiens
acagtctgcctctcagagcagc

SEQ ID NO: 9093358 - DNA, 22 bp, Homo sapiens
acagtctgcctctcagagcagc

SEQ ID NO: 9093359 - DNA, 17 bp, Homo sapiens
acagtctgcctgacagt

SEQ ID NO: 9093360 - DNA, 17 bp, Homo sapiens
acagtctgcctgacagt

SEQ ID NO: 9093361 - DNA, 22 bp, Homo sapiens
acagtgtggttgtttctggtta

SEQ ID NO: 9093362 - DNA, 23 bp, Homo sapiens
acagtgtggtggacaaggagcag

SEQ ID NO: 9093363 - DNA, 22 bp, Homo sapiens
acagtgtgtgggaaatgtgact

SEQ ID NO: 9093364 - DNA, 22 bp, Homo sapiens
acagtgtgtgctttcccttacg

SEQ ID NO: 9093365 - DNA, 22 bp, Homo sapiens
acagtgtgtcctaaaggtctgg

SEQ ID NO: 9093366 - DNA, 22 bp, Homo sapiens
acagtgtgtcctaaaggtctgg

SEQ ID NO: 9093367 - DNA, 22 bp, Homo sapiens
acagtgtggtttgagcactggg

SEQ ID NO: 9093368 - DNA, 22 bp, Homo sapiens
acagtgtgggacattaggaaat

SEQ ID NO: 9093369 - DNA, 22 bp, Homo sapiens
acagtgtggaaagtcaacttga

SEQ ID NO: 9093370 - DNA, 22 bp, Homo sapiens
acagtgtggggtgagatggaac

SEQ ID NO: 9093371 - DNA, 22 bp, Homo sapiens
acagtgtggtgatggcacttgc

SEQ ID NO: 9093372 - DNA, 19 bp, Homo sapiens
acagtgtctgtatataaat

SEQ ID NO: 9093373 - DNA, 22 bp, Homo sapiens
acagtgtgacaattgtgtcaga

SEQ ID NO: 9093374 - DNA, 21 bp, Homo sapiens
acagtgtgcttctctccctcc

SEQ ID NO: 9093375 - DNA, 16 bp, Homo sapiens
acagtgtgctaagcat

SEQ ID NO: 9093376 - DNA, 22 bp, Homo sapiens
acagtgtgcaagaaatggggga

SEQ ID NO: 9093377 - DNA, 22 bp, Homo sapiens
acagtgtgatgggcctgcctga

SEQ ID NO: 9093378 - DNA, 22 bp, Homo sapiens
acagtctactaaacatcatcag

SEQ ID NO: 9093379 - DNA, 22 bp, Homo sapiens
acagtcctgttgtcaaagcaat

SEQ ID NO: 9093380 - DNA, 22 bp, Homo sapiens
acagtctaatcttgtgttctgt

SEQ ID NO: 9093381 - DNA, 22 bp, Homo sapiens
acagtcatagcagcctttgtta

SEQ ID NO: 9093382 - DNA, 22 bp, Homo sapiens
acagtcaatcagaacagcatgt

SEQ ID NO: 9093383 - DNA, 22 bp, Homo sapiens
acagtcaatcagaacagcatgt

SEQ ID NO: 9093384 - DNA, 22 bp, Homo sapiens
acagtcaatgagtgagtgaatg

SEQ ID NO: 9093385 - DNA, 19 bp, Homo sapiens
accagcccactcccagttt

SEQ ID NO: 9093386 - DNA, 19 bp, Homo sapiens
accagcccactcccagttt

SEQ ID NO: 9093387 - DNA, 22 bp, Homo sapiens
accagccaccaccaggagatcg

SEQ ID NO: 9093388 - DNA, 22 bp, Homo sapiens
accagcagttatgaggccagga

SEQ ID NO: 9093389 - DNA, 22 bp, Homo sapiens
accagcagcctagagcgttctt

SEQ ID NO: 9093390 - DNA, 22 bp, Homo sapiens
agggacagtatccatctcacag

SEQ ID NO: 9093391 - DNA, 22 bp, Homo sapiens
aggctttaattatctacaggag

SEQ ID NO: 9093392 - DNA, 22 bp, Homo sapiens
aggctttaagtggcctacagct

SEQ ID NO: 9093393 - DNA, 22 bp, Homo sapiens
aggcttgtggggaatctgtgtg

SEQ ID NO: 9093394 - DNA, 22 bp, Homo sapiens
aggctttaagcaagcatattgt

SEQ ID NO: 9093395 - DNA, 22 bp, Homo sapiens
aggctttaagcaagcatattgt

SEQ ID NO: 9093396 - DNA, 22 bp, Homo sapiens
aggcttggttaattctgtgtga

SEQ ID NO: 9093397 - DNA, 22 bp, Homo sapiens
aggcttggtttatagaagtaat

SEQ ID NO: 9093398 - DNA, 22 bp, Homo sapiens
aggcttgtctcagaagatgctg

SEQ ID NO: 9093399 - DNA, 22 bp, Homo sapiens
aggcttgggtcagaaggcttgt

SEQ ID NO: 9093400 - DNA, 18 bp, Homo sapiens
aggcttgggcccagcagc

SEQ ID NO: 9093401 - DNA, 22 bp, Homo sapiens
aggcttgggactgcttaggagc

SEQ ID NO: 9093402 - DNA, 20 bp, Homo sapiens
aggcttggcttggcaggaac

SEQ ID NO: 9093403 - DNA, 21 bp, Homo sapiens
agggcagattagctgtaagag

SEQ ID NO: 9093404 - DNA, 21 bp, Homo sapiens
agggcagattagctgtaagag

SEQ ID NO: 9093405 - DNA, 22 bp, Homo sapiens
agggcagcacaaggcatggact

SEQ ID NO: 9093406 - DNA, 22 bp, Homo sapiens
agggcagcacaaggcatggact

SEQ ID NO: 9093407 - DNA, 22 bp, Homo sapiens
agggcagcacaaggcatggact

SEQ ID NO: 9093408 - DNA, 22 bp, Homo sapiens
agggcagcagcggcccaggcct

SEQ ID NO: 9093409 - DNA, 22 bp, Homo sapiens
agggcagcagcggcccaggcct

SEQ ID NO: 9093410 - DNA, 22 bp, Homo sapiens
agggagagaagttatacaagat

SEQ ID NO: 9093411 - DNA, 22 bp, Homo sapiens
agggagagacatttccttcttg

SEQ ID NO: 9093412 - DNA, 22 bp, Homo sapiens
agggagagacatttccttcttg

SEQ ID NO: 9093413 - DNA, 18 bp, Homo sapiens
agggagagaccgcgggtc

SEQ ID NO: 9093414 - DNA, 18 bp, Homo sapiens
agggagagaccgcgggtc

SEQ ID NO: 9093415 - DNA, 22 bp, Homo sapiens
accagccccaccgggactgcag

SEQ ID NO: 9093416 - DNA, 22 bp, Homo sapiens
agggagaggagggtcttgttga

SEQ ID NO: 9093417 - DNA, 22 bp, Homo sapiens
accagcctgtctgagtcgtggg

SEQ ID NO: 9093418 - DNA, 22 bp, Homo sapiens
accagctcagaagccagaaaga

SEQ ID NO: 9093419 - DNA, 22 bp, Homo sapiens
accagcctggccaacatggcaa

SEQ ID NO: 9093420 - DNA, 22 bp, Homo sapiens
accagcctggccaacatggcaa

SEQ ID NO: 9093421 - DNA, 22 bp, Homo sapiens
accagcctggccaacatggtga

SEQ ID NO: 9093422 - DNA, 22 bp, Homo sapiens
accagcctgtctgagtcgtggg

SEQ ID NO: 9093423 - DNA, 22 bp, Homo sapiens
accagcctgtctgagtcgtggg

SEQ ID NO: 9093424 - DNA, 22 bp, Homo sapiens
accagcctggccaacatggtga

SEQ ID NO: 9093425 - DNA, 17 bp, Homo sapiens
accagcctctcctgggg

SEQ ID NO: 9093426 - DNA, 17 bp, Homo sapiens
accagcctctcctgggg

SEQ ID NO: 9093427 - DNA, 17 bp, Homo sapiens
accagcctctcctgggg

SEQ ID NO: 9093428 - DNA, 22 bp, Homo sapiens
accagccctcaggtcagatact

SEQ ID NO: 9093429 - DNA, 22 bp, Homo sapiens
accagcctcctagctgctcctg

SEQ ID NO: 9093430 - DNA, 22 bp, Homo sapiens
accagcctcctagctgctcctg

SEQ ID NO: 9093431 - DNA, 22 bp, Homo sapiens
accctcatgaagctggcctgga

SEQ ID NO: 9093432 - DNA, 22 bp, Homo sapiens
agggggctcagtgactgaagtg

SEQ ID NO: 9093433 - DNA, 22 bp, Homo sapiens
agggggcattatgaggcttttc

SEQ ID NO: 9093434 - DNA, 22 bp, Homo sapiens
agggggctcagcatggatggag

SEQ ID NO: 9093435 - DNA, 22 bp, Homo sapiens
agggggctcagcaggctctgga

SEQ ID NO: 9093436 - DNA, 22 bp, Homo sapiens
agggggaggctgtgctgcgtct

SEQ ID NO: 9093437 - DNA, 22 bp, Homo sapiens
aggggcctggacatggacgcgc

SEQ ID NO: 9093438 - DNA, 22 bp, Homo sapiens
agggggagtttcagttagaaag

SEQ ID NO: 9093439 - DNA, 22 bp, Homo sapiens
agggggcatcaggtcctggctc

SEQ ID NO: 9093440 - DNA, 22 bp, Homo sapiens
acccaggctggcagaggctcct

SEQ ID NO: 9093441 - DNA, 22 bp, Homo sapiens
acccaggctggagtgcagtgtc

SEQ ID NO: 9093442 - DNA, 22 bp, Homo sapiens
acccaggctggagtgcagtgtc

SEQ ID NO: 9093443 - DNA, 22 bp, Homo sapiens
acccaggctggagtgcagtggt

SEQ ID NO: 9093444 - DNA, 22 bp, Homo sapiens
acccaggctggagtgcagtggt

SEQ ID NO: 9093445 - DNA, 22 bp, Homo sapiens
acccaggctggagtgcagtggc

SEQ ID NO: 9093446 - DNA, 22 bp, Homo sapiens
acccaggctggagtgcagtggc

SEQ ID NO: 9093447 - DNA, 22 bp, Homo sapiens
acccaggctggagtgcagtggg

SEQ ID NO: 9093448 - DNA, 22 bp, Homo sapiens
acccaggctggagtgcagtggg

SEQ ID NO: 9093449 - DNA, 22 bp, Homo sapiens
acccaggctggagtgcagtgat

SEQ ID NO: 9093450 - DNA, 22 bp, Homo sapiens
acccaggctggagtgcagtgat

SEQ ID NO: 9093451 - DNA, 22 bp, Homo sapiens
agggctgcctgactccagagcc

SEQ ID NO: 9093452 - DNA, 22 bp, Homo sapiens
agggctgcctgctctgcattga

SEQ ID NO: 9093453 - DNA, 22 bp, Homo sapiens
acccaggctggagtgcagtgac

SEQ ID NO: 9093454 - DNA, 22 bp, Homo sapiens
acccaggctggagtgcagtgac

SEQ ID NO: 9093455 - DNA, 22 bp, Homo sapiens
acccagctctttgatggtcttg

SEQ ID NO: 9093456 - DNA, 22 bp, Homo sapiens
acccagctggatgcatggaggc

SEQ ID NO: 9093457 - DNA, 20 bp, Homo sapiens
acccagctctgtgccctggg

SEQ ID NO: 9093458 - DNA, 22 bp, Homo sapiens
agggctgcccagtgtgagagct

SEQ ID NO: 9093459 - DNA, 22 bp, Homo sapiens
accaggctggagtgcagtggcg

SEQ ID NO: 9093460 - DNA, 22 bp, Homo sapiens
accaggctggagtgcagtggcg

SEQ ID NO: 9093461 - DNA, 22 bp, Homo sapiens
accaggctgtgaagtgagacta

SEQ ID NO: 9093462 - DNA, 22 bp, Homo sapiens
acccagagccagggtcaggagc

SEQ ID NO: 9093463 - DNA, 22 bp, Homo sapiens
acccagcatgacacctgcacat

SEQ ID NO: 9093464 - DNA, 22 bp, Homo sapiens
acccagcatgacacctgcacat

SEQ ID NO: 9093465 - DNA, 22 bp, Homo sapiens
acccagcatgacacctgcacat

SEQ ID NO: 9093466 - DNA, 22 bp, Homo sapiens
acccagagtgtctgtctcagtc

SEQ ID NO: 9093467 - DNA, 22 bp, Homo sapiens
acccagccacagcattgaggga

SEQ ID NO: 9093468 - DNA, 22 bp, Homo sapiens
acccagccatgttcagttctct

SEQ ID NO: 9093469 - DNA, 22 bp, Homo sapiens
acccagcccagaatctggggcc

SEQ ID NO: 9093470 - DNA, 22 bp, Homo sapiens
acccagcccagaatctggggcc

SEQ ID NO: 9093471 - DNA, 22 bp, Homo sapiens
acccagcctacaaagctcacct

SEQ ID NO: 9093472 - DNA, 19 bp, Homo sapiens
acccagcccaggagtggca

SEQ ID NO: 9093473 - DNA, 19 bp, Homo sapiens
acccagcccaggagtggca

SEQ ID NO: 9093474 - DNA, 22 bp, Homo sapiens
acatgttgctaaatccaatggt

SEQ ID NO: 9093475 - DNA, 22 bp, Homo sapiens
acatgttagctactattgttat

SEQ ID NO: 9093476 - DNA, 22 bp, Homo sapiens
acatgttaaacatcatggaatg

SEQ ID NO: 9093477 - DNA, 22 bp, Homo sapiens
acatgttaaacatcatggaatg

SEQ ID NO: 9093478 - DNA, 22 bp, Homo sapiens
acatgttagaaatgcagaatct

SEQ ID NO: 9093479 - DNA, 22 bp, Homo sapiens
acatgttagaaatgcagaatct

SEQ ID NO: 9093480 - DNA, 22 bp, Homo sapiens
acatgtgttttcctacttatga

SEQ ID NO: 9093481 - DNA, 22 bp, Homo sapiens
aggccagggtcccacactcgca

SEQ ID NO: 9093482 - DNA, 22 bp, Homo sapiens
aggccaggcctttctccattcc

SEQ ID NO: 9093483 - DNA, 22 bp, Homo sapiens
aggccaggcctttctccattcc

SEQ ID NO: 9093484 - DNA, 22 bp, Homo sapiens
aggccagggcactgctctttag

SEQ ID NO: 9093485 - DNA, 22 bp, Homo sapiens
aggcctcttcagggagcatgga

SEQ ID NO: 9093486 - DNA, 22 bp, Homo sapiens
aggcctcttcagggagcatgga

SEQ ID NO: 9093487 - DNA, 18 bp, Homo sapiens
aggcctctgtgtgcccag

SEQ ID NO: 9093488 - DNA, 22 bp, Homo sapiens
aggcctctgtagggccctgaag

SEQ ID NO: 9093489 - DNA, 22 bp, Homo sapiens
aggcctctgggtctcctctgac

SEQ ID NO: 9093490 - DNA, 20 bp, Homo sapiens
aggcctgagagatgactggg

SEQ ID NO: 9093491 - DNA, 22 bp, Homo sapiens
aggcctgacttgaatttagggc

SEQ ID NO: 9093492 - DNA, 22 bp, Homo sapiens
aggcctgagcagaggagtggac

SEQ ID NO: 9093493 - DNA, 22 bp, Homo sapiens
aggcctgaggaccagataaatg

SEQ ID NO: 9093494 - DNA, 22 bp, Homo sapiens
aggcctgaggaccttctggagg

SEQ ID NO: 9093495 - DNA, 22 bp, Homo sapiens
aggcctgaagtgtggagtgggg

SEQ ID NO: 9093496 - DNA, 22 bp, Homo sapiens
aggcctgaaggaagatgagctg

SEQ ID NO: 9093497 - DNA, 22 bp, Homo sapiens
aggcctcttgtcttcctcacat

SEQ ID NO: 9093498 - DNA, 22 bp, Homo sapiens
aggcctctgggtctcctctgac

SEQ ID NO: 9093499 - DNA, 22 bp, Homo sapiens
acatgtttggctctatgctata

SEQ ID NO: 9093500 - DNA, 22 bp, Homo sapiens
acatgtttaagtttaatgaaaa

SEQ ID NO: 9093501 - DNA, 22 bp, Homo sapiens
acatgtttaagtttaatgaaaa

SEQ ID NO: 9093502 - DNA, 21 bp, Homo sapiens
acatccagggtcctcactgcc

SEQ ID NO: 9093503 - DNA, 22 bp, Homo sapiens
acatcatttctagttcctgtca

SEQ ID NO: 9093504 - DNA, 22 bp, Homo sapiens
acatcatgagagacttaaattg

SEQ ID NO: 9093505 - DNA, 23 bp, Homo sapiens
acatcatgatagccaacttggga

SEQ ID NO: 9093506 - DNA, 22 bp, Homo sapiens
acatcatgagagacttaaattg

SEQ ID NO: 9093507 - DNA, 22 bp, Homo sapiens
acatcattgtccgttgtcatga

SEQ ID NO: 9093508 - DNA, 22 bp, Homo sapiens
acatcacagagcccagataaag

SEQ ID NO: 9093509 - DNA, 22 bp, Homo sapiens
acatgccatgaaggtatttttg

SEQ ID NO: 9093510 - DNA, 22 bp, Homo sapiens
acatgccatggttgtttgctgc

SEQ ID NO: 9093511 - DNA, 22 bp, Homo sapiens
acatgccatctttgtcaggagt

SEQ ID NO: 9093512 - DNA, 22 bp, Homo sapiens
acatgccatctttgtcaggagt

SEQ ID NO: 9093513 - DNA, 22 bp, Homo sapiens
acatgccatcactttcattcct

SEQ ID NO: 9093514 - DNA, 22 bp, Homo sapiens
acatgccagcctcagcagcagt

SEQ ID NO: 9093515 - DNA, 22 bp, Homo sapiens
acatgctacacagagctcctcg

SEQ ID NO: 9093516 - DNA, 22 bp, Homo sapiens
acatgccagcactgcttttcag

SEQ ID NO: 9093517 - DNA, 22 bp, Homo sapiens
acatgccaatttggttagttca

SEQ ID NO: 9093518 - DNA, 22 bp, Homo sapiens
acatgccagcccatttaaatgg

SEQ ID NO: 9093519 - DNA, 22 bp, Homo sapiens
acatgccagcccatttaaatgg

SEQ ID NO: 9093520 - DNA, 22 bp, Homo sapiens
acatgcatacaagcacatgtag

SEQ ID NO: 9093521 - DNA, 22 bp, Homo sapiens
acatgctaggtacagatctaaa

SEQ ID NO: 9093522 - DNA, 22 bp, Homo sapiens
aggccaggcaacattctgaagt

SEQ ID NO: 9093523 - DNA, 22 bp, Homo sapiens
acatttcagaatcacacagctt

SEQ ID NO: 9093524 - DNA, 22 bp, Homo sapiens
acatttctaatttaatgtaaca

SEQ ID NO: 9093525 - DNA, 22 bp, Homo sapiens
aggcctgaggaccttctggagg

SEQ ID NO: 9093526 - DNA, 22 bp, Homo sapiens
aggcctgcagcaggagcaaacc

SEQ ID NO: 9093527 - DNA, 22 bp, Homo sapiens
aggcctgaggttcctgtgctca

SEQ ID NO: 9093528 - DNA, 18 bp, Homo sapiens
aggcctgcccagcactgt

SEQ ID NO: 9093529 - DNA, 22 bp, Homo sapiens
aggcctgagccccaggtttgtt

SEQ ID NO: 9093530 - DNA, 22 bp, Homo sapiens
aggctcttcttttattaactga

SEQ ID NO: 9093531 - DNA, 22 bp, Homo sapiens
aggctgaaaacgagatggcaat

SEQ ID NO: 9093532 - DNA, 22 bp, Homo sapiens
acattgcaataataattctctt

SEQ ID NO: 9093533 - DNA, 22 bp, Homo sapiens
acattgcaataataattctctt

SEQ ID NO: 9093534 - DNA, 22 bp, Homo sapiens
acattgatgtgatgcagaagtg

SEQ ID NO: 9093535 - DNA, 22 bp, Homo sapiens
acattgatgaaaaggtatcatt

SEQ ID NO: 9093536 - DNA, 22 bp, Homo sapiens
aggctgagaaagtgggaagatg

SEQ ID NO: 9093537 - DNA, 22 bp, Homo sapiens
aggctgagaaagtgggaagatg

SEQ ID NO: 9093538 - DNA, 22 bp, Homo sapiens
aggctgagactgtgcattagtg

SEQ ID NO: 9093539 - DNA, 22 bp, Homo sapiens
aggctgagactgtgcattagtg

SEQ ID NO: 9093540 - DNA, 22 bp, Homo sapiens
acattgatatttcaaatacagg

SEQ ID NO: 9093541 - DNA, 22 bp, Homo sapiens
acatttctcagggagttttgct

SEQ ID NO: 9093542 - DNA, 22 bp, Homo sapiens
aggctgagctggcccttgaaat

SEQ ID NO: 9093543 - DNA, 22 bp, Homo sapiens
aggctgaggagggatgttgctt

SEQ ID NO: 9093544 - DNA, 22 bp, Homo sapiens
aggctgaggagggatgttgctt

SEQ ID NO: 9093545 - DNA, 22 bp, Homo sapiens
acatttctcttagagttggact

SEQ ID NO: 9093546 - DNA, 22 bp, Homo sapiens
acatttctttctattcagtagc

SEQ ID NO: 9093547 - DNA, 22 bp, Homo sapiens
acatttgacatttagtatcagc

SEQ ID NO: 9093548 - DNA, 22 bp, Homo sapiens
acatttgactgtagatacttgc

SEQ ID NO: 9093549 - DNA, 17 bp, Homo sapiens
acatttgcaaaggtctg

SEQ ID NO: 9093550 - DNA, 23 bp, Homo sapiens
aagtacatatatttagatagtga

SEQ ID NO: 9093551 - DNA, 22 bp, Homo sapiens
aagtacatggaggatagctgct

SEQ ID NO: 9093552 - DNA, 22 bp, Homo sapiens
aagtacatgctgtaatgattgg

SEQ ID NO: 9093553 - DNA, 22 bp, Homo sapiens
aagtacatgctgtaatgattgg

SEQ ID NO: 9093554 - DNA, 22 bp, Homo sapiens
aagtacttctagatggataatc

SEQ ID NO: 9093555 - DNA, 22 bp, Homo sapiens
aagtacatttttaacttacagc

SEQ ID NO: 9093556 - DNA, 22 bp, Homo sapiens
aagtacattatatgagcagaat

SEQ ID NO: 9093557 - DNA, 22 bp, Homo sapiens
aagtagaaaaccgcactggact

SEQ ID NO: 9093558 - DNA, 22 bp, Homo sapiens
aagtactttaggatatgtaact

SEQ ID NO: 9093559 - DNA, 22 bp, Homo sapiens
accccaggagctgtgcctagtc

SEQ ID NO: 9093560 - DNA, 22 bp, Homo sapiens
accccaggagctgtgcctagtc

SEQ ID NO: 9093561 - DNA, 22 bp, Homo sapiens
aagtatctgggagatttgcttt

SEQ ID NO: 9093562 - DNA, 22 bp, Homo sapiens
accccctgcctgcagcaggggc

SEQ ID NO: 9093563 - DNA, 22 bp, Homo sapiens
aagtatctttctagcaactaaa

SEQ ID NO: 9093564 - DNA, 22 bp, Homo sapiens
aagtcacaagcatatatgcatt

SEQ ID NO: 9093565 - DNA, 22 bp, Homo sapiens
aagtcacaagcatatatgcatt

SEQ ID NO: 9093566 - DNA, 23 bp, Homo sapiens
accccaggcatcgcattcctctt

SEQ ID NO: 9093567 - DNA, 22 bp, Homo sapiens
accccaggcccagggaagaggc

SEQ ID NO: 9093568 - DNA, 22 bp, Homo sapiens
accccagggctgccagcctcct

SEQ ID NO: 9093569 - DNA, 22 bp, Homo sapiens
accccagggctgccagcctcct

SEQ ID NO: 9093570 - DNA, 22 bp, Homo sapiens
accccaggtccaggttacagag

SEQ ID NO: 9093571 - DNA, 22 bp, Homo sapiens
accccaggtccaggttacagag

SEQ ID NO: 9093572 - DNA, 22 bp, Homo sapiens
accccaggtcatctgagagtcc

SEQ ID NO: 9093573 - DNA, 22 bp, Homo sapiens
acccccaaacatcaagggctga

SEQ ID NO: 9093574 - DNA, 22 bp, Homo sapiens
accccaggtctccaggctctgg

SEQ ID NO: 9093575 - DNA, 23 bp, Homo sapiens
accatgatgggagtgcaaataag

SEQ ID NO: 9093576 - DNA, 22 bp, Homo sapiens
accatgataatgatgtatcatt

SEQ ID NO: 9093577 - DNA, 22 bp, Homo sapiens
aagtaacagcatcaagtctcaa

SEQ ID NO: 9093578 - DNA, 23 bp, Homo sapiens
aagtaacagggataatagcagtt

SEQ ID NO: 9093579 - DNA, 22 bp, Homo sapiens
accatccaaactgctttctgtg

SEQ ID NO: 9093580 - DNA, 22 bp, Homo sapiens
accatcttagcagactgcagtg

SEQ ID NO: 9093581 - DNA, 22 bp, Homo sapiens
aaggtgggtggatcacgaggtc

SEQ ID NO: 9093582 - DNA, 22 bp, Homo sapiens
aaggtagattctggatcgaagg

SEQ ID NO: 9093583 - DNA, 22 bp, Homo sapiens
aagggctgaatgaagggttgaa

SEQ ID NO: 9093584 - DNA, 22 bp, Homo sapiens
aagggctgagaagtggggctgg

SEQ ID NO: 9093585 - DNA, 22 bp, Homo sapiens
aagggctgaaagaccttgggca

SEQ ID NO: 9093586 - DNA, 17 bp, Homo sapiens
aaggtgagagctgttct

SEQ ID NO: 9093587 - DNA, 22 bp, Homo sapiens
aaggtgagagggaaattttcca

SEQ ID NO: 9093588 - DNA, 22 bp, Homo sapiens
aaggtgaggattttgttctgct

SEQ ID NO: 9093589 - DNA, 22 bp, Homo sapiens
aaggtgaagctcccgatgagaa

SEQ ID NO: 9093590 - DNA, 22 bp, Homo sapiens
aaggtgaactggtaatgacaga

SEQ ID NO: 9093591 - DNA, 22 bp, Homo sapiens
aaggtgaaactggaagctggcc

SEQ ID NO: 9093592 - DNA, 18 bp, Homo sapiens
aaggtctgtctggtaggt

SEQ ID NO: 9093593 - DNA, 22 bp, Homo sapiens
aaggtctgtggccacctctggg

SEQ ID NO: 9093594 - DNA, 22 bp, Homo sapiens
acatgtgtacatatatatgtgc

SEQ ID NO: 9093595 - DNA, 22 bp, Homo sapiens
acatgtgtctaagaatgaaaga

SEQ ID NO: 9093596 - DNA, 22 bp, Homo sapiens
acatgtgtacttttaaggatgt

SEQ ID NO: 9093597 - DNA, 22 bp, Homo sapiens
acatgtgtggacatgaatctac

SEQ ID NO: 9093598 - DNA, 22 bp, Homo sapiens
aaggctgtccaggagaaaatag

SEQ ID NO: 9093599 - DNA, 22 bp, Homo sapiens
aaggctggtttccttgatgttt

SEQ ID NO: 9093600 - DNA, 22 bp, Homo sapiens
aaggctggtttccttgatgttt

SEQ ID NO: 9093601 - DNA, 22 bp, Homo sapiens
aaggctggggtgcagacggcct

SEQ ID NO: 9093602 - DNA, 22 bp, Homo sapiens
aaggctgggaaacatgcaggcc

SEQ ID NO: 9093603 - DNA, 22 bp, Homo sapiens
aaggcttgtagatttgggcttt

SEQ ID NO: 9093604 - DNA, 22 bp, Homo sapiens
aaggcttggtctagtcatgcca

SEQ ID NO: 9093605 - DNA, 22 bp, Homo sapiens
aaggctgtttattagaaaaagt

SEQ ID NO: 9093606 - DNA, 22 bp, Homo sapiens
aaggctgtgtcagaagctccct

SEQ ID NO: 9093607 - DNA, 22 bp, Homo sapiens
aaggctgtgtcagaagctccct

SEQ ID NO: 9093608 - DNA, 22 bp, Homo sapiens
aaggctgttgtttcacaacaaa

SEQ ID NO: 9093609 - DNA, 22 bp, Homo sapiens
aaggctgtttattagaaaaagt

SEQ ID NO: 9093610 - DNA, 16 bp, Homo sapiens
aaggctgattttccct

SEQ ID NO: 9093611 - DNA, 22 bp, Homo sapiens
aaggctgcctctgccagaggag

SEQ ID NO: 9093612 - DNA, 22 bp, Homo sapiens
aaggctgattagactgatagct

SEQ ID NO: 9093613 - DNA, 22 bp, Homo sapiens
aaggctgattagactgatagct

SEQ ID NO: 9093614 - DNA, 22 bp, Homo sapiens
aaggctgagtaaaacagagaac

SEQ ID NO: 9093615 - DNA, 22 bp, Homo sapiens
aaggctgagtaaaacagagaac

SEQ ID NO: 9093616 - DNA, 22 bp, Homo sapiens
aaggctgaggtagggcctaaaa

SEQ ID NO: 9093617 - DNA, 22 bp, Homo sapiens
aaggctgaggtagggcctaaaa

SEQ ID NO: 9093618 - DNA, 22 bp, Homo sapiens
aaggctgagggctgtacctggc

SEQ ID NO: 9093619 - DNA, 22 bp, Homo sapiens
aaggctgagggctgtacctggc

SEQ ID NO: 9093620 - DNA, 22 bp, Homo sapiens
aaggctgaaagaccttgaacct

SEQ ID NO: 9093621 - DNA, 22 bp, Homo sapiens
aaggctcttggagtgaatgcag

SEQ ID NO: 9093622 - DNA, 22 bp, Homo sapiens
aaggctcttggagtgaatgcag

SEQ ID NO: 9093623 - DNA, 22 bp, Homo sapiens
aaggctgaggagggcctgcagg

SEQ ID NO: 9093624 - DNA, 22 bp, Homo sapiens
aaggctgaggagggcctgcagg

SEQ ID NO: 9093625 - DNA, 22 bp, Homo sapiens
aaggctgaggagggcctgcagg

SEQ ID NO: 9093626 - DNA, 22 bp, Homo sapiens
aaggctgaggagggcctgcagg

SEQ ID NO: 9093627 - DNA, 22 bp, Homo sapiens
aaggctgaggcagtgaggcaga

SEQ ID NO: 9093628 - DNA, 22 bp, Homo sapiens
aaggctgaggctggagaattac

SEQ ID NO: 9093629 - DNA, 22 bp, Homo sapiens
aaggcatgatgtaatcaatgat

SEQ ID NO: 9093630 - DNA, 22 bp, Homo sapiens
aagggctcggtagcagtcctga

SEQ ID NO: 9093631 - DNA, 22 bp, Homo sapiens
aagggctcggtagcagtcctga

SEQ ID NO: 9093632 - DNA, 22 bp, Homo sapiens
aagggcctgccagctcttcatg

SEQ ID NO: 9093633 - DNA, 22 bp, Homo sapiens
aagggcccattctctcagaaaa

SEQ ID NO: 9093634 - DNA, 22 bp, Homo sapiens
aagggcctcctggggagcctgg

SEQ ID NO: 9093635 - DNA, 19 bp, Homo sapiens
aagggcctctgctgtcttc

SEQ ID NO: 9093636 - DNA, 22 bp, Homo sapiens
aagggccattgctgagagcagt

SEQ ID NO: 9093637 - DNA, 22 bp, Homo sapiens
aagggccagggctctagagata

SEQ ID NO: 9093638 - DNA, 22 bp, Homo sapiens
aagggcatttgtattccctgca

SEQ ID NO: 9093639 - DNA, 22 bp, Homo sapiens
aagggcatgggatgaaaagtag

SEQ ID NO: 9093640 - DNA, 22 bp, Homo sapiens
aagggagaaaacttgtggctta

SEQ ID NO: 9093641 - DNA, 22 bp, Homo sapiens
aagggagaaaacttgtggctta

SEQ ID NO: 9093642 - DNA, 22 bp, Homo sapiens
aagggactttgtcagctttcca

SEQ ID NO: 9093643 - DNA, 22 bp, Homo sapiens
aagctgcaaaaaatttctgtct

SEQ ID NO: 9093644 - DNA, 22 bp, Homo sapiens
aagctcttgaagaccaccagga

SEQ ID NO: 9093645 - DNA, 22 bp, Homo sapiens
aagctcttcttgccaccattca

SEQ ID NO: 9093646 - DNA, 22 bp, Homo sapiens
aagctgcaaggaagtgtgccag

SEQ ID NO: 9093647 - DNA, 21 bp, Homo sapiens
aagctcttctcagggtcacct

SEQ ID NO: 9093648 - DNA, 22 bp, Homo sapiens
aagccaggtgtttaggccagcg

SEQ ID NO: 9093649 - DNA, 22 bp, Homo sapiens
aagccaggtgtttaggccagcg

SEQ ID NO: 9093650 - DNA, 22 bp, Homo sapiens
aagccagggtttgtggatctat

SEQ ID NO: 9093651 - DNA, 22 bp, Homo sapiens
aagccagggattcctgagggag

SEQ ID NO: 9093652 - DNA, 22 bp, Homo sapiens
aagccaggcatgcttggacagt

SEQ ID NO: 9093653 - DNA, 22 bp, Homo sapiens
aagctgcagaccccctgtctca

SEQ ID NO: 9093654 - DNA, 22 bp, Homo sapiens
aagctgcagatgtgcctgtgga

SEQ ID NO: 9093655 - DNA, 22 bp, Homo sapiens
aagctgcactacttgagggacc

SEQ ID NO: 9093656 - DNA, 22 bp, Homo sapiens
aagctgcactacttgagggacc

SEQ ID NO: 9093657 - DNA, 22 bp, Homo sapiens
aagctgcagaccccctgtctca

SEQ ID NO: 9093658 - DNA, 22 bp, Homo sapiens
aagctgcagcacagagaggtgg

SEQ ID NO: 9093659 - DNA, 22 bp, Homo sapiens
aagctgcagcacagagaggtgg

SEQ ID NO: 9093660 - DNA, 22 bp, Homo sapiens
aagctgcaggttgaatccaggt

SEQ ID NO: 9093661 - DNA, 22 bp, Homo sapiens
aagctgcatgaagttgagtaga

SEQ ID NO: 9093662 - DNA, 22 bp, Homo sapiens
aagctgccaatggtaagctgct

SEQ ID NO: 9093663 - DNA, 22 bp, Homo sapiens
aagctgccaccagcccagggca

SEQ ID NO: 9093664 - DNA, 22 bp, Homo sapiens
aagctgccacacggtgagtact

SEQ ID NO: 9093665 - DNA, 22 bp, Homo sapiens
aagctgccagattcagtctgct

SEQ ID NO: 9093666 - DNA, 22 bp, Homo sapiens
aagctgccagctgagctgaggc

SEQ ID NO: 9093667 - DNA, 22 bp, Homo sapiens
aagctgccagctgagctgaggc

SEQ ID NO: 9093668 - DNA, 22 bp, Homo sapiens
acaggcaggttgagaaacattt

SEQ ID NO: 9093669 - DNA, 23 bp, Homo sapiens
aagctgccagtctgaagcctggg

SEQ ID NO: 9093670 - DNA, 22 bp, Homo sapiens
aagctgccatagaacgagaggt

SEQ ID NO: 9093671 - DNA, 22 bp, Homo sapiens
aagctgcccaagactgaagcat

SEQ ID NO: 9093672 - DNA, 22 bp, Homo sapiens
acaggcaggtcctgtcccagct

SEQ ID NO: 9093673 - DNA, 22 bp, Homo sapiens
acaggcaggtcctgtcccagct

SEQ ID NO: 9093674 - DNA, 22 bp, Homo sapiens
acagtacagtgcagaggaagat

SEQ ID NO: 9093675 - DNA, 22 bp, Homo sapiens
acagtacctgctctcaagcaaa

SEQ ID NO: 9093676 - DNA, 22 bp, Homo sapiens
acagtactaagtgctcacatga

SEQ ID NO: 9093677 - DNA, 22 bp, Homo sapiens
acagtacctgctctcaagcaaa

SEQ ID NO: 9093678 - DNA, 22 bp, Homo sapiens
acagtactctaatgaaaagtgc

SEQ ID NO: 9093679 - DNA, 22 bp, Homo sapiens
acaggtgtggggctgtggtact

SEQ ID NO: 9093680 - DNA, 22 bp, Homo sapiens
aaggaaatctttgtaacatctt

SEQ ID NO: 9093681 - DNA, 22 bp, Homo sapiens
acagggctctgacaccaaggta

SEQ ID NO: 9093682 - DNA, 22 bp, Homo sapiens
aaggaaatagatgcagatggta

SEQ ID NO: 9093683 - DNA, 22 bp, Homo sapiens
aaggaaaggatgagcatgcatt

SEQ ID NO: 9093684 - DNA, 22 bp, Homo sapiens
aaggaaatacaacatgtattca

SEQ ID NO: 9093685 - DNA, 22 bp, Homo sapiens
aaggaaaggatgagcatgcatt

SEQ ID NO: 9093686 - DNA, 22 bp, Homo sapiens
aaggaaaggatgagcatgcatt

SEQ ID NO: 9093687 - DNA, 22 bp, Homo sapiens
aaggaaagctgtggttctgaga

SEQ ID NO: 9093688 - DNA, 22 bp, Homo sapiens
aaggaaagattctctctctaga

SEQ ID NO: 9093689 - DNA, 22 bp, Homo sapiens
aaggaaagattctctctctaga

SEQ ID NO: 9093690 - DNA, 22 bp, Homo sapiens
aaggaaagattctctctctaga

SEQ ID NO: 9093691 - DNA, 22 bp, Homo sapiens
acaggcagttgaggtttgtgtg

SEQ ID NO: 9093692 - DNA, 22 bp, Homo sapiens
acaggcagttgaggtttgtgtg

SEQ ID NO: 9093693 - DNA, 22 bp, Homo sapiens
aaggaaagacatataaatgact

SEQ ID NO: 9093694 - DNA, 22 bp, Homo sapiens
aaggaaagacatataaatgact

SEQ ID NO: 9093695 - DNA, 22 bp, Homo sapiens
aaggaaagacatataaatgact

SEQ ID NO: 9093696 - DNA, 22 bp, Homo sapiens
aaggaaagagtatgcaccttgt

SEQ ID NO: 9093697 - DNA, 22 bp, Homo sapiens
aaggaaagacatataaatgact

SEQ ID NO: 9093698 - DNA, 22 bp, Homo sapiens
acagttctaaatcttggataat

SEQ ID NO: 9093699 - DNA, 22 bp, Homo sapiens
aaggcagagatattcttgatct

SEQ ID NO: 9093700 - DNA, 19 bp, Homo sapiens
acagttctaatttctgtgg

SEQ ID NO: 9093701 - DNA, 22 bp, Homo sapiens
acagttctttggatggaagaat

SEQ ID NO: 9093702 - DNA, 22 bp, Homo sapiens
acagttctgtcctagacttcgt

SEQ ID NO: 9093703 - DNA, 22 bp, Homo sapiens
acagttctgtcctagacttcgt

SEQ ID NO: 9093704 - DNA, 22 bp, Homo sapiens
acagttcttaaaacttgaatta

SEQ ID NO: 9093705 - DNA, 22 bp, Homo sapiens
acagttctgcaagatatttttt

SEQ ID NO: 9093706 - DNA, 22 bp, Homo sapiens
acagttctgagctataattgct

SEQ ID NO: 9093707 - DNA, 22 bp, Homo sapiens
acagttctgcctgtttgagaag

SEQ ID NO: 9093708 - DNA, 22 bp, Homo sapiens
acagttgggctgtagcatgctt

SEQ ID NO: 9093709 - DNA, 22 bp, Homo sapiens
aaggcagccgtgtgactgcatg

SEQ ID NO: 9093710 - DNA, 22 bp, Homo sapiens
aaggcagccgtgtgactgcatg

SEQ ID NO: 9093711 - DNA, 22 bp, Homo sapiens
aaggcagccgtgtgactgcatg

SEQ ID NO: 9093712 - DNA, 22 bp, Homo sapiens
aaggcagccgtgtgactgcatg

SEQ ID NO: 9093713 - DNA, 22 bp, Homo sapiens
aaggcagcctctgccagccggg

SEQ ID NO: 9093714 - DNA, 22 bp, Homo sapiens
aaggcagccgtgtgactgcatg

SEQ ID NO: 9093715 - DNA, 22 bp, Homo sapiens
aaggcagcctctgccagccggg

SEQ ID NO: 9093716 - DNA, 22 bp, Homo sapiens
aaggcagcctctgccagccggg

SEQ ID NO: 9093717 - DNA, 22 bp, Homo sapiens
aaggcagcctttgtttgattga

SEQ ID NO: 9093718 - DNA, 22 bp, Homo sapiens
aaggcagccttttgagttgatt

SEQ ID NO: 9093719 - DNA, 22 bp, Homo sapiens
aaggcagccttttgagttgatt

SEQ ID NO: 9093720 - DNA, 22 bp, Homo sapiens
aaggcagcctttgtttgattga

SEQ ID NO: 9093721 - DNA, 22 bp, Homo sapiens
aaggcagccttttgagttgatt

SEQ ID NO: 9093722 - DNA, 22 bp, Homo sapiens
aaggcagtcaaagcagacttct

SEQ ID NO: 9093723 - DNA, 18 bp, Homo sapiens
aaggcagtatgattgcac

SEQ ID NO: 9093724 - DNA, 18 bp, Homo sapiens
aaggcagtatgattgcac

SEQ ID NO: 9093725 - DNA, 22 bp, Homo sapiens
aaggcagtaggtgtttcaaact

SEQ ID NO: 9093726 - DNA, 22 bp, Homo sapiens
aaggcagtatctgtagagtgct

SEQ ID NO: 9093727 - DNA, 22 bp, Homo sapiens
aaggcagtaggatcttccacag

SEQ ID NO: 9093728 - DNA, 22 bp, Homo sapiens
aaggcagtactttatgtccata

SEQ ID NO: 9093729 - DNA, 22 bp, Homo sapiens
aaggcagtaaaatctaccttgc

SEQ ID NO: 9093730 - DNA, 22 bp, Homo sapiens
aaggcaggtattgatgccacag

SEQ ID NO: 9093731 - DNA, 22 bp, Homo sapiens
aaggcagtcagttgttttgaaa

SEQ ID NO: 9093732 - DNA, 22 bp, Homo sapiens
aaggcagtcagttgttttgaaa

SEQ ID NO: 9093733 - DNA, 22 bp, Homo sapiens
aaggcagtctggtttcaaagca

SEQ ID NO: 9093734 - DNA, 22 bp, Homo sapiens
aaggcagtggctggaaaacctg

SEQ ID NO: 9093735 - DNA, 22 bp, Homo sapiens
aaggcagttaccgcaatggagg

SEQ ID NO: 9093736 - DNA, 22 bp, Homo sapiens
aaggcagtggttgtgatactgt

SEQ ID NO: 9093737 - DNA, 22 bp, Homo sapiens
aaggcagttaatttggctagaa

SEQ ID NO: 9093738 - DNA, 22 bp, Homo sapiens
aaggcagtggttgggtggagga

SEQ ID NO: 9093739 - DNA, 22 bp, Homo sapiens
aaggcagttcactcacgcagcc

SEQ ID NO: 9093740 - DNA, 22 bp, Homo sapiens
aaggcagtttgggccaccatct

SEQ ID NO: 9093741 - DNA, 22 bp, Homo sapiens
aaggcaggatgcggacccatct

SEQ ID NO: 9093742 - DNA, 22 bp, Homo sapiens
aaggcaggatgggaaaagattt

SEQ ID NO: 9093743 - DNA, 22 bp, Homo sapiens
aaggcaggatgggaaaagattt

SEQ ID NO: 9093744 - DNA, 22 bp, Homo sapiens
aaggcaggatgcggacccatct

SEQ ID NO: 9093745 - DNA, 22 bp, Homo sapiens
aaggcagctttaaaaaagatgc

SEQ ID NO: 9093746 - DNA, 22 bp, Homo sapiens
aaggcagctttaaaaaagatgc

SEQ ID NO: 9093747 - DNA, 22 bp, Homo sapiens
aaggcagctcagctcatggcag

SEQ ID NO: 9093748 - DNA, 22 bp, Homo sapiens
aaggcagctcagctcatggcag

SEQ ID NO: 9093749 - DNA, 22 bp, Homo sapiens
aaggcagcttcaccacagcatt

SEQ ID NO: 9093750 - DNA, 22 bp, Homo sapiens
aaggcagcttcaccacagcatt

SEQ ID NO: 9093751 - DNA, 22 bp, Homo sapiens
aaggcagcttcaccacagcatt

SEQ ID NO: 9093752 - DNA, 22 bp, Homo sapiens
aaggaaattaggttattttgct

SEQ ID NO: 9093753 - DNA, 22 bp, Homo sapiens
aaggaaatgaggttgatggatg

SEQ ID NO: 9093754 - DNA, 22 bp, Homo sapiens
aaggaaatgtgcctgacactgc

SEQ ID NO: 9093755 - DNA, 22 bp, Homo sapiens
aaggaaatctttgtaacatctt

SEQ ID NO: 9093756 - DNA, 22 bp, Homo sapiens
aaggaaatgtgcctgacactgc

SEQ ID NO: 9093757 - DNA, 22 bp, Homo sapiens
aaggaaatgtgcctgacactgc

SEQ ID NO: 9093758 - DNA, 22 bp, Homo sapiens
aaggaaatgaggttgatggatg

SEQ ID NO: 9093759 - DNA, 22 bp, Homo sapiens
aaggaaatctttgtaacatctt

SEQ ID NO: 9093760 - DNA, 22 bp, Homo sapiens
acagtataaactcctaaaagcc

SEQ ID NO: 9093761 - DNA, 22 bp, Homo sapiens
acagtatacattgattaggacc

SEQ ID NO: 9093762 - DNA, 22 bp, Homo sapiens
acagtagtcttaatttcatgta

SEQ ID NO: 9093763 - DNA, 22 bp, Homo sapiens
acagtagtctcaggaataggca

SEQ ID NO: 9093764 - DNA, 22 bp, Homo sapiens
acagtactgtgttaactgaacc

SEQ ID NO: 9093765 - DNA, 22 bp, Homo sapiens
acagtactgagtactgagttgg

SEQ ID NO: 9093766 - DNA, 22 bp, Homo sapiens
acagtactgctgttcttgtcct

SEQ ID NO: 9093767 - DNA, 22 bp, Homo sapiens
acagtactctaatgaaaagtgc

SEQ ID NO: 9093768 - DNA, 21 bp, Homo sapiens
acagtacttgagatcttttga

SEQ ID NO: 9093769 - DNA, 21 bp, Homo sapiens
acagtacttgagatcttttga

SEQ ID NO: 9093770 - DNA, 22 bp, Homo sapiens
acagtagaaacaggcaggcaga

SEQ ID NO: 9093771 - DNA, 22 bp, Homo sapiens
acagtagaggcttgatcgcagc

SEQ ID NO: 9093772 - DNA, 21 bp, Homo sapiens
aaggcagaagcatggaatgag

SEQ ID NO: 9093773 - DNA, 21 bp, Homo sapiens
aaggcagaagcatggaatgag

SEQ ID NO: 9093774 - DNA, 19 bp, Homo sapiens
aaggcagaagttggatatg

SEQ ID NO: 9093775 - DNA, 22 bp, Homo sapiens
aaggcagaaagggatgtgagtg

SEQ ID NO: 9093776 - DNA, 22 bp, Homo sapiens
aaggcacttttctaaagacctt

SEQ ID NO: 9093777 - DNA, 22 bp, Homo sapiens
aaggcagaaagggatgtgagtg

SEQ ID NO: 9093778 - DNA, 22 bp, Homo sapiens
aaggcagaaagggatgtgagtg

SEQ ID NO: 9093779 - DNA, 22 bp, Homo sapiens
aaggcagaaagggatgtgagtg

SEQ ID NO: 9093780 - DNA, 22 bp, Homo sapiens
aaggcacttgcccagagctgca

SEQ ID NO: 9093781 - DNA, 22 bp, Homo sapiens
aaggaagaagggaagttactta

SEQ ID NO: 9093782 - DNA, 22 bp, Homo sapiens
aaggaagaagactctttactcc

SEQ ID NO: 9093783 - DNA, 22 bp, Homo sapiens
aaggaagaaatgaataggtgga

SEQ ID NO: 9093784 - DNA, 22 bp, Homo sapiens
aatcaaagaatgggctagttgg

SEQ ID NO: 9093785 - DNA, 22 bp, Homo sapiens
aatatttttgaggccctgttat

SEQ ID NO: 9093786 - DNA, 22 bp, Homo sapiens
aatatttttgaggccctgttat

SEQ ID NO: 9093787 - DNA, 19 bp, Homo sapiens
aatattttagcctcttcct

SEQ ID NO: 9093788 - DNA, 22 bp, Homo sapiens
aatattttaggctttccaggct

SEQ ID NO: 9093789 - DNA, 22 bp, Homo sapiens
aatattttaggctttccaggct

SEQ ID NO: 9093790 - DNA, 22 bp, Homo sapiens
acttgtgtaacacagaaagaac

SEQ ID NO: 9093791 - DNA, 22 bp, Homo sapiens
acttgtttacaagcagttctga

SEQ ID NO: 9093792 - DNA, 22 bp, Homo sapiens
aatcaagagctgactatatttt

SEQ ID NO: 9093793 - DNA, 22 bp, Homo sapiens
aatcaagaggcgatggatggaa

SEQ ID NO: 9093794 - DNA, 22 bp, Homo sapiens
aatccatttactctttacaaga

SEQ ID NO: 9093795 - DNA, 22 bp, Homo sapiens
aatcctgaggcaaagagatgag

SEQ ID NO: 9093796 - DNA, 22 bp, Homo sapiens
aatcctggaatacaagagtgaa

SEQ ID NO: 9093797 - DNA, 22 bp, Homo sapiens
aatcctgacctgggcatgcttg

SEQ ID NO: 9093798 - DNA, 22 bp, Homo sapiens
aatccagcacatggacacagtc

SEQ ID NO: 9093799 - DNA, 22 bp, Homo sapiens
acttgtttgcctaaaattttga

SEQ ID NO: 9093800 - DNA, 19 bp, Homo sapiens
acttgttttggaggtgatg

SEQ ID NO: 9093801 - DNA, 22 bp, Homo sapiens
aatatcacaggaggagaccaag

SEQ ID NO: 9093802 - DNA, 22 bp, Homo sapiens
aatattcatttgcagaagaagt

SEQ ID NO: 9093803 - DNA, 19 bp, Homo sapiens
aatattttagcctcttcct

SEQ ID NO: 9093804 - DNA, 22 bp, Homo sapiens
aatatatttgaatcaggaacaa

SEQ ID NO: 9093805 - DNA, 23 bp, Homo sapiens
aatatatgtgtttttctgcttca

SEQ ID NO: 9093806 - DNA, 22 bp, Homo sapiens
aatatatgtggtattgaccagc

SEQ ID NO: 9093807 - DNA, 22 bp, Homo sapiens
acttgactttgtcatttgtgct

SEQ ID NO: 9093808 - DNA, 22 bp, Homo sapiens
acttgaatttagtttttcctaa

SEQ ID NO: 9093809 - DNA, 22 bp, Homo sapiens
aatatatgagggagctatttga

SEQ ID NO: 9093810 - DNA, 21 bp, Homo sapiens
aatatatgcaatgctttctgc

SEQ ID NO: 9093811 - DNA, 22 bp, Homo sapiens
aatatatgaccaggaagttctg

SEQ ID NO: 9093812 - DNA, 22 bp, Homo sapiens
aatatatgactccactgcatga

SEQ ID NO: 9093813 - DNA, 22 bp, Homo sapiens
aatatatgactccactgcatga

SEQ ID NO: 9093814 - DNA, 21 bp, Homo sapiens
acttgaagttggagtttctgt

SEQ ID NO: 9093815 - DNA, 22 bp, Homo sapiens
acttgaataggtgtcaaggcca

SEQ ID NO: 9093816 - DNA, 22 bp, Homo sapiens
acttgaaaccttggcaaacaat

SEQ ID NO: 9093817 - DNA, 22 bp, Homo sapiens
acttgaaaagctcagcagtagt

SEQ ID NO: 9093818 - DNA, 19 bp, Homo sapiens
acttcttttcaacacagga

SEQ ID NO: 9093819 - DNA, 22 bp, Homo sapiens
acttcttttcaaatcatgcaaa

SEQ ID NO: 9093820 - DNA, 19 bp, Homo sapiens
acttcttttcaacacagga

SEQ ID NO: 9093821 - DNA, 22 bp, Homo sapiens
acttcctgctatgagcttctgt

SEQ ID NO: 9093822 - DNA, 22 bp, Homo sapiens
acttcctggattcccaagggct

SEQ ID NO: 9093823 - DNA, 22 bp, Homo sapiens
aatacaatcaaattcactagca

SEQ ID NO: 9093824 - DNA, 22 bp, Homo sapiens
aatacagagaatgttatttgga

SEQ ID NO: 9093825 - DNA, 22 bp, Homo sapiens
aatacagagaatgttatttgga

SEQ ID NO: 9093826 - DNA, 22 bp, Homo sapiens
aatacaatcaaattcactagca

SEQ ID NO: 9093827 - DNA, 22 bp, Homo sapiens
aatgaggccagtagaaggaagt

SEQ ID NO: 9093828 - DNA, 22 bp, Homo sapiens
aatgaggcttgcattgtgaact

SEQ ID NO: 9093829 - DNA, 22 bp, Homo sapiens
aatgagggggatgggaaagtgt

SEQ ID NO: 9093830 - DNA, 22 bp, Homo sapiens
aatgagctagacctgcttcctc

SEQ ID NO: 9093831 - DNA, 22 bp, Homo sapiens
aatgagatggcaatgacttaaa

SEQ ID NO: 9093832 - DNA, 20 bp, Homo sapiens
aatgagatgacttagaggaa

SEQ ID NO: 9093833 - DNA, 20 bp, Homo sapiens
aatgagatgacttagaggaa

SEQ ID NO: 9093834 - DNA, 22 bp, Homo sapiens
aatgagatggaggactcttaat

SEQ ID NO: 9093835 - DNA, 22 bp, Homo sapiens
aatgagatggaggactcttaat

SEQ ID NO: 9093836 - DNA, 18 bp, Homo sapiens
agaaggagctatgggcag

SEQ ID NO: 9093837 - DNA, 22 bp, Homo sapiens
agaagggaactcagagatgatt

SEQ ID NO: 9093838 - DNA, 18 bp, Homo sapiens
agaaggagctatgggcag

SEQ ID NO: 9093839 - DNA, 22 bp, Homo sapiens
agaagggaactcagagatgatt

SEQ ID NO: 9093840 - DNA, 21 bp, Homo sapiens
agaagggattgtggtaaagat

SEQ ID NO: 9093841 - DNA, 22 bp, Homo sapiens
aatgagttatttaatagaaagg

SEQ ID NO: 9093842 - DNA, 22 bp, Homo sapiens
aatgagttagatgagaaaataa

SEQ ID NO: 9093843 - DNA, 20 bp, Homo sapiens
agaaatactttggtataatg

SEQ ID NO: 9093844 - DNA, 22 bp, Homo sapiens
agaaatactgcctaagactgta

SEQ ID NO: 9093845 - DNA, 22 bp, Homo sapiens
aatgacatggagcatcttttca

SEQ ID NO: 9093846 - DNA, 22 bp, Homo sapiens
aatgacctcagagcacccagaa

SEQ ID NO: 9093847 - DNA, 22 bp, Homo sapiens
aatgagaaaacacagaggaggt

SEQ ID NO: 9093848 - DNA, 22 bp, Homo sapiens
aatgagaaccttgaaaggaact

SEQ ID NO: 9093849 - DNA, 22 bp, Homo sapiens
aatgagaatgtaagtgaagaga

SEQ ID NO: 9093850 - DNA, 22 bp, Homo sapiens
aatgagagaagacaggcaagtg

SEQ ID NO: 9093851 - DNA, 22 bp, Homo sapiens
aatgagaagcctaggtgtactg

SEQ ID NO: 9093852 - DNA, 22 bp, Homo sapiens
aatgagaagcctaggtgtactg

SEQ ID NO: 9093853 - DNA, 22 bp, Homo sapiens
aatgagaactgggagttggtgg

SEQ ID NO: 9093854 - DNA, 22 bp, Homo sapiens
aatgaaactagtagaatctttg

SEQ ID NO: 9093855 - DNA, 22 bp, Homo sapiens
agaaaactctacatctgtatgt

SEQ ID NO: 9093856 - DNA, 22 bp, Homo sapiens
agaaaactgcagagtagcctca

SEQ ID NO: 9093857 - DNA, 22 bp, Homo sapiens
agaaaactgcagagtagcctca

SEQ ID NO: 9093858 - DNA, 22 bp, Homo sapiens
agaaaactgcagagtagcctca

SEQ ID NO: 9093859 - DNA, 22 bp, Homo sapiens
aatgaacacagccctctacttt

SEQ ID NO: 9093860 - DNA, 22 bp, Homo sapiens
aatgaacacttagcctttctat

SEQ ID NO: 9093861 - DNA, 22 bp, Homo sapiens
agaaaacataggagacaggaaa

SEQ ID NO: 9093862 - DNA, 22 bp, Homo sapiens
agaaaacataggagacaggaaa

SEQ ID NO: 9093863 - DNA, 22 bp, Homo sapiens
agaaaacagaaagtcattggtg

SEQ ID NO: 9093864 - DNA, 22 bp, Homo sapiens
agaaaacagaaagtcattggtg

SEQ ID NO: 9093865 - DNA, 22 bp, Homo sapiens
agaaaaatcttggcgcttgtct

SEQ ID NO: 9093866 - DNA, 22 bp, Homo sapiens
aatcctggcatgtgccttggga

SEQ ID NO: 9093867 - DNA, 22 bp, Homo sapiens
agaaaacagaaagtcattggtg

SEQ ID NO: 9093868 - DNA, 20 bp, Homo sapiens
agaaataccacatttggcaa

SEQ ID NO: 9093869 - DNA, 22 bp, Homo sapiens
agaaatactaggaatattcata

SEQ ID NO: 9093870 - DNA, 22 bp, Homo sapiens
agaaatactaggaatattcata

SEQ ID NO: 9093871 - DNA, 22 bp, Homo sapiens
aatgaacaggtgaatgtcagat

SEQ ID NO: 9093872 - DNA, 22 bp, Homo sapiens
aatgaacatataaagagatctt

SEQ ID NO: 9093873 - DNA, 22 bp, Homo sapiens
aatgaacatggacaagttaata

SEQ ID NO: 9093874 - DNA, 22 bp, Homo sapiens
aataatgttatgtcattcttct

SEQ ID NO: 9093875 - DNA, 22 bp, Homo sapiens
aataatgttatgtcattcttct

SEQ ID NO: 9093876 - DNA, 22 bp, Homo sapiens
aataatgtttatttgtattctc

SEQ ID NO: 9093877 - DNA, 22 bp, Homo sapiens
aataatgtttatttgtattctc

SEQ ID NO: 9093878 - DNA, 22 bp, Homo sapiens
aataattagtgggacagagaac

SEQ ID NO: 9093879 - DNA, 22 bp, Homo sapiens
aataattttgagagcctggaaa

SEQ ID NO: 9093880 - DNA, 22 bp, Homo sapiens
aataattatttgagagcagacc

SEQ ID NO: 9093881 - DNA, 22 bp, Homo sapiens
aataatagttgcaaagtgttta

SEQ ID NO: 9093882 - DNA, 22 bp, Homo sapiens
aataatagttgcaaagtgttta

SEQ ID NO: 9093883 - DNA, 22 bp, Homo sapiens
aataatagttgcaaagtgttta

SEQ ID NO: 9093884 - DNA, 22 bp, Homo sapiens
actgcgctccagcctgggtgac

SEQ ID NO: 9093885 - DNA, 22 bp, Homo sapiens
aataagatcttaaaggttatat

SEQ ID NO: 9093886 - DNA, 23 bp, Homo sapiens
actgcctgtgccgatctctctca

SEQ ID NO: 9093887 - DNA, 23 bp, Homo sapiens
actgcctgtgccgatctctctca

SEQ ID NO: 9093888 - DNA, 22 bp, Homo sapiens
aataagattgacacaagtacct

SEQ ID NO: 9093889 - DNA, 22 bp, Homo sapiens
actgcctgtttggcatggcccc

SEQ ID NO: 9093890 - DNA, 22 bp, Homo sapiens
actgcctgtttggcatggcccc

SEQ ID NO: 9093891 - DNA, 22 bp, Homo sapiens
aagtttactggggagatcacct

SEQ ID NO: 9093892 - DNA, 22 bp, Homo sapiens
aagtttagggaagtctgagcgc

SEQ ID NO: 9093893 - DNA, 22 bp, Homo sapiens
aagtttaggccaaattagattt

SEQ ID NO: 9093894 - DNA, 22 bp, Homo sapiens
aagtttagcgctctctcaagga

SEQ ID NO: 9093895 - DNA, 22 bp, Homo sapiens
aagtttagcttgagatggaaag

SEQ ID NO: 9093896 - DNA, 22 bp, Homo sapiens
aagtttagaactataagagtga

SEQ ID NO: 9093897 - DNA, 22 bp, Homo sapiens
aagtttagatataggtattctg

SEQ ID NO: 9093898 - DNA, 22 bp, Homo sapiens
aagtttagtcttgtcttagtaa

SEQ ID NO: 9093899 - DNA, 22 bp, Homo sapiens
aagtttagtagggacagatgga

SEQ ID NO: 9093900 - DNA, 22 bp, Homo sapiens
aagtttagtattagggaaaagt

SEQ ID NO: 9093901 - DNA, 20 bp, Homo sapiens
aagtttaggggaaagtgaca

SEQ ID NO: 9093902 - DNA, 22 bp, Homo sapiens
aagtttagttaagtaaactctt

SEQ ID NO: 9093903 - DNA, 22 bp, Homo sapiens
aagtttagtggtggtgttccat

SEQ ID NO: 9093904 - DNA, 22 bp, Homo sapiens
aagtttagtgaaactctagggg

SEQ ID NO: 9093905 - DNA, 22 bp, Homo sapiens
aagtttatgttctttgaaggca

SEQ ID NO: 9093906 - DNA, 22 bp, Homo sapiens
aagtttatccctctcacagtta

SEQ ID NO: 9093907 - DNA, 22 bp, Homo sapiens
aagttctaattttgcattcagg

SEQ ID NO: 9093908 - DNA, 21 bp, Homo sapiens
aagttgtctcttttggttcct

SEQ ID NO: 9093909 - DNA, 21 bp, Homo sapiens
aagttgtctcttttggttcct

SEQ ID NO: 9093910 - DNA, 22 bp, Homo sapiens
aagtttaacttgaattctttct

SEQ ID NO: 9093911 - DNA, 22 bp, Homo sapiens
aagtttatgttggtaagatatc

SEQ ID NO: 9093912 - DNA, 22 bp, Homo sapiens
aagtttcaaatataaaattaca

SEQ ID NO: 9093913 - DNA, 22 bp, Homo sapiens
aagtttcaaatgttgattatgc

SEQ ID NO: 9093914 - DNA, 22 bp, Homo sapiens
aagtttcaaatataaaattaca

SEQ ID NO: 9093915 - DNA, 22 bp, Homo sapiens
aagtttcatgatgtaattattg

SEQ ID NO: 9093916 - DNA, 22 bp, Homo sapiens
aagtttctattattacattcgt

SEQ ID NO: 9093917 - DNA, 22 bp, Homo sapiens
aagtttcatgtggaggtagact

SEQ ID NO: 9093918 - DNA, 22 bp, Homo sapiens
aataagatcctgaagatatgtt

SEQ ID NO: 9093919 - DNA, 22 bp, Homo sapiens
aataagatcctgaagatatgtt

SEQ ID NO: 9093920 - DNA, 22 bp, Homo sapiens
aataagaattgccagatttgaa

SEQ ID NO: 9093921 - DNA, 22 bp, Homo sapiens
aataacttcagttcttacatta

SEQ ID NO: 9093922 - DNA, 22 bp, Homo sapiens
aataacttaagaaatttcccca

SEQ ID NO: 9093923 - DNA, 22 bp, Homo sapiens
aataacttaagaaatttcccca

SEQ ID NO: 9093924 - DNA, 22 bp, Homo sapiens
aagtttctcaatggcaactggg

SEQ ID NO: 9093925 - DNA, 22 bp, Homo sapiens
aataagaattgccagatttgaa

SEQ ID NO: 9093926 - DNA, 22 bp, Homo sapiens
aagtcacattctgaggtattgg

SEQ ID NO: 9093927 - DNA, 22 bp, Homo sapiens
aagtcacagctaaatagctaag

SEQ ID NO: 9093928 - DNA, 22 bp, Homo sapiens
aagtcacagagttggaagtcag

SEQ ID NO: 9093929 - DNA, 22 bp, Homo sapiens
aagtcacagaacccattgtaac

SEQ ID NO: 9093930 - DNA, 22 bp, Homo sapiens
aagtcagaaaacagagcaatta

SEQ ID NO: 9093931 - DNA, 22 bp, Homo sapiens
aagtcagaaaacagagcaatta

SEQ ID NO: 9093932 - DNA, 22 bp, Homo sapiens
aagtcagaaatatctgccatca

SEQ ID NO: 9093933 - DNA, 22 bp, Homo sapiens
aagtcagaaatatctgccatca

SEQ ID NO: 9093934 - DNA, 22 bp, Homo sapiens
aagtcagacagctgagctgcct

SEQ ID NO: 9093935 - DNA, 22 bp, Homo sapiens
aagtcagaccttgttgatagct

SEQ ID NO: 9093936 - DNA, 22 bp, Homo sapiens
aagtcagaaattattcaggaat

SEQ ID NO: 9093937 - DNA, 22 bp, Homo sapiens
aagtcagaaatcatctagtgta

SEQ ID NO: 9093938 - DNA, 22 bp, Homo sapiens
aagtcagaataatgtttctttt

SEQ ID NO: 9093939 - DNA, 22 bp, Homo sapiens
aagtcagataggtgagtccaaa

SEQ ID NO: 9093940 - DNA, 23 bp, Homo sapiens
aagtcagagccaagtcaatgaga

SEQ ID NO: 9093941 - DNA, 22 bp, Homo sapiens
aagtcagagcaactgagacatt

SEQ ID NO: 9093942 - DNA, 23 bp, Homo sapiens
aagtcagagccaagtcaatgaga

SEQ ID NO: 9093943 - DNA, 22 bp, Homo sapiens
aagtcagagcaactgagacatt

SEQ ID NO: 9093944 - DNA, 22 bp, Homo sapiens
aagtcagagatgccaaagatta

SEQ ID NO: 9093945 - DNA, 22 bp, Homo sapiens
aagtcagagatcaaggtgtcta

SEQ ID NO: 9093946 - DNA, 22 bp, Homo sapiens
actaaatgagatactgtcttca

SEQ ID NO: 9093947 - DNA, 22 bp, Homo sapiens
actaaatgcattggtatctatt

SEQ ID NO: 9093948 - DNA, 22 bp, Homo sapiens
actaaatgaactattaatactt

SEQ ID NO: 9093949 - DNA, 22 bp, Homo sapiens
actaaatggaatgattactata

SEQ ID NO: 9093950 - DNA, 22 bp, Homo sapiens
actaaatgctgcataaatgctt

SEQ ID NO: 9093951 - DNA, 22 bp, Homo sapiens
actaaatggaatgattactata

SEQ ID NO: 9093952 - DNA, 23 bp, Homo sapiens
actaaatggggctttgcttaaag

SEQ ID NO: 9093953 - DNA, 23 bp, Homo sapiens
actaaatggggctttgcttaaag

SEQ ID NO: 9093954 - DNA, 22 bp, Homo sapiens
actaacatgttaatcaaaagaa

SEQ ID NO: 9093955 - DNA, 22 bp, Homo sapiens
actaaatttgtcaatgacactt

SEQ ID NO: 9093956 - DNA, 21 bp, Homo sapiens
aagtggagaagaaaagctgga

SEQ ID NO: 9093957 - DNA, 22 bp, Homo sapiens
aagtggactaatacaaggacta

SEQ ID NO: 9093958 - DNA, 22 bp, Homo sapiens
aagtgcttggctaatggttatg

SEQ ID NO: 9093959 - DNA, 22 bp, Homo sapiens
aagttctaaggtgcattattct

SEQ ID NO: 9093960 - DNA, 18 bp, Homo sapiens
actccccacaggctctgt

SEQ ID NO: 9093961 - DNA, 22 bp, Homo sapiens
actcccaggttgcctggcaggc

SEQ ID NO: 9093962 - DNA, 22 bp, Homo sapiens
actccaggttttttcactgaag

SEQ ID NO: 9093963 - DNA, 22 bp, Homo sapiens
actcccaggttgcctggcaggc

SEQ ID NO: 9093964 - DNA, 22 bp, Homo sapiens
actcccagctcagggctttccc

SEQ ID NO: 9093965 - DNA, 22 bp, Homo sapiens
actcccagaacatgctcttctt

SEQ ID NO: 9093966 - DNA, 22 bp, Homo sapiens
actcccactccagagtagaagc

SEQ ID NO: 9093967 - DNA, 22 bp, Homo sapiens
aagttatctttgattagaaata

SEQ ID NO: 9093968 - DNA, 22 bp, Homo sapiens
aagttcaaaaatgtaatcagtg

SEQ ID NO: 9093969 - DNA, 22 bp, Homo sapiens
aagttcaaattggggcctgtga

SEQ ID NO: 9093970 - DNA, 22 bp, Homo sapiens
aagttcaagagtgacatattag

SEQ ID NO: 9093971 - DNA, 22 bp, Homo sapiens
aagttcaagatcaaggttccag

SEQ ID NO: 9093972 - DNA, 22 bp, Homo sapiens
aagttcaagctctgcctaaaat

SEQ ID NO: 9093973 - DNA, 22 bp, Homo sapiens
aagttcaaggaagcctccagtt

SEQ ID NO: 9093974 - DNA, 20 bp, Homo sapiens
actccaggtggcatgaggac

SEQ ID NO: 9093975 - DNA, 20 bp, Homo sapiens
actccaggtggcatgaggac

SEQ ID NO: 9093976 - DNA, 22 bp, Homo sapiens
actccaggtaggcacattgaca

SEQ ID NO: 9093977 - DNA, 22 bp, Homo sapiens
aagttcaaggcaggtcctgagg

SEQ ID NO: 9093978 - DNA, 20 bp, Homo sapiens
actccaggtggcatgaggac

SEQ ID NO: 9093979 - DNA, 22 bp, Homo sapiens
aagttagagattccatcatgct

SEQ ID NO: 9093980 - DNA, 22 bp, Homo sapiens
aagttactggcaagggctgcag

SEQ ID NO: 9093981 - DNA, 22 bp, Homo sapiens
aagttactggcaagggctgcag

SEQ ID NO: 9093982 - DNA, 23 bp, Homo sapiens
aagttagtttcaataaagcaatt

SEQ ID NO: 9093983 - DNA, 22 bp, Homo sapiens
aagttagtggataaacagcaaa

SEQ ID NO: 9093984 - DNA, 22 bp, Homo sapiens
actaatgattattgtcattgtg

SEQ ID NO: 9093985 - DNA, 22 bp, Homo sapiens
actaagtagtttcacatataat

SEQ ID NO: 9093986 - DNA, 22 bp, Homo sapiens
actaacatttgtgtatgtcttg

SEQ ID NO: 9093987 - DNA, 22 bp, Homo sapiens
actacaaaagcactgggtatta

SEQ ID NO: 9093988 - DNA, 22 bp, Homo sapiens
actaattgagtgcatgatcttt

SEQ ID NO: 9093989 - DNA, 22 bp, Homo sapiens
actaattgtatagttgatgtaa

SEQ ID NO: 9093990 - DNA, 20 bp, Homo sapiens
aagtgttttgacttctgacc

SEQ ID NO: 9093991 - DNA, 22 bp, Homo sapiens
actacaatactcttagtaaaag

SEQ ID NO: 9093992 - DNA, 22 bp, Homo sapiens
acacatatctaagatagatgac

SEQ ID NO: 9093993 - DNA, 22 bp, Homo sapiens
acacatatgccattacagcaaa

SEQ ID NO: 9093994 - DNA, 22 bp, Homo sapiens
acacatatatttgcatatacac

SEQ ID NO: 9093995 - DNA, 22 bp, Homo sapiens
acacatatatttgcatatacac

SEQ ID NO: 9093996 - DNA, 23 bp, Homo sapiens
acacatatattcagatacagatg

SEQ ID NO: 9093997 - DNA, 22 bp, Homo sapiens
agcagctttaagtcactggtta

SEQ ID NO: 9093998 - DNA, 22 bp, Homo sapiens
agcagcttggttttaggcatgg

SEQ ID NO: 9093999 - DNA, 22 bp, Homo sapiens
agcagcttgttaaaaagttcca

SEQ ID NO: 9094000 - DNA, 18 bp, Homo sapiens
agcagctttgtgcttgat

SEQ ID NO: 9094001 - DNA, 18 bp, Homo sapiens
agcagctttgtgcttgat

SEQ ID NO: 9094002 - DNA, 22 bp, Homo sapiens
agcagcagtacatataagacta

SEQ ID NO: 9094003 - DNA, 22 bp, Homo sapiens
agcagcagtacatataagacta

SEQ ID NO: 9094004 - DNA, 22 bp, Homo sapiens
agcagcagtatccttccccggc

SEQ ID NO: 9094005 - DNA, 22 bp, Homo sapiens
agcagcagtatccttccccggc

SEQ ID NO: 9094006 - DNA, 22 bp, Homo sapiens
agcagcagtcatgcctatgctc

SEQ ID NO: 9094007 - DNA, 22 bp, Homo sapiens
acacaggcaatgtgagtgggag

SEQ ID NO: 9094008 - DNA, 21 bp, Homo sapiens
acacaggcagtgtcccgaggt

SEQ ID NO: 9094009 - DNA, 22 bp, Homo sapiens
agcagcaggtgacctcgatgcc

SEQ ID NO: 9094010 - DNA, 22 bp, Homo sapiens
agcagcaggtgcttctggatct

SEQ ID NO: 9094011 - DNA, 22 bp, Homo sapiens
agcagcagtgtgtggtcatgtt

SEQ ID NO: 9094012 - DNA, 22 bp, Homo sapiens
agcagcagtgtggtttggggaa

SEQ ID NO: 9094013 - DNA, 23 bp, Homo sapiens
agcagcagtgagaggtgtcttac

SEQ ID NO: 9094014 - DNA, 23 bp, Homo sapiens
agcagcagtgagaggtgtcttac

SEQ ID NO: 9094015 - DNA, 22 bp, Homo sapiens
agcagcagtgacagccgaaagc

SEQ ID NO: 9094016 - DNA, 22 bp, Homo sapiens
agcagcagtcctttgtgtaatt

SEQ ID NO: 9094017 - DNA, 22 bp, Homo sapiens
agcagcagtgtgtggtcatgtt

SEQ ID NO: 9094018 - DNA, 22 bp, Homo sapiens
agcagcagtgttctggaattct

SEQ ID NO: 9094019 - DNA, 22 bp, Homo sapiens
acacaggaactctgagaggtgg

SEQ ID NO: 9094020 - DNA, 22 bp, Homo sapiens
acacaggaactctgagaggtgg

SEQ ID NO: 9094021 - DNA, 22 bp, Homo sapiens
acacaggaagagagataataat

SEQ ID NO: 9094022 - DNA, 22 bp, Homo sapiens
acaatttctgatcagtgaattt

SEQ ID NO: 9094023 - DNA, 22 bp, Homo sapiens
acaatttctaatatagatctta

SEQ ID NO: 9094024 - DNA, 20 bp, Homo sapiens
acaatttcctcactatatgc

SEQ ID NO: 9094025 - DNA, 22 bp, Homo sapiens
acaatttgaggctactcaattg

SEQ ID NO: 9094026 - DNA, 22 bp, Homo sapiens
acaattttaagccagagtgggt

SEQ ID NO: 9094027 - DNA, 22 bp, Homo sapiens
acacaggaggaggatggtggtc

SEQ ID NO: 9094028 - DNA, 22 bp, Homo sapiens
acacaggagatatgtaatggct

SEQ ID NO: 9094029 - DNA, 22 bp, Homo sapiens
acacaggagatatgtaatggct

SEQ ID NO: 9094030 - DNA, 22 bp, Homo sapiens
acacaggagatatgtaatggct

SEQ ID NO: 9094031 - DNA, 21 bp, Homo sapiens
acacaggagtttcttctttct

SEQ ID NO: 9094032 - DNA, 21 bp, Homo sapiens
acacaggagtttcttctttct

SEQ ID NO: 9094033 - DNA, 22 bp, Homo sapiens
acacaggaagtcagcactgatg

SEQ ID NO: 9094034 - DNA, 22 bp, Homo sapiens
acacaggaagtcagcactgatg

SEQ ID NO: 9094035 - DNA, 22 bp, Homo sapiens
acacaggaagtcagcactgatg

SEQ ID NO: 9094036 - DNA, 22 bp, Homo sapiens
acacaggacggccctgtggctt

SEQ ID NO: 9094037 - DNA, 22 bp, Homo sapiens
agcacctgcctgcattggctat

SEQ ID NO: 9094038 - DNA, 22 bp, Homo sapiens
acaatttatccattgtatagtt

SEQ ID NO: 9094039 - DNA, 22 bp, Homo sapiens
agcaccctcagccttatccaga

SEQ ID NO: 9094040 - DNA, 22 bp, Homo sapiens
agcaccatcgggttcttgcttt

SEQ ID NO: 9094041 - DNA, 22 bp, Homo sapiens
agcacctccagagcttgaagct

SEQ ID NO: 9094042 - DNA, 22 bp, Homo sapiens
agcaccctttgtgagcataagt

SEQ ID NO: 9094043 - DNA, 22 bp, Homo sapiens
agcacctgcacagtggaggaaa

SEQ ID NO: 9094044 - DNA, 22 bp, Homo sapiens
agcacctgcacagtggaggaaa

SEQ ID NO: 9094045 - DNA, 22 bp, Homo sapiens
agcacctccttagctatgacca

SEQ ID NO: 9094046 - DNA, 22 bp, Homo sapiens
agcagggcagtgcttcagctct

SEQ ID NO: 9094047 - DNA, 23 bp, Homo sapiens
acacatttttcccgttctgaggt

SEQ ID NO: 9094048 - DNA, 22 bp, Homo sapiens
acacattttctaacagggatca

SEQ ID NO: 9094049 - DNA, 22 bp, Homo sapiens
acacattttgttaaaccctgtg

SEQ ID NO: 9094050 - DNA, 23 bp, Homo sapiens
acacatttttcccgttctgaggt

SEQ ID NO: 9094051 - DNA, 22 bp, Homo sapiens
acacattttcaacactgtcaag

SEQ ID NO: 9094052 - DNA, 22 bp, Homo sapiens
acacattttcaacactgtcaag

SEQ ID NO: 9094053 - DNA, 19 bp, Homo sapiens
acacatttgcacaatccac

SEQ ID NO: 9094054 - DNA, 22 bp, Homo sapiens
acacatttgcataatacctcat

SEQ ID NO: 9094055 - DNA, 19 bp, Homo sapiens
acacatttgcacaatccac

SEQ ID NO: 9094056 - DNA, 22 bp, Homo sapiens
acacatttgcataatacctcat

SEQ ID NO: 9094057 - DNA, 22 bp, Homo sapiens
agcaggaaagaaaaatctgtgt

SEQ ID NO: 9094058 - DNA, 23 bp, Homo sapiens
agcaggaaaccgagggtgatgtt

SEQ ID NO: 9094059 - DNA, 23 bp, Homo sapiens
agcaggaaaccgagggtgatgtt

SEQ ID NO: 9094060 - DNA, 23 bp, Homo sapiens
agcaggaaaccgagggtgatgtt

SEQ ID NO: 9094061 - DNA, 22 bp, Homo sapiens
acacatttctctttttgtaagt

SEQ ID NO: 9094062 - DNA, 22 bp, Homo sapiens
acactgtgagctgaagggctgc

SEQ ID NO: 9094063 - DNA, 18 bp, Homo sapiens
acactgcagcagtctgct

SEQ ID NO: 9094064 - DNA, 18 bp, Homo sapiens
acactgcagcagtctgct

SEQ ID NO: 9094065 - DNA, 22 bp, Homo sapiens
acactgcagatgaaagcataag

SEQ ID NO: 9094066 - DNA, 22 bp, Homo sapiens
agcagggccaacagtaaacacc

SEQ ID NO: 9094067 - DNA, 22 bp, Homo sapiens
acagaaattcaaactggaattt

SEQ ID NO: 9094068 - DNA, 22 bp, Homo sapiens
acagaaattgctaatagctcat

SEQ ID NO: 9094069 - DNA, 22 bp, Homo sapiens
acagaaattctgggacagaaaa

SEQ ID NO: 9094070 - DNA, 22 bp, Homo sapiens
acagaaattctgggacagaaaa

SEQ ID NO: 9094071 - DNA, 22 bp, Homo sapiens
acagaaattgctaatagctcat

SEQ ID NO: 9094072 - DNA, 22 bp, Homo sapiens
acagaaattgctaatagctcat

SEQ ID NO: 9094073 - DNA, 22 bp, Homo sapiens
agccacagggggtgagggacaa

SEQ ID NO: 9094074 - DNA, 22 bp, Homo sapiens
agccacagggggtgagggacaa

SEQ ID NO: 9094075 - DNA, 22 bp, Homo sapiens
agccacagggggtgagggacaa

SEQ ID NO: 9094076 - DNA, 22 bp, Homo sapiens
agccacaggccatgagatacca

SEQ ID NO: 9094077 - DNA, 22 bp, Homo sapiens
agccacaggccatgagatacca

SEQ ID NO: 9094078 - DNA, 22 bp, Homo sapiens
agccacaggaaacagagacagc

SEQ ID NO: 9094079 - DNA, 22 bp, Homo sapiens
agccacaggaaacagagacagc

SEQ ID NO: 9094080 - DNA, 22 bp, Homo sapiens
acagaacaagacctgcttattg

SEQ ID NO: 9094081 - DNA, 22 bp, Homo sapiens
acagaacaagacctgcttattg

SEQ ID NO: 9094082 - DNA, 22 bp, Homo sapiens
acagaacaagacctgcttattg

SEQ ID NO: 9094083 - DNA, 22 bp, Homo sapiens
acagaaattgggcaaatggaag

SEQ ID NO: 9094084 - DNA, 22 bp, Homo sapiens
acagaacaacaaggtggaccag

SEQ ID NO: 9094085 - DNA, 22 bp, Homo sapiens
acagaaattgggcaaatggaag

SEQ ID NO: 9094086 - DNA, 20 bp, Homo sapiens
agcagtgtttcttgactcta

SEQ ID NO: 9094087 - DNA, 22 bp, Homo sapiens
agcagtgttggtgggagcatct

SEQ ID NO: 9094088 - DNA, 22 bp, Homo sapiens
agcagtgttctaatctggctag

SEQ ID NO: 9094089 - DNA, 22 bp, Homo sapiens
agcagttacgggcctatctagg

SEQ ID NO: 9094090 - DNA, 22 bp, Homo sapiens
agcagtgttttgattctgggag

SEQ ID NO: 9094091 - DNA, 22 bp, Homo sapiens
agcagttaccaaggaacctggt

SEQ ID NO: 9094092 - DNA, 20 bp, Homo sapiens
agcagtgtggggagactgtg

SEQ ID NO: 9094093 - DNA, 18 bp, Homo sapiens
agcagtgtggcaagcaga

SEQ ID NO: 9094094 - DNA, 22 bp, Homo sapiens
agcagtgtgcttcgtttcatga

SEQ ID NO: 9094095 - DNA, 22 bp, Homo sapiens
agcagtgggtgacagagctgag

SEQ ID NO: 9094096 - DNA, 22 bp, Homo sapiens
agcagtggctggatggtgtgct

SEQ ID NO: 9094097 - DNA, 22 bp, Homo sapiens
agcagtgggggagtgttagttt

SEQ ID NO: 9094098 - DNA, 22 bp, Homo sapiens
acactgtgcagattccctgtga

SEQ ID NO: 9094099 - DNA, 22 bp, Homo sapiens
agctctccacacataggactag

SEQ ID NO: 9094100 - DNA, 22 bp, Homo sapiens
agctccttgaagggctctggga

SEQ ID NO: 9094101 - DNA, 22 bp, Homo sapiens
agctcctgttctgagagcagga

SEQ ID NO: 9094102 - DNA, 22 bp, Homo sapiens
agctccttgaagggctctggga

SEQ ID NO: 9094103 - DNA, 22 bp, Homo sapiens
agctcctgttctgagagcagga

SEQ ID NO: 9094104 - DNA, 22 bp, Homo sapiens
agctcctgttctgagagcagga

SEQ ID NO: 9094105 - DNA, 19 bp, Homo sapiens
agctcctgttcagcagctc

SEQ ID NO: 9094106 - DNA, 19 bp, Homo sapiens
agctcctgttcagcagctc

SEQ ID NO: 9094107 - DNA, 19 bp, Homo sapiens
agctcctgttcagcagctc

SEQ ID NO: 9094108 - DNA, 19 bp, Homo sapiens
agctcctgttcagcagctc

SEQ ID NO: 9094109 - DNA, 22 bp, Homo sapiens
agctctgggctgacatgctccc

SEQ ID NO: 9094110 - DNA, 22 bp, Homo sapiens
agctctgggggaaagtctgctc

SEQ ID NO: 9094111 - DNA, 22 bp, Homo sapiens
acagcaggcacacaaggataga

SEQ ID NO: 9094112 - DNA, 22 bp, Homo sapiens
acagcaggcacacaaggataga

SEQ ID NO: 9094113 - DNA, 22 bp, Homo sapiens
acagcaggatttggcgatgttg

SEQ ID NO: 9094114 - DNA, 22 bp, Homo sapiens
acagcaggatttggcgatgttg

SEQ ID NO: 9094115 - DNA, 22 bp, Homo sapiens
acagcaggcatgaagaaatgtt

SEQ ID NO: 9094116 - DNA, 22 bp, Homo sapiens
agctcctgtgtgcccacctgct

SEQ ID NO: 9094117 - DNA, 22 bp, Homo sapiens
acagcaggagccttcatatgct

SEQ ID NO: 9094118 - DNA, 22 bp, Homo sapiens
acagcaaaggacgaacactctg

SEQ ID NO: 9094119 - DNA, 22 bp, Homo sapiens
acagcaaaggacgaacactctg

SEQ ID NO: 9094120 - DNA, 22 bp, Homo sapiens
acagcaactcctgcttctgagt

SEQ ID NO: 9094121 - DNA, 22 bp, Homo sapiens
acagcaagacccctagcatggt

SEQ ID NO: 9094122 - DNA, 17 bp, Homo sapiens
agcctgctgatctcaca

SEQ ID NO: 9094123 - DNA, 17 bp, Homo sapiens
agcctgctgatctcaca

SEQ ID NO: 9094124 - DNA, 22 bp, Homo sapiens
agcctgcgatcccacctggcct

SEQ ID NO: 9094125 - DNA, 22 bp, Homo sapiens
agcctgccttgggctgcttgag

SEQ ID NO: 9094126 - DNA, 20 bp, Homo sapiens
agcctgccagctggcccaga

SEQ ID NO: 9094127 - DNA, 21 bp, Homo sapiens
acagcaagccttcctttcagg

SEQ ID NO: 9094128 - DNA, 21 bp, Homo sapiens
acagcaagccttcctttcagg

SEQ ID NO: 9094129 - DNA, 21 bp, Homo sapiens
acagcaagccttcacatgagt

SEQ ID NO: 9094130 - DNA, 22 bp, Homo sapiens
acagcaataggaaatacttgca

SEQ ID NO: 9094131 - DNA, 22 bp, Homo sapiens
acagcaatctgagagacatagt

SEQ ID NO: 9094132 - DNA, 22 bp, Homo sapiens
acagcaagccagcttgtcactg

SEQ ID NO: 9094133 - DNA, 21 bp, Homo sapiens
acagcaagccttcacatgagt

SEQ ID NO: 9094134 - DNA, 23 bp, Homo sapiens
acagcaagaggaccagatgtgag

SEQ ID NO: 9094135 - DNA, 23 bp, Homo sapiens
acagcaagaggaccagatgtgag

SEQ ID NO: 9094136 - DNA, 22 bp, Homo sapiens
acagcaactcctgcttctgagt

SEQ ID NO: 9094137 - DNA, 23 bp, Homo sapiens
acagcaagaggaccagatgtgag

SEQ ID NO: 9094138 - DNA, 22 bp, Homo sapiens
agctatatagatggtgtgtttg

SEQ ID NO: 9094139 - DNA, 22 bp, Homo sapiens
agctagggcaaatatgagatac

SEQ ID NO: 9094140 - DNA, 17 bp, Homo sapiens
agctagggcctagaatc

SEQ ID NO: 9094141 - DNA, 22 bp, Homo sapiens
agctaggggaccaaggtggccc

SEQ ID NO: 9094142 - DNA, 22 bp, Homo sapiens
agccatcctccacagccttgat

SEQ ID NO: 9094143 - DNA, 22 bp, Homo sapiens
agccacagtctgatgcctgaga

SEQ ID NO: 9094144 - DNA, 22 bp, Homo sapiens
agccacagtctgatgcctgaga

SEQ ID NO: 9094145 - DNA, 22 bp, Homo sapiens
agccacagtctgatgcctgaga

SEQ ID NO: 9094146 - DNA, 22 bp, Homo sapiens
agccacagtcaacctgtccata

SEQ ID NO: 9094147 - DNA, 22 bp, Homo sapiens
agccacagtcaacctgtccata

SEQ ID NO: 9094148 - DNA, 22 bp, Homo sapiens
agccacagtcaacctgtccata

SEQ ID NO: 9094149 - DNA, 22 bp, Homo sapiens
agccacaggtgttggccagtgt

SEQ ID NO: 9094150 - DNA, 22 bp, Homo sapiens
agccacagtcaacctgtccata

SEQ ID NO: 9094151 - DNA, 22 bp, Homo sapiens
agccacagtcaacctgtccata

SEQ ID NO: 9094152 - DNA, 22 bp, Homo sapiens
agccatgggctcccagtccttt

SEQ ID NO: 9094153 - DNA, 22 bp, Homo sapiens
agccattgttgtcttcatcttc

SEQ ID NO: 9094154 - DNA, 22 bp, Homo sapiens
agccatgggagactgtgggaga

SEQ ID NO: 9094155 - DNA, 22 bp, Homo sapiens
agccatggcgccactagaggga

SEQ ID NO: 9094156 - DNA, 22 bp, Homo sapiens
agccatgctccttcccctctgg

SEQ ID NO: 9094157 - DNA, 22 bp, Homo sapiens
agccatctctgaaatcaaagct

SEQ ID NO: 9094158 - DNA, 22 bp, Homo sapiens
agcccagctgcctgcctgctgt

SEQ ID NO: 9094159 - DNA, 22 bp, Homo sapiens
agccattttggtaatgataaca

SEQ ID NO: 9094160 - DNA, 22 bp, Homo sapiens
agccattttggtaatgataaca

SEQ ID NO: 9094161 - DNA, 22 bp, Homo sapiens
agccattttggtaatgataaca

SEQ ID NO: 9094162 - DNA, 22 bp, Homo sapiens
agccattttcctgaaatataac

SEQ ID NO: 9094163 - DNA, 22 bp, Homo sapiens
agccattttcctgaaatataac

SEQ ID NO: 9094164 - DNA, 22 bp, Homo sapiens
agccatttggacttctggtagg

SEQ ID NO: 9094165 - DNA, 22 bp, Homo sapiens
agcccagcttccttctgtctct

SEQ ID NO: 9094166 - DNA, 22 bp, Homo sapiens
acagagcaggtccagaagtgcc

SEQ ID NO: 9094167 - DNA, 22 bp, Homo sapiens
acagagcactgccctgtgccgc

SEQ ID NO: 9094168 - DNA, 22 bp, Homo sapiens
acagagcatataaagtgctttg

SEQ ID NO: 9094169 - DNA, 22 bp, Homo sapiens
acagagcatgctcagtgtgtga

SEQ ID NO: 9094170 - DNA, 22 bp, Homo sapiens
acagagcatcagatgaaatcaa

SEQ ID NO: 9094171 - DNA, 22 bp, Homo sapiens
acagagcagttctggagctggc

SEQ ID NO: 9094172 - DNA, 22 bp, Homo sapiens
acagagcagttctggagctggc

SEQ ID NO: 9094173 - DNA, 22 bp, Homo sapiens
acagagcataatgtctagcaca

SEQ ID NO: 9094174 - DNA, 22 bp, Homo sapiens
agcccccaggagtctccacgcc

SEQ ID NO: 9094175 - DNA, 19 bp, Homo sapiens
agcccccagacagcaggcc

SEQ ID NO: 9094176 - DNA, 22 bp, Homo sapiens
acagagcatttgggacagagag

SEQ ID NO: 9094177 - DNA, 22 bp, Homo sapiens
agcccccaggagtctccacgcc

SEQ ID NO: 9094178 - DNA, 22 bp, Homo sapiens
agcccccaggatgcaaaatgac

SEQ ID NO: 9094179 - DNA, 22 bp, Homo sapiens
agcccccaggatgcaaaatgac

SEQ ID NO: 9094180 - DNA, 22 bp, Homo sapiens
agcccccagtctaaactgttgg

SEQ ID NO: 9094181 - DNA, 22 bp, Homo sapiens
agcccccaggatgcaaaatgac

SEQ ID NO: 9094182 - DNA, 22 bp, Homo sapiens
agcccccagtctaaactgttgg

SEQ ID NO: 9094183 - DNA, 23 bp, Homo sapiens
agcccctcatatctgctttctct

SEQ ID NO: 9094184 - DNA, 23 bp, Homo sapiens
agcccctcatggtgtctagacag

SEQ ID NO: 9094185 - DNA, 17 bp, Homo sapiens
agcccctcagcgtcacc

SEQ ID NO: 9094186 - DNA, 22 bp, Homo sapiens
agcccctctgtagctaatagta

SEQ ID NO: 9094187 - DNA, 22 bp, Homo sapiens
agcccctccagtggcataaaat

SEQ ID NO: 9094188 - DNA, 22 bp, Homo sapiens
agcccctctccgccctgagtcg

SEQ ID NO: 9094189 - DNA, 22 bp, Homo sapiens
acagagttgtgtttgtacaacg

SEQ ID NO: 9094190 - DNA, 22 bp, Homo sapiens
acagagtttatgtgtgtacaaa

SEQ ID NO: 9094191 - DNA, 22 bp, Homo sapiens
acagataaagaaacaatcacag

SEQ ID NO: 9094192 - DNA, 22 bp, Homo sapiens
acagagttgtaaacatttacca

SEQ ID NO: 9094193 - DNA, 22 bp, Homo sapiens
acagagttcccactccagaagc

SEQ ID NO: 9094194 - DNA, 22 bp, Homo sapiens
acagagttgtgtttgtacaacg

SEQ ID NO: 9094195 - DNA, 22 bp, Homo sapiens
acagagttaatggataggcagg

SEQ ID NO: 9094196 - DNA, 22 bp, Homo sapiens
acagagttaaagtggagtttaa

SEQ ID NO: 9094197 - DNA, 23 bp, Homo sapiens
acagaggtccaaacagtataagc

SEQ ID NO: 9094198 - DNA, 22 bp, Homo sapiens
agcccctctgtggctctgcctc

SEQ ID NO: 9094199 - DNA, 22 bp, Homo sapiens
acagaggtggacctcagcaggc

SEQ ID NO: 9094200 - DNA, 22 bp, Homo sapiens
acagaggtggacctcagcaggc

SEQ ID NO: 9094201 - DNA, 22 bp, Homo sapiens
agagctgggacttggactcaat

SEQ ID NO: 9094202 - DNA, 22 bp, Homo sapiens
agagctggggcataaatgccac

SEQ ID NO: 9094203 - DNA, 22 bp, Homo sapiens
agagctgggacttggactcaat

SEQ ID NO: 9094204 - DNA, 22 bp, Homo sapiens
agagctgggacttggactcaat

SEQ ID NO: 9094205 - DNA, 22 bp, Homo sapiens
agagctgggacttggactcaat

SEQ ID NO: 9094206 - DNA, 22 bp, Homo sapiens
agagctgggacttggactcaat

SEQ ID NO: 9094207 - DNA, 22 bp, Homo sapiens
aatttatatgtaattaggcaca

SEQ ID NO: 9094208 - DNA, 22 bp, Homo sapiens
aatttacacttcatttggaggg

SEQ ID NO: 9094209 - DNA, 22 bp, Homo sapiens
aatttacacttcatttggaggg

SEQ ID NO: 9094210 - DNA, 22 bp, Homo sapiens
aatttacacttcatttggaggg

SEQ ID NO: 9094211 - DNA, 22 bp, Homo sapiens
aatttacaggtgcactcgccat

SEQ ID NO: 9094212 - DNA, 22 bp, Homo sapiens
aatttacaggtgcactcgccat

SEQ ID NO: 9094213 - DNA, 22 bp, Homo sapiens
aatttacaggtgcactcgccat

SEQ ID NO: 9094214 - DNA, 22 bp, Homo sapiens
aatttacaggtgcactcgccat

SEQ ID NO: 9094215 - DNA, 22 bp, Homo sapiens
aatttacagttgctgatggtac

SEQ ID NO: 9094216 - DNA, 22 bp, Homo sapiens
aatttacagttgctgatggtac

SEQ ID NO: 9094217 - DNA, 22 bp, Homo sapiens
aatttacagttgctgatggtac

SEQ ID NO: 9094218 - DNA, 22 bp, Homo sapiens
aatttacagttgctgatggtac

SEQ ID NO: 9094219 - DNA, 20 bp, Homo sapiens
aatttactcacagaatgaat

SEQ ID NO: 9094220 - DNA, 20 bp, Homo sapiens
aatttactcacagaatgaat

SEQ ID NO: 9094221 - DNA, 22 bp, Homo sapiens
aattatattgtggtgtgaatgt

SEQ ID NO: 9094222 - DNA, 22 bp, Homo sapiens
aattatattgtggtgtgaatgt

SEQ ID NO: 9094223 - DNA, 22 bp, Homo sapiens
aattatccacctttgcatgatt

SEQ ID NO: 9094224 - DNA, 22 bp, Homo sapiens
aattatggaatttttagagaag

SEQ ID NO: 9094225 - DNA, 22 bp, Homo sapiens
aattatggtatgttcaacaact

SEQ ID NO: 9094226 - DNA, 22 bp, Homo sapiens
aattatggtcactgttcctggg

SEQ ID NO: 9094227 - DNA, 22 bp, Homo sapiens
aattatggtggatcccagtggg

SEQ ID NO: 9094228 - DNA, 22 bp, Homo sapiens
aattatggtgtgtggttaaggg

SEQ ID NO: 9094229 - DNA, 22 bp, Homo sapiens
aattatattgaagttgaatgtc

SEQ ID NO: 9094230 - DNA, 22 bp, Homo sapiens
aattatattgaagttgaatgtc

SEQ ID NO: 9094231 - DNA, 22 bp, Homo sapiens
aattatatgttaatcttcaatt

SEQ ID NO: 9094232 - DNA, 22 bp, Homo sapiens
aattatatgttaatcttcaatt

SEQ ID NO: 9094233 - DNA, 20 bp, Homo sapiens
aattatataactccaacatt

SEQ ID NO: 9094234 - DNA, 20 bp, Homo sapiens
aattatataactccaacatt

SEQ ID NO: 9094235 - DNA, 22 bp, Homo sapiens
aattatatgttaatcttcaatt

SEQ ID NO: 9094236 - DNA, 22 bp, Homo sapiens
aattagtattgcgattcattag

SEQ ID NO: 9094237 - DNA, 22 bp, Homo sapiens
aattaccatcgtcaaatcatat

SEQ ID NO: 9094238 - DNA, 20 bp, Homo sapiens
aattagcttaagtcaatcag

SEQ ID NO: 9094239 - DNA, 22 bp, Homo sapiens
aatgttgttggctcttcatgat

SEQ ID NO: 9094240 - DNA, 22 bp, Homo sapiens
aatgtttcgtaaattgtctatg

SEQ ID NO: 9094241 - DNA, 22 bp, Homo sapiens
aatgtttctggatattgtgggt

SEQ ID NO: 9094242 - DNA, 22 bp, Homo sapiens
aatgtttcaattaagtctttta

SEQ ID NO: 9094243 - DNA, 22 bp, Homo sapiens
aatgtttcatttagttgtctcc

SEQ ID NO: 9094244 - DNA, 22 bp, Homo sapiens
aatgttatttctgcatagtagt

SEQ ID NO: 9094245 - DNA, 22 bp, Homo sapiens
aatgttattgtcctttccaaaa

SEQ ID NO: 9094246 - DNA, 22 bp, Homo sapiens
aatgttcaaaagcatcagtgaa

SEQ ID NO: 9094247 - DNA, 22 bp, Homo sapiens
aatgttcagaggacaatataaa

SEQ ID NO: 9094248 - DNA, 22 bp, Homo sapiens
aatgttcaaacagatcacttag

SEQ ID NO: 9094249 - DNA, 22 bp, Homo sapiens
aatgttcagcgagggatgctag

SEQ ID NO: 9094250 - DNA, 22 bp, Homo sapiens
aatgttctcaacaaaaggaagc

SEQ ID NO: 9094251 - DNA, 22 bp, Homo sapiens
aatgttctgggagagaagctgt

SEQ ID NO: 9094252 - DNA, 22 bp, Homo sapiens
aatgttgccccaggacaaagga

SEQ ID NO: 9094253 - DNA, 22 bp, Homo sapiens
aatgttgcagagtgattgtcca

SEQ ID NO: 9094254 - DNA, 22 bp, Homo sapiens
aatgtctgtgccttaaaacttc

SEQ ID NO: 9094255 - DNA, 22 bp, Homo sapiens
aatgtctgctctactcaggagg

SEQ ID NO: 9094256 - DNA, 22 bp, Homo sapiens
aatgtctgagtctctgtatccc

SEQ ID NO: 9094257 - DNA, 22 bp, Homo sapiens
aatgtctgaggctcatctgagg

SEQ ID NO: 9094258 - DNA, 22 bp, Homo sapiens
aatgtcatttttaaatgtgaga

SEQ ID NO: 9094259 - DNA, 22 bp, Homo sapiens
aatgtctacaccgtatgttgtt

SEQ ID NO: 9094260 - DNA, 22 bp, Homo sapiens
aatgtctatttgctacaaagcc

SEQ ID NO: 9094261 - DNA, 22 bp, Homo sapiens
aatgtctacattctgaattcgt

SEQ ID NO: 9094262 - DNA, 22 bp, Homo sapiens
agacagggtcttgatcagagct

SEQ ID NO: 9094263 - DNA, 22 bp, Homo sapiens
agacagggtgatcgcttgagcc

SEQ ID NO: 9094264 - DNA, 22 bp, Homo sapiens
agacagggtgatcgcttgagcc

SEQ ID NO: 9094265 - DNA, 22 bp, Homo sapiens
aatgtattctctttataagata

SEQ ID NO: 9094266 - DNA, 22 bp, Homo sapiens
aatgtattcctcatgcaagagt

SEQ ID NO: 9094267 - DNA, 22 bp, Homo sapiens
agacagggccactcatcctcac

SEQ ID NO: 9094268 - DNA, 22 bp, Homo sapiens
agacagggtcttgatcagagct

SEQ ID NO: 9094269 - DNA, 21 bp, Homo sapiens
aatgtcattgaatggtgagac

SEQ ID NO: 9094270 - DNA, 22 bp, Homo sapiens
aatgtcaattaccagaacagaa

SEQ ID NO: 9094271 - DNA, 22 bp, Homo sapiens
aatgtcaattaccagaacagaa

SEQ ID NO: 9094272 - DNA, 22 bp, Homo sapiens
aatgtcaattaccagaacagaa

SEQ ID NO: 9094273 - DNA, 22 bp, Homo sapiens
aatgtattctctttataagata

SEQ ID NO: 9094274 - DNA, 22 bp, Homo sapiens
aatgtcaatctcagagaacaca

SEQ ID NO: 9094275 - DNA, 21 bp, Homo sapiens
agaagggattgtggtaaagat

SEQ ID NO: 9094276 - DNA, 22 bp, Homo sapiens
agaagggctacacgggctctcc

SEQ ID NO: 9094277 - DNA, 22 bp, Homo sapiens
agaaggggcccaaggatgtcag

SEQ ID NO: 9094278 - DNA, 22 bp, Homo sapiens
agaagggtagggacttatccaa

SEQ ID NO: 9094279 - DNA, 22 bp, Homo sapiens
agaagggtagttgtaagagtga

SEQ ID NO: 9094280 - DNA, 22 bp, Homo sapiens
agaagtaggcagggctgtatca

SEQ ID NO: 9094281 - DNA, 22 bp, Homo sapiens
agaagggtgtatacatttcctg

SEQ ID NO: 9094282 - DNA, 22 bp, Homo sapiens
agaagggttcaggaatatgtta

SEQ ID NO: 9094283 - DNA, 23 bp, Homo sapiens
agaagggtccttggcagcgacag

SEQ ID NO: 9094284 - DNA, 23 bp, Homo sapiens
agaagggtccttggcagcgacag

SEQ ID NO: 9094285 - DNA, 23 bp, Homo sapiens
agaagggtccttggcagcgacag

SEQ ID NO: 9094286 - DNA, 23 bp, Homo sapiens
agaaggtgggcctgctgagttat

SEQ ID NO: 9094287 - DNA, 22 bp, Homo sapiens
aatgcaaacagcccagaatcca

SEQ ID NO: 9094288 - DNA, 22 bp, Homo sapiens
aatgcaaacagcccagaatcca

SEQ ID NO: 9094289 - DNA, 22 bp, Homo sapiens
aatgcaaacttcttgttacttg

SEQ ID NO: 9094290 - DNA, 22 bp, Homo sapiens
aatgcaaacttcttgttacttg

SEQ ID NO: 9094291 - DNA, 22 bp, Homo sapiens
aatgcaaagcaagcagagattt

SEQ ID NO: 9094292 - DNA, 22 bp, Homo sapiens
aatgcaaagcaagcagagattt

SEQ ID NO: 9094293 - DNA, 22 bp, Homo sapiens
aatgcaaagctctttaatcctt

SEQ ID NO: 9094294 - DNA, 22 bp, Homo sapiens
aatgcaaattctagggccctat

SEQ ID NO: 9094295 - DNA, 22 bp, Homo sapiens
aatgcaaattatcaggcttctc

SEQ ID NO: 9094296 - DNA, 22 bp, Homo sapiens
agacagagatactatgttgtca

SEQ ID NO: 9094297 - DNA, 22 bp, Homo sapiens
agacagagatactatgttgtca

SEQ ID NO: 9094298 - DNA, 19 bp, Homo sapiens
agacagagctcagtgggtt

SEQ ID NO: 9094299 - DNA, 19 bp, Homo sapiens
agacagagctcagtgggtt

SEQ ID NO: 9094300 - DNA, 19 bp, Homo sapiens
agacagagctcagtgggtt

SEQ ID NO: 9094301 - DNA, 22 bp, Homo sapiens
agacagagatactatgttgtca

SEQ ID NO: 9094302 - DNA, 21 bp, Homo sapiens
agacactggtttagcattcat

SEQ ID NO: 9094303 - DNA, 22 bp, Homo sapiens
agacaggccactctggtctggt

SEQ ID NO: 9094304 - DNA, 22 bp, Homo sapiens
agacaggccactctggtctggt

SEQ ID NO: 9094305 - DNA, 22 bp, Homo sapiens
agacagcagaaactagagcact

SEQ ID NO: 9094306 - DNA, 21 bp, Homo sapiens
agacagagtgcagtctacata

SEQ ID NO: 9094307 - DNA, 21 bp, Homo sapiens
agacagagtgcagtctacata

SEQ ID NO: 9094308 - DNA, 22 bp, Homo sapiens
agacagcaatatgggagacgga

SEQ ID NO: 9094309 - DNA, 23 bp, Homo sapiens
agacagaggctgaggctggccgc

SEQ ID NO: 9094310 - DNA, 23 bp, Homo sapiens
agacagaggctgaggctggccgc

SEQ ID NO: 9094311 - DNA, 23 bp, Homo sapiens
agacagaggctgaggctggccgc

SEQ ID NO: 9094312 - DNA, 22 bp, Homo sapiens
acaattcaagatgagattcagg

SEQ ID NO: 9094313 - DNA, 22 bp, Homo sapiens
acaattcaagatgagattcagg

SEQ ID NO: 9094314 - DNA, 22 bp, Homo sapiens
acaattcaagatgagattcagg

SEQ ID NO: 9094315 - DNA, 22 bp, Homo sapiens
acaattcaagaagagagatgaa

SEQ ID NO: 9094316 - DNA, 22 bp, Homo sapiens
acaattcattaatgtgaggtag

SEQ ID NO: 9094317 - DNA, 22 bp, Homo sapiens
acaattccacatggcatgcagg

SEQ ID NO: 9094318 - DNA, 22 bp, Homo sapiens
acaattcaagcaagagagacaa

SEQ ID NO: 9094319 - DNA, 22 bp, Homo sapiens
acaattcactccagtgacccca

SEQ ID NO: 9094320 - DNA, 22 bp, Homo sapiens
acaatgtttttgttcaaagagt

SEQ ID NO: 9094321 - DNA, 22 bp, Homo sapiens
acaatgttttgaaacatctagg

SEQ ID NO: 9094322 - DNA, 22 bp, Homo sapiens
agatggggtttcatcatgttgg

SEQ ID NO: 9094323 - DNA, 22 bp, Homo sapiens
agatggggtttcatcatgttgg

SEQ ID NO: 9094324 - DNA, 22 bp, Homo sapiens
agatggggtttcatcatgttgg

SEQ ID NO: 9094325 - DNA, 22 bp, Homo sapiens
agatggggctgaaagttccaat

SEQ ID NO: 9094326 - DNA, 22 bp, Homo sapiens
agatggggctgaaagttccaat

SEQ ID NO: 9094327 - DNA, 22 bp, Homo sapiens
agatggggctgaaagttccaat

SEQ ID NO: 9094328 - DNA, 22 bp, Homo sapiens
agatggggctcagtgtggaggc

SEQ ID NO: 9094329 - DNA, 22 bp, Homo sapiens
agatggggctcagtgtggaggc

SEQ ID NO: 9094330 - DNA, 22 bp, Homo sapiens
agcaaggcagctttcactgctt

SEQ ID NO: 9094331 - DNA, 22 bp, Homo sapiens
agcacaggtacggagatgctac

SEQ ID NO: 9094332 - DNA, 22 bp, Homo sapiens
agcaagattttccttgaatgtt

SEQ ID NO: 9094333 - DNA, 22 bp, Homo sapiens
agcaagatttttcaggttagta

SEQ ID NO: 9094334 - DNA, 22 bp, Homo sapiens
agcaagattgaggcttcctcag

SEQ ID NO: 9094335 - DNA, 22 bp, Homo sapiens
agcaagcagaaatgccatggca

SEQ ID NO: 9094336 - DNA, 22 bp, Homo sapiens
agcaagcagaattctgtcctct

SEQ ID NO: 9094337 - DNA, 22 bp, Homo sapiens
agcaagctggaggggctcatga

SEQ ID NO: 9094338 - DNA, 22 bp, Homo sapiens
agcaagctgttcttggagagta

SEQ ID NO: 9094339 - DNA, 22 bp, Homo sapiens
agcaagcattgctggttaggtc

SEQ ID NO: 9094340 - DNA, 22 bp, Homo sapiens
agcaagctacctagatagtcta

SEQ ID NO: 9094341 - DNA, 22 bp, Homo sapiens
acaagtttatttgattagaaca

SEQ ID NO: 9094342 - DNA, 22 bp, Homo sapiens
acaagttccactacagagttgt

SEQ ID NO: 9094343 - DNA, 22 bp, Homo sapiens
acaagttctgggaattaggaca

SEQ ID NO: 9094344 - DNA, 22 bp, Homo sapiens
acaagttctgggaattaggaca

SEQ ID NO: 9094345 - DNA, 22 bp, Homo sapiens
acaagttcatggtgctttcctg

SEQ ID NO: 9094346 - DNA, 22 bp, Homo sapiens
agatggggctcagtgtggaggc

SEQ ID NO: 9094347 - DNA, 22 bp, Homo sapiens
agatggggcagaatggagccat

SEQ ID NO: 9094348 - DNA, 19 bp, Homo sapiens
agatggggaagagtgtgag

SEQ ID NO: 9094349 - DNA, 22 bp, Homo sapiens
agatggggcagaatggagccat

SEQ ID NO: 9094350 - DNA, 22 bp, Homo sapiens
acaaggtatccacattaaatgt

SEQ ID NO: 9094351 - DNA, 19 bp, Homo sapiens
acaagtcacttacttagta

SEQ ID NO: 9094352 - DNA, 22 bp, Homo sapiens
acaagtgggtcctacataaagc

SEQ ID NO: 9094353 - DNA, 22 bp, Homo sapiens
acaaattctttctgcctattgg

SEQ ID NO: 9094354 - DNA, 22 bp, Homo sapiens
acaagctttgtgatagtagaga

SEQ ID NO: 9094355 - DNA, 22 bp, Homo sapiens
acaagctttgtgatagtagaga

SEQ ID NO: 9094356 - DNA, 22 bp, Homo sapiens
acaaggaacaagcatgtagttt

SEQ ID NO: 9094357 - DNA, 22 bp, Homo sapiens
acaaggctttggagggttctta

SEQ ID NO: 9094358 - DNA, 22 bp, Homo sapiens
acaaatgttacataagtttgga

SEQ ID NO: 9094359 - DNA, 22 bp, Homo sapiens
acaaattatagaaaattgagct

SEQ ID NO: 9094360 - DNA, 22 bp, Homo sapiens
acaaatgtctacattgagaata

SEQ ID NO: 9094361 - DNA, 18 bp, Homo sapiens
acaaatgtagtgtcttaa

SEQ ID NO: 9094362 - DNA, 22 bp, Homo sapiens
agagctgggtggtggtgactca

SEQ ID NO: 9094363 - DNA, 22 bp, Homo sapiens
agagctgggtggacttgtagtt

SEQ ID NO: 9094364 - DNA, 22 bp, Homo sapiens
agagctggggccagagtcaagg

SEQ ID NO: 9094365 - DNA, 22 bp, Homo sapiens
agagctggggcccgtaaagcca

SEQ ID NO: 9094366 - DNA, 22 bp, Homo sapiens
agagctggggccagagtcaagg

SEQ ID NO: 9094367 - DNA, 22 bp, Homo sapiens
agagctggggccagagtcaagg

SEQ ID NO: 9094368 - DNA, 22 bp, Homo sapiens
agagctggggccagagtcaagg

SEQ ID NO: 9094369 - DNA, 22 bp, Homo sapiens
agagctggggccagagtcaagg

SEQ ID NO: 9094370 - DNA, 22 bp, Homo sapiens
agagctggggccagagtcaagg

SEQ ID NO: 9094371 - DNA, 22 bp, Homo sapiens
agagctgggtgaagtgccatca

SEQ ID NO: 9094372 - DNA, 22 bp, Homo sapiens
agagctgggtgaagtgccatca

SEQ ID NO: 9094373 - DNA, 22 bp, Homo sapiens
agagctgggtgaagtgccatca

SEQ ID NO: 9094374 - DNA, 22 bp, Homo sapiens
agagctggggctctgggtttaa

SEQ ID NO: 9094375 - DNA, 22 bp, Homo sapiens
aattttctaaggtgatgatctg

SEQ ID NO: 9094376 - DNA, 22 bp, Homo sapiens
aattttctaaggtgatgatctg

SEQ ID NO: 9094377 - DNA, 22 bp, Homo sapiens
aattttattaactggatgtagc

SEQ ID NO: 9094378 - DNA, 22 bp, Homo sapiens
aattttatgccttgcacgttgg

SEQ ID NO: 9094379 - DNA, 22 bp, Homo sapiens
agaggccatctgctctgtgggg

SEQ ID NO: 9094380 - DNA, 20 bp, Homo sapiens
agaggccagttaggagtcta

SEQ ID NO: 9094381 - DNA, 20 bp, Homo sapiens
agaggccagttaggagtcta

SEQ ID NO: 9094382 - DNA, 22 bp, Homo sapiens
aattttctgatgatgaagcacg

SEQ ID NO: 9094383 - DNA, 22 bp, Homo sapiens
aattttctaaggtgatgatctg

SEQ ID NO: 9094384 - DNA, 22 bp, Homo sapiens
aattttctgcctagcaaaaact

SEQ ID NO: 9094385 - DNA, 22 bp, Homo sapiens
agaggccatgctagaggcctgg

SEQ ID NO: 9094386 - DNA, 22 bp, Homo sapiens
agaggccatggggcatttttca

SEQ ID NO: 9094387 - DNA, 22 bp, Homo sapiens
agaggccccatgggatggcggt

SEQ ID NO: 9094388 - DNA, 22 bp, Homo sapiens
agaggccccaggtgagcatgcc

SEQ ID NO: 9094389 - DNA, 22 bp, Homo sapiens
acaaaaagggagatgaggtaga

SEQ ID NO: 9094390 - DNA, 22 bp, Homo sapiens
acaaaatagagttctcccctgg

SEQ ID NO: 9094391 - DNA, 20 bp, Homo sapiens
acaaaataggtactgggtag

SEQ ID NO: 9094392 - DNA, 22 bp, Homo sapiens
acaaacagagttgaaaaatagg

SEQ ID NO: 9094393 - DNA, 22 bp, Homo sapiens
acaaacagagttgaaaaatagg

SEQ ID NO: 9094394 - DNA, 22 bp, Homo sapiens
acaaacagctaacatatgttaa

SEQ ID NO: 9094395 - DNA, 22 bp, Homo sapiens
acaaacagctaacatatgttaa

SEQ ID NO: 9094396 - DNA, 22 bp, Homo sapiens
acaaacagagttgaaaaatagg

SEQ ID NO: 9094397 - DNA, 22 bp, Homo sapiens
acaaacatcttgacctcagatt

SEQ ID NO: 9094398 - DNA, 22 bp, Homo sapiens
acaaaccagcttaagcaagatg

SEQ ID NO: 9094399 - DNA, 22 bp, Homo sapiens
acaaaccagcttaagcaagatg

SEQ ID NO: 9094400 - DNA, 22 bp, Homo sapiens
acaaaccagcttaagcaagatg

SEQ ID NO: 9094401 - DNA, 22 bp, Homo sapiens
acaaaccagcttaagcaagatg

SEQ ID NO: 9094402 - DNA, 22 bp, Homo sapiens
acaaactaaaattctttattga

SEQ ID NO: 9094403 - DNA, 22 bp, Homo sapiens
acaaaatttttagacaaggctt

SEQ ID NO: 9094404 - DNA, 22 bp, Homo sapiens
acaaaatttttagacaaggctt

SEQ ID NO: 9094405 - DNA, 22 bp, Homo sapiens
acaaaattgtgttaaactttat

SEQ ID NO: 9094406 - DNA, 22 bp, Homo sapiens
acaaaattgtgttaaactttat

SEQ ID NO: 9094407 - DNA, 22 bp, Homo sapiens
acaaaattgtgttaaactttat

SEQ ID NO: 9094408 - DNA, 22 bp, Homo sapiens
acaaaattgtgttaaactttat

SEQ ID NO: 9094409 - DNA, 22 bp, Homo sapiens
acaaaattacctagttattttc

SEQ ID NO: 9094410 - DNA, 22 bp, Homo sapiens
acaaatgagaatgtagacagag

SEQ ID NO: 9094411 - DNA, 22 bp, Homo sapiens
acaaatgagaatgtagacagag

SEQ ID NO: 9094412 - DNA, 22 bp, Homo sapiens
acaaatgagaatgtagacagag

SEQ ID NO: 9094413 - DNA, 22 bp, Homo sapiens
acaaatgccatgtgacctacca

SEQ ID NO: 9094414 - DNA, 22 bp, Homo sapiens
acaaatgcaagttttatgtcaa

SEQ ID NO: 9094415 - DNA, 22 bp, Homo sapiens
acaaactgaatgggttttctgt

SEQ ID NO: 9094416 - DNA, 22 bp, Homo sapiens
aagaggaaatgattgactatat

SEQ ID NO: 9094417 - DNA, 22 bp, Homo sapiens
aagaggaactgggggctgagtc

SEQ ID NO: 9094418 - DNA, 22 bp, Homo sapiens
aagagctgtatgccatatgatt

SEQ ID NO: 9094419 - DNA, 22 bp, Homo sapiens
aagagctgtatgccatatgatt

SEQ ID NO: 9094420 - DNA, 21 bp, Homo sapiens
aagagctgtcaggaaggctgc

SEQ ID NO: 9094421 - DNA, 22 bp, Homo sapiens
aagagctggctcttgcagcagc

SEQ ID NO: 9094422 - DNA, 22 bp, Homo sapiens
aagagctggctcttgcagcagc

SEQ ID NO: 9094423 - DNA, 22 bp, Homo sapiens
aagagctggtcacaggtccatt

SEQ ID NO: 9094424 - DNA, 22 bp, Homo sapiens
aagagctggctcttgcagcagc

SEQ ID NO: 9094425 - DNA, 22 bp, Homo sapiens
aagagctggatggaatctggga

SEQ ID NO: 9094426 - DNA, 22 bp, Homo sapiens
aagagctggatggaatctggga

SEQ ID NO: 9094427 - DNA, 21 bp, Homo sapiens
aagagctggatcaaggataag

SEQ ID NO: 9094428 - DNA, 22 bp, Homo sapiens
aagagctggatgaagaaatcaa

SEQ ID NO: 9094429 - DNA, 22 bp, Homo sapiens
aagagctggattgtgctgcaga

SEQ ID NO: 9094430 - DNA, 22 bp, Homo sapiens
aagagctggcccaatctgagca

SEQ ID NO: 9094431 - DNA, 22 bp, Homo sapiens
aagagctggattgtgctgcaga

SEQ ID NO: 9094432 - DNA, 22 bp, Homo sapiens
aagagctggcccaatctgagca

SEQ ID NO: 9094433 - DNA, 22 bp, Homo sapiens
aagagctggagctgctacagga

SEQ ID NO: 9094434 - DNA, 22 bp, Homo sapiens
aagagctggaagtgaagataac

SEQ ID NO: 9094435 - DNA, 22 bp, Homo sapiens
aagagctggagtttgcagccct

SEQ ID NO: 9094436 - DNA, 22 bp, Homo sapiens
aagagctggagtttgcagccct

SEQ ID NO: 9094437 - DNA, 22 bp, Homo sapiens
aagagctggagtttgcagccct

SEQ ID NO: 9094438 - DNA, 22 bp, Homo sapiens
aagagctgattaagtcatgagg

SEQ ID NO: 9094439 - DNA, 22 bp, Homo sapiens
aagagctgattaagtcatgagg

SEQ ID NO: 9094440 - DNA, 22 bp, Homo sapiens
aagagctgattaagtcatgagg

SEQ ID NO: 9094441 - DNA, 22 bp, Homo sapiens
aagagctgcccaaggtgaacag

SEQ ID NO: 9094442 - DNA, 22 bp, Homo sapiens
aagagctgcccaaggtgaacag

SEQ ID NO: 9094443 - DNA, 22 bp, Homo sapiens
aagagctgcatctaagccatga

SEQ ID NO: 9094444 - DNA, 22 bp, Homo sapiens
aagagctccaggcaatgcggtc

SEQ ID NO: 9094445 - DNA, 20 bp, Homo sapiens
aagagctgactcacagtggt

SEQ ID NO: 9094446 - DNA, 22 bp, Homo sapiens
acaaggctgctgtgattgggaa

SEQ ID NO: 9094447 - DNA, 19 bp, Homo sapiens
acaaggctgggagagcgcc

SEQ ID NO: 9094448 - DNA, 22 bp, Homo sapiens
acaaggctgtggggagaactga

SEQ ID NO: 9094449 - DNA, 22 bp, Homo sapiens
acaaggctctaatttcattgaa

SEQ ID NO: 9094450 - DNA, 22 bp, Homo sapiens
acaaggctgaacagtgaagccg

SEQ ID NO: 9094451 - DNA, 22 bp, Homo sapiens
acaaggcagtacaatgatgaca

SEQ ID NO: 9094452 - DNA, 22 bp, Homo sapiens
acaaggcactttatgaagagga

SEQ ID NO: 9094453 - DNA, 22 bp, Homo sapiens
acaaggcactttatgaagagga

SEQ ID NO: 9094454 - DNA, 22 bp, Homo sapiens
acaaagataagtcagaaagtca

SEQ ID NO: 9094455 - DNA, 22 bp, Homo sapiens
acaaagatgtttaaagcattta

SEQ ID NO: 9094456 - DNA, 22 bp, Homo sapiens
acaaagatgtttaaagcattta

SEQ ID NO: 9094457 - DNA, 22 bp, Homo sapiens
acaaagatgtttaaagcattta

SEQ ID NO: 9094458 - DNA, 22 bp, Homo sapiens
acaaagatcttgctttcctact

SEQ ID NO: 9094459 - DNA, 22 bp, Homo sapiens
acaaagattcatttgcattatt

SEQ ID NO: 9094460 - DNA, 22 bp, Homo sapiens
aagagagaactcccttcgccag

SEQ ID NO: 9094461 - DNA, 22 bp, Homo sapiens
acaaagcacgagtgccatggac

SEQ ID NO: 9094462 - DNA, 22 bp, Homo sapiens
acaaagagggaccagtgacttg

SEQ ID NO: 9094463 - DNA, 22 bp, Homo sapiens
aagacatcagtgatgacatttg

SEQ ID NO: 9094464 - DNA, 22 bp, Homo sapiens
aagacattactggaatctgact

SEQ ID NO: 9094465 - DNA, 22 bp, Homo sapiens
aagacatgttttaagaatattt

SEQ ID NO: 9094466 - DNA, 22 bp, Homo sapiens
aagagaggggttgcatggaaat

SEQ ID NO: 9094467 - DNA, 22 bp, Homo sapiens
aagagaggggttgcatggaaat

SEQ ID NO: 9094468 - DNA, 22 bp, Homo sapiens
aagagagtcagtctgagcacca

SEQ ID NO: 9094469 - DNA, 22 bp, Homo sapiens
aagagagggatttggtttattg

SEQ ID NO: 9094470 - DNA, 22 bp, Homo sapiens
aagagaggggttgcatggaaat

SEQ ID NO: 9094471 - DNA, 17 bp, Homo sapiens
aagagaggctgagctgg

SEQ ID NO: 9094472 - DNA, 17 bp, Homo sapiens
aagagaggctgagctgg

SEQ ID NO: 9094473 - DNA, 17 bp, Homo sapiens
aagagaggctgagctgg

SEQ ID NO: 9094474 - DNA, 22 bp, Homo sapiens
aagagaggacatggtgaacctg

SEQ ID NO: 9094475 - DNA, 22 bp, Homo sapiens
aagagaggacatggtgaacctg

SEQ ID NO: 9094476 - DNA, 17 bp, Homo sapiens
aagagaggctgagctgg

SEQ ID NO: 9094477 - DNA, 22 bp, Homo sapiens
aagagagggacttattaaagtc

SEQ ID NO: 9094478 - DNA, 22 bp, Homo sapiens
aagagatgttgaagtttattag

SEQ ID NO: 9094479 - DNA, 22 bp, Homo sapiens
aagagatgtgggctgctgtgca

SEQ ID NO: 9094480 - DNA, 22 bp, Homo sapiens
aagagatgtgggctgctgtgca

SEQ ID NO: 9094481 - DNA, 22 bp, Homo sapiens
aagagatgttgaagtttattag

SEQ ID NO: 9094482 - DNA, 22 bp, Homo sapiens
aagagatgttgaagtttattag

SEQ ID NO: 9094483 - DNA, 22 bp, Homo sapiens
aagagatgatggcagccagagg

SEQ ID NO: 9094484 - DNA, 22 bp, Homo sapiens
aagagatgatggcagccagagg

SEQ ID NO: 9094485 - DNA, 22 bp, Homo sapiens
aagagatgaaggtcctgactgt

SEQ ID NO: 9094486 - DNA, 22 bp, Homo sapiens
aagagatgaaggtcctgactgt

SEQ ID NO: 9094487 - DNA, 22 bp, Homo sapiens
aagagatgctttacatcggatg

SEQ ID NO: 9094488 - DNA, 22 bp, Homo sapiens
aagagatgctttacatcggatg

SEQ ID NO: 9094489 - DNA, 22 bp, Homo sapiens
aagagatgtggaatcatttaca

SEQ ID NO: 9094490 - DNA, 22 bp, Homo sapiens
aagagatgtggaatcatttaca

SEQ ID NO: 9094491 - DNA, 22 bp, Homo sapiens
aagagatgtggaatcatttaca

SEQ ID NO: 9094492 - DNA, 20 bp, Homo sapiens
acaaggaaccaggaggtggc

SEQ ID NO: 9094493 - DNA, 22 bp, Homo sapiens
aatttaactgagagtactttta

SEQ ID NO: 9094494 - DNA, 22 bp, Homo sapiens
aattgtcaaacacaaataagag

SEQ ID NO: 9094495 - DNA, 22 bp, Homo sapiens
aattgtcttgaaagcaacactt

SEQ ID NO: 9094496 - DNA, 22 bp, Homo sapiens
aattgtacataaaccatttggc

SEQ ID NO: 9094497 - DNA, 22 bp, Homo sapiens
aattgtacaggaagttgctgga

SEQ ID NO: 9094498 - DNA, 22 bp, Homo sapiens
aattgtacaagccttgtgccat

SEQ ID NO: 9094499 - DNA, 22 bp, Homo sapiens
aattgtaagtgctgagttaagg

SEQ ID NO: 9094500 - DNA, 20 bp, Homo sapiens
aagacaccagtggcagcccc

SEQ ID NO: 9094501 - DNA, 22 bp, Homo sapiens
aagacagcagcacctctcgttt

SEQ ID NO: 9094502 - DNA, 22 bp, Homo sapiens
aagacagctcaggacagattca

SEQ ID NO: 9094503 - DNA, 22 bp, Homo sapiens
aagacagctcaggacagattca

SEQ ID NO: 9094504 - DNA, 22 bp, Homo sapiens
aagacagcattgctgagggctt

SEQ ID NO: 9094505 - DNA, 22 bp, Homo sapiens
aagacagtgacagtcacaattg

SEQ ID NO: 9094506 - DNA, 22 bp, Homo sapiens
aagacagtgtgtcaggcaggtg

SEQ ID NO: 9094507 - DNA, 22 bp, Homo sapiens
aagacaggaacatagcaaatcc

SEQ ID NO: 9094508 - DNA, 22 bp, Homo sapiens
aagacaggaaaagctccaggcc

SEQ ID NO: 9094509 - DNA, 22 bp, Homo sapiens
aagacaggaacatagcaaatcc

SEQ ID NO: 9094510 - DNA, 23 bp, Homo sapiens
aagaataaatgacattaaaggtg

SEQ ID NO: 9094511 - DNA, 22 bp, Homo sapiens
aagaataaattaagatacttag

SEQ ID NO: 9094512 - DNA, 22 bp, Homo sapiens
aagaataacacttaggttttgc

SEQ ID NO: 9094513 - DNA, 22 bp, Homo sapiens
aagaataaattaagatacttag

SEQ ID NO: 9094514 - DNA, 22 bp, Homo sapiens
aagaataaattaagatacttag

SEQ ID NO: 9094515 - DNA, 22 bp, Homo sapiens
aagaataagaggatttagaaca

SEQ ID NO: 9094516 - DNA, 22 bp, Homo sapiens
aattggaaaatgctacatatca

SEQ ID NO: 9094517 - DNA, 22 bp, Homo sapiens
aattggcaagcaagttatccag

SEQ ID NO: 9094518 - DNA, 22 bp, Homo sapiens
aattggcaagcagatttccact

SEQ ID NO: 9094519 - DNA, 22 bp, Homo sapiens
aattggtttgaataaataaaga

SEQ ID NO: 9094520 - DNA, 22 bp, Homo sapiens
aattggcagtttcatcagacag

SEQ ID NO: 9094521 - DNA, 22 bp, Homo sapiens
aattggcagaactttatatatt

SEQ ID NO: 9094522 - DNA, 22 bp, Homo sapiens
aattggcaagcagatttccact

SEQ ID NO: 9094523 - DNA, 22 bp, Homo sapiens
aatgttttagattactgctggg

SEQ ID NO: 9094524 - DNA, 22 bp, Homo sapiens
aatgttttatagctcaagcaat

SEQ ID NO: 9094525 - DNA, 22 bp, Homo sapiens
aagaaatggcttcatctgagta

SEQ ID NO: 9094526 - DNA, 22 bp, Homo sapiens
aagaaatgcagaaatgtgctgg

SEQ ID NO: 9094527 - DNA, 22 bp, Homo sapiens
aagaaatgcagaaatgtgctgg

SEQ ID NO: 9094528 - DNA, 22 bp, Homo sapiens
aagaaatgcacacaactgctgg

SEQ ID NO: 9094529 - DNA, 22 bp, Homo sapiens
aagaaatggcttcatctgagta

SEQ ID NO: 9094530 - DNA, 22 bp, Homo sapiens
aagaaatgctgatgttggatgg

SEQ ID NO: 9094531 - DNA, 22 bp, Homo sapiens
aagaaatggaagatccatggtg

SEQ ID NO: 9094532 - DNA, 22 bp, Homo sapiens
aatgttttatagctcaagcaat

SEQ ID NO: 9094533 - DNA, 22 bp, Homo sapiens
aatgttttcccagtgcagacga

SEQ ID NO: 9094534 - DNA, 22 bp, Homo sapiens
aatgttttcattatcctaactg

SEQ ID NO: 9094535 - DNA, 22 bp, Homo sapiens
aatgttttctctgtgaacacat

SEQ ID NO: 9094536 - DNA, 22 bp, Homo sapiens
aatgttttgcattagttttcta

SEQ ID NO: 9094537 - DNA, 22 bp, Homo sapiens
aatgttttctgactgctaactt

SEQ ID NO: 9094538 - DNA, 22 bp, Homo sapiens
aagaagcactttcctacatgtt

SEQ ID NO: 9094539 - DNA, 22 bp, Homo sapiens
aagaagcactttcctacatgtt

SEQ ID NO: 9094540 - DNA, 22 bp, Homo sapiens
aagaaagcattagacaggcatt

SEQ ID NO: 9094541 - DNA, 22 bp, Homo sapiens
aagaaatacatggtttttgagt

SEQ ID NO: 9094542 - DNA, 22 bp, Homo sapiens
aagaaatattgggccttataaa

SEQ ID NO: 9094543 - DNA, 21 bp, Homo sapiens
aagaaagataattaaggaccc

SEQ ID NO: 9094544 - DNA, 21 bp, Homo sapiens
aagaaagataattaaggaccc

SEQ ID NO: 9094545 - DNA, 21 bp, Homo sapiens
aagaaagataattaaggaccc

SEQ ID NO: 9094546 - DNA, 22 bp, Homo sapiens
aacttcagttgagaaaggcatg

SEQ ID NO: 9094547 - DNA, 18 bp, Homo sapiens
aacttcaactacaatgga

SEQ ID NO: 9094548 - DNA, 22 bp, Homo sapiens
aacttcaagcttcgtcccttcg

SEQ ID NO: 9094549 - DNA, 22 bp, Homo sapiens
aacttcaaatgtgactttgcat

SEQ ID NO: 9094550 - DNA, 22 bp, Homo sapiens
aagcacaggatcttgaggagcg

SEQ ID NO: 9094551 - DNA, 22 bp, Homo sapiens
aagcacaggatcttgaggagcg

SEQ ID NO: 9094552 - DNA, 22 bp, Homo sapiens
aagcacaggagacgcacagcca

SEQ ID NO: 9094553 - DNA, 22 bp, Homo sapiens
aagcacaggagacgcacagcca

SEQ ID NO: 9094554 - DNA, 22 bp, Homo sapiens
aagcacaggagacgcacagcca

SEQ ID NO: 9094555 - DNA, 22 bp, Homo sapiens
aagcacaggagacgcacagcca

SEQ ID NO: 9094556 - DNA, 22 bp, Homo sapiens
acactggtaggaagagatggct

SEQ ID NO: 9094557 - DNA, 22 bp, Homo sapiens
acactggtatgactgttccagt

SEQ ID NO: 9094558 - DNA, 22 bp, Homo sapiens
aagcacacttggctctgtgtac

SEQ ID NO: 9094559 - DNA, 21 bp, Homo sapiens
acactggtgcctgatgtcagg

SEQ ID NO: 9094560 - DNA, 22 bp, Homo sapiens
aagcacagaaaaggagcatgga

SEQ ID NO: 9094561 - DNA, 22 bp, Homo sapiens
aagcacagtaaaagcagatttt

SEQ ID NO: 9094562 - DNA, 22 bp, Homo sapiens
aagcacagtaaaagcagatttt

SEQ ID NO: 9094563 - DNA, 22 bp, Homo sapiens
aagcacagtgccaagttctatt

SEQ ID NO: 9094564 - DNA, 22 bp, Homo sapiens
aagcacagtgccaagttctatt

SEQ ID NO: 9094565 - DNA, 22 bp, Homo sapiens
aagcacagtaaaagcagatttt

SEQ ID NO: 9094566 - DNA, 22 bp, Homo sapiens
acagaattaggagatcctcttg

SEQ ID NO: 9094567 - DNA, 22 bp, Homo sapiens
aagcacagtgggcagagcagcc

SEQ ID NO: 9094568 - DNA, 22 bp, Homo sapiens
aagcacagtgggcagagcagcc

SEQ ID NO: 9094569 - DNA, 22 bp, Homo sapiens
aagcacagtgggcagagcagcc

SEQ ID NO: 9094570 - DNA, 22 bp, Homo sapiens
aagcacagggactcaggaccgg

SEQ ID NO: 9094571 - DNA, 22 bp, Homo sapiens
aagcacagggactttaggaata

SEQ ID NO: 9094572 - DNA, 22 bp, Homo sapiens
aagcacagggtgtctgcattca

SEQ ID NO: 9094573 - DNA, 22 bp, Homo sapiens
aagatttactttctttgtaata

SEQ ID NO: 9094574 - DNA, 18 bp, Homo sapiens
acactgcagcagtctgct

SEQ ID NO: 9094575 - DNA, 22 bp, Homo sapiens
acactgcttctctggcagagcc

SEQ ID NO: 9094576 - DNA, 22 bp, Homo sapiens
aagatttaccactttattcaag

SEQ ID NO: 9094577 - DNA, 22 bp, Homo sapiens
aagatttaccactttattcaag

SEQ ID NO: 9094578 - DNA, 22 bp, Homo sapiens
aagattcttgactagaatgatt

SEQ ID NO: 9094579 - DNA, 22 bp, Homo sapiens
aagattctttgaggattttact

SEQ ID NO: 9094580 - DNA, 22 bp, Homo sapiens
aagattctgtcagttaggagga

SEQ ID NO: 9094581 - DNA, 22 bp, Homo sapiens
aagattctgtatttctaacaat

SEQ ID NO: 9094582 - DNA, 22 bp, Homo sapiens
aagattcttaaatttgtttctc

SEQ ID NO: 9094583 - DNA, 22 bp, Homo sapiens
aagattcttattaggtaatttt

SEQ ID NO: 9094584 - DNA, 22 bp, Homo sapiens
aagattcttacctatacccagt

SEQ ID NO: 9094585 - DNA, 22 bp, Homo sapiens
aagattcttacctatacccagt

SEQ ID NO: 9094586 - DNA, 22 bp, Homo sapiens
aagatgttctattttcactttt

SEQ ID NO: 9094587 - DNA, 22 bp, Homo sapiens
aagatgttctattttcactttt

SEQ ID NO: 9094588 - DNA, 22 bp, Homo sapiens
aagatgttctattttcactttt

SEQ ID NO: 9094589 - DNA, 22 bp, Homo sapiens
aagatgttgactcctttgatgt

SEQ ID NO: 9094590 - DNA, 20 bp, Homo sapiens
aagattctgatttgtagcgt

SEQ ID NO: 9094591 - DNA, 18 bp, Homo sapiens
aagattctgcttctctct

SEQ ID NO: 9094592 - DNA, 22 bp, Homo sapiens
aagaggcctcacctcactgccc

SEQ ID NO: 9094593 - DNA, 22 bp, Homo sapiens
aagaggcctcacctcactgccc

SEQ ID NO: 9094594 - DNA, 22 bp, Homo sapiens
aagaggccttggtctgacctga

SEQ ID NO: 9094595 - DNA, 22 bp, Homo sapiens
aagaggcgccgggtacgtggcg

SEQ ID NO: 9094596 - DNA, 22 bp, Homo sapiens
aagaggcgctcctcacttccta

SEQ ID NO: 9094597 - DNA, 22 bp, Homo sapiens
aagatgttattgtcttccttgc

SEQ ID NO: 9094598 - DNA, 22 bp, Homo sapiens
aagatgttattgtcttccttgc

SEQ ID NO: 9094599 - DNA, 22 bp, Homo sapiens
acacagtaccccaaggctgggc

SEQ ID NO: 9094600 - DNA, 20 bp, Homo sapiens
acacagtagcaattagtgca

SEQ ID NO: 9094601 - DNA, 22 bp, Homo sapiens
acacaggggaaagtggagctga

SEQ ID NO: 9094602 - DNA, 22 bp, Homo sapiens
acacagggctgcgcctgacccc

SEQ ID NO: 9094603 - DNA, 22 bp, Homo sapiens
acacagggggcattctaggagt

SEQ ID NO: 9094604 - DNA, 22 bp, Homo sapiens
acagcagctaaaggtgtctcct

SEQ ID NO: 9094605 - DNA, 22 bp, Homo sapiens
aagcatttggttctgaagactc

SEQ ID NO: 9094606 - DNA, 22 bp, Homo sapiens
acagcagctaaaggtgtctcct

SEQ ID NO: 9094607 - DNA, 22 bp, Homo sapiens
acagcagctaaaggtgtctcct

SEQ ID NO: 9094608 - DNA, 22 bp, Homo sapiens
acagcagctaacccctgggcca

SEQ ID NO: 9094609 - DNA, 22 bp, Homo sapiens
aagcatttggcatgaaactctt

SEQ ID NO: 9094610 - DNA, 22 bp, Homo sapiens
aagcatttcaatataatattca

SEQ ID NO: 9094611 - DNA, 22 bp, Homo sapiens
aagcatttcaggtagagatatt

SEQ ID NO: 9094612 - DNA, 22 bp, Homo sapiens
aagcatttatagataagaattt

SEQ ID NO: 9094613 - DNA, 17 bp, Homo sapiens
aagcatttaatttgcta

SEQ ID NO: 9094614 - DNA, 22 bp, Homo sapiens
aagcatgtacaatgagtgtctc

SEQ ID NO: 9094615 - DNA, 22 bp, Homo sapiens
aagcatgtgtataagctgggca

SEQ ID NO: 9094616 - DNA, 22 bp, Homo sapiens
aagcatgtgctggggctttttg

SEQ ID NO: 9094617 - DNA, 22 bp, Homo sapiens
aagcatgtactcaagcaaatgt

SEQ ID NO: 9094618 - DNA, 22 bp, Homo sapiens
aagcattctgcattttcaaaga

SEQ ID NO: 9094619 - DNA, 22 bp, Homo sapiens
aagccaagtgctggccatgggc

SEQ ID NO: 9094620 - DNA, 22 bp, Homo sapiens
aagccaagttggaagactgaat

SEQ ID NO: 9094621 - DNA, 19 bp, Homo sapiens
aagccagctgccagctcgg

SEQ ID NO: 9094622 - DNA, 22 bp, Homo sapiens
acagcagcttcctgactgtact

SEQ ID NO: 9094623 - DNA, 22 bp, Homo sapiens
acagcagcttcctgactgtact

SEQ ID NO: 9094624 - DNA, 22 bp, Homo sapiens
acagcagcttgtctgttcttta

SEQ ID NO: 9094625 - DNA, 22 bp, Homo sapiens
acagcagcttgtctgttcttta

SEQ ID NO: 9094626 - DNA, 22 bp, Homo sapiens
acagcagctgccttcaggctct

SEQ ID NO: 9094627 - DNA, 22 bp, Homo sapiens
acagcagctgggttcccaccat

SEQ ID NO: 9094628 - DNA, 22 bp, Homo sapiens
acagcagctgggttcccaccat

SEQ ID NO: 9094629 - DNA, 22 bp, Homo sapiens
acagcagctaacccctgggcca

SEQ ID NO: 9094630 - DNA, 23 bp, Homo sapiens
acagacaacactgatgagagaaa

SEQ ID NO: 9094631 - DNA, 22 bp, Homo sapiens
aagcagcatgattgtaatacta

SEQ ID NO: 9094632 - DNA, 22 bp, Homo sapiens
aagcagcatgtgggttatcggg

SEQ ID NO: 9094633 - DNA, 22 bp, Homo sapiens
aagcagcatgattgtaatacta

SEQ ID NO: 9094634 - DNA, 22 bp, Homo sapiens
aagcagcattcagtgaaatgtg

SEQ ID NO: 9094635 - DNA, 22 bp, Homo sapiens
aagcagcattgtaaccaatgcc

SEQ ID NO: 9094636 - DNA, 18 bp, Homo sapiens
acagacaaaatggaaatg

SEQ ID NO: 9094637 - DNA, 18 bp, Homo sapiens
acagacaaaatggaaatg

SEQ ID NO: 9094638 - DNA, 18 bp, Homo sapiens
acagacaaaatggaaatg

SEQ ID NO: 9094639 - DNA, 22 bp, Homo sapiens
acagaatttacacatctctaaa

SEQ ID NO: 9094640 - DNA, 22 bp, Homo sapiens
acagaattgatggaaatctcag

SEQ ID NO: 9094641 - DNA, 22 bp, Homo sapiens
acagaattgatggaaatctcag

SEQ ID NO: 9094642 - DNA, 22 bp, Homo sapiens
acagaattgaagctgagtaaat

SEQ ID NO: 9094643 - DNA, 22 bp, Homo sapiens
acagagtaggtgctcagtaaat

SEQ ID NO: 9094644 - DNA, 22 bp, Homo sapiens
acagagtaggtgctcagtaaat

SEQ ID NO: 9094645 - DNA, 21 bp, Homo sapiens
acagagtagttgaaacagaga

SEQ ID NO: 9094646 - DNA, 22 bp, Homo sapiens
acagagtaggtgctgtcgactg

SEQ ID NO: 9094647 - DNA, 22 bp, Homo sapiens
acagagtatctatcaggagtat

SEQ ID NO: 9094648 - DNA, 22 bp, Homo sapiens
acagagtattggaaaggcagtg

SEQ ID NO: 9094649 - DNA, 22 bp, Homo sapiens
acagaggtttccattgaggttt

SEQ ID NO: 9094650 - DNA, 22 bp, Homo sapiens
acagagtacattcagagactat

SEQ ID NO: 9094651 - DNA, 22 bp, Homo sapiens
acagagtagctcaagaagattg

SEQ ID NO: 9094652 - DNA, 19 bp, Homo sapiens
aagcagccctggcaagagc

SEQ ID NO: 9094653 - DNA, 22 bp, Homo sapiens
aagcagcctggcatgatgcttt

SEQ ID NO: 9094654 - DNA, 22 bp, Homo sapiens
aagcagcctggcatgatgcttt

SEQ ID NO: 9094655 - DNA, 22 bp, Homo sapiens
aagcagccactggccagttata

SEQ ID NO: 9094656 - DNA, 22 bp, Homo sapiens
aagcagctgatttcacagctca

SEQ ID NO: 9094657 - DNA, 22 bp, Homo sapiens
aagcagctgatttcacagctca

SEQ ID NO: 9094658 - DNA, 22 bp, Homo sapiens
aagcagctgatttcacagctca

SEQ ID NO: 9094659 - DNA, 22 bp, Homo sapiens
aagcagctgaaggattcagggt

SEQ ID NO: 9094660 - DNA, 22 bp, Homo sapiens
acagaggtgtgtgtaggacagt

SEQ ID NO: 9094661 - DNA, 22 bp, Homo sapiens
acagaggttaggatgggttgta

SEQ ID NO: 9094662 - DNA, 22 bp, Homo sapiens
acagaggttaggatgggttgta

SEQ ID NO: 9094663 - DNA, 22 bp, Homo sapiens
acagaggttaggatgggttgta

SEQ ID NO: 9094664 - DNA, 22 bp, Homo sapiens
aataacttttaaaagaccctgg

SEQ ID NO: 9094665 - DNA, 22 bp, Homo sapiens
aataacttgtatggttattcca

SEQ ID NO: 9094666 - DNA, 22 bp, Homo sapiens
aataacttgtatggttattcca

SEQ ID NO: 9094667 - DNA, 22 bp, Homo sapiens
aataacttgaagatctcttcca

SEQ ID NO: 9094668 - DNA, 22 bp, Homo sapiens
aataacttgaagatctcttcca

SEQ ID NO: 9094669 - DNA, 22 bp, Homo sapiens
aataacttcatcttcaggatag

SEQ ID NO: 9094670 - DNA, 22 bp, Homo sapiens
aataacttcatgtaacatttaa

SEQ ID NO: 9094671 - DNA, 22 bp, Homo sapiens
aataacttcatgtaacatttaa

SEQ ID NO: 9094672 - DNA, 22 bp, Homo sapiens
aataacttcagttcttacatta

SEQ ID NO: 9094673 - DNA, 22 bp, Homo sapiens
aataacttcatcttcaggatag

SEQ ID NO: 9094674 - DNA, 22 bp, Homo sapiens
aataagaactccatttactcgt

SEQ ID NO: 9094675 - DNA, 22 bp, Homo sapiens
aataacttttaaaagaccctgg

SEQ ID NO: 9094676 - DNA, 22 bp, Homo sapiens
aacatttttaagaccaagtgct

SEQ ID NO: 9094677 - DNA, 21 bp, Homo sapiens
aaccagagccaggctctcagc

SEQ ID NO: 9094678 - DNA, 21 bp, Homo sapiens
aaccagagccaggctctcagc

SEQ ID NO: 9094679 - DNA, 22 bp, Homo sapiens
aatagtgcttacattatcatga

SEQ ID NO: 9094680 - DNA, 22 bp, Homo sapiens
aatagtttgaatttatcagatg

SEQ ID NO: 9094681 - DNA, 22 bp, Homo sapiens
aatagttgtagtatctatctcg

SEQ ID NO: 9094682 - DNA, 22 bp, Homo sapiens
aatagttgtgaatcaggactag

SEQ ID NO: 9094683 - DNA, 22 bp, Homo sapiens
aatagttctagctcagaagctc

SEQ ID NO: 9094684 - DNA, 22 bp, Homo sapiens
aatagttttataggtgggatta

SEQ ID NO: 9094685 - DNA, 22 bp, Homo sapiens
aaccacagagccccctcagatg

SEQ ID NO: 9094686 - DNA, 22 bp, Homo sapiens
aaccacagagccccctcagatg

SEQ ID NO: 9094687 - DNA, 22 bp, Homo sapiens
aaccactggtctgaggtacaag

SEQ ID NO: 9094688 - DNA, 22 bp, Homo sapiens
aacaggcactaagcatgtgggg

SEQ ID NO: 9094689 - DNA, 22 bp, Homo sapiens
aacaggcactaagcatgtgggg

SEQ ID NO: 9094690 - DNA, 22 bp, Homo sapiens
aacaggcaatttaggactcttt

SEQ ID NO: 9094691 - DNA, 22 bp, Homo sapiens
aacaggcaatttaggactcttt

SEQ ID NO: 9094692 - DNA, 22 bp, Homo sapiens
aacaggcaacagttgactctga

SEQ ID NO: 9094693 - DNA, 22 bp, Homo sapiens
aacaggcaaactgtgggatccc

SEQ ID NO: 9094694 - DNA, 22 bp, Homo sapiens
aacaggcaacagttgactctga

SEQ ID NO: 9094695 - DNA, 22 bp, Homo sapiens
aacaggcaaactgtgggatccc

SEQ ID NO: 9094696 - DNA, 22 bp, Homo sapiens
aacaggcaaactgtgggatccc

SEQ ID NO: 9094697 - DNA, 23 bp, Homo sapiens
aacaggatgtgcttcatcttttg

SEQ ID NO: 9094698 - DNA, 22 bp, Homo sapiens
aacaggaattgcaggcagatct

SEQ ID NO: 9094699 - DNA, 22 bp, Homo sapiens
aacaggaattgcaggcagatct

SEQ ID NO: 9094700 - DNA, 22 bp, Homo sapiens
aacaggcagcagactgaatctg

SEQ ID NO: 9094701 - DNA, 15 bp, Homo sapiens
aacaggcatttatat

SEQ ID NO: 9094702 - DNA, 22 bp, Homo sapiens
aacaggcaggagaattctgcct

SEQ ID NO: 9094703 - DNA, 22 bp, Homo sapiens
aacaggctatttctttacaaac

SEQ ID NO: 9094704 - DNA, 22 bp, Homo sapiens
aacaggcctcattccagctctc

SEQ ID NO: 9094705 - DNA, 22 bp, Homo sapiens
aacagggacaaggatagagaaa

SEQ ID NO: 9094706 - DNA, 22 bp, Homo sapiens
aacaggcactaagcatgtgggg

SEQ ID NO: 9094707 - DNA, 22 bp, Homo sapiens
aacaggcttttggaaagttaca

SEQ ID NO: 9094708 - DNA, 22 bp, Homo sapiens
aacatgaaacccaaacagaata

SEQ ID NO: 9094709 - DNA, 22 bp, Homo sapiens
aacagtaaaaatcatttagttg

SEQ ID NO: 9094710 - DNA, 22 bp, Homo sapiens
aacaggttgaggtcaaatgcaa

SEQ ID NO: 9094711 - DNA, 20 bp, Homo sapiens
aacagggggctgcagagggc

SEQ ID NO: 9094712 - DNA, 20 bp, Homo sapiens
aacagggggctgcagagggc

SEQ ID NO: 9094713 - DNA, 22 bp, Homo sapiens
aacatgcccgctgtatgccatt

SEQ ID NO: 9094714 - DNA, 22 bp, Homo sapiens
aacatgcatgttatttatcagt

SEQ ID NO: 9094715 - DNA, 22 bp, Homo sapiens
aacatgcatgaagaagttatat

SEQ ID NO: 9094716 - DNA, 22 bp, Homo sapiens
aacatgcatgaagaagttatat

SEQ ID NO: 9094717 - DNA, 22 bp, Homo sapiens
aactgcactgttcttttctaca

SEQ ID NO: 9094718 - DNA, 22 bp, Homo sapiens
aactgcatgtgtgtggcatgat

SEQ ID NO: 9094719 - DNA, 22 bp, Homo sapiens
aactgcatgtgtgtggcatgat

SEQ ID NO: 9094720 - DNA, 22 bp, Homo sapiens
aactgcattcagaaagctcact

SEQ ID NO: 9094721 - DNA, 22 bp, Homo sapiens
aactgcattagctaacgtgagt

SEQ ID NO: 9094722 - DNA, 22 bp, Homo sapiens
aactgcattcagaaagctcact

SEQ ID NO: 9094723 - DNA, 22 bp, Homo sapiens
aactgcattgtactaaacttgt

SEQ ID NO: 9094724 - DNA, 22 bp, Homo sapiens
aactgcattgtactaaacttgt

SEQ ID NO: 9094725 - DNA, 16 bp, Homo sapiens
aactgcatgagtgggt

SEQ ID NO: 9094726 - DNA, 22 bp, Homo sapiens
aactgcataatatatcatgcag

SEQ ID NO: 9094727 - DNA, 22 bp, Homo sapiens
aactgcataatatatcatgcag

SEQ ID NO: 9094728 - DNA, 22 bp, Homo sapiens
aactgaaacggtgatcttttaa

SEQ ID NO: 9094729 - DNA, 22 bp, Homo sapiens
aatccaatcctactcagaaagt

SEQ ID NO: 9094730 - DNA, 22 bp, Homo sapiens
aatcatcccaactgagaatccc

SEQ ID NO: 9094731 - DNA, 22 bp, Homo sapiens
aatccaatcctactcagaaagt

SEQ ID NO: 9094732 - DNA, 22 bp, Homo sapiens
aactacagaatcatagaaaata

SEQ ID NO: 9094733 - DNA, 22 bp, Homo sapiens
aactacatcaccctatttctgt

SEQ ID NO: 9094734 - DNA, 22 bp, Homo sapiens
aactacatcaccctatttctgt

SEQ ID NO: 9094735 - DNA, 22 bp, Homo sapiens
aactacatagaaattagtattt

SEQ ID NO: 9094736 - DNA, 22 bp, Homo sapiens
aactacagtatgtccaaagaat

SEQ ID NO: 9094737 - DNA, 22 bp, Homo sapiens
aactacaatatgtatgtatgta

SEQ ID NO: 9094738 - DNA, 22 bp, Homo sapiens
aatataatgctgttttatgcca

SEQ ID NO: 9094739 - DNA, 22 bp, Homo sapiens
aatgatcattataaagtgctct

SEQ ID NO: 9094740 - DNA, 22 bp, Homo sapiens
aatgatctactctcattatctc

SEQ ID NO: 9094741 - DNA, 21 bp, Homo sapiens
aactggttcaattcaactaga

SEQ ID NO: 9094742 - DNA, 22 bp, Homo sapiens
aactggttatgttacctatgtc

SEQ ID NO: 9094743 - DNA, 20 bp, Homo sapiens
aatgatcagcatagcaagga

SEQ ID NO: 9094744 - DNA, 22 bp, Homo sapiens
aatgatcacctggtaaagagag

SEQ ID NO: 9094745 - DNA, 22 bp, Homo sapiens
aatgatcactgcagttgatgag

SEQ ID NO: 9094746 - DNA, 22 bp, Homo sapiens
aatgatatagcagacatagcct

SEQ ID NO: 9094747 - DNA, 22 bp, Homo sapiens
aatgatatagcagacatagcct

SEQ ID NO: 9094748 - DNA, 22 bp, Homo sapiens
aatgatatttattgaatagatg

SEQ ID NO: 9094749 - DNA, 22 bp, Homo sapiens
aatgatatttattgaatagatg

SEQ ID NO: 9094750 - DNA, 22 bp, Homo sapiens
aatgatatttattgaatagatg

SEQ ID NO: 9094751 - DNA, 20 bp, Homo sapiens
aactgcctgcccagaggtgg

SEQ ID NO: 9094752 - DNA, 22 bp, Homo sapiens
aactgcctggccaggctgcaac

SEQ ID NO: 9094753 - DNA, 22 bp, Homo sapiens
aactgcatttaacaaatactct

SEQ ID NO: 9094754 - DNA, 22 bp, Homo sapiens
aactgcatttaacaaatactct

SEQ ID NO: 9094755 - DNA, 22 bp, Homo sapiens
aactgcatttgcataagtccat

SEQ ID NO: 9094756 - DNA, 22 bp, Homo sapiens
aactgcatttgcataagtccat

SEQ ID NO: 9094757 - DNA, 22 bp, Homo sapiens
aatgataccaaacatgtagata

SEQ ID NO: 9094758 - DNA, 22 bp, Homo sapiens
aatgataccgccaatattacca

SEQ ID NO: 9094759 - DNA, 22 bp, Homo sapiens
aactggttctggaggctgcagg

SEQ ID NO: 9094760 - DNA, 22 bp, Homo sapiens
aactggttctcttttgcttgtg

SEQ ID NO: 9094761 - DNA, 23 bp, Homo sapiens
aactggttgaaggctgttaattg

SEQ ID NO: 9094762 - DNA, 18 bp, Homo sapiens
aactgttgaaatagcttg

SEQ ID NO: 9094763 - DNA, 22 bp, Homo sapiens
aacttaatgatttcatgcatgt

SEQ ID NO: 9094764 - DNA, 22 bp, Homo sapiens
aacactgagaggggagtggcac

SEQ ID NO: 9094765 - DNA, 20 bp, Homo sapiens
aacactgaggcctactcttc

SEQ ID NO: 9094766 - DNA, 22 bp, Homo sapiens
aaggtatatgtacaatagacat

SEQ ID NO: 9094767 - DNA, 22 bp, Homo sapiens
aaggtatagcttgcatacagaa

SEQ ID NO: 9094768 - DNA, 22 bp, Homo sapiens
aacactgagaacaatacagagt

SEQ ID NO: 9094769 - DNA, 22 bp, Homo sapiens
aacactgaagtagtgaatactg

SEQ ID NO: 9094770 - DNA, 22 bp, Homo sapiens
aacactgacgacgtgaactaaa

SEQ ID NO: 9094771 - DNA, 22 bp, Homo sapiens
aacactgacctctaccctcagt

SEQ ID NO: 9094772 - DNA, 22 bp, Homo sapiens
aacactgaagaccaggtaattt

SEQ ID NO: 9094773 - DNA, 22 bp, Homo sapiens
aacactgaaatgtcttaagatt

SEQ ID NO: 9094774 - DNA, 22 bp, Homo sapiens
aacactgaaatgtcttaagatt

SEQ ID NO: 9094775 - DNA, 22 bp, Homo sapiens
aaggtattttctaatgtatact

SEQ ID NO: 9094776 - DNA, 23 bp, Homo sapiens
aaggtatttattttaaaggtaag

SEQ ID NO: 9094777 - DNA, 22 bp, Homo sapiens
aaggtatttagtgtgaaagcta

SEQ ID NO: 9094778 - DNA, 22 bp, Homo sapiens
aaggtcacactcccagagctga

SEQ ID NO: 9094779 - DNA, 22 bp, Homo sapiens
aaggtcacactcccagagctga

SEQ ID NO: 9094780 - DNA, 22 bp, Homo sapiens
aacaaagtttcaggaagataga

SEQ ID NO: 9094781 - DNA, 22 bp, Homo sapiens
aacaaatgataccagttctcaa

SEQ ID NO: 9094782 - DNA, 22 bp, Homo sapiens
aacactctgagtatagaccact

SEQ ID NO: 9094783 - DNA, 22 bp, Homo sapiens
aacactctctgttggtaaggct

SEQ ID NO: 9094784 - DNA, 22 bp, Homo sapiens
aacactagtctagaccagacca

SEQ ID NO: 9094785 - DNA, 22 bp, Homo sapiens
aacactatctgccttacaggga

SEQ ID NO: 9094786 - DNA, 19 bp, Homo sapiens
aacaccagagtcaggagtc

SEQ ID NO: 9094787 - DNA, 22 bp, Homo sapiens
aacaccttctccttgcaggcca

SEQ ID NO: 9094788 - DNA, 22 bp, Homo sapiens
aacacctaaaaatcattgttga

SEQ ID NO: 9094789 - DNA, 22 bp, Homo sapiens
aacagcatcaccccataacatt

SEQ ID NO: 9094790 - DNA, 22 bp, Homo sapiens
aacagcatatttcatatattga

SEQ ID NO: 9094791 - DNA, 22 bp, Homo sapiens
aacagcataccaatgtacatat

SEQ ID NO: 9094792 - DNA, 22 bp, Homo sapiens
aacagcagggggacctgctggt

SEQ ID NO: 9094793 - DNA, 22 bp, Homo sapiens
aacagcagggatgacatggcca

SEQ ID NO: 9094794 - DNA, 22 bp, Homo sapiens
aacagcagggatggggtggcca

SEQ ID NO: 9094795 - DNA, 22 bp, Homo sapiens
aacagcagctgcctgaatttgc

SEQ ID NO: 9094796 - DNA, 22 bp, Homo sapiens
aacagaggctccctgcacttgt

SEQ ID NO: 9094797 - DNA, 22 bp, Homo sapiens
aacagaggctccctgcacttgt

SEQ ID NO: 9094798 - DNA, 22 bp, Homo sapiens
aaggtctaaagctactgagttg

SEQ ID NO: 9094799 - DNA, 22 bp, Homo sapiens
aaggtctgagttttgccaggcc

SEQ ID NO: 9094800 - DNA, 22 bp, Homo sapiens
aaggtcctgtagccacagagcc

SEQ ID NO: 9094801 - DNA, 22 bp, Homo sapiens
aaggtccttttgcagtgtgatc

SEQ ID NO: 9094802 - DNA, 22 bp, Homo sapiens
aacagaggatgtttgaaattca

SEQ ID NO: 9094803 - DNA, 22 bp, Homo sapiens
aagtccaaggtcaccattcaca

SEQ ID NO: 9094804 - DNA, 22 bp, Homo sapiens
aagtccaaggtcaccattcaca

SEQ ID NO: 9094805 - DNA, 22 bp, Homo sapiens
aagtccaaggctgggtgcagtg

SEQ ID NO: 9094806 - DNA, 22 bp, Homo sapiens
aagtcatgagtcctcttctgtg

SEQ ID NO: 9094807 - DNA, 23 bp, Homo sapiens
aacagccacactgctgagattca

SEQ ID NO: 9094808 - DNA, 22 bp, Homo sapiens
aacagcatgctgggtaacattg

SEQ ID NO: 9094809 - DNA, 17 bp, Homo sapiens
aagtccagcctgcagct

SEQ ID NO: 9094810 - DNA, 22 bp, Homo sapiens
aacagcttgaggaatatcatca

SEQ ID NO: 9094811 - DNA, 22 bp, Homo sapiens
aacaggaattgatgggagtcct

SEQ ID NO: 9094812 - DNA, 22 bp, Homo sapiens
aacaggaatgaggagaaaaggt

SEQ ID NO: 9094813 - DNA, 22 bp, Homo sapiens
aagctgaggcccatggcaaggt

SEQ ID NO: 9094814 - DNA, 22 bp, Homo sapiens
aagctgaggcccatggcaaggt

SEQ ID NO: 9094815 - DNA, 22 bp, Homo sapiens
aaatgtgctaaagtattaacat

SEQ ID NO: 9094816 - DNA, 22 bp, Homo sapiens
aaatgtgagttatagcaataga

SEQ ID NO: 9094817 - DNA, 22 bp, Homo sapiens
aaatgtgatactgttcttttta

SEQ ID NO: 9094818 - DNA, 22 bp, Homo sapiens
aaatgtctatctggcatattcc

SEQ ID NO: 9094819 - DNA, 22 bp, Homo sapiens
aaatgtgcttgtgatcagctgt

SEQ ID NO: 9094820 - DNA, 22 bp, Homo sapiens
aaatgtgcttcttactctcaat

SEQ ID NO: 9094821 - DNA, 22 bp, Homo sapiens
aaatgtgcttcttactctcaat

SEQ ID NO: 9094822 - DNA, 22 bp, Homo sapiens
aaatgtgcttgtgatcagctgt

SEQ ID NO: 9094823 - DNA, 22 bp, Homo sapiens
aaatgtgtatatgaaacatgat

SEQ ID NO: 9094824 - DNA, 22 bp, Homo sapiens
aaatgtgtcagtttcattctct

SEQ ID NO: 9094825 - DNA, 22 bp, Homo sapiens
aaatgtgtgcacaaagacagct

SEQ ID NO: 9094826 - DNA, 22 bp, Homo sapiens
aaatgtgtcatattcaaagtca

SEQ ID NO: 9094827 - DNA, 22 bp, Homo sapiens
aaatgtgttcctttgctacaga

SEQ ID NO: 9094828 - DNA, 22 bp, Homo sapiens
aaatgtttctacttgtgagcat

SEQ ID NO: 9094829 - DNA, 21 bp, Homo sapiens
aaattcacctagtaaaacttc

SEQ ID NO: 9094830 - DNA, 22 bp, Homo sapiens
aaattctaaggtcacaatgttg

SEQ ID NO: 9094831 - DNA, 22 bp, Homo sapiens
aaatgttcccaatatgaagctg

SEQ ID NO: 9094832 - DNA, 22 bp, Homo sapiens
aaatgttccattattgtgtaat

SEQ ID NO: 9094833 - DNA, 22 bp, Homo sapiens
aaatgttccattattgtgtaat

SEQ ID NO: 9094834 - DNA, 22 bp, Homo sapiens
aaatgttaggttgtactgagtc

SEQ ID NO: 9094835 - DNA, 22 bp, Homo sapiens
aaatgttccgggtaaggagaaa

SEQ ID NO: 9094836 - DNA, 22 bp, Homo sapiens
aaatgttcccaatatgaagctg

SEQ ID NO: 9094837 - DNA, 22 bp, Homo sapiens
aaatgttccgggtaaggagaaa

SEQ ID NO: 9094838 - DNA, 22 bp, Homo sapiens
aaatgttcccaatatgaagctg

SEQ ID NO: 9094839 - DNA, 22 bp, Homo sapiens
aaatgttctactttgataatta

SEQ ID NO: 9094840 - DNA, 22 bp, Homo sapiens
aaatgttctaaattacatgtga

SEQ ID NO: 9094841 - DNA, 22 bp, Homo sapiens
aaatgtgttcctttgctacaga

SEQ ID NO: 9094842 - DNA, 22 bp, Homo sapiens
aaatgtgtttcgaaaactggtg

SEQ ID NO: 9094843 - DNA, 22 bp, Homo sapiens
aaattctttcatggctaataag

SEQ ID NO: 9094844 - DNA, 22 bp, Homo sapiens
aaattgaatttgggaaacattg

SEQ ID NO: 9094845 - DNA, 22 bp, Homo sapiens
aaattgaatttgggaaacattg

SEQ ID NO: 9094846 - DNA, 22 bp, Homo sapiens
aaattctaaggtcacaatgttg

SEQ ID NO: 9094847 - DNA, 22 bp, Homo sapiens
aaattctatgtcaatgtttatt

SEQ ID NO: 9094848 - DNA, 22 bp, Homo sapiens
aaattctatgtcaatgtttatt

SEQ ID NO: 9094849 - DNA, 22 bp, Homo sapiens
aaattctatgtcaatgtttatt

SEQ ID NO: 9094850 - DNA, 22 bp, Homo sapiens
aaattctatgtcaatgtttatt

SEQ ID NO: 9094851 - DNA, 22 bp, Homo sapiens
aaattcttcaggtaattttgat

SEQ ID NO: 9094852 - DNA, 22 bp, Homo sapiens
aaattctttcatggctaataag

SEQ ID NO: 9094853 - DNA, 22 bp, Homo sapiens
aaattgcaggtaggtgggtgat

SEQ ID NO: 9094854 - DNA, 22 bp, Homo sapiens
aaattgcattcaggatgcagga

SEQ ID NO: 9094855 - DNA, 22 bp, Homo sapiens
aacaaacagttaagtgtggatg

SEQ ID NO: 9094856 - DNA, 22 bp, Homo sapiens
aaattttagaccaggcaaaact

SEQ ID NO: 9094857 - DNA, 22 bp, Homo sapiens
aacaaacagttaagtgtggatg

SEQ ID NO: 9094858 - DNA, 22 bp, Homo sapiens
aacaaacattacctggtgctgg

SEQ ID NO: 9094859 - DNA, 22 bp, Homo sapiens
aacaaaccttccctatacgtct

SEQ ID NO: 9094860 - DNA, 22 bp, Homo sapiens
aacaaacctgggtggagaaagg

SEQ ID NO: 9094861 - DNA, 20 bp, Homo sapiens
aacaaactacaaaattatgt

SEQ ID NO: 9094862 - DNA, 22 bp, Homo sapiens
aacaaaggccgttaataaccac

SEQ ID NO: 9094863 - DNA, 21 bp, Homo sapiens
aacaaagggatgctcatcttt

SEQ ID NO: 9094864 - DNA, 22 bp, Homo sapiens
aacaaagccctgcccaagagct

SEQ ID NO: 9094865 - DNA, 22 bp, Homo sapiens
aacaaagtcgttgcctagaaga

SEQ ID NO: 9094866 - DNA, 22 bp, Homo sapiens
aacaaagtagctgctgttctta

SEQ ID NO: 9094867 - DNA, 22 bp, Homo sapiens
aacaaagcaccactgagtcagt

SEQ ID NO: 9094868 - DNA, 20 bp, Homo sapiens
aacaaactacaaaattatgt

SEQ ID NO: 9094869 - DNA, 22 bp, Homo sapiens
aacaaactcaaatggaagagtg

SEQ ID NO: 9094870 - DNA, 22 bp, Homo sapiens
aacaaactcaaatggaagagtg

SEQ ID NO: 9094871 - DNA, 22 bp, Homo sapiens
aaagtatttttgacaggcatta

SEQ ID NO: 9094872 - DNA, 22 bp, Homo sapiens
aaagtcaaggtttagactagag

SEQ ID NO: 9094873 - DNA, 22 bp, Homo sapiens
aaagtatttgtgatttttacca

SEQ ID NO: 9094874 - DNA, 22 bp, Homo sapiens
aaagtattcaaaaatatttggt

SEQ ID NO: 9094875 - DNA, 22 bp, Homo sapiens
aaagtattcttgactgtttttc

SEQ ID NO: 9094876 - DNA, 22 bp, Homo sapiens
aaagtattcaaaaatatttggt

SEQ ID NO: 9094877 - DNA, 22 bp, Homo sapiens
aaagtatgttgtggcttttaaa

SEQ ID NO: 9094878 - DNA, 22 bp, Homo sapiens
aaagtatcaagggaagcatttt

SEQ ID NO: 9094879 - DNA, 22 bp, Homo sapiens
aaagtatatttacttactgtga

SEQ ID NO: 9094880 - DNA, 22 bp, Homo sapiens
aaagtatctgaccgattataaa

SEQ ID NO: 9094881 - DNA, 22 bp, Homo sapiens
aaagtatcttactgcagccgag

SEQ ID NO: 9094882 - DNA, 22 bp, Homo sapiens
aaagtatgattggggattattt

SEQ ID NO: 9094883 - DNA, 22 bp, Homo sapiens
aaagtatatatgcactttagaa

SEQ ID NO: 9094884 - DNA, 22 bp, Homo sapiens
aaagtagctttgtaggtacagt

SEQ ID NO: 9094885 - DNA, 22 bp, Homo sapiens
aaagtagcttagttgatatttc

SEQ ID NO: 9094886 - DNA, 22 bp, Homo sapiens
aaagtatatatgcactttagaa

SEQ ID NO: 9094887 - DNA, 22 bp, Homo sapiens
aaagtagatttctcatggcgaa

SEQ ID NO: 9094888 - DNA, 22 bp, Homo sapiens
aaagtagcccttctggaattta

SEQ ID NO: 9094889 - DNA, 22 bp, Homo sapiens
aaagtagagttgtggaattact

SEQ ID NO: 9094890 - DNA, 22 bp, Homo sapiens
aaagtagaggcattgatcaggt

SEQ ID NO: 9094891 - DNA, 22 bp, Homo sapiens
aaagtcacagtttaggggatat

SEQ ID NO: 9094892 - DNA, 22 bp, Homo sapiens
aaagtgcagggtgctctggtat

SEQ ID NO: 9094893 - DNA, 22 bp, Homo sapiens
aaagtgctgtgattacaggcat

SEQ ID NO: 9094894 - DNA, 22 bp, Homo sapiens
aaagtgctggtattacaggtgt

SEQ ID NO: 9094895 - DNA, 22 bp, Homo sapiens
aaagtgctgtgggctgtaagtg

SEQ ID NO: 9094896 - DNA, 22 bp, Homo sapiens
aaagtgcttcctttttgagggt

SEQ ID NO: 9094897 - DNA, 22 bp, Homo sapiens
aaagtggtttttcagactttga

SEQ ID NO: 9094898 - DNA, 22 bp, Homo sapiens
aaagtggtttcccagttcagta

SEQ ID NO: 9094899 - DNA, 22 bp, Homo sapiens
aaagtggtttatgatattccaa

SEQ ID NO: 9094900 - DNA, 22 bp, Homo sapiens
aaagtggttgctgtcagcctct

SEQ ID NO: 9094901 - DNA, 22 bp, Homo sapiens
aaagtggttcttacatccgtgg

SEQ ID NO: 9094902 - DNA, 22 bp, Homo sapiens
aaagtggtgggcgaactcatca

SEQ ID NO: 9094903 - DNA, 22 bp, Homo sapiens
aaagtggtctgcatcccttctg

SEQ ID NO: 9094904 - DNA, 22 bp, Homo sapiens
aaagtggtcaccttctcatttc

SEQ ID NO: 9094905 - DNA, 21 bp, Homo sapiens
aaagtggtaaggattattttg

SEQ ID NO: 9094906 - DNA, 22 bp, Homo sapiens
aaagtgggaacaatggagagtg

SEQ ID NO: 9094907 - DNA, 22 bp, Homo sapiens
aaagtgtaaaagcatgttaggg

SEQ ID NO: 9094908 - DNA, 22 bp, Homo sapiens
aactaaatgtgtatctactcaa

SEQ ID NO: 9094909 - DNA, 22 bp, Homo sapiens
aactaaaactggtttgttctct

SEQ ID NO: 9094910 - DNA, 22 bp, Homo sapiens
aaaggttttcatcacagcaaga

SEQ ID NO: 9094911 - DNA, 22 bp, Homo sapiens
aactaaatctggcatttagagc

SEQ ID NO: 9094912 - DNA, 22 bp, Homo sapiens
aactaaaccatgacattatatt

SEQ ID NO: 9094913 - DNA, 18 bp, Homo sapiens
aactaaagatctttaagc

SEQ ID NO: 9094914 - DNA, 22 bp, Homo sapiens
aactaacagtcattaaaagaac

SEQ ID NO: 9094915 - DNA, 22 bp, Homo sapiens
aactaaatctggcatttagagc

SEQ ID NO: 9094916 - DNA, 22 bp, Homo sapiens
aactaaatctggcatttagagc

SEQ ID NO: 9094917 - DNA, 22 bp, Homo sapiens
aaaggtttatttaatcagggag

SEQ ID NO: 9094918 - DNA, 22 bp, Homo sapiens
aaaggttgaattcaggatccac

SEQ ID NO: 9094919 - DNA, 22 bp, Homo sapiens
aaaggaaaataagtagttccat

SEQ ID NO: 9094920 - DNA, 22 bp, Homo sapiens
aaagcttttcagtatgttcatg

SEQ ID NO: 9094921 - DNA, 22 bp, Homo sapiens
aaaggaagattgagcttttcca

SEQ ID NO: 9094922 - DNA, 22 bp, Homo sapiens
aaaggaagatgccaggactctg

SEQ ID NO: 9094923 - DNA, 22 bp, Homo sapiens
aaaggaagatgccaggactctg

SEQ ID NO: 9094924 - DNA, 22 bp, Homo sapiens
aaagggcctccgcctgggcagg

SEQ ID NO: 9094925 - DNA, 22 bp, Homo sapiens
aaagccagtggtatgagagaaa

SEQ ID NO: 9094926 - DNA, 22 bp, Homo sapiens
aaagatcagaggatagctgagt

SEQ ID NO: 9094927 - DNA, 23 bp, Homo sapiens
aaagatcaaagtggcaggcctgt

SEQ ID NO: 9094928 - DNA, 22 bp, Homo sapiens
aaagatcaatagataaagctac

SEQ ID NO: 9094929 - DNA, 22 bp, Homo sapiens
aaagatcacactgtggggcagt

SEQ ID NO: 9094930 - DNA, 22 bp, Homo sapiens
aaagatcaatagataaagctac

SEQ ID NO: 9094931 - DNA, 22 bp, Homo sapiens
aaagatatgtctccaaagagat

SEQ ID NO: 9094932 - DNA, 22 bp, Homo sapiens
aacaaacaaacattttgtcatc

SEQ ID NO: 9094933 - DNA, 22 bp, Homo sapiens
aaagagtttggagacaagatca

SEQ ID NO: 9094934 - DNA, 22 bp, Homo sapiens
aaattttgtattctagttctag

SEQ ID NO: 9094935 - DNA, 22 bp, Homo sapiens
aacaaaagccgaagtaggtgtc

SEQ ID NO: 9094936 - DNA, 22 bp, Homo sapiens
aaattttcctggtaaagatgga

SEQ ID NO: 9094937 - DNA, 22 bp, Homo sapiens
aaattttgtattctagttctag

SEQ ID NO: 9094938 - DNA, 22 bp, Homo sapiens
aaattttgtattctagttctag

SEQ ID NO: 9094939 - DNA, 21 bp, Homo sapiens
aaattttcttggctgtagtgt

SEQ ID NO: 9094940 - DNA, 22 bp, Homo sapiens
aaattagaaatactttcaaagc

SEQ ID NO: 9094941 - DNA, 22 bp, Homo sapiens
aaattttagactcctgggtcta

SEQ ID NO: 9094942 - DNA, 22 bp, Homo sapiens
aaattttagactcctgggtcta

SEQ ID NO: 9094943 - DNA, 22 bp, Homo sapiens
aaattttagactcctgggtcta

SEQ ID NO: 9094944 - DNA, 22 bp, Homo sapiens
aaattttagtaaggaagttgag

SEQ ID NO: 9094945 - DNA, 22 bp, Homo sapiens
aaagctgtagaatcatcttaat

SEQ ID NO: 9094946 - DNA, 22 bp, Homo sapiens
aaagctgggggccctggtctag

SEQ ID NO: 9094947 - DNA, 22 bp, Homo sapiens
aaagcttagcattttcaaaatg

SEQ ID NO: 9094948 - DNA, 22 bp, Homo sapiens
aaagcttctattcacttacttg

SEQ ID NO: 9094949 - DNA, 22 bp, Homo sapiens
aaagcttctaggcctattgctt

SEQ ID NO: 9094950 - DNA, 22 bp, Homo sapiens
aaagctgctttaaacatctatg

SEQ ID NO: 9094951 - DNA, 22 bp, Homo sapiens
aaagctgctttggtttctggaa

SEQ ID NO: 9094952 - DNA, 22 bp, Homo sapiens
aaagctgctgccaatcaggctt

SEQ ID NO: 9094953 - DNA, 22 bp, Homo sapiens
aaagctgctgccaatcaggctt

SEQ ID NO: 9094954 - DNA, 22 bp, Homo sapiens
aaagctgctgtgaatggtttgg

SEQ ID NO: 9094955 - DNA, 22 bp, Homo sapiens
aaagctgctttaaacatctatg

SEQ ID NO: 9094956 - DNA, 22 bp, Homo sapiens
aaagctgctatgaacattctat

SEQ ID NO: 9094957 - DNA, 22 bp, Homo sapiens
aaagctgcccttgtgaaacaag

SEQ ID NO: 9094958 - DNA, 22 bp, Homo sapiens
aaagctgcccttgtgaaacaag

SEQ ID NO: 9094959 - DNA, 22 bp, Homo sapiens
aaagctgccaaggagaatacta

SEQ ID NO: 9094960 - DNA, 22 bp, Homo sapiens
aaagctgcaagctcctgaggaa

SEQ ID NO: 9094961 - DNA, 22 bp, Homo sapiens
aaagctgccaaggagaatacta

SEQ ID NO: 9094962 - DNA, 22 bp, Homo sapiens
aaagctgattgcaggaagagag

SEQ ID NO: 9094963 - DNA, 22 bp, Homo sapiens
aaagctgcccagctgcctgttt

SEQ ID NO: 9094964 - DNA, 22 bp, Homo sapiens
aaagctgccctacacggaagca

SEQ ID NO: 9094965 - DNA, 22 bp, Homo sapiens
aacagatttgtgaagctactca

SEQ ID NO: 9094966 - DNA, 22 bp, Homo sapiens
aacagcaagggcggggtcaaga

SEQ ID NO: 9094967 - DNA, 22 bp, Homo sapiens
aacagattgtaacctgatagcc

SEQ ID NO: 9094968 - DNA, 22 bp, Homo sapiens
aacagatggccaagtgcatggg

SEQ ID NO: 9094969 - DNA, 22 bp, Homo sapiens
aacagagtggagccaaactttg

SEQ ID NO: 9094970 - DNA, 22 bp, Homo sapiens
aacagatataggcagaactttg

SEQ ID NO: 9094971 - DNA, 22 bp, Homo sapiens
aacagagtttcaaataacatct

SEQ ID NO: 9094972 - DNA, 22 bp, Homo sapiens
aacagcaatagcactattcatt

SEQ ID NO: 9094973 - DNA, 22 bp, Homo sapiens
aacagcagaaactgcaagctac

SEQ ID NO: 9094974 - DNA, 22 bp, Homo sapiens
aagcatgggaatcccacagggt

SEQ ID NO: 9094975 - DNA, 22 bp, Homo sapiens
aagcatgggaggcctggaggag

SEQ ID NO: 9094976 - DNA, 22 bp, Homo sapiens
aagcatgggaggcctggaggag

SEQ ID NO: 9094977 - DNA, 22 bp, Homo sapiens
aaatgtacactttgcatcttga

SEQ ID NO: 9094978 - DNA, 22 bp, Homo sapiens
aaatgtacaacatccatatata

SEQ ID NO: 9094979 - DNA, 22 bp, Homo sapiens
aaatgtaagtctttgtttctta

SEQ ID NO: 9094980 - DNA, 22 bp, Homo sapiens
aaatgtaagtctttgtttctta

SEQ ID NO: 9094981 - DNA, 22 bp, Homo sapiens
aaatggcaggctctttgctagt

SEQ ID NO: 9094982 - DNA, 22 bp, Homo sapiens
aagcatcttaaaaagtatcaga

SEQ ID NO: 9094983 - DNA, 22 bp, Homo sapiens
aagcatcttctatcagttagac

SEQ ID NO: 9094984 - DNA, 22 bp, Homo sapiens
aagcatctctatgtggagagtg

SEQ ID NO: 9094985 - DNA, 20 bp, Homo sapiens
aagcatctggatgtagcaat

SEQ ID NO: 9094986 - DNA, 22 bp, Homo sapiens
aagctctttccactaaaccact

SEQ ID NO: 9094987 - DNA, 22 bp, Homo sapiens
aagctcttgttgaatcttgtca

SEQ ID NO: 9094988 - DNA, 22 bp, Homo sapiens
aagctcttttcaccattaaagt

SEQ ID NO: 9094989 - DNA, 22 bp, Homo sapiens
aagctcttttacaatcctaggc

SEQ ID NO: 9094990 - DNA, 22 bp, Homo sapiens
aagctctttccctcttcagaac

SEQ ID NO: 9094991 - DNA, 22 bp, Homo sapiens
aagctctttccctcttcagaac

SEQ ID NO: 9094992 - DNA, 22 bp, Homo sapiens
aagctgaagacacagctccagt

SEQ ID NO: 9094993 - DNA, 22 bp, Homo sapiens
aagctgaaataatatctatgtt

SEQ ID NO: 9094994 - DNA, 22 bp, Homo sapiens
aagctgaaacattagcctaaac

SEQ ID NO: 9094995 - DNA, 22 bp, Homo sapiens
aagctcttttctgcctcaccca

SEQ ID NO: 9094996 - DNA, 22 bp, Homo sapiens
aaatgtactgatacttatttta

SEQ ID NO: 9094997 - DNA, 18 bp, Homo sapiens
aaatgtactgtccatggc

SEQ ID NO: 9094998 - DNA, 18 bp, Homo sapiens
aaatgtactgtccatggc

SEQ ID NO: 9094999 - DNA, 22 bp, Homo sapiens
aaatgtaccttgatagtttggt

SEQ ID NO: 9095000 - DNA, 22 bp, Homo sapiens
aaatgtacgggagtagaattag

SEQ ID NO: 9095001 - DNA, 22 bp, Homo sapiens
aaatgtattgcataggatattt

SEQ ID NO: 9095002 - DNA, 22 bp, Homo sapiens
aaatgtagttgaaaagttaagg

SEQ ID NO: 9095003 - DNA, 22 bp, Homo sapiens
aaatcgcttgaacccaggaagt

SEQ ID NO: 9095004 - DNA, 22 bp, Homo sapiens
aaatcggttggttcaaggtaat

SEQ ID NO: 9095005 - DNA, 22 bp, Homo sapiens
aaatcctaataatgcactagtg

SEQ ID NO: 9095006 - DNA, 22 bp, Homo sapiens
aagcacagagatgggcacgcct

SEQ ID NO: 9095007 - DNA, 22 bp, Homo sapiens
aagcacagataaaacaggattc

SEQ ID NO: 9095008 - DNA, 22 bp, Homo sapiens
aagcacagataaaacaggattc

SEQ ID NO: 9095009 - DNA, 22 bp, Homo sapiens
aagcacagagaggtaaagtaac

SEQ ID NO: 9095010 - DNA, 22 bp, Homo sapiens
aagcacagagaggtaaagtaac

SEQ ID NO: 9095011 - DNA, 22 bp, Homo sapiens
aagcacagactccctctgagtg

SEQ ID NO: 9095012 - DNA, 22 bp, Homo sapiens
aaatctcaaaggcttagcatct

SEQ ID NO: 9095013 - DNA, 23 bp, Homo sapiens
aagcacagaatggtttaggagtt

SEQ ID NO: 9095014 - DNA, 23 bp, Homo sapiens
aagcacagaatggtttaggagtt

SEQ ID NO: 9095015 - DNA, 22 bp, Homo sapiens
aagcacagacacaaaaggcttt

SEQ ID NO: 9095016 - DNA, 22 bp, Homo sapiens
aaatgcaggaaattatgctttt

SEQ ID NO: 9095017 - DNA, 22 bp, Homo sapiens
aaatgcagctgggcatgagagg

SEQ ID NO: 9095018 - DNA, 22 bp, Homo sapiens
aaatgcaggaaattatgctttt

SEQ ID NO: 9095019 - DNA, 23 bp, Homo sapiens
aaatgcacagtattgatttttaa

SEQ ID NO: 9095020 - DNA, 23 bp, Homo sapiens
aaatgcacagtattgatttttaa

SEQ ID NO: 9095021 - DNA, 22 bp, Homo sapiens
aaatgcacaggttttaaatcct

SEQ ID NO: 9095022 - DNA, 23 bp, Homo sapiens
aaatgcacagtattgatttttaa

SEQ ID NO: 9095023 - DNA, 22 bp, Homo sapiens
aagcacagataaaacaggattc

SEQ ID NO: 9095024 - DNA, 22 bp, Homo sapiens
aagcacagatgcaagggggacc

SEQ ID NO: 9095025 - DNA, 22 bp, Homo sapiens
aagcacagctggaacagcagga

SEQ ID NO: 9095026 - DNA, 22 bp, Homo sapiens
aagcacagcagagccttgcttg

SEQ ID NO: 9095027 - DNA, 21 bp, Homo sapiens
aaatgcagtctctgagatctg

SEQ ID NO: 9095028 - DNA, 22 bp, Homo sapiens
aaatgcagtggttctacttctc

SEQ ID NO: 9095029 - DNA, 21 bp, Homo sapiens
aaatgcagtctctgagatctg

SEQ ID NO: 9095030 - DNA, 22 bp, Homo sapiens
aaatgcaggtagtatttatttt

SEQ ID NO: 9095031 - DNA, 21 bp, Homo sapiens
aaatgcaggctctttgttttc

SEQ ID NO: 9095032 - DNA, 23 bp, Homo sapiens
aaatgcagggtcgcaggttacag

SEQ ID NO: 9095033 - DNA, 22 bp, Homo sapiens
aaatgcagtttcctgagaccca

SEQ ID NO: 9095034 - DNA, 22 bp, Homo sapiens
aaatgcatcagctcataagaga

SEQ ID NO: 9095035 - DNA, 22 bp, Homo sapiens
aaatgcatgagaaagtattctg

SEQ ID NO: 9095036 - DNA, 22 bp, Homo sapiens
aaatactgtagataatagagtt

SEQ ID NO: 9095037 - DNA, 22 bp, Homo sapiens
aaatagacaggcttaaatagga

SEQ ID NO: 9095038 - DNA, 22 bp, Homo sapiens
aaatagacacttggacagacaa

SEQ ID NO: 9095039 - DNA, 22 bp, Homo sapiens
aaatagagctgggttaaacttt

SEQ ID NO: 9095040 - DNA, 22 bp, Homo sapiens
aaatagattgctgaggcattac

SEQ ID NO: 9095041 - DNA, 22 bp, Homo sapiens
aaatagattgctgaggcattac

SEQ ID NO: 9095042 - DNA, 22 bp, Homo sapiens
aaatagatttcctagcattgga

SEQ ID NO: 9095043 - DNA, 22 bp, Homo sapiens
aaatagatttcctagcattgga

SEQ ID NO: 9095044 - DNA, 22 bp, Homo sapiens
aaatccattctgttttaaaagt

SEQ ID NO: 9095045 - DNA, 22 bp, Homo sapiens
aaatagctgtatttaccctgta

SEQ ID NO: 9095046 - DNA, 22 bp, Homo sapiens
aaatagcttttcataattctca

SEQ ID NO: 9095047 - DNA, 22 bp, Homo sapiens
aaatagcttctaagccttttga

SEQ ID NO: 9095048 - DNA, 22 bp, Homo sapiens
aaatagcttctaagccttttga

SEQ ID NO: 9095049 - DNA, 22 bp, Homo sapiens
aaatagcagctttgacagcaca

SEQ ID NO: 9095050 - DNA, 22 bp, Homo sapiens
aaatagcattgtatttagctga

SEQ ID NO: 9095051 - DNA, 22 bp, Homo sapiens
aaataacttatgatcgtctggc

SEQ ID NO: 9095052 - DNA, 22 bp, Homo sapiens
aaagttttattcaagcattagt

SEQ ID NO: 9095053 - DNA, 22 bp, Homo sapiens
aaagttttatatgctgcagcga

SEQ ID NO: 9095054 - DNA, 22 bp, Homo sapiens
aaagtgtttacattgctataag

SEQ ID NO: 9095055 - DNA, 21 bp, Homo sapiens
aaagtgtgtggggaagaagga

SEQ ID NO: 9095056 - DNA, 22 bp, Homo sapiens
aaagtgtggtcgttcattttgt

SEQ ID NO: 9095057 - DNA, 22 bp, Homo sapiens
aaagtgttgaagaaaatgttca

SEQ ID NO: 9095058 - DNA, 22 bp, Homo sapiens
aaagtgtcttacccagggagaa

SEQ ID NO: 9095059 - DNA, 22 bp, Homo sapiens
aaagtgttgatatgtgacatcc

SEQ ID NO: 9095060 - DNA, 22 bp, Homo sapiens
aaagtgttgggaagaaagtgca

SEQ ID NO: 9095061 - DNA, 22 bp, Homo sapiens
aaataactttctgtgtatagtc

SEQ ID NO: 9095062 - DNA, 22 bp, Homo sapiens
aaataacttggtttcatcagag

SEQ ID NO: 9095063 - DNA, 22 bp, Homo sapiens
aaataacttggtttcatcagag

SEQ ID NO: 9095064 - DNA, 22 bp, Homo sapiens
aaataacttggtttcatcagag

SEQ ID NO: 9095065 - DNA, 22 bp, Homo sapiens
aaataacttggtttcatcagag

SEQ ID NO: 9095066 - DNA, 22 bp, Homo sapiens
aaataactttctgtgtatagtc

SEQ ID NO: 9095067 - DNA, 22 bp, Homo sapiens
aaataactttctgtgtatagtc

SEQ ID NO: 9095068 - DNA, 22 bp, Homo sapiens
aaataagaaattcttctttgca

SEQ ID NO: 9095069 - DNA, 22 bp, Homo sapiens
aaataagaggacagatgtttgg

SEQ ID NO: 9095070 - DNA, 22 bp, Homo sapiens
aaataagaaattcttctttgca

SEQ ID NO: 9095071 - DNA, 22 bp, Homo sapiens
aaataagttagcagattccagt

SEQ ID NO: 9095072 - DNA, 22 bp, Homo sapiens
aaataagtgtgggccagtcaaa

SEQ ID NO: 9095073 - DNA, 22 bp, Homo sapiens
aaataagttaaactagaatgat

SEQ ID NO: 9095074 - DNA, 22 bp, Homo sapiens
aaataagtgtgggccagtcaaa

SEQ ID NO: 9095075 - DNA, 17 bp, Homo sapiens
aaactgaaaaattcact

SEQ ID NO: 9095076 - DNA, 22 bp, Homo sapiens
aaactgaaacatcatcatgttg

SEQ ID NO: 9095077 - DNA, 21 bp, Homo sapiens
aaactgaagagacaggaactt

SEQ ID NO: 9095078 - DNA, 21 bp, Homo sapiens
aaactgaccttgcctgagaca

SEQ ID NO: 9095079 - DNA, 21 bp, Homo sapiens
aaactgaccttgcctgagaca

SEQ ID NO: 9095080 - DNA, 21 bp, Homo sapiens
aaactgaccttgcctgagaca

SEQ ID NO: 9095081 - DNA, 21 bp, Homo sapiens
aaagaatcatgggtaatttca

SEQ ID NO: 9095082 - DNA, 22 bp, Homo sapiens
aaagaatgtctgaacagctggc

SEQ ID NO: 9095083 - DNA, 22 bp, Homo sapiens
aaagaatgtctgaacagctggc

SEQ ID NO: 9095084 - DNA, 22 bp, Homo sapiens
aaagaatctatatatcaccacc

SEQ ID NO: 9095085 - DNA, 22 bp, Homo sapiens
aaagaatagcctttgtccaaat

SEQ ID NO: 9095086 - DNA, 22 bp, Homo sapiens
aaagaatagcctttgtccaaat

SEQ ID NO: 9095087 - DNA, 22 bp, Homo sapiens
aaagaacatcggagtgggcggg

SEQ ID NO: 9095088 - DNA, 22 bp, Homo sapiens
aaactgattttaacattgatat

SEQ ID NO: 9095089 - DNA, 22 bp, Homo sapiens
aaagagttggactttctcaggc

SEQ ID NO: 9095090 - DNA, 22 bp, Homo sapiens
aaagagttcttgtagctttgag

SEQ ID NO: 9095091 - DNA, 22 bp, Homo sapiens
aaagagttgaggcagttatcca

SEQ ID NO: 9095092 - DNA, 22 bp, Homo sapiens
aaagagttgaaaactaacagtg

SEQ ID NO: 9095093 - DNA, 22 bp, Homo sapiens
aaagagttgaggcagttatcca

SEQ ID NO: 9095094 - DNA, 22 bp, Homo sapiens
aaagagttctatgatctttcca

SEQ ID NO: 9095095 - DNA, 22 bp, Homo sapiens
aaagagttaagagtcttaagct

SEQ ID NO: 9095096 - DNA, 22 bp, Homo sapiens
aaagagttacacagtttcagaa

SEQ ID NO: 9095097 - DNA, 21 bp, Homo sapiens
aaagaggttaatattgtaagt

SEQ ID NO: 9095098 - DNA, 22 bp, Homo sapiens
aaagagggacaggcgcagacac

SEQ ID NO: 9095099 - DNA, 22 bp, Homo sapiens
aaattagaagtgctcaggaata

SEQ ID NO: 9095100 - DNA, 22 bp, Homo sapiens
aaattagaaatactttcaaagc

SEQ ID NO: 9095101 - DNA, 22 bp, Homo sapiens
aaattagaccagggctcctgga

SEQ ID NO: 9095102 - DNA, 22 bp, Homo sapiens
aaattacagccttgggtagctt

SEQ ID NO: 9095103 - DNA, 22 bp, Homo sapiens
aaattacagccttgggtagctt

SEQ ID NO: 9095104 - DNA, 22 bp, Homo sapiens
aaattacagatcaccaatgcat

SEQ ID NO: 9095105 - DNA, 22 bp, Homo sapiens
aaattacagatcaccaatgcat

SEQ ID NO: 9095106 - DNA, 22 bp, Homo sapiens
aaatgcagaatgatttcatcta

SEQ ID NO: 9095107 - DNA, 22 bp, Homo sapiens
aaatgcagaatgatttcatcta

SEQ ID NO: 9095108 - DNA, 22 bp, Homo sapiens
aaatgcactgaacacatgttgt

SEQ ID NO: 9095109 - DNA, 22 bp, Homo sapiens
aaatgcactgaacacatgttgt

SEQ ID NO: 9095110 - DNA, 22 bp, Homo sapiens
aaagacacaaatgtagaccaaa

SEQ ID NO: 9095111 - DNA, 22 bp, Homo sapiens
aaatgcactctgcttctgtgac

SEQ ID NO: 9095112 - DNA, 22 bp, Homo sapiens
aaatgcagattttgatgcagca

SEQ ID NO: 9095113 - DNA, 22 bp, Homo sapiens
aaatgcagatccctgaatctca

SEQ ID NO: 9095114 - DNA, 22 bp, Homo sapiens
aaatgcagatccctgaatctca

SEQ ID NO: 9095115 - DNA, 22 bp, Homo sapiens
aaatgcagcagctaattgaaaa

SEQ ID NO: 9095116 - DNA, 22 bp, Homo sapiens
aaagaggcaatcaatgtagcaa

SEQ ID NO: 9095117 - DNA, 22 bp, Homo sapiens
aaagaggcaatcaatgtagcaa

SEQ ID NO: 9095118 - DNA, 22 bp, Homo sapiens
aaagaggcaatcaatgtagcaa

SEQ ID NO: 9095119 - DNA, 22 bp, Homo sapiens
aaagaggaaccaagagcacgtg

SEQ ID NO: 9095120 - DNA, 22 bp, Homo sapiens
aaaccttcacatctactctaca

SEQ ID NO: 9095121 - DNA, 22 bp, Homo sapiens
aaacctttgcctggaagggagt

SEQ ID NO: 9095122 - DNA, 22 bp, Homo sapiens
aaacctttgtgtgtctgtgcct

SEQ ID NO: 9095123 - DNA, 22 bp, Homo sapiens
aaaggtcttctcaaacatccca

SEQ ID NO: 9095124 - DNA, 22 bp, Homo sapiens
aaaggtcttcagtgctttcact

SEQ ID NO: 9095125 - DNA, 23 bp, Homo sapiens
aaaggtctctgagccttggtttc

SEQ ID NO: 9095126 - DNA, 22 bp, Homo sapiens
aaacccagggttttgtcttccc

SEQ ID NO: 9095127 - DNA, 22 bp, Homo sapiens
aaaccctgctcttatggaactt

SEQ ID NO: 9095128 - DNA, 22 bp, Homo sapiens
aaaccctgcccttcccaagatg

SEQ ID NO: 9095129 - DNA, 22 bp, Homo sapiens
aaacctatatagtcttagaagc

SEQ ID NO: 9095130 - DNA, 22 bp, Homo sapiens
aaactctataggcagaagcaat

SEQ ID NO: 9095131 - DNA, 22 bp, Homo sapiens
aaactctagtaaaatgtattca

SEQ ID NO: 9095132 - DNA, 22 bp, Homo sapiens
aaactagatgaaacgagtaaag

SEQ ID NO: 9095133 - DNA, 22 bp, Homo sapiens
aaactagatgattatgaagcat

SEQ ID NO: 9095134 - DNA, 20 bp, Homo sapiens
aaagttcatgtttgcacttt

SEQ ID NO: 9095135 - DNA, 22 bp, Homo sapiens
aaagttcatggtgttatagaaa

SEQ ID NO: 9095136 - DNA, 20 bp, Homo sapiens
aaagttcatgtttgcacttt

SEQ ID NO: 9095137 - DNA, 22 bp, Homo sapiens
aaagttcatggtgttatagaaa

SEQ ID NO: 9095138 - DNA, 21 bp, Homo sapiens
aaagttcatgctttaatattc

SEQ ID NO: 9095139 - DNA, 21 bp, Homo sapiens
aaagttcatgctttaatattc

SEQ ID NO: 9095140 - DNA, 22 bp, Homo sapiens
aaagttcagtgccttctataca

SEQ ID NO: 9095141 - DNA, 18 bp, Homo sapiens
aaagttcagggagagttg

SEQ ID NO: 9095142 - DNA, 22 bp, Homo sapiens
aaagttcactgaccagcactgg

SEQ ID NO: 9095143 - DNA, 22 bp, Homo sapiens
aaagttcactgaccagcactgg

SEQ ID NO: 9095144 - DNA, 22 bp, Homo sapiens
aaagttcactatgtagcagcgt

SEQ ID NO: 9095145 - DNA, 22 bp, Homo sapiens
aaaccttttcagctgaatggag

SEQ ID NO: 9095146 - DNA, 22 bp, Homo sapiens
aaagggtcagattctgctagtg

SEQ ID NO: 9095147 - DNA, 22 bp, Homo sapiens
aaagggtccagatacttggaaa

SEQ ID NO: 9095148 - DNA, 22 bp, Homo sapiens
aaacagttttcctagctgtctg

SEQ ID NO: 9095149 - DNA, 22 bp, Homo sapiens
aaaggtatcatgtccatacagt

SEQ ID NO: 9095150 - DNA, 22 bp, Homo sapiens
aaaggtcaaaatcgtgacattg

SEQ ID NO: 9095151 - DNA, 22 bp, Homo sapiens
aaaggtcaagctggactcaggt

SEQ ID NO: 9095152 - DNA, 22 bp, Homo sapiens
aaaggtcattgaaaaggaggaa

SEQ ID NO: 9095153 - DNA, 17 bp, Homo sapiens
aaaggtcgataaggtgg

SEQ ID NO: 9095154 - DNA, 22 bp, Homo sapiens
aaaggtcagctgccatcgttct

SEQ ID NO: 9095155 - DNA, 22 bp, Homo sapiens
aaaggtcagctgccatcgttct

SEQ ID NO: 9095156 - DNA, 22 bp, Homo sapiens
aaaggtcagacttaggctgggc

SEQ ID NO: 9095157 - DNA, 22 bp, Homo sapiens
aaacagttaattgctttcagtt

SEQ ID NO: 9095158 - DNA, 22 bp, Homo sapiens
aaacagtgtttttatgatttat

SEQ ID NO: 9095159 - DNA, 22 bp, Homo sapiens
aaacagtggccaattctggaga

SEQ ID NO: 9095160 - DNA, 18 bp, Homo sapiens
aaacagtgcctaagtgtc

SEQ ID NO: 9095161 - DNA, 22 bp, Homo sapiens
aaacagtgcctggcatggagga

SEQ ID NO: 9095162 - DNA, 22 bp, Homo sapiens
aaacaatgaaattcattcttca

SEQ ID NO: 9095163 - DNA, 22 bp, Homo sapiens
aaacaatgacaacacagctgcg

SEQ ID NO: 9095164 - DNA, 22 bp, Homo sapiens
aaacaatgacaacacagctgcg

SEQ ID NO: 9095165 - DNA, 22 bp, Homo sapiens
aaacaatgagcttttacacact

SEQ ID NO: 9095166 - DNA, 22 bp, Homo sapiens
aaacaatgagcttttacacact

SEQ ID NO: 9095167 - DNA, 17 bp, Homo sapiens
aaacaatgcagacaagc

SEQ ID NO: 9095168 - DNA, 22 bp, Homo sapiens
aaacaatgtacatttataatgc

SEQ ID NO: 9095169 - DNA, 22 bp, Homo sapiens
aaacaatgtagattaccattta

SEQ ID NO: 9095170 - DNA, 22 bp, Homo sapiens
aaacaatgtagattaccattta

SEQ ID NO: 9095171 - DNA, 22 bp, Homo sapiens
aaacaatgtacatttataatgc

SEQ ID NO: 9095172 - DNA, 22 bp, Homo sapiens
aaacaatgttgtctccaagagg

SEQ ID NO: 9095173 - DNA, 22 bp, Homo sapiens
aaacaatgtagattaccattta

SEQ ID NO: 9095174 - DNA, 22 bp, Homo sapiens
aaacaatgttcctatattagag

SEQ ID NO: 9095175 - DNA, 22 bp, Homo sapiens
aaacagctgtcattgttttaaa

SEQ ID NO: 9095176 - DNA, 22 bp, Homo sapiens
aaacagcttgtaaggtgtaatt

SEQ ID NO: 9095177 - DNA, 17 bp, Homo sapiens
aaacagtgagtgttatg

SEQ ID NO: 9095178 - DNA, 22 bp, Homo sapiens
aaactccagtgaatactagaat

SEQ ID NO: 9095179 - DNA, 22 bp, Homo sapiens
aaactccagtgaatactagaat

SEQ ID NO: 9095180 - DNA, 22 bp, Homo sapiens
aaactctaagacactgtacaat

SEQ ID NO: 9095181 - DNA, 22 bp, Homo sapiens
aaaagtactattttaacaaagt

SEQ ID NO: 9095182 - DNA, 22 bp, Homo sapiens
aaaagtactattttaacaaagt

SEQ ID NO: 9095183 - DNA, 22 bp, Homo sapiens
aaaagtatagggtttggagtca

SEQ ID NO: 9095184 - DNA, 22 bp, Homo sapiens
aaagacatggaactagagatgg

SEQ ID NO: 9095185 - DNA, 22 bp, Homo sapiens
aaagacatggaactagagatgg

SEQ ID NO: 9095186 - DNA, 22 bp, Homo sapiens
aaagacatggaactagagatgg

SEQ ID NO: 9095187 - DNA, 22 bp, Homo sapiens
aaagaaggggtctacatccaat

SEQ ID NO: 9095188 - DNA, 22 bp, Homo sapiens
aaaagtatggtggtccttttta

SEQ ID NO: 9095189 - DNA, 22 bp, Homo sapiens
aaaagtattggccaccatttct

SEQ ID NO: 9095190 - DNA, 22 bp, Homo sapiens
aaaagtatggtggtccttttta

SEQ ID NO: 9095191 - DNA, 22 bp, Homo sapiens
aaaagtatccacagctcaggag

SEQ ID NO: 9095192 - DNA, 22 bp, Homo sapiens
aaactcaagtctatgaacaagg

SEQ ID NO: 9095193 - DNA, 22 bp, Homo sapiens
aaactcaaagtcagatcagaga

SEQ ID NO: 9095194 - DNA, 22 bp, Homo sapiens
aaactcaagtctatgaacaagg

SEQ ID NO: 9095195 - DNA, 22 bp, Homo sapiens
aaactcagaaggtacagaaggg

SEQ ID NO: 9095196 - DNA, 22 bp, Homo sapiens
aaaagagagttgccagtctgta

SEQ ID NO: 9095197 - DNA, 22 bp, Homo sapiens
aaaagagagttgccagtctgta

SEQ ID NO: 9095198 - DNA, 22 bp, Homo sapiens
aaaagagagttgccagtctgta

SEQ ID NO: 9095199 - DNA, 22 bp, Homo sapiens
aaacccagagactagaaagacc

SEQ ID NO: 9095200 - DNA, 22 bp, Homo sapiens
aaacccagagactagaaagacc

SEQ ID NO: 9095201 - DNA, 22 bp, Homo sapiens
aaaagagaatcctgtacagaga

SEQ ID NO: 9095202 - DNA, 22 bp, Homo sapiens
aaaagagaaagtggcaggcttt

SEQ ID NO: 9095203 - DNA, 22 bp, Homo sapiens
aaaagagaatcctgtacagaga

SEQ ID NO: 9095204 - DNA, 22 bp, Homo sapiens
aaaagagaaagtggcaggcttt

SEQ ID NO: 9095205 - DNA, 22 bp, Homo sapiens
aaaagagaaagtggcaggcttt

SEQ ID NO: 9095206 - DNA, 22 bp, Homo sapiens
aaaagagagctgaggagctcca

SEQ ID NO: 9095207 - DNA, 22 bp, Homo sapiens
aaaagagagctgaggagctcca

SEQ ID NO: 9095208 - DNA, 22 bp, Homo sapiens
aaaagagagctgaggagctcca

SEQ ID NO: 9095209 - DNA, 22 bp, Homo sapiens
aaaagagaatcctgtacagaga

SEQ ID NO: 9095210 - DNA, 22 bp, Homo sapiens
aaagaccatgtttacagctagg

SEQ ID NO: 9095211 - DNA, 22 bp, Homo sapiens
aaagacattgaagaaggactta

SEQ ID NO: 9095212 - DNA, 22 bp, Homo sapiens
aaagaccatgtttacagctagg

SEQ ID NO: 9095213 - DNA, 22 bp, Homo sapiens
aaagacattgaagaaggactta

SEQ ID NO: 9095214 - DNA, 22 bp, Homo sapiens
aaagacattagcttagatgtca

SEQ ID NO: 9095215 - DNA, 22 bp, Homo sapiens
aaagacattagcttagatgtca

SEQ ID NO: 9095216 - DNA, 22 bp, Homo sapiens
aaagacattagcttagatgtca

SEQ ID NO: 9095217 - DNA, 22 bp, Homo sapiens
aaagacattagattaacgtaca

SEQ ID NO: 9095218 - DNA, 22 bp, Homo sapiens
aaagacatggcaagagatgggg

SEQ ID NO: 9095219 - DNA, 22 bp, Homo sapiens
aaaatcctctaattctagaata

SEQ ID NO: 9095220 - DNA, 22 bp, Homo sapiens
aaaatcagtacactttattttg

SEQ ID NO: 9095221 - DNA, 22 bp, Homo sapiens
aaaatcacaagcttgggtcact

SEQ ID NO: 9095222 - DNA, 22 bp, Homo sapiens
aaagactaaatgaatgagctca

SEQ ID NO: 9095223 - DNA, 22 bp, Homo sapiens
aaagactaaccagttgtcaaaa

SEQ ID NO: 9095224 - DNA, 22 bp, Homo sapiens
aaacaatgaaatatttttatgg

SEQ ID NO: 9095225 - DNA, 22 bp, Homo sapiens
aaacaatgaaatatttttatgg

SEQ ID NO: 9095226 - DNA, 22 bp, Homo sapiens
aaacaatgaaattcattcttca

SEQ ID NO: 9095227 - DNA, 22 bp, Homo sapiens
aaacaatgaaattcattcttca

SEQ ID NO: 9095228 - DNA, 22 bp, Homo sapiens
aaacaagtgtaaactagtctgt

SEQ ID NO: 9095229 - DNA, 22 bp, Homo sapiens
aaacaaacaattagttgtgtgg

SEQ ID NO: 9095230 - DNA, 22 bp, Homo sapiens
aaacaaacaattagttgtgtgg

SEQ ID NO: 9095231 - DNA, 22 bp, Homo sapiens
aaaattttgccctatccttcat

SEQ ID NO: 9095232 - DNA, 22 bp, Homo sapiens
aaaatctaagtagcgagtaagg

SEQ ID NO: 9095233 - DNA, 22 bp, Homo sapiens
aaacagaaatttcctcatgctc

SEQ ID NO: 9095234 - DNA, 22 bp, Homo sapiens
aaacactttagaaagggacttg

SEQ ID NO: 9095235 - DNA, 22 bp, Homo sapiens
aaacacttgcaaaatggttcct

SEQ ID NO: 9095236 - DNA, 22 bp, Homo sapiens
aaacactttaagtgaggaggat

SEQ ID NO: 9095237 - DNA, 22 bp, Homo sapiens
aaacacttcttaggtcttaagt

SEQ ID NO: 9095238 - DNA, 22 bp, Homo sapiens
aaacacttgcaaaatggttcct

SEQ ID NO: 9095239 - DNA, 22 bp, Homo sapiens
aaacacttcttaggtcttaagt

SEQ ID NO: 9095240 - DNA, 22 bp, Homo sapiens
aaacacttcctgtaacatgaca

SEQ ID NO: 9095241 - DNA, 22 bp, Homo sapiens
aaacacttcctgtaacatgaca

SEQ ID NO: 9095242 - DNA, 22 bp, Homo sapiens
aaacacttcctgtaacatgaca

SEQ ID NO: 9095243 - DNA, 22 bp, Homo sapiens
aaacactgtgtcaaactggggc

SEQ ID NO: 9095244 - DNA, 22 bp, Homo sapiens
aaacactgtgtcaaactggggc

SEQ ID NO: 9095245 - DNA, 22 bp, Homo sapiens
aaacacttcaaggacttctgtc

SEQ ID NO: 9095246 - DNA, 22 bp, Homo sapiens
aaacacttcaaggacttctgtc

SEQ ID NO: 9095247 - DNA, 22 bp, Homo sapiens
aaacacttcaaggacttctgtc

SEQ ID NO: 9095248 - DNA, 22 bp, Homo sapiens
aaacagagagatgtatgtggag

SEQ ID NO: 9095249 - DNA, 22 bp, Homo sapiens
aaaagacatctatttcaggcag

SEQ ID NO: 9095250 - DNA, 22 bp, Homo sapiens
aaaagacatctatttcaggcag

SEQ ID NO: 9095251 - DNA, 22 bp, Homo sapiens
aaaagacatctatttcaggcag

SEQ ID NO: 9095252 - DNA, 22 bp, Homo sapiens
aaaagacatatgtgggcattct

SEQ ID NO: 9095253 - DNA, 22 bp, Homo sapiens
aaaagacaggtgtctgcggccc

SEQ ID NO: 9095254 - DNA, 22 bp, Homo sapiens
aaaatgacattccagtgatatt

SEQ ID NO: 9095255 - DNA, 22 bp, Homo sapiens
aaaatgaataagttaacccagg

SEQ ID NO: 9095256 - DNA, 22 bp, Homo sapiens
aaaatgaataagttaacccagg

SEQ ID NO: 9095257 - DNA, 22 bp, Homo sapiens
aaaaatcacttttataggcagc

SEQ ID NO: 9095258 - DNA, 22 bp, Homo sapiens
aaaaatctatgactgcttctcc

SEQ ID NO: 9095259 - DNA, 22 bp, Homo sapiens
aaaaaagattgatggtggatgc

SEQ ID NO: 9095260 - DNA, 22 bp, Homo sapiens
aaaaaagattgatggtggatgc

SEQ ID NO: 9095261 - DNA, 22 bp, Homo sapiens
aaaaaagattgatggtggatgc

SEQ ID NO: 9095262 - DNA, 22 bp, Homo sapiens
aaaaaagattgatggtggatgc

SEQ ID NO: 9095263 - DNA, 23 bp, Homo sapiens
aaaaaaccatgtaggcactcagt

SEQ ID NO: 9095264 - DNA, 22 bp, Homo sapiens
aaaaaattatcatagttcctga

SEQ ID NO: 9095265 - DNA, 22 bp, Homo sapiens
aaaaaatcagatctttggttaa

SEQ ID NO: 9095266 - DNA, 22 bp, Homo sapiens
aaaaaattatcatagttcctga

SEQ ID NO: 9095267 - DNA, 22 bp, Homo sapiens
aaaaaattatcatagttcctga

SEQ ID NO: 9095268 - DNA, 20 bp, Homo sapiens
aaaaacagtaatgctgaaga

SEQ ID NO: 9095269 - DNA, 20 bp, Homo sapiens
aaaaacagtaatgctgaaga

SEQ ID NO: 9095270 - DNA, 22 bp, Homo sapiens
aaaaacactgggctgggagtca

SEQ ID NO: 9095271 - DNA, 22 bp, Homo sapiens
aaaaacacaagtggcttggtct

SEQ ID NO: 9095272 - DNA, 22 bp, Homo sapiens
aaaaacacaagtggcttggtct

SEQ ID NO: 9095273 - DNA, 22 bp, Homo sapiens
aaaaacagaatgtgtctaactc

SEQ ID NO: 9095274 - DNA, 22 bp, Homo sapiens
aaaaacagaatgtgtctaactc

SEQ ID NO: 9095275 - DNA, 22 bp, Homo sapiens
aaaaaattccattctgtgcctt

SEQ ID NO: 9095276 - DNA, 22 bp, Homo sapiens
aaaaacacaactgtctttctct

SEQ ID NO: 9095277 - DNA, 22 bp, Homo sapiens
aaaaacacaactgtctttctct

SEQ ID NO: 9095278 - DNA, 22 bp, Homo sapiens
aaaaacacaactgtctttctct

SEQ ID NO: 9095279 - DNA, 23 bp, Homo sapiens
aaaatcttctgcctatgaagaaa

SEQ ID NO: 9095280 - DNA, 23 bp, Homo sapiens
aaaatcttctgcctatgaagaaa

SEQ ID NO: 9095281 - DNA, 22 bp, Homo sapiens
aaaatcttgactgtttttagaa

SEQ ID NO: 9095282 - DNA, 22 bp, Homo sapiens
aaaatcttgactgtttttagaa

SEQ ID NO: 9095283 - DNA, 22 bp, Homo sapiens
aaaatcttgactgtttttagaa

SEQ ID NO: 9095284 - DNA, 22 bp, Homo sapiens
aaaatgaacagaacaatgggga

SEQ ID NO: 9095285 - DNA, 22 bp, Homo sapiens
aaaatgaagcaaaggcattcag

SEQ ID NO: 9095286 - DNA, 22 bp, Homo sapiens
aaaatgaagcaaaggcattcag

SEQ ID NO: 9095287 - DNA, 22 bp, Homo sapiens
aaaatgaacagaacaatgggga

SEQ ID NO: 9095288 - DNA, 22 bp, Homo sapiens
aaaatcttgtgacttaggaagg

SEQ ID NO: 9095289 - DNA, 22 bp, Homo sapiens
aaaaacctttcccatactaaga

SEQ ID NO: 9095290 - DNA, 22 bp, Homo sapiens
aaaatagttaacgttcagagta

SEQ ID NO: 9095291 - DNA, 22 bp, Homo sapiens
aaaaacctcaattacttttgca

SEQ ID NO: 9095292 - DNA, 22 bp, Homo sapiens
aaaaaccattgtcttcagtctc

SEQ ID NO: 9095293 - DNA, 22 bp, Homo sapiens
gcaccatgacagtgaggagaac

SEQ ID NO: 9095294 - DNA, 23 bp, Homo sapiens
attatccagtgcacttcacagct

SEQ ID NO: 9095295 - DNA, 22 bp, Homo sapiens
gcacccagaataaggacaggac

SEQ ID NO: 9095296 - DNA, 22 bp, Homo sapiens
attatctatgtagaatgatttt

SEQ ID NO: 9095297 - DNA, 22 bp, Homo sapiens
attatcctcagaaaacatgtga

SEQ ID NO: 9095298 - DNA, 22 bp, Homo sapiens
attatctatgtagaatgatttt

SEQ ID NO: 9095299 - DNA, 22 bp, Homo sapiens
attatctatgtagaatgatttt

SEQ ID NO: 9095300 - DNA, 22 bp, Homo sapiens
attatgcatatacatttgacta

SEQ ID NO: 9095301 - DNA, 22 bp, Homo sapiens
attatgtctttagatatttggt

SEQ ID NO: 9095302 - DNA, 22 bp, Homo sapiens
attatgtgtaacgagtttattg

SEQ ID NO: 9095303 - DNA, 19 bp, Homo sapiens
attatgtgttttaatccat

SEQ ID NO: 9095304 - DNA, 22 bp, Homo sapiens
attatggctttcatgggcaata

SEQ ID NO: 9095305 - DNA, 22 bp, Homo sapiens
attatggagaaatatgtacagg

SEQ ID NO: 9095306 - DNA, 22 bp, Homo sapiens
attatggacatcaaataactct

SEQ ID NO: 9095307 - DNA, 22 bp, Homo sapiens
attatgtatttggtatagtttg

SEQ ID NO: 9095308 - DNA, 22 bp, Homo sapiens
attcaagtacagttttcttctt

SEQ ID NO: 9095309 - DNA, 22 bp, Homo sapiens
attcaagtccagcttctctaca

SEQ ID NO: 9095310 - DNA, 22 bp, Homo sapiens
attcaagtacagttttcttctt

SEQ ID NO: 9095311 - DNA, 22 bp, Homo sapiens
gcagagattatgccatggaaag

SEQ ID NO: 9095312 - DNA, 22 bp, Homo sapiens
attcaataaatatgctacatgg

SEQ ID NO: 9095313 - DNA, 22 bp, Homo sapiens
attcaagttcttctgtctttgc

SEQ ID NO: 9095314 - DNA, 22 bp, Homo sapiens
attcaataaatatgctacatgg

SEQ ID NO: 9095315 - DNA, 22 bp, Homo sapiens
attcaagtccagcttctctaca

SEQ ID NO: 9095316 - DNA, 22 bp, Homo sapiens
attcaagtccagcttctctaca

SEQ ID NO: 9095317 - DNA, 22 bp, Homo sapiens
gcagagatcggacactcagtaa

SEQ ID NO: 9095318 - DNA, 22 bp, Homo sapiens
gcagagaggatattattgtcca

SEQ ID NO: 9095319 - DNA, 22 bp, Homo sapiens
gcagagagttgggctgcgccag

SEQ ID NO: 9095320 - DNA, 22 bp, Homo sapiens
gcagagaggaatgaagccatcc

SEQ ID NO: 9095321 - DNA, 22 bp, Homo sapiens
gcagagaggaatgaagccatcc

SEQ ID NO: 9095322 - DNA, 22 bp, Homo sapiens
gcacacaggcagtttccagcca

SEQ ID NO: 9095323 - DNA, 22 bp, Homo sapiens
gcaccaggaggcccttctcatc

SEQ ID NO: 9095324 - DNA, 22 bp, Homo sapiens
gcacacagctagattaccattc

SEQ ID NO: 9095325 - DNA, 22 bp, Homo sapiens
gcacacaggcagtttccagcca

SEQ ID NO: 9095326 - DNA, 22 bp, Homo sapiens
gcacacagctagattaccattc

SEQ ID NO: 9095327 - DNA, 22 bp, Homo sapiens
gcacacagccagctgagggcta

SEQ ID NO: 9095328 - DNA, 22 bp, Homo sapiens
gcacacagccagctgagggcta

SEQ ID NO: 9095329 - DNA, 22 bp, Homo sapiens
gcacacagactaaccatatttc

SEQ ID NO: 9095330 - DNA, 22 bp, Homo sapiens
gcacacagaattgattcactgt

SEQ ID NO: 9095331 - DNA, 22 bp, Homo sapiens
gcacacagaattgattcactgt

SEQ ID NO: 9095332 - DNA, 16 bp, Homo sapiens
gcacacagccagcctt

SEQ ID NO: 9095333 - DNA, 22 bp, Homo sapiens
gcacacagagaggtggtatgtc

SEQ ID NO: 9095334 - DNA, 22 bp, Homo sapiens
gcacacagattaggaaacagaa

SEQ ID NO: 9095335 - DNA, 22 bp, Homo sapiens
attatataggacttgcccttcc

SEQ ID NO: 9095336 - DNA, 22 bp, Homo sapiens
attatattgagtataaccagag

SEQ ID NO: 9095337 - DNA, 22 bp, Homo sapiens
attatattgagtataaccagag

SEQ ID NO: 9095338 - DNA, 22 bp, Homo sapiens
attatatttgaaaggttggaag

SEQ ID NO: 9095339 - DNA, 22 bp, Homo sapiens
attatcagccgtcccactacat

SEQ ID NO: 9095340 - DNA, 22 bp, Homo sapiens
attatcagaaattcaaagggtg

SEQ ID NO: 9095341 - DNA, 22 bp, Homo sapiens
attatccagcaccaatgtcaga

SEQ ID NO: 9095342 - DNA, 22 bp, Homo sapiens
attaactgtactttctaatttt

SEQ ID NO: 9095343 - DNA, 22 bp, Homo sapiens
attaagagcctactatgtgccg

SEQ ID NO: 9095344 - DNA, 22 bp, Homo sapiens
attaagactattgatatttaca

SEQ ID NO: 9095345 - DNA, 22 bp, Homo sapiens
attaagagttacaaatagagta

SEQ ID NO: 9095346 - DNA, 22 bp, Homo sapiens
attataggcttgagccaccgtg

SEQ ID NO: 9095347 - DNA, 22 bp, Homo sapiens
attataggcttgagccaccgtg

SEQ ID NO: 9095348 - DNA, 22 bp, Homo sapiens
attatataaaattctggaagct

SEQ ID NO: 9095349 - DNA, 22 bp, Homo sapiens
attataggcttgagccaccgtg

SEQ ID NO: 9095350 - DNA, 19 bp, Homo sapiens
attaacatcagtgttggcc

SEQ ID NO: 9095351 - DNA, 22 bp, Homo sapiens
attaacatgagttggagatagg

SEQ ID NO: 9095352 - DNA, 22 bp, Homo sapiens
attaacatgcagccagacacac

SEQ ID NO: 9095353 - DNA, 22 bp, Homo sapiens
attaacatgcagccagacacac

SEQ ID NO: 9095354 - DNA, 22 bp, Homo sapiens
attaaattttcactaggctccc

SEQ ID NO: 9095355 - DNA, 22 bp, Homo sapiens
gattcttatgagtgaactttac

SEQ ID NO: 9095356 - DNA, 22 bp, Homo sapiens
attaaattggacgctgggggaa

SEQ ID NO: 9095357 - DNA, 22 bp, Homo sapiens
attaaattggatctgcatagtt

SEQ ID NO: 9095358 - DNA, 22 bp, Homo sapiens
attaaattggatctgcatagtt

SEQ ID NO: 9095359 - DNA, 22 bp, Homo sapiens
gattctgcgatgaggacgagct

SEQ ID NO: 9095360 - DNA, 18 bp, Homo sapiens
gattctgattctggaggc

SEQ ID NO: 9095361 - DNA, 18 bp, Homo sapiens
gattctgattctggaggc

SEQ ID NO: 9095362 - DNA, 22 bp, Homo sapiens
gattctgagctggtgttttacg

SEQ ID NO: 9095363 - DNA, 22 bp, Homo sapiens
gattccttggctctgtctcagg

SEQ ID NO: 9095364 - DNA, 22 bp, Homo sapiens
gattcctttggtgaactgccga

SEQ ID NO: 9095365 - DNA, 22 bp, Homo sapiens
gattccacggctcagcctcaac

SEQ ID NO: 9095366 - DNA, 22 bp, Homo sapiens
gatgtcttgttgatttcattct

SEQ ID NO: 9095367 - DNA, 22 bp, Homo sapiens
gatgtcttctcaactgtagacc

SEQ ID NO: 9095368 - DNA, 22 bp, Homo sapiens
gatgtgaggtggtaaacaggga

SEQ ID NO: 9095369 - DNA, 22 bp, Homo sapiens
gatgtgagtggtagctgggatt

SEQ ID NO: 9095370 - DNA, 22 bp, Homo sapiens
gattcactcatattttacgttt

SEQ ID NO: 9095371 - DNA, 22 bp, Homo sapiens
gattccaaatggagatgtccac

SEQ ID NO: 9095372 - DNA, 22 bp, Homo sapiens
gatgtggatgatcttagatggt

SEQ ID NO: 9095373 - DNA, 23 bp, Homo sapiens
gagtggggagaaattggttaaac

SEQ ID NO: 9095374 - DNA, 22 bp, Homo sapiens
gagtggggcccactgctgggtg

SEQ ID NO: 9095375 - DNA, 22 bp, Homo sapiens
atgttatgtctgggaaggggta

SEQ ID NO: 9095376 - DNA, 22 bp, Homo sapiens
atgttattaaagtacagattct

SEQ ID NO: 9095377 - DNA, 22 bp, Homo sapiens
atgttattaaagtacagattct

SEQ ID NO: 9095378 - DNA, 23 bp, Homo sapiens
atgttattattagcagtcttgcc

SEQ ID NO: 9095379 - DNA, 22 bp, Homo sapiens
gatggcaggcaggtgagtagag

SEQ ID NO: 9095380 - DNA, 22 bp, Homo sapiens
gatggcagcatattgacagcat

SEQ ID NO: 9095381 - DNA, 22 bp, Homo sapiens
gatggcagcagcagccagggat

SEQ ID NO: 9095382 - DNA, 22 bp, Homo sapiens
gatggcaggtagtggtctcatc

SEQ ID NO: 9095383 - DNA, 22 bp, Homo sapiens
gatggcagtcaaccaggtgagg

SEQ ID NO: 9095384 - DNA, 22 bp, Homo sapiens
gatggcagtggagttagtgatt

SEQ ID NO: 9095385 - DNA, 22 bp, Homo sapiens
atgttatttctgaaagatcatt

SEQ ID NO: 9095386 - DNA, 22 bp, Homo sapiens
atgttatttctgaaagatcatt

SEQ ID NO: 9095387 - DNA, 22 bp, Homo sapiens
atgttatttctgaaagatcatt

SEQ ID NO: 9095388 - DNA, 22 bp, Homo sapiens
gatggcacacagacatccccgc

SEQ ID NO: 9095389 - DNA, 20 bp, Homo sapiens
gatggatttcaacacctttc

SEQ ID NO: 9095390 - DNA, 22 bp, Homo sapiens
gatggagtctgaagctgggaac

SEQ ID NO: 9095391 - DNA, 21 bp, Homo sapiens
gatgatggcaggcagcactgg

SEQ ID NO: 9095392 - DNA, 22 bp, Homo sapiens
attcttttttaaggaatagaac

SEQ ID NO: 9095393 - DNA, 22 bp, Homo sapiens
gcagtaaagcctgagatatatg

SEQ ID NO: 9095394 - DNA, 22 bp, Homo sapiens
gcagtaaaggtgacaatatagg

SEQ ID NO: 9095395 - DNA, 22 bp, Homo sapiens
attgcaaagcattgtgagcgca

SEQ ID NO: 9095396 - DNA, 22 bp, Homo sapiens
attgcaaagcattgtgagcgca

SEQ ID NO: 9095397 - DNA, 22 bp, Homo sapiens
gcagtaagatgtttcccagagc

SEQ ID NO: 9095398 - DNA, 22 bp, Homo sapiens
gcagtaagaaagtcaagcagtt

SEQ ID NO: 9095399 - DNA, 22 bp, Homo sapiens
gcagtaagaaagtcaagcagtt

SEQ ID NO: 9095400 - DNA, 22 bp, Homo sapiens
attgcaaagcgtagactctaaa

SEQ ID NO: 9095401 - DNA, 22 bp, Homo sapiens
attgcaaaggtcccattcaaga

SEQ ID NO: 9095402 - DNA, 22 bp, Homo sapiens
attgcaaaggtcccattcaaga

SEQ ID NO: 9095403 - DNA, 22 bp, Homo sapiens
attgcaaaggtcccattcaaga

SEQ ID NO: 9095404 - DNA, 22 bp, Homo sapiens
attgcaaatgagtcttaatata

SEQ ID NO: 9095405 - DNA, 22 bp, Homo sapiens
attgcaaatgagtcttaatata

SEQ ID NO: 9095406 - DNA, 22 bp, Homo sapiens
attgcaaatggtttggtcatct

SEQ ID NO: 9095407 - DNA, 22 bp, Homo sapiens
attgcaaatgagtcttaatata

SEQ ID NO: 9095408 - DNA, 22 bp, Homo sapiens
attgcaaataatgcgagccagt

SEQ ID NO: 9095409 - DNA, 22 bp, Homo sapiens
attgcaaataactgtactgaat

SEQ ID NO: 9095410 - DNA, 22 bp, Homo sapiens
attgcactccagcctgggggac

SEQ ID NO: 9095411 - DNA, 22 bp, Homo sapiens
attgcactccagcctgggggac

SEQ ID NO: 9095412 - DNA, 22 bp, Homo sapiens
attgcactccagcctgggtgac

SEQ ID NO: 9095413 - DNA, 22 bp, Homo sapiens
attgcacagctgaatattttgg

SEQ ID NO: 9095414 - DNA, 22 bp, Homo sapiens
attgcactccggcctgggtgac

SEQ ID NO: 9095415 - DNA, 22 bp, Homo sapiens
attgcactccagcctgggtgac

SEQ ID NO: 9095416 - DNA, 22 bp, Homo sapiens
attgcactccggcctgggtgac

SEQ ID NO: 9095417 - DNA, 19 bp, Homo sapiens
gcatcatttgtctcttctt

SEQ ID NO: 9095418 - DNA, 22 bp, Homo sapiens
gcatcattctggctctttccat

SEQ ID NO: 9095419 - DNA, 22 bp, Homo sapiens
gcatcatttgtcctctaggact

SEQ ID NO: 9095420 - DNA, 19 bp, Homo sapiens
gcatcagagcagaaggggt

SEQ ID NO: 9095421 - DNA, 22 bp, Homo sapiens
gcatggcaaatatcgagggcag

SEQ ID NO: 9095422 - DNA, 22 bp, Homo sapiens
gcatggcagtgaggatggtgct

SEQ ID NO: 9095423 - DNA, 22 bp, Homo sapiens
gcatggcagccagtacatggtg

SEQ ID NO: 9095424 - DNA, 22 bp, Homo sapiens
gcatggcaagatcaggagacca

SEQ ID NO: 9095425 - DNA, 22 bp, Homo sapiens
gcatggcagaacacctcgcccg

SEQ ID NO: 9095426 - DNA, 20 bp, Homo sapiens
gcaggcagggaatgggggtg

SEQ ID NO: 9095427 - DNA, 15 bp, Homo sapiens
gcaggcaggtcacct

SEQ ID NO: 9095428 - DNA, 22 bp, Homo sapiens
attctgatgcctgggtactgcc

SEQ ID NO: 9095429 - DNA, 22 bp, Homo sapiens
attctgcacatccaagaacagg

SEQ ID NO: 9095430 - DNA, 22 bp, Homo sapiens
attctgcaggtggaggatggca

SEQ ID NO: 9095431 - DNA, 22 bp, Homo sapiens
attctgcatggtggtgtctctg

SEQ ID NO: 9095432 - DNA, 22 bp, Homo sapiens
gcagggattgtgcagggggcta

SEQ ID NO: 9095433 - DNA, 22 bp, Homo sapiens
attctgctcattttatttccag

SEQ ID NO: 9095434 - DNA, 22 bp, Homo sapiens
attctgctgcacaccttccccc

SEQ ID NO: 9095435 - DNA, 22 bp, Homo sapiens
attcttttcccaactgctttaa

SEQ ID NO: 9095436 - DNA, 22 bp, Homo sapiens
attcttttaagccccagggatt

SEQ ID NO: 9095437 - DNA, 22 bp, Homo sapiens
attctttggacaataagtggtg

SEQ ID NO: 9095438 - DNA, 17 bp, Homo sapiens
attctttgatgtctctg

SEQ ID NO: 9095439 - DNA, 22 bp, Homo sapiens
gcagggcagtgtgtctgtgggg

SEQ ID NO: 9095440 - DNA, 22 bp, Homo sapiens
gcagggcatagaggcacggagg

SEQ ID NO: 9095441 - DNA, 22 bp, Homo sapiens
attctctttgtataacatcttg

SEQ ID NO: 9095442 - DNA, 22 bp, Homo sapiens
attctctttgtataacatcttg

SEQ ID NO: 9095443 - DNA, 22 bp, Homo sapiens
attctgagtacaacaagatgtt

SEQ ID NO: 9095444 - DNA, 22 bp, Homo sapiens
attctgagaggcacaatgtgga

SEQ ID NO: 9095445 - DNA, 22 bp, Homo sapiens
gcagctgtgtaatgagcccaca

SEQ ID NO: 9095446 - DNA, 22 bp, Homo sapiens
gcagctgtgggttccaagtcta

SEQ ID NO: 9095447 - DNA, 22 bp, Homo sapiens
gcagctgtgggttccaagtcta

SEQ ID NO: 9095448 - DNA, 22 bp, Homo sapiens
gcagctgtggtgctgagatagg

SEQ ID NO: 9095449 - DNA, 22 bp, Homo sapiens
gcagctgtgggcctcggagagc

SEQ ID NO: 9095450 - DNA, 19 bp, Homo sapiens
gcagctgtgggaagagcca

SEQ ID NO: 9095451 - DNA, 22 bp, Homo sapiens
attctgagttagagtcagccag

SEQ ID NO: 9095452 - DNA, 21 bp, Homo sapiens
attctgagttgtcagtcttca

SEQ ID NO: 9095453 - DNA, 21 bp, Homo sapiens
attctgagtcttggggtctca

SEQ ID NO: 9095454 - DNA, 22 bp, Homo sapiens
attctgagttagagtcagccag

SEQ ID NO: 9095455 - DNA, 22 bp, Homo sapiens
gcaggcaattttggaaggtcag

SEQ ID NO: 9095456 - DNA, 22 bp, Homo sapiens
gcagcttggtgaaaggtgatgg

SEQ ID NO: 9095457 - DNA, 23 bp, Homo sapiens
gcagcttgtggtttagtagaggg

SEQ ID NO: 9095458 - DNA, 22 bp, Homo sapiens
gcagcttcaagatactttttct

SEQ ID NO: 9095459 - DNA, 22 bp, Homo sapiens
gcagcttcagccagagggccag

SEQ ID NO: 9095460 - DNA, 22 bp, Homo sapiens
gcagctgttcagctggccagat

SEQ ID NO: 9095461 - DNA, 22 bp, Homo sapiens
gcagctgttcagctggccagat

SEQ ID NO: 9095462 - DNA, 22 bp, Homo sapiens
gcagcttcagtaggtgaagaca

SEQ ID NO: 9095463 - DNA, 22 bp, Homo sapiens
gcagcttcctgagtgtggacag

SEQ ID NO: 9095464 - DNA, 22 bp, Homo sapiens
gcagcttggatttctgtagttt

SEQ ID NO: 9095465 - DNA, 22 bp, Homo sapiens
gcaggcaggcttccttgaactg

SEQ ID NO: 9095466 - DNA, 22 bp, Homo sapiens
gcaggcaggagcccaactgcct

SEQ ID NO: 9095467 - DNA, 22 bp, Homo sapiens
gcaggcaggcttccttgaactg

SEQ ID NO: 9095468 - DNA, 22 bp, Homo sapiens
gcaggcaggaaggactaagtaa

SEQ ID NO: 9095469 - DNA, 22 bp, Homo sapiens
gcaggcaggaaggactaagtaa

SEQ ID NO: 9095470 - DNA, 19 bp, Homo sapiens
gcaggcagctggggtatcc

SEQ ID NO: 9095471 - DNA, 22 bp, Homo sapiens
gcaggcaggagcccaactgcct

SEQ ID NO: 9095472 - DNA, 22 bp, Homo sapiens
gcaggcaggagcccaactgcct

SEQ ID NO: 9095473 - DNA, 22 bp, Homo sapiens
gcaggcaggagcccaactgcct

SEQ ID NO: 9095474 - DNA, 22 bp, Homo sapiens
gcaggcaggagcccaactgcct

SEQ ID NO: 9095475 - DNA, 22 bp, Homo sapiens
attccaaaaggatgttagaatg

SEQ ID NO: 9095476 - DNA, 22 bp, Homo sapiens
attccaaagacagaagcagctg

SEQ ID NO: 9095477 - DNA, 22 bp, Homo sapiens
attccaaacttaccccagagga

SEQ ID NO: 9095478 - DNA, 22 bp, Homo sapiens
attccaaactctttccctgtcg

SEQ ID NO: 9095479 - DNA, 22 bp, Homo sapiens
attcaataagtcactgtggaat

SEQ ID NO: 9095480 - DNA, 22 bp, Homo sapiens
attcaataagtcactgtggaat

SEQ ID NO: 9095481 - DNA, 20 bp, Homo sapiens
attcacaaagccagtgttgc

SEQ ID NO: 9095482 - DNA, 22 bp, Homo sapiens
attcacaaataacaggtgcaga

SEQ ID NO: 9095483 - DNA, 22 bp, Homo sapiens
attcacaacaaaaggatatgag

SEQ ID NO: 9095484 - DNA, 22 bp, Homo sapiens
attccacacagtaatactcaat

SEQ ID NO: 9095485 - DNA, 22 bp, Homo sapiens
attccacacagtaatactcaat

SEQ ID NO: 9095486 - DNA, 22 bp, Homo sapiens
attccaaaggttaatgcccatt

SEQ ID NO: 9095487 - DNA, 22 bp, Homo sapiens
attccaaaggttaatgcccatt

SEQ ID NO: 9095488 - DNA, 22 bp, Homo sapiens
attccaaagcacatcagaacta

SEQ ID NO: 9095489 - DNA, 22 bp, Homo sapiens
attccaaagacagaagcagctg

SEQ ID NO: 9095490 - DNA, 22 bp, Homo sapiens
attccaaagcctgaataatgga

SEQ ID NO: 9095491 - DNA, 22 bp, Homo sapiens
attccaaaggctggcctggagg

SEQ ID NO: 9095492 - DNA, 22 bp, Homo sapiens
attccacataggccttcatgac

SEQ ID NO: 9095493 - DNA, 22 bp, Homo sapiens
attttcagttgaaaaagttggt

SEQ ID NO: 9095494 - DNA, 22 bp, Homo sapiens
attttcatgactaccttaaata

SEQ ID NO: 9095495 - DNA, 22 bp, Homo sapiens
attttcattttgcagggtgaga

SEQ ID NO: 9095496 - DNA, 22 bp, Homo sapiens
attttccaaaataattgttact

SEQ ID NO: 9095497 - DNA, 22 bp, Homo sapiens
gccttccttacacctgctcagc

SEQ ID NO: 9095498 - DNA, 22 bp, Homo sapiens
gccttcctgcagctctgagcgt

SEQ ID NO: 9095499 - DNA, 22 bp, Homo sapiens
gccttccctggctaggcaagca

SEQ ID NO: 9095500 - DNA, 22 bp, Homo sapiens
gccttcccaccctgcgaggctg

SEQ ID NO: 9095501 - DNA, 22 bp, Homo sapiens
gccttccaggcagggggagcag

SEQ ID NO: 9095502 - DNA, 22 bp, Homo sapiens
gccttcccaagacgcctgagtt

SEQ ID NO: 9095503 - DNA, 22 bp, Homo sapiens
attttcctcaagcctctggaag

SEQ ID NO: 9095504 - DNA, 22 bp, Homo sapiens
attttcctagtcatgtgcttct

SEQ ID NO: 9095505 - DNA, 22 bp, Homo sapiens
attttcctcaagcctctggaag

SEQ ID NO: 9095506 - DNA, 22 bp, Homo sapiens
attttccttctaagaggaaggt

SEQ ID NO: 9095507 - DNA, 22 bp, Homo sapiens
attttcctccatgtgagcagtt

SEQ ID NO: 9095508 - DNA, 22 bp, Homo sapiens
attttcctccatgtgagcagtt

SEQ ID NO: 9095509 - DNA, 22 bp, Homo sapiens
gcctgtgcttaactgacgtgag

SEQ ID NO: 9095510 - DNA, 22 bp, Homo sapiens
gcctgtgctgttccctctgcca

SEQ ID NO: 9095511 - DNA, 17 bp, Homo sapiens
gccttccagcatgtggg

SEQ ID NO: 9095512 - DNA, 22 bp, Homo sapiens
atttgtcaaaacacagagaaca

SEQ ID NO: 9095513 - DNA, 22 bp, Homo sapiens
atttgtcaataagatgaacata

SEQ ID NO: 9095514 - DNA, 22 bp, Homo sapiens
atttgtaccatctggtatacag

SEQ ID NO: 9095515 - DNA, 22 bp, Homo sapiens
atttgtagtgaagtgaaaataa

SEQ ID NO: 9095516 - DNA, 22 bp, Homo sapiens
atttgtcaataagatgaacata

SEQ ID NO: 9095517 - DNA, 22 bp, Homo sapiens
atttgtcatgtatgtaaagttg

SEQ ID NO: 9095518 - DNA, 22 bp, Homo sapiens
attttcagcccccactcgtggc

SEQ ID NO: 9095519 - DNA, 22 bp, Homo sapiens
attttcagtgatcatagcacac

SEQ ID NO: 9095520 - DNA, 22 bp, Homo sapiens
attttcagcccccactcgtggc

SEQ ID NO: 9095521 - DNA, 22 bp, Homo sapiens
attttagagctccaagtacagc

SEQ ID NO: 9095522 - DNA, 22 bp, Homo sapiens
atttgggagttgctagtgagtt

SEQ ID NO: 9095523 - DNA, 22 bp, Homo sapiens
atttggtagtcctgataagatt

SEQ ID NO: 9095524 - DNA, 22 bp, Homo sapiens
atttcttcctctgtcagtaact

SEQ ID NO: 9095525 - DNA, 22 bp, Homo sapiens
atttggcttacacgatattttc

SEQ ID NO: 9095526 - DNA, 22 bp, Homo sapiens
atttggcttctctaatactata

SEQ ID NO: 9095527 - DNA, 22 bp, Homo sapiens
atttggcttggcaacaactttc

SEQ ID NO: 9095528 - DNA, 22 bp, Homo sapiens
atttgtacaaatttatgttagt

SEQ ID NO: 9095529 - DNA, 22 bp, Homo sapiens
atttgtaagctagagccatgat

SEQ ID NO: 9095530 - DNA, 22 bp, Homo sapiens
atttgtaaagtgcttaaaagta

SEQ ID NO: 9095531 - DNA, 22 bp, Homo sapiens
atttgtaaagtgcttaaaagta

SEQ ID NO: 9095532 - DNA, 22 bp, Homo sapiens
atttgtaaagtgcttaaaagta

SEQ ID NO: 9095533 - DNA, 22 bp, Homo sapiens
caaaagatacttgcatctaact

SEQ ID NO: 9095534 - DNA, 21 bp, Homo sapiens
caaaagagactgattcttgga

SEQ ID NO: 9095535 - DNA, 21 bp, Homo sapiens
caaaagagactgattcttgga

SEQ ID NO: 9095536 - DNA, 20 bp, Homo sapiens
caaaagcaatgaagttatga

SEQ ID NO: 9095537 - DNA, 22 bp, Homo sapiens
caaaagcaaagtccctgaatgt

SEQ ID NO: 9095538 - DNA, 19 bp, Homo sapiens
gctcagagacacctgttgc

SEQ ID NO: 9095539 - DNA, 22 bp, Homo sapiens
gctcagagagaggatatgttat

SEQ ID NO: 9095540 - DNA, 19 bp, Homo sapiens
gctcagagacacctgttgc

SEQ ID NO: 9095541 - DNA, 22 bp, Homo sapiens
gctcagagagaggctcaccatt

SEQ ID NO: 9095542 - DNA, 22 bp, Homo sapiens
gctcagagagtttcacaagttt

SEQ ID NO: 9095543 - DNA, 22 bp, Homo sapiens
gctcagagaatttactgctgcc

SEQ ID NO: 9095544 - DNA, 22 bp, Homo sapiens
gctcagagaatcagcagacacc

SEQ ID NO: 9095545 - DNA, 22 bp, Homo sapiens
gctcagagaagttaaggaattt

SEQ ID NO: 9095546 - DNA, 22 bp, Homo sapiens
gctcagagaaattataggaatt

SEQ ID NO: 9095547 - DNA, 22 bp, Homo sapiens
gctcagagaagttgtgcctggc

SEQ ID NO: 9095548 - DNA, 22 bp, Homo sapiens
gctcagagaagttgtgcctggc

SEQ ID NO: 9095549 - DNA, 22 bp, Homo sapiens
attttgataatcatgttagaga

SEQ ID NO: 9095550 - DNA, 22 bp, Homo sapiens
attttgataatcatgttagaga

SEQ ID NO: 9095551 - DNA, 22 bp, Homo sapiens
attttgatgctatctaatgaat

SEQ ID NO: 9095552 - DNA, 22 bp, Homo sapiens
attttgacagaagaggccctaa

SEQ ID NO: 9095553 - DNA, 22 bp, Homo sapiens
attttgaatcaccttggaagaa

SEQ ID NO: 9095554 - DNA, 22 bp, Homo sapiens
attttgaagggaattgaagttc

SEQ ID NO: 9095555 - DNA, 17 bp, Homo sapiens
gccttccttcctccaca

SEQ ID NO: 9095556 - DNA, 17 bp, Homo sapiens
gccttccttcctccaca

SEQ ID NO: 9095557 - DNA, 22 bp, Homo sapiens
gccttccttttaccaccagcca

SEQ ID NO: 9095558 - DNA, 22 bp, Homo sapiens
attttgatgtatctttgtagct

SEQ ID NO: 9095559 - DNA, 22 bp, Homo sapiens
attttgctgtggtacattagga

SEQ ID NO: 9095560 - DNA, 22 bp, Homo sapiens
attttgctgtggtacattagga

SEQ ID NO: 9095561 - DNA, 22 bp, Homo sapiens
gctcagagaaaactggggcttg

SEQ ID NO: 9095562 - DNA, 22 bp, Homo sapiens
gctcagagaaaactggggcttg

SEQ ID NO: 9095563 - DNA, 22 bp, Homo sapiens
gctcagagaaattataggaatt

SEQ ID NO: 9095564 - DNA, 22 bp, Homo sapiens
gctcaaatgtcatggggagcct

SEQ ID NO: 9095565 - DNA, 22 bp, Homo sapiens
gctcaaatcccagcgggctcct

SEQ ID NO: 9095566 - DNA, 22 bp, Homo sapiens
gctcccaggatgaggagccagg

SEQ ID NO: 9095567 - DNA, 22 bp, Homo sapiens
gctcccaggatgaggagccagg

SEQ ID NO: 9095568 - DNA, 22 bp, Homo sapiens
gctccagggaacagaatgtact

SEQ ID NO: 9095569 - DNA, 22 bp, Homo sapiens
caaaagcagttctatctgagtt

SEQ ID NO: 9095570 - DNA, 22 bp, Homo sapiens
caaaagcagcaagtttatatgt

SEQ ID NO: 9095571 - DNA, 22 bp, Homo sapiens
caaaagcagcaagtttatatgt

SEQ ID NO: 9095572 - DNA, 22 bp, Homo sapiens
gctcccaggcatggaggtaatt

SEQ ID NO: 9095573 - DNA, 22 bp, Homo sapiens
gctcccaggcatggaggtaatt

SEQ ID NO: 9095574 - DNA, 22 bp, Homo sapiens
gctcccagggaccgcagggcag

SEQ ID NO: 9095575 - DNA, 22 bp, Homo sapiens
gctcccagggacactggccact

SEQ ID NO: 9095576 - DNA, 22 bp, Homo sapiens
gctcccagggacactggccact

SEQ ID NO: 9095577 - DNA, 22 bp, Homo sapiens
gctccccagcttagccctggct

SEQ ID NO: 9095578 - DNA, 22 bp, Homo sapiens
gctccccaaaagctccaggaaa

SEQ ID NO: 9095579 - DNA, 22 bp, Homo sapiens
gctcccagtctgatggaggaga

SEQ ID NO: 9095580 - DNA, 22 bp, Homo sapiens
gctcccagggcagcgcagaaga

SEQ ID NO: 9095581 - DNA, 22 bp, Homo sapiens
gctcccagggaccgcagggcag

SEQ ID NO: 9095582 - DNA, 22 bp, Homo sapiens
gctcccaggttcttgggccttg

SEQ ID NO: 9095583 - DNA, 20 bp, Homo sapiens
caaagacatgctaggggtgg

SEQ ID NO: 9095584 - DNA, 22 bp, Homo sapiens
caaagacacgggaaacaacgtt

SEQ ID NO: 9095585 - DNA, 22 bp, Homo sapiens
caaagaggtgagaggagccttt

SEQ ID NO: 9095586 - DNA, 22 bp, Homo sapiens
gctctgctgtcttcttgcaggc

SEQ ID NO: 9095587 - DNA, 22 bp, Homo sapiens
gctctgctgtgtttgttcagca

SEQ ID NO: 9095588 - DNA, 22 bp, Homo sapiens
gctctgctgtggaatcctctcc

SEQ ID NO: 9095589 - DNA, 22 bp, Homo sapiens
gctctgctgggtgggcagttat

SEQ ID NO: 9095590 - DNA, 22 bp, Homo sapiens
gctctgctgggtgggcagttat

SEQ ID NO: 9095591 - DNA, 22 bp, Homo sapiens
caaagaatgagtgagtacataa

SEQ ID NO: 9095592 - DNA, 22 bp, Homo sapiens
caaagaatcactcatctttagc

SEQ ID NO: 9095593 - DNA, 22 bp, Homo sapiens
caaagaatgagtgagtacataa

SEQ ID NO: 9095594 - DNA, 22 bp, Homo sapiens
caaagacacgggaaacaacgtt

SEQ ID NO: 9095595 - DNA, 22 bp, Homo sapiens
caaagaatagcatggcatttgt

SEQ ID NO: 9095596 - DNA, 22 bp, Homo sapiens
caaagaatagtgagaagatgta

SEQ ID NO: 9095597 - DNA, 19 bp, Homo sapiens
atttattgtatgattccat

SEQ ID NO: 9095598 - DNA, 19 bp, Homo sapiens
atttattgtatgattccat

SEQ ID NO: 9095599 - DNA, 22 bp, Homo sapiens
atttcaacagagtttgaaggca

SEQ ID NO: 9095600 - DNA, 22 bp, Homo sapiens
gccatcctgatgacaggccact

SEQ ID NO: 9095601 - DNA, 22 bp, Homo sapiens
gccatcatatcccctgtgacct

SEQ ID NO: 9095602 - DNA, 20 bp, Homo sapiens
gccatccagcctcccaggag

SEQ ID NO: 9095603 - DNA, 19 bp, Homo sapiens
gccatcccaagcattttgg

SEQ ID NO: 9095604 - DNA, 22 bp, Homo sapiens
gccatcatcaagaatgtacagc

SEQ ID NO: 9095605 - DNA, 22 bp, Homo sapiens
gccatcctctgagcactaggca

SEQ ID NO: 9095606 - DNA, 20 bp, Homo sapiens
gccatgaggggaggtgactg

SEQ ID NO: 9095607 - DNA, 22 bp, Homo sapiens
gccatcttgagccaggaagtga

SEQ ID NO: 9095608 - DNA, 22 bp, Homo sapiens
gccatcttcaacatcagaagtt

SEQ ID NO: 9095609 - DNA, 22 bp, Homo sapiens
gccatcttgggccatgatgcca

SEQ ID NO: 9095610 - DNA, 22 bp, Homo sapiens
gccatgaaaccagaggatggct

SEQ ID NO: 9095611 - DNA, 22 bp, Homo sapiens
gcccagtctcttctggccctgt

SEQ ID NO: 9095612 - DNA, 22 bp, Homo sapiens
gcccagtctcttctggccctgt

SEQ ID NO: 9095613 - DNA, 22 bp, Homo sapiens
gcccagtagttcaaggttgcag

SEQ ID NO: 9095614 - DNA, 22 bp, Homo sapiens
gcccaggtgccctctgccttac

SEQ ID NO: 9095615 - DNA, 22 bp, Homo sapiens
gcccaggttggagagcagtggc

SEQ ID NO: 9095616 - DNA, 22 bp, Homo sapiens
gcccaggttggagagcagtggc

SEQ ID NO: 9095617 - DNA, 22 bp, Homo sapiens
gcccaggttggagagcagtggc

SEQ ID NO: 9095618 - DNA, 22 bp, Homo sapiens
gcccagggtgcttagaacccat

SEQ ID NO: 9095619 - DNA, 22 bp, Homo sapiens
gcccagggtgaagtgcagttgt

SEQ ID NO: 9095620 - DNA, 22 bp, Homo sapiens
gcccagggtgaagtgcagttgt

SEQ ID NO: 9095621 - DNA, 22 bp, Homo sapiens
gcccagggtctacaaaaatatt

SEQ ID NO: 9095622 - DNA, 19 bp, Homo sapiens
gcccaggggcccgatgctg

SEQ ID NO: 9095623 - DNA, 22 bp, Homo sapiens
atttcaaggggtccttgcttgg

SEQ ID NO: 9095624 - DNA, 19 bp, Homo sapiens
atttcaagaggtttattgg

SEQ ID NO: 9095625 - DNA, 22 bp, Homo sapiens
atttcaaggactacttttcaat

SEQ ID NO: 9095626 - DNA, 22 bp, Homo sapiens
atttcaaggctacagaaacctt

SEQ ID NO: 9095627 - DNA, 22 bp, Homo sapiens
atttcaacgttagatgtaatag

SEQ ID NO: 9095628 - DNA, 19 bp, Homo sapiens
atttcaagaggtttattgg

SEQ ID NO: 9095629 - DNA, 22 bp, Homo sapiens
atttcaagaaggcagcagtggt

SEQ ID NO: 9095630 - DNA, 22 bp, Homo sapiens
atttcccaggactagaaatata

SEQ ID NO: 9095631 - DNA, 22 bp, Homo sapiens
atttcccaggactagaaatata

SEQ ID NO: 9095632 - DNA, 22 bp, Homo sapiens
gcccagtgctgagggtgctgct

SEQ ID NO: 9095633 - DNA, 22 bp, Homo sapiens
atttccctccagggaaagctta

SEQ ID NO: 9095634 - DNA, 22 bp, Homo sapiens
gccctggggaaggtgtctccaa

SEQ ID NO: 9095635 - DNA, 22 bp, Homo sapiens
gccctggggaaggtgtctccaa

SEQ ID NO: 9095636 - DNA, 22 bp, Homo sapiens
gccctgggctccctgctccaca

SEQ ID NO: 9095637 - DNA, 18 bp, Homo sapiens
gccctggtggagctggtg

SEQ ID NO: 9095638 - DNA, 22 bp, Homo sapiens
gccctgtcccttggcttctagg

SEQ ID NO: 9095639 - DNA, 22 bp, Homo sapiens
gccctggttttagaggagcagg

SEQ ID NO: 9095640 - DNA, 22 bp, Homo sapiens
gccctgtatccaagtcccatct

SEQ ID NO: 9095641 - DNA, 22 bp, Homo sapiens
gccctgtcggaactgcgacctc

SEQ ID NO: 9095642 - DNA, 22 bp, Homo sapiens
gccctgtgccagtcacgctgtg

SEQ ID NO: 9095643 - DNA, 22 bp, Homo sapiens
gccctgtgagtcatgcggcaga

SEQ ID NO: 9095644 - DNA, 22 bp, Homo sapiens
atttcttacataacaaattgtt

SEQ ID NO: 9095645 - DNA, 22 bp, Homo sapiens
atttcttacataacaaattgtt

SEQ ID NO: 9095646 - DNA, 22 bp, Homo sapiens
atttcttatctgaggtctacat

SEQ ID NO: 9095647 - DNA, 22 bp, Homo sapiens
atttcttatctgaggtctacat

SEQ ID NO: 9095648 - DNA, 22 bp, Homo sapiens
atttcttaaaacttcagggaga

SEQ ID NO: 9095649 - DNA, 22 bp, Homo sapiens
atttcttaaaacttcagggaga

SEQ ID NO: 9095650 - DNA, 22 bp, Homo sapiens
atttcttatgaatattgactgt

SEQ ID NO: 9095651 - DNA, 22 bp, Homo sapiens
atttcttatgaatattgactgt

SEQ ID NO: 9095652 - DNA, 22 bp, Homo sapiens
atttcttcaggtcagaaataga

SEQ ID NO: 9095653 - DNA, 22 bp, Homo sapiens
atttcttcaggtcagaaataga

SEQ ID NO: 9095654 - DNA, 19 bp, Homo sapiens
attgtacattgagtttggc

SEQ ID NO: 9095655 - DNA, 22 bp, Homo sapiens
attgtactggtaaagaagtggg

SEQ ID NO: 9095656 - DNA, 22 bp, Homo sapiens
gccagccacaagggaggcttgt

SEQ ID NO: 9095657 - DNA, 22 bp, Homo sapiens
attgtacatatgatgtatgtaa

SEQ ID NO: 9095658 - DNA, 22 bp, Homo sapiens
attgtacatatgatgtatgtaa

SEQ ID NO: 9095659 - DNA, 22 bp, Homo sapiens
attgtacataaaatgtatgtct

SEQ ID NO: 9095660 - DNA, 22 bp, Homo sapiens
attgtacataaaatgtatgtct

SEQ ID NO: 9095661 - DNA, 22 bp, Homo sapiens
attgtacaggttggaggaagtg

SEQ ID NO: 9095662 - DNA, 22 bp, Homo sapiens
gccagccacttcccagactggc

SEQ ID NO: 9095663 - DNA, 22 bp, Homo sapiens
gccagccagaaacgtcacactg

SEQ ID NO: 9095664 - DNA, 23 bp, Homo sapiens
gccagccagaatttctccactgt

SEQ ID NO: 9095665 - DNA, 22 bp, Homo sapiens
gccagccacttcagctatggct

SEQ ID NO: 9095666 - DNA, 22 bp, Homo sapiens
gccagccagggaagggagagac

SEQ ID NO: 9095667 - DNA, 20 bp, Homo sapiens
gccagctgcccttccaccct

SEQ ID NO: 9095668 - DNA, 22 bp, Homo sapiens
gccagctgccaagttgtgagat

SEQ ID NO: 9095669 - DNA, 22 bp, Homo sapiens
gccagctgccctctgctggtcc

SEQ ID NO: 9095670 - DNA, 22 bp, Homo sapiens
gccagctgcatctcctgggctg

SEQ ID NO: 9095671 - DNA, 21 bp, Homo sapiens
gccagctgcagggcttccttg

SEQ ID NO: 9095672 - DNA, 21 bp, Homo sapiens
gccagctgcagggcttccttg

SEQ ID NO: 9095673 - DNA, 22 bp, Homo sapiens
gccagccagtttgctgatggct

SEQ ID NO: 9095674 - DNA, 22 bp, Homo sapiens
gccagccagtttgctgatggct

SEQ ID NO: 9095675 - DNA, 22 bp, Homo sapiens
atttatcaccagttagctgact

SEQ ID NO: 9095676 - DNA, 22 bp, Homo sapiens
atttatcaccagttagctgact

SEQ ID NO: 9095677 - DNA, 22 bp, Homo sapiens
atttatagggcattgaaaactg

SEQ ID NO: 9095678 - DNA, 22 bp, Homo sapiens
atttatattttgggagctcctg

SEQ ID NO: 9095679 - DNA, 22 bp, Homo sapiens
atttagtttaggaaaagtaggt

SEQ ID NO: 9095680 - DNA, 22 bp, Homo sapiens
gccagctggagtgagagtgggc

SEQ ID NO: 9095681 - DNA, 22 bp, Homo sapiens
gccagctggaaatctgcttgaa

SEQ ID NO: 9095682 - DNA, 22 bp, Homo sapiens
gccagctggagactggcagggg

SEQ ID NO: 9095683 - DNA, 22 bp, Homo sapiens
gccagctgcttctccagaattt

SEQ ID NO: 9095684 - DNA, 20 bp, Homo sapiens
atttatgtatagcttgttgt

SEQ ID NO: 9095685 - DNA, 22 bp, Homo sapiens
atttatgtatctgtgtagatca

SEQ ID NO: 9095686 - DNA, 22 bp, Homo sapiens
gccatcatatcccctgtgacct

SEQ ID NO: 9095687 - DNA, 22 bp, Homo sapiens
gccatcatatcccctgtgacct

SEQ ID NO: 9095688 - DNA, 22 bp, Homo sapiens
atgttatagttataaaatgagg

SEQ ID NO: 9095689 - DNA, 21 bp, Homo sapiens
gagtgcaggtctgatgccatc

SEQ ID NO: 9095690 - DNA, 22 bp, Homo sapiens
gaggttcattcagctctgtcac

SEQ ID NO: 9095691 - DNA, 22 bp, Homo sapiens
gaggttcagtcctgctctgtca

SEQ ID NO: 9095692 - DNA, 22 bp, Homo sapiens
gaggttctgggggtctgcctgg

SEQ ID NO: 9095693 - DNA, 22 bp, Homo sapiens
gaggttctgggggtctgcctgg

SEQ ID NO: 9095694 - DNA, 22 bp, Homo sapiens
gaggttcgatacagcgtattta

SEQ ID NO: 9095695 - DNA, 22 bp, Homo sapiens
gaggttccagacagcttaggga

SEQ ID NO: 9095696 - DNA, 22 bp, Homo sapiens
gaggttccccattgtactggct

SEQ ID NO: 9095697 - DNA, 22 bp, Homo sapiens
atgttacagcagcccgaatgga

SEQ ID NO: 9095698 - DNA, 22 bp, Homo sapiens
atgttacagagaaagtggaagc

SEQ ID NO: 9095699 - DNA, 22 bp, Homo sapiens
atgttacagaaagcaaagatga

SEQ ID NO: 9095700 - DNA, 22 bp, Homo sapiens
atgttacatgaaacggcctact

SEQ ID NO: 9095701 - DNA, 22 bp, Homo sapiens
atgttacatgaaacggcctact

SEQ ID NO: 9095702 - DNA, 22 bp, Homo sapiens
atgttacatagtccttatttgt

SEQ ID NO: 9095703 - DNA, 22 bp, Homo sapiens
atgttacagttgagtaaattaa

SEQ ID NO: 9095704 - DNA, 22 bp, Homo sapiens
atgttacagttgagtaaattaa

SEQ ID NO: 9095705 - DNA, 22 bp, Homo sapiens
atgttagaaggaatgttaaaag

SEQ ID NO: 9095706 - DNA, 22 bp, Homo sapiens
atgtggctccttactcatcagc

SEQ ID NO: 9095707 - DNA, 22 bp, Homo sapiens
atgtgctcttattaccctgtcg

SEQ ID NO: 9095708 - DNA, 22 bp, Homo sapiens
atgtgctgagtgtgtatataca

SEQ ID NO: 9095709 - DNA, 22 bp, Homo sapiens
atgtgctgtaatccattgaagg

SEQ ID NO: 9095710 - DNA, 22 bp, Homo sapiens
atgtgcttatggtctctggttg

SEQ ID NO: 9095711 - DNA, 22 bp, Homo sapiens
atgtgcttcgccagggcgttgc

SEQ ID NO: 9095712 - DNA, 22 bp, Homo sapiens
atgtgcttgaagcctcagagaa

SEQ ID NO: 9095713 - DNA, 22 bp, Homo sapiens
atgtggatttgggagtgatcag

SEQ ID NO: 9095714 - DNA, 22 bp, Homo sapiens
atgtggccagtcatgtagtaac

SEQ ID NO: 9095715 - DNA, 19 bp, Homo sapiens
atgtgcccaggggaaagaa

SEQ ID NO: 9095716 - DNA, 22 bp, Homo sapiens
atgtgccacatgatattgtctc

SEQ ID NO: 9095717 - DNA, 22 bp, Homo sapiens
atgtgccaatttatagaggctc

SEQ ID NO: 9095718 - DNA, 22 bp, Homo sapiens
atgtgccatctactgtcccaag

SEQ ID NO: 9095719 - DNA, 22 bp, Homo sapiens
atgtgccagtgccaggtctcta

SEQ ID NO: 9095720 - DNA, 22 bp, Homo sapiens
atgtgccaacgtgcaggtttgt

SEQ ID NO: 9095721 - DNA, 22 bp, Homo sapiens
atgtcagtttcattttaagtca

SEQ ID NO: 9095722 - DNA, 22 bp, Homo sapiens
atgtcagagcttccacaatagt

SEQ ID NO: 9095723 - DNA, 22 bp, Homo sapiens
atgtcagaagctggatgacagc

SEQ ID NO: 9095724 - DNA, 22 bp, Homo sapiens
atgtcagatgtttatctgattt

SEQ ID NO: 9095725 - DNA, 22 bp, Homo sapiens
atgtcagatcctcagaaagtct

SEQ ID NO: 9095726 - DNA, 22 bp, Homo sapiens
atgtcaccttcggtggcacggt

SEQ ID NO: 9095727 - DNA, 22 bp, Homo sapiens
gaggctctttctttggacttca

SEQ ID NO: 9095728 - DNA, 22 bp, Homo sapiens
atgtatcagataaagcatgtgg

SEQ ID NO: 9095729 - DNA, 22 bp, Homo sapiens
atgtatcagaaatagcattggc

SEQ ID NO: 9095730 - DNA, 22 bp, Homo sapiens
atgtatcagataaagcatgtgg

SEQ ID NO: 9095731 - DNA, 22 bp, Homo sapiens
atgtatcagaaatagcattggc

SEQ ID NO: 9095732 - DNA, 22 bp, Homo sapiens
atgtatcacagcaatgtagtca

SEQ ID NO: 9095733 - DNA, 22 bp, Homo sapiens
atgtatgtagtgtacatataca

SEQ ID NO: 9095734 - DNA, 22 bp, Homo sapiens
atgtatttctatgtagtgaaga

SEQ ID NO: 9095735 - DNA, 23 bp, Homo sapiens
atgtatttaaatttcagtgatga

SEQ ID NO: 9095736 - DNA, 23 bp, Homo sapiens
atgtatttaaatttcagtgatga

SEQ ID NO: 9095737 - DNA, 22 bp, Homo sapiens
gaggctctttaaatcttttgga

SEQ ID NO: 9095738 - DNA, 22 bp, Homo sapiens
gaggctctttctttggacttca

SEQ ID NO: 9095739 - DNA, 22 bp, Homo sapiens
gaggctctgtgatgtgccaggc

SEQ ID NO: 9095740 - DNA, 22 bp, Homo sapiens
atgggcaggcactggctctcag

SEQ ID NO: 9095741 - DNA, 22 bp, Homo sapiens
atgggcagagtggggacaggaa

SEQ ID NO: 9095742 - DNA, 22 bp, Homo sapiens
gaggagggagctggaagctctt

SEQ ID NO: 9095743 - DNA, 22 bp, Homo sapiens
gaggagctgtcaccgtgactca

SEQ ID NO: 9095744 - DNA, 22 bp, Homo sapiens
gaggagggagctggaagctctt

SEQ ID NO: 9095745 - DNA, 22 bp, Homo sapiens
gaggagggcctggtgtcccttc

SEQ ID NO: 9095746 - DNA, 22 bp, Homo sapiens
gaggcacagagccctaggagct

SEQ ID NO: 9095747 - DNA, 22 bp, Homo sapiens
gaggcacagagccctaggagct

SEQ ID NO: 9095748 - DNA, 22 bp, Homo sapiens
gaggcacagagtaggtgcacac

SEQ ID NO: 9095749 - DNA, 22 bp, Homo sapiens
gaggcacaatacatgtctcaag

SEQ ID NO: 9095750 - DNA, 22 bp, Homo sapiens
gaggaggggcacttgtctccta

SEQ ID NO: 9095751 - DNA, 22 bp, Homo sapiens
gaggcacagtcccgaggcaagg

SEQ ID NO: 9095752 - DNA, 22 bp, Homo sapiens
gaggcacagagtaggtgcacac

SEQ ID NO: 9095753 - DNA, 22 bp, Homo sapiens
gaggcacagtgtttggtcagtg

SEQ ID NO: 9095754 - DNA, 22 bp, Homo sapiens
gaggcacagtgtttggtcagtg

SEQ ID NO: 9095755 - DNA, 22 bp, Homo sapiens
gaggcacagtgtttggtcagtg

SEQ ID NO: 9095756 - DNA, 22 bp, Homo sapiens
gaggcacagtgtttggtcagtg

SEQ ID NO: 9095757 - DNA, 18 bp, Homo sapiens
gaggcacatagttggggc

SEQ ID NO: 9095758 - DNA, 22 bp, Homo sapiens
gaggcacatatatacagagccc

SEQ ID NO: 9095759 - DNA, 20 bp, Homo sapiens
atgtatattactggctgtga

SEQ ID NO: 9095760 - DNA, 22 bp, Homo sapiens
atgtatcaactgcaggcaagtt

SEQ ID NO: 9095761 - DNA, 22 bp, Homo sapiens
gagctgcagcggctgacgcaac

SEQ ID NO: 9095762 - DNA, 22 bp, Homo sapiens
gagctgcagagtaacctttgca

SEQ ID NO: 9095763 - DNA, 22 bp, Homo sapiens
gagctgcagcggctgacgcaac

SEQ ID NO: 9095764 - DNA, 22 bp, Homo sapiens
gagctgccaagattacaatcag

SEQ ID NO: 9095765 - DNA, 22 bp, Homo sapiens
gagctgccagacatgggaatga

SEQ ID NO: 9095766 - DNA, 22 bp, Homo sapiens
gagctgccagtgtatgaattct

SEQ ID NO: 9095767 - DNA, 22 bp, Homo sapiens
gagctgccagacatgggaatga

SEQ ID NO: 9095768 - DNA, 22 bp, Homo sapiens
gagctgccctgagctttgcatg

SEQ ID NO: 9095769 - DNA, 18 bp, Homo sapiens
gagctgccatatttagtt

SEQ ID NO: 9095770 - DNA, 22 bp, Homo sapiens
gagctgccagtgtatgaattct

SEQ ID NO: 9095771 - DNA, 22 bp, Homo sapiens
gagctgcactgggggtggaatg

SEQ ID NO: 9095772 - DNA, 22 bp, Homo sapiens
gagctgagtgtcctaggcatgg

SEQ ID NO: 9095773 - DNA, 22 bp, Homo sapiens
gagctgagtgtcctaggcatgg

SEQ ID NO: 9095774 - DNA, 20 bp, Homo sapiens
gagctgagtgtggtcatggg

SEQ ID NO: 9095775 - DNA, 20 bp, Homo sapiens
gagctgagtgtggtcatggg

SEQ ID NO: 9095776 - DNA, 22 bp, Homo sapiens
gagctgagttacctccagatca

SEQ ID NO: 9095777 - DNA, 20 bp, Homo sapiens
gagctgagtgtggtcatggg

SEQ ID NO: 9095778 - DNA, 22 bp, Homo sapiens
gagccccttctgcagtcaggtt

SEQ ID NO: 9095779 - DNA, 22 bp, Homo sapiens
gagccccttctgcagtcaggtt

SEQ ID NO: 9095780 - DNA, 22 bp, Homo sapiens
gagcccgagcgcgtacccggcg

SEQ ID NO: 9095781 - DNA, 22 bp, Homo sapiens
gagcccgagcgcgtacccggcg

SEQ ID NO: 9095782 - DNA, 22 bp, Homo sapiens
gagccccaggacagctctagtt

SEQ ID NO: 9095783 - DNA, 22 bp, Homo sapiens
gagccctcaccgcctgaccagg

SEQ ID NO: 9095784 - DNA, 22 bp, Homo sapiens
gagccctcaatgaatctgcatt

SEQ ID NO: 9095785 - DNA, 22 bp, Homo sapiens
gagccctcattgaatctgcatt

SEQ ID NO: 9095786 - DNA, 22 bp, Homo sapiens
gagccctcgggcgagcccgcgc

SEQ ID NO: 9095787 - DNA, 22 bp, Homo sapiens
gagccctccatggagccaggca

SEQ ID NO: 9095788 - DNA, 22 bp, Homo sapiens
gagccctctctgtaggcaagta

SEQ ID NO: 9095789 - DNA, 19 bp, Homo sapiens
gagccctctccatggccac

SEQ ID NO: 9095790 - DNA, 22 bp, Homo sapiens
atgggcagacagggagctcacg

SEQ ID NO: 9095791 - DNA, 22 bp, Homo sapiens
gagccccaccctagacattctg

SEQ ID NO: 9095792 - DNA, 22 bp, Homo sapiens
gagcccagtctgctcctgcgcc

SEQ ID NO: 9095793 - DNA, 22 bp, Homo sapiens
atgggcagagctggtgggaggc

SEQ ID NO: 9095794 - DNA, 22 bp, Homo sapiens
atggctgcagagacctgaagaa

SEQ ID NO: 9095795 - DNA, 22 bp, Homo sapiens
atggctgcagccggccctgcgc

SEQ ID NO: 9095796 - DNA, 22 bp, Homo sapiens
atggctgcagtccgtgccctgg

SEQ ID NO: 9095797 - DNA, 22 bp, Homo sapiens
atggctctttattctgctgcat

SEQ ID NO: 9095798 - DNA, 22 bp, Homo sapiens
atggctctgttttttatgctct

SEQ ID NO: 9095799 - DNA, 22 bp, Homo sapiens
atggctgagatgggctccaggc

SEQ ID NO: 9095800 - DNA, 19 bp, Homo sapiens
atggctctgatttaatgtg

SEQ ID NO: 9095801 - DNA, 22 bp, Homo sapiens
atggctctagaatacccctcag

SEQ ID NO: 9095802 - DNA, 22 bp, Homo sapiens
atggcagacctgggctggagaa

SEQ ID NO: 9095803 - DNA, 22 bp, Homo sapiens
atggcagacgaggcagcagggg

SEQ ID NO: 9095804 - DNA, 22 bp, Homo sapiens
gagcacaggctgctgtgaactg

SEQ ID NO: 9095805 - DNA, 22 bp, Homo sapiens
gagcacagctgtcttgcaagct

SEQ ID NO: 9095806 - DNA, 22 bp, Homo sapiens
gagcacagctggaggtagcatt

SEQ ID NO: 9095807 - DNA, 22 bp, Homo sapiens
gagcacagctggaggtagcatt

SEQ ID NO: 9095808 - DNA, 22 bp, Homo sapiens
gagcacagctggaggtagcatt

SEQ ID NO: 9095809 - DNA, 22 bp, Homo sapiens
gagcacagctggaggtagcatt

SEQ ID NO: 9095810 - DNA, 22 bp, Homo sapiens
gagcacagcgcagtttgtaatt

SEQ ID NO: 9095811 - DNA, 22 bp, Homo sapiens
gagcacaggctttggtggacac

SEQ ID NO: 9095812 - DNA, 22 bp, Homo sapiens
atgggagtgtgcttgaggagtt

SEQ ID NO: 9095813 - DNA, 22 bp, Homo sapiens
atgggagtgtgcttgaggagtt

SEQ ID NO: 9095814 - DNA, 22 bp, Homo sapiens
atgggagggtggaaaggctctg

SEQ ID NO: 9095815 - DNA, 22 bp, Homo sapiens
atgggagggtggaaaggctctg

SEQ ID NO: 9095816 - DNA, 22 bp, Homo sapiens
atgggagggtggaaaggctctg

SEQ ID NO: 9095817 - DNA, 22 bp, Homo sapiens
atgctggtggttgatggcagga

SEQ ID NO: 9095818 - DNA, 22 bp, Homo sapiens
atgctggtctgcagagttggga

SEQ ID NO: 9095819 - DNA, 22 bp, Homo sapiens
atgctggggcctcagaccagaa

SEQ ID NO: 9095820 - DNA, 22 bp, Homo sapiens
atgctggtctgcagagttggga

SEQ ID NO: 9095821 - DNA, 22 bp, Homo sapiens
atgctggtctcattgggttagg

SEQ ID NO: 9095822 - DNA, 22 bp, Homo sapiens
atgctgggaagtcctaaccaca

SEQ ID NO: 9095823 - DNA, 22 bp, Homo sapiens
atgctgtggccagagttcaact

SEQ ID NO: 9095824 - DNA, 22 bp, Homo sapiens
atgctgtgtcaggaatttgata

SEQ ID NO: 9095825 - DNA, 22 bp, Homo sapiens
atgctgtggtagacagcattcc

SEQ ID NO: 9095826 - DNA, 22 bp, Homo sapiens
atgctgtgattgtagaaatatt

SEQ ID NO: 9095827 - DNA, 22 bp, Homo sapiens
atgctgtgagtgtgccgcagag

SEQ ID NO: 9095828 - DNA, 22 bp, Homo sapiens
gagaaggtggacctgaaggagc

SEQ ID NO: 9095829 - DNA, 22 bp, Homo sapiens
gagaaggggtgatgtgggtaat

SEQ ID NO: 9095830 - DNA, 22 bp, Homo sapiens
atgctgtgtctagcaggaacac

SEQ ID NO: 9095831 - DNA, 22 bp, Homo sapiens
atgctgtgtggccacctccatg

SEQ ID NO: 9095832 - DNA, 22 bp, Homo sapiens
atgctgtgtggtcaagttaatt

SEQ ID NO: 9095833 - DNA, 22 bp, Homo sapiens
atgctgtgttttaaatggaaat

SEQ ID NO: 9095834 - DNA, 23 bp, Homo sapiens
gagaacagccacagagagctgtg

SEQ ID NO: 9095835 - DNA, 22 bp, Homo sapiens
atggcagacctcctggccacaa

SEQ ID NO: 9095836 - DNA, 22 bp, Homo sapiens
atggcagaaagaatagaggcta

SEQ ID NO: 9095837 - DNA, 22 bp, Homo sapiens
atggcagaaagaatagaggcta

SEQ ID NO: 9095838 - DNA, 22 bp, Homo sapiens
atggcacatgttgccttcgaat

SEQ ID NO: 9095839 - DNA, 22 bp, Homo sapiens
atggcaccaaatatgtctcatt

SEQ ID NO: 9095840 - DNA, 22 bp, Homo sapiens
atggcactaagagggagctgga

SEQ ID NO: 9095841 - DNA, 22 bp, Homo sapiens
atggattggatttttatggacc

SEQ ID NO: 9095842 - DNA, 22 bp, Homo sapiens
atggatgagtccttgagacaca

SEQ ID NO: 9095843 - DNA, 22 bp, Homo sapiens
atggatgaaggcgaggatgagg

SEQ ID NO: 9095844 - DNA, 18 bp, Homo sapiens
atggcacagtctttccct

SEQ ID NO: 9095845 - DNA, 22 bp, Homo sapiens
atggcaattgtaaatggaaaga

SEQ ID NO: 9095846 - DNA, 22 bp, Homo sapiens
atggcacagatgttctgattat

SEQ ID NO: 9095847 - DNA, 22 bp, Homo sapiens
atggcaagcaagctgaagagat

SEQ ID NO: 9095848 - DNA, 22 bp, Homo sapiens
atggagggtgtcagagagcgaa

SEQ ID NO: 9095849 - DNA, 22 bp, Homo sapiens
gagacagtgaggaaggctaggt

SEQ ID NO: 9095850 - DNA, 22 bp, Homo sapiens
gagacaggccaggtggtactta

SEQ ID NO: 9095851 - DNA, 22 bp, Homo sapiens
atggatcacagtgccgtgggtg

SEQ ID NO: 9095852 - DNA, 22 bp, Homo sapiens
atggatctaccttcaggctctg

SEQ ID NO: 9095853 - DNA, 22 bp, Homo sapiens
gagacaggccaggtggtactta

SEQ ID NO: 9095854 - DNA, 22 bp, Homo sapiens
gagacaggcagctagtgggtca

SEQ ID NO: 9095855 - DNA, 22 bp, Homo sapiens
gagacaggatttaaccaaagct

SEQ ID NO: 9095856 - DNA, 22 bp, Homo sapiens
gagacaggcagctagtgggtca

SEQ ID NO: 9095857 - DNA, 22 bp, Homo sapiens
gagacaggatttaaccaaagct

SEQ ID NO: 9095858 - DNA, 22 bp, Homo sapiens
gagaatatattgaagtagttcc

SEQ ID NO: 9095859 - DNA, 22 bp, Homo sapiens
gagacaggatttaaccaaagct

SEQ ID NO: 9095860 - DNA, 17 bp, Homo sapiens
gagacagcaggagcccc

SEQ ID NO: 9095861 - DNA, 22 bp, Homo sapiens
gaagagatgacaaaggagcatg

SEQ ID NO: 9095862 - DNA, 22 bp, Homo sapiens
gaagagcatatgaagagcatat

SEQ ID NO: 9095863 - DNA, 22 bp, Homo sapiens
gaagagcatatgaagagcatat

SEQ ID NO: 9095864 - DNA, 22 bp, Homo sapiens
gaagagccaggtgtcgctgtgg

SEQ ID NO: 9095865 - DNA, 22 bp, Homo sapiens
gaagagcatttgcccaggctgt

SEQ ID NO: 9095866 - DNA, 22 bp, Homo sapiens
gaagagatgacaaaggagcatg

SEQ ID NO: 9095867 - DNA, 21 bp, Homo sapiens
gaagagagtcctcatcctgag

SEQ ID NO: 9095868 - DNA, 21 bp, Homo sapiens
gaagagagtcctcatcctgag

SEQ ID NO: 9095869 - DNA, 22 bp, Homo sapiens
atgatggaggccgtgatggacg

SEQ ID NO: 9095870 - DNA, 22 bp, Homo sapiens
atgatggaggtgtcctggattt

SEQ ID NO: 9095871 - DNA, 22 bp, Homo sapiens
atgatgtagacaaaaatatgct

SEQ ID NO: 9095872 - DNA, 22 bp, Homo sapiens
atgatgtaaatagagcctaggt

SEQ ID NO: 9095873 - DNA, 22 bp, Homo sapiens
atgatgtcattttaatttctaa

SEQ ID NO: 9095874 - DNA, 23 bp, Homo sapiens
atgatgtttttggtagtcaaatg

SEQ ID NO: 9095875 - DNA, 22 bp, Homo sapiens
atgatgtctatctttgtagtat

SEQ ID NO: 9095876 - DNA, 22 bp, Homo sapiens
atgagctgggccatccagtgat

SEQ ID NO: 9095877 - DNA, 22 bp, Homo sapiens
atgagctgggccatccagtgat

SEQ ID NO: 9095878 - DNA, 22 bp, Homo sapiens
atgagctgtgggattccagagg

SEQ ID NO: 9095879 - DNA, 22 bp, Homo sapiens
atgagctcatccgagtcacact

SEQ ID NO: 9095880 - DNA, 22 bp, Homo sapiens
atgagccctggaggcatttttt

SEQ ID NO: 9095881 - DNA, 19 bp, Homo sapiens
atgagcaggcaagacaagc

SEQ ID NO: 9095882 - DNA, 22 bp, Homo sapiens
atgagcatccagaacagtgcct

SEQ ID NO: 9095883 - DNA, 21 bp, Homo sapiens
gaagagagtcctcatcctgag

SEQ ID NO: 9095884 - DNA, 22 bp, Homo sapiens
gaagagagccgcgggacatcag

SEQ ID NO: 9095885 - DNA, 22 bp, Homo sapiens
gaagagagccgcgggacatcag

SEQ ID NO: 9095886 - DNA, 22 bp, Homo sapiens
gaagagagccgcgggacatcag

SEQ ID NO: 9095887 - DNA, 22 bp, Homo sapiens
gaagagagccgcgggacatcag

SEQ ID NO: 9095888 - DNA, 22 bp, Homo sapiens
gaagagagccgcgggacatcag

SEQ ID NO: 9095889 - DNA, 22 bp, Homo sapiens
gaagagagagtggggttctgcg

SEQ ID NO: 9095890 - DNA, 22 bp, Homo sapiens
gaagagagaacattacataaac

SEQ ID NO: 9095891 - DNA, 22 bp, Homo sapiens
gaagagaaggtgtaggccatcc

SEQ ID NO: 9095892 - DNA, 22 bp, Homo sapiens
gaagaaatgtgttcaaggtagg

SEQ ID NO: 9095893 - DNA, 22 bp, Homo sapiens
gaagaaagggaattaacttgag

SEQ ID NO: 9095894 - DNA, 22 bp, Homo sapiens
gaagagagaacattacataaac

SEQ ID NO: 9095895 - DNA, 22 bp, Homo sapiens
gaagagagagccctggggtccg

SEQ ID NO: 9095896 - DNA, 22 bp, Homo sapiens
gaagagagagccctggggtccg

SEQ ID NO: 9095897 - DNA, 22 bp, Homo sapiens
gaagagagagccctggggtccg

SEQ ID NO: 9095898 - DNA, 22 bp, Homo sapiens
gaagagagagccctggggtccg

SEQ ID NO: 9095899 - DNA, 22 bp, Homo sapiens
gaagcctttgcctaaaacatta

SEQ ID NO: 9095900 - DNA, 22 bp, Homo sapiens
gaagctaaaccacagctaagaa

SEQ ID NO: 9095901 - DNA, 22 bp, Homo sapiens
gaagctaatgatttattttctg

SEQ ID NO: 9095902 - DNA, 22 bp, Homo sapiens
gaagctaatgagataaatgcca

SEQ ID NO: 9095903 - DNA, 22 bp, Homo sapiens
gaagctaaaagagatgtggttt

SEQ ID NO: 9095904 - DNA, 22 bp, Homo sapiens
gaagctaaaccacagctaagaa

SEQ ID NO: 9095905 - DNA, 22 bp, Homo sapiens
gaagccttgaactgcaaacccc

SEQ ID NO: 9095906 - DNA, 22 bp, Homo sapiens
gaagcagcagctggggacagtt

SEQ ID NO: 9095907 - DNA, 22 bp, Homo sapiens
gaagctccgtactatgactttt

SEQ ID NO: 9095908 - DNA, 22 bp, Homo sapiens
gaagctccgtactatgactttt

SEQ ID NO: 9095909 - DNA, 22 bp, Homo sapiens
gaagctgacccaggagcgtgtg

SEQ ID NO: 9095910 - DNA, 22 bp, Homo sapiens
gaagctctggacagtgaagaag

SEQ ID NO: 9095911 - DNA, 22 bp, Homo sapiens
gaagctctggacagtgaagaag

SEQ ID NO: 9095912 - DNA, 22 bp, Homo sapiens
gaagctctggacagtgaagaag

SEQ ID NO: 9095913 - DNA, 22 bp, Homo sapiens
gaagctgatgaggaccagattg

SEQ ID NO: 9095914 - DNA, 22 bp, Homo sapiens
gaagctgatgaggaccagattg

SEQ ID NO: 9095915 - DNA, 22 bp, Homo sapiens
gaagctgaggtcaggtgggtgg

SEQ ID NO: 9095916 - DNA, 22 bp, Homo sapiens
gaagctgagctgaggcatgttg

SEQ ID NO: 9095917 - DNA, 22 bp, Homo sapiens
gaaggaggctccccaaagtctg

SEQ ID NO: 9095918 - DNA, 22 bp, Homo sapiens
gaaggaggctccccaaagtctg

SEQ ID NO: 9095919 - DNA, 22 bp, Homo sapiens
gaaggaggcgttagccctagga

SEQ ID NO: 9095920 - DNA, 22 bp, Homo sapiens
gaagctggagaatgggtctagg

SEQ ID NO: 9095921 - DNA, 22 bp, Homo sapiens
gaagctggctgaagttcagcta

SEQ ID NO: 9095922 - DNA, 22 bp, Homo sapiens
gaagctgggtcgctgggatcct

SEQ ID NO: 9095923 - DNA, 22 bp, Homo sapiens
gaagctgtgaacaagctacgtg

SEQ ID NO: 9095924 - DNA, 22 bp, Homo sapiens
gaaggagctaccaagactgaat

SEQ ID NO: 9095925 - DNA, 22 bp, Homo sapiens
atgcagtggcagctcctggtgt

SEQ ID NO: 9095926 - DNA, 22 bp, Homo sapiens
atgcagtggcttcagtgtcagt

SEQ ID NO: 9095927 - DNA, 22 bp, Homo sapiens
atgcagttaggtaatagtctca

SEQ ID NO: 9095928 - DNA, 22 bp, Homo sapiens
gaaggaggctccccaaagtctg

SEQ ID NO: 9095929 - DNA, 22 bp, Homo sapiens
gaaggaggtctgatacaatatg

SEQ ID NO: 9095930 - DNA, 22 bp, Homo sapiens
gaaggagggtgcggatctgagc

SEQ ID NO: 9095931 - DNA, 22 bp, Homo sapiens
gaatttcattgctctgctgtgt

SEQ ID NO: 9095932 - DNA, 22 bp, Homo sapiens
gaatttcaggacaactggaagg

SEQ ID NO: 9095933 - DNA, 22 bp, Homo sapiens
gaatttcagggtctggtaggaa

SEQ ID NO: 9095934 - DNA, 22 bp, Homo sapiens
gaatttcagatcagagaccatt

SEQ ID NO: 9095935 - DNA, 22 bp, Homo sapiens
gaatttcatttgtttcctacca

SEQ ID NO: 9095936 - DNA, 22 bp, Homo sapiens
gaatttggatctttgatagagt

SEQ ID NO: 9095937 - DNA, 22 bp, Homo sapiens
gaattttaagtgttcgcctctt

SEQ ID NO: 9095938 - DNA, 22 bp, Homo sapiens
gaatttgtcccttgatataaaa

SEQ ID NO: 9095939 - DNA, 22 bp, Homo sapiens
gaatttgtgctcaggaagatta

SEQ ID NO: 9095940 - DNA, 22 bp, Homo sapiens
gaattttaataaaggtttatca

SEQ ID NO: 9095941 - DNA, 22 bp, Homo sapiens
gaattttaataaaggtttatca

SEQ ID NO: 9095942 - DNA, 19 bp, Homo sapiens
gaattttaggacttcagca

SEQ ID NO: 9095943 - DNA, 22 bp, Homo sapiens
gaattttagaatatgtgggctt

SEQ ID NO: 9095944 - DNA, 22 bp, Homo sapiens
atgctaaatgttaatgttacct

SEQ ID NO: 9095945 - DNA, 22 bp, Homo sapiens
atgctaaatgttaatgttacct

SEQ ID NO: 9095946 - DNA, 22 bp, Homo sapiens
atgctacactatttgctgagca

SEQ ID NO: 9095947 - DNA, 22 bp, Homo sapiens
atgctacaacattatctggggt

SEQ ID NO: 9095948 - DNA, 22 bp, Homo sapiens
atgctaattgattgtcgtgtct

SEQ ID NO: 9095949 - DNA, 22 bp, Homo sapiens
atgctacagcatctctcatcag

SEQ ID NO: 9095950 - DNA, 22 bp, Homo sapiens
atgctacagagataggttgggt

SEQ ID NO: 9095951 - DNA, 22 bp, Homo sapiens
atgctacagagtttgaatatgt

SEQ ID NO: 9095952 - DNA, 22 bp, Homo sapiens
atgctaaactatgatcattttc

SEQ ID NO: 9095953 - DNA, 22 bp, Homo sapiens
atgctaaatggccagtaccaaa

SEQ ID NO: 9095954 - DNA, 20 bp, Homo sapiens
gacagcttggggtgtcacct

SEQ ID NO: 9095955 - DNA, 22 bp, Homo sapiens
gacaggaaacaagaaggcagga

SEQ ID NO: 9095956 - DNA, 22 bp, Homo sapiens
gacaggaaacaagaaggcagga

SEQ ID NO: 9095957 - DNA, 22 bp, Homo sapiens
gacagcttgcctggtactgcaa

SEQ ID NO: 9095958 - DNA, 22 bp, Homo sapiens
gacagcttcttgggccgggcct

SEQ ID NO: 9095959 - DNA, 22 bp, Homo sapiens
gacagcttctagaggaattggt

SEQ ID NO: 9095960 - DNA, 22 bp, Homo sapiens
gacagcttctatgtgacgagca

SEQ ID NO: 9095961 - DNA, 22 bp, Homo sapiens
gacagcttctagaaatggtcac

SEQ ID NO: 9095962 - DNA, 22 bp, Homo sapiens
atgctctgggcaggagccctgg

SEQ ID NO: 9095963 - DNA, 22 bp, Homo sapiens
gacaggaaaggggtctgttttc

SEQ ID NO: 9095964 - DNA, 22 bp, Homo sapiens
gacaggaaaggggtctgttttc

SEQ ID NO: 9095965 - DNA, 22 bp, Homo sapiens
gacagcttagtgaaaatgtaaa

SEQ ID NO: 9095966 - DNA, 22 bp, Homo sapiens
gacagcttaggaagtttctatt

SEQ ID NO: 9095967 - DNA, 22 bp, Homo sapiens
atgctatgtaactggcagatag

SEQ ID NO: 9095968 - DNA, 22 bp, Homo sapiens
gacagcttcgaggaggtgagct

SEQ ID NO: 9095969 - DNA, 22 bp, Homo sapiens
gacagcttagtgaaaatgtaaa

SEQ ID NO: 9095970 - DNA, 22 bp, Homo sapiens
atgctactcattaagtttgtca

SEQ ID NO: 9095971 - DNA, 22 bp, Homo sapiens
atgctactatccttctgcttaa

SEQ ID NO: 9095972 - DNA, 22 bp, Homo sapiens
atgctacaggagccccacttag

SEQ ID NO: 9095973 - DNA, 18 bp, Homo sapiens
atgctacaggcaggtgtc

SEQ ID NO: 9095974 - DNA, 18 bp, Homo sapiens
atgctacaggcaggtgtc

SEQ ID NO: 9095975 - DNA, 22 bp, Homo sapiens
atgctacaggattctccttatc

SEQ ID NO: 9095976 - DNA, 22 bp, Homo sapiens
atgctacagccctctttgcata

SEQ ID NO: 9095977 - DNA, 22 bp, Homo sapiens
atgctacagccctctttgcata

SEQ ID NO: 9095978 - DNA, 22 bp, Homo sapiens
gaagtagaaagcctcgtaaata

SEQ ID NO: 9095979 - DNA, 22 bp, Homo sapiens
gaagtagattcgttgcatcttg

SEQ ID NO: 9095980 - DNA, 22 bp, Homo sapiens
gaagtatagcagatgttattta

SEQ ID NO: 9095981 - DNA, 22 bp, Homo sapiens
gaagtagattcgttgcatcttg

SEQ ID NO: 9095982 - DNA, 22 bp, Homo sapiens
gaagtagaaaactcagtttcaa

SEQ ID NO: 9095983 - DNA, 22 bp, Homo sapiens
gaagtattatagcatattagcc

SEQ ID NO: 9095984 - DNA, 22 bp, Homo sapiens
gaagtatatgtctttaatctat

SEQ ID NO: 9095985 - DNA, 22 bp, Homo sapiens
gaagtcagaaaagaattaggga

SEQ ID NO: 9095986 - DNA, 22 bp, Homo sapiens
gaagtatttctgagttgcccag

SEQ ID NO: 9095987 - DNA, 22 bp, Homo sapiens
gaagtattactctgaatgtatt

SEQ ID NO: 9095988 - DNA, 22 bp, Homo sapiens
atgcagttttcaaagactattc

SEQ ID NO: 9095989 - DNA, 22 bp, Homo sapiens
atgcagtttaaggcacaattag

SEQ ID NO: 9095990 - DNA, 22 bp, Homo sapiens
atgcagttttaaatcatttcag

SEQ ID NO: 9095991 - DNA, 22 bp, Homo sapiens
atgcagtttatctccaaatcat

SEQ ID NO: 9095992 - DNA, 22 bp, Homo sapiens
atgcagtttatctccaaatcat

SEQ ID NO: 9095993 - DNA, 22 bp, Homo sapiens
gaagtccagatcaagtcaccag

SEQ ID NO: 9095994 - DNA, 22 bp, Homo sapiens
gaagtcagctccccaggtcccc

SEQ ID NO: 9095995 - DNA, 23 bp, Homo sapiens
gaagtcagccctacagagagcag

SEQ ID NO: 9095996 - DNA, 23 bp, Homo sapiens
gaagtcagccctacagagagcag

SEQ ID NO: 9095997 - DNA, 23 bp, Homo sapiens
gaagtcagccctacagagagcag

SEQ ID NO: 9095998 - DNA, 22 bp, Homo sapiens
atgccactgcactccagcctag

SEQ ID NO: 9095999 - DNA, 22 bp, Homo sapiens
atgccactgcactccagcctag

SEQ ID NO: 9096000 - DNA, 22 bp, Homo sapiens
atgccactgcactccagcctgg

SEQ ID NO: 9096001 - DNA, 22 bp, Homo sapiens
atgccactgcactccagcctgg

SEQ ID NO: 9096002 - DNA, 22 bp, Homo sapiens
atgccactgcactccagcctgg

SEQ ID NO: 9096003 - DNA, 22 bp, Homo sapiens
gaatttcagaggtaacatcatc

SEQ ID NO: 9096004 - DNA, 22 bp, Homo sapiens
gaatttcagaggtaacatcatc

SEQ ID NO: 9096005 - DNA, 22 bp, Homo sapiens
gaatttcaagcagtgcaatgtt

SEQ ID NO: 9096006 - DNA, 22 bp, Homo sapiens
gaatttcacaaggtgaggataa

SEQ ID NO: 9096007 - DNA, 22 bp, Homo sapiens
gaatttcaaagaggttaagagg

SEQ ID NO: 9096008 - DNA, 22 bp, Homo sapiens
gaatttcaacagtcctcaaatg

SEQ ID NO: 9096009 - DNA, 22 bp, Homo sapiens
gaatttcaagcagtgcaatgtt

SEQ ID NO: 9096010 - DNA, 22 bp, Homo sapiens
gaatttcaaaagccagaacggg

SEQ ID NO: 9096011 - DNA, 22 bp, Homo sapiens
atctttcagagctccatcaggg

SEQ ID NO: 9096012 - DNA, 22 bp, Homo sapiens
atctttcatctctattatttga

SEQ ID NO: 9096013 - DNA, 22 bp, Homo sapiens
atctttctatggtactttctcc

SEQ ID NO: 9096014 - DNA, 22 bp, Homo sapiens
atctttctatggtactttctcc

SEQ ID NO: 9096015 - DNA, 22 bp, Homo sapiens
atctttctctgcactatacaat

SEQ ID NO: 9096016 - DNA, 22 bp, Homo sapiens
atctttctccatatacatcttt

SEQ ID NO: 9096017 - DNA, 22 bp, Homo sapiens
cttctcctctgagtcctgggag

SEQ ID NO: 9096018 - DNA, 22 bp, Homo sapiens
cttctcctgtaagaagatcaaa

SEQ ID NO: 9096019 - DNA, 22 bp, Homo sapiens
cttctccctgggggctctttat

SEQ ID NO: 9096020 - DNA, 22 bp, Homo sapiens
cttctccctgggggctctttat

SEQ ID NO: 9096021 - DNA, 22 bp, Homo sapiens
cttctccctggcttctgcacac

SEQ ID NO: 9096022 - DNA, 19 bp, Homo sapiens
cttctccagcttctagaag

SEQ ID NO: 9096023 - DNA, 22 bp, Homo sapiens
cttctcccaagtatgcagtttg

SEQ ID NO: 9096024 - DNA, 22 bp, Homo sapiens
atctggacagtgttactatgac

SEQ ID NO: 9096025 - DNA, 19 bp, Homo sapiens
atctggacttatcctatat

SEQ ID NO: 9096026 - DNA, 22 bp, Homo sapiens
atctggactggacatagtcttt

SEQ ID NO: 9096027 - DNA, 22 bp, Homo sapiens
atctggaagtcagaggtttgca

SEQ ID NO: 9096028 - DNA, 22 bp, Homo sapiens
ctttacagaaagagaactctgg

SEQ ID NO: 9096029 - DNA, 22 bp, Homo sapiens
ctttacataaggataaacctgg

SEQ ID NO: 9096030 - DNA, 22 bp, Homo sapiens
ctttacataaggataaacctgg

SEQ ID NO: 9096031 - DNA, 22 bp, Homo sapiens
ctttacagataggaactactca

SEQ ID NO: 9096032 - DNA, 22 bp, Homo sapiens
atctttgggatcctgatttact

SEQ ID NO: 9096033 - DNA, 20 bp, Homo sapiens
atctttggctcagaagcctt

SEQ ID NO: 9096034 - DNA, 22 bp, Homo sapiens
atctttgctattgtaaatcacg

SEQ ID NO: 9096035 - DNA, 22 bp, Homo sapiens
atctttgcccagagactcagcc

SEQ ID NO: 9096036 - DNA, 22 bp, Homo sapiens
ctttattagatgtagactttct

SEQ ID NO: 9096037 - DNA, 22 bp, Homo sapiens
ctttattcctacaagattttct

SEQ ID NO: 9096038 - DNA, 22 bp, Homo sapiens
ctttattctgcaaattgccttg

SEQ ID NO: 9096039 - DNA, 22 bp, Homo sapiens
ctttattgtccttcttaggtgg

SEQ ID NO: 9096040 - DNA, 22 bp, Homo sapiens
ctttacttctcaaaataaagca

SEQ ID NO: 9096041 - DNA, 22 bp, Homo sapiens
ctttactgaagtgaagacctgg

SEQ ID NO: 9096042 - DNA, 22 bp, Homo sapiens
ctttttatagctatgtcctatg

SEQ ID NO: 9096043 - DNA, 22 bp, Homo sapiens
ctttttatagctatgtcctatg

SEQ ID NO: 9096044 - DNA, 22 bp, Homo sapiens
ctttttatctcttaatgatgtt

SEQ ID NO: 9096045 - DNA, 19 bp, Homo sapiens
ctttttcaccttctagaag

SEQ ID NO: 9096046 - DNA, 19 bp, Homo sapiens
ctttttcaccttctagaag

SEQ ID NO: 9096047 - DNA, 21 bp, Homo sapiens
ctttttactcgttcatatgca

SEQ ID NO: 9096048 - DNA, 22 bp, Homo sapiens
ctttttactctgttgtctcagc

SEQ ID NO: 9096049 - DNA, 22 bp, Homo sapiens
cttttgttgcccttgtcgcagg

SEQ ID NO: 9096050 - DNA, 22 bp, Homo sapiens
ctttttataccgtgccagttga

SEQ ID NO: 9096051 - DNA, 22 bp, Homo sapiens
atgacagaggagtgcaggtgat

SEQ ID NO: 9096052 - DNA, 22 bp, Homo sapiens
atgacagaggagtgcaggtgat

SEQ ID NO: 9096053 - DNA, 22 bp, Homo sapiens
atgacagaccctctaaagacaa

SEQ ID NO: 9096054 - DNA, 22 bp, Homo sapiens
atgagatgtgtctaatggaacc

SEQ ID NO: 9096055 - DNA, 22 bp, Homo sapiens
atgagatgttcaggagtctgag

SEQ ID NO: 9096056 - DNA, 22 bp, Homo sapiens
atgagcaattaggaagaaaaca

SEQ ID NO: 9096057 - DNA, 19 bp, Homo sapiens
atgagcaatagttttaatc

SEQ ID NO: 9096058 - DNA, 22 bp, Homo sapiens
atgagcaagagctatgtacaga

SEQ ID NO: 9096059 - DNA, 22 bp, Homo sapiens
atgagcagatgctcctgcctct

SEQ ID NO: 9096060 - DNA, 22 bp, Homo sapiens
atgagatgaggaatggccctcc

SEQ ID NO: 9096061 - DNA, 22 bp, Homo sapiens
atgagatgtgtctaatggaacc

SEQ ID NO: 9096062 - DNA, 22 bp, Homo sapiens
atgagatgtgtctaatggaacc

SEQ ID NO: 9096063 - DNA, 22 bp, Homo sapiens
atgagatagactatgtcataca

SEQ ID NO: 9096064 - DNA, 22 bp, Homo sapiens
atgagagctctatgatctgttt

SEQ ID NO: 9096065 - DNA, 22 bp, Homo sapiens
atgagaggtttcgtcagaggaa

SEQ ID NO: 9096066 - DNA, 22 bp, Homo sapiens
atgagaggtttcgtcagaggaa

SEQ ID NO: 9096067 - DNA, 22 bp, Homo sapiens
atgagaaagagttgtatctaga

SEQ ID NO: 9096068 - DNA, 22 bp, Homo sapiens
atgagaaagagttgtatctaga

SEQ ID NO: 9096069 - DNA, 22 bp, Homo sapiens
atgagaaagttaatcatcatga

SEQ ID NO: 9096070 - DNA, 22 bp, Homo sapiens
atgagaaagagttgtatctaga

SEQ ID NO: 9096071 - DNA, 22 bp, Homo sapiens
atgagacatgacttcaggcctt

SEQ ID NO: 9096072 - DNA, 22 bp, Homo sapiens
atgagacatgacttcaggcctt

SEQ ID NO: 9096073 - DNA, 22 bp, Homo sapiens
atgagagactgtgtgttgggag

SEQ ID NO: 9096074 - DNA, 22 bp, Homo sapiens
atgagactacctgtaatgtggc

SEQ ID NO: 9096075 - DNA, 22 bp, Homo sapiens
atgagaatggtgattctgcaga

SEQ ID NO: 9096076 - DNA, 22 bp, Homo sapiens
atgagaaggacataaattatag

SEQ ID NO: 9096077 - DNA, 22 bp, Homo sapiens
atgagaaggacataaattatag

SEQ ID NO: 9096078 - DNA, 22 bp, Homo sapiens
atgagaaggacataaattatag

SEQ ID NO: 9096079 - DNA, 22 bp, Homo sapiens
atgagaatatgatttactattg

SEQ ID NO: 9096080 - DNA, 22 bp, Homo sapiens
ctttgccatgttgcctgcagaa

SEQ ID NO: 9096081 - DNA, 22 bp, Homo sapiens
ctttgctgccagaacccagcag

SEQ ID NO: 9096082 - DNA, 22 bp, Homo sapiens
ctttgcttactggtgtctgcat

SEQ ID NO: 9096083 - DNA, 22 bp, Homo sapiens
ctttgctagtgtttcagtagac

SEQ ID NO: 9096084 - DNA, 22 bp, Homo sapiens
ctttgctagtgtttcagtagac

SEQ ID NO: 9096085 - DNA, 22 bp, Homo sapiens
ctttgcctcctagagcacgttc

SEQ ID NO: 9096086 - DNA, 22 bp, Homo sapiens
ctttgcctcctagagcacgttc

SEQ ID NO: 9096087 - DNA, 20 bp, Homo sapiens
ctttgcctattctctgcctg

SEQ ID NO: 9096088 - DNA, 20 bp, Homo sapiens
ctttgcctattctctgcctg

SEQ ID NO: 9096089 - DNA, 20 bp, Homo sapiens
ctttgcctattctctgcctg

SEQ ID NO: 9096090 - DNA, 22 bp, Homo sapiens
ctttggctgacaggtttctggt

SEQ ID NO: 9096091 - DNA, 22 bp, Homo sapiens
ctttggctgacaggtttctggt

SEQ ID NO: 9096092 - DNA, 22 bp, Homo sapiens
ctttggctacaagcgctgcaat

SEQ ID NO: 9096093 - DNA, 22 bp, Homo sapiens
ctttggctacaagcgctgcaat

SEQ ID NO: 9096094 - DNA, 22 bp, Homo sapiens
ctttggctcatggttttatcca

SEQ ID NO: 9096095 - DNA, 22 bp, Homo sapiens
ctttggctctttagaattccct

SEQ ID NO: 9096096 - DNA, 22 bp, Homo sapiens
ctttggctcatggttttatcca

SEQ ID NO: 9096097 - DNA, 22 bp, Homo sapiens
ctttggctaacaaatcagcttg

SEQ ID NO: 9096098 - DNA, 22 bp, Homo sapiens
ctttggctaacaaatcagcttg

SEQ ID NO: 9096099 - DNA, 22 bp, Homo sapiens
ctttggctaacaaatcagcttg

SEQ ID NO: 9096100 - DNA, 22 bp, Homo sapiens
ctttgcttgacactgtgattgt

SEQ ID NO: 9096101 - DNA, 22 bp, Homo sapiens
ctttgctttactcccactgtgt

SEQ ID NO: 9096102 - DNA, 19 bp, Homo sapiens
ctttgcttgtttctgtgtc

SEQ ID NO: 9096103 - DNA, 22 bp, Homo sapiens
ctttgcttctccaacctgctca

SEQ ID NO: 9096104 - DNA, 22 bp, Homo sapiens
ctttgcttctccaacctgctca

SEQ ID NO: 9096105 - DNA, 22 bp, Homo sapiens
ctttggaaaaagtgactggctc

SEQ ID NO: 9096106 - DNA, 22 bp, Homo sapiens
ctttggaaaaatacctggcata

SEQ ID NO: 9096107 - DNA, 22 bp, Homo sapiens
ctttgggatttcatgagagcta

SEQ ID NO: 9096108 - DNA, 20 bp, Homo sapiens
ctttgggtttctcatgtaca

SEQ ID NO: 9096109 - DNA, 22 bp, Homo sapiens
ctttgggtattctcccttgggg

SEQ ID NO: 9096110 - DNA, 22 bp, Homo sapiens
ctttggctgcattcgagttgct

SEQ ID NO: 9096111 - DNA, 22 bp, Homo sapiens
ctttggctgacgaggaggaggc

SEQ ID NO: 9096112 - DNA, 22 bp, Homo sapiens
ctttggctgtcctcttggctgg

SEQ ID NO: 9096113 - DNA, 22 bp, Homo sapiens
ctttggctggcaccccagcggg

SEQ ID NO: 9096114 - DNA, 22 bp, Homo sapiens
ctttggcttgcactattacact

SEQ ID NO: 9096115 - DNA, 22 bp, Homo sapiens
ctttggctgggcaaagggaggt

SEQ ID NO: 9096116 - DNA, 22 bp, Homo sapiens
ctttggctgtcctcttggctgg

SEQ ID NO: 9096117 - DNA, 22 bp, Homo sapiens
ctttggcttgccctggcagtac

SEQ ID NO: 9096118 - DNA, 22 bp, Homo sapiens
ctttggcttgccctggcagtac

SEQ ID NO: 9096119 - DNA, 22 bp, Homo sapiens
atgacactgtcctagtaaggaa

SEQ ID NO: 9096120 - DNA, 22 bp, Homo sapiens
atgacagaaggcctccctgaca

SEQ ID NO: 9096121 - DNA, 22 bp, Homo sapiens
atgacagacagaagggattttt

SEQ ID NO: 9096122 - DNA, 22 bp, Homo sapiens
atgaatttttctaagcttttgt

SEQ ID NO: 9096123 - DNA, 22 bp, Homo sapiens
atgacaatggacatagttaaaa

SEQ ID NO: 9096124 - DNA, 22 bp, Homo sapiens
atgacacataaaacaaggactg

SEQ ID NO: 9096125 - DNA, 22 bp, Homo sapiens
gggaggagggtgctggctaaac

SEQ ID NO: 9096126 - DNA, 21 bp, Homo sapiens
gggagctggaaactgggtgac

SEQ ID NO: 9096127 - DNA, 21 bp, Homo sapiens
gggagctggaaactgggtgac

SEQ ID NO: 9096128 - DNA, 22 bp, Homo sapiens
gggagctgccttagaccggagg

SEQ ID NO: 9096129 - DNA, 22 bp, Homo sapiens
gggagctgctgaacacaagggt

SEQ ID NO: 9096130 - DNA, 22 bp, Homo sapiens
gggagctgcggtcttgcgaaga

SEQ ID NO: 9096131 - DNA, 22 bp, Homo sapiens
gggaggcagtgctggaggctgg

SEQ ID NO: 9096132 - DNA, 22 bp, Homo sapiens
gggaggcagtgctggaggctgg

SEQ ID NO: 9096133 - DNA, 22 bp, Homo sapiens
gggagctgatcaggtggattca

SEQ ID NO: 9096134 - DNA, 22 bp, Homo sapiens
gggagctgatgatgtaagtccc

SEQ ID NO: 9096135 - DNA, 22 bp, Homo sapiens
gggagctgcacacgccccggaa

SEQ ID NO: 9096136 - DNA, 22 bp, Homo sapiens
cagacagaaggaaggccaacat

SEQ ID NO: 9096137 - DNA, 22 bp, Homo sapiens
cagacagaaggaaggccaacat

SEQ ID NO: 9096138 - DNA, 22 bp, Homo sapiens
cagacacaccaggcccattctg

SEQ ID NO: 9096139 - DNA, 22 bp, Homo sapiens
cagacacacaagcaatctaagt

SEQ ID NO: 9096140 - DNA, 22 bp, Homo sapiens
cagacacacaagcaatctaagt

SEQ ID NO: 9096141 - DNA, 22 bp, Homo sapiens
cagaaacagacatgacgcagta

SEQ ID NO: 9096142 - DNA, 22 bp, Homo sapiens
cagaaacagacatgacgcagta

SEQ ID NO: 9096143 - DNA, 22 bp, Homo sapiens
cagaaacagacatgacgcagta

SEQ ID NO: 9096144 - DNA, 22 bp, Homo sapiens
cagaaacaggcaacgtgtgcac

SEQ ID NO: 9096145 - DNA, 22 bp, Homo sapiens
cagaaacagagaaatattggct

SEQ ID NO: 9096146 - DNA, 22 bp, Homo sapiens
cagaataaaggtacaattgagt

SEQ ID NO: 9096147 - DNA, 22 bp, Homo sapiens
cagaatttaagtggattattct

SEQ ID NO: 9096148 - DNA, 22 bp, Homo sapiens
cagaatttaagtggattattct

SEQ ID NO: 9096149 - DNA, 22 bp, Homo sapiens
cagaatttttcactcaatcttc

SEQ ID NO: 9096150 - DNA, 22 bp, Homo sapiens
cagacaaagcggaaactgttta

SEQ ID NO: 9096151 - DNA, 22 bp, Homo sapiens
cagaatttttcgaatgtactgt

SEQ ID NO: 9096152 - DNA, 22 bp, Homo sapiens
cagacaaagcggaaactgttta

SEQ ID NO: 9096153 - DNA, 22 bp, Homo sapiens
cagaatttgaagtaatattcca

SEQ ID NO: 9096154 - DNA, 22 bp, Homo sapiens
cagaatttcccacactgggact

SEQ ID NO: 9096155 - DNA, 22 bp, Homo sapiens
cagaatttcccacactgggact

SEQ ID NO: 9096156 - DNA, 22 bp, Homo sapiens
cagaatttcagtgatgttttct

SEQ ID NO: 9096157 - DNA, 22 bp, Homo sapiens
cagaatttcagtgatgttttct

SEQ ID NO: 9096158 - DNA, 22 bp, Homo sapiens
cagaatttagaaaacaacataa

SEQ ID NO: 9096159 - DNA, 22 bp, Homo sapiens
cagaatttagcacaatgtatgg

SEQ ID NO: 9096160 - DNA, 22 bp, Homo sapiens
cagaatttagcacaatgtatgg

SEQ ID NO: 9096161 - DNA, 22 bp, Homo sapiens
ggctggcactctgtccagtgtc

SEQ ID NO: 9096162 - DNA, 19 bp, Homo sapiens
ggctggcaagtgacagtgt

SEQ ID NO: 9096163 - DNA, 19 bp, Homo sapiens
ggctggcaagtgacagtgt

SEQ ID NO: 9096164 - DNA, 22 bp, Homo sapiens
ggctggcactgaggagagctct

SEQ ID NO: 9096165 - DNA, 22 bp, Homo sapiens
cagaaaataaagtttctacgca

SEQ ID NO: 9096166 - DNA, 22 bp, Homo sapiens
cagaaaatagagtttctctgag

SEQ ID NO: 9096167 - DNA, 22 bp, Homo sapiens
cagaaaatagagtttctctgag

SEQ ID NO: 9096168 - DNA, 22 bp, Homo sapiens
cagaaacactgtatttagggaa

SEQ ID NO: 9096169 - DNA, 22 bp, Homo sapiens
cagaaacacttgtagagaagtt

SEQ ID NO: 9096170 - DNA, 22 bp, Homo sapiens
cagaaacacttgtagagaagtt

SEQ ID NO: 9096171 - DNA, 22 bp, Homo sapiens
cagaaacacttgtagagaagtt

SEQ ID NO: 9096172 - DNA, 22 bp, Homo sapiens
gggatctgtgttgcgatggatt

SEQ ID NO: 9096173 - DNA, 22 bp, Homo sapiens
gggatctgggcctcacacacat

SEQ ID NO: 9096174 - DNA, 22 bp, Homo sapiens
gggatctgatgcactgctgaaa

SEQ ID NO: 9096175 - DNA, 22 bp, Homo sapiens
gggatctgggacaacaggtggt

SEQ ID NO: 9096176 - DNA, 22 bp, Homo sapiens
gggatctggaattttggtatgt

SEQ ID NO: 9096177 - DNA, 23 bp, Homo sapiens
gggatctgtaaacctggagaacc

SEQ ID NO: 9096178 - DNA, 23 bp, Homo sapiens
gggatctgtaagttgaagacaaa

SEQ ID NO: 9096179 - DNA, 22 bp, Homo sapiens
gggatgaattgagtcagaaggg

SEQ ID NO: 9096180 - DNA, 22 bp, Homo sapiens
gggatgagagtagggtgtgaaa

SEQ ID NO: 9096181 - DNA, 22 bp, Homo sapiens
gggatgagagctgggacagaag

SEQ ID NO: 9096182 - DNA, 22 bp, Homo sapiens
cagagcagaaacctgggtgatt

SEQ ID NO: 9096183 - DNA, 22 bp, Homo sapiens
cagagcacctgctcattgccag

SEQ ID NO: 9096184 - DNA, 22 bp, Homo sapiens
cagagcacccaaggagcatttg

SEQ ID NO: 9096185 - DNA, 22 bp, Homo sapiens
cagagcacccaaggagcatttg

SEQ ID NO: 9096186 - DNA, 22 bp, Homo sapiens
cagagaacttagctagttttcc

SEQ ID NO: 9096187 - DNA, 22 bp, Homo sapiens
cagacttgacggcagctgcttt

SEQ ID NO: 9096188 - DNA, 22 bp, Homo sapiens
cagacttgacggcagctgcttt

SEQ ID NO: 9096189 - DNA, 22 bp, Homo sapiens
cagactgtagagtttgagaagt

SEQ ID NO: 9096190 - DNA, 20 bp, Homo sapiens
gggaggcattggtccctcac

SEQ ID NO: 9096191 - DNA, 22 bp, Homo sapiens
cagagacaccccagaaaataag

SEQ ID NO: 9096192 - DNA, 22 bp, Homo sapiens
cagagacacttaacaggaatgg

SEQ ID NO: 9096193 - DNA, 22 bp, Homo sapiens
cagagacacttaacaggaatgg

SEQ ID NO: 9096194 - DNA, 22 bp, Homo sapiens
gggatctgctccagagggaaaa

SEQ ID NO: 9096195 - DNA, 22 bp, Homo sapiens
gggatctgatttaggatgggag

SEQ ID NO: 9096196 - DNA, 22 bp, Homo sapiens
cagagacaacctggtagagaaa

SEQ ID NO: 9096197 - DNA, 22 bp, Homo sapiens
cagagacaacctggtagagaaa

SEQ ID NO: 9096198 - DNA, 22 bp, Homo sapiens
cagagacaacctggtagagaaa

SEQ ID NO: 9096199 - DNA, 22 bp, Homo sapiens
cagagacaacctggtagagaaa

SEQ ID NO: 9096200 - DNA, 22 bp, Homo sapiens
gggcaggggtcagtggccccaa

SEQ ID NO: 9096201 - DNA, 22 bp, Homo sapiens
gggcaggtacaagatgcttctt

SEQ ID NO: 9096202 - DNA, 22 bp, Homo sapiens
cagagcaggcccactgccctcc

SEQ ID NO: 9096203 - DNA, 22 bp, Homo sapiens
cagagcagtgaggagttgtgta

SEQ ID NO: 9096204 - DNA, 22 bp, Homo sapiens
cagagcagaaggtccaagcctg

SEQ ID NO: 9096205 - DNA, 22 bp, Homo sapiens
cagagcagaagcggtcctcaca

SEQ ID NO: 9096206 - DNA, 22 bp, Homo sapiens
cagagcagaagcggtcctcaca

SEQ ID NO: 9096207 - DNA, 22 bp, Homo sapiens
cagagcagacgttgagattaag

SEQ ID NO: 9096208 - DNA, 22 bp, Homo sapiens
cagagcagacgttgagattaag

SEQ ID NO: 9096209 - DNA, 18 bp, Homo sapiens
cagagcagaggtggagcg

SEQ ID NO: 9096210 - DNA, 22 bp, Homo sapiens
cagagcatgaataaaagttaca

SEQ ID NO: 9096211 - DNA, 19 bp, Homo sapiens
cagagcagtggttcctgaa

SEQ ID NO: 9096212 - DNA, 22 bp, Homo sapiens
cagagcagtgaggagttgtgta

SEQ ID NO: 9096213 - DNA, 22 bp, Homo sapiens
cagagcagtggagagtaggtct

SEQ ID NO: 9096214 - DNA, 20 bp, Homo sapiens
cagagcagtgcccaggcggc

SEQ ID NO: 9096215 - DNA, 22 bp, Homo sapiens
cagagccaaacctcagggcccg

SEQ ID NO: 9096216 - DNA, 22 bp, Homo sapiens
cagagcatgtcaactagcttta

SEQ ID NO: 9096217 - DNA, 22 bp, Homo sapiens
cagagcattgagggtctgccaa

SEQ ID NO: 9096218 - DNA, 20 bp, Homo sapiens
cagagccaagagcagcatct

SEQ ID NO: 9096219 - DNA, 22 bp, Homo sapiens
cagagccacagcctccagattt

SEQ ID NO: 9096220 - DNA, 20 bp, Homo sapiens
cagagccaagagcagcatct

SEQ ID NO: 9096221 - DNA, 22 bp, Homo sapiens
cagatgaataaatgatgaggta

SEQ ID NO: 9096222 - DNA, 22 bp, Homo sapiens
cagatgaagtattacagacatt

SEQ ID NO: 9096223 - DNA, 19 bp, Homo sapiens
cagatgagaaaagtgaggt

SEQ ID NO: 9096224 - DNA, 22 bp, Homo sapiens
cagatgagagtggccagggttc

SEQ ID NO: 9096225 - DNA, 18 bp, Homo sapiens
cagatgagatgcaatctc

SEQ ID NO: 9096226 - DNA, 22 bp, Homo sapiens
cagatgagagtggccagggttc

SEQ ID NO: 9096227 - DNA, 18 bp, Homo sapiens
cagatgagatgcaatctc

SEQ ID NO: 9096228 - DNA, 23 bp, Homo sapiens
cagatgaggttggcagcatggtc

SEQ ID NO: 9096229 - DNA, 23 bp, Homo sapiens
cagatgaggttggcagcatggtc

SEQ ID NO: 9096230 - DNA, 22 bp, Homo sapiens
cagatgagggctggaggtgagc

SEQ ID NO: 9096231 - DNA, 22 bp, Homo sapiens
cagatgagcatgggcacaagca

SEQ ID NO: 9096232 - DNA, 22 bp, Homo sapiens
cagatgaggcaacctcattgct

SEQ ID NO: 9096233 - DNA, 22 bp, Homo sapiens
cagatatgctgagactcctgtg

SEQ ID NO: 9096234 - DNA, 22 bp, Homo sapiens
ggtcaacagaggtaatggtaac

SEQ ID NO: 9096235 - DNA, 22 bp, Homo sapiens
ggtcaacagaatttgtactcag

SEQ ID NO: 9096236 - DNA, 22 bp, Homo sapiens
cagatgcaggtctgctcacctg

SEQ ID NO: 9096237 - DNA, 23 bp, Homo sapiens
cagatgaggttggcagcatggtc

SEQ ID NO: 9096238 - DNA, 22 bp, Homo sapiens
ggtccgtttttgaagacagtgg

SEQ ID NO: 9096239 - DNA, 22 bp, Homo sapiens
ggtcctgcctgctgtccttcaa

SEQ ID NO: 9096240 - DNA, 23 bp, Homo sapiens
ggtcctgcccccggtcgcccaaa

SEQ ID NO: 9096241 - DNA, 22 bp, Homo sapiens
ggtcctgaggggagctgaaggt

SEQ ID NO: 9096242 - DNA, 22 bp, Homo sapiens
ggtcctggcagctctgtgtcca

SEQ ID NO: 9096243 - DNA, 22 bp, Homo sapiens
ggtcctggaaattgacggaaag

SEQ ID NO: 9096244 - DNA, 22 bp, Homo sapiens
ggtcctgcgtctggctcgcccg

SEQ ID NO: 9096245 - DNA, 22 bp, Homo sapiens
ggtcctggaagtgtaagtggca

SEQ ID NO: 9096246 - DNA, 22 bp, Homo sapiens
cagatgtttgtctatatgcttt

SEQ ID NO: 9096247 - DNA, 19 bp, Homo sapiens
cagatgttttcagttcatt

SEQ ID NO: 9096248 - DNA, 22 bp, Homo sapiens
cagatgtggaatgcagcaggct

SEQ ID NO: 9096249 - DNA, 22 bp, Homo sapiens
cagatgtggttaacatgtacat

SEQ ID NO: 9096250 - DNA, 22 bp, Homo sapiens
cagatgttgttcctgcctgtag

SEQ ID NO: 9096251 - DNA, 20 bp, Homo sapiens
cagatggcacgtcagggcat

SEQ ID NO: 9096252 - DNA, 22 bp, Homo sapiens
ggtcctggcagctctgtgtcca

SEQ ID NO: 9096253 - DNA, 22 bp, Homo sapiens
gggtccaggtcttcaggcagag

SEQ ID NO: 9096254 - DNA, 22 bp, Homo sapiens
gggtcccaggaaggagcagtgt

SEQ ID NO: 9096255 - DNA, 22 bp, Homo sapiens
gggtaggaaatccagaggtggc

SEQ ID NO: 9096256 - DNA, 22 bp, Homo sapiens
gggtacagttcttccagtgtca

SEQ ID NO: 9096257 - DNA, 22 bp, Homo sapiens
gggtgggatctgtggagcctca

SEQ ID NO: 9096258 - DNA, 18 bp, Homo sapiens
gggtcctgttcttggaag

SEQ ID NO: 9096259 - DNA, 18 bp, Homo sapiens
gggtcctgtgggagacag

SEQ ID NO: 9096260 - DNA, 18 bp, Homo sapiens
gggtcctgtgggagacag

SEQ ID NO: 9096261 - DNA, 21 bp, Homo sapiens
gggtcctgggatgggatccag

SEQ ID NO: 9096262 - DNA, 18 bp, Homo sapiens
gggtcctgtgggagacag

SEQ ID NO: 9096263 - DNA, 21 bp, Homo sapiens
gggtcctgggatgggatccag

SEQ ID NO: 9096264 - DNA, 22 bp, Homo sapiens
gggtcctgcgtgggcccaggac

SEQ ID NO: 9096265 - DNA, 22 bp, Homo sapiens
gggtcctgcgtgggcccaggac

SEQ ID NO: 9096266 - DNA, 22 bp, Homo sapiens
gggtcctggaatctgcatttta

SEQ ID NO: 9096267 - DNA, 20 bp, Homo sapiens
gggtcctgacttggtctcct

SEQ ID NO: 9096268 - DNA, 22 bp, Homo sapiens
gggtccctggaattacttgaca

SEQ ID NO: 9096269 - DNA, 18 bp, Homo sapiens
gggtccccagctgcaggg

SEQ ID NO: 9096270 - DNA, 22 bp, Homo sapiens
gggtcccctcatcatggagact

SEQ ID NO: 9096271 - DNA, 22 bp, Homo sapiens
gggtcccctcatcatggagact

SEQ ID NO: 9096272 - DNA, 20 bp, Homo sapiens
gggtgtgggcccggccaggc

SEQ ID NO: 9096273 - DNA, 22 bp, Homo sapiens
gggtgtgttcctaaggaaacca

SEQ ID NO: 9096274 - DNA, 20 bp, Homo sapiens
gggtgtgtgcagggcctggt

SEQ ID NO: 9096275 - DNA, 18 bp, Homo sapiens
gggttcacctgcctttgg

SEQ ID NO: 9096276 - DNA, 22 bp, Homo sapiens
gggttcagactaaagctatgca

SEQ ID NO: 9096277 - DNA, 22 bp, Homo sapiens
gggttaggtccctcccttctgg

SEQ ID NO: 9096278 - DNA, 22 bp, Homo sapiens
gggttccaatgatgagcaagag

SEQ ID NO: 9096279 - DNA, 22 bp, Homo sapiens
gggttccagtctgaaactacag

SEQ ID NO: 9096280 - DNA, 22 bp, Homo sapiens
gggttcttatagtatcagagct

SEQ ID NO: 9096281 - DNA, 22 bp, Homo sapiens
gggttcagagtcaggtgtgata

SEQ ID NO: 9096282 - DNA, 22 bp, Homo sapiens
gggttcaggttggcctgagcac

SEQ ID NO: 9096283 - DNA, 22 bp, Homo sapiens
gggttccaaacatagtcttcct

SEQ ID NO: 9096284 - DNA, 22 bp, Homo sapiens
ggtatactgcatgacattgggg

SEQ ID NO: 9096285 - DNA, 22 bp, Homo sapiens
gggctgtggagccgcgagggct

SEQ ID NO: 9096286 - DNA, 22 bp, Homo sapiens
gggctgtgaggtgagaacttac

SEQ ID NO: 9096287 - DNA, 22 bp, Homo sapiens
gggctgtgaggtgagaacttac

SEQ ID NO: 9096288 - DNA, 22 bp, Homo sapiens
gggctgtgagagtggggctgct

SEQ ID NO: 9096289 - DNA, 22 bp, Homo sapiens
gggctggatctcacgtgagacc

SEQ ID NO: 9096290 - DNA, 22 bp, Homo sapiens
cagagccagcagtggggacagg

SEQ ID NO: 9096291 - DNA, 22 bp, Homo sapiens
cagagccagaactagaccttgt

SEQ ID NO: 9096292 - DNA, 22 bp, Homo sapiens
cagagccagagacctgctgtgc

SEQ ID NO: 9096293 - DNA, 22 bp, Homo sapiens
gggctggaggagatccagaggc

SEQ ID NO: 9096294 - DNA, 21 bp, Homo sapiens
gggctggaggatgggaagccc

SEQ ID NO: 9096295 - DNA, 22 bp, Homo sapiens
gggctggaggtgagcaggacag

SEQ ID NO: 9096296 - DNA, 22 bp, Homo sapiens
ggggcagatggaacagagcaca

SEQ ID NO: 9096297 - DNA, 22 bp, Homo sapiens
ggggcagatggaacagagcaca

SEQ ID NO: 9096298 - DNA, 22 bp, Homo sapiens
ggggcagagtctggactgttgt

SEQ ID NO: 9096299 - DNA, 23 bp, Homo sapiens
ggggcctgcaccggtctgcgcgg

SEQ ID NO: 9096300 - DNA, 22 bp, Homo sapiens
ggggcctcgccgccgcctctgc

SEQ ID NO: 9096301 - DNA, 22 bp, Homo sapiens
ggggaggaagctctcagttcca

SEQ ID NO: 9096302 - DNA, 22 bp, Homo sapiens
ggggcagagagaaggaagcttg

SEQ ID NO: 9096303 - DNA, 22 bp, Homo sapiens
ggggcagagaataaaaacctaa

SEQ ID NO: 9096304 - DNA, 22 bp, Homo sapiens
ggggcagagtagctggggtgtg

SEQ ID NO: 9096305 - DNA, 22 bp, Homo sapiens
ggggcagagtagctggggtgtg

SEQ ID NO: 9096306 - DNA, 22 bp, Homo sapiens
ggggcagagcatagctccaatt

SEQ ID NO: 9096307 - DNA, 21 bp, Homo sapiens
ggggcagagctaggccctgca

SEQ ID NO: 9096308 - DNA, 21 bp, Homo sapiens
ggggcagagctaggccctgca

SEQ ID NO: 9096309 - DNA, 22 bp, Homo sapiens
gggtaattggaaatattaatag

SEQ ID NO: 9096310 - DNA, 22 bp, Homo sapiens
gggtaatggaggaggcagcccc

SEQ ID NO: 9096311 - DNA, 22 bp, Homo sapiens
gggtaaatctcttttcatggct

SEQ ID NO: 9096312 - DNA, 21 bp, Homo sapiens
ggggttggcaagagcagagac

SEQ ID NO: 9096313 - DNA, 22 bp, Homo sapiens
ggggccttggatctgtgccccg

SEQ ID NO: 9096314 - DNA, 22 bp, Homo sapiens
ggggccttggatctgtgccccg

SEQ ID NO: 9096315 - DNA, 22 bp, Homo sapiens
ggggtgaggtttatgttctggg

SEQ ID NO: 9096316 - DNA, 22 bp, Homo sapiens
ggggccttttctgaatgtggaa

SEQ ID NO: 9096317 - DNA, 22 bp, Homo sapiens
ggggcctgtagagcttcaggga

SEQ ID NO: 9096318 - DNA, 22 bp, Homo sapiens
ggggcctgcgaggttcaacttc

SEQ ID NO: 9096319 - DNA, 19 bp, Homo sapiens
ggggcctgtgatggtcaca

SEQ ID NO: 9096320 - DNA, 22 bp, Homo sapiens
ggggccttggatctgtgccccg

SEQ ID NO: 9096321 - DNA, 20 bp, Homo sapiens
gtacacatatatgtatgtgt

SEQ ID NO: 9096322 - DNA, 22 bp, Homo sapiens
gtacacatatattaaaaattgt

SEQ ID NO: 9096323 - DNA, 22 bp, Homo sapiens
gtacacatatttccaagggtaa

SEQ ID NO: 9096324 - DNA, 23 bp, Homo sapiens
gtacacatagtgtagttatattt

SEQ ID NO: 9096325 - DNA, 22 bp, Homo sapiens
gtacacattatgcttctctaaa

SEQ ID NO: 9096326 - DNA, 22 bp, Homo sapiens
gtacacattgtctgtttacttc

SEQ ID NO: 9096327 - DNA, 22 bp, Homo sapiens
gtacacatactattcaaagaga

SEQ ID NO: 9096328 - DNA, 22 bp, Homo sapiens
gtacacataggttactgattaa

SEQ ID NO: 9096329 - DNA, 22 bp, Homo sapiens
gtaggcaggtggaggagtgaag

SEQ ID NO: 9096330 - DNA, 22 bp, Homo sapiens
gtaggccagtgtgaaacctggt

SEQ ID NO: 9096331 - DNA, 22 bp, Homo sapiens
gtaggcagtgcttgattttcca

SEQ ID NO: 9096332 - DNA, 22 bp, Homo sapiens
gtaggcagtctctcaggtgatc

SEQ ID NO: 9096333 - DNA, 22 bp, Homo sapiens
gtaggcagtctctcaggtgatc

SEQ ID NO: 9096334 - DNA, 22 bp, Homo sapiens
gtaggcagtggttggaagagaa

SEQ ID NO: 9096335 - DNA, 22 bp, Homo sapiens
gtaggcagtggttggaagagaa

SEQ ID NO: 9096336 - DNA, 22 bp, Homo sapiens
gtagaaatatttatctctgaga

SEQ ID NO: 9096337 - DNA, 22 bp, Homo sapiens
gtaggcagataggagtgcagcc

SEQ ID NO: 9096338 - DNA, 22 bp, Homo sapiens
gtaggcagataggagtgcagcc

SEQ ID NO: 9096339 - DNA, 22 bp, Homo sapiens
gtaggcagggctgtggggagaa

SEQ ID NO: 9096340 - DNA, 22 bp, Homo sapiens
gtaggcagggctgtggggagaa

SEQ ID NO: 9096341 - DNA, 22 bp, Homo sapiens
gtaggcagggctgtggggagaa

SEQ ID NO: 9096342 - DNA, 22 bp, Homo sapiens
gtaggcagtctctcaggtgatc

SEQ ID NO: 9096343 - DNA, 22 bp, Homo sapiens
gtaggcaggtggaggagtgaag

SEQ ID NO: 9096344 - DNA, 22 bp, Homo sapiens
gtaggcaggtggaggagtgaag

SEQ ID NO: 9096345 - DNA, 22 bp, Homo sapiens
gtacttctttagtcaatatgta

SEQ ID NO: 9096346 - DNA, 22 bp, Homo sapiens
gtagaaatagtggttgacagga

SEQ ID NO: 9096347 - DNA, 22 bp, Homo sapiens
gtactttgttaccatagctcca

SEQ ID NO: 9096348 - DNA, 22 bp, Homo sapiens
cagcaaaggtagaagcacagga

SEQ ID NO: 9096349 - DNA, 22 bp, Homo sapiens
cagcaaagcttaatttatatct

SEQ ID NO: 9096350 - DNA, 19 bp, Homo sapiens
cagcaaacactgtaaatgg

SEQ ID NO: 9096351 - DNA, 22 bp, Homo sapiens
cagcaaagcaggctcctagaac

SEQ ID NO: 9096352 - DNA, 22 bp, Homo sapiens
cagcaaaatttgaggattgcct

SEQ ID NO: 9096353 - DNA, 22 bp, Homo sapiens
cagcagccactagagggctcac

SEQ ID NO: 9096354 - DNA, 22 bp, Homo sapiens
cagcagccactagagggctcac

SEQ ID NO: 9096355 - DNA, 22 bp, Homo sapiens
cagcagcagattcagcgtctgg

SEQ ID NO: 9096356 - DNA, 22 bp, Homo sapiens
cagcaaaggtagaagcacagga

SEQ ID NO: 9096357 - DNA, 22 bp, Homo sapiens
cagcaaaggtagaagcacagga

SEQ ID NO: 9096358 - DNA, 22 bp, Homo sapiens
cagcagcagattcagcgtctgg

SEQ ID NO: 9096359 - DNA, 22 bp, Homo sapiens
cagcagcctacaatgcacagaa

SEQ ID NO: 9096360 - DNA, 22 bp, Homo sapiens
cagcagcctacaatgcacagaa

SEQ ID NO: 9096361 - DNA, 22 bp, Homo sapiens
cagcagcctacaatgcacagaa

SEQ ID NO: 9096362 - DNA, 22 bp, Homo sapiens
cagcagcctacaatgcacagaa

SEQ ID NO: 9096363 - DNA, 22 bp, Homo sapiens
cagcagccagacaagatacatc

SEQ ID NO: 9096364 - DNA, 22 bp, Homo sapiens
cagcagccatgtaccacactca

SEQ ID NO: 9096365 - DNA, 20 bp, Homo sapiens
cagattctccactaacatat

SEQ ID NO: 9096366 - DNA, 22 bp, Homo sapiens
cagattctcactgtattcaggt

SEQ ID NO: 9096367 - DNA, 22 bp, Homo sapiens
cagattcaacctaagacaatct

SEQ ID NO: 9096368 - DNA, 22 bp, Homo sapiens
cagattagttgtgctatggcct

SEQ ID NO: 9096369 - DNA, 22 bp, Homo sapiens
cagattcttcattcattctaca

SEQ ID NO: 9096370 - DNA, 22 bp, Homo sapiens
cagattcttcattcattctaca

SEQ ID NO: 9096371 - DNA, 22 bp, Homo sapiens
cagattcttctgtatttttgct

SEQ ID NO: 9096372 - DNA, 22 bp, Homo sapiens
cagattcttcattgccccattc

SEQ ID NO: 9096373 - DNA, 22 bp, Homo sapiens
cagattctgaagtctagctgct

SEQ ID NO: 9096374 - DNA, 22 bp, Homo sapiens
cagattctgcagtcaacttgct

SEQ ID NO: 9096375 - DNA, 22 bp, Homo sapiens
cagattctccaggggctgcaga

SEQ ID NO: 9096376 - DNA, 22 bp, Homo sapiens
cagattctccaggggctgcaga

SEQ ID NO: 9096377 - DNA, 22 bp, Homo sapiens
cagattctgaagtctagctgct

SEQ ID NO: 9096378 - DNA, 22 bp, Homo sapiens
cagattctgggcccagcttgtc

SEQ ID NO: 9096379 - DNA, 22 bp, Homo sapiens
cagattctgggcccagcttgtc

SEQ ID NO: 9096380 - DNA, 22 bp, Homo sapiens
cagattcttcattcattctaca

SEQ ID NO: 9096381 - DNA, 22 bp, Homo sapiens
cagattcttaatttatgggatt

SEQ ID NO: 9096382 - DNA, 22 bp, Homo sapiens
cagatttgccacttactcgttg

SEQ ID NO: 9096383 - DNA, 22 bp, Homo sapiens
cagattttgatgaatgtggaaa

SEQ ID NO: 9096384 - DNA, 22 bp, Homo sapiens
cagatttaagatatttgtattg

SEQ ID NO: 9096385 - DNA, 22 bp, Homo sapiens
cagatttcaaggaggcactcca

SEQ ID NO: 9096386 - DNA, 22 bp, Homo sapiens
cagatttattttacatccttca

SEQ ID NO: 9096387 - DNA, 20 bp, Homo sapiens
gtccagagtaatgtgctgac

SEQ ID NO: 9096388 - DNA, 22 bp, Homo sapiens
gtccagaggtccaggatcaagg

SEQ ID NO: 9096389 - DNA, 22 bp, Homo sapiens
gtccagagggtcaagtttcttg

SEQ ID NO: 9096390 - DNA, 22 bp, Homo sapiens
gtccagagggctgcaggatgct

SEQ ID NO: 9096391 - DNA, 22 bp, Homo sapiens
gtccagagatggacgagcagat

SEQ ID NO: 9096392 - DNA, 22 bp, Homo sapiens
gtccagagatggacgagcagat

SEQ ID NO: 9096393 - DNA, 22 bp, Homo sapiens
gtccagagaggcaggaggctac

SEQ ID NO: 9096394 - DNA, 22 bp, Homo sapiens
gtccagagaggcaggaggctac

SEQ ID NO: 9096395 - DNA, 22 bp, Homo sapiens
gtccagagaggcaggaggctac

SEQ ID NO: 9096396 - DNA, 22 bp, Homo sapiens
gtccagagagtaaagggggtaa

SEQ ID NO: 9096397 - DNA, 22 bp, Homo sapiens
gtccagagagtaaagggggtaa

SEQ ID NO: 9096398 - DNA, 22 bp, Homo sapiens
cagcatctgttggatggataag

SEQ ID NO: 9096399 - DNA, 22 bp, Homo sapiens
cagcatctctgggagaagcatc

SEQ ID NO: 9096400 - DNA, 22 bp, Homo sapiens
cagcatctcctgtgcagaggga

SEQ ID NO: 9096401 - DNA, 22 bp, Homo sapiens
cagcatctcctgtgcagaggga

SEQ ID NO: 9096402 - DNA, 22 bp, Homo sapiens
cagcatctcgtggctggataga

SEQ ID NO: 9096403 - DNA, 22 bp, Homo sapiens
cagccagctggtgcggcagagc

SEQ ID NO: 9096404 - DNA, 22 bp, Homo sapiens
cagccagctggcactgtgagta

SEQ ID NO: 9096405 - DNA, 22 bp, Homo sapiens
cagccagctgtcccaagtgcct

SEQ ID NO: 9096406 - DNA, 22 bp, Homo sapiens
cagccagctgtcccaagtgcct

SEQ ID NO: 9096407 - DNA, 22 bp, Homo sapiens
cagccagctgtcccaagtgcct

SEQ ID NO: 9096408 - DNA, 22 bp, Homo sapiens
cagccagcttcagatccaagcc

SEQ ID NO: 9096409 - DNA, 22 bp, Homo sapiens
cagccagcttcagatccaagcc

SEQ ID NO: 9096410 - DNA, 22 bp, Homo sapiens
gtccagcaggatgcaagtgcca

SEQ ID NO: 9096411 - DNA, 22 bp, Homo sapiens
gtccagcatttaggcttgctga

SEQ ID NO: 9096412 - DNA, 22 bp, Homo sapiens
cagccagaacctaggatgagct

SEQ ID NO: 9096413 - DNA, 22 bp, Homo sapiens
cagccagaacctaggatgagct

SEQ ID NO: 9096414 - DNA, 22 bp, Homo sapiens
cagccaggagctccccctgctc

SEQ ID NO: 9096415 - DNA, 22 bp, Homo sapiens
gtcacacaggttgaaatgcagt

SEQ ID NO: 9096416 - DNA, 22 bp, Homo sapiens
gtcacaattataggaactcaga

SEQ ID NO: 9096417 - DNA, 22 bp, Homo sapiens
gtagggacttgttttactagta

SEQ ID NO: 9096418 - DNA, 22 bp, Homo sapiens
gtcacagatggggaaacggagg

SEQ ID NO: 9096419 - DNA, 22 bp, Homo sapiens
gtcacaggaaagggtgtaaggg

SEQ ID NO: 9096420 - DNA, 22 bp, Homo sapiens
gtcacagatctcttgagtcaag

SEQ ID NO: 9096421 - DNA, 22 bp, Homo sapiens
gtcagatctttggggatgctgt

SEQ ID NO: 9096422 - DNA, 22 bp, Homo sapiens
gtcagatctttggggatgctgt

SEQ ID NO: 9096423 - DNA, 22 bp, Homo sapiens
gtcacaggcctggatgaggggc

SEQ ID NO: 9096424 - DNA, 22 bp, Homo sapiens
gtcacagggtccccatatggag

SEQ ID NO: 9096425 - DNA, 22 bp, Homo sapiens
gtcacaggaagcagcaggcact

SEQ ID NO: 9096426 - DNA, 22 bp, Homo sapiens
gtcacaggaagcagcaggcact

SEQ ID NO: 9096427 - DNA, 22 bp, Homo sapiens
gtcacaggcagtaactaggacc

SEQ ID NO: 9096428 - DNA, 22 bp, Homo sapiens
gtcacaggcctggatgaggggc

SEQ ID NO: 9096429 - DNA, 22 bp, Homo sapiens
cagcatctccatggctttggag

SEQ ID NO: 9096430 - DNA, 22 bp, Homo sapiens
gtcagcagtgtcagctctgggg

SEQ ID NO: 9096431 - DNA, 22 bp, Homo sapiens
cagcatcctttgctggtttccc

SEQ ID NO: 9096432 - DNA, 17 bp, Homo sapiens
gtcagcagcttgcttgt

SEQ ID NO: 9096433 - DNA, 22 bp, Homo sapiens
gtcagcagggctccctggcagg

SEQ ID NO: 9096434 - DNA, 22 bp, Homo sapiens
gtcagcagggtccccttgagtg

SEQ ID NO: 9096435 - DNA, 22 bp, Homo sapiens
gtcagcagggtccccttgagtg

SEQ ID NO: 9096436 - DNA, 22 bp, Homo sapiens
gtcagcagtggcagctcccggg

SEQ ID NO: 9096437 - DNA, 22 bp, Homo sapiens
gtcagcagtgtcagctctgggg

SEQ ID NO: 9096438 - DNA, 22 bp, Homo sapiens
gtcagcagaaacgccacatgca

SEQ ID NO: 9096439 - DNA, 22 bp, Homo sapiens
gtcagattaatagcaataataa

SEQ ID NO: 9096440 - DNA, 22 bp, Homo sapiens
gtcagattaatagcaataataa

SEQ ID NO: 9096441 - DNA, 22 bp, Homo sapiens
gtcagcaaaaaatttatgtgag

SEQ ID NO: 9096442 - DNA, 22 bp, Homo sapiens
cagccctgtccctgagggacct

SEQ ID NO: 9096443 - DNA, 22 bp, Homo sapiens
cagccctgtctatgactgatga

SEQ ID NO: 9096444 - DNA, 22 bp, Homo sapiens
cagccctgtccctgagggacct

SEQ ID NO: 9096445 - DNA, 22 bp, Homo sapiens
cagccctggtgaggttggctat

SEQ ID NO: 9096446 - DNA, 22 bp, Homo sapiens
cagccctggccccaggtggtct

SEQ ID NO: 9096447 - DNA, 22 bp, Homo sapiens
cagccctggcccaggtgcctta

SEQ ID NO: 9096448 - DNA, 22 bp, Homo sapiens
cagccctgaaacaacctcctct

SEQ ID NO: 9096449 - DNA, 22 bp, Homo sapiens
cagccctgaaacaacctcctct

SEQ ID NO: 9096450 - DNA, 22 bp, Homo sapiens
cagccctggtgccaaggttccc

SEQ ID NO: 9096451 - DNA, 22 bp, Homo sapiens
cagccctgtccaatgtctgctc

SEQ ID NO: 9096452 - DNA, 22 bp, Homo sapiens
cagccctgtccagcagagggtg

SEQ ID NO: 9096453 - DNA, 22 bp, Homo sapiens
cagccctgtccagcagagggtg

SEQ ID NO: 9096454 - DNA, 22 bp, Homo sapiens
cagccctgtccctgagggacct

SEQ ID NO: 9096455 - DNA, 22 bp, Homo sapiens
cagccctgtccaatgtctgctc

SEQ ID NO: 9096456 - DNA, 22 bp, Homo sapiens
cagccctgtccaatgtctgctc

SEQ ID NO: 9096457 - DNA, 22 bp, Homo sapiens
cagccctgtccaatgtctgctc

SEQ ID NO: 9096458 - DNA, 22 bp, Homo sapiens
cagccctgtccagcagagggtg

SEQ ID NO: 9096459 - DNA, 22 bp, Homo sapiens
cagccctgtccagcagagggtg

SEQ ID NO: 9096460 - DNA, 22 bp, Homo sapiens
gtgagagctgctccagatctct

SEQ ID NO: 9096461 - DNA, 22 bp, Homo sapiens
gtgagagggctgggctcatgat

SEQ ID NO: 9096462 - DNA, 22 bp, Homo sapiens
gtgagagggctgggctcatgat

SEQ ID NO: 9096463 - DNA, 22 bp, Homo sapiens
gtgagagggctgggctcatgat

SEQ ID NO: 9096464 - DNA, 22 bp, Homo sapiens
gtgagaggttcctgttagaact

SEQ ID NO: 9096465 - DNA, 22 bp, Homo sapiens
gtgagagggctgggctcatgat

SEQ ID NO: 9096466 - DNA, 22 bp, Homo sapiens
gtgagagcctgtctggatgtcg

SEQ ID NO: 9096467 - DNA, 22 bp, Homo sapiens
gtgagagatgctttcttaacgc

SEQ ID NO: 9096468 - DNA, 22 bp, Homo sapiens
gtcctgtgccgaggtgggaagc

SEQ ID NO: 9096469 - DNA, 22 bp, Homo sapiens
gtcctgtgccctgggtggcgct

SEQ ID NO: 9096470 - DNA, 22 bp, Homo sapiens
gtcctgtgcaccgtgggatgtt

SEQ ID NO: 9096471 - DNA, 22 bp, Homo sapiens
gtcctgtgagattcatgctcaa

SEQ ID NO: 9096472 - DNA, 22 bp, Homo sapiens
gtcctgtgacctgcatcctgag

SEQ ID NO: 9096473 - DNA, 22 bp, Homo sapiens
gtcctgtcccccaaggctgtgg

SEQ ID NO: 9096474 - DNA, 22 bp, Homo sapiens
gtcctgtcccccaaggctgtgg

SEQ ID NO: 9096475 - DNA, 22 bp, Homo sapiens
gtcctggttttcacagaccttt

SEQ ID NO: 9096476 - DNA, 22 bp, Homo sapiens
gtcctggtcctgcctccccatg

SEQ ID NO: 9096477 - DNA, 22 bp, Homo sapiens
gtcctggtgccacctgcgggat

SEQ ID NO: 9096478 - DNA, 22 bp, Homo sapiens
gtcctggtggagtctctgggga

SEQ ID NO: 9096479 - DNA, 17 bp, Homo sapiens
gtcctggtgtgtgagga

SEQ ID NO: 9096480 - DNA, 22 bp, Homo sapiens
cagccctcctaccctgccaggc

SEQ ID NO: 9096481 - DNA, 22 bp, Homo sapiens
cagccctcctaccctgccaggc

SEQ ID NO: 9096482 - DNA, 20 bp, Homo sapiens
cagccctccagtggaggcag

SEQ ID NO: 9096483 - DNA, 20 bp, Homo sapiens
cagccctccagtggaggcag

SEQ ID NO: 9096484 - DNA, 22 bp, Homo sapiens
cagccctctgaagaggcgcttg

SEQ ID NO: 9096485 - DNA, 22 bp, Homo sapiens
cagccctcctttcactcccagg

SEQ ID NO: 9096486 - DNA, 22 bp, Homo sapiens
cagccctctctgggccccaagg

SEQ ID NO: 9096487 - DNA, 19 bp, Homo sapiens
cagccctcttaccactgtg

SEQ ID NO: 9096488 - DNA, 22 bp, Homo sapiens
cagccctgaaacaacctcctct

SEQ ID NO: 9096489 - DNA, 19 bp, Homo sapiens
cagccctcttaccactgtg

SEQ ID NO: 9096490 - DNA, 22 bp, Homo sapiens
gtgagatggagttggtgtcttt

SEQ ID NO: 9096491 - DNA, 18 bp, Homo sapiens
gtgagcagagagcatcac

SEQ ID NO: 9096492 - DNA, 22 bp, Homo sapiens
gtgagcagaacaggtggcttct

SEQ ID NO: 9096493 - DNA, 22 bp, Homo sapiens
gtgagcagaataagggttgaga

SEQ ID NO: 9096494 - DNA, 22 bp, Homo sapiens
cagccctcatcccgcctgcgtt

SEQ ID NO: 9096495 - DNA, 22 bp, Homo sapiens
cagccctcatctcagcttcttt

SEQ ID NO: 9096496 - DNA, 22 bp, Homo sapiens
cactatatgcctttgaaataca

SEQ ID NO: 9096497 - DNA, 22 bp, Homo sapiens
cactatatctgttcttgtttat

SEQ ID NO: 9096498 - DNA, 22 bp, Homo sapiens
cactatatctctttcatctttt

SEQ ID NO: 9096499 - DNA, 22 bp, Homo sapiens
cactatatctctttcatctttt

SEQ ID NO: 9096500 - DNA, 22 bp, Homo sapiens
cactagttcacaaaataggaaa

SEQ ID NO: 9096501 - DNA, 22 bp, Homo sapiens
cactagtaattcttgtgctgga

SEQ ID NO: 9096502 - DNA, 21 bp, Homo sapiens
cactccacttagaacagggtt

SEQ ID NO: 9096503 - DNA, 21 bp, Homo sapiens
cactccacttagaacagggtt

SEQ ID NO: 9096504 - DNA, 21 bp, Homo sapiens
cactccacttagaacagggtt

SEQ ID NO: 9096505 - DNA, 21 bp, Homo sapiens
cactccacttagaacagggtt

SEQ ID NO: 9096506 - DNA, 20 bp, Homo sapiens
cactctaaccatatttcctc

SEQ ID NO: 9096507 - DNA, 22 bp, Homo sapiens
cactctaacctccatcttccat

SEQ ID NO: 9096508 - DNA, 22 bp, Homo sapiens
cactcctgttccactaaatgag

SEQ ID NO: 9096509 - DNA, 22 bp, Homo sapiens
cactcccttcaggagcctagga

SEQ ID NO: 9096510 - DNA, 22 bp, Homo sapiens
cactgcactccagcctgggaga

SEQ ID NO: 9096511 - DNA, 22 bp, Homo sapiens
cactgcaacctccacctcctgg

SEQ ID NO: 9096512 - DNA, 22 bp, Homo sapiens
cactctgactggccctgcagga

SEQ ID NO: 9096513 - DNA, 22 bp, Homo sapiens
cactctgaactattaacttggg

SEQ ID NO: 9096514 - DNA, 22 bp, Homo sapiens
cactctgacacatgaacttgat

SEQ ID NO: 9096515 - DNA, 22 bp, Homo sapiens
cactgcactccagcctgggaga

SEQ ID NO: 9096516 - DNA, 22 bp, Homo sapiens
cactgcactccagcctgggaga

SEQ ID NO: 9096517 - DNA, 22 bp, Homo sapiens
cactgcactccagcctgggaga

SEQ ID NO: 9096518 - DNA, 22 bp, Homo sapiens
caccaggctgaaccagagggga

SEQ ID NO: 9096519 - DNA, 22 bp, Homo sapiens
caccaggctgcccaggacaggg

SEQ ID NO: 9096520 - DNA, 22 bp, Homo sapiens
caccaggcacagctctcctgct

SEQ ID NO: 9096521 - DNA, 20 bp, Homo sapiens
caccaggcgctctgagaaca

SEQ ID NO: 9096522 - DNA, 22 bp, Homo sapiens
cacctgcctcatttgtccctgc

SEQ ID NO: 9096523 - DNA, 22 bp, Homo sapiens
cacctgccctttcttgctccac

SEQ ID NO: 9096524 - DNA, 22 bp, Homo sapiens
cacctgcctgcaggggctccac

SEQ ID NO: 9096525 - DNA, 22 bp, Homo sapiens
cacctgcctgctagagcctgac

SEQ ID NO: 9096526 - DNA, 22 bp, Homo sapiens
cacctgcctgctagagcctgac

SEQ ID NO: 9096527 - DNA, 22 bp, Homo sapiens
caccaggctggagtgcagaggt

SEQ ID NO: 9096528 - DNA, 20 bp, Homo sapiens
cacctggatatgacccagct

SEQ ID NO: 9096529 - DNA, 22 bp, Homo sapiens
cacctgcctggtccttagggct

SEQ ID NO: 9096530 - DNA, 22 bp, Homo sapiens
cacctgggctaaactatgcagg

SEQ ID NO: 9096531 - DNA, 22 bp, Homo sapiens
ggccaggctgccctgggagcag

SEQ ID NO: 9096532 - DNA, 22 bp, Homo sapiens
ggccaggctggtctcagacttc

SEQ ID NO: 9096533 - DNA, 22 bp, Homo sapiens
ggccaggctggtctcagacttc

SEQ ID NO: 9096534 - DNA, 22 bp, Homo sapiens
ggccaggctggtctcagacttc

SEQ ID NO: 9096535 - DNA, 22 bp, Homo sapiens
ggccaggctggtctcagacttc

SEQ ID NO: 9096536 - DNA, 22 bp, Homo sapiens
ggccaggctggttccttgacct

SEQ ID NO: 9096537 - DNA, 22 bp, Homo sapiens
cactgcactccagcttgggtga

SEQ ID NO: 9096538 - DNA, 22 bp, Homo sapiens
cactgcactccagcttgggtga

SEQ ID NO: 9096539 - DNA, 22 bp, Homo sapiens
cactgcactccagcctgggtga

SEQ ID NO: 9096540 - DNA, 22 bp, Homo sapiens
cactgcactccagcctgggtga

SEQ ID NO: 9096541 - DNA, 22 bp, Homo sapiens
cactgcactccagcctgggtga

SEQ ID NO: 9096542 - DNA, 22 bp, Homo sapiens
cactgcactccagcctgggtga

SEQ ID NO: 9096543 - DNA, 22 bp, Homo sapiens
cactgcactccagcctgggtga

SEQ ID NO: 9096544 - DNA, 22 bp, Homo sapiens
cactgcactccagcctgggtca

SEQ ID NO: 9096545 - DNA, 22 bp, Homo sapiens
cactgcactccagcctgggtca

SEQ ID NO: 9096546 - DNA, 22 bp, Homo sapiens
cactgcactccagcctgggtca

SEQ ID NO: 9096547 - DNA, 22 bp, Homo sapiens
cactgcactccagcctgggaga

SEQ ID NO: 9096548 - DNA, 22 bp, Homo sapiens
cactgcactccagcctgggtca

SEQ ID NO: 9096549 - DNA, 22 bp, Homo sapiens
cactgcactccagcctgggtca

SEQ ID NO: 9096550 - DNA, 22 bp, Homo sapiens
ggctctgcttcagaaggctcat

SEQ ID NO: 9096551 - DNA, 22 bp, Homo sapiens
ggctctgcttgaggccagcctg

SEQ ID NO: 9096552 - DNA, 22 bp, Homo sapiens
ggctctgcttctcacctgttcc

SEQ ID NO: 9096553 - DNA, 22 bp, Homo sapiens
cactggtgtctgagcagggtga

SEQ ID NO: 9096554 - DNA, 22 bp, Homo sapiens
cactggtgtattagagctagaa

SEQ ID NO: 9096555 - DNA, 23 bp, Homo sapiens
cactggtggggtttaaaagaagc

SEQ ID NO: 9096556 - DNA, 22 bp, Homo sapiens
cactggtgatgaggcagttagg

SEQ ID NO: 9096557 - DNA, 22 bp, Homo sapiens
cactgggcaattctgagcctaa

SEQ ID NO: 9096558 - DNA, 22 bp, Homo sapiens
cacttaaatgttcctacagcag

SEQ ID NO: 9096559 - DNA, 20 bp, Homo sapiens
ggctctggaatctggtgggc

SEQ ID NO: 9096560 - DNA, 22 bp, Homo sapiens
cactgtgctccttccttagcac

SEQ ID NO: 9096561 - DNA, 20 bp, Homo sapiens
ggctctggaatctggtgggc

SEQ ID NO: 9096562 - DNA, 22 bp, Homo sapiens
ggctctgcttgaggccagcctg

SEQ ID NO: 9096563 - DNA, 22 bp, Homo sapiens
ggctctggaaagtgtccttgat

SEQ ID NO: 9096564 - DNA, 22 bp, Homo sapiens
ggctctggaaagtgtccttgat

SEQ ID NO: 9096565 - DNA, 22 bp, Homo sapiens
cacttaagcagttaatttatct

SEQ ID NO: 9096566 - DNA, 22 bp, Homo sapiens
cacttatctcatttaatcacca

SEQ ID NO: 9096567 - DNA, 22 bp, Homo sapiens
cacttcaaataagctcttctca

SEQ ID NO: 9096568 - DNA, 22 bp, Homo sapiens
cacttcaaatatggcttcatga

SEQ ID NO: 9096569 - DNA, 22 bp, Homo sapiens
cacttcaaatatggcttcatga

SEQ ID NO: 9096570 - DNA, 22 bp, Homo sapiens
cacttcaacctctgagtcctgg

SEQ ID NO: 9096571 - DNA, 22 bp, Homo sapiens
cacttcaagagcaagggtgcca

SEQ ID NO: 9096572 - DNA, 22 bp, Homo sapiens
cacttcaacagttatttcttag

SEQ ID NO: 9096573 - DNA, 22 bp, Homo sapiens
cacttcaacagttatttcttag

SEQ ID NO: 9096574 - DNA, 22 bp, Homo sapiens
cacttcaatctctgcctccatc

SEQ ID NO: 9096575 - DNA, 22 bp, Homo sapiens
cacttcaattaacttcagcatt

SEQ ID NO: 9096576 - DNA, 22 bp, Homo sapiens
cacttcaaggaatatctagaaa

SEQ ID NO: 9096577 - DNA, 19 bp, Homo sapiens
cacttcaatcctttatcaa

SEQ ID NO: 9096578 - DNA, 19 bp, Homo sapiens
cacttcaatcctttatcaa

SEQ ID NO: 9096579 - DNA, 22 bp, Homo sapiens
cacttgagttcttaatagtcag

SEQ ID NO: 9096580 - DNA, 22 bp, Homo sapiens
cacttgagttcttaatagtcag

SEQ ID NO: 9096581 - DNA, 22 bp, Homo sapiens
cacttgttggtggtgaaatcac

SEQ ID NO: 9096582 - DNA, 22 bp, Homo sapiens
cacttggtttgggagtacataa

SEQ ID NO: 9096583 - DNA, 22 bp, Homo sapiens
caccactggaggtcttggcttt

SEQ ID NO: 9096584 - DNA, 22 bp, Homo sapiens
cacattccttacattcatagag

SEQ ID NO: 9096585 - DNA, 22 bp, Homo sapiens
cacattcctgagcttcgacctg

SEQ ID NO: 9096586 - DNA, 22 bp, Homo sapiens
cacattcctggtgctcagcagc

SEQ ID NO: 9096587 - DNA, 22 bp, Homo sapiens
caccactgcttcctgccatctg

SEQ ID NO: 9096588 - DNA, 21 bp, Homo sapiens
cacattccatgggtctattta

SEQ ID NO: 9096589 - DNA, 22 bp, Homo sapiens
cacattccccagagctggggct

SEQ ID NO: 9096590 - DNA, 22 bp, Homo sapiens
caccagcttgggctgtggaaat

SEQ ID NO: 9096591 - DNA, 22 bp, Homo sapiens
caccagcttctcattgcgggtc

SEQ ID NO: 9096592 - DNA, 22 bp, Homo sapiens
caccagctttgcccactgccca

SEQ ID NO: 9096593 - DNA, 22 bp, Homo sapiens
cacatgtttgctacatttttct

SEQ ID NO: 9096594 - DNA, 22 bp, Homo sapiens
cacatgttcttgaagccaactc

SEQ ID NO: 9096595 - DNA, 22 bp, Homo sapiens
cacattatgctactaccaaatg

SEQ ID NO: 9096596 - DNA, 22 bp, Homo sapiens
cacattaaaatcctaacttcca

SEQ ID NO: 9096597 - DNA, 20 bp, Homo sapiens
cacattaaggaaaacaactg

SEQ ID NO: 9096598 - DNA, 18 bp, Homo sapiens
ggcagatgacaggagaga

SEQ ID NO: 9096599 - DNA, 22 bp, Homo sapiens
ggcagagttggtggagtcagtt

SEQ ID NO: 9096600 - DNA, 22 bp, Homo sapiens
cacatgcaagtcctcagttcta

SEQ ID NO: 9096601 - DNA, 22 bp, Homo sapiens
cacatgcaccagaaatcaacat

SEQ ID NO: 9096602 - DNA, 22 bp, Homo sapiens
cacatgagtgtaggaagaggga

SEQ ID NO: 9096603 - DNA, 22 bp, Homo sapiens
cacatgagtgagaacatgcagt

SEQ ID NO: 9096604 - DNA, 22 bp, Homo sapiens
cacatgagtcctgccaggtatg

SEQ ID NO: 9096605 - DNA, 22 bp, Homo sapiens
ggcagaggtgacagtgtctttt

SEQ ID NO: 9096606 - DNA, 22 bp, Homo sapiens
ggcagaggtgacagtgtctttt

SEQ ID NO: 9096607 - DNA, 22 bp, Homo sapiens
cacatgagacaattaaagactt

SEQ ID NO: 9096608 - DNA, 22 bp, Homo sapiens
cacatgagacaattaaagactt

SEQ ID NO: 9096609 - DNA, 22 bp, Homo sapiens
cacatgaggtggagatgaatga

SEQ ID NO: 9096610 - DNA, 22 bp, Homo sapiens
cacatgaggtgacttccaagct

SEQ ID NO: 9096611 - DNA, 19 bp, Homo sapiens
cacatgagggctgagggac

SEQ ID NO: 9096612 - DNA, 22 bp, Homo sapiens
cacatgagagcccccaagagca

SEQ ID NO: 9096613 - DNA, 22 bp, Homo sapiens
cacatgagagcccccaagagca

SEQ ID NO: 9096614 - DNA, 22 bp, Homo sapiens
cacatgaaggctggggtcgtga

SEQ ID NO: 9096615 - DNA, 22 bp, Homo sapiens
cacatgaaggctggggtcgtga

SEQ ID NO: 9096616 - DNA, 22 bp, Homo sapiens
cacatgaagattcaactggatg

SEQ ID NO: 9096617 - DNA, 22 bp, Homo sapiens
cacatgaattcacatgtatttt

SEQ ID NO: 9096618 - DNA, 20 bp, Homo sapiens
ggcaatcctaacgtgttcca

SEQ ID NO: 9096619 - DNA, 22 bp, Homo sapiens
ggcaatatttatataggcaagg

SEQ ID NO: 9096620 - DNA, 22 bp, Homo sapiens
ggcaatatggaagctacagaga

SEQ ID NO: 9096621 - DNA, 22 bp, Homo sapiens
ggcaatgtagattctgtagatt

SEQ ID NO: 9096622 - DNA, 22 bp, Homo sapiens
ggcaatagttgtgggttcttta

SEQ ID NO: 9096623 - DNA, 22 bp, Homo sapiens
ggcaataatgacattttaaaaa

SEQ ID NO: 9096624 - DNA, 22 bp, Homo sapiens
ggcaataatctactctgccact

SEQ ID NO: 9096625 - DNA, 22 bp, Homo sapiens
ggcaataaaagtatccagtttc

SEQ ID NO: 9096626 - DNA, 22 bp, Homo sapiens
ggcaagttctaatgattagaat

SEQ ID NO: 9096627 - DNA, 23 bp, Homo sapiens
ggcaataacgagcttgtctctga

SEQ ID NO: 9096628 - DNA, 22 bp, Homo sapiens
ggcaataaatgacttctgcatt

SEQ ID NO: 9096629 - DNA, 22 bp, Homo sapiens
ggcaatttcatgtggtttaaac

SEQ ID NO: 9096630 - DNA, 22 bp, Homo sapiens
ggcaatttggtcatttgtattg

SEQ ID NO: 9096631 - DNA, 16 bp, Homo sapiens
cacatatatttatatg

SEQ ID NO: 9096632 - DNA, 22 bp, Homo sapiens
cacagtgcgaaagaaacccagc

SEQ ID NO: 9096633 - DNA, 22 bp, Homo sapiens
cacagtgcatgatgggcagaag

SEQ ID NO: 9096634 - DNA, 22 bp, Homo sapiens
cacagtgcatgatgggcagaag

SEQ ID NO: 9096635 - DNA, 22 bp, Homo sapiens
ggcaaggggtcaggctgagaca

SEQ ID NO: 9096636 - DNA, 22 bp, Homo sapiens
ggcaagtcaggaagttgacatt

SEQ ID NO: 9096637 - DNA, 22 bp, Homo sapiens
ggcaaggtactctagagcacat

SEQ ID NO: 9096638 - DNA, 19 bp, Homo sapiens
cacagtgcagccatttctc

SEQ ID NO: 9096639 - DNA, 22 bp, Homo sapiens
cacagtgcactaagctccgggg

SEQ ID NO: 9096640 - DNA, 22 bp, Homo sapiens
cacagtgcaatcggccacaaat

SEQ ID NO: 9096641 - DNA, 22 bp, Homo sapiens
cacagtgagctgggcatcagtt

SEQ ID NO: 9096642 - DNA, 22 bp, Homo sapiens
cacagtgactggcacatagtaa

SEQ ID NO: 9096643 - DNA, 22 bp, Homo sapiens
cacagtcctgccagagggcctt

SEQ ID NO: 9096644 - DNA, 22 bp, Homo sapiens
cacagtcttatcccaaccacca

SEQ ID NO: 9096645 - DNA, 22 bp, Homo sapiens
cacagtgaagcatgcagacatc

SEQ ID NO: 9096646 - DNA, 22 bp, Homo sapiens
cacaggtgtgtcctggtcttgt

SEQ ID NO: 9096647 - DNA, 22 bp, Homo sapiens
cacaggcacccctgactgctca

SEQ ID NO: 9096648 - DNA, 22 bp, Homo sapiens
cacaggcacccctgactgctca

SEQ ID NO: 9096649 - DNA, 23 bp, Homo sapiens
cacaggcagaaatcaagacggta

SEQ ID NO: 9096650 - DNA, 22 bp, Homo sapiens
cacaggcacgcctctggccagg

SEQ ID NO: 9096651 - DNA, 22 bp, Homo sapiens
cacaggcacgcctctggccagg

SEQ ID NO: 9096652 - DNA, 22 bp, Homo sapiens
cacaggcacgcctctggccagg

SEQ ID NO: 9096653 - DNA, 22 bp, Homo sapiens
cacaggcagccttgtagaagaa

SEQ ID NO: 9096654 - DNA, 23 bp, Homo sapiens
cacaggcagaaatcaagacggta

SEQ ID NO: 9096655 - DNA, 22 bp, Homo sapiens
cacaggcaggaggttctccagt

SEQ ID NO: 9096656 - DNA, 22 bp, Homo sapiens
cacaggcaggaggttctccagt

SEQ ID NO: 9096657 - DNA, 22 bp, Homo sapiens
ggagagcattcttagtctgttt

SEQ ID NO: 9096658 - DNA, 20 bp, Homo sapiens
ggagagccacatagtctccc

SEQ ID NO: 9096659 - DNA, 22 bp, Homo sapiens
cacaggagtgctgctattgttg

SEQ ID NO: 9096660 - DNA, 22 bp, Homo sapiens
cacaggaggttaggaagtggtc

SEQ ID NO: 9096661 - DNA, 18 bp, Homo sapiens
cacaggagccacactcac

SEQ ID NO: 9096662 - DNA, 22 bp, Homo sapiens
cacaggaggttaggaagtggtc

SEQ ID NO: 9096663 - DNA, 18 bp, Homo sapiens
cacaggcaggtgataggt

SEQ ID NO: 9096664 - DNA, 18 bp, Homo sapiens
cacaggcaggtgataggt

SEQ ID NO: 9096665 - DNA, 18 bp, Homo sapiens
cacaggcaggtgataggt

SEQ ID NO: 9096666 - DNA, 22 bp, Homo sapiens
cacaggccagtaagactgtgtt

SEQ ID NO: 9096667 - DNA, 22 bp, Homo sapiens
cacaggccaataccctctctct

SEQ ID NO: 9096668 - DNA, 22 bp, Homo sapiens
cacaggccagtaagactgtgtt

SEQ ID NO: 9096669 - DNA, 22 bp, Homo sapiens
cacaggccagtaagactgtgtt

SEQ ID NO: 9096670 - DNA, 20 bp, Homo sapiens
cacaggccccaagacctgta

SEQ ID NO: 9096671 - DNA, 22 bp, Homo sapiens
cacaggcctgtctctttctaac

SEQ ID NO: 9096672 - DNA, 20 bp, Homo sapiens
cacaggccttgtgagcagac

SEQ ID NO: 9096673 - DNA, 20 bp, Homo sapiens
cacaggccttgtgagcagac

SEQ ID NO: 9096674 - DNA, 20 bp, Homo sapiens
cacaggccttgtgagcagac

SEQ ID NO: 9096675 - DNA, 22 bp, Homo sapiens
cacagggcaggtactctcagag

SEQ ID NO: 9096676 - DNA, 22 bp, Homo sapiens
cacagggctttgatggctgagt

SEQ ID NO: 9096677 - DNA, 22 bp, Homo sapiens
cacagggctttgatggctgagt

SEQ ID NO: 9096678 - DNA, 22 bp, Homo sapiens
cacaggtaatagcctaggctat

SEQ ID NO: 9096679 - DNA, 22 bp, Homo sapiens
cacagggttgttctgaggattc

SEQ ID NO: 9096680 - DNA, 22 bp, Homo sapiens
cacaggggcaaactgtagggga

SEQ ID NO: 9096681 - DNA, 22 bp, Homo sapiens
cacaggtccttcctgccctggg

SEQ ID NO: 9096682 - DNA, 22 bp, Homo sapiens
cacaggtccttcctgccctggg

SEQ ID NO: 9096683 - DNA, 22 bp, Homo sapiens
gctgcctgatttacatagtgaa

SEQ ID NO: 9096684 - DNA, 22 bp, Homo sapiens
caagaacattgtgatcacttca

SEQ ID NO: 9096685 - DNA, 22 bp, Homo sapiens
caagaaatgtttactgagcatc

SEQ ID NO: 9096686 - DNA, 22 bp, Homo sapiens
caagaaattctgttcagatagc

SEQ ID NO: 9096687 - DNA, 22 bp, Homo sapiens
gctgccctgtctgcagcaggac

SEQ ID NO: 9096688 - DNA, 22 bp, Homo sapiens
gctgccctgtctgcagcaggac

SEQ ID NO: 9096689 - DNA, 22 bp, Homo sapiens
caacaagcgctcagagcaaagc

SEQ ID NO: 9096690 - DNA, 22 bp, Homo sapiens
caaattttgtgtgttctctagt

SEQ ID NO: 9096691 - DNA, 22 bp, Homo sapiens
caacaagcgctcagagcaaagc

SEQ ID NO: 9096692 - DNA, 22 bp, Homo sapiens
caacaagtgttcgtaaagtgcc

SEQ ID NO: 9096693 - DNA, 22 bp, Homo sapiens
caacactgacaatggactgatt

SEQ ID NO: 9096694 - DNA, 22 bp, Homo sapiens
caacacaggttctgcaaaggaa

SEQ ID NO: 9096695 - DNA, 22 bp, Homo sapiens
caaagtcagccagctagtaggt

SEQ ID NO: 9096696 - DNA, 17 bp, Homo sapiens
gctctggcacaggattg

SEQ ID NO: 9096697 - DNA, 22 bp, Homo sapiens
caaagtcagggaagagtggctg

SEQ ID NO: 9096698 - DNA, 22 bp, Homo sapiens
caaagtcatggggatgcaggtc

SEQ ID NO: 9096699 - DNA, 22 bp, Homo sapiens
gctctgctgtgtttgttcagca

SEQ ID NO: 9096700 - DNA, 22 bp, Homo sapiens
gctctgcttgcatcatgactgc

SEQ ID NO: 9096701 - DNA, 22 bp, Homo sapiens
gctctgctttctggggggatcc

SEQ ID NO: 9096702 - DNA, 22 bp, Homo sapiens
caaagtgcagaaggaactgggt

SEQ ID NO: 9096703 - DNA, 22 bp, Homo sapiens
caaagtgagttataaacatctt

SEQ ID NO: 9096704 - DNA, 22 bp, Homo sapiens
caaagtgcctgtaccactttgc

SEQ ID NO: 9096705 - DNA, 22 bp, Homo sapiens
caaagtgagagaatggcagaaa

SEQ ID NO: 9096706 - DNA, 22 bp, Homo sapiens
caaagtgagagaatggcagaaa

SEQ ID NO: 9096707 - DNA, 22 bp, Homo sapiens
caaagtgctaggattacaggcg

SEQ ID NO: 9096708 - DNA, 22 bp, Homo sapiens
caaagtgctaggattacaggcc

SEQ ID NO: 9096709 - DNA, 22 bp, Homo sapiens
caaagtgctaggattacaggcc

SEQ ID NO: 9096710 - DNA, 22 bp, Homo sapiens
caaagtgctaggattacaggcg

SEQ ID NO: 9096711 - DNA, 22 bp, Homo sapiens
caaagtgctaggattataggtg

SEQ ID NO: 9096712 - DNA, 17 bp, Homo sapiens
gctgccacctttggagc

SEQ ID NO: 9096713 - DNA, 22 bp, Homo sapiens
gctgccacgatctctgctgtag

SEQ ID NO: 9096714 - DNA, 22 bp, Homo sapiens
gctgccctcccagggcaagctt

SEQ ID NO: 9096715 - DNA, 22 bp, Homo sapiens
caagcctgtctcaccagtgcta

SEQ ID NO: 9096716 - DNA, 22 bp, Homo sapiens
caagcctgtctcaccagtgcta

SEQ ID NO: 9096717 - DNA, 22 bp, Homo sapiens
caagctccttacatccacaggg

SEQ ID NO: 9096718 - DNA, 22 bp, Homo sapiens
caagctctgggatagcagagag

SEQ ID NO: 9096719 - DNA, 22 bp, Homo sapiens
gctgggctcaccaggccactag

SEQ ID NO: 9096720 - DNA, 22 bp, Homo sapiens
gctggggagcaagagtagtgag

SEQ ID NO: 9096721 - DNA, 22 bp, Homo sapiens
gctggggagcaagagtagtgag

SEQ ID NO: 9096722 - DNA, 22 bp, Homo sapiens
gctggggactccccaccatagc

SEQ ID NO: 9096723 - DNA, 20 bp, Homo sapiens
gctgggctttgactgacaca

SEQ ID NO: 9096724 - DNA, 22 bp, Homo sapiens
gctgggcttgtggccagctggg

SEQ ID NO: 9096725 - DNA, 19 bp, Homo sapiens
gctggggaatggatattga

SEQ ID NO: 9096726 - DNA, 22 bp, Homo sapiens
gctggctgaggtctagctcttt

SEQ ID NO: 9096727 - DNA, 22 bp, Homo sapiens
gctggctgaggtctagctcttt

SEQ ID NO: 9096728 - DNA, 22 bp, Homo sapiens
gctggctgaggtctagctcttt

SEQ ID NO: 9096729 - DNA, 22 bp, Homo sapiens
gctggctgagttctgtcgtctg

SEQ ID NO: 9096730 - DNA, 22 bp, Homo sapiens
gctggctgagttctgtcgtctg

SEQ ID NO: 9096731 - DNA, 22 bp, Homo sapiens
caagcccaggattccccagtta

SEQ ID NO: 9096732 - DNA, 22 bp, Homo sapiens
caagcccccggcaagtgtgtat

SEQ ID NO: 9096733 - DNA, 20 bp, Homo sapiens
caagccctctttagcctgcc

SEQ ID NO: 9096734 - DNA, 22 bp, Homo sapiens
caagccctgttaggggtctcta

SEQ ID NO: 9096735 - DNA, 22 bp, Homo sapiens
gctggcccagggtcacctagga

SEQ ID NO: 9096736 - DNA, 22 bp, Homo sapiens
gctggcccagggtcacctagga

SEQ ID NO: 9096737 - DNA, 20 bp, Homo sapiens
gctggctgaactgaaagcaa

SEQ ID NO: 9096738 - DNA, 22 bp, Homo sapiens
gctggctgaatcttctgcaata

SEQ ID NO: 9096739 - DNA, 20 bp, Homo sapiens
gctggctgaactgaaagcaa

SEQ ID NO: 9096740 - DNA, 22 bp, Homo sapiens
gctggctctttttgccgggctc

SEQ ID NO: 9096741 - DNA, 22 bp, Homo sapiens
gctggctgacagatttggggtg

SEQ ID NO: 9096742 - DNA, 17 bp, Homo sapiens
gctggctgacccatgcc

SEQ ID NO: 9096743 - DNA, 22 bp, Homo sapiens
gctggctgagcactggtttata

SEQ ID NO: 9096744 - DNA, 22 bp, Homo sapiens
gctggctgagatctgttttcct

SEQ ID NO: 9096745 - DNA, 22 bp, Homo sapiens
caagaagttgacagccaggtga

SEQ ID NO: 9096746 - DNA, 22 bp, Homo sapiens
gctggaccaggtgtgcacaggc

SEQ ID NO: 9096747 - DNA, 22 bp, Homo sapiens
gctggacttagaggtggaaaag

SEQ ID NO: 9096748 - DNA, 22 bp, Homo sapiens
gctggactcaggggactcaggg

SEQ ID NO: 9096749 - DNA, 22 bp, Homo sapiens
caagaattaagaattttgatgt

SEQ ID NO: 9096750 - DNA, 22 bp, Homo sapiens
caagaatataaatactttcaaa

SEQ ID NO: 9096751 - DNA, 22 bp, Homo sapiens
caagaatataaatactttcaaa

SEQ ID NO: 9096752 - DNA, 22 bp, Homo sapiens
caagaatataaatactttcaaa

SEQ ID NO: 9096753 - DNA, 22 bp, Homo sapiens
gctgcctgcctagttccacagt

SEQ ID NO: 9096754 - DNA, 18 bp, Homo sapiens
gctgcctgcattcctcac

SEQ ID NO: 9096755 - DNA, 22 bp, Homo sapiens
gctgcctgcacagagctgcttt

SEQ ID NO: 9096756 - DNA, 22 bp, Homo sapiens
gctggaaggctaggctcagttg

SEQ ID NO: 9096757 - DNA, 22 bp, Homo sapiens
gctgctttttggatttggcaca

SEQ ID NO: 9096758 - DNA, 22 bp, Homo sapiens
gctgcttttcacagagacaaga

SEQ ID NO: 9096759 - DNA, 22 bp, Homo sapiens
gctgctttctgttaggaattgg

SEQ ID NO: 9096760 - DNA, 22 bp, Homo sapiens
gctgctttgaaagaggagcttt

SEQ ID NO: 9096761 - DNA, 22 bp, Homo sapiens
gctgctttctgttaggaattgg

SEQ ID NO: 9096762 - DNA, 22 bp, Homo sapiens
gctgctttgacagtgggaacag

SEQ ID NO: 9096763 - DNA, 22 bp, Homo sapiens
gctgctttgacagtgggaacag

SEQ ID NO: 9096764 - DNA, 22 bp, Homo sapiens
gctgctttggaaagcatggaaa

SEQ ID NO: 9096765 - DNA, 22 bp, Homo sapiens
gctgctttgatatgcaaggaac

SEQ ID NO: 9096766 - DNA, 22 bp, Homo sapiens
cacaaatggttgtagacattaa

SEQ ID NO: 9096767 - DNA, 23 bp, Homo sapiens
cacaactaatcagaatctctagg

SEQ ID NO: 9096768 - DNA, 22 bp, Homo sapiens
cacaaatgtgcagaaatgtgag

SEQ ID NO: 9096769 - DNA, 22 bp, Homo sapiens
cacaacttagcaatgttttaga

SEQ ID NO: 9096770 - DNA, 22 bp, Homo sapiens
ggacatttagaacagagtattt

SEQ ID NO: 9096771 - DNA, 22 bp, Homo sapiens
ggacatggagctccatggaggc

SEQ ID NO: 9096772 - DNA, 22 bp, Homo sapiens
ggacatttcataagaccattct

SEQ ID NO: 9096773 - DNA, 22 bp, Homo sapiens
ggaagctccccaagcctgccct

SEQ ID NO: 9096774 - DNA, 22 bp, Homo sapiens
ggaagctgaacttagcaaggaa

SEQ ID NO: 9096775 - DNA, 22 bp, Homo sapiens
ggaagctgaacttagcaaggaa

SEQ ID NO: 9096776 - DNA, 22 bp, Homo sapiens
ggaagctgaacttagcaaggaa

SEQ ID NO: 9096777 - DNA, 23 bp, Homo sapiens
ggaagctcacgtagtcctgcact

SEQ ID NO: 9096778 - DNA, 22 bp, Homo sapiens
ggaagctagttgtgtttcagga

SEQ ID NO: 9096779 - DNA, 22 bp, Homo sapiens
ggaagagcctggggtgtcaggc

SEQ ID NO: 9096780 - DNA, 22 bp, Homo sapiens
ggaagctgaatccagagacagg

SEQ ID NO: 9096781 - DNA, 22 bp, Homo sapiens
ggaagctgaatccagagacagg

SEQ ID NO: 9096782 - DNA, 22 bp, Homo sapiens
ggaagctgaacttagcaaggaa

SEQ ID NO: 9096783 - DNA, 22 bp, Homo sapiens
ggaagctgccagtccaccagct

SEQ ID NO: 9096784 - DNA, 22 bp, Homo sapiens
ggaagctgccagtccaccagct

SEQ ID NO: 9096785 - DNA, 22 bp, Homo sapiens
ggaagctgcataactagcgtgg

SEQ ID NO: 9096786 - DNA, 22 bp, Homo sapiens
ggaagctgaggcccagtgaagg

SEQ ID NO: 9096787 - DNA, 22 bp, Homo sapiens
ggaagctgcagtcccccccaag

SEQ ID NO: 9096788 - DNA, 22 bp, Homo sapiens
cacaaataccagtttcctaaca

SEQ ID NO: 9096789 - DNA, 22 bp, Homo sapiens
ggaagctgggatctctctcccg

SEQ ID NO: 9096790 - DNA, 22 bp, Homo sapiens
ggaagctgtgctctcaggcctc

SEQ ID NO: 9096791 - DNA, 22 bp, Homo sapiens
ggaagctggtaattgttgggac

SEQ ID NO: 9096792 - DNA, 22 bp, Homo sapiens
ggaagctggggagctttggaga

SEQ ID NO: 9096793 - DNA, 22 bp, Homo sapiens
ggaagctggctcttataaatat

SEQ ID NO: 9096794 - DNA, 22 bp, Homo sapiens
ggaagctggcatatgtaatcct

SEQ ID NO: 9096795 - DNA, 22 bp, Homo sapiens
ggaagctggacaggctttgagt

SEQ ID NO: 9096796 - DNA, 22 bp, Homo sapiens
ggaagctgcttagctaatgtag

SEQ ID NO: 9096797 - DNA, 22 bp, Homo sapiens
ggagagcagggaggctgctctg

SEQ ID NO: 9096798 - DNA, 20 bp, Homo sapiens
ggagagcagggaagacagta

SEQ ID NO: 9096799 - DNA, 22 bp, Homo sapiens
ggagagcagggtcctgagatac

SEQ ID NO: 9096800 - DNA, 22 bp, Homo sapiens
ggagaaggtgctggtcactgtg

SEQ ID NO: 9096801 - DNA, 22 bp, Homo sapiens
ggagaagggtatgtgtggcgga

SEQ ID NO: 9096802 - DNA, 22 bp, Homo sapiens
ggagaagggtatgtgtggcgga

SEQ ID NO: 9096803 - DNA, 22 bp, Homo sapiens
ggagaaggtgctggtcactgtg

SEQ ID NO: 9096804 - DNA, 22 bp, Homo sapiens
ggagaaggtgctggtcactgtg

SEQ ID NO: 9096805 - DNA, 22 bp, Homo sapiens
ggagaaggtgctggtcactgtg

SEQ ID NO: 9096806 - DNA, 22 bp, Homo sapiens
ggagaaggtgctggtcactgtg

SEQ ID NO: 9096807 - DNA, 22 bp, Homo sapiens
ggagaagggccaattccatgta

SEQ ID NO: 9096808 - DNA, 22 bp, Homo sapiens
ggagaagggccaattccatgta

SEQ ID NO: 9096809 - DNA, 22 bp, Homo sapiens
ggagaagggcatggtagtttta

SEQ ID NO: 9096810 - DNA, 22 bp, Homo sapiens
ggagaagggacagactcagctt

SEQ ID NO: 9096811 - DNA, 22 bp, Homo sapiens
ggagaagggacagactcagctt

SEQ ID NO: 9096812 - DNA, 22 bp, Homo sapiens
cacacagtaggcactcattaat

SEQ ID NO: 9096813 - DNA, 22 bp, Homo sapiens
ggagaagggaactgagtttttg

SEQ ID NO: 9096814 - DNA, 22 bp, Homo sapiens
ggagaaggcgaagtcattcttt

SEQ ID NO: 9096815 - DNA, 22 bp, Homo sapiens
ggagaaggcgaagtcattcttt

SEQ ID NO: 9096816 - DNA, 22 bp, Homo sapiens
ggagaaggcacacccacctctg

SEQ ID NO: 9096817 - DNA, 22 bp, Homo sapiens
ggagaaggcacacccacctctg

SEQ ID NO: 9096818 - DNA, 22 bp, Homo sapiens
cacacagtggagtattactcag

SEQ ID NO: 9096819 - DNA, 22 bp, Homo sapiens
ggactgggtaggagcccagggc

SEQ ID NO: 9096820 - DNA, 22 bp, Homo sapiens
ggagaaggcacacccacctctg

SEQ ID NO: 9096821 - DNA, 22 bp, Homo sapiens
cacacaggcaggatcccttccc

SEQ ID NO: 9096822 - DNA, 22 bp, Homo sapiens
cacacaggatgaagcagcagaa

SEQ ID NO: 9096823 - DNA, 22 bp, Homo sapiens
cacacaggatgaagcagcagaa

SEQ ID NO: 9096824 - DNA, 22 bp, Homo sapiens
cacacagggagaaagaaagcct

SEQ ID NO: 9096825 - DNA, 22 bp, Homo sapiens
cacacagggagaaagaaagcct

SEQ ID NO: 9096826 - DNA, 22 bp, Homo sapiens
cacacaggtaagcctctttcaa

SEQ ID NO: 9096827 - DNA, 22 bp, Homo sapiens
cacacaggtaagcctctttcaa

SEQ ID NO: 9096828 - DNA, 22 bp, Homo sapiens
cacacaggagagtgctggaggt

SEQ ID NO: 9096829 - DNA, 22 bp, Homo sapiens
ggaagagcctggggtgtcaggc

SEQ ID NO: 9096830 - DNA, 22 bp, Homo sapiens
caatttcattaatagatataga

SEQ ID NO: 9096831 - DNA, 22 bp, Homo sapiens
caatttcatgccatgtattgct

SEQ ID NO: 9096832 - DNA, 22 bp, Homo sapiens
caatttcatcttgtgcttcaat

SEQ ID NO: 9096833 - DNA, 18 bp, Homo sapiens
caatttcatccttaagcc

SEQ ID NO: 9096834 - DNA, 18 bp, Homo sapiens
caatttcatccttaagcc

SEQ ID NO: 9096835 - DNA, 22 bp, Homo sapiens
caatttcagacctttccttgga

SEQ ID NO: 9096836 - DNA, 22 bp, Homo sapiens
caatttcagacctttccttgga

SEQ ID NO: 9096837 - DNA, 22 bp, Homo sapiens
caatttcactaataatatttac

SEQ ID NO: 9096838 - DNA, 22 bp, Homo sapiens
caatttcaatacaaaatacatt

SEQ ID NO: 9096839 - DNA, 21 bp, Homo sapiens
caatcagttggcatttgagca

SEQ ID NO: 9096840 - DNA, 21 bp, Homo sapiens
caatcagttggcatttgagca

SEQ ID NO: 9096841 - DNA, 22 bp, Homo sapiens
caatcagtttctgttgtataat

SEQ ID NO: 9096842 - DNA, 22 bp, Homo sapiens
caattcatgggctgaggaaggg

SEQ ID NO: 9096843 - DNA, 22 bp, Homo sapiens
caattcatctgggtaggtagcc

SEQ ID NO: 9096844 - DNA, 22 bp, Homo sapiens
caattcatgtgagcggactctt

SEQ ID NO: 9096845 - DNA, 22 bp, Homo sapiens
caattcatgttaaacagaagca

SEQ ID NO: 9096846 - DNA, 22 bp, Homo sapiens
caatcacaaagagacaagtgtc

SEQ ID NO: 9096847 - DNA, 19 bp, Homo sapiens
caatatatagtgagtggat

SEQ ID NO: 9096848 - DNA, 22 bp, Homo sapiens
caatatgcaagctattaagtat

SEQ ID NO: 9096849 - DNA, 22 bp, Homo sapiens
caatattcagtggaaaagccat

SEQ ID NO: 9096850 - DNA, 22 bp, Homo sapiens
caatttcaagattctgttcttt

SEQ ID NO: 9096851 - DNA, 22 bp, Homo sapiens
caatttcaagattctgttcttt

SEQ ID NO: 9096852 - DNA, 22 bp, Homo sapiens
caatttcaagattctgttcttt

SEQ ID NO: 9096853 - DNA, 22 bp, Homo sapiens
caattgcaatagagaaaagagt

SEQ ID NO: 9096854 - DNA, 22 bp, Homo sapiens
caattgaacagatgagttaaat

SEQ ID NO: 9096855 - DNA, 22 bp, Homo sapiens
caattcattacattgcaaagac

SEQ ID NO: 9096856 - DNA, 22 bp, Homo sapiens
caataagatgtattgagcagag

SEQ ID NO: 9096857 - DNA, 22 bp, Homo sapiens
caaggctggctcacaataatga

SEQ ID NO: 9096858 - DNA, 22 bp, Homo sapiens
caaggctgtctccagcttccaa

SEQ ID NO: 9096859 - DNA, 22 bp, Homo sapiens
caaggctgagaaattctgccct

SEQ ID NO: 9096860 - DNA, 22 bp, Homo sapiens
caaggctgcaaaactacatggg

SEQ ID NO: 9096861 - DNA, 22 bp, Homo sapiens
caaggctgcaaaactacatggg

SEQ ID NO: 9096862 - DNA, 22 bp, Homo sapiens
caaggctgcaaaactacatggg

SEQ ID NO: 9096863 - DNA, 22 bp, Homo sapiens
caaggctgctgcgggtcgcacc

SEQ ID NO: 9096864 - DNA, 22 bp, Homo sapiens
caaggctgctgcgggtcgcacc

SEQ ID NO: 9096865 - DNA, 22 bp, Homo sapiens
caaggccttcttgggagagatt

SEQ ID NO: 9096866 - DNA, 22 bp, Homo sapiens
gctggggaggcagcagagaaca

SEQ ID NO: 9096867 - DNA, 22 bp, Homo sapiens
gctggggagctagacctcagca

SEQ ID NO: 9096868 - DNA, 18 bp, Homo sapiens
caatagaaacagtaggaa

SEQ ID NO: 9096869 - DNA, 22 bp, Homo sapiens
caatagaaaactcaatacttaa

SEQ ID NO: 9096870 - DNA, 18 bp, Homo sapiens
caatagaaacagtaggaa

SEQ ID NO: 9096871 - DNA, 22 bp, Homo sapiens
caatagaaggcacagataggta

SEQ ID NO: 9096872 - DNA, 22 bp, Homo sapiens
caatactttagtaaaatggccc

SEQ ID NO: 9096873 - DNA, 22 bp, Homo sapiens
caatagaaaactcaatacttaa

SEQ ID NO: 9096874 - DNA, 22 bp, Homo sapiens
caatacttccttgttagaggca

SEQ ID NO: 9096875 - DNA, 20 bp, Homo sapiens
caatagaatgtggagataag

SEQ ID NO: 9096876 - DNA, 20 bp, Homo sapiens
caatagaatgtggagataag

SEQ ID NO: 9096877 - DNA, 22 bp, Homo sapiens
caatagaaggcacagataggta

SEQ ID NO: 9096878 - DNA, 22 bp, Homo sapiens
caatagcagcttctgaatgcaa

SEQ ID NO: 9096879 - DNA, 22 bp, Homo sapiens
caatagagacctggattctccc

SEQ ID NO: 9096880 - DNA, 22 bp, Homo sapiens
caatagataactgagatagact

SEQ ID NO: 9096881 - DNA, 22 bp, Homo sapiens
caatatagagagaaaattatgt

SEQ ID NO: 9096882 - DNA, 22 bp, Homo sapiens
caatagttcggtcctgaaggcc

SEQ ID NO: 9096883 - DNA, 22 bp, Homo sapiens
caatagcaggtctacagagaga

SEQ ID NO: 9096884 - DNA, 22 bp, Homo sapiens
caatagcaggtctacagagaga

SEQ ID NO: 9096885 - DNA, 22 bp, Homo sapiens
caatagtaaattacggaggaga

SEQ ID NO: 9096886 - DNA, 22 bp, Homo sapiens
caatatataatgagtactttcc

SEQ ID NO: 9096887 - DNA, 22 bp, Homo sapiens
caatatataatgagtactttcc

SEQ ID NO: 9096888 - DNA, 22 bp, Homo sapiens
caatatataggaacaacttagg

SEQ ID NO: 9096889 - DNA, 22 bp, Homo sapiens
caatatataggaacaacttagg

SEQ ID NO: 9096890 - DNA, 22 bp, Homo sapiens
atagaaatggcagctggtgcta

SEQ ID NO: 9096891 - DNA, 22 bp, Homo sapiens
atagaaatggcagctggtgcta

SEQ ID NO: 9096892 - DNA, 19 bp, Homo sapiens
atagaaagggttaaagaca

SEQ ID NO: 9096893 - DNA, 19 bp, Homo sapiens
atagaaagggttaaagaca

SEQ ID NO: 9096894 - DNA, 21 bp, Homo sapiens
atactttgaattacagccttg

SEQ ID NO: 9096895 - DNA, 22 bp, Homo sapiens
atactttgggggttagtgtaga

SEQ ID NO: 9096896 - DNA, 21 bp, Homo sapiens
atactttgaattacagccttg

SEQ ID NO: 9096897 - DNA, 22 bp, Homo sapiens
atactttggtcactattattgg

SEQ ID NO: 9096898 - DNA, 22 bp, Homo sapiens
atagaaacagaggtcaggcatt

SEQ ID NO: 9096899 - DNA, 22 bp, Homo sapiens
atagaaacagggaagcaaagca

SEQ ID NO: 9096900 - DNA, 22 bp, Homo sapiens
atagaaaacagatgtccttaaa

SEQ ID NO: 9096901 - DNA, 17 bp, Homo sapiens
ctggagctgtgtaacct

SEQ ID NO: 9096902 - DNA, 22 bp, Homo sapiens
ctggagctgtcttcacaggcct

SEQ ID NO: 9096903 - DNA, 22 bp, Homo sapiens
ctggagcttattgggagcagaa

SEQ ID NO: 9096904 - DNA, 21 bp, Homo sapiens
ctggagcttggtgagaagtgt

SEQ ID NO: 9096905 - DNA, 22 bp, Homo sapiens
ctggccaggcttgggacagaca

SEQ ID NO: 9096906 - DNA, 22 bp, Homo sapiens
ctggccaggcttgggacagaca

SEQ ID NO: 9096907 - DNA, 22 bp, Homo sapiens
atagacatatggctttgtttct

SEQ ID NO: 9096908 - DNA, 22 bp, Homo sapiens
atagacatggtcttttgtcatt

SEQ ID NO: 9096909 - DNA, 22 bp, Homo sapiens
atagacattataacacagagct

SEQ ID NO: 9096910 - DNA, 20 bp, Homo sapiens
atagacaaagacatgccaga

SEQ ID NO: 9096911 - DNA, 22 bp, Homo sapiens
atagaatgtattatagtacaga

SEQ ID NO: 9096912 - DNA, 22 bp, Homo sapiens
atagaatttgtacttgtagaac

SEQ ID NO: 9096913 - DNA, 22 bp, Homo sapiens
atagaatttgtacttgtagaac

SEQ ID NO: 9096914 - DNA, 22 bp, Homo sapiens
atagacaaacacgaagatgaca

SEQ ID NO: 9096915 - DNA, 22 bp, Homo sapiens
ataggcagactctttttggagg

SEQ ID NO: 9096916 - DNA, 22 bp, Homo sapiens
atagggcagtggcatctcttaa

SEQ ID NO: 9096917 - DNA, 22 bp, Homo sapiens
atagggaggaactgagtcagga

SEQ ID NO: 9096918 - DNA, 22 bp, Homo sapiens
ataggcttggcttattcttggg

SEQ ID NO: 9096919 - DNA, 22 bp, Homo sapiens
atagcatacatgttgttacttg

SEQ ID NO: 9096920 - DNA, 22 bp, Homo sapiens
atagcatacatgttgttacttg

SEQ ID NO: 9096921 - DNA, 23 bp, Homo sapiens
atagaccattgtctcacacttca

SEQ ID NO: 9096922 - DNA, 22 bp, Homo sapiens
atagacgcggccgctgatgcag

SEQ ID NO: 9096923 - DNA, 22 bp, Homo sapiens
atagaccctggaaatggcagag

SEQ ID NO: 9096924 - DNA, 22 bp, Homo sapiens
ataggtctgaaagtgtatcctg

SEQ ID NO: 9096925 - DNA, 22 bp, Homo sapiens
ataggtcagagccacagtgaag

SEQ ID NO: 9096926 - DNA, 22 bp, Homo sapiens
atagggcccccgtgggtgctca

SEQ ID NO: 9096927 - DNA, 22 bp, Homo sapiens
ataggtccaaggagaggtcttt

SEQ ID NO: 9096928 - DNA, 22 bp, Homo sapiens
ataggtgaaatattcaaaatgt

SEQ ID NO: 9096929 - DNA, 22 bp, Homo sapiens
atagtacagagggctactggtt

SEQ ID NO: 9096930 - DNA, 19 bp, Homo sapiens
ctggaaagttggcagtgag

SEQ ID NO: 9096931 - DNA, 22 bp, Homo sapiens
atacagaagcctgtatttctgg

SEQ ID NO: 9096932 - DNA, 22 bp, Homo sapiens
ctggaagaccccccaggactca

SEQ ID NO: 9096933 - DNA, 22 bp, Homo sapiens
ctggaagaactccagttctgtg

SEQ ID NO: 9096934 - DNA, 22 bp, Homo sapiens
atacatgactcacacattctgc

SEQ ID NO: 9096935 - DNA, 22 bp, Homo sapiens
atacatcttccttttaaaatgc

SEQ ID NO: 9096936 - DNA, 22 bp, Homo sapiens
atacatcttgtcagattcatgt

SEQ ID NO: 9096937 - DNA, 22 bp, Homo sapiens
atacatctctttgaagtgcttt

SEQ ID NO: 9096938 - DNA, 22 bp, Homo sapiens
ctggagctgtcttcacaggcct

SEQ ID NO: 9096939 - DNA, 22 bp, Homo sapiens
ctggagctggtatagggacaaa

SEQ ID NO: 9096940 - DNA, 22 bp, Homo sapiens
ctggagctggcttccttccact

SEQ ID NO: 9096941 - DNA, 22 bp, Homo sapiens
ctggagctggcccaggctggcc

SEQ ID NO: 9096942 - DNA, 22 bp, Homo sapiens
ctggagctgctgtccttgggtg

SEQ ID NO: 9096943 - DNA, 22 bp, Homo sapiens
ataattatctcagacacttgtt

SEQ ID NO: 9096944 - DNA, 22 bp, Homo sapiens
ataattaatttcagtaatctcc

SEQ ID NO: 9096945 - DNA, 22 bp, Homo sapiens
ataatggcttctgagtattagg

SEQ ID NO: 9096946 - DNA, 22 bp, Homo sapiens
ataatggcttgtggtgttattc

SEQ ID NO: 9096947 - DNA, 22 bp, Homo sapiens
ataatcagaattcatgaaagat

SEQ ID NO: 9096948 - DNA, 21 bp, Homo sapiens
ataatgtacaaaaactgtctt

SEQ ID NO: 9096949 - DNA, 22 bp, Homo sapiens
ataatgtttttgtataagcatg

SEQ ID NO: 9096950 - DNA, 22 bp, Homo sapiens
ataatgttgatgattgtctttg

SEQ ID NO: 9096951 - DNA, 21 bp, Homo sapiens
atacagaacattgatccaaga

SEQ ID NO: 9096952 - DNA, 22 bp, Homo sapiens
atacagaagaactatagccact

SEQ ID NO: 9096953 - DNA, 22 bp, Homo sapiens
atacagaagaactatagccact

SEQ ID NO: 9096954 - DNA, 22 bp, Homo sapiens
atacagaactctcagttgtata

SEQ ID NO: 9096955 - DNA, 21 bp, Homo sapiens
atacagaacattgatccaaga

SEQ ID NO: 9096956 - DNA, 20 bp, Homo sapiens
atacacattcatagaaaaat

SEQ ID NO: 9096957 - DNA, 20 bp, Homo sapiens
atacacattcatagaaaaat

SEQ ID NO: 9096958 - DNA, 20 bp, Homo sapiens
ataatttaccctgcaccact

SEQ ID NO: 9096959 - DNA, 22 bp, Homo sapiens
ctgccctgtggctctgagtcat

SEQ ID NO: 9096960 - DNA, 22 bp, Homo sapiens
ctgccctgtggctctgagtcat

SEQ ID NO: 9096961 - DNA, 22 bp, Homo sapiens
ctgccctgtgcacaggaaactg

SEQ ID NO: 9096962 - DNA, 22 bp, Homo sapiens
ctgccctgtgagggtccttggg

SEQ ID NO: 9096963 - DNA, 22 bp, Homo sapiens
ctgccctgtgagggtccttggg

SEQ ID NO: 9096964 - DNA, 22 bp, Homo sapiens
ctgccctgtctttttctgatga

SEQ ID NO: 9096965 - DNA, 22 bp, Homo sapiens
ctgccctgtctgcagcctggct

SEQ ID NO: 9096966 - DNA, 22 bp, Homo sapiens
ctgccctgtctgcagcctggct

SEQ ID NO: 9096967 - DNA, 22 bp, Homo sapiens
ctgccctgtccttcccgccggc

SEQ ID NO: 9096968 - DNA, 22 bp, Homo sapiens
ctgccctgtatcttctcccaat

SEQ ID NO: 9096969 - DNA, 22 bp, Homo sapiens
ctgccctgtatcttctcccaat

SEQ ID NO: 9096970 - DNA, 22 bp, Homo sapiens
ctgccctgtagctgttctagca

SEQ ID NO: 9096971 - DNA, 22 bp, Homo sapiens
ctgccctgtatcttctcccaat

SEQ ID NO: 9096972 - DNA, 22 bp, Homo sapiens
ataagtttgtctttgtaaagat

SEQ ID NO: 9096973 - DNA, 22 bp, Homo sapiens
ataataaaccaggatgggtctg

SEQ ID NO: 9096974 - DNA, 22 bp, Homo sapiens
ataataaaccaggatgggtctg

SEQ ID NO: 9096975 - DNA, 22 bp, Homo sapiens
ataagtgagaacaaaaattaga

SEQ ID NO: 9096976 - DNA, 22 bp, Homo sapiens
ctgccctgtttggacagcccgg

SEQ ID NO: 9096977 - DNA, 22 bp, Homo sapiens
ctgccctgtttggacagcccgg

SEQ ID NO: 9096978 - DNA, 22 bp, Homo sapiens
ctgccctgtttggacagcccgg

SEQ ID NO: 9096979 - DNA, 22 bp, Homo sapiens
ctgccctgtggttgtgggttct

SEQ ID NO: 9096980 - DNA, 22 bp, Homo sapiens
ctgccctgtggctctgagtcat

SEQ ID NO: 9096981 - DNA, 22 bp, Homo sapiens
ctgcctgctgcctgtggagggt

SEQ ID NO: 9096982 - DNA, 22 bp, Homo sapiens
ctgcctgctgccctccagagcc

SEQ ID NO: 9096983 - DNA, 22 bp, Homo sapiens
ctgcctgctgattagtattgtc

SEQ ID NO: 9096984 - DNA, 22 bp, Homo sapiens
ctgcctgctgattagtattgtc

SEQ ID NO: 9096985 - DNA, 22 bp, Homo sapiens
ctgcctgctgacattctttata

SEQ ID NO: 9096986 - DNA, 22 bp, Homo sapiens
ctgcctgctgacattctttata

SEQ ID NO: 9096987 - DNA, 18 bp, Homo sapiens
ctgcctgctctccagctt

SEQ ID NO: 9096988 - DNA, 18 bp, Homo sapiens
ctgcctgctctccagctt

SEQ ID NO: 9096989 - DNA, 22 bp, Homo sapiens
ctgcctgcttttctgggagccg

SEQ ID NO: 9096990 - DNA, 22 bp, Homo sapiens
ctgcctgcttctgagccagagg

SEQ ID NO: 9096991 - DNA, 22 bp, Homo sapiens
ctgcctgcttctgagccagagg

SEQ ID NO: 9096992 - DNA, 22 bp, Homo sapiens
ctgcctgcttctgagccagagg

SEQ ID NO: 9096993 - DNA, 23 bp, Homo sapiens
ctgcctgctggggagacagatct

SEQ ID NO: 9096994 - DNA, 22 bp, Homo sapiens
ctgcctgcttaccatgcatcag

SEQ ID NO: 9096995 - DNA, 22 bp, Homo sapiens
ctgcctgcttaccatgcatcag

SEQ ID NO: 9096996 - DNA, 23 bp, Homo sapiens
ataataattatggcagcaaagtg

SEQ ID NO: 9096997 - DNA, 23 bp, Homo sapiens
ataataattatggcagcaaagtg

SEQ ID NO: 9096998 - DNA, 22 bp, Homo sapiens
ataataatgaaagccactgtgt

SEQ ID NO: 9096999 - DNA, 22 bp, Homo sapiens
ataataaaccaggatgggtctg

SEQ ID NO: 9097000 - DNA, 22 bp, Homo sapiens
agttttctctgtgttctgctta

SEQ ID NO: 9097001 - DNA, 22 bp, Homo sapiens
agttttctttcgcaaaggtaca

SEQ ID NO: 9097002 - DNA, 22 bp, Homo sapiens
agttttctgttctacaatttga

SEQ ID NO: 9097003 - DNA, 22 bp, Homo sapiens
agttttctgttctacaatttga

SEQ ID NO: 9097004 - DNA, 22 bp, Homo sapiens
agttttctgctaaaccagctaa

SEQ ID NO: 9097005 - DNA, 22 bp, Homo sapiens
agttttctttcatctatcagca

SEQ ID NO: 9097006 - DNA, 22 bp, Homo sapiens
agttttctcacatcaaaaatga

SEQ ID NO: 9097007 - DNA, 22 bp, Homo sapiens
agttttctcacatcaaaaatga

SEQ ID NO: 9097008 - DNA, 21 bp, Homo sapiens
agttttctgagttataaaata

SEQ ID NO: 9097009 - DNA, 21 bp, Homo sapiens
agttttctgagttataaaata

SEQ ID NO: 9097010 - DNA, 22 bp, Homo sapiens
agttttctgacccctgctctat

SEQ ID NO: 9097011 - DNA, 22 bp, Homo sapiens
agttttctctgtgttctgctta

SEQ ID NO: 9097012 - DNA, 22 bp, Homo sapiens
agttttcagtaaatattagtga

SEQ ID NO: 9097013 - DNA, 20 bp, Homo sapiens
agttttcagcagaacaccca

SEQ ID NO: 9097014 - DNA, 22 bp, Homo sapiens
ctgccctggtcccatggctgat

SEQ ID NO: 9097015 - DNA, 22 bp, Homo sapiens
ctgccctggtcccatggctgat

SEQ ID NO: 9097016 - DNA, 22 bp, Homo sapiens
ctgccctgtagctgttctagca

SEQ ID NO: 9097017 - DNA, 22 bp, Homo sapiens
ctgccctgacctgcctcagagt

SEQ ID NO: 9097018 - DNA, 22 bp, Homo sapiens
ctgccctgacctgcctcagagt

SEQ ID NO: 9097019 - DNA, 22 bp, Homo sapiens
ctgccctgactgaccttttgaa

SEQ ID NO: 9097020 - DNA, 22 bp, Homo sapiens
ctgccctgactgaccttttgaa

SEQ ID NO: 9097021 - DNA, 22 bp, Homo sapiens
ctgccctctagggatgcactgg

SEQ ID NO: 9097022 - DNA, 22 bp, Homo sapiens
ctgccctgacctgcctcagagt

SEQ ID NO: 9097023 - DNA, 22 bp, Homo sapiens
ctgccctctagaggaggactga

SEQ ID NO: 9097024 - DNA, 22 bp, Homo sapiens
ctgcccgctgctagagaggccg

SEQ ID NO: 9097025 - DNA, 22 bp, Homo sapiens
ctgccctcccagttggtccgtg

SEQ ID NO: 9097026 - DNA, 22 bp, Homo sapiens
ctgccctcccagttggtccgtg

SEQ ID NO: 9097027 - DNA, 18 bp, Homo sapiens
ctgcccagagcatttcat

SEQ ID NO: 9097028 - DNA, 18 bp, Homo sapiens
ctgcccagagcatttcat

SEQ ID NO: 9097029 - DNA, 18 bp, Homo sapiens
ctgccccttctctgagat

SEQ ID NO: 9097030 - DNA, 18 bp, Homo sapiens
ctgcccagagcacttgtg

SEQ ID NO: 9097031 - DNA, 18 bp, Homo sapiens
ctgcccagagcacttgtg

SEQ ID NO: 9097032 - DNA, 22 bp, Homo sapiens
agttttgatactttctcttcat

SEQ ID NO: 9097033 - DNA, 22 bp, Homo sapiens
agtttcagaatttatgcagaca

SEQ ID NO: 9097034 - DNA, 22 bp, Homo sapiens
agtttcagaatttatgcagaca

SEQ ID NO: 9097035 - DNA, 21 bp, Homo sapiens
agtttcaggaagttcagctgc

SEQ ID NO: 9097036 - DNA, 22 bp, Homo sapiens
agtttcacatagctcagtgctc

SEQ ID NO: 9097037 - DNA, 18 bp, Homo sapiens
agtttcagggcaggaaac

SEQ ID NO: 9097038 - DNA, 18 bp, Homo sapiens
agtttcagggcaggaaac

SEQ ID NO: 9097039 - DNA, 20 bp, Homo sapiens
agtttcagggagtcccatct

SEQ ID NO: 9097040 - DNA, 22 bp, Homo sapiens
agtttcagtgttgacagatggt

SEQ ID NO: 9097041 - DNA, 22 bp, Homo sapiens
agtttcagtgttgacagatggt

SEQ ID NO: 9097042 - DNA, 22 bp, Homo sapiens
agtttcagtgttgacagatggt

SEQ ID NO: 9097043 - DNA, 22 bp, Homo sapiens
agtttcatattaccatgtcacc

SEQ ID NO: 9097044 - DNA, 22 bp, Homo sapiens
agtttctctagagtctttgaaa

SEQ ID NO: 9097045 - DNA, 22 bp, Homo sapiens
agtttctctagagtctttgaaa

SEQ ID NO: 9097046 - DNA, 22 bp, Homo sapiens
agtttctctcagtatagaatag

SEQ ID NO: 9097047 - DNA, 22 bp, Homo sapiens
agtttctctcagtatagaatag

SEQ ID NO: 9097048 - DNA, 22 bp, Homo sapiens
agtttctcttaatctagtatct

SEQ ID NO: 9097049 - DNA, 22 bp, Homo sapiens
agtttctctttgacaccaaaat

SEQ ID NO: 9097050 - DNA, 22 bp, Homo sapiens
agtttctgcaaatcatttttat

SEQ ID NO: 9097051 - DNA, 22 bp, Homo sapiens
agtttcttgaagactgatgttt

SEQ ID NO: 9097052 - DNA, 22 bp, Homo sapiens
ctgagtctcccggcagtggagg

SEQ ID NO: 9097053 - DNA, 22 bp, Homo sapiens
ctgatacaatgtctgctttata

SEQ ID NO: 9097054 - DNA, 22 bp, Homo sapiens
ctgataggttattttcagtgag

SEQ ID NO: 9097055 - DNA, 22 bp, Homo sapiens
ctgataggatttagtttctgtt

SEQ ID NO: 9097056 - DNA, 22 bp, Homo sapiens
ctgatagacaatcaccatggga

SEQ ID NO: 9097057 - DNA, 18 bp, Homo sapiens
ctgataggggtggcagct

SEQ ID NO: 9097058 - DNA, 22 bp, Homo sapiens
ctgagtggaacataggatgata

SEQ ID NO: 9097059 - DNA, 22 bp, Homo sapiens
ctgagtgatagcgatggggaac

SEQ ID NO: 9097060 - DNA, 18 bp, Homo sapiens
ctgagtgatgatggggtg

SEQ ID NO: 9097061 - DNA, 22 bp, Homo sapiens
ctgagttctaggctgccacctt

SEQ ID NO: 9097062 - DNA, 22 bp, Homo sapiens
agttttattgtcccagaggtga

SEQ ID NO: 9097063 - DNA, 22 bp, Homo sapiens
agttttattccaatgtgcagca

SEQ ID NO: 9097064 - DNA, 22 bp, Homo sapiens
agttttattccaatgtgcagca

SEQ ID NO: 9097065 - DNA, 22 bp, Homo sapiens
agttttattaaatccacagaag

SEQ ID NO: 9097066 - DNA, 20 bp, Homo sapiens
agtttgtgtgtctatgcgct

SEQ ID NO: 9097067 - DNA, 22 bp, Homo sapiens
agttttatgttcacagaaggat

SEQ ID NO: 9097068 - DNA, 22 bp, Homo sapiens
agttttatgttcacagaaggat

SEQ ID NO: 9097069 - DNA, 19 bp, Homo sapiens
agtttattataggtgattc

SEQ ID NO: 9097070 - DNA, 22 bp, Homo sapiens
agtttattgtatatggtagttt

SEQ ID NO: 9097071 - DNA, 22 bp, Homo sapiens
agtttatttctccatttaccta

SEQ ID NO: 9097072 - DNA, 22 bp, Homo sapiens
agtttatttttgataagtcttg

SEQ ID NO: 9097073 - DNA, 22 bp, Homo sapiens
agtttatttctccatttaccta

SEQ ID NO: 9097074 - DNA, 22 bp, Homo sapiens
agtttcacacaacatttgcatg

SEQ ID NO: 9097075 - DNA, 22 bp, Homo sapiens
agtttcacagagggttagacgc

SEQ ID NO: 9097076 - DNA, 22 bp, Homo sapiens
agtttcacacaacatttgcatg

SEQ ID NO: 9097077 - DNA, 22 bp, Homo sapiens
agtgttcatttattcattcact

SEQ ID NO: 9097078 - DNA, 20 bp, Homo sapiens
agtgttccggaagactggca

SEQ ID NO: 9097079 - DNA, 22 bp, Homo sapiens
agtgttcatttattcattcact

SEQ ID NO: 9097080 - DNA, 22 bp, Homo sapiens
agtgttccacacatctggggaa

SEQ ID NO: 9097081 - DNA, 20 bp, Homo sapiens
agtgttccggaagactggca

SEQ ID NO: 9097082 - DNA, 22 bp, Homo sapiens
agtgttcctgctctcaggaagc

SEQ ID NO: 9097083 - DNA, 22 bp, Homo sapiens
agtttacaacagtagctatgga

SEQ ID NO: 9097084 - DNA, 22 bp, Homo sapiens
agtttacaacagtagctatgga

SEQ ID NO: 9097085 - DNA, 19 bp, Homo sapiens
agtttattataggtgattc

SEQ ID NO: 9097086 - DNA, 22 bp, Homo sapiens
agtttatgtctttacttcagct

SEQ ID NO: 9097087 - DNA, 22 bp, Homo sapiens
agtttatgtgtaagacagctgt

SEQ ID NO: 9097088 - DNA, 22 bp, Homo sapiens
agtgttcactctgtggagccca

SEQ ID NO: 9097089 - DNA, 23 bp, Homo sapiens
agtgttcagcatgtagtaaatac

SEQ ID NO: 9097090 - DNA, 22 bp, Homo sapiens
agtgttcagtgattgtcaaccg

SEQ ID NO: 9097091 - DNA, 22 bp, Homo sapiens
agtgttcaggatctgaggccag

SEQ ID NO: 9097092 - DNA, 22 bp, Homo sapiens
ctgagaggcggaggttgcagtg

SEQ ID NO: 9097093 - DNA, 22 bp, Homo sapiens
ctgtgcctgcaggccacatcaa

SEQ ID NO: 9097094 - DNA, 22 bp, Homo sapiens
ctgtgcctggggggcagagctg

SEQ ID NO: 9097095 - DNA, 22 bp, Homo sapiens
ctgtgcctggggggcagagctg

SEQ ID NO: 9097096 - DNA, 22 bp, Homo sapiens
ctgtgcctccagtctcgcttct

SEQ ID NO: 9097097 - DNA, 22 bp, Homo sapiens
ctgtgccttggcgctgtgccac

SEQ ID NO: 9097098 - DNA, 22 bp, Homo sapiens
ctgtgccttctgcctggaacat

SEQ ID NO: 9097099 - DNA, 22 bp, Homo sapiens
ctgtgccttctacttcactcta

SEQ ID NO: 9097100 - DNA, 22 bp, Homo sapiens
ctgtgcctttgtagctgtgcct

SEQ ID NO: 9097101 - DNA, 22 bp, Homo sapiens
ctgtgcctttgtagctgtgcct

SEQ ID NO: 9097102 - DNA, 22 bp, Homo sapiens
ctgtgcctaagatgcatgtctc

SEQ ID NO: 9097103 - DNA, 22 bp, Homo sapiens
ctgtgcagtaggtcagggctgg

SEQ ID NO: 9097104 - DNA, 19 bp, Homo sapiens
ctgtgcaggccgggctgag

SEQ ID NO: 9097105 - DNA, 22 bp, Homo sapiens
atcaggaacgttcatggactgt

SEQ ID NO: 9097106 - DNA, 22 bp, Homo sapiens
atcaggaagaagaatgtgttgg

SEQ ID NO: 9097107 - DNA, 22 bp, Homo sapiens
atcaggaagaattggatgctac

SEQ ID NO: 9097108 - DNA, 20 bp, Homo sapiens
atcaggaagagagactgacc

SEQ ID NO: 9097109 - DNA, 22 bp, Homo sapiens
atcaggaacgttcatggactgt

SEQ ID NO: 9097110 - DNA, 22 bp, Homo sapiens
atcaggaaatacttatttataa

SEQ ID NO: 9097111 - DNA, 20 bp, Homo sapiens
ctgtgctccgggttcctgga

SEQ ID NO: 9097112 - DNA, 22 bp, Homo sapiens
atcaggaagatctagcgaatgt

SEQ ID NO: 9097113 - DNA, 22 bp, Homo sapiens
atcaggaagccagtctaatgga

SEQ ID NO: 9097114 - DNA, 22 bp, Homo sapiens
atcaggaagcctgcactgagct

SEQ ID NO: 9097115 - DNA, 22 bp, Homo sapiens
atcaggaagcgtctggtatttt

SEQ ID NO: 9097116 - DNA, 22 bp, Homo sapiens
atcaggaagcgtctggtatttt

SEQ ID NO: 9097117 - DNA, 22 bp, Homo sapiens
atcaggaatcttttgtcagaca

SEQ ID NO: 9097118 - DNA, 22 bp, Homo sapiens
atcaggaatgaatacttttgga

SEQ ID NO: 9097119 - DNA, 22 bp, Homo sapiens
ctgtgggagcacatgacagata

SEQ ID NO: 9097120 - DNA, 22 bp, Homo sapiens
atcaggccagcaatccctgggc

SEQ ID NO: 9097121 - DNA, 21 bp, Homo sapiens
atcattaattgctgagtgaca

SEQ ID NO: 9097122 - DNA, 22 bp, Homo sapiens
ctgtgtccccctcagccaggtg

SEQ ID NO: 9097123 - DNA, 22 bp, Homo sapiens
ctgtgtcccttgtcccagagcc

SEQ ID NO: 9097124 - DNA, 22 bp, Homo sapiens
ctgtgtcccagtaccttgggta

SEQ ID NO: 9097125 - DNA, 22 bp, Homo sapiens
ctgtgtcccagccaggataatg

SEQ ID NO: 9097126 - DNA, 22 bp, Homo sapiens
atcattcaaatgatttggaggt

SEQ ID NO: 9097127 - DNA, 22 bp, Homo sapiens
atcattcaagtgctctaaaatg

SEQ ID NO: 9097128 - DNA, 22 bp, Homo sapiens
atcattatcctcctatttgcct

SEQ ID NO: 9097129 - DNA, 22 bp, Homo sapiens
atcattcagcctaagcaagtac

SEQ ID NO: 9097130 - DNA, 22 bp, Homo sapiens
atcattcagtctctgggacagt

SEQ ID NO: 9097131 - DNA, 22 bp, Homo sapiens
ctgtgtgtcctcggacgagttt

SEQ ID NO: 9097132 - DNA, 22 bp, Homo sapiens
ctgtgtgtgaacacagcccagc

SEQ ID NO: 9097133 - DNA, 22 bp, Homo sapiens
ctgttatattggtatatttaca

SEQ ID NO: 9097134 - DNA, 23 bp, Homo sapiens
ctgttatatgggtgttatgtgct

SEQ ID NO: 9097135 - DNA, 22 bp, Homo sapiens
ctgttatttctgaatgccatcc

SEQ ID NO: 9097136 - DNA, 22 bp, Homo sapiens
ctgtttatctaggagttgcagg

SEQ ID NO: 9097137 - DNA, 22 bp, Homo sapiens
ctgtttatctctaacctgttta

SEQ ID NO: 9097138 - DNA, 22 bp, Homo sapiens
ctgtttattgagcaatctgcca

SEQ ID NO: 9097139 - DNA, 22 bp, Homo sapiens
ctgtttcaaaactagtacaaca

SEQ ID NO: 9097140 - DNA, 20 bp, Homo sapiens
ctgtttattagaagtggatt

SEQ ID NO: 9097141 - DNA, 22 bp, Homo sapiens
ctgtttattacgtaattaatat

SEQ ID NO: 9097142 - DNA, 22 bp, Homo sapiens
cttcatgtacagttattggaga

SEQ ID NO: 9097143 - DNA, 17 bp, Homo sapiens
atctgcatttctaatga

SEQ ID NO: 9097144 - DNA, 22 bp, Homo sapiens
cttcatctttctgagcctcagt

SEQ ID NO: 9097145 - DNA, 23 bp, Homo sapiens
cttcatcaaaagttaacactagt

SEQ ID NO: 9097146 - DNA, 22 bp, Homo sapiens
cttcatcaactctaacaaatgt

SEQ ID NO: 9097147 - DNA, 22 bp, Homo sapiens
cttcagttctaaagtagaatgt

SEQ ID NO: 9097148 - DNA, 22 bp, Homo sapiens
cttcagtttatcccatcatcca

SEQ ID NO: 9097149 - DNA, 22 bp, Homo sapiens
atctccagtgcccaaaggaaat

SEQ ID NO: 9097150 - DNA, 22 bp, Homo sapiens
atctatttctgctaataacaat

SEQ ID NO: 9097151 - DNA, 22 bp, Homo sapiens
atctccagctcgcagagctcct

SEQ ID NO: 9097152 - DNA, 22 bp, Homo sapiens
atctccagctcgcagagctcct

SEQ ID NO: 9097153 - DNA, 22 bp, Homo sapiens
atctccagctggctgtgataaa

SEQ ID NO: 9097154 - DNA, 22 bp, Homo sapiens
atctcattttggtttctactta

SEQ ID NO: 9097155 - DNA, 22 bp, Homo sapiens
atccttctacctaggactattt

SEQ ID NO: 9097156 - DNA, 22 bp, Homo sapiens
atccttcttctgctagtgtcta

SEQ ID NO: 9097157 - DNA, 21 bp, Homo sapiens
atccttgatcagaagagtgct

SEQ ID NO: 9097158 - DNA, 22 bp, Homo sapiens
atccttgagaaaataaatgacc

SEQ ID NO: 9097159 - DNA, 19 bp, Homo sapiens
cttcagcatctccggagct

SEQ ID NO: 9097160 - DNA, 22 bp, Homo sapiens
cttcagcagcctcttgcataaa

SEQ ID NO: 9097161 - DNA, 22 bp, Homo sapiens
atccttcaaaaggaatagcagg

SEQ ID NO: 9097162 - DNA, 22 bp, Homo sapiens
atccttcaaaaggaatagcagg

SEQ ID NO: 9097163 - DNA, 22 bp, Homo sapiens
cttcagcaactttggaatgttt

SEQ ID NO: 9097164 - DNA, 22 bp, Homo sapiens
cttcagcaactttggaatgttt

SEQ ID NO: 9097165 - DNA, 22 bp, Homo sapiens
cttcagcagcctcttgcataaa

SEQ ID NO: 9097166 - DNA, 23 bp, Homo sapiens
cttcagcagaaacataaattctc

SEQ ID NO: 9097167 - DNA, 22 bp, Homo sapiens
ctgtttcatgaatgcaatttca

SEQ ID NO: 9097168 - DNA, 22 bp, Homo sapiens
ctgtttcatagagttgtgaatt

SEQ ID NO: 9097169 - DNA, 22 bp, Homo sapiens
ctgtttcatgtcttccgcagct

SEQ ID NO: 9097170 - DNA, 22 bp, Homo sapiens
ctgtttcagaacttcttaaaaa

SEQ ID NO: 9097171 - DNA, 22 bp, Homo sapiens
ctgtttcagctactgttccatg

SEQ ID NO: 9097172 - DNA, 22 bp, Homo sapiens
ctgtttcacgtgtttaagccca

SEQ ID NO: 9097173 - DNA, 22 bp, Homo sapiens
ctgtttcaagtgaagtcagaca

SEQ ID NO: 9097174 - DNA, 19 bp, Homo sapiens
ctgtttcaagtaggaggag

SEQ ID NO: 9097175 - DNA, 22 bp, Homo sapiens
ctgtttcaaagggtactgtgag

SEQ ID NO: 9097176 - DNA, 22 bp, Homo sapiens
ctgtttcaccactggctctttg

SEQ ID NO: 9097177 - DNA, 22 bp, Homo sapiens
ctgtttcaatttgaggatcagc

SEQ ID NO: 9097178 - DNA, 22 bp, Homo sapiens
ctgtttcaagtgaagtcagaca

SEQ ID NO: 9097179 - DNA, 22 bp, Homo sapiens
cttcagagagtccagggactgc

SEQ ID NO: 9097180 - DNA, 22 bp, Homo sapiens
cttcagagaacttgatcgctgc

SEQ ID NO: 9097181 - DNA, 22 bp, Homo sapiens
cttcagaagcctgcagcctttg

SEQ ID NO: 9097182 - DNA, 22 bp, Homo sapiens
ctggggaggcagggctgcccct

SEQ ID NO: 9097183 - DNA, 22 bp, Homo sapiens
ctggggaggatgctacgacctg

SEQ ID NO: 9097184 - DNA, 22 bp, Homo sapiens
ctggggaggatgctacgacctg

SEQ ID NO: 9097185 - DNA, 22 bp, Homo sapiens
ctgggctgttctgcccctgggt

SEQ ID NO: 9097186 - DNA, 22 bp, Homo sapiens
ctggggagtgaaattcttaaat

SEQ ID NO: 9097187 - DNA, 22 bp, Homo sapiens
ctggggatgggacctggcataa

SEQ ID NO: 9097188 - DNA, 22 bp, Homo sapiens
ctggggatcctttttgcatcta

SEQ ID NO: 9097189 - DNA, 22 bp, Homo sapiens
ctggggagtgaaggtaattaca

SEQ ID NO: 9097190 - DNA, 22 bp, Homo sapiens
ctggggagtgaaggtaattaca

SEQ ID NO: 9097191 - DNA, 22 bp, Homo sapiens
ctggggagtgaaggtaattaca

SEQ ID NO: 9097192 - DNA, 22 bp, Homo sapiens
ctgggctgtggtgtggcccaaa

SEQ ID NO: 9097193 - DNA, 23 bp, Homo sapiens
ctgggctgtcctgaggtcacctc

SEQ ID NO: 9097194 - DNA, 23 bp, Homo sapiens
ctgggctgtcctgaggtcacctc

SEQ ID NO: 9097195 - DNA, 22 bp, Homo sapiens
ctgggctgtcccaaccccatcc

SEQ ID NO: 9097196 - DNA, 22 bp, Homo sapiens
ctgggctgtcccagggcggcag

SEQ ID NO: 9097197 - DNA, 22 bp, Homo sapiens
ctgggctgtcaatggccctctg

SEQ ID NO: 9097198 - DNA, 22 bp, Homo sapiens
ctgggctgtcaatggccctctg

SEQ ID NO: 9097199 - DNA, 22 bp, Homo sapiens
ctgggctgtcaatggccctctg

SEQ ID NO: 9097200 - DNA, 22 bp, Homo sapiens
ctggtgggaagatggaaaacat

SEQ ID NO: 9097201 - DNA, 22 bp, Homo sapiens
ctggtgggaagatggaaaacat

SEQ ID NO: 9097202 - DNA, 22 bp, Homo sapiens
ctggtgggaggcaaggtggaag

SEQ ID NO: 9097203 - DNA, 22 bp, Homo sapiens
ctggtgggagcagcaggcagct

SEQ ID NO: 9097204 - DNA, 22 bp, Homo sapiens
ctggtgggagcagcaggcagct

SEQ ID NO: 9097205 - DNA, 22 bp, Homo sapiens
ctggtccttgacgcgtgggagg

SEQ ID NO: 9097206 - DNA, 19 bp, Homo sapiens
ctggtgcttgagtgagtca

SEQ ID NO: 9097207 - DNA, 22 bp, Homo sapiens
ctggtggaatggcagagggaac

SEQ ID NO: 9097208 - DNA, 22 bp, Homo sapiens
ctggggcagagcccagcaattt

SEQ ID NO: 9097209 - DNA, 22 bp, Homo sapiens
ctggtcctctccagcaggcatt

SEQ ID NO: 9097210 - DNA, 22 bp, Homo sapiens
ctggggcatcatccattctttc

SEQ ID NO: 9097211 - DNA, 22 bp, Homo sapiens
ctgtcattgtacatgttataca

SEQ ID NO: 9097212 - DNA, 22 bp, Homo sapiens
ctgtcatttaagacattctgga

SEQ ID NO: 9097213 - DNA, 22 bp, Homo sapiens
ctgtcatttaagacattctgga

SEQ ID NO: 9097214 - DNA, 22 bp, Homo sapiens
ctgtcattttcttccaatataa

SEQ ID NO: 9097215 - DNA, 21 bp, Homo sapiens
ctgtccacatcacagagcctc

SEQ ID NO: 9097216 - DNA, 21 bp, Homo sapiens
ctgtccacatcacagagcctc

SEQ ID NO: 9097217 - DNA, 22 bp, Homo sapiens
ctgtccagcttggctcctgggg

SEQ ID NO: 9097218 - DNA, 22 bp, Homo sapiens
ctgtccagctgaccagagcagc

SEQ ID NO: 9097219 - DNA, 22 bp, Homo sapiens
ctgtccagctgaccagagcagc

SEQ ID NO: 9097220 - DNA, 22 bp, Homo sapiens
ctgtatttagttaaaatgctaa

SEQ ID NO: 9097221 - DNA, 22 bp, Homo sapiens
ctgtatttcccacattctctat

SEQ ID NO: 9097222 - DNA, 22 bp, Homo sapiens
ctgtatttagttaaaatgctaa

SEQ ID NO: 9097223 - DNA, 22 bp, Homo sapiens
ctgtatttagttaaaatgctaa

SEQ ID NO: 9097224 - DNA, 22 bp, Homo sapiens
ctgtattagtccatttgagctg

SEQ ID NO: 9097225 - DNA, 22 bp, Homo sapiens
atattttgaagttaataatgtg

SEQ ID NO: 9097226 - DNA, 22 bp, Homo sapiens
atattttgaagttaataatgtg

SEQ ID NO: 9097227 - DNA, 22 bp, Homo sapiens
atattttggcaaatgtctagat

SEQ ID NO: 9097228 - DNA, 22 bp, Homo sapiens
ctgtaatcccagctactcggga

SEQ ID NO: 9097229 - DNA, 22 bp, Homo sapiens
ctgtatctgtgttggatgagtt

SEQ ID NO: 9097230 - DNA, 22 bp, Homo sapiens
atatttgttagagtctatgtgt

SEQ ID NO: 9097231 - DNA, 22 bp, Homo sapiens
atatttgttagagtctatgtgt

SEQ ID NO: 9097232 - DNA, 22 bp, Homo sapiens
atatttgttgagttcttatgat

SEQ ID NO: 9097233 - DNA, 22 bp, Homo sapiens
atattttcacagaacttgcaaa

SEQ ID NO: 9097234 - DNA, 22 bp, Homo sapiens
atattttcacagaacttgcaaa

SEQ ID NO: 9097235 - DNA, 22 bp, Homo sapiens
atatttgttgagttcttatgat

SEQ ID NO: 9097236 - DNA, 22 bp, Homo sapiens
atatttgtttggcagagttcag

SEQ ID NO: 9097237 - DNA, 22 bp, Homo sapiens
atattttccgaacttgaggtag

SEQ ID NO: 9097238 - DNA, 22 bp, Homo sapiens
atattttccgaacttgaggtag

SEQ ID NO: 9097239 - DNA, 22 bp, Homo sapiens
atattttctggaactatgcctg

SEQ ID NO: 9097240 - DNA, 22 bp, Homo sapiens
ctgggccatcagaggggctgga

SEQ ID NO: 9097241 - DNA, 22 bp, Homo sapiens
ctgggccagttatgtctcatct

SEQ ID NO: 9097242 - DNA, 22 bp, Homo sapiens
ctgggccagtctcggccgctct

SEQ ID NO: 9097243 - DNA, 20 bp, Homo sapiens
ctgggccatccttttacaat

SEQ ID NO: 9097244 - DNA, 22 bp, Homo sapiens
ctgggccatctcctttgtgtgg

SEQ ID NO: 9097245 - DNA, 22 bp, Homo sapiens
ctgggccagtctcggccgctct

SEQ ID NO: 9097246 - DNA, 22 bp, Homo sapiens
ctgggccagggaggtgtctgta

SEQ ID NO: 9097247 - DNA, 22 bp, Homo sapiens
ctgggcagtttacattcctacc

SEQ ID NO: 9097248 - DNA, 22 bp, Homo sapiens
ctgggcagttcgctttcgtttt

SEQ ID NO: 9097249 - DNA, 22 bp, Homo sapiens
ctgggcagttcgctttcgtttt

SEQ ID NO: 9097250 - DNA, 22 bp, Homo sapiens
ctgggccagggaggtgtctgta

SEQ ID NO: 9097251 - DNA, 22 bp, Homo sapiens
ctgggccatctctctgcaagtg

SEQ ID NO: 9097252 - DNA, 22 bp, Homo sapiens
ctgggccatggaagtctctgcc

SEQ ID NO: 9097253 - DNA, 22 bp, Homo sapiens
ctgggccatgggccagcgaggc

SEQ ID NO: 9097254 - DNA, 22 bp, Homo sapiens
ctgggccatgggccagcgaggc

SEQ ID NO: 9097255 - DNA, 22 bp, Homo sapiens
ctgggccatgggccagcgaggc

SEQ ID NO: 9097256 - DNA, 22 bp, Homo sapiens
ctgggcctctcagctcccgcgg

SEQ ID NO: 9097257 - DNA, 17 bp, Homo sapiens
ctgggcctctgcccttt

SEQ ID NO: 9097258 - DNA, 17 bp, Homo sapiens
ctgggcctctgcccttt

SEQ ID NO: 9097259 - DNA, 22 bp, Homo sapiens
ctgggctgtaatgtggcactga

SEQ ID NO: 9097260 - DNA, 22 bp, Homo sapiens
ctgggcctgggaggccaggtct

SEQ ID NO: 9097261 - DNA, 22 bp, Homo sapiens
ctgggcctggggctgttgagag

SEQ ID NO: 9097262 - DNA, 22 bp, Homo sapiens
ctgggcctgggaggccaggtct

SEQ ID NO: 9097263 - DNA, 22 bp, Homo sapiens
ctgggcctgggaggccaggtct

SEQ ID NO: 9097264 - DNA, 22 bp, Homo sapiens
ctgggcctggcgttccaggctg

SEQ ID NO: 9097265 - DNA, 22 bp, Homo sapiens
ctgggcctggagcccacgagcc

SEQ ID NO: 9097266 - DNA, 22 bp, Homo sapiens
ctgggcctggcgttccaggctg

SEQ ID NO: 9097267 - DNA, 22 bp, Homo sapiens
ctgggcctggacgggcagatct

SEQ ID NO: 9097268 - DNA, 22 bp, Homo sapiens
ctgggcctggacgggcagatct

SEQ ID NO: 9097269 - DNA, 22 bp, Homo sapiens
ctgggcctggacgggcagatct

SEQ ID NO: 9097270 - DNA, 22 bp, Homo sapiens
ctgggcctgccaccatcttagg

SEQ ID NO: 9097271 - DNA, 22 bp, Homo sapiens
ctgggcctgccaccatcttagg

SEQ ID NO: 9097272 - DNA, 22 bp, Homo sapiens
ctgggcctgagctctgaagagt

SEQ ID NO: 9097273 - DNA, 19 bp, Homo sapiens
ctgggcctgcatggttgtt

SEQ ID NO: 9097274 - DNA, 23 bp, Homo sapiens
atagtcatgtaaaatatttgaag

SEQ ID NO: 9097275 - DNA, 22 bp, Homo sapiens
atagtatttccagaaatagtct

SEQ ID NO: 9097276 - DNA, 22 bp, Homo sapiens
atagtatttccagaaatagtct

SEQ ID NO: 9097277 - DNA, 18 bp, Homo sapiens
atagtgcagatcaagccc

SEQ ID NO: 9097278 - DNA, 19 bp, Homo sapiens
atatatgtatacaatgtgg

SEQ ID NO: 9097279 - DNA, 22 bp, Homo sapiens
atatattttgcggtcacgtggc

SEQ ID NO: 9097280 - DNA, 22 bp, Homo sapiens
atatattttgcggtcacgtggc

SEQ ID NO: 9097281 - DNA, 22 bp, Homo sapiens
atatattttttgagacagagtc

SEQ ID NO: 9097282 - DNA, 23 bp, Homo sapiens
atatcacacccagtacagtctcc

SEQ ID NO: 9097283 - DNA, 22 bp, Homo sapiens
atatcaaacgaagttattttaa

SEQ ID NO: 9097284 - DNA, 22 bp, Homo sapiens
agtctgcattcacagcaattat

SEQ ID NO: 9097285 - DNA, 22 bp, Homo sapiens
agtctgccaagccagatcatgt

SEQ ID NO: 9097286 - DNA, 22 bp, Homo sapiens
agtctgcactcaggtggaggtc

SEQ ID NO: 9097287 - DNA, 22 bp, Homo sapiens
agtctgagtctaaaggcttgag

SEQ ID NO: 9097288 - DNA, 22 bp, Homo sapiens
agtctgagtatctctgagccag

SEQ ID NO: 9097289 - DNA, 23 bp, Homo sapiens
agtctgaattgagatgtgctgtg

SEQ ID NO: 9097290 - DNA, 22 bp, Homo sapiens
agtctgaagatattcttgcagg

SEQ ID NO: 9097291 - DNA, 22 bp, Homo sapiens
agtctgaaggcaatctgctgac

SEQ ID NO: 9097292 - DNA, 22 bp, Homo sapiens
agtctgaagtagtctttagtgt

SEQ ID NO: 9097293 - DNA, 22 bp, Homo sapiens
agtctgaagactcatgtctgaa

SEQ ID NO: 9097294 - DNA, 22 bp, Homo sapiens
agtctgaaccagatggcaaggt

SEQ ID NO: 9097295 - DNA, 22 bp, Homo sapiens
agtctgaaccagatggcaaggt

SEQ ID NO: 9097296 - DNA, 22 bp, Homo sapiens
agtcattatgggtaaagttttt

SEQ ID NO: 9097297 - DNA, 22 bp, Homo sapiens
agtcatcaccagtacagtgtgc

SEQ ID NO: 9097298 - DNA, 22 bp, Homo sapiens
agtccaaagcagatgagggcca

SEQ ID NO: 9097299 - DNA, 22 bp, Homo sapiens
agtccaaacaaacttcccgagg

SEQ ID NO: 9097300 - DNA, 22 bp, Homo sapiens
agtctgtgactcattggatctc

SEQ ID NO: 9097301 - DNA, 22 bp, Homo sapiens
agtctgtgaaaagataggaagt

SEQ ID NO: 9097302 - DNA, 22 bp, Homo sapiens
agtctgcctttccaatcccgtg

SEQ ID NO: 9097303 - DNA, 20 bp, Homo sapiens
agtctgcctgctccttctcc

SEQ ID NO: 9097304 - DNA, 22 bp, Homo sapiens
agtctggaatttggcctgagca

SEQ ID NO: 9097305 - DNA, 22 bp, Homo sapiens
agtctgtgtatattcactgccc

SEQ ID NO: 9097306 - DNA, 22 bp, Homo sapiens
ctcaggcacgggtcagtgagcg

SEQ ID NO: 9097307 - DNA, 22 bp, Homo sapiens
ctcaggcaaggcccgcattctc

SEQ ID NO: 9097308 - DNA, 22 bp, Homo sapiens
ctcaggcacttttgtcacagac

SEQ ID NO: 9097309 - DNA, 22 bp, Homo sapiens
ctcaggcacttttgtcacagac

SEQ ID NO: 9097310 - DNA, 22 bp, Homo sapiens
ctcaggcacgggtcagtgagcg

SEQ ID NO: 9097311 - DNA, 22 bp, Homo sapiens
ctcctccctgcgattgctctgc

SEQ ID NO: 9097312 - DNA, 22 bp, Homo sapiens
ctcctccctgcgattgctctgc

SEQ ID NO: 9097313 - DNA, 22 bp, Homo sapiens
ctcctccctctttgccacacat

SEQ ID NO: 9097314 - DNA, 22 bp, Homo sapiens
ctcctcccacggtctcaggaag

SEQ ID NO: 9097315 - DNA, 22 bp, Homo sapiens
ctcctcccacggtctcaggaag

SEQ ID NO: 9097316 - DNA, 22 bp, Homo sapiens
ctcctctcaaaagtaggttgac

SEQ ID NO: 9097317 - DNA, 22 bp, Homo sapiens
ctcctctcaggctggatggcgc

SEQ ID NO: 9097318 - DNA, 22 bp, Homo sapiens
agtgcagctgggactgtagggt

SEQ ID NO: 9097319 - DNA, 22 bp, Homo sapiens
ctcctcagctgggaggagtccc

SEQ ID NO: 9097320 - DNA, 22 bp, Homo sapiens
ctcctcagagagcagcttgggg

SEQ ID NO: 9097321 - DNA, 22 bp, Homo sapiens
ctcccaggttacatctgagcct

SEQ ID NO: 9097322 - DNA, 22 bp, Homo sapiens
ctcccaggtgtcccttctgcca

SEQ ID NO: 9097323 - DNA, 22 bp, Homo sapiens
ctcccaggtgtcccttctgcca

SEQ ID NO: 9097324 - DNA, 22 bp, Homo sapiens
ctcccagggtagggagagacta

SEQ ID NO: 9097325 - DNA, 22 bp, Homo sapiens
ctcccagggtctaggctgctgg

SEQ ID NO: 9097326 - DNA, 22 bp, Homo sapiens
ctccagtgtctcagagcagatg

SEQ ID NO: 9097327 - DNA, 22 bp, Homo sapiens
ctccagtggtgatggggaagaa

SEQ ID NO: 9097328 - DNA, 22 bp, Homo sapiens
ctccagttggccccagttggtt

SEQ ID NO: 9097329 - DNA, 22 bp, Homo sapiens
ctccagttggccccagttggtt

SEQ ID NO: 9097330 - DNA, 20 bp, Homo sapiens
ctccagtgttcaggggagtg

SEQ ID NO: 9097331 - DNA, 20 bp, Homo sapiens
ctccagtgttcaggggagtg

SEQ ID NO: 9097332 - DNA, 22 bp, Homo sapiens
ctccagtgcttctagaaaatac

SEQ ID NO: 9097333 - DNA, 22 bp, Homo sapiens
ctccagtgggggtgagcctaga

SEQ ID NO: 9097334 - DNA, 22 bp, Homo sapiens
agtgacagtctcagagatcagg

SEQ ID NO: 9097335 - DNA, 22 bp, Homo sapiens
agtgacagtatttgttgccaat

SEQ ID NO: 9097336 - DNA, 22 bp, Homo sapiens
agtgacagtctcagagatcagg

SEQ ID NO: 9097337 - DNA, 22 bp, Homo sapiens
agtgacagtttcaggcattttt

SEQ ID NO: 9097338 - DNA, 22 bp, Homo sapiens
agtgacagtttcaggcattttt

SEQ ID NO: 9097339 - DNA, 22 bp, Homo sapiens
agtgacagtttcaggcattttt

SEQ ID NO: 9097340 - DNA, 22 bp, Homo sapiens
agtgacagtctgatttctcaaa

SEQ ID NO: 9097341 - DNA, 22 bp, Homo sapiens
ctccagttggccccagttggtt

SEQ ID NO: 9097342 - DNA, 20 bp, Homo sapiens
ctccatgacttgaattagta

SEQ ID NO: 9097343 - DNA, 22 bp, Homo sapiens
agtgacagtatttgttgccaat

SEQ ID NO: 9097344 - DNA, 22 bp, Homo sapiens
agtgactggtgtgaagttaaat

SEQ ID NO: 9097345 - DNA, 22 bp, Homo sapiens
agtgactggttttgacaggaat

SEQ ID NO: 9097346 - DNA, 22 bp, Homo sapiens
agtgactggtgtgaagttaaat

SEQ ID NO: 9097347 - DNA, 22 bp, Homo sapiens
agtgaccaatcactgaatgatt

SEQ ID NO: 9097348 - DNA, 22 bp, Homo sapiens
agtgacatttgcaccagctgct

SEQ ID NO: 9097349 - DNA, 22 bp, Homo sapiens
agtgaccatctaacgcctgtga

SEQ ID NO: 9097350 - DNA, 22 bp, Homo sapiens
agtgcacaccttagtacaaagt

SEQ ID NO: 9097351 - DNA, 22 bp, Homo sapiens
agtgcacaccttagtacaaagt

SEQ ID NO: 9097352 - DNA, 22 bp, Homo sapiens
agtgcagaggctgggaaatgct

SEQ ID NO: 9097353 - DNA, 22 bp, Homo sapiens
agtgcagagtacatttgtggca

SEQ ID NO: 9097354 - DNA, 22 bp, Homo sapiens
agtgcagaggctgggaaatgct

SEQ ID NO: 9097355 - DNA, 22 bp, Homo sapiens
agtgcagatttttagtcagctt

SEQ ID NO: 9097356 - DNA, 22 bp, Homo sapiens
agtgcagagagcaatactctac

SEQ ID NO: 9097357 - DNA, 22 bp, Homo sapiens
agtgcagactgaaatgaccttc

SEQ ID NO: 9097358 - DNA, 22 bp, Homo sapiens
agtgcagagacctggtcaggca

SEQ ID NO: 9097359 - DNA, 22 bp, Homo sapiens
ctctctgggggccatgccaaga

SEQ ID NO: 9097360 - DNA, 22 bp, Homo sapiens
ctctctgggggccatgccaaga

SEQ ID NO: 9097361 - DNA, 22 bp, Homo sapiens
ctctctgggcccagttggcacc

SEQ ID NO: 9097362 - DNA, 22 bp, Homo sapiens
ctctctgggcccagttggcacc

SEQ ID NO: 9097363 - DNA, 22 bp, Homo sapiens
ctctctgggcccagttggcacc

SEQ ID NO: 9097364 - DNA, 22 bp, Homo sapiens
ctctctgggaatattttattct

SEQ ID NO: 9097365 - DNA, 22 bp, Homo sapiens
ctctctggcttggcacggagat

SEQ ID NO: 9097366 - DNA, 22 bp, Homo sapiens
ctctctgggaatattttattct

SEQ ID NO: 9097367 - DNA, 22 bp, Homo sapiens
ctctctggtacatagagtttgg

SEQ ID NO: 9097368 - DNA, 18 bp, Homo sapiens
ctctctgggtgaggacaa

SEQ ID NO: 9097369 - DNA, 22 bp, Homo sapiens
ctctctgggtcctcttttatag

SEQ ID NO: 9097370 - DNA, 22 bp, Homo sapiens
ctctctgggtcctcttttatag

SEQ ID NO: 9097371 - DNA, 22 bp, Homo sapiens
ctctctggggttccagacgtgg

SEQ ID NO: 9097372 - DNA, 22 bp, Homo sapiens
agtgcaggccccaggccaggcc

SEQ ID NO: 9097373 - DNA, 22 bp, Homo sapiens
ctctctccttagctgcagacca

SEQ ID NO: 9097374 - DNA, 22 bp, Homo sapiens
ctctctggcttggcacggagat

SEQ ID NO: 9097375 - DNA, 22 bp, Homo sapiens
agtggctggacgacaagggtga

SEQ ID NO: 9097376 - DNA, 22 bp, Homo sapiens
agtggctggagccccaggctgg

SEQ ID NO: 9097377 - DNA, 22 bp, Homo sapiens
agtggctggcataggaacagac

SEQ ID NO: 9097378 - DNA, 23 bp, Homo sapiens
agtggctggacagactttcctgg

SEQ ID NO: 9097379 - DNA, 22 bp, Homo sapiens
agtggctgaagcatcaaaggca

SEQ ID NO: 9097380 - DNA, 22 bp, Homo sapiens
agtggctgaatatattttacta

SEQ ID NO: 9097381 - DNA, 22 bp, Homo sapiens
agtggcagccgagcaggagatg

SEQ ID NO: 9097382 - DNA, 22 bp, Homo sapiens
ctctctggtcccagattccaga

SEQ ID NO: 9097383 - DNA, 22 bp, Homo sapiens
ctctctggtacatagagtttgg

SEQ ID NO: 9097384 - DNA, 22 bp, Homo sapiens
ctctctggtcccagattccaga

SEQ ID NO: 9097385 - DNA, 22 bp, Homo sapiens
agtggcaggaaagtggaagaga

SEQ ID NO: 9097386 - DNA, 22 bp, Homo sapiens
ctctgagcagaggccgtggcta

SEQ ID NO: 9097387 - DNA, 22 bp, Homo sapiens
agtgggagagaagcaagtagta

SEQ ID NO: 9097388 - DNA, 22 bp, Homo sapiens
agtgggcagtgcgctcggatgc

SEQ ID NO: 9097389 - DNA, 22 bp, Homo sapiens
agtgggcagcccaggaggtctt

SEQ ID NO: 9097390 - DNA, 22 bp, Homo sapiens
agtgggcagcccaggaggtctt

SEQ ID NO: 9097391 - DNA, 22 bp, Homo sapiens
agtgggcaaaacagctcagagc

SEQ ID NO: 9097392 - DNA, 22 bp, Homo sapiens
agtggggaagagcatgggccct

SEQ ID NO: 9097393 - DNA, 22 bp, Homo sapiens
agtgggcatgatctggtgtctg

SEQ ID NO: 9097394 - DNA, 22 bp, Homo sapiens
agtgggcatatgaagtctcaag

SEQ ID NO: 9097395 - DNA, 22 bp, Homo sapiens
ctctgagagtgctcagagggta

SEQ ID NO: 9097396 - DNA, 22 bp, Homo sapiens
ctctgagagagctggtgagcac

SEQ ID NO: 9097397 - DNA, 22 bp, Homo sapiens
ctctgagagcggtctgtggctt

SEQ ID NO: 9097398 - DNA, 22 bp, Homo sapiens
ctctgagaagccttgatgggga

SEQ ID NO: 9097399 - DNA, 22 bp, Homo sapiens
ctctgagaaagctgtgagctaa

SEQ ID NO: 9097400 - DNA, 22 bp, Homo sapiens
ctctgagactcaagtgagtggg

SEQ ID NO: 9097401 - DNA, 22 bp, Homo sapiens
agtggctggtagttactgagca

SEQ ID NO: 9097402 - DNA, 19 bp, Homo sapiens
agtggctgggcagaagcaa

SEQ ID NO: 9097403 - DNA, 22 bp, Homo sapiens
agtggctgtaggctatgagaga

SEQ ID NO: 9097404 - DNA, 22 bp, Homo sapiens
agtggctgtatcagtcaaccct

SEQ ID NO: 9097405 - DNA, 22 bp, Homo sapiens
agtggctggtctaaggtcacag

SEQ ID NO: 9097406 - DNA, 22 bp, Homo sapiens
agtggctgtactattttttcat

SEQ ID NO: 9097407 - DNA, 22 bp, Homo sapiens
ctctgacattctgtgactctga

SEQ ID NO: 9097408 - DNA, 21 bp, Homo sapiens
agtggctgtcaagggggcctt

SEQ ID NO: 9097409 - DNA, 22 bp, Homo sapiens
agtggctgtcctggctctaact

SEQ ID NO: 9097410 - DNA, 22 bp, Homo sapiens
agtggggacaatgagagcaggt

SEQ ID NO: 9097411 - DNA, 20 bp, Homo sapiens
agtggggagtcaggagtgcc

SEQ ID NO: 9097412 - DNA, 22 bp, Homo sapiens
agtggggaggtccaggccaccc

SEQ ID NO: 9097413 - DNA, 22 bp, Homo sapiens
agtgtctgaacctgcagtggga

SEQ ID NO: 9097414 - DNA, 22 bp, Homo sapiens
agtgtctgaaggatttggcttc

SEQ ID NO: 9097415 - DNA, 22 bp, Homo sapiens
agtgtctgaagcctcagcccga

SEQ ID NO: 9097416 - DNA, 22 bp, Homo sapiens
agtgtctgaactgggtgctgac

SEQ ID NO: 9097417 - DNA, 22 bp, Homo sapiens
agtgtctgagctatcattaggg

SEQ ID NO: 9097418 - DNA, 21 bp, Homo sapiens
agtgtctgagcgctgcttctg

SEQ ID NO: 9097419 - DNA, 22 bp, Homo sapiens
agtgtctgagccagaattagaa

SEQ ID NO: 9097420 - DNA, 22 bp, Homo sapiens
agtgtctgagtaaatttctcat

SEQ ID NO: 9097421 - DNA, 22 bp, Homo sapiens
agtgtctgatcagttgactaga

SEQ ID NO: 9097422 - DNA, 22 bp, Homo sapiens
agtgtctgatgcacagttgtcc

SEQ ID NO: 9097423 - DNA, 23 bp, Homo sapiens
agtgtctgagtgcaggctgtgca

SEQ ID NO: 9097424 - DNA, 18 bp, Homo sapiens
ctcttaagcctttgtcaa

SEQ ID NO: 9097425 - DNA, 18 bp, Homo sapiens
ctcttaagcctttgtcaa

SEQ ID NO: 9097426 - DNA, 22 bp, Homo sapiens
ctcttaatgaccttaattcaag

SEQ ID NO: 9097427 - DNA, 20 bp, Homo sapiens
ctcttaaatgtaaagtaggc

SEQ ID NO: 9097428 - DNA, 22 bp, Homo sapiens
ctcttagatatggagaattacc

SEQ ID NO: 9097429 - DNA, 19 bp, Homo sapiens
ctcttacagaatagacaca

SEQ ID NO: 9097430 - DNA, 22 bp, Homo sapiens
agtgtctgcctatttttcaagc

SEQ ID NO: 9097431 - DNA, 22 bp, Homo sapiens
ctctgtttggcgctgctccttc

SEQ ID NO: 9097432 - DNA, 22 bp, Homo sapiens
ctcttaaaaacttgatatattt

SEQ ID NO: 9097433 - DNA, 22 bp, Homo sapiens
agtgtctgccagctgccaggtg

SEQ ID NO: 9097434 - DNA, 22 bp, Homo sapiens
agtgtctgccaactgcatggtc

SEQ ID NO: 9097435 - DNA, 22 bp, Homo sapiens
agtgtctgccagctgccaggtg

SEQ ID NO: 9097436 - DNA, 22 bp, Homo sapiens
agtgtctgcagtgatgtctctt

SEQ ID NO: 9097437 - DNA, 22 bp, Homo sapiens
agtgtctgcaaaatgaaagagc

SEQ ID NO: 9097438 - DNA, 22 bp, Homo sapiens
agtgtctgatgcacagttgtcc

SEQ ID NO: 9097439 - DNA, 22 bp, Homo sapiens
agtgtgtgtttgggcggtttat

SEQ ID NO: 9097440 - DNA, 22 bp, Homo sapiens
agtgtgtgtttgggcggtttat

SEQ ID NO: 9097441 - DNA, 22 bp, Homo sapiens
agtgtgtgtttgggcggtttat

SEQ ID NO: 9097442 - DNA, 21 bp, Homo sapiens
agtgtgtgtggaatgagaata

SEQ ID NO: 9097443 - DNA, 22 bp, Homo sapiens
ctgaagcaattgagagatgttt

SEQ ID NO: 9097444 - DNA, 22 bp, Homo sapiens
ctgaagcaggaacagcgagatt

SEQ ID NO: 9097445 - DNA, 22 bp, Homo sapiens
ctgaagcagatgtggctgagat

SEQ ID NO: 9097446 - DNA, 22 bp, Homo sapiens
ctgaagcaaatgaaacagctct

SEQ ID NO: 9097447 - DNA, 22 bp, Homo sapiens
agtgtgggggctttggtgtcac

SEQ ID NO: 9097448 - DNA, 21 bp, Homo sapiens
agtgtgtgataggcaggaaga

SEQ ID NO: 9097449 - DNA, 21 bp, Homo sapiens
agtgtgtgataggcaggaaga

SEQ ID NO: 9097450 - DNA, 22 bp, Homo sapiens
agtgtgtgcatgcattcgtgca

SEQ ID NO: 9097451 - DNA, 22 bp, Homo sapiens
agtgtgtgcatgcattcgtgca

SEQ ID NO: 9097452 - DNA, 18 bp, Homo sapiens
agtgtgtgccctttcagg

SEQ ID NO: 9097453 - DNA, 18 bp, Homo sapiens
agtgtgtgccctttcagg

SEQ ID NO: 9097454 - DNA, 22 bp, Homo sapiens
agtgtgtgcctttggatacctg

SEQ ID NO: 9097455 - DNA, 22 bp, Homo sapiens
agtgtgtgctgttccccggagg

SEQ ID NO: 9097456 - DNA, 21 bp, Homo sapiens
agtgtgtgtggaatgagaata

SEQ ID NO: 9097457 - DNA, 22 bp, Homo sapiens
ctgagaggatgctgcagtggag

SEQ ID NO: 9097458 - DNA, 22 bp, Homo sapiens
ctgagaggatgctgcagtggag

SEQ ID NO: 9097459 - DNA, 22 bp, Homo sapiens
ctgagaggcggagcttgcagtg

SEQ ID NO: 9097460 - DNA, 22 bp, Homo sapiens
ctgagaggcggaggttgcagtg

SEQ ID NO: 9097461 - DNA, 22 bp, Homo sapiens
ctgagaggcggagcttgcagtg

SEQ ID NO: 9097462 - DNA, 22 bp, Homo sapiens
ctgagaggcacaaggcatttcg

SEQ ID NO: 9097463 - DNA, 22 bp, Homo sapiens
ctgagaggcagccagagaaaat

SEQ ID NO: 9097464 - DNA, 22 bp, Homo sapiens
ctgaagcagggagtgatgaagt

SEQ ID NO: 9097465 - DNA, 22 bp, Homo sapiens
ctgaagcagggagtgatgaagt

SEQ ID NO: 9097466 - DNA, 22 bp, Homo sapiens
ctgaagcatatcatgccaagtt

SEQ ID NO: 9097467 - DNA, 22 bp, Homo sapiens
ctgaagcatatcatgccaagtt

SEQ ID NO: 9097468 - DNA, 22 bp, Homo sapiens
ctgaagcatgcgtttgtaaact

SEQ ID NO: 9097469 - DNA, 22 bp, Homo sapiens
ctgaagccacgatagcttccta

SEQ ID NO: 9097470 - DNA, 22 bp, Homo sapiens
ctgaagccacgatagcttccta

SEQ ID NO: 9097471 - DNA, 22 bp, Homo sapiens
ctgaagctctccagtttgtttc

SEQ ID NO: 9097472 - DNA, 22 bp, Homo sapiens
ctgaagctaggtcaaaaaaggg

SEQ ID NO: 9097473 - DNA, 22 bp, Homo sapiens
ctgaagctgcataccaaagact

SEQ ID NO: 9097474 - DNA, 22 bp, Homo sapiens
ctgaagctgaaaacttccagca

SEQ ID NO: 9097475 - DNA, 22 bp, Homo sapiens
ctgaagcttgataaactataaa

SEQ ID NO: 9097476 - DNA, 22 bp, Homo sapiens
ctgaagcttgataaactataaa

SEQ ID NO: 9097477 - DNA, 22 bp, Homo sapiens
ctgaagcttagtttacgctcca

SEQ ID NO: 9097478 - DNA, 22 bp, Homo sapiens
ctgaagctgggcacttcctttt

SEQ ID NO: 9097479 - DNA, 17 bp, Homo sapiens
aggtataaaatggtagc

SEQ ID NO: 9097480 - DNA, 22 bp, Homo sapiens
cctggctcattatgtgccccca

SEQ ID NO: 9097481 - DNA, 22 bp, Homo sapiens
aggtataagtctcatttctgtt

SEQ ID NO: 9097482 - DNA, 22 bp, Homo sapiens
aggtatcaacagcagagtctga

SEQ ID NO: 9097483 - DNA, 22 bp, Homo sapiens
aggtatctggtaagaggcagac

SEQ ID NO: 9097484 - DNA, 22 bp, Homo sapiens
cctggctcaaggcgaggactcc

SEQ ID NO: 9097485 - DNA, 22 bp, Homo sapiens
cctggctcaaggcgaggactcc

SEQ ID NO: 9097486 - DNA, 22 bp, Homo sapiens
cctggcctttgaacgctagact

SEQ ID NO: 9097487 - DNA, 22 bp, Homo sapiens
cctggccttaagggcagggagc

SEQ ID NO: 9097488 - DNA, 22 bp, Homo sapiens
cctggctcagaccccagttctg

SEQ ID NO: 9097489 - DNA, 22 bp, Homo sapiens
cctggctcagaccccagttctg

SEQ ID NO: 9097490 - DNA, 22 bp, Homo sapiens
cctggctcagcagctctttctc

SEQ ID NO: 9097491 - DNA, 22 bp, Homo sapiens
cctggccttaagggcagggagc

SEQ ID NO: 9097492 - DNA, 22 bp, Homo sapiens
cctggccagcagccccttcctc

SEQ ID NO: 9097493 - DNA, 22 bp, Homo sapiens
cctggagctcactgggagccgg

SEQ ID NO: 9097494 - DNA, 22 bp, Homo sapiens
cctggagctcactgggagccgg

SEQ ID NO: 9097495 - DNA, 22 bp, Homo sapiens
cctggagcccctctggccagcc

SEQ ID NO: 9097496 - DNA, 22 bp, Homo sapiens
cctggagcccctctggccagcc

SEQ ID NO: 9097497 - DNA, 22 bp, Homo sapiens
cctggagcgcgggtcaagctgg

SEQ ID NO: 9097498 - DNA, 22 bp, Homo sapiens
cctggagcgcgggtcaagctgg

SEQ ID NO: 9097499 - DNA, 20 bp, Homo sapiens
cctggagcctggaaggagtc

SEQ ID NO: 9097500 - DNA, 22 bp, Homo sapiens
cctgcctgcgtcctctgagggc

SEQ ID NO: 9097501 - DNA, 22 bp, Homo sapiens
cctgcctgcgtcctctgagggc

SEQ ID NO: 9097502 - DNA, 22 bp, Homo sapiens
agggtggcagttactggagcaa

SEQ ID NO: 9097503 - DNA, 20 bp, Homo sapiens
agggtggcaagttagtgaca

SEQ ID NO: 9097504 - DNA, 23 bp, Homo sapiens
agggtgagcaagctatggagacc

SEQ ID NO: 9097505 - DNA, 22 bp, Homo sapiens
aggggcttatgtttctccaggc

SEQ ID NO: 9097506 - DNA, 22 bp, Homo sapiens
agggtggagggagtccctgagc

SEQ ID NO: 9097507 - DNA, 23 bp, Homo sapiens
agggtgagcaagctatggagacc

SEQ ID NO: 9097508 - DNA, 22 bp, Homo sapiens
agggtgcgttctatgagaatct

SEQ ID NO: 9097509 - DNA, 22 bp, Homo sapiens
cctggagcactctccctggctg

SEQ ID NO: 9097510 - DNA, 22 bp, Homo sapiens
cctggagcaggagctgcagagg

SEQ ID NO: 9097511 - DNA, 22 bp, Homo sapiens
cctggagcaggagctgcagagg

SEQ ID NO: 9097512 - DNA, 22 bp, Homo sapiens
cctggagcaggagctgcagagg

SEQ ID NO: 9097513 - DNA, 21 bp, Homo sapiens
cctggactaaaaccaggccac

SEQ ID NO: 9097514 - DNA, 21 bp, Homo sapiens
cctggactaaaaccaggccac

SEQ ID NO: 9097515 - DNA, 22 bp, Homo sapiens
cctggagcaggagctgcagagg

SEQ ID NO: 9097516 - DNA, 22 bp, Homo sapiens
cctggagcatcaggaggaaggg

SEQ ID NO: 9097517 - DNA, 22 bp, Homo sapiens
cctggagcccaaggcagtgaga

SEQ ID NO: 9097518 - DNA, 22 bp, Homo sapiens
cctggagcccaaggcagtgaga

SEQ ID NO: 9097519 - DNA, 22 bp, Homo sapiens
cctggagcccaaggcagtgaga

SEQ ID NO: 9097520 - DNA, 22 bp, Homo sapiens
cctggagcccaaggcagtgaga

SEQ ID NO: 9097521 - DNA, 22 bp, Homo sapiens
cctgcctgctttctgctttgca

SEQ ID NO: 9097522 - DNA, 22 bp, Homo sapiens
cctgcctgctttctgctttgca

SEQ ID NO: 9097523 - DNA, 22 bp, Homo sapiens
cctgcctggatcagccatcctg

SEQ ID NO: 9097524 - DNA, 22 bp, Homo sapiens
cctgcctggatcagccatcctg

SEQ ID NO: 9097525 - DNA, 22 bp, Homo sapiens
cctgcctggagctgagtgtgga

SEQ ID NO: 9097526 - DNA, 22 bp, Homo sapiens
cctgcctggagctgagtgtgga

SEQ ID NO: 9097527 - DNA, 22 bp, Homo sapiens
cctgcctggagctgagtgtgga

SEQ ID NO: 9097528 - DNA, 22 bp, Homo sapiens
cctgcctggctgtcagcagagc

SEQ ID NO: 9097529 - DNA, 22 bp, Homo sapiens
cctgcctggcccaccttgccac

SEQ ID NO: 9097530 - DNA, 22 bp, Homo sapiens
cctgcctggcacatagtactct

SEQ ID NO: 9097531 - DNA, 22 bp, Homo sapiens
aggtggagatcagggactaagg

SEQ ID NO: 9097532 - DNA, 23 bp, Homo sapiens
aggtggagctgtgcagccggggc

SEQ ID NO: 9097533 - DNA, 22 bp, Homo sapiens
aggtggagtgaaggaaaggcag

SEQ ID NO: 9097534 - DNA, 21 bp, Homo sapiens
aggtggagtgcttagcatcca

SEQ ID NO: 9097535 - DNA, 23 bp, Homo sapiens
cctgggtttcagagctgcttttc

SEQ ID NO: 9097536 - DNA, 22 bp, Homo sapiens
cctgggttggagagcaatggtg

SEQ ID NO: 9097537 - DNA, 22 bp, Homo sapiens
cctgggtgtcatgggcagctgg

SEQ ID NO: 9097538 - DNA, 22 bp, Homo sapiens
cctgggttagtatctgtttcca

SEQ ID NO: 9097539 - DNA, 22 bp, Homo sapiens
cctgggttattttggtctagtg

SEQ ID NO: 9097540 - DNA, 22 bp, Homo sapiens
cctgggtgtcatgggcagctgg

SEQ ID NO: 9097541 - DNA, 22 bp, Homo sapiens
aggtgcagaaaaaagtccttta

SEQ ID NO: 9097542 - DNA, 22 bp, Homo sapiens
aggtgcacctgagggtgtcatc

SEQ ID NO: 9097543 - DNA, 22 bp, Homo sapiens
cctgggcaggatgggcccggtg

SEQ ID NO: 9097544 - DNA, 21 bp, Homo sapiens
aggtgcagagccagggaccag

SEQ ID NO: 9097545 - DNA, 22 bp, Homo sapiens
aggtgcactgtctaattaggtc

SEQ ID NO: 9097546 - DNA, 22 bp, Homo sapiens
aggtgaggtttgggaggtgtca

SEQ ID NO: 9097547 - DNA, 22 bp, Homo sapiens
aggtgagtcctgggcacaggta

SEQ ID NO: 9097548 - DNA, 19 bp, Homo sapiens
aggtgatgtgactctagaa

SEQ ID NO: 9097549 - DNA, 22 bp, Homo sapiens
cctgggcaggtgtggcttcccc

SEQ ID NO: 9097550 - DNA, 22 bp, Homo sapiens
cctgggcaggtgtggcttcccc

SEQ ID NO: 9097551 - DNA, 22 bp, Homo sapiens
cctgggcaggtgtggcttcccc

SEQ ID NO: 9097552 - DNA, 22 bp, Homo sapiens
cctgggcagggagaccaggctc

SEQ ID NO: 9097553 - DNA, 22 bp, Homo sapiens
cctgggcaggatgggcccggtg

SEQ ID NO: 9097554 - DNA, 22 bp, Homo sapiens
cctgggcaggccggacgctggg

SEQ ID NO: 9097555 - DNA, 22 bp, Homo sapiens
cctgggcaggccggacgctggg

SEQ ID NO: 9097556 - DNA, 22 bp, Homo sapiens
aggtctgtctggccccatgaat

SEQ ID NO: 9097557 - DNA, 22 bp, Homo sapiens
aggtctggtgttgggcctgaaa

SEQ ID NO: 9097558 - DNA, 22 bp, Homo sapiens
aggtctggtgttgatgaattcc

SEQ ID NO: 9097559 - DNA, 18 bp, Homo sapiens
aggtctgtggtcaccagg

SEQ ID NO: 9097560 - DNA, 22 bp, Homo sapiens
aggtgaggtttgggaggtgtca

SEQ ID NO: 9097561 - DNA, 19 bp, Homo sapiens
aggtgaggggcaccatgtc

SEQ ID NO: 9097562 - DNA, 22 bp, Homo sapiens
aggtgagggtgccagtgcatgg

SEQ ID NO: 9097563 - DNA, 22 bp, Homo sapiens
aggtctgggcaccactggctgc

SEQ ID NO: 9097564 - DNA, 22 bp, Homo sapiens
aggtctggtatttttctatact

SEQ ID NO: 9097565 - DNA, 22 bp, Homo sapiens
aggtctggtgagagcaggtgct

SEQ ID NO: 9097566 - DNA, 22 bp, Homo sapiens
aggtctggtgggctttagattg

SEQ ID NO: 9097567 - DNA, 22 bp, Homo sapiens
aggtctggaggcggagtcagga

SEQ ID NO: 9097568 - DNA, 22 bp, Homo sapiens
aggtctggaggcggagtcagga

SEQ ID NO: 9097569 - DNA, 22 bp, Homo sapiens
aggtctggaggcggagtcagga

SEQ ID NO: 9097570 - DNA, 22 bp, Homo sapiens
aggtctggagtgggatctgaga

SEQ ID NO: 9097571 - DNA, 22 bp, Homo sapiens
aggtctggctcttctccacaga

SEQ ID NO: 9097572 - DNA, 22 bp, Homo sapiens
aggtattattagcatctctatt

SEQ ID NO: 9097573 - DNA, 22 bp, Homo sapiens
aggtctcttgctgtctctgggc

SEQ ID NO: 9097574 - DNA, 22 bp, Homo sapiens
aggtcctgtccttggtctctga

SEQ ID NO: 9097575 - DNA, 22 bp, Homo sapiens
aggtcctgtccttggtctctga

SEQ ID NO: 9097576 - DNA, 22 bp, Homo sapiens
aggtcctgtccttggtctctga

SEQ ID NO: 9097577 - DNA, 22 bp, Homo sapiens
aggtctgactctttgccacata

SEQ ID NO: 9097578 - DNA, 22 bp, Homo sapiens
aggtctggaaacagcagggaga

SEQ ID NO: 9097579 - DNA, 23 bp, Homo sapiens
aggtctggacccttggcccctgc

SEQ ID NO: 9097580 - DNA, 20 bp, Homo sapiens
aggtctgattccagaatcag

SEQ ID NO: 9097581 - DNA, 18 bp, Homo sapiens
aggtctgaggaagagcct

SEQ ID NO: 9097582 - DNA, 22 bp, Homo sapiens
aggtctgagtatggcctgagaa

SEQ ID NO: 9097583 - DNA, 22 bp, Homo sapiens
cgtggccagtttcaagctacca

SEQ ID NO: 9097584 - DNA, 22 bp, Homo sapiens
cgtgctctggactcgtggcaca

SEQ ID NO: 9097585 - DNA, 22 bp, Homo sapiens
cgtggcagtggaaggctgggtg

SEQ ID NO: 9097586 - DNA, 22 bp, Homo sapiens
ctaaacaagatactaatgaggt

SEQ ID NO: 9097587 - DNA, 22 bp, Homo sapiens
ctaaaattatcaagataattcc

SEQ ID NO: 9097588 - DNA, 22 bp, Homo sapiens
cgtggctggggaggtcagccag

SEQ ID NO: 9097589 - DNA, 17 bp, Homo sapiens
cgtggctgagccataga

SEQ ID NO: 9097590 - DNA, 22 bp, Homo sapiens
ctaaacctttgtgcttgcaatt

SEQ ID NO: 9097591 - DNA, 22 bp, Homo sapiens
ctaaacatcttgcaatgcacag

SEQ ID NO: 9097592 - DNA, 22 bp, Homo sapiens
ctaaacaagatactaatgaggt

SEQ ID NO: 9097593 - DNA, 22 bp, Homo sapiens
ctaaacaagggattataattga

SEQ ID NO: 9097594 - DNA, 22 bp, Homo sapiens
ctaaacaatgaacaaagcactg

SEQ ID NO: 9097595 - DNA, 22 bp, Homo sapiens
ctaaacaatgaacaaagcactg

SEQ ID NO: 9097596 - DNA, 19 bp, Homo sapiens
cgcctggcaggccctgcgc

SEQ ID NO: 9097597 - DNA, 22 bp, Homo sapiens
cgcctgggagtccacacctgct

SEQ ID NO: 9097598 - DNA, 22 bp, Homo sapiens
cgcggtggcggcctccagcgcc

SEQ ID NO: 9097599 - DNA, 22 bp, Homo sapiens
cgcgctgcagacagcggaggcc

SEQ ID NO: 9097600 - DNA, 22 bp, Homo sapiens
cgtgccactgcactctagcctg

SEQ ID NO: 9097601 - DNA, 22 bp, Homo sapiens
cggtcaggtgcagcgttggcac

SEQ ID NO: 9097602 - DNA, 22 bp, Homo sapiens
cggtcaggtgcagcgttggcac

SEQ ID NO: 9097603 - DNA, 22 bp, Homo sapiens
cggtcaggtgcagcgttggcac

SEQ ID NO: 9097604 - DNA, 22 bp, Homo sapiens
cgtgagggcatggcagtgagga

SEQ ID NO: 9097605 - DNA, 22 bp, Homo sapiens
agtcagaattcgatcccaggtc

SEQ ID NO: 9097606 - DNA, 22 bp, Homo sapiens
agtcagacataattctaacatt

SEQ ID NO: 9097607 - DNA, 23 bp, Homo sapiens
agtcagagagtgtgagacaactg

SEQ ID NO: 9097608 - DNA, 22 bp, Homo sapiens
agtcagagcaaactggacagac

SEQ ID NO: 9097609 - DNA, 22 bp, Homo sapiens
agtcagagcaaactggacagac

SEQ ID NO: 9097610 - DNA, 23 bp, Homo sapiens
agtcagagcagaagggctgcttg

SEQ ID NO: 9097611 - DNA, 22 bp, Homo sapiens
agtcagagcaaactggacagac

SEQ ID NO: 9097612 - DNA, 22 bp, Homo sapiens
agtcagagaccctagatctaat

SEQ ID NO: 9097613 - DNA, 22 bp, Homo sapiens
agtcagagaatgttttcatgga

SEQ ID NO: 9097614 - DNA, 22 bp, Homo sapiens
agtcagagagctctcagcatag

SEQ ID NO: 9097615 - DNA, 22 bp, Homo sapiens
agtcagagagctctcagcatag

SEQ ID NO: 9097616 - DNA, 23 bp, Homo sapiens
ctacaagagcaagcatggacaag

SEQ ID NO: 9097617 - DNA, 23 bp, Homo sapiens
ctacaagagcaagcatggacaag

SEQ ID NO: 9097618 - DNA, 22 bp, Homo sapiens
agtcagagtgtgcaggccggct

SEQ ID NO: 9097619 - DNA, 22 bp, Homo sapiens
agtcagagttttgaggtgtgac

SEQ ID NO: 9097620 - DNA, 22 bp, Homo sapiens
agtcagagttcttggggagaca

SEQ ID NO: 9097621 - DNA, 22 bp, Homo sapiens
agtcagaggaatgggccaggct

SEQ ID NO: 9097622 - DNA, 22 bp, Homo sapiens
agtcagagtcgccgacagtcaa

SEQ ID NO: 9097623 - DNA, 22 bp, Homo sapiens
ctacagaaacactggacatgtg

SEQ ID NO: 9097624 - DNA, 22 bp, Homo sapiens
ctacactagagttgcaatggaa

SEQ ID NO: 9097625 - DNA, 22 bp, Homo sapiens
ctacacagttctgcctaatggc

SEQ ID NO: 9097626 - DNA, 22 bp, Homo sapiens
ctacaagatttttaaaactgta

SEQ ID NO: 9097627 - DNA, 22 bp, Homo sapiens
agtcagttgcaaacatcaggca

SEQ ID NO: 9097628 - DNA, 22 bp, Homo sapiens
agtcataattataaacatcagt

SEQ ID NO: 9097629 - DNA, 22 bp, Homo sapiens
agtcagtgtagaaagcccaggc

SEQ ID NO: 9097630 - DNA, 22 bp, Homo sapiens
agtcagtgtcaacaggaagtag

SEQ ID NO: 9097631 - DNA, 22 bp, Homo sapiens
agtcagtgttctccggagaggc

SEQ ID NO: 9097632 - DNA, 22 bp, Homo sapiens
agtcagtgttctgggttgtaat

SEQ ID NO: 9097633 - DNA, 22 bp, Homo sapiens
agtcagtgtgattctcaggagg

SEQ ID NO: 9097634 - DNA, 22 bp, Homo sapiens
agtcagttaacctcacagcatc

SEQ ID NO: 9097635 - DNA, 22 bp, Homo sapiens
agtcaggctgacaggctaggag

SEQ ID NO: 9097636 - DNA, 22 bp, Homo sapiens
agtcaggcagctgagctttatg

SEQ ID NO: 9097637 - DNA, 22 bp, Homo sapiens
agtcagtgtagaaagcccaggc

SEQ ID NO: 9097638 - DNA, 22 bp, Homo sapiens
agtcagggcctggcctgctgaa

SEQ ID NO: 9097639 - DNA, 22 bp, Homo sapiens
aggtgtctggatgggtgtcctt

SEQ ID NO: 9097640 - DNA, 22 bp, Homo sapiens
cctggtgccactagagaatgtc

SEQ ID NO: 9097641 - DNA, 22 bp, Homo sapiens
cctggtgcaccaagtaagggtg

SEQ ID NO: 9097642 - DNA, 22 bp, Homo sapiens
cctggtgccactagagaatgtc

SEQ ID NO: 9097643 - DNA, 22 bp, Homo sapiens
cctggtgcccccaagccagctg

SEQ ID NO: 9097644 - DNA, 22 bp, Homo sapiens
aggtttataggaaatttgttcc

SEQ ID NO: 9097645 - DNA, 22 bp, Homo sapiens
aggtttataggaaatttgttcc

SEQ ID NO: 9097646 - DNA, 22 bp, Homo sapiens
aggttccaagaaatcatcagtg

SEQ ID NO: 9097647 - DNA, 22 bp, Homo sapiens
aggttcacacacacaaaaagat

SEQ ID NO: 9097648 - DNA, 22 bp, Homo sapiens
aggttcagagttgttgatgttt

SEQ ID NO: 9097649 - DNA, 22 bp, Homo sapiens
aggttcagacgcataataggca

SEQ ID NO: 9097650 - DNA, 23 bp, Homo sapiens
aggttcagctttcttactctggg

SEQ ID NO: 9097651 - DNA, 22 bp, Homo sapiens
aggttcagatgacttttatgct

SEQ ID NO: 9097652 - DNA, 22 bp, Homo sapiens
aggttcagtctttggacccctc

SEQ ID NO: 9097653 - DNA, 22 bp, Homo sapiens
aggttcagtgcctggaacaggg

SEQ ID NO: 9097654 - DNA, 17 bp, Homo sapiens
aggttcaggttacattc

SEQ ID NO: 9097655 - DNA, 22 bp, Homo sapiens
aggttcagtaaatgttagttga

SEQ ID NO: 9097656 - DNA, 23 bp, Homo sapiens
aggttcaggagatggaggaacaa

SEQ ID NO: 9097657 - DNA, 23 bp, Homo sapiens
aggttcaggagatggaggaacaa

SEQ ID NO: 9097658 - DNA, 22 bp, Homo sapiens
aggttcaggctgcacacctgag

SEQ ID NO: 9097659 - DNA, 22 bp, Homo sapiens
aggttcaggctgcacacctgag

SEQ ID NO: 9097660 - DNA, 22 bp, Homo sapiens
aggttcaggcacttgcccaaca

SEQ ID NO: 9097661 - DNA, 23 bp, Homo sapiens
aggttatgattatagagcgagga

SEQ ID NO: 9097662 - DNA, 23 bp, Homo sapiens
aggttatgattatagagcgagga

SEQ ID NO: 9097663 - DNA, 22 bp, Homo sapiens
aggttatcatcagttgagcact

SEQ ID NO: 9097664 - DNA, 22 bp, Homo sapiens
aggttaactgggataacacatt

SEQ ID NO: 9097665 - DNA, 22 bp, Homo sapiens
aggttacagtcatctcagaatc

SEQ ID NO: 9097666 - DNA, 23 bp, Homo sapiens
aggttacagttgttaagttgcaa

SEQ ID NO: 9097667 - DNA, 22 bp, Homo sapiens
aggttaggaagatacagaatgt

SEQ ID NO: 9097668 - DNA, 22 bp, Homo sapiens
aggttacataggctttaaaagt

SEQ ID NO: 9097669 - DNA, 22 bp, Homo sapiens
agtacaaatgcagccagagtag

SEQ ID NO: 9097670 - DNA, 21 bp, Homo sapiens
agtacaaaaattcctttctca

SEQ ID NO: 9097671 - DNA, 22 bp, Homo sapiens
agtacaaaatgcagcatcatca

SEQ ID NO: 9097672 - DNA, 22 bp, Homo sapiens
agtaacagggtatttgtgtggg

SEQ ID NO: 9097673 - DNA, 22 bp, Homo sapiens
agtaataatttatattagggag

SEQ ID NO: 9097674 - DNA, 22 bp, Homo sapiens
agtaacaggtgtacagactatc

SEQ ID NO: 9097675 - DNA, 20 bp, Homo sapiens
cctttattatttgtatgatg

SEQ ID NO: 9097676 - DNA, 22 bp, Homo sapiens
aggtttctatgctgtttatctt

SEQ ID NO: 9097677 - DNA, 22 bp, Homo sapiens
aggtttctcctttaaagcatgg

SEQ ID NO: 9097678 - DNA, 19 bp, Homo sapiens
aggtttctaactattcaag

SEQ ID NO: 9097679 - DNA, 21 bp, Homo sapiens
aggtttctcttttatggaggg

SEQ ID NO: 9097680 - DNA, 22 bp, Homo sapiens
aggtttattaagtaaatagagc

SEQ ID NO: 9097681 - DNA, 22 bp, Homo sapiens
cagctgaattcttcagactcca

SEQ ID NO: 9097682 - DNA, 22 bp, Homo sapiens
cagctgacactttgacctagag

SEQ ID NO: 9097683 - DNA, 22 bp, Homo sapiens
cagctgacaagagtccttggag

SEQ ID NO: 9097684 - DNA, 22 bp, Homo sapiens
cagctgacctggctaagggagc

SEQ ID NO: 9097685 - DNA, 22 bp, Homo sapiens
cagctctggttcctgggcccag

SEQ ID NO: 9097686 - DNA, 22 bp, Homo sapiens
cagctctgtaaattccttcatc

SEQ ID NO: 9097687 - DNA, 20 bp, Homo sapiens
cagctctgggcaggtcgagg

SEQ ID NO: 9097688 - DNA, 22 bp, Homo sapiens
cagctctggggcagagtgacta

SEQ ID NO: 9097689 - DNA, 22 bp, Homo sapiens
cagctctggggcagagtgacta

SEQ ID NO: 9097690 - DNA, 22 bp, Homo sapiens
cagctctgggtaggaggaatct

SEQ ID NO: 9097691 - DNA, 22 bp, Homo sapiens
cagctctgggtaggaggaatct

SEQ ID NO: 9097692 - DNA, 22 bp, Homo sapiens
cagctctgggtaggaggaatct

SEQ ID NO: 9097693 - DNA, 22 bp, Homo sapiens
cagctctggtccagggagggca

SEQ ID NO: 9097694 - DNA, 22 bp, Homo sapiens
cagctctggttcctgggcccag

SEQ ID NO: 9097695 - DNA, 22 bp, Homo sapiens
cagctctgggtgacaggagggc

SEQ ID NO: 9097696 - DNA, 22 bp, Homo sapiens
cagctctgggtgacaggagggc

SEQ ID NO: 9097697 - DNA, 22 bp, Homo sapiens
agctgcaaccttagctataggc

SEQ ID NO: 9097698 - DNA, 22 bp, Homo sapiens
agctgcaacatctgcttgtccc

SEQ ID NO: 9097699 - DNA, 20 bp, Homo sapiens
agctgcaacagactgtatgg

SEQ ID NO: 9097700 - DNA, 22 bp, Homo sapiens
agctgcaagaagaggtccctga

SEQ ID NO: 9097701 - DNA, 22 bp, Homo sapiens
agctgcaactgtccttgccttg

SEQ ID NO: 9097702 - DNA, 23 bp, Homo sapiens
agctgcaagactccctgtctgag

SEQ ID NO: 9097703 - DNA, 22 bp, Homo sapiens
agctgcaaagatgatttgttgt

SEQ ID NO: 9097704 - DNA, 22 bp, Homo sapiens
agctgcaaagatctgtcagtca

SEQ ID NO: 9097705 - DNA, 22 bp, Homo sapiens
agctgcaaagatctgtcagtca

SEQ ID NO: 9097706 - DNA, 22 bp, Homo sapiens
agctgcaaaggcacacttgggc

SEQ ID NO: 9097707 - DNA, 20 bp, Homo sapiens
agctgcaacagactgtatgg

SEQ ID NO: 9097708 - DNA, 22 bp, Homo sapiens
agctgcaaaccaggccggcgcg

SEQ ID NO: 9097709 - DNA, 19 bp, Homo sapiens
agctgcaaaaggtggaact

SEQ ID NO: 9097710 - DNA, 21 bp, Homo sapiens
agctgcaaaaacatacagttc

SEQ ID NO: 9097711 - DNA, 21 bp, Homo sapiens
agctgcaaaaacatacagttc

SEQ ID NO: 9097712 - DNA, 22 bp, Homo sapiens
agctgcaagtccaaaggaatta

SEQ ID NO: 9097713 - DNA, 22 bp, Homo sapiens
agctgcaagtaagcttgctcct

SEQ ID NO: 9097714 - DNA, 14 bp, Homo sapiens
agctgcaagcatcc

SEQ ID NO: 9097715 - DNA, 22 bp, Homo sapiens
agctgcaagtctgtgtggggag

SEQ ID NO: 9097716 - DNA, 22 bp, Homo sapiens
agctgcaagatttcttttgtat

SEQ ID NO: 9097717 - DNA, 22 bp, Homo sapiens
agctgcaagataaaagtgatgt

SEQ ID NO: 9097718 - DNA, 22 bp, Homo sapiens
agctgcaagataaaagtgatgt

SEQ ID NO: 9097719 - DNA, 21 bp, Homo sapiens
agctgcaagagcaacatcttt

SEQ ID NO: 9097720 - DNA, 22 bp, Homo sapiens
agctgcaattctggacatagtc

SEQ ID NO: 9097721 - DNA, 22 bp, Homo sapiens
agctgcaattaaagactgtgaa

SEQ ID NO: 9097722 - DNA, 22 bp, Homo sapiens
agctgcaagtgttgcctcctac

SEQ ID NO: 9097723 - DNA, 22 bp, Homo sapiens
agctgcaatacccttcttcctt

SEQ ID NO: 9097724 - DNA, 22 bp, Homo sapiens
cagctgagaccagaatgcaggt

SEQ ID NO: 9097725 - DNA, 22 bp, Homo sapiens
cagctgagaccagaatgcaggt

SEQ ID NO: 9097726 - DNA, 22 bp, Homo sapiens
cagctgagaaggtctgatcagg

SEQ ID NO: 9097727 - DNA, 22 bp, Homo sapiens
cagctgagaagtgatagctgca

SEQ ID NO: 9097728 - DNA, 22 bp, Homo sapiens
cagctgagaaatggggaaaggg

SEQ ID NO: 9097729 - DNA, 22 bp, Homo sapiens
cagctgagaaaggcaggctcac

SEQ ID NO: 9097730 - DNA, 22 bp, Homo sapiens
agctgattccactttttcccca

SEQ ID NO: 9097731 - DNA, 22 bp, Homo sapiens
agctgattccactttttcccca

SEQ ID NO: 9097732 - DNA, 22 bp, Homo sapiens
cagctgagaccagaatgcaggt

SEQ ID NO: 9097733 - DNA, 23 bp, Homo sapiens
agctgaggctgtgggtgtcagag

SEQ ID NO: 9097734 - DNA, 22 bp, Homo sapiens
cagctgagagacaatgagtcat

SEQ ID NO: 9097735 - DNA, 19 bp, Homo sapiens
agctgcagaccagaagtgc

SEQ ID NO: 9097736 - DNA, 22 bp, Homo sapiens
agctgcagagaaaagaggctgg

SEQ ID NO: 9097737 - DNA, 22 bp, Homo sapiens
agctgcagaggtttgtgcaaca

SEQ ID NO: 9097738 - DNA, 22 bp, Homo sapiens
agctgcagattctatctagaag

SEQ ID NO: 9097739 - DNA, 22 bp, Homo sapiens
caggaaggaccgtccagatcag

SEQ ID NO: 9097740 - DNA, 22 bp, Homo sapiens
caggaaggaccgtccagatcag

SEQ ID NO: 9097741 - DNA, 22 bp, Homo sapiens
caggaagagaacatggaggctg

SEQ ID NO: 9097742 - DNA, 22 bp, Homo sapiens
caggaaggggctcactctggcc

SEQ ID NO: 9097743 - DNA, 22 bp, Homo sapiens
agctgccacagagcctggccag

SEQ ID NO: 9097744 - DNA, 22 bp, Homo sapiens
agctgccaagtttctcagttta

SEQ ID NO: 9097745 - DNA, 22 bp, Homo sapiens
agctgccacagagcctggccag

SEQ ID NO: 9097746 - DNA, 22 bp, Homo sapiens
agctgccaagttggagtagcaa

SEQ ID NO: 9097747 - DNA, 22 bp, Homo sapiens
agctgcatttcagtgaaatatt

SEQ ID NO: 9097748 - DNA, 22 bp, Homo sapiens
caggaaggcgcggctgtgcctg

SEQ ID NO: 9097749 - DNA, 22 bp, Homo sapiens
caggaaggggctcactctggcc

SEQ ID NO: 9097750 - DNA, 22 bp, Homo sapiens
caggaaggcgcggctgtgcctg

SEQ ID NO: 9097751 - DNA, 22 bp, Homo sapiens
caggaaggcgcggctgtgcctg

SEQ ID NO: 9097752 - DNA, 22 bp, Homo sapiens
caggaaggcccacctgtcctgt

SEQ ID NO: 9097753 - DNA, 22 bp, Homo sapiens
caggaaggcccacctgtcctgt

SEQ ID NO: 9097754 - DNA, 22 bp, Homo sapiens
caggaaggcccacctgtcctgt

SEQ ID NO: 9097755 - DNA, 22 bp, Homo sapiens
caggcactcattcagagaggtg

SEQ ID NO: 9097756 - DNA, 22 bp, Homo sapiens
caggcactggccagtcagcaca

SEQ ID NO: 9097757 - DNA, 22 bp, Homo sapiens
caggcactcattcagagaggtg

SEQ ID NO: 9097758 - DNA, 22 bp, Homo sapiens
caggcactggggatgctgggat

SEQ ID NO: 9097759 - DNA, 22 bp, Homo sapiens
caggcactgtgcaagggtctcg

SEQ ID NO: 9097760 - DNA, 22 bp, Homo sapiens
caggcactgtgcaagggtctcg

SEQ ID NO: 9097761 - DNA, 22 bp, Homo sapiens
agctgctgcaagtggtgctaac

SEQ ID NO: 9097762 - DNA, 19 bp, Homo sapiens
agctgctggcccagggacc

SEQ ID NO: 9097763 - DNA, 22 bp, Homo sapiens
agctgctgagccatgtcctgct

SEQ ID NO: 9097764 - DNA, 22 bp, Homo sapiens
agctgctgagccatgtcctgct

SEQ ID NO: 9097765 - DNA, 22 bp, Homo sapiens
caggaggagggtacaccatcag

SEQ ID NO: 9097766 - DNA, 22 bp, Homo sapiens
caggaggagggtacaccatcag

SEQ ID NO: 9097767 - DNA, 22 bp, Homo sapiens
caggaggacatactggctcaca

SEQ ID NO: 9097768 - DNA, 22 bp, Homo sapiens
caggaggacatactggctcaca

SEQ ID NO: 9097769 - DNA, 22 bp, Homo sapiens
caggaggacatactggctcaca

SEQ ID NO: 9097770 - DNA, 22 bp, Homo sapiens
caggaggagcattagcgtctca

SEQ ID NO: 9097771 - DNA, 22 bp, Homo sapiens
caggaggagcattagcgtctca

SEQ ID NO: 9097772 - DNA, 21 bp, Homo sapiens
agctgccaccctagcttctga

SEQ ID NO: 9097773 - DNA, 22 bp, Homo sapiens
agctgccacctctgcctttggg

SEQ ID NO: 9097774 - DNA, 21 bp, Homo sapiens
agctgccaccctagcttctga

SEQ ID NO: 9097775 - DNA, 22 bp, Homo sapiens
agctgccacatggtgtcactgt

SEQ ID NO: 9097776 - DNA, 22 bp, Homo sapiens
caggagccccaggctgacaata

SEQ ID NO: 9097777 - DNA, 22 bp, Homo sapiens
caggagccccaggctgacaata

SEQ ID NO: 9097778 - DNA, 18 bp, Homo sapiens
agctggccctggctgccg

SEQ ID NO: 9097779 - DNA, 22 bp, Homo sapiens
agctggccctcgagagccaatt

SEQ ID NO: 9097780 - DNA, 22 bp, Homo sapiens
agctggccctcgagagccaatt

SEQ ID NO: 9097781 - DNA, 18 bp, Homo sapiens
agctggccctggctgccg

SEQ ID NO: 9097782 - DNA, 18 bp, Homo sapiens
agctggccctggctgccg

SEQ ID NO: 9097783 - DNA, 22 bp, Homo sapiens
agctggccggcctccaggtgga

SEQ ID NO: 9097784 - DNA, 22 bp, Homo sapiens
agctggcctcactgcagaatgc

SEQ ID NO: 9097785 - DNA, 20 bp, Homo sapiens
caggccagaggtttgatggc

SEQ ID NO: 9097786 - DNA, 22 bp, Homo sapiens
caggccagaggctgttgttgcg

SEQ ID NO: 9097787 - DNA, 22 bp, Homo sapiens
agctggccattgtgagtggcct

SEQ ID NO: 9097788 - DNA, 22 bp, Homo sapiens
agctggccattgtgagtggcct

SEQ ID NO: 9097789 - DNA, 20 bp, Homo sapiens
agctggcccacaggtgtggg

SEQ ID NO: 9097790 - DNA, 22 bp, Homo sapiens
agctggcccactgtgtggtcca

SEQ ID NO: 9097791 - DNA, 20 bp, Homo sapiens
agctggcccccggtggcctg

SEQ ID NO: 9097792 - DNA, 22 bp, Homo sapiens
caggcacttctgctgcttgtct

SEQ ID NO: 9097793 - DNA, 22 bp, Homo sapiens
caggcactgtgctgagctctgc

SEQ ID NO: 9097794 - DNA, 19 bp, Homo sapiens
agctgggctgtcacagtga

SEQ ID NO: 9097795 - DNA, 19 bp, Homo sapiens
agctgggctgtcacagtga

SEQ ID NO: 9097796 - DNA, 19 bp, Homo sapiens
agctgggcttactcactcg

SEQ ID NO: 9097797 - DNA, 22 bp, Homo sapiens
agctgggctggagctccaagcg

SEQ ID NO: 9097798 - DNA, 22 bp, Homo sapiens
agctgggctggagctccaagcg

SEQ ID NO: 9097799 - DNA, 22 bp, Homo sapiens
caggccagcagggcctccgtgg

SEQ ID NO: 9097800 - DNA, 22 bp, Homo sapiens
caggccagcagggcctccgtgg

SEQ ID NO: 9097801 - DNA, 22 bp, Homo sapiens
caggccaggctgcatttgcccc

SEQ ID NO: 9097802 - DNA, 22 bp, Homo sapiens
caggccagcttcctgacatcct

SEQ ID NO: 9097803 - DNA, 22 bp, Homo sapiens
cagggctcgctcttgcccttcg

SEQ ID NO: 9097804 - DNA, 22 bp, Homo sapiens
cagggctcccttgcaaggaggg

SEQ ID NO: 9097805 - DNA, 22 bp, Homo sapiens
cagggctcgctcgctcgctcgc

SEQ ID NO: 9097806 - DNA, 22 bp, Homo sapiens
cagggcttgatctgcatcctgc

SEQ ID NO: 9097807 - DNA, 22 bp, Homo sapiens
cagggcttgcaggagaaagttt

SEQ ID NO: 9097808 - DNA, 22 bp, Homo sapiens
caggggctccctgggtgccagt

SEQ ID NO: 9097809 - DNA, 22 bp, Homo sapiens
caggggcggtggctcacgcctg

SEQ ID NO: 9097810 - DNA, 22 bp, Homo sapiens
cagggctccctctggctcccag

SEQ ID NO: 9097811 - DNA, 22 bp, Homo sapiens
cagggctccctgcagcctctgt

SEQ ID NO: 9097812 - DNA, 22 bp, Homo sapiens
cagggctccctgcagcctctgt

SEQ ID NO: 9097813 - DNA, 22 bp, Homo sapiens
cagggctccccagagagcctct

SEQ ID NO: 9097814 - DNA, 22 bp, Homo sapiens
cagggctccccagagagcctct

SEQ ID NO: 9097815 - DNA, 22 bp, Homo sapiens
cagggctccccgcaccgcagcc

SEQ ID NO: 9097816 - DNA, 22 bp, Homo sapiens
cagggatgtctctggaagggag

SEQ ID NO: 9097817 - DNA, 22 bp, Homo sapiens
cagggcctcctaaggcatctaa

SEQ ID NO: 9097818 - DNA, 22 bp, Homo sapiens
cagggcctccccggcagtcttt

SEQ ID NO: 9097819 - DNA, 22 bp, Homo sapiens
cagggcctccccggcagtcttt

SEQ ID NO: 9097820 - DNA, 22 bp, Homo sapiens
cagggcctccccggcagtcttt

SEQ ID NO: 9097821 - DNA, 22 bp, Homo sapiens
cagggcctccccggcagtcttt

SEQ ID NO: 9097822 - DNA, 23 bp, Homo sapiens
cagggccaggcagcagctgtcac

SEQ ID NO: 9097823 - DNA, 22 bp, Homo sapiens
cagggcctctgtgggctctctc

SEQ ID NO: 9097824 - DNA, 22 bp, Homo sapiens
cagggcctctgtgggctctctc

SEQ ID NO: 9097825 - DNA, 22 bp, Homo sapiens
cagggcctgcaagagacctggg

SEQ ID NO: 9097826 - DNA, 22 bp, Homo sapiens
cagggcctcgaagcctctgggc

SEQ ID NO: 9097827 - DNA, 22 bp, Homo sapiens
cagggcctcgaagcctctgggc

SEQ ID NO: 9097828 - DNA, 22 bp, Homo sapiens
cagggcctctcatcccacgggc

SEQ ID NO: 9097829 - DNA, 22 bp, Homo sapiens
cagggtgactgccctggccact

SEQ ID NO: 9097830 - DNA, 22 bp, Homo sapiens
cagggtgcagtgtcgctgctag

SEQ ID NO: 9097831 - DNA, 22 bp, Homo sapiens
caggggctccctgggtgccagt

SEQ ID NO: 9097832 - DNA, 22 bp, Homo sapiens
caggggctgagaaggaacgtcc

SEQ ID NO: 9097833 - DNA, 22 bp, Homo sapiens
caggggctgtggcacatggtgt

SEQ ID NO: 9097834 - DNA, 22 bp, Homo sapiens
caggtcctttagtgtccagaac

SEQ ID NO: 9097835 - DNA, 22 bp, Homo sapiens
caggtcctttagtgtccagaac

SEQ ID NO: 9097836 - DNA, 22 bp, Homo sapiens
caggtccttgtttgtaaagcag

SEQ ID NO: 9097837 - DNA, 22 bp, Homo sapiens
cagggtgcgccactcagatgta

SEQ ID NO: 9097838 - DNA, 22 bp, Homo sapiens
cagggtgcgccactcagatgta

SEQ ID NO: 9097839 - DNA, 22 bp, Homo sapiens
cagggtgcctcccgctcgccgg

SEQ ID NO: 9097840 - DNA, 22 bp, Homo sapiens
cagggtgcctcccgctcgccgg

SEQ ID NO: 9097841 - DNA, 22 bp, Homo sapiens
cagggtgcctgtcctcagcaaa

SEQ ID NO: 9097842 - DNA, 22 bp, Homo sapiens
cagggtgcctctgctcccacca

SEQ ID NO: 9097843 - DNA, 22 bp, Homo sapiens
caggtgagaggcggtcctgcat

SEQ ID NO: 9097844 - DNA, 20 bp, Homo sapiens
caggtgagcagatctgggtg

SEQ ID NO: 9097845 - DNA, 22 bp, Homo sapiens
caggtgagctctatctagggag

SEQ ID NO: 9097846 - DNA, 22 bp, Homo sapiens
caggcctggttgagccctgaga

SEQ ID NO: 9097847 - DNA, 22 bp, Homo sapiens
caggctcactgtaaggtcagct

SEQ ID NO: 9097848 - DNA, 18 bp, Homo sapiens
agctggggcctctggtcc

SEQ ID NO: 9097849 - DNA, 22 bp, Homo sapiens
agctggggcatttatccactaa

SEQ ID NO: 9097850 - DNA, 22 bp, Homo sapiens
caggctccactgtaggcagctc

SEQ ID NO: 9097851 - DNA, 22 bp, Homo sapiens
agctgtgattatccactggaat

SEQ ID NO: 9097852 - DNA, 22 bp, Homo sapiens
agctgtgattatccactggaat

SEQ ID NO: 9097853 - DNA, 22 bp, Homo sapiens
agctgtgaccttcaagagctac

SEQ ID NO: 9097854 - DNA, 22 bp, Homo sapiens
agctgtgaccttcaagagctac

SEQ ID NO: 9097855 - DNA, 22 bp, Homo sapiens
caggctcagcaggagcctgacc

SEQ ID NO: 9097856 - DNA, 22 bp, Homo sapiens
caggctcagctctggccagtgc

SEQ ID NO: 9097857 - DNA, 22 bp, Homo sapiens
caggctcagaagccagtggagc

SEQ ID NO: 9097858 - DNA, 22 bp, Homo sapiens
caggctcagaagccagtggagc

SEQ ID NO: 9097859 - DNA, 22 bp, Homo sapiens
caggctgagctctggcctgggc

SEQ ID NO: 9097860 - DNA, 22 bp, Homo sapiens
caggctgcggtcggctctggtc

SEQ ID NO: 9097861 - DNA, 22 bp, Homo sapiens
caggctgcggtcggctctggtc

SEQ ID NO: 9097862 - DNA, 22 bp, Homo sapiens
agctgtggaagactgtcagggt

SEQ ID NO: 9097863 - DNA, 22 bp, Homo sapiens
agctgtggaagactgtcagggt

SEQ ID NO: 9097864 - DNA, 22 bp, Homo sapiens
agctgtggagtagggggttgga

SEQ ID NO: 9097865 - DNA, 22 bp, Homo sapiens
caggctgagctctggcctgggc

SEQ ID NO: 9097866 - DNA, 19 bp, Homo sapiens
agctgtggatgtgggattt

SEQ ID NO: 9097867 - DNA, 22 bp, Homo sapiens
agctgtgctgtggtcatctggg

SEQ ID NO: 9097868 - DNA, 22 bp, Homo sapiens
agctgtgctgccaagttgctga

SEQ ID NO: 9097869 - DNA, 22 bp, Homo sapiens
agctgtgctgtggtcatctggg

SEQ ID NO: 9097870 - DNA, 22 bp, Homo sapiens
agctgtgcacactgtgaagtag

SEQ ID NO: 9097871 - DNA, 19 bp, Homo sapiens
agctgtgcagacacttcgc

SEQ ID NO: 9097872 - DNA, 22 bp, Homo sapiens
agctgtgccttgctgcacggtg

SEQ ID NO: 9097873 - DNA, 22 bp, Homo sapiens
agctgtgcctattcgtggcaag

SEQ ID NO: 9097874 - DNA, 22 bp, Homo sapiens
agctgtgccttgctgcacggtg

SEQ ID NO: 9097875 - DNA, 22 bp, Homo sapiens
cagggagctgacaaccaaggag

SEQ ID NO: 9097876 - DNA, 22 bp, Homo sapiens
cagggagctctgggccggactc

SEQ ID NO: 9097877 - DNA, 22 bp, Homo sapiens
cagggagctggctggcgtgagt

SEQ ID NO: 9097878 - DNA, 22 bp, Homo sapiens
cagggagctggagttggagtac

SEQ ID NO: 9097879 - DNA, 22 bp, Homo sapiens
cagggagctggctggcgtgagt

SEQ ID NO: 9097880 - DNA, 22 bp, Homo sapiens
cagggagctggctggctgtgcc

SEQ ID NO: 9097881 - DNA, 22 bp, Homo sapiens
cagggagctggctggctgtgcc

SEQ ID NO: 9097882 - DNA, 22 bp, Homo sapiens
cagggatgggatggagtcagtt

SEQ ID NO: 9097883 - DNA, 22 bp, Homo sapiens
cagggatgggatggagtcagtt

SEQ ID NO: 9097884 - DNA, 22 bp, Homo sapiens
cagggagctttcccaggaccct

SEQ ID NO: 9097885 - DNA, 22 bp, Homo sapiens
caggctgctgacaggcttggag

SEQ ID NO: 9097886 - DNA, 22 bp, Homo sapiens
caggctggagtacaattgtgtg

SEQ ID NO: 9097887 - DNA, 22 bp, Homo sapiens
caggctggacattagatacata

SEQ ID NO: 9097888 - DNA, 22 bp, Homo sapiens
caggctggacattagatacata

SEQ ID NO: 9097889 - DNA, 22 bp, Homo sapiens
caggctggagtgcagtggtgcc

SEQ ID NO: 9097890 - DNA, 22 bp, Homo sapiens
caggctggagtgcagtggtgcc

SEQ ID NO: 9097891 - DNA, 22 bp, Homo sapiens
caggctggagtgcagtggtgcc

SEQ ID NO: 9097892 - DNA, 22 bp, Homo sapiens
caggctggagtgcagtggtgcc

SEQ ID NO: 9097893 - DNA, 22 bp, Homo sapiens
caggctggagtgcagtgtcgcc

SEQ ID NO: 9097894 - DNA, 22 bp, Homo sapiens
caggctggagtgcagtgtcgcc

SEQ ID NO: 9097895 - DNA, 22 bp, Homo sapiens
caggctggagttacctttaggg

SEQ ID NO: 9097896 - DNA, 22 bp, Homo sapiens
caggctggagttacctttaggg

SEQ ID NO: 9097897 - DNA, 22 bp, Homo sapiens
caggctggagtgcagttgtgca

SEQ ID NO: 9097898 - DNA, 22 bp, Homo sapiens
caggctggagtgcagttgtgca

SEQ ID NO: 9097899 - DNA, 22 bp, Homo sapiens
caggctggagtgcagttgtgca

SEQ ID NO: 9097900 - DNA, 22 bp, Homo sapiens
caggctggagtgcagttgtgca

SEQ ID NO: 9097901 - DNA, 22 bp, Homo sapiens
caggctggagtgcagtgtcgcc

SEQ ID NO: 9097902 - DNA, 22 bp, Homo sapiens
catgggggtctggacaacaggc

SEQ ID NO: 9097903 - DNA, 22 bp, Homo sapiens
catgggggtctggacaacaggc

SEQ ID NO: 9097904 - DNA, 22 bp, Homo sapiens
catggggatgaggctgagactt

SEQ ID NO: 9097905 - DNA, 22 bp, Homo sapiens
catggggagacacctagggaaa

SEQ ID NO: 9097906 - DNA, 22 bp, Homo sapiens
aggattgtgcctccagtcagaa

SEQ ID NO: 9097907 - DNA, 22 bp, Homo sapiens
aggatttaatcagttggcattt

SEQ ID NO: 9097908 - DNA, 22 bp, Homo sapiens
catggctgaacactcagtgact

SEQ ID NO: 9097909 - DNA, 22 bp, Homo sapiens
catgggctgaaaatctgcaaac

SEQ ID NO: 9097910 - DNA, 22 bp, Homo sapiens
aggatttgaaatatttagtaaa

SEQ ID NO: 9097911 - DNA, 22 bp, Homo sapiens
catgtataggtccatagtgaat

SEQ ID NO: 9097912 - DNA, 22 bp, Homo sapiens
catgtacattctgtagatggag

SEQ ID NO: 9097913 - DNA, 22 bp, Homo sapiens
catgtacattctgtagatggag

SEQ ID NO: 9097914 - DNA, 21 bp, Homo sapiens
catggggttgctatagcaaaa

SEQ ID NO: 9097915 - DNA, 22 bp, Homo sapiens
catgggggctgaggctgctgta

SEQ ID NO: 9097916 - DNA, 22 bp, Homo sapiens
catgtcagggaagagagtcagt

SEQ ID NO: 9097917 - DNA, 22 bp, Homo sapiens
catgtcagggaagagagtcagt

SEQ ID NO: 9097918 - DNA, 22 bp, Homo sapiens
aggcactgcagattacaggcgc

SEQ ID NO: 9097919 - DNA, 22 bp, Homo sapiens
catgtcaaccagttgtttgaat

SEQ ID NO: 9097920 - DNA, 22 bp, Homo sapiens
aggattgtgcctccagtcagaa

SEQ ID NO: 9097921 - DNA, 22 bp, Homo sapiens
catggcagaaacctgagctgct

SEQ ID NO: 9097922 - DNA, 22 bp, Homo sapiens
catggcagaaacctgagctgct

SEQ ID NO: 9097923 - DNA, 22 bp, Homo sapiens
catggcaatttcataaacaggt

SEQ ID NO: 9097924 - DNA, 22 bp, Homo sapiens
catggcaataggaatgatgtga

SEQ ID NO: 9097925 - DNA, 22 bp, Homo sapiens
catggcaataaacctacacagt

SEQ ID NO: 9097926 - DNA, 22 bp, Homo sapiens
catggcaacaactctttattcc

SEQ ID NO: 9097927 - DNA, 22 bp, Homo sapiens
catggaggaggaagggcgttgt

SEQ ID NO: 9097928 - DNA, 22 bp, Homo sapiens
catggaaggcaaaagacacaga

SEQ ID NO: 9097929 - DNA, 22 bp, Homo sapiens
aggagggatagaaaaatacttg

SEQ ID NO: 9097930 - DNA, 22 bp, Homo sapiens
aggagggatagaaaaatacttg

SEQ ID NO: 9097931 - DNA, 22 bp, Homo sapiens
aggagggatagaaaaatacttg

SEQ ID NO: 9097932 - DNA, 21 bp, Homo sapiens
aggagggcacaaggccaggaa

SEQ ID NO: 9097933 - DNA, 22 bp, Homo sapiens
aggagggctaggaaaaccagga

SEQ ID NO: 9097934 - DNA, 22 bp, Homo sapiens
aggagggcaggctggctgccta

SEQ ID NO: 9097935 - DNA, 20 bp, Homo sapiens
aggaggggatagaatcaaag

SEQ ID NO: 9097936 - DNA, 16 bp, Homo sapiens
aggaggggaattagga

SEQ ID NO: 9097937 - DNA, 20 bp, Homo sapiens
aggaggggatagaatcaaag

SEQ ID NO: 9097938 - DNA, 22 bp, Homo sapiens
cattaaattccttgttctcaaa

SEQ ID NO: 9097939 - DNA, 22 bp, Homo sapiens
cattaaatcttccagacctcac

SEQ ID NO: 9097940 - DNA, 22 bp, Homo sapiens
cattaaatcttccagacctcac

SEQ ID NO: 9097941 - DNA, 22 bp, Homo sapiens
cattaaatatcaacctagacta

SEQ ID NO: 9097942 - DNA, 22 bp, Homo sapiens
cattaaacaaccttgaatcaat

SEQ ID NO: 9097943 - DNA, 22 bp, Homo sapiens
cattaaaatatctcatggtgtt

SEQ ID NO: 9097944 - DNA, 15 bp, Homo sapiens
aggcactgtgggacc

SEQ ID NO: 9097945 - DNA, 22 bp, Homo sapiens
aggcactgtggaagacatggtt

SEQ ID NO: 9097946 - DNA, 22 bp, Homo sapiens
aggcactgtgctgatgtcttat

SEQ ID NO: 9097947 - DNA, 22 bp, Homo sapiens
aggcactgtgcttcttatatgt

SEQ ID NO: 9097948 - DNA, 22 bp, Homo sapiens
aggcactgtactaggtacaggg

SEQ ID NO: 9097949 - DNA, 22 bp, Homo sapiens
aggcactggtctaccccttagt

SEQ ID NO: 9097950 - DNA, 22 bp, Homo sapiens
aggcactgtgcagtcccaagca

SEQ ID NO: 9097951 - DNA, 22 bp, Homo sapiens
aggcactgtgctgatgtcttat

SEQ ID NO: 9097952 - DNA, 22 bp, Homo sapiens
aggcactgtgcagtcccaagca

SEQ ID NO: 9097953 - DNA, 22 bp, Homo sapiens
catttgaaattcttagaacaaa

SEQ ID NO: 9097954 - DNA, 22 bp, Homo sapiens
cattaacaattgtttatgctgt

SEQ ID NO: 9097955 - DNA, 21 bp, Homo sapiens
aggcagcaggatccagggaca

SEQ ID NO: 9097956 - DNA, 19 bp, Homo sapiens
aggcagcaggccagggatg

SEQ ID NO: 9097957 - DNA, 19 bp, Homo sapiens
aggcagcaggccagggatg

SEQ ID NO: 9097958 - DNA, 21 bp, Homo sapiens
aggcagcaggatccagggaca

SEQ ID NO: 9097959 - DNA, 22 bp, Homo sapiens
ccaaggtggctacagccctgca

SEQ ID NO: 9097960 - DNA, 22 bp, Homo sapiens
ccaaggtgggaggattgcttga

SEQ ID NO: 9097961 - DNA, 22 bp, Homo sapiens
ccaaggtgggcagatcacgagg

SEQ ID NO: 9097962 - DNA, 22 bp, Homo sapiens
ccaatcctcatgttcaacaacc

SEQ ID NO: 9097963 - DNA, 22 bp, Homo sapiens
ccaatacttagattaaaatagt

SEQ ID NO: 9097964 - DNA, 18 bp, Homo sapiens
aggcaggctggagtgact

SEQ ID NO: 9097965 - DNA, 22 bp, Homo sapiens
ccaagtccccaagcatgccagg

SEQ ID NO: 9097966 - DNA, 22 bp, Homo sapiens
ccaagtgatacacccgcctcgg

SEQ ID NO: 9097967 - DNA, 23 bp, Homo sapiens
aggcagcaggttgtccagggtga

SEQ ID NO: 9097968 - DNA, 23 bp, Homo sapiens
aggcagcaggttgtccagggtga

SEQ ID NO: 9097969 - DNA, 22 bp, Homo sapiens
aggcagcagggccactggctga

SEQ ID NO: 9097970 - DNA, 22 bp, Homo sapiens
aggcagcagggccactggctga

SEQ ID NO: 9097971 - DNA, 22 bp, Homo sapiens
aggcagcagggccactggctga

SEQ ID NO: 9097972 - DNA, 19 bp, Homo sapiens
aggcagcaggccagggatg

SEQ ID NO: 9097973 - DNA, 22 bp, Homo sapiens
ccaagataatctgtgaaaaatc

SEQ ID NO: 9097974 - DNA, 22 bp, Homo sapiens
ccaagagtaaattcatgatgcc

SEQ ID NO: 9097975 - DNA, 23 bp, Homo sapiens
aggcagcaggttgtccagggtga

SEQ ID NO: 9097976 - DNA, 23 bp, Homo sapiens
aggcagcaggttgtccagggtga

SEQ ID NO: 9097977 - DNA, 23 bp, Homo sapiens
aggcagcaggttgtccagggtga

SEQ ID NO: 9097978 - DNA, 22 bp, Homo sapiens
aggcagcagggccactggctga

SEQ ID NO: 9097979 - DNA, 22 bp, Homo sapiens
ccaagcctagtcgtgcacacag

SEQ ID NO: 9097980 - DNA, 22 bp, Homo sapiens
ccaagctgcctgaggcaaattt

SEQ ID NO: 9097981 - DNA, 22 bp, Homo sapiens
ccaagctacttaggagtctgag

SEQ ID NO: 9097982 - DNA, 22 bp, Homo sapiens
aggaccttggaataacaaattc

SEQ ID NO: 9097983 - DNA, 22 bp, Homo sapiens
aggaccctgctcaagcatctcc

SEQ ID NO: 9097984 - DNA, 22 bp, Homo sapiens
aggacccacgcacaggaacccc

SEQ ID NO: 9097985 - DNA, 22 bp, Homo sapiens
aggaccctgaggtctcctgtga

SEQ ID NO: 9097986 - DNA, 22 bp, Homo sapiens
aggaccagtgagtctggcaagt

SEQ ID NO: 9097987 - DNA, 22 bp, Homo sapiens
aggacccaagcacagttcctgg

SEQ ID NO: 9097988 - DNA, 22 bp, Homo sapiens
aggaccagaggccagagtcagc

SEQ ID NO: 9097989 - DNA, 22 bp, Homo sapiens
aggaccaacatagcagcagtgg

SEQ ID NO: 9097990 - DNA, 22 bp, Homo sapiens
aggaccagcctccaggtctctt

SEQ ID NO: 9097991 - DNA, 22 bp, Homo sapiens
aggacatgtttgtatcttcctt

SEQ ID NO: 9097992 - DNA, 22 bp, Homo sapiens
aggacatgtgcctccagggcag

SEQ ID NO: 9097993 - DNA, 22 bp, Homo sapiens
aggacatgtgcctccagggcag

SEQ ID NO: 9097994 - DNA, 22 bp, Homo sapiens
aggacaggattgagctgaactg

SEQ ID NO: 9097995 - DNA, 22 bp, Homo sapiens
caggtggcttctctgcagcctt

SEQ ID NO: 9097996 - DNA, 22 bp, Homo sapiens
caggtggcttctccctaggcca

SEQ ID NO: 9097997 - DNA, 22 bp, Homo sapiens
aggagaaggaagtgcatcacta

SEQ ID NO: 9097998 - DNA, 22 bp, Homo sapiens
aggagaaggaagtgcatcacta

SEQ ID NO: 9097999 - DNA, 19 bp, Homo sapiens
aggagaagtagcagaaatt

SEQ ID NO: 9098000 - DNA, 19 bp, Homo sapiens
aggagaagtagcagaaatt

SEQ ID NO: 9098001 - DNA, 22 bp, Homo sapiens
aggagaagtaaggctagatgat

SEQ ID NO: 9098002 - DNA, 22 bp, Homo sapiens
aggagaagtaaggctagatgat

SEQ ID NO: 9098003 - DNA, 22 bp, Homo sapiens
cagtggcctgagccaggcttcc

SEQ ID NO: 9098004 - DNA, 19 bp, Homo sapiens
cagtggcctggaggtctct

SEQ ID NO: 9098005 - DNA, 22 bp, Homo sapiens
cagtggcctgagccaggcttcc

SEQ ID NO: 9098006 - DNA, 17 bp, Homo sapiens
cagtggcctatggcttt

SEQ ID NO: 9098007 - DNA, 22 bp, Homo sapiens
cagtggccatggtggcaggggt

SEQ ID NO: 9098008 - DNA, 22 bp, Homo sapiens
cagtggcatggttgactgcagt

SEQ ID NO: 9098009 - DNA, 22 bp, Homo sapiens
cagtgctatttggacacaggga

SEQ ID NO: 9098010 - DNA, 22 bp, Homo sapiens
cagtgctcctgatgtacccttg

SEQ ID NO: 9098011 - DNA, 22 bp, Homo sapiens
cagtgctagaatgtaactctag

SEQ ID NO: 9098012 - DNA, 21 bp, Homo sapiens
cagtgctcaatctgacagtgg

SEQ ID NO: 9098013 - DNA, 22 bp, Homo sapiens
cagtgctatttggacacaggga

SEQ ID NO: 9098014 - DNA, 22 bp, Homo sapiens
cagtgcctcttaagtgtcaccc

SEQ ID NO: 9098015 - DNA, 22 bp, Homo sapiens
cagtgcctgggacccggctgtg

SEQ ID NO: 9098016 - DNA, 22 bp, Homo sapiens
cagtgcctggcatagaggcggc

SEQ ID NO: 9098017 - DNA, 22 bp, Homo sapiens
cagtgcctggatagcaacatga

SEQ ID NO: 9098018 - DNA, 22 bp, Homo sapiens
aggactccatgtgtcctggaga

SEQ ID NO: 9098019 - DNA, 22 bp, Homo sapiens
aggactaaggaacagctgattc

SEQ ID NO: 9098020 - DNA, 22 bp, Homo sapiens
aggactaaaaagatgctctccc

SEQ ID NO: 9098021 - DNA, 22 bp, Homo sapiens
aggactgaaaatgagttcttct

SEQ ID NO: 9098022 - DNA, 22 bp, Homo sapiens
catattctgttggtcacataga

SEQ ID NO: 9098023 - DNA, 22 bp, Homo sapiens
catataaatacaacatgtgtta

SEQ ID NO: 9098024 - DNA, 22 bp, Homo sapiens
catatttatagatctggcattt

SEQ ID NO: 9098025 - DNA, 22 bp, Homo sapiens
catattgtctattgctgttttt

SEQ ID NO: 9098026 - DNA, 22 bp, Homo sapiens
catattgtaaaaggttgaatcc

SEQ ID NO: 9098027 - DNA, 22 bp, Homo sapiens
catatttagtgtttggagatcg

SEQ ID NO: 9098028 - DNA, 22 bp, Homo sapiens
aggagggagcttaagccaggca

SEQ ID NO: 9098029 - DNA, 22 bp, Homo sapiens
aggagggagcttaagccaggca

SEQ ID NO: 9098030 - DNA, 22 bp, Homo sapiens
catattttagttgctgaacagc

SEQ ID NO: 9098031 - DNA, 22 bp, Homo sapiens
aggagggagcactatatgggga

SEQ ID NO: 9098032 - DNA, 22 bp, Homo sapiens
catatttattcttctgccagtg

SEQ ID NO: 9098033 - DNA, 22 bp, Homo sapiens
cataggtcactgtacaggttaa

SEQ ID NO: 9098034 - DNA, 22 bp, Homo sapiens
cataggaatgaggacaattagc

SEQ ID NO: 9098035 - DNA, 22 bp, Homo sapiens
cataggaaaagcattcttcttg

SEQ ID NO: 9098036 - DNA, 22 bp, Homo sapiens
catagacattcagcactcacta

SEQ ID NO: 9098037 - DNA, 22 bp, Homo sapiens
catagagtgatgtaaggtatgt

SEQ ID NO: 9098038 - DNA, 22 bp, Homo sapiens
catacattacctaacttaatgc

SEQ ID NO: 9098039 - DNA, 22 bp, Homo sapiens
catacatatgtggatgtcatat

SEQ ID NO: 9098040 - DNA, 22 bp, Homo sapiens
cagtttccctgcttgaaaacgt

SEQ ID NO: 9098041 - DNA, 22 bp, Homo sapiens
cagtttatttccaagatgacaa

SEQ ID NO: 9098042 - DNA, 22 bp, Homo sapiens
cagttttagctagagcaaacca

SEQ ID NO: 9098043 - DNA, 22 bp, Homo sapiens
cagtggcgtgatctctgctcac

SEQ ID NO: 9098044 - DNA, 22 bp, Homo sapiens
cagtgggtgccatcgtgccctt

SEQ ID NO: 9098045 - DNA, 22 bp, Homo sapiens
cagtggcctttcctgctgctca

SEQ ID NO: 9098046 - DNA, 22 bp, Homo sapiens
cagtggcgtgatctctgctcac

SEQ ID NO: 9098047 - DNA, 22 bp, Homo sapiens
cagtgggtggctaagtggctga

SEQ ID NO: 9098048 - DNA, 23 bp, Homo sapiens
cagtggtcagaacgtgggagggt

SEQ ID NO: 9098049 - DNA, 22 bp, Homo sapiens
cagtggtccctgaggttgctgg

SEQ ID NO: 9098050 - DNA, 22 bp, Homo sapiens
cagtttatgcagctggaataga

SEQ ID NO: 9098051 - DNA, 22 bp, Homo sapiens
cagttctggaggctccacatct

SEQ ID NO: 9098052 - DNA, 22 bp, Homo sapiens
cagttctgagctttcccagaag

SEQ ID NO: 9098053 - DNA, 22 bp, Homo sapiens
cagtggtggaatgaggaattgt

SEQ ID NO: 9098054 - DNA, 22 bp, Homo sapiens
cagttctgactttcataatgtc

SEQ ID NO: 9098055 - DNA, 18 bp, Homo sapiens
cagtggtgctgggatgtg

SEQ ID NO: 9098056 - DNA, 22 bp, Homo sapiens
cagtggtgaagagcaggggctc

SEQ ID NO: 9098057 - DNA, 22 bp, Homo sapiens
cagtggtctgtgcttctgtaca

SEQ ID NO: 9098058 - DNA, 17 bp, Homo sapiens
cagtggtctgaggtatg

SEQ ID NO: 9098059 - DNA, 22 bp, Homo sapiens
ccatggcttacagatggagcat

SEQ ID NO: 9098060 - DNA, 22 bp, Homo sapiens
ccatggcttctttctctgccag

SEQ ID NO: 9098061 - DNA, 22 bp, Homo sapiens
ccatggctaagtatctgtagaa

SEQ ID NO: 9098062 - DNA, 22 bp, Homo sapiens
ccatggctccttgccctgtagc

SEQ ID NO: 9098063 - DNA, 22 bp, Homo sapiens
ccatggctcttaccttgttata

SEQ ID NO: 9098064 - DNA, 22 bp, Homo sapiens
aggctgagtcgggaggatcact

SEQ ID NO: 9098065 - DNA, 22 bp, Homo sapiens
aggctgagtcgggaggatcact

SEQ ID NO: 9098066 - DNA, 22 bp, Homo sapiens
aggctgaggtaggaggatcgct

SEQ ID NO: 9098067 - DNA, 22 bp, Homo sapiens
aggctgaggtaggaggatcgct

SEQ ID NO: 9098068 - DNA, 22 bp, Homo sapiens
aggctgaggtgtgctgtgatcg

SEQ ID NO: 9098069 - DNA, 22 bp, Homo sapiens
aggctgaggtgtgctgtgatcg

SEQ ID NO: 9098070 - DNA, 22 bp, Homo sapiens
aggctgagtcgggaggatcact

SEQ ID NO: 9098071 - DNA, 22 bp, Homo sapiens
aggctgagtcaagttagggtga

SEQ ID NO: 9098072 - DNA, 22 bp, Homo sapiens
aggctctgtgacaatcaagctg

SEQ ID NO: 9098073 - DNA, 21 bp, Homo sapiens
aggctctgtgaatatgtttcc

SEQ ID NO: 9098074 - DNA, 22 bp, Homo sapiens
ccagggtggaggctggatggag

SEQ ID NO: 9098075 - DNA, 22 bp, Homo sapiens
ccagggtggaggctggatggag

SEQ ID NO: 9098076 - DNA, 22 bp, Homo sapiens
aggctctgtgatccacaatgag

SEQ ID NO: 9098077 - DNA, 22 bp, Homo sapiens
aggctctgtgatccacaatgag

SEQ ID NO: 9098078 - DNA, 22 bp, Homo sapiens
aggctctgtgatgtgccaggca

SEQ ID NO: 9098079 - DNA, 22 bp, Homo sapiens
aggctgaggtaggaggatcgct

SEQ ID NO: 9098080 - DNA, 20 bp, Homo sapiens
aggctgagggtgattgtgtc

SEQ ID NO: 9098081 - DNA, 22 bp, Homo sapiens
aggctgaggggcgagggaccct

SEQ ID NO: 9098082 - DNA, 22 bp, Homo sapiens
aggctctgtgcagcctgcatct

SEQ ID NO: 9098083 - DNA, 22 bp, Homo sapiens
aggctgcctcgtgagctcgctg

SEQ ID NO: 9098084 - DNA, 22 bp, Homo sapiens
aggctgcctctgcaggatccct

SEQ ID NO: 9098085 - DNA, 22 bp, Homo sapiens
aggctgcctgttccaatctcct

SEQ ID NO: 9098086 - DNA, 22 bp, Homo sapiens
cccactgctgctctccatggca

SEQ ID NO: 9098087 - DNA, 18 bp, Homo sapiens
cccactgtccccacaggc

SEQ ID NO: 9098088 - DNA, 16 bp, Homo sapiens
cccactgtctggtctt

SEQ ID NO: 9098089 - DNA, 22 bp, Homo sapiens
cccactgtctgttcccagggcc

SEQ ID NO: 9098090 - DNA, 20 bp, Homo sapiens
aggctgcctaaggctctgca

SEQ ID NO: 9098091 - DNA, 22 bp, Homo sapiens
ccatgtccagaatgtgtcacgt

SEQ ID NO: 9098092 - DNA, 22 bp, Homo sapiens
ccatgggcgcacaggcctggag

SEQ ID NO: 9098093 - DNA, 22 bp, Homo sapiens
ccatgggaattgggaggtccca

SEQ ID NO: 9098094 - DNA, 22 bp, Homo sapiens
ccatgggaattgggaggtccca

SEQ ID NO: 9098095 - DNA, 17 bp, Homo sapiens
aggctggctcacaggga

SEQ ID NO: 9098096 - DNA, 20 bp, Homo sapiens
cccagagccatagccagaca

SEQ ID NO: 9098097 - DNA, 22 bp, Homo sapiens
cccagagatgtcctgagtgata

SEQ ID NO: 9098098 - DNA, 22 bp, Homo sapiens
cccagagatgtcctgagtgata

SEQ ID NO: 9098099 - DNA, 19 bp, Homo sapiens
cccagagcatcctgaactt

SEQ ID NO: 9098100 - DNA, 17 bp, Homo sapiens
ccaggagcgtgggtctc

SEQ ID NO: 9098101 - DNA, 22 bp, Homo sapiens
ccaggagctatgtacacactat

SEQ ID NO: 9098102 - DNA, 17 bp, Homo sapiens
ccaggagcgtgggtctc

SEQ ID NO: 9098103 - DNA, 22 bp, Homo sapiens
ccaggagctggagggtgcagtg

SEQ ID NO: 9098104 - DNA, 22 bp, Homo sapiens
ccaggagctggagggtgcagtg

SEQ ID NO: 9098105 - DNA, 22 bp, Homo sapiens
ccaggagctggcatgtggagag

SEQ ID NO: 9098106 - DNA, 22 bp, Homo sapiens
aggctccaaattaccaagctct

SEQ ID NO: 9098107 - DNA, 22 bp, Homo sapiens
aggctcatccccacaaagcaaa

SEQ ID NO: 9098108 - DNA, 22 bp, Homo sapiens
aggctcatccccacaaagcaaa

SEQ ID NO: 9098109 - DNA, 22 bp, Homo sapiens
aggctcattcttgcctctgagc

SEQ ID NO: 9098110 - DNA, 22 bp, Homo sapiens
aggctcattcttgcctctgagc

SEQ ID NO: 9098111 - DNA, 22 bp, Homo sapiens
aggctcagttcacgtcaacttt

SEQ ID NO: 9098112 - DNA, 22 bp, Homo sapiens
aggctcagtgcaaatcattctg

SEQ ID NO: 9098113 - DNA, 22 bp, Homo sapiens
aggctcagttctgtggtgagcc

SEQ ID NO: 9098114 - DNA, 22 bp, Homo sapiens
aggctccaccccgccagacctt

SEQ ID NO: 9098115 - DNA, 22 bp, Homo sapiens
aggctccaccccgccagacctt

SEQ ID NO: 9098116 - DNA, 22 bp, Homo sapiens
aggctccaccagtcaggtgcat

SEQ ID NO: 9098117 - DNA, 22 bp, Homo sapiens
aggctccaccagtcaggtgcat

SEQ ID NO: 9098118 - DNA, 22 bp, Homo sapiens
aggctccaccagtcaggtgcat

SEQ ID NO: 9098119 - DNA, 22 bp, Homo sapiens
aggctccaccagtcaggtgcat

SEQ ID NO: 9098120 - DNA, 23 bp, Homo sapiens
aggctccacatgggcactttgca

SEQ ID NO: 9098121 - DNA, 22 bp, Homo sapiens
aggctccaccctacagagctcc

SEQ ID NO: 9098122 - DNA, 22 bp, Homo sapiens
aggctccaccctacagagctcc

SEQ ID NO: 9098123 - DNA, 22 bp, Homo sapiens
aggctccaccctacagagctcc

SEQ ID NO: 9098124 - DNA, 22 bp, Homo sapiens
ccagggaaggctctgcctgctt

SEQ ID NO: 9098125 - DNA, 22 bp, Homo sapiens
ccagggagcggggctgggtctc

SEQ ID NO: 9098126 - DNA, 22 bp, Homo sapiens
ccagggagcggggctgggtctc

SEQ ID NO: 9098127 - DNA, 22 bp, Homo sapiens
ccagggaggagcatttcatggt

SEQ ID NO: 9098128 - DNA, 22 bp, Homo sapiens
aggctcctatcgctttcagcaa

SEQ ID NO: 9098129 - DNA, 22 bp, Homo sapiens
aggctccgtccagtctcaggcc

SEQ ID NO: 9098130 - DNA, 22 bp, Homo sapiens
aggctcccatggtgtggcagga

SEQ ID NO: 9098131 - DNA, 22 bp, Homo sapiens
aggctcctgagaggcagaggct

SEQ ID NO: 9098132 - DNA, 17 bp, Homo sapiens
aggctcctcctaaggtc

SEQ ID NO: 9098133 - DNA, 22 bp, Homo sapiens
aggctccttgctcacaggctca

SEQ ID NO: 9098134 - DNA, 22 bp, Homo sapiens
ccagggtcttggagaggagtgc

SEQ ID NO: 9098135 - DNA, 22 bp, Homo sapiens
ccagggtgagtgtcatgggtta

SEQ ID NO: 9098136 - DNA, 22 bp, Homo sapiens
ccagggtgctctgtggcgtcgc

SEQ ID NO: 9098137 - DNA, 22 bp, Homo sapiens
ccagggtgaccagctggcctag

SEQ ID NO: 9098138 - DNA, 22 bp, Homo sapiens
ccagggtgagaaaaggctggat

SEQ ID NO: 9098139 - DNA, 22 bp, Homo sapiens
ccagggtgagaaaaggctggat

SEQ ID NO: 9098140 - DNA, 22 bp, Homo sapiens
ccagagaaagtgaagcaaatgt

SEQ ID NO: 9098141 - DNA, 22 bp, Homo sapiens
ccagagagggcgccacctggag

SEQ ID NO: 9098142 - DNA, 22 bp, Homo sapiens
ccagagaggggaagggcttgcc

SEQ ID NO: 9098143 - DNA, 22 bp, Homo sapiens
ccagagagggcgccacctggag

SEQ ID NO: 9098144 - DNA, 20 bp, Homo sapiens
ccacaggagtccagtcgacc

SEQ ID NO: 9098145 - DNA, 20 bp, Homo sapiens
ccacaggagtccagtcgacc

SEQ ID NO: 9098146 - DNA, 22 bp, Homo sapiens
ccagagaaaggtttgattcatt

SEQ ID NO: 9098147 - DNA, 22 bp, Homo sapiens
ccacaggatccaagggaaggca

SEQ ID NO: 9098148 - DNA, 22 bp, Homo sapiens
ccacaggacggaggtctggccg

SEQ ID NO: 9098149 - DNA, 22 bp, Homo sapiens
ccacaggaccagaggagatcac

SEQ ID NO: 9098150 - DNA, 22 bp, Homo sapiens
ccacaggaccagaggagatcac

SEQ ID NO: 9098151 - DNA, 22 bp, Homo sapiens
ccacaggaggatgttcagacaa

SEQ ID NO: 9098152 - DNA, 22 bp, Homo sapiens
ccacaggacggaggtctggccg

SEQ ID NO: 9098153 - DNA, 20 bp, Homo sapiens
ccagagagtaggttagtgat

SEQ ID NO: 9098154 - DNA, 22 bp, Homo sapiens
ccagagaggtagcttaccctct

SEQ ID NO: 9098155 - DNA, 22 bp, Homo sapiens
ccagagaggggaagggcttgcc

SEQ ID NO: 9098156 - DNA, 17 bp, Homo sapiens
ccagagagtagttagga

SEQ ID NO: 9098157 - DNA, 22 bp, Homo sapiens
ccagagagtatcatggagagta

SEQ ID NO: 9098158 - DNA, 22 bp, Homo sapiens
ccagagagtcgatgggggacac

SEQ ID NO: 9098159 - DNA, 22 bp, Homo sapiens
ccagagagtcgatgggggacac

SEQ ID NO: 9098160 - DNA, 22 bp, Homo sapiens
ccagagagtatcatggagagta

SEQ ID NO: 9098161 - DNA, 22 bp, Homo sapiens
aggcaggggagctggaagggta

SEQ ID NO: 9098162 - DNA, 22 bp, Homo sapiens
aggcaggggagctggaagggta

SEQ ID NO: 9098163 - DNA, 22 bp, Homo sapiens
aggcaggggagctggaagggta

SEQ ID NO: 9098164 - DNA, 22 bp, Homo sapiens
aggcaggggagctggaagggta

SEQ ID NO: 9098165 - DNA, 22 bp, Homo sapiens
aggcagggtcttgctatgttgc

SEQ ID NO: 9098166 - DNA, 22 bp, Homo sapiens
ccacaggacacaactgctgacc

SEQ ID NO: 9098167 - DNA, 22 bp, Homo sapiens
ccacaggaagttatgagtacta

SEQ ID NO: 9098168 - DNA, 22 bp, Homo sapiens
ccacagcttcgcagtctgctgc

SEQ ID NO: 9098169 - DNA, 21 bp, Homo sapiens
ccacagctggtctctgagccc

SEQ ID NO: 9098170 - DNA, 17 bp, Homo sapiens
aggcaggtaagagttat

SEQ ID NO: 9098171 - DNA, 17 bp, Homo sapiens
aggcaggtaagagttat

SEQ ID NO: 9098172 - DNA, 22 bp, Homo sapiens
ccagcagaggggcggagtgcag

SEQ ID NO: 9098173 - DNA, 22 bp, Homo sapiens
ccagcagagggcgcttcacacc

SEQ ID NO: 9098174 - DNA, 22 bp, Homo sapiens
aggccagactttggccaaatcc

SEQ ID NO: 9098175 - DNA, 22 bp, Homo sapiens
aggccagagaggggaccagcct

SEQ ID NO: 9098176 - DNA, 22 bp, Homo sapiens
ccagcagaagctcccgctgggt

SEQ ID NO: 9098177 - DNA, 22 bp, Homo sapiens
ccagcagaagctcccgctgggt

SEQ ID NO: 9098178 - DNA, 22 bp, Homo sapiens
ccagcagacacacaggcgtggg

SEQ ID NO: 9098179 - DNA, 22 bp, Homo sapiens
ccagcagacacacaggcgtggg

SEQ ID NO: 9098180 - DNA, 22 bp, Homo sapiens
ccagcactgctctcagactgag

SEQ ID NO: 9098181 - DNA, 19 bp, Homo sapiens
ccagcagaagccactcctg

SEQ ID NO: 9098182 - DNA, 19 bp, Homo sapiens
ccagcagaagccactcctg

SEQ ID NO: 9098183 - DNA, 19 bp, Homo sapiens
ccagcagacacagctgccc

SEQ ID NO: 9098184 - DNA, 19 bp, Homo sapiens
ccagcagacacagctgccc

SEQ ID NO: 9098185 - DNA, 19 bp, Homo sapiens
ccagcagacacagctgccc

SEQ ID NO: 9098186 - DNA, 22 bp, Homo sapiens
ccagcagagcatggggaggaag

SEQ ID NO: 9098187 - DNA, 22 bp, Homo sapiens
ccagcagagctcaaacttcctg

SEQ ID NO: 9098188 - DNA, 22 bp, Homo sapiens
ccagagcaattctcacagaact

SEQ ID NO: 9098189 - DNA, 22 bp, Homo sapiens
ccagagcagatgtggccttggt

SEQ ID NO: 9098190 - DNA, 22 bp, Homo sapiens
ccagagcaattctcacagaact

SEQ ID NO: 9098191 - DNA, 21 bp, Homo sapiens
aggcatggaaatggcacactg

SEQ ID NO: 9098192 - DNA, 21 bp, Homo sapiens
aggcatggaaatggcacactg

SEQ ID NO: 9098193 - DNA, 22 bp, Homo sapiens
ccagagtgacgtgaagtgtgaa

SEQ ID NO: 9098194 - DNA, 22 bp, Homo sapiens
ccagagtgacgtgaagtgtgaa

SEQ ID NO: 9098195 - DNA, 22 bp, Homo sapiens
aggcatggcactgagcagcttc

SEQ ID NO: 9098196 - DNA, 22 bp, Homo sapiens
aggcatggatgtagcagtgacc

SEQ ID NO: 9098197 - DNA, 22 bp, Homo sapiens
aggcatggatggatccagggct

SEQ ID NO: 9098198 - DNA, 22 bp, Homo sapiens
aggcatggatgtagcagtgacc

SEQ ID NO: 9098199 - DNA, 22 bp, Homo sapiens
aggcatggcactgagcagcttc

SEQ ID NO: 9098200 - DNA, 22 bp, Homo sapiens
aggcatggatgtagcagtgacc

SEQ ID NO: 9098201 - DNA, 22 bp, Homo sapiens
ccaggaaaaacacattgaagag

SEQ ID NO: 9098202 - DNA, 22 bp, Homo sapiens
aggccctggcactgcctgggag

SEQ ID NO: 9098203 - DNA, 22 bp, Homo sapiens
aggccctggcccccagagattc

SEQ ID NO: 9098204 - DNA, 22 bp, Homo sapiens
aggccctgggcagttctgtagc

SEQ ID NO: 9098205 - DNA, 22 bp, Homo sapiens
ccaggacaagtgtggccatggc

SEQ ID NO: 9098206 - DNA, 22 bp, Homo sapiens
aggccctgggagcagagatgca

SEQ ID NO: 9098207 - DNA, 18 bp, Homo sapiens
aggccctggcctcgaaca

SEQ ID NO: 9098208 - DNA, 18 bp, Homo sapiens
aggccctggcctcgaaca

SEQ ID NO: 9098209 - DNA, 22 bp, Homo sapiens
ccaggagagcgccctcccggcc

SEQ ID NO: 9098210 - DNA, 22 bp, Homo sapiens
ccaggagagcattgcacagagg

SEQ ID NO: 9098211 - DNA, 22 bp, Homo sapiens
ccaggagagcaggcgtgcagct

SEQ ID NO: 9098212 - DNA, 22 bp, Homo sapiens
ccaggagagcagaagcccaggc

SEQ ID NO: 9098213 - DNA, 22 bp, Homo sapiens
ccaggagatgggagcatctaaa

SEQ ID NO: 9098214 - DNA, 22 bp, Homo sapiens
ccaggagatgggaaagtagcag

SEQ ID NO: 9098215 - DNA, 19 bp, Homo sapiens
ccaggagagcttggagaag

SEQ ID NO: 9098216 - DNA, 22 bp, Homo sapiens
ccaggagatgatgttggggatt

SEQ ID NO: 9098217 - DNA, 22 bp, Homo sapiens
ccaggagatgggagcatctaaa

SEQ ID NO: 9098218 - DNA, 22 bp, Homo sapiens
ccaggagcgggaaaaggaagaa

SEQ ID NO: 9098219 - DNA, 22 bp, Homo sapiens
ccaggagcgcgtgaacaggctg

SEQ ID NO: 9098220 - DNA, 22 bp, Homo sapiens
ccaggagcaaagatcactggga

SEQ ID NO: 9098221 - DNA, 22 bp, Homo sapiens
ccagcttctctctgatgcagct

SEQ ID NO: 9098222 - DNA, 22 bp, Homo sapiens
ccagcttctctgttccagcccc

SEQ ID NO: 9098223 - DNA, 22 bp, Homo sapiens
ccagcttctctctgatgcagct

SEQ ID NO: 9098224 - DNA, 19 bp, Homo sapiens
ccagctggcctgggacctc

SEQ ID NO: 9098225 - DNA, 22 bp, Homo sapiens
ccagcttgtttgaagctcgtca

SEQ ID NO: 9098226 - DNA, 22 bp, Homo sapiens
ccagcttgaagatgtgctggtt

SEQ ID NO: 9098227 - DNA, 19 bp, Homo sapiens
aggcccagcgctgggggct

SEQ ID NO: 9098228 - DNA, 21 bp, Homo sapiens
aggcccagagtcttgggggga

SEQ ID NO: 9098229 - DNA, 22 bp, Homo sapiens
aggcccagcccgtcctcgtgct

SEQ ID NO: 9098230 - DNA, 22 bp, Homo sapiens
ccagcctggactgggtcttgtg

SEQ ID NO: 9098231 - DNA, 22 bp, Homo sapiens
aggcccagagcaggaaagggtt

SEQ ID NO: 9098232 - DNA, 22 bp, Homo sapiens
aggccagatgtcgggctagaag

SEQ ID NO: 9098233 - DNA, 22 bp, Homo sapiens
ccagccctgccagagagagctg

SEQ ID NO: 9098234 - DNA, 22 bp, Homo sapiens
ccagccctgccagagagagctg

SEQ ID NO: 9098235 - DNA, 22 bp, Homo sapiens
ccagccctgccagagagagctg

SEQ ID NO: 9098236 - DNA, 22 bp, Homo sapiens
aggccagatattgtgctaccca

SEQ ID NO: 9098237 - DNA, 19 bp, Homo sapiens
ccagcctctcttccacccc

SEQ ID NO: 9098238 - DNA, 22 bp, Homo sapiens
ccagcctgaaatgcctcatcct

SEQ ID NO: 9098239 - DNA, 23 bp, Homo sapiens
ccagcctctgggtcttcatccag

SEQ ID NO: 9098240 - DNA, 22 bp, Homo sapiens
ccagcctgaaatgcctcatcct

SEQ ID NO: 9098241 - DNA, 22 bp, Homo sapiens
ccagcctgaaatgcctcatcct

SEQ ID NO: 9098242 - DNA, 22 bp, Homo sapiens
ccagcctgaaatgcctcatcct

SEQ ID NO: 9098243 - DNA, 22 bp, Homo sapiens
ccagcctgaaatgcctcatcct

SEQ ID NO: 9098244 - DNA, 22 bp, Homo sapiens
aggcttcttgataaaatgcaga

SEQ ID NO: 9098245 - DNA, 22 bp, Homo sapiens
aggcttcttgagccccacaggc

SEQ ID NO: 9098246 - DNA, 22 bp, Homo sapiens
aggcttcttgagccccacaggc

SEQ ID NO: 9098247 - DNA, 22 bp, Homo sapiens
aggcttgactgctgattttgcc

SEQ ID NO: 9098248 - DNA, 19 bp, Homo sapiens
aggcttggaacagccttat

SEQ ID NO: 9098249 - DNA, 22 bp, Homo sapiens
aggcttcttgggcttcattctg

SEQ ID NO: 9098250 - DNA, 22 bp, Homo sapiens
aggcttcttttagaggggatgg

SEQ ID NO: 9098251 - DNA, 18 bp, Homo sapiens
aggcttcttggctcagtc

SEQ ID NO: 9098252 - DNA, 18 bp, Homo sapiens
aggcttcttggctcagtc

SEQ ID NO: 9098253 - DNA, 22 bp, Homo sapiens
aggcttgacaattttacatgta

SEQ ID NO: 9098254 - DNA, 22 bp, Homo sapiens
cccaggaggtggagcttgcagt

SEQ ID NO: 9098255 - DNA, 22 bp, Homo sapiens
aggcttggaggttctgtagcca

SEQ ID NO: 9098256 - DNA, 22 bp, Homo sapiens
aggcttggaagtggcagaactg

SEQ ID NO: 9098257 - DNA, 19 bp, Homo sapiens
aggcttggattgtggccaa

SEQ ID NO: 9098258 - DNA, 22 bp, Homo sapiens
aggcttctagggttggcagcgg

SEQ ID NO: 9098259 - DNA, 22 bp, Homo sapiens
aggcttctagggttggcagcgg

SEQ ID NO: 9098260 - DNA, 19 bp, Homo sapiens
aggcttctaccctgtccag

SEQ ID NO: 9098261 - DNA, 22 bp, Homo sapiens
aggcttctacgtggtcccaggg

SEQ ID NO: 9098262 - DNA, 22 bp, Homo sapiens
aggcttctgataccatgagaga

SEQ ID NO: 9098263 - DNA, 22 bp, Homo sapiens
aggcttctggggcaccgagcga

SEQ ID NO: 9098264 - DNA, 22 bp, Homo sapiens
aggcttctgtgagctcatacaa

SEQ ID NO: 9098265 - DNA, 22 bp, Homo sapiens
aggctggctgagctgcagcctg

SEQ ID NO: 9098266 - DNA, 22 bp, Homo sapiens
aggctggctgacttctgaagca

SEQ ID NO: 9098267 - DNA, 22 bp, Homo sapiens
aggctggctggcaggggacaca

SEQ ID NO: 9098268 - DNA, 22 bp, Homo sapiens
aggcttcctggaggaagaggta

SEQ ID NO: 9098269 - DNA, 22 bp, Homo sapiens
agggaacagtgaaaggcatcag

SEQ ID NO: 9098270 - DNA, 22 bp, Homo sapiens
agggaaattaatgtgagcaatg

SEQ ID NO: 9098271 - DNA, 22 bp, Homo sapiens
agggaaatctttcaacacttca

SEQ ID NO: 9098272 - DNA, 22 bp, Homo sapiens
cccaggatggggctgcagttat

SEQ ID NO: 9098273 - DNA, 23 bp, Homo sapiens
cccaggagtttcactgcaaaggt

SEQ ID NO: 9098274 - DNA, 22 bp, Homo sapiens
cccaggagtttgagttcagcat

SEQ ID NO: 9098275 - DNA, 20 bp, Homo sapiens
cccaggagtttgctcttact

SEQ ID NO: 9098276 - DNA, 22 bp, Homo sapiens
cccaggagtttgagttcagcat

SEQ ID NO: 9098277 - DNA, 22 bp, Homo sapiens
cccaggagttggaggctgcagt

SEQ ID NO: 9098278 - DNA, 22 bp, Homo sapiens
cccaggagttggaggctgcagt

SEQ ID NO: 9098279 - DNA, 22 bp, Homo sapiens
cccaggagttggaggctgcagt

SEQ ID NO: 9098280 - DNA, 22 bp, Homo sapiens
cccagggaagccatttctgact

SEQ ID NO: 9098281 - DNA, 22 bp, Homo sapiens
agggaagaagctggtagtaggt

SEQ ID NO: 9098282 - DNA, 23 bp, Homo sapiens
agggaagaaacatgaagggctgt

SEQ ID NO: 9098283 - DNA, 22 bp, Homo sapiens
cccagggctgcagatggaggct

SEQ ID NO: 9098284 - DNA, 22 bp, Homo sapiens
cccagggccctggacagctaca

SEQ ID NO: 9098285 - DNA, 22 bp, Homo sapiens
cccagggccctggacagctaca

SEQ ID NO: 9098286 - DNA, 22 bp, Homo sapiens
cccagggcttttctcactagac

SEQ ID NO: 9098287 - DNA, 22 bp, Homo sapiens
cccaggggaggtcctcagggaa

SEQ ID NO: 9098288 - DNA, 22 bp, Homo sapiens
ccctctgctcaggtgcataggc

SEQ ID NO: 9098289 - DNA, 22 bp, Homo sapiens
ccctctgctcaggtgcataggc

SEQ ID NO: 9098290 - DNA, 22 bp, Homo sapiens
ccctctgcctgcgccctggtgt

SEQ ID NO: 9098291 - DNA, 22 bp, Homo sapiens
ccctctgcctgcgccctggtgt

SEQ ID NO: 9098292 - DNA, 22 bp, Homo sapiens
agggatgggaactcctccagca

SEQ ID NO: 9098293 - DNA, 22 bp, Homo sapiens
ccctcccaggagtggccagaga

SEQ ID NO: 9098294 - DNA, 22 bp, Homo sapiens
ccctcccaggagtggccagaga

SEQ ID NO: 9098295 - DNA, 22 bp, Homo sapiens
ccctcccaggagtggccagaga

SEQ ID NO: 9098296 - DNA, 20 bp, Homo sapiens
ccctctgcacatggctgtgg

SEQ ID NO: 9098297 - DNA, 22 bp, Homo sapiens
ccctctctcggttgctgtggtt

SEQ ID NO: 9098298 - DNA, 22 bp, Homo sapiens
ccctctctgctgcatagaggaa

SEQ ID NO: 9098299 - DNA, 20 bp, Homo sapiens
agggcagagggattacaggc

SEQ ID NO: 9098300 - DNA, 22 bp, Homo sapiens
agggcagaggcggacacggaag

SEQ ID NO: 9098301 - DNA, 22 bp, Homo sapiens
agggcagagacatgcttcctga

SEQ ID NO: 9098302 - DNA, 18 bp, Homo sapiens
ccctcttgcacaaagcaa

SEQ ID NO: 9098303 - DNA, 22 bp, Homo sapiens
agggcagagagatgaatgggat

SEQ ID NO: 9098304 - DNA, 22 bp, Homo sapiens
agggcagagcactgaattggga

SEQ ID NO: 9098305 - DNA, 22 bp, Homo sapiens
agggcagagctgtctaaatggc

SEQ ID NO: 9098306 - DNA, 22 bp, Homo sapiens
agggcagagattaattaagaca

SEQ ID NO: 9098307 - DNA, 22 bp, Homo sapiens
agggcagagatctgagtgggca

SEQ ID NO: 9098308 - DNA, 22 bp, Homo sapiens
agggactccgtgcacagtggtt

SEQ ID NO: 9098309 - DNA, 22 bp, Homo sapiens
agggagaaaattggatgcacaa

SEQ ID NO: 9098310 - DNA, 22 bp, Homo sapiens
agggagaaaattggatgcacaa

SEQ ID NO: 9098311 - DNA, 22 bp, Homo sapiens
agggagaacagttgcagcagac

SEQ ID NO: 9098312 - DNA, 22 bp, Homo sapiens
agggagaacagttgcagcagac

SEQ ID NO: 9098313 - DNA, 22 bp, Homo sapiens
agggagaacagttgcagcagac

SEQ ID NO: 9098314 - DNA, 22 bp, Homo sapiens
agggagaagagaacaaagccct

SEQ ID NO: 9098315 - DNA, 22 bp, Homo sapiens
agggagaagagaacaaagccct

SEQ ID NO: 9098316 - DNA, 22 bp, Homo sapiens
agggagtggttaagaaggtgca

SEQ ID NO: 9098317 - DNA, 22 bp, Homo sapiens
agggatgatggaaagaagcagg

SEQ ID NO: 9098318 - DNA, 22 bp, Homo sapiens
agggatgatggaaagaagcagg

SEQ ID NO: 9098319 - DNA, 22 bp, Homo sapiens
agggatgatggaaagaagcagg

SEQ ID NO: 9098320 - DNA, 22 bp, Homo sapiens
agggagttcagaggctggtttg

SEQ ID NO: 9098321 - DNA, 22 bp, Homo sapiens
agggatcagaatttcctccttt

SEQ ID NO: 9098322 - DNA, 22 bp, Homo sapiens
agggatcagcagagggtgtggt

SEQ ID NO: 9098323 - DNA, 22 bp, Homo sapiens
agggatcagcagagggtgtggt

SEQ ID NO: 9098324 - DNA, 22 bp, Homo sapiens
agggatgatcagggtagaggct

SEQ ID NO: 9098325 - DNA, 22 bp, Homo sapiens
agggatgactcttggctgattc

SEQ ID NO: 9098326 - DNA, 22 bp, Homo sapiens
agggatgagtgagtaaacaata

SEQ ID NO: 9098327 - DNA, 22 bp, Homo sapiens
agggatgactcttggctgattc

SEQ ID NO: 9098328 - DNA, 22 bp, Homo sapiens
agggatcacggtggacttggat

SEQ ID NO: 9098329 - DNA, 22 bp, Homo sapiens
cctctggcttactgttgggttt

SEQ ID NO: 9098330 - DNA, 22 bp, Homo sapiens
agggctgcaggcaagatatggc

SEQ ID NO: 9098331 - DNA, 21 bp, Homo sapiens
cctctggcttgtgctgtgccc

SEQ ID NO: 9098332 - DNA, 21 bp, Homo sapiens
cctctggcttgtgctgtgccc

SEQ ID NO: 9098333 - DNA, 21 bp, Homo sapiens
cctctggcttgtgctgtgccc

SEQ ID NO: 9098334 - DNA, 22 bp, Homo sapiens
cctctggcttactgttgggttt

SEQ ID NO: 9098335 - DNA, 22 bp, Homo sapiens
cctctgggaagccagtcctgct

SEQ ID NO: 9098336 - DNA, 22 bp, Homo sapiens
cctctgggaagccagtcctgct

SEQ ID NO: 9098337 - DNA, 22 bp, Homo sapiens
cctctgggcaggtagcagcagc

SEQ ID NO: 9098338 - DNA, 22 bp, Homo sapiens
cctctgggccagcctggaccct

SEQ ID NO: 9098339 - DNA, 16 bp, Homo sapiens
cctctgggatgtttgc

SEQ ID NO: 9098340 - DNA, 22 bp, Homo sapiens
cctctgggagactgctactgag

SEQ ID NO: 9098341 - DNA, 22 bp, Homo sapiens
cctctgggcaggtagcagcagc

SEQ ID NO: 9098342 - DNA, 22 bp, Homo sapiens
cctctgggcctggaagggcagt

SEQ ID NO: 9098343 - DNA, 22 bp, Homo sapiens
cctctgggcggagatctgctgc

SEQ ID NO: 9098344 - DNA, 22 bp, Homo sapiens
cctctgggcggagatctgctgc

SEQ ID NO: 9098345 - DNA, 16 bp, Homo sapiens
cctctgggcctgcaag

SEQ ID NO: 9098346 - DNA, 22 bp, Homo sapiens
cctcctggaggctctaagggag

SEQ ID NO: 9098347 - DNA, 22 bp, Homo sapiens
cctcctggagcattggtgagga

SEQ ID NO: 9098348 - DNA, 18 bp, Homo sapiens
agggctgatgagtttggg

SEQ ID NO: 9098349 - DNA, 23 bp, Homo sapiens
agggctgatgccattgcagctct

SEQ ID NO: 9098350 - DNA, 22 bp, Homo sapiens
cctcctggaggctctagggaaa

SEQ ID NO: 9098351 - DNA, 22 bp, Homo sapiens
agggctgagtgggagagagttg

SEQ ID NO: 9098352 - DNA, 22 bp, Homo sapiens
cctgagagtgcgtgcctcctta

SEQ ID NO: 9098353 - DNA, 22 bp, Homo sapiens
cctgagagtgagtgcctcctta

SEQ ID NO: 9098354 - DNA, 22 bp, Homo sapiens
aggggagaggtgagcaacttct

SEQ ID NO: 9098355 - DNA, 17 bp, Homo sapiens
aggggagagtgggaaga

SEQ ID NO: 9098356 - DNA, 22 bp, Homo sapiens
cctgagctttaaaagccatgta

SEQ ID NO: 9098357 - DNA, 22 bp, Homo sapiens
cctgagctttaaaagccatgta

SEQ ID NO: 9098358 - DNA, 22 bp, Homo sapiens
cctgaggacacacgctgcagga

SEQ ID NO: 9098359 - DNA, 22 bp, Homo sapiens
cctgaggacacacgctgcagga

SEQ ID NO: 9098360 - DNA, 22 bp, Homo sapiens
cctgaggacagtgtgaccatgg

SEQ ID NO: 9098361 - DNA, 22 bp, Homo sapiens
aggggagagaacataaggaagt

SEQ ID NO: 9098362 - DNA, 22 bp, Homo sapiens
aggggagagaacataaggaagt

SEQ ID NO: 9098363 - DNA, 22 bp, Homo sapiens
aggggagaatttcaactcaggt

SEQ ID NO: 9098364 - DNA, 22 bp, Homo sapiens
aggggagactggaatctaacat

SEQ ID NO: 9098365 - DNA, 22 bp, Homo sapiens
aggggagaaaaatgccttctgt

SEQ ID NO: 9098366 - DNA, 22 bp, Homo sapiens
aggggacatttagcaatgacta

SEQ ID NO: 9098367 - DNA, 21 bp, Homo sapiens
aggggacagagtagctccagg

SEQ ID NO: 9098368 - DNA, 22 bp, Homo sapiens
aggggctgggacagagccaagc

SEQ ID NO: 9098369 - DNA, 22 bp, Homo sapiens
aggggctgggacagagccaagc

SEQ ID NO: 9098370 - DNA, 22 bp, Homo sapiens
aggggctggcttatctgagagt

SEQ ID NO: 9098371 - DNA, 22 bp, Homo sapiens
aggggctgcctggcttggcact

SEQ ID NO: 9098372 - DNA, 22 bp, Homo sapiens
cctgaggatgccagcatgggtg

SEQ ID NO: 9098373 - DNA, 22 bp, Homo sapiens
cctgaggagattgtggctgggg

SEQ ID NO: 9098374 - DNA, 22 bp, Homo sapiens
cctgaggagattgtggctgggg

SEQ ID NO: 9098375 - DNA, 22 bp, Homo sapiens
cctgaggccctggctgtgctga

SEQ ID NO: 9098376 - DNA, 22 bp, Homo sapiens
cctgaggcaaggacttggtggc

SEQ ID NO: 9098377 - DNA, 22 bp, Homo sapiens
cctgaggcaaggacttggtggc

SEQ ID NO: 9098378 - DNA, 22 bp, Homo sapiens
cctgaggcaaggacttggtggc

SEQ ID NO: 9098379 - DNA, 22 bp, Homo sapiens
agggctcctatgccccatggac

SEQ ID NO: 9098380 - DNA, 22 bp, Homo sapiens
agggctcctatgatgctctgcc

SEQ ID NO: 9098381 - DNA, 22 bp, Homo sapiens
agggctcctatgatgctctgcc

SEQ ID NO: 9098382 - DNA, 22 bp, Homo sapiens
agggctcctatgatgctctgcc

SEQ ID NO: 9098383 - DNA, 22 bp, Homo sapiens
agggctccgggccaccggcctg

SEQ ID NO: 9098384 - DNA, 22 bp, Homo sapiens
agggctccgggcaggcgatgga

SEQ ID NO: 9098385 - DNA, 22 bp, Homo sapiens
agggctcctgaggcccttctgg

SEQ ID NO: 9098386 - DNA, 23 bp, Homo sapiens
agggctccttgttgattagcatt

SEQ ID NO: 9098387 - DNA, 22 bp, Homo sapiens
agggctcctccccggcctccac

SEQ ID NO: 9098388 - DNA, 22 bp, Homo sapiens
agggctcctccccggcctccac

SEQ ID NO: 9098389 - DNA, 22 bp, Homo sapiens
agggctcctatgccccatggac

SEQ ID NO: 9098390 - DNA, 22 bp, Homo sapiens
agggctctcttggacaactgct

SEQ ID NO: 9098391 - DNA, 22 bp, Homo sapiens
cctcctctgtgcagctgtgggt

SEQ ID NO: 9098392 - DNA, 22 bp, Homo sapiens
cctcctctgtgcagctgtgggt

SEQ ID NO: 9098393 - DNA, 22 bp, Homo sapiens
agggctctgttggggtcagcac

SEQ ID NO: 9098394 - DNA, 22 bp, Homo sapiens
agggctctgttggggtcagcac

SEQ ID NO: 9098395 - DNA, 22 bp, Homo sapiens
agggctctgtccccagaggccc

SEQ ID NO: 9098396 - DNA, 22 bp, Homo sapiens
agggctctgtgactatcactgc

SEQ ID NO: 9098397 - DNA, 22 bp, Homo sapiens
agggctcccgcggtgtccggga

SEQ ID NO: 9098398 - DNA, 22 bp, Homo sapiens
agggctccaggggctgggtgac

SEQ ID NO: 9098399 - DNA, 22 bp, Homo sapiens
agggctccaggggctgggtgac

SEQ ID NO: 9098400 - DNA, 22 bp, Homo sapiens
agggctcccgtgaggtgactgc

SEQ ID NO: 9098401 - DNA, 22 bp, Homo sapiens
agggctccaggggaccatcagt

SEQ ID NO: 9098402 - DNA, 22 bp, Homo sapiens
agggctccaaggaagtgtagct

SEQ ID NO: 9098403 - DNA, 22 bp, Homo sapiens
agggctccaaggaagtgtagct

SEQ ID NO: 9098404 - DNA, 22 bp, Homo sapiens
agggctccaaggaagtgtagct

SEQ ID NO: 9098405 - DNA, 22 bp, Homo sapiens
ccctggagggacagctgctcta

SEQ ID NO: 9098406 - DNA, 22 bp, Homo sapiens
ccctggaggcggagcttgcagt

SEQ ID NO: 9098407 - DNA, 22 bp, Homo sapiens
agggccagaatccctcagtcta

SEQ ID NO: 9098408 - DNA, 22 bp, Homo sapiens
agggccagaatccctcagtcta

SEQ ID NO: 9098409 - DNA, 22 bp, Homo sapiens
agggccagagtctgtgtagata

SEQ ID NO: 9098410 - DNA, 22 bp, Homo sapiens
agggccagagtctgtgtagata

SEQ ID NO: 9098411 - DNA, 22 bp, Homo sapiens
ccctttccatggctctcctagg

SEQ ID NO: 9098412 - DNA, 22 bp, Homo sapiens
cccttcagtgctaggctgcctg

SEQ ID NO: 9098413 - DNA, 22 bp, Homo sapiens
ccctttccatggctctcctagg

SEQ ID NO: 9098414 - DNA, 22 bp, Homo sapiens
ccctttcccttctggctcaggg

SEQ ID NO: 9098415 - DNA, 22 bp, Homo sapiens
ccctttctccagaactgtctga

SEQ ID NO: 9098416 - DNA, 22 bp, Homo sapiens
ccctttcctgaagaatattttt

SEQ ID NO: 9098417 - DNA, 22 bp, Homo sapiens
ccctttcttccgtgacttctgc

SEQ ID NO: 9098418 - DNA, 22 bp, Homo sapiens
ccctttgcccagtatattctag

SEQ ID NO: 9098419 - DNA, 18 bp, Homo sapiens
ccctttgccctatgagta

SEQ ID NO: 9098420 - DNA, 22 bp, Homo sapiens
ccctttgggttccccaagcctg

SEQ ID NO: 9098421 - DNA, 22 bp, Homo sapiens
ccctttggcatttccaggatat

SEQ ID NO: 9098422 - DNA, 22 bp, Homo sapiens
ccctttggaagaggctcactga

SEQ ID NO: 9098423 - DNA, 22 bp, Homo sapiens
catgaaaaatttactgttaaca

SEQ ID NO: 9098424 - DNA, 22 bp, Homo sapiens
catgaaaaatttactgttaaca

SEQ ID NO: 9098425 - DNA, 22 bp, Homo sapiens
catcttttggtaggagccgggc

SEQ ID NO: 9098426 - DNA, 22 bp, Homo sapiens
catcttttggcctattctgagg

SEQ ID NO: 9098427 - DNA, 20 bp, Homo sapiens
tcattccaaatagttcagca

SEQ ID NO: 9098428 - DNA, 22 bp, Homo sapiens
catctttgttctgtaaactttt

SEQ ID NO: 9098429 - DNA, 22 bp, Homo sapiens
catcttttcagaagccattctg

SEQ ID NO: 9098430 - DNA, 22 bp, Homo sapiens
catctttgttttggatataatc

SEQ ID NO: 9098431 - DNA, 22 bp, Homo sapiens
catctttgttctgtaaactttt

SEQ ID NO: 9098432 - DNA, 22 bp, Homo sapiens
catctttgttctgtaaactttt

SEQ ID NO: 9098433 - DNA, 22 bp, Homo sapiens
catctttgtttcatctgtccag

SEQ ID NO: 9098434 - DNA, 22 bp, Homo sapiens
catctttgtttcatctgtccag

SEQ ID NO: 9098435 - DNA, 22 bp, Homo sapiens
catctttggagaaacttccgtt

SEQ ID NO: 9098436 - DNA, 22 bp, Homo sapiens
tcatcagtttagaaaaaatatg

SEQ ID NO: 9098437 - DNA, 22 bp, Homo sapiens
tcatgaatcgtggaatgattta

SEQ ID NO: 9098438 - DNA, 22 bp, Homo sapiens
tcatgattcttctaccacagca

SEQ ID NO: 9098439 - DNA, 22 bp, Homo sapiens
tcatgatttttctttacagttg

SEQ ID NO: 9098440 - DNA, 18 bp, Homo sapiens
tcatgaggtagaggctgg

SEQ ID NO: 9098441 - DNA, 23 bp, Homo sapiens
tcatgagtggctgcggggctgag

SEQ ID NO: 9098442 - DNA, 22 bp, Homo sapiens
tcatgattggaatggaatatgt

SEQ ID NO: 9098443 - DNA, 22 bp, Homo sapiens
tcatgatttacttggtggatga

SEQ ID NO: 9098444 - DNA, 22 bp, Homo sapiens
tcatgatttcctggttaaggac

SEQ ID NO: 9098445 - DNA, 22 bp, Homo sapiens
tcatgattaacatttccaagca

SEQ ID NO: 9098446 - DNA, 22 bp, Homo sapiens
tcattctctgggatgcagtttg

SEQ ID NO: 9098447 - DNA, 22 bp, Homo sapiens
tcattccctccagctgtggcta

SEQ ID NO: 9098448 - DNA, 22 bp, Homo sapiens
tcattccatttccagctctgaa

SEQ ID NO: 9098449 - DNA, 22 bp, Homo sapiens
tccacattatgtttctcctttc

SEQ ID NO: 9098450 - DNA, 22 bp, Homo sapiens
tccagaccatggatggctgcaa

SEQ ID NO: 9098451 - DNA, 22 bp, Homo sapiens
tccacatccattgcttgacttt

SEQ ID NO: 9098452 - DNA, 22 bp, Homo sapiens
tccacagttttgccactagctg

SEQ ID NO: 9098453 - DNA, 22 bp, Homo sapiens
tccacagttttgccactagctg

SEQ ID NO: 9098454 - DNA, 22 bp, Homo sapiens
tccacaggtatgaggccccacc

SEQ ID NO: 9098455 - DNA, 22 bp, Homo sapiens
tccacaggtatttctccttgct

SEQ ID NO: 9098456 - DNA, 20 bp, Homo sapiens
tccaagccctccttccattc

SEQ ID NO: 9098457 - DNA, 20 bp, Homo sapiens
tccaagccctccttccattc

SEQ ID NO: 9098458 - DNA, 21 bp, Homo sapiens
tccaagccttcaacacattca

SEQ ID NO: 9098459 - DNA, 22 bp, Homo sapiens
tccacagggcctttctggtgtg

SEQ ID NO: 9098460 - DNA, 17 bp, Homo sapiens
tccaagccagcttgcct

SEQ ID NO: 9098461 - DNA, 22 bp, Homo sapiens
tccagctggcccggccatgaat

SEQ ID NO: 9098462 - DNA, 22 bp, Homo sapiens
tccagctggcccggccatgaat

SEQ ID NO: 9098463 - DNA, 22 bp, Homo sapiens
tccaggcccatggagcagagct

SEQ ID NO: 9098464 - DNA, 22 bp, Homo sapiens
tccaggcccgagatgggctgga

SEQ ID NO: 9098465 - DNA, 22 bp, Homo sapiens
tccaggcccgagatgggctgga

SEQ ID NO: 9098466 - DNA, 22 bp, Homo sapiens
tccaggcccctgcctgggcctg

SEQ ID NO: 9098467 - DNA, 22 bp, Homo sapiens
tccaggccccactgaagcccct

SEQ ID NO: 9098468 - DNA, 22 bp, Homo sapiens
tccaggccccagaccgtactgc

SEQ ID NO: 9098469 - DNA, 18 bp, Homo sapiens
catgtgttctacatcagt

SEQ ID NO: 9098470 - DNA, 22 bp, Homo sapiens
catgtgttgtctcatttaatcc

SEQ ID NO: 9098471 - DNA, 22 bp, Homo sapiens
tccaggctcccctgcgtgctcc

SEQ ID NO: 9098472 - DNA, 19 bp, Homo sapiens
tccaggctccattggcaga

SEQ ID NO: 9098473 - DNA, 22 bp, Homo sapiens
tccagctgcaaggggcacagct

SEQ ID NO: 9098474 - DNA, 22 bp, Homo sapiens
tccagctcttcagttctgcaaa

SEQ ID NO: 9098475 - DNA, 17 bp, Homo sapiens
tccagcctcctctgctg

SEQ ID NO: 9098476 - DNA, 17 bp, Homo sapiens
tccagcctcctctgctg

SEQ ID NO: 9098477 - DNA, 22 bp, Homo sapiens
tccagcctcctatttaccctaa

SEQ ID NO: 9098478 - DNA, 22 bp, Homo sapiens
tccagcctcctatttaccctaa

SEQ ID NO: 9098479 - DNA, 22 bp, Homo sapiens
tccagcctaatgttcttcccac

SEQ ID NO: 9098480 - DNA, 22 bp, Homo sapiens
tccagcctaatgttcttcccac

SEQ ID NO: 9098481 - DNA, 22 bp, Homo sapiens
tccagcctaggggaacagctgc

SEQ ID NO: 9098482 - DNA, 22 bp, Homo sapiens
tccagcctaggggaacagctgc

SEQ ID NO: 9098483 - DNA, 22 bp, Homo sapiens
tccagcctcatttctcctgctt

SEQ ID NO: 9098484 - DNA, 22 bp, Homo sapiens
tccagcctcatttctcctgctt

SEQ ID NO: 9098485 - DNA, 22 bp, Homo sapiens
tccagcctcatttctcctgctt

SEQ ID NO: 9098486 - DNA, 19 bp, Homo sapiens
tccagccctgttccctttt

SEQ ID NO: 9098487 - DNA, 22 bp, Homo sapiens
tccagccctgtgtctgggagag

SEQ ID NO: 9098488 - DNA, 22 bp, Homo sapiens
tccagcctaatgttcttcccac

SEQ ID NO: 9098489 - DNA, 22 bp, Homo sapiens
tccagccctgtggcttccaccc

SEQ ID NO: 9098490 - DNA, 22 bp, Homo sapiens
tccagcccagctcctctcagaa

SEQ ID NO: 9098491 - DNA, 22 bp, Homo sapiens
tccagcccagctgtccccttca

SEQ ID NO: 9098492 - DNA, 22 bp, Homo sapiens
tccagagaggcatatttacaag

SEQ ID NO: 9098493 - DNA, 22 bp, Homo sapiens
tccagagagccacggacagggg

SEQ ID NO: 9098494 - DNA, 22 bp, Homo sapiens
tccagagagccacggacagggg

SEQ ID NO: 9098495 - DNA, 22 bp, Homo sapiens
tccagagagatagtggctaata

SEQ ID NO: 9098496 - DNA, 22 bp, Homo sapiens
tccagagagaaaaacaagcttt

SEQ ID NO: 9098497 - DNA, 19 bp, Homo sapiens
tccagactgtccaggctat

SEQ ID NO: 9098498 - DNA, 22 bp, Homo sapiens
tccagagaacgatgaaagctgg

SEQ ID NO: 9098499 - DNA, 22 bp, Homo sapiens
tccagagaattctacgcagtgc

SEQ ID NO: 9098500 - DNA, 22 bp, Homo sapiens
tccagagacttgcatgtgcttg

SEQ ID NO: 9098501 - DNA, 22 bp, Homo sapiens
tccagagaattctacgcagtgc

SEQ ID NO: 9098502 - DNA, 21 bp, Homo sapiens
cattcacagtctggctcttga

SEQ ID NO: 9098503 - DNA, 22 bp, Homo sapiens
cattcagagctttcttatcata

SEQ ID NO: 9098504 - DNA, 22 bp, Homo sapiens
cattcagagctttcttatcata

SEQ ID NO: 9098505 - DNA, 17 bp, Homo sapiens
cattcagagtaattaca

SEQ ID NO: 9098506 - DNA, 22 bp, Homo sapiens
cattcacatcttgttccatcac

SEQ ID NO: 9098507 - DNA, 22 bp, Homo sapiens
cattcaaattaagattttgtta

SEQ ID NO: 9098508 - DNA, 22 bp, Homo sapiens
cattcaaattaagattttgtta

SEQ ID NO: 9098509 - DNA, 22 bp, Homo sapiens
cattcaaattaagattttgtta

SEQ ID NO: 9098510 - DNA, 22 bp, Homo sapiens
cattcaaattaagattttgtta

SEQ ID NO: 9098511 - DNA, 22 bp, Homo sapiens
cattcaaatgtgccactgtcct

SEQ ID NO: 9098512 - DNA, 22 bp, Homo sapiens
cattcaaatgtgccactgtcct

SEQ ID NO: 9098513 - DNA, 22 bp, Homo sapiens
cattcaaatgtgccactgtcct

SEQ ID NO: 9098514 - DNA, 22 bp, Homo sapiens
cattcacaaaaccacatgccat

SEQ ID NO: 9098515 - DNA, 22 bp, Homo sapiens
cattcacaactgagcattgttg

SEQ ID NO: 9098516 - DNA, 22 bp, Homo sapiens
cattcacaaagctgattgatgg

SEQ ID NO: 9098517 - DNA, 22 bp, Homo sapiens
cattcacaatggattgcttcaa

SEQ ID NO: 9098518 - DNA, 22 bp, Homo sapiens
cattcacaatggattgcttcaa

SEQ ID NO: 9098519 - DNA, 22 bp, Homo sapiens
catgttcacctgtggcactagt

SEQ ID NO: 9098520 - DNA, 22 bp, Homo sapiens
catgttcagtgacagttattga

SEQ ID NO: 9098521 - DNA, 22 bp, Homo sapiens
catgttcatcagatcaattgta

SEQ ID NO: 9098522 - DNA, 19 bp, Homo sapiens
catgttatgctgtagtatc

SEQ ID NO: 9098523 - DNA, 22 bp, Homo sapiens
catgttatttatccattaaaca

SEQ ID NO: 9098524 - DNA, 22 bp, Homo sapiens
catgttaatgaatttttgcagt

SEQ ID NO: 9098525 - DNA, 22 bp, Homo sapiens
catgttaaattgagtttgcaat

SEQ ID NO: 9098526 - DNA, 22 bp, Homo sapiens
catgttaagtgtttgataacca

SEQ ID NO: 9098527 - DNA, 22 bp, Homo sapiens
catgttaatatgcattgagtac

SEQ ID NO: 9098528 - DNA, 22 bp, Homo sapiens
cattcaaaggcatgtcctattt

SEQ ID NO: 9098529 - DNA, 22 bp, Homo sapiens
cattcaaaggcatgtcctattt

SEQ ID NO: 9098530 - DNA, 22 bp, Homo sapiens
cattatattttactgcatggga

SEQ ID NO: 9098531 - DNA, 22 bp, Homo sapiens
catgttgtagtatcataatggt

SEQ ID NO: 9098532 - DNA, 22 bp, Homo sapiens
catgttgtgaaggaaaatgggc

SEQ ID NO: 9098533 - DNA, 22 bp, Homo sapiens
tcccagagcccaagttggagag

SEQ ID NO: 9098534 - DNA, 22 bp, Homo sapiens
tcccagagcctctgccactctg

SEQ ID NO: 9098535 - DNA, 22 bp, Homo sapiens
tcccagagcctctgccactctg

SEQ ID NO: 9098536 - DNA, 21 bp, Homo sapiens
tcccactctaaatggactgaa

SEQ ID NO: 9098537 - DNA, 20 bp, Homo sapiens
tcccactcttgtgttttcag

SEQ ID NO: 9098538 - DNA, 22 bp, Homo sapiens
tcccagaggaaatggcagctga

SEQ ID NO: 9098539 - DNA, 22 bp, Homo sapiens
tcccagagctgataagccttta

SEQ ID NO: 9098540 - DNA, 22 bp, Homo sapiens
tcccagaggactgttggtgcta

SEQ ID NO: 9098541 - DNA, 22 bp, Homo sapiens
tcccagccacaggtgtagccct

SEQ ID NO: 9098542 - DNA, 22 bp, Homo sapiens
tcccagccacaggtgtagccct

SEQ ID NO: 9098543 - DNA, 22 bp, Homo sapiens
tcccagagctgataagccttta

SEQ ID NO: 9098544 - DNA, 22 bp, Homo sapiens
tcccagagctctggaggttgga

SEQ ID NO: 9098545 - DNA, 22 bp, Homo sapiens
tcccagagctctgacaccagct

SEQ ID NO: 9098546 - DNA, 22 bp, Homo sapiens
tcccagagctctggaggttgga

SEQ ID NO: 9098547 - DNA, 22 bp, Homo sapiens
tcccagagctctgacaccagct

SEQ ID NO: 9098548 - DNA, 22 bp, Homo sapiens
tcccagagctctgacaccagct

SEQ ID NO: 9098549 - DNA, 22 bp, Homo sapiens
tcccagccaggctctaccactt

SEQ ID NO: 9098550 - DNA, 22 bp, Homo sapiens
tcccagccacagtttccacctg

SEQ ID NO: 9098551 - DNA, 22 bp, Homo sapiens
tcccagccaggctctaccactt

SEQ ID NO: 9098552 - DNA, 22 bp, Homo sapiens
tcccagccaggctctaccactt

SEQ ID NO: 9098553 - DNA, 22 bp, Homo sapiens
tcccagccacagtttccacctg

SEQ ID NO: 9098554 - DNA, 22 bp, Homo sapiens
tcccagccacagtttccacctg

SEQ ID NO: 9098555 - DNA, 22 bp, Homo sapiens
tcccagcccagatttgtgtgac

SEQ ID NO: 9098556 - DNA, 22 bp, Homo sapiens
tcccagcccagatttgtgtgac

SEQ ID NO: 9098557 - DNA, 22 bp, Homo sapiens
tcccagcccagacttctccagt

SEQ ID NO: 9098558 - DNA, 22 bp, Homo sapiens
tcccagcccagacttctccagt

SEQ ID NO: 9098559 - DNA, 22 bp, Homo sapiens
tcccagccattcctttaggtgt

SEQ ID NO: 9098560 - DNA, 22 bp, Homo sapiens
tcccagccattcctttaggtgt

SEQ ID NO: 9098561 - DNA, 22 bp, Homo sapiens
tcccaggacaggccacatggaa

SEQ ID NO: 9098562 - DNA, 22 bp, Homo sapiens
tcccaggaattgaagccagtgt

SEQ ID NO: 9098563 - DNA, 22 bp, Homo sapiens
tcccaggacaggccacatggaa

SEQ ID NO: 9098564 - DNA, 22 bp, Homo sapiens
tcctcagcttttatttcacttg

SEQ ID NO: 9098565 - DNA, 22 bp, Homo sapiens
tcctcaggctgcctggaagact

SEQ ID NO: 9098566 - DNA, 22 bp, Homo sapiens
tccctagtcgcatctgtggaga

SEQ ID NO: 9098567 - DNA, 22 bp, Homo sapiens
tccctagtcgcatctgtggaga

SEQ ID NO: 9098568 - DNA, 22 bp, Homo sapiens
tccctcactggttctgcatccc

SEQ ID NO: 9098569 - DNA, 22 bp, Homo sapiens
tccctagtcgcatctgtggaga

SEQ ID NO: 9098570 - DNA, 22 bp, Homo sapiens
tccctagtcgcatctgtggaga

SEQ ID NO: 9098571 - DNA, 22 bp, Homo sapiens
tccctaggtcctagtcacagta

SEQ ID NO: 9098572 - DNA, 22 bp, Homo sapiens
tcctcagcattagcacagacat

SEQ ID NO: 9098573 - DNA, 22 bp, Homo sapiens
tccctcagaaattctctctgaa

SEQ ID NO: 9098574 - DNA, 22 bp, Homo sapiens
catttggaccaaaatagccaac

SEQ ID NO: 9098575 - DNA, 22 bp, Homo sapiens
catttggattttgaagagagta

SEQ ID NO: 9098576 - DNA, 22 bp, Homo sapiens
catttggccattccagtcacat

SEQ ID NO: 9098577 - DNA, 20 bp, Homo sapiens
catttgggatcatgaggttt

SEQ ID NO: 9098578 - DNA, 22 bp, Homo sapiens
tcctcagggaagatgagcctca

SEQ ID NO: 9098579 - DNA, 22 bp, Homo sapiens
catttggaaagagactagagaa

SEQ ID NO: 9098580 - DNA, 22 bp, Homo sapiens
catttgtacagaacagctttat

SEQ ID NO: 9098581 - DNA, 22 bp, Homo sapiens
catttgtaatactgacttgcag

SEQ ID NO: 9098582 - DNA, 22 bp, Homo sapiens
catttgtacatgttgtcttctt

SEQ ID NO: 9098583 - DNA, 22 bp, Homo sapiens
catttgtagagtaggaaagagt

SEQ ID NO: 9098584 - DNA, 22 bp, Homo sapiens
catttgtagctatttactgtat

SEQ ID NO: 9098585 - DNA, 22 bp, Homo sapiens
catttgtaggatgcttcttgtt

SEQ ID NO: 9098586 - DNA, 22 bp, Homo sapiens
catttgtagtatctgtttatat

SEQ ID NO: 9098587 - DNA, 22 bp, Homo sapiens
catttgtagtatctgtttatat

SEQ ID NO: 9098588 - DNA, 22 bp, Homo sapiens
catttgtagtatctgtttatat

SEQ ID NO: 9098589 - DNA, 22 bp, Homo sapiens
catttgtagtatctgtttatat

SEQ ID NO: 9098590 - DNA, 22 bp, Homo sapiens
catttgtagttaaaaatgtctc

SEQ ID NO: 9098591 - DNA, 22 bp, Homo sapiens
catttgtagttaaaaatgtctc

SEQ ID NO: 9098592 - DNA, 22 bp, Homo sapiens
catttgtagttaaaaatgtctc

SEQ ID NO: 9098593 - DNA, 22 bp, Homo sapiens
catttgtatagtgcttagacca

SEQ ID NO: 9098594 - DNA, 22 bp, Homo sapiens
catttgtatgttcctccttagg

SEQ ID NO: 9098595 - DNA, 22 bp, Homo sapiens
catttgtatctgggctgctgtg

SEQ ID NO: 9098596 - DNA, 22 bp, Homo sapiens
catttgtatcatatgtatctta

SEQ ID NO: 9098597 - DNA, 22 bp, Homo sapiens
catttgtatcatatgtatctta

SEQ ID NO: 9098598 - DNA, 22 bp, Homo sapiens
tcctcccctcagggcaacggat

SEQ ID NO: 9098599 - DNA, 17 bp, Homo sapiens
tcctccccgcagttgca

SEQ ID NO: 9098600 - DNA, 21 bp, Homo sapiens
tcctctccatgatctgtttgt

SEQ ID NO: 9098601 - DNA, 22 bp, Homo sapiens
tcccgttgatgacggtgcatcc

SEQ ID NO: 9098602 - DNA, 22 bp, Homo sapiens
tccctagaatatctgctgcagc

SEQ ID NO: 9098603 - DNA, 23 bp, Homo sapiens
tccctacaaagtgcaggaatcag

SEQ ID NO: 9098604 - DNA, 22 bp, Homo sapiens
tccctaaactctgaactgattc

SEQ ID NO: 9098605 - DNA, 22 bp, Homo sapiens
tccccagctctgtgcttccact

SEQ ID NO: 9098606 - DNA, 22 bp, Homo sapiens
tccccagcttgctacttctgct

SEQ ID NO: 9098607 - DNA, 22 bp, Homo sapiens
tccccagcattgagggtctctc

SEQ ID NO: 9098608 - DNA, 22 bp, Homo sapiens
tccccagccgtgaaggagagga

SEQ ID NO: 9098609 - DNA, 22 bp, Homo sapiens
tccccagacagcgggaggcctg

SEQ ID NO: 9098610 - DNA, 22 bp, Homo sapiens
tccccagaggaatatgagattg

SEQ ID NO: 9098611 - DNA, 19 bp, Homo sapiens
tccccagcacctctgagtc

SEQ ID NO: 9098612 - DNA, 19 bp, Homo sapiens
tccccagcacctctgagtc

SEQ ID NO: 9098613 - DNA, 22 bp, Homo sapiens
tccccagaggtgaggcagcttt

SEQ ID NO: 9098614 - DNA, 22 bp, Homo sapiens
tccccagatgacatcaaaaggc

SEQ ID NO: 9098615 - DNA, 18 bp, Homo sapiens
cattcttggcagcttttg

SEQ ID NO: 9098616 - DNA, 22 bp, Homo sapiens
tcccaggaggtgcttcctagga

SEQ ID NO: 9098617 - DNA, 22 bp, Homo sapiens
cattgaaatatggaaactgatg

SEQ ID NO: 9098618 - DNA, 22 bp, Homo sapiens
cattgcaacttcaaactcctgg

SEQ ID NO: 9098619 - DNA, 22 bp, Homo sapiens
cattgcaacttcaaactcctgg

SEQ ID NO: 9098620 - DNA, 22 bp, Homo sapiens
tcccagggtcctcttctggaat

SEQ ID NO: 9098621 - DNA, 22 bp, Homo sapiens
tcccagggtcctcttctggaat

SEQ ID NO: 9098622 - DNA, 22 bp, Homo sapiens
cattgcaacttcaaactcctgg

SEQ ID NO: 9098623 - DNA, 21 bp, Homo sapiens
cattgagataggagagattgt

SEQ ID NO: 9098624 - DNA, 22 bp, Homo sapiens
ccacatggtcctcatttactct

SEQ ID NO: 9098625 - DNA, 22 bp, Homo sapiens
ccacatttcttcacttgtccca

SEQ ID NO: 9098626 - DNA, 22 bp, Homo sapiens
tcctgaccattccttgtctcca

SEQ ID NO: 9098627 - DNA, 22 bp, Homo sapiens
tcctgacctcttgctctgacct

SEQ ID NO: 9098628 - DNA, 22 bp, Homo sapiens
tcctgactaggagggctaaggt

SEQ ID NO: 9098629 - DNA, 22 bp, Homo sapiens
tcctgactccaggtcctgtgtg

SEQ ID NO: 9098630 - DNA, 22 bp, Homo sapiens
ccacatgatgaggaagctgaac

SEQ ID NO: 9098631 - DNA, 22 bp, Homo sapiens
ccacatctggtggccagtgcta

SEQ ID NO: 9098632 - DNA, 21 bp, Homo sapiens
tcctctgcagtgaggtggcct

SEQ ID NO: 9098633 - DNA, 22 bp, Homo sapiens
tcctctgacaccttgtgcagtg

SEQ ID NO: 9098634 - DNA, 22 bp, Homo sapiens
tcctctgagacatcaggttgag

SEQ ID NO: 9098635 - DNA, 22 bp, Homo sapiens
tcctctgagcctcagtttctca

SEQ ID NO: 9098636 - DNA, 22 bp, Homo sapiens
tcctgaaggcctgagttccacc

SEQ ID NO: 9098637 - DNA, 22 bp, Homo sapiens
tcctgaagtatgggtatggagt

SEQ ID NO: 9098638 - DNA, 22 bp, Homo sapiens
tcctgaagtattgtttgagtaa

SEQ ID NO: 9098639 - DNA, 22 bp, Homo sapiens
tcctgaagtatgggtatggagt

SEQ ID NO: 9098640 - DNA, 22 bp, Homo sapiens
tcctgaagtatgggtatggagt

SEQ ID NO: 9098641 - DNA, 22 bp, Homo sapiens
tcctgaagtcacaggctctgag

SEQ ID NO: 9098642 - DNA, 21 bp, Homo sapiens
tcctctgcagtgaggtggcct

SEQ ID NO: 9098643 - DNA, 22 bp, Homo sapiens
tcctgaattcctctttgcatcc

SEQ ID NO: 9098644 - DNA, 22 bp, Homo sapiens
tcctgaagtcacaggctctgag

SEQ ID NO: 9098645 - DNA, 22 bp, Homo sapiens
tcctctccatgtctcacgccac

SEQ ID NO: 9098646 - DNA, 22 bp, Homo sapiens
tcctctctgcactggccctgcc

SEQ ID NO: 9098647 - DNA, 18 bp, Homo sapiens
tcctctctttccccaggg

SEQ ID NO: 9098648 - DNA, 22 bp, Homo sapiens
tcctctgactcacagcctgggg

SEQ ID NO: 9098649 - DNA, 22 bp, Homo sapiens
tcctctgaatgtacttcataat

SEQ ID NO: 9098650 - DNA, 22 bp, Homo sapiens
tcctctgaatgctgttgaagaa

SEQ ID NO: 9098651 - DNA, 22 bp, Homo sapiens
tcgcttgaacccaggaagtgga

SEQ ID NO: 9098652 - DNA, 22 bp, Homo sapiens
tcgctgtgaaaaccttggacaa

SEQ ID NO: 9098653 - DNA, 22 bp, Homo sapiens
tcggagctgtagatgaaaccct

SEQ ID NO: 9098654 - DNA, 22 bp, Homo sapiens
tcggagctgtagatgaaaccct

SEQ ID NO: 9098655 - DNA, 22 bp, Homo sapiens
tcggaggatatcacagagcttt

SEQ ID NO: 9098656 - DNA, 22 bp, Homo sapiens
tcgggctcgctctcctagcgga

SEQ ID NO: 9098657 - DNA, 22 bp, Homo sapiens
tcggagctgtagatgaaaccct

SEQ ID NO: 9098658 - DNA, 22 bp, Homo sapiens
ccacccttccattcttcctctt

SEQ ID NO: 9098659 - DNA, 22 bp, Homo sapiens
ccacccttgggttcggaggccg

SEQ ID NO: 9098660 - DNA, 22 bp, Homo sapiens
ccaccgccatggcgttgtacag

SEQ ID NO: 9098661 - DNA, 22 bp, Homo sapiens
ccaccctggacaggcctctgag

SEQ ID NO: 9098662 - DNA, 22 bp, Homo sapiens
ccaccagcttcagcagccgcgg

SEQ ID NO: 9098663 - DNA, 22 bp, Homo sapiens
ccaccagcttcagcagccgcgg

SEQ ID NO: 9098664 - DNA, 22 bp, Homo sapiens
ccaccagcttcagcagccgcgg

SEQ ID NO: 9098665 - DNA, 22 bp, Homo sapiens
ccaccagcagtgtgcaaggatt

SEQ ID NO: 9098666 - DNA, 22 bp, Homo sapiens
ccaccacatttgcctagacttt

SEQ ID NO: 9098667 - DNA, 22 bp, Homo sapiens
ccaccacttctggcttctggtg

SEQ ID NO: 9098668 - DNA, 22 bp, Homo sapiens
tcgctcaggcttgagtgtagtg

SEQ ID NO: 9098669 - DNA, 22 bp, Homo sapiens
ccaccagctttgccaccctgct

SEQ ID NO: 9098670 - DNA, 22 bp, Homo sapiens
ccaccagctttgccaccctgct

SEQ ID NO: 9098671 - DNA, 22 bp, Homo sapiens
ccaccagctttgccaccctgct

SEQ ID NO: 9098672 - DNA, 22 bp, Homo sapiens
tctcccacggtacaggataaac

SEQ ID NO: 9098673 - DNA, 22 bp, Homo sapiens
tctcccacagtctcccatggct

SEQ ID NO: 9098674 - DNA, 22 bp, Homo sapiens
ccagagaggccaaggtcgtggt

SEQ ID NO: 9098675 - DNA, 22 bp, Homo sapiens
ccagagaggccaaggtcgtggt

SEQ ID NO: 9098676 - DNA, 22 bp, Homo sapiens
ccagagaggcaaaactccttcc

SEQ ID NO: 9098677 - DNA, 22 bp, Homo sapiens
tctccgggtggcggcgaaggga

SEQ ID NO: 9098678 - DNA, 22 bp, Homo sapiens
tctccctggagccctgaagcat

SEQ ID NO: 9098679 - DNA, 22 bp, Homo sapiens
tctccctgtggaggacccctta

SEQ ID NO: 9098680 - DNA, 20 bp, Homo sapiens
tctccagatgcagatgacat

SEQ ID NO: 9098681 - DNA, 22 bp, Homo sapiens
tctccagaggtcccttgtctct

SEQ ID NO: 9098682 - DNA, 22 bp, Homo sapiens
tctccagagtaaccttggagca

SEQ ID NO: 9098683 - DNA, 18 bp, Homo sapiens
tctccacttctgtgagaa

SEQ ID NO: 9098684 - DNA, 18 bp, Homo sapiens
tctccacttctgtgagaa

SEQ ID NO: 9098685 - DNA, 19 bp, Homo sapiens
tctccagctttgggctttt

SEQ ID NO: 9098686 - DNA, 19 bp, Homo sapiens
tctccagctttgggctttt

SEQ ID NO: 9098687 - DNA, 22 bp, Homo sapiens
ccagagagagaggtcaatggca

SEQ ID NO: 9098688 - DNA, 21 bp, Homo sapiens
ccagagagagggaagtgggtt

SEQ ID NO: 9098689 - DNA, 19 bp, Homo sapiens
ccagagagctaggtacaga

SEQ ID NO: 9098690 - DNA, 22 bp, Homo sapiens
ccagagaggcaaaactccttcc

SEQ ID NO: 9098691 - DNA, 19 bp, Homo sapiens
ccagagagctaggtacaga

SEQ ID NO: 9098692 - DNA, 22 bp, Homo sapiens
ccagagagctacaaggcataaa

SEQ ID NO: 9098693 - DNA, 22 bp, Homo sapiens
ccagagagagtactgggctctg

SEQ ID NO: 9098694 - DNA, 22 bp, Homo sapiens
ccagagagagtactgggctctg

SEQ ID NO: 9098695 - DNA, 21 bp, Homo sapiens
ccagagagagggaagtgggtt

SEQ ID NO: 9098696 - DNA, 22 bp, Homo sapiens
tctccactattttctagctctt

SEQ ID NO: 9098697 - DNA, 22 bp, Homo sapiens
tctccacaccagaaggagctga

SEQ ID NO: 9098698 - DNA, 22 bp, Homo sapiens
ccagaaaactctacatgcttgt

SEQ ID NO: 9098699 - DNA, 22 bp, Homo sapiens
ccagaaaactctacatgcttgt

SEQ ID NO: 9098700 - DNA, 22 bp, Homo sapiens
ccagaaaaatcctcccttgtcc

SEQ ID NO: 9098701 - DNA, 22 bp, Homo sapiens
ccactttgcaagatattcagag

SEQ ID NO: 9098702 - DNA, 22 bp, Homo sapiens
ccactttgagaagctgatgaaa

SEQ ID NO: 9098703 - DNA, 18 bp, Homo sapiens
ccactttgcagcctggcc

SEQ ID NO: 9098704 - DNA, 22 bp, Homo sapiens
ccactttgaaccactgaggtgg

SEQ ID NO: 9098705 - DNA, 22 bp, Homo sapiens
ccactttgtaatgtgttatgtt

SEQ ID NO: 9098706 - DNA, 19 bp, Homo sapiens
ccactttgcttctctgggt

SEQ ID NO: 9098707 - DNA, 19 bp, Homo sapiens
ccactttgcttctctgggt

SEQ ID NO: 9098708 - DNA, 22 bp, Homo sapiens
ccacttttgggaacagtgagta

SEQ ID NO: 9098709 - DNA, 22 bp, Homo sapiens
tctcaacagtgcaagctgctcc

SEQ ID NO: 9098710 - DNA, 22 bp, Homo sapiens
tctcaaatttgttagataaaat

SEQ ID NO: 9098711 - DNA, 22 bp, Homo sapiens
tctcaaatttgttagataaaat

SEQ ID NO: 9098712 - DNA, 22 bp, Homo sapiens
tctcaaatttgctggaccagta

SEQ ID NO: 9098713 - DNA, 22 bp, Homo sapiens
tctcaaattcccttttcctcct

SEQ ID NO: 9098714 - DNA, 22 bp, Homo sapiens
tctcaaatttatacagagttca

SEQ ID NO: 9098715 - DNA, 22 bp, Homo sapiens
tctcaaatttatacagagttca

SEQ ID NO: 9098716 - DNA, 22 bp, Homo sapiens
tctcaagcttgttggtatgttt

SEQ ID NO: 9098717 - DNA, 22 bp, Homo sapiens
tctcaagcttgttggtatgttt

SEQ ID NO: 9098718 - DNA, 22 bp, Homo sapiens
tctcaagcttgttggtatgttt

SEQ ID NO: 9098719 - DNA, 22 bp, Homo sapiens
tctcaagagggaggcaatcatg

SEQ ID NO: 9098720 - DNA, 22 bp, Homo sapiens
tctatattccagatacagatta

SEQ ID NO: 9098721 - DNA, 22 bp, Homo sapiens
tctcaaatgtaaagcatgattt

SEQ ID NO: 9098722 - DNA, 22 bp, Homo sapiens
tctcaaattcccttttcctcct

SEQ ID NO: 9098723 - DNA, 22 bp, Homo sapiens
tctatattccagatacagatta

SEQ ID NO: 9098724 - DNA, 22 bp, Homo sapiens
tctatattccagatacagatta

SEQ ID NO: 9098725 - DNA, 22 bp, Homo sapiens
tctatattccagatacagatta

SEQ ID NO: 9098726 - DNA, 18 bp, Homo sapiens
tctatatggacatagaga

SEQ ID NO: 9098727 - DNA, 16 bp, Homo sapiens
ccacctgcagctctca

SEQ ID NO: 9098728 - DNA, 22 bp, Homo sapiens
ccacctgagataagagagctca

SEQ ID NO: 9098729 - DNA, 22 bp, Homo sapiens
ccacctcctcggccatgtgacg

SEQ ID NO: 9098730 - DNA, 22 bp, Homo sapiens
ccagcccttagataaacctggc

SEQ ID NO: 9098731 - DNA, 22 bp, Homo sapiens
ccagcccttcccaactggccag

SEQ ID NO: 9098732 - DNA, 22 bp, Homo sapiens
ccagcccttcccaactggccag

SEQ ID NO: 9098733 - DNA, 22 bp, Homo sapiens
ccagccctgtttatgtgtcact

SEQ ID NO: 9098734 - DNA, 22 bp, Homo sapiens
ccagcccttagataaacctggc

SEQ ID NO: 9098735 - DNA, 19 bp, Homo sapiens
ccagccctgtcacttcttg

SEQ ID NO: 9098736 - DNA, 19 bp, Homo sapiens
ccagccctgtcacttcttg

SEQ ID NO: 9098737 - DNA, 19 bp, Homo sapiens
ccagccctgtcacttcttg

SEQ ID NO: 9098738 - DNA, 19 bp, Homo sapiens
ccagccctgtcacttcttg

SEQ ID NO: 9098739 - DNA, 22 bp, Homo sapiens
ccagccctgtttatgtgtcact

SEQ ID NO: 9098740 - DNA, 22 bp, Homo sapiens
ccagccctgtttatgtgtcact

SEQ ID NO: 9098741 - DNA, 22 bp, Homo sapiens
ccagccctgtttatgtgtcact

SEQ ID NO: 9098742 - DNA, 22 bp, Homo sapiens
ccagccctgcctctcagggccc

SEQ ID NO: 9098743 - DNA, 22 bp, Homo sapiens
ccagccctgtaaggatgaggca

SEQ ID NO: 9098744 - DNA, 22 bp, Homo sapiens
ccagccctgtaaggatgaggca

SEQ ID NO: 9098745 - DNA, 22 bp, Homo sapiens
ccagccctgtcaccaactggag

SEQ ID NO: 9098746 - DNA, 22 bp, Homo sapiens
ccagccctgtcaccaactggag

SEQ ID NO: 9098747 - DNA, 22 bp, Homo sapiens
ccagccctgtcaccaactggag

SEQ ID NO: 9098748 - DNA, 19 bp, Homo sapiens
ccagccctgtcacttcttg

SEQ ID NO: 9098749 - DNA, 19 bp, Homo sapiens
ccagccctgtcacttcttg

SEQ ID NO: 9098750 - DNA, 22 bp, Homo sapiens
ccagccctgcctctcagggccc

SEQ ID NO: 9098751 - DNA, 22 bp, Homo sapiens
ccagccctgcctctcagggccc

SEQ ID NO: 9098752 - DNA, 22 bp, Homo sapiens
ccagccctgcctctcagggccc

SEQ ID NO: 9098753 - DNA, 22 bp, Homo sapiens
ccagccctgcctctcagggccc

SEQ ID NO: 9098754 - DNA, 22 bp, Homo sapiens
ccagccctgccagagagagctg

SEQ ID NO: 9098755 - DNA, 22 bp, Homo sapiens
ccagccctcactgaggcctctc

SEQ ID NO: 9098756 - DNA, 22 bp, Homo sapiens
ccagccctcactgaggcctctc

SEQ ID NO: 9098757 - DNA, 22 bp, Homo sapiens
ccagccctcactgaggcctctc

SEQ ID NO: 9098758 - DNA, 22 bp, Homo sapiens
ccagccacagcttccagctcct

SEQ ID NO: 9098759 - DNA, 22 bp, Homo sapiens
ccagccctcactgaggcctctc

SEQ ID NO: 9098760 - DNA, 20 bp, Homo sapiens
ccagcatgtacacatgtgga

SEQ ID NO: 9098761 - DNA, 20 bp, Homo sapiens
ccagcatgtacacatgtgga

SEQ ID NO: 9098762 - DNA, 22 bp, Homo sapiens
ccagcatggcacctgagatgag

SEQ ID NO: 9098763 - DNA, 22 bp, Homo sapiens
ccagccacagcttccagctcct

SEQ ID NO: 9098764 - DNA, 22 bp, Homo sapiens
tctgcagaagccatggccttgc

SEQ ID NO: 9098765 - DNA, 22 bp, Homo sapiens
tctgcagaaggaatcagctgag

SEQ ID NO: 9098766 - DNA, 22 bp, Homo sapiens
tctgcagaaggaatcagctgag

SEQ ID NO: 9098767 - DNA, 22 bp, Homo sapiens
tctgcagaagtggctgggccac

SEQ ID NO: 9098768 - DNA, 22 bp, Homo sapiens
tctgagagtctctgaggcagat

SEQ ID NO: 9098769 - DNA, 22 bp, Homo sapiens
tctgagagtctctgaggcagat

SEQ ID NO: 9098770 - DNA, 22 bp, Homo sapiens
tctgagagcctctagcctaagt

SEQ ID NO: 9098771 - DNA, 22 bp, Homo sapiens
tctgagagatacaaggaggcaa

SEQ ID NO: 9098772 - DNA, 22 bp, Homo sapiens
ccagcccttcccaactggccag

SEQ ID NO: 9098773 - DNA, 22 bp, Homo sapiens
ccagcccttcccaactggccag

SEQ ID NO: 9098774 - DNA, 22 bp, Homo sapiens
tctgagagcaggaggagctgct

SEQ ID NO: 9098775 - DNA, 22 bp, Homo sapiens
ccagcagggttggtttcttctg

SEQ ID NO: 9098776 - DNA, 22 bp, Homo sapiens
tctctgtgtgccttcatctgcc

SEQ ID NO: 9098777 - DNA, 19 bp, Homo sapiens
ccagcaggttcatttcagg

SEQ ID NO: 9098778 - DNA, 22 bp, Homo sapiens
ccagcatcagcacccaaggagc

SEQ ID NO: 9098779 - DNA, 22 bp, Homo sapiens
tctcttaaaagattttaatgac

SEQ ID NO: 9098780 - DNA, 18 bp, Homo sapiens
tctgaatattatgcagtg

SEQ ID NO: 9098781 - DNA, 22 bp, Homo sapiens
tctgaatgcacttagttaccaa

SEQ ID NO: 9098782 - DNA, 19 bp, Homo sapiens
tctgaatgggatgagttgg

SEQ ID NO: 9098783 - DNA, 22 bp, Homo sapiens
tctgaaggtttgattggagcta

SEQ ID NO: 9098784 - DNA, 19 bp, Homo sapiens
tctgaagtccagggcatac

SEQ ID NO: 9098785 - DNA, 22 bp, Homo sapiens
tctgaataatgtccttgtatca

SEQ ID NO: 9098786 - DNA, 22 bp, Homo sapiens
tctgaagtgatcatcatttctc

SEQ ID NO: 9098787 - DNA, 22 bp, Homo sapiens
ccagcatccatgctccctcggg

SEQ ID NO: 9098788 - DNA, 22 bp, Homo sapiens
ccagcatccatgctccctcggg

SEQ ID NO: 9098789 - DNA, 22 bp, Homo sapiens
ccagcatccatgctccctcggg

SEQ ID NO: 9098790 - DNA, 18 bp, Homo sapiens
ccagcatgccagaggctg

SEQ ID NO: 9098791 - DNA, 22 bp, Homo sapiens
ccagcatctatgtgctgttgat

SEQ ID NO: 9098792 - DNA, 22 bp, Homo sapiens
ccagcatcgacttcctgcctga

SEQ ID NO: 9098793 - DNA, 22 bp, Homo sapiens
ccagcatctaacgctcctggga

SEQ ID NO: 9098794 - DNA, 22 bp, Homo sapiens
ccagcagggcagtgccctggac

SEQ ID NO: 9098795 - DNA, 22 bp, Homo sapiens
ccagcagctgtggctttgcctc

SEQ ID NO: 9098796 - DNA, 22 bp, Homo sapiens
ccagcagctttattggctctcc

SEQ ID NO: 9098797 - DNA, 22 bp, Homo sapiens
ccagcagctttattggctctcc

SEQ ID NO: 9098798 - DNA, 21 bp, Homo sapiens
ccagcagctcaaggatctctt

SEQ ID NO: 9098799 - DNA, 22 bp, Homo sapiens
ccagcagcgatagggtgagtgc

SEQ ID NO: 9098800 - DNA, 22 bp, Homo sapiens
ccagcagctcagctactggtca

SEQ ID NO: 9098801 - DNA, 22 bp, Homo sapiens
ccagcagctccctcagggtccg

SEQ ID NO: 9098802 - DNA, 22 bp, Homo sapiens
ccagcagctgacaccagtccca

SEQ ID NO: 9098803 - DNA, 22 bp, Homo sapiens
ccagcagctgctatgtggtttt

SEQ ID NO: 9098804 - DNA, 22 bp, Homo sapiens
ccagcagctgcaaagcctgggt

SEQ ID NO: 9098805 - DNA, 22 bp, Homo sapiens
ccagcagagtctaggaaggagg

SEQ ID NO: 9098806 - DNA, 22 bp, Homo sapiens
ccagcagagtctaggaaggagg

SEQ ID NO: 9098807 - DNA, 22 bp, Homo sapiens
ccagcagagggtcttggccatt

SEQ ID NO: 9098808 - DNA, 22 bp, Homo sapiens
ccagcagagggtcttggccatt

SEQ ID NO: 9098809 - DNA, 22 bp, Homo sapiens
ccagcagaggggcggagtgcag

SEQ ID NO: 9098810 - DNA, 22 bp, Homo sapiens
ccagcactgctctcagactgag

SEQ ID NO: 9098811 - DNA, 22 bp, Homo sapiens
ccagcagcaggccaggccctcc

SEQ ID NO: 9098812 - DNA, 22 bp, Homo sapiens
ccagcagcagcgtccaaggaga

SEQ ID NO: 9098813 - DNA, 22 bp, Homo sapiens
ccagcagcagcgtccaaggaga

SEQ ID NO: 9098814 - DNA, 22 bp, Homo sapiens
ccagcagcagcgtccaaggaga

SEQ ID NO: 9098815 - DNA, 22 bp, Homo sapiens
ccagcagcccctcaatgatctg

SEQ ID NO: 9098816 - DNA, 22 bp, Homo sapiens
ccagcagcccacaggcgtccct

SEQ ID NO: 9098817 - DNA, 22 bp, Homo sapiens
ccagcagcccacaggcgtccct

SEQ ID NO: 9098818 - DNA, 22 bp, Homo sapiens
ccagcagccctcttccaagact

SEQ ID NO: 9098819 - DNA, 22 bp, Homo sapiens
ccagcagccctcttccaagact

SEQ ID NO: 9098820 - DNA, 22 bp, Homo sapiens
ccagcagcatcctgcagcactt

SEQ ID NO: 9098821 - DNA, 22 bp, Homo sapiens
ccagcagcaggccaggccctcc

SEQ ID NO: 9098822 - DNA, 22 bp, Homo sapiens
ccagcagccagagaaggacctc

SEQ ID NO: 9098823 - DNA, 22 bp, Homo sapiens
ccagcagccaccttctcgaaat

SEQ ID NO: 9098824 - DNA, 22 bp, Homo sapiens
tctcctggcctttaggttaagg

SEQ ID NO: 9098825 - DNA, 23 bp, Homo sapiens
tctcctggctgcactgtggccac

SEQ ID NO: 9098826 - DNA, 22 bp, Homo sapiens
tctctgagttttaaggatgatg

SEQ ID NO: 9098827 - DNA, 22 bp, Homo sapiens
tctctgcatgacccaaggctga

SEQ ID NO: 9098828 - DNA, 23 bp, Homo sapiens
tctctgcatgtcctgagcacatc

SEQ ID NO: 9098829 - DNA, 22 bp, Homo sapiens
tctctgcagctaagaaattaat

SEQ ID NO: 9098830 - DNA, 19 bp, Homo sapiens
tctctgcagcgcgcccggc

SEQ ID NO: 9098831 - DNA, 22 bp, Homo sapiens
tctctgagttttaaggatgatg

SEQ ID NO: 9098832 - DNA, 22 bp, Homo sapiens
tctctgcaactacatcttaggg

SEQ ID NO: 9098833 - DNA, 22 bp, Homo sapiens
tctctgggaaatggagaatttt

SEQ ID NO: 9098834 - DNA, 22 bp, Homo sapiens
tctctgggaatgggcctgggta

SEQ ID NO: 9098835 - DNA, 22 bp, Homo sapiens
tctctgggaattcacaagccct

SEQ ID NO: 9098836 - DNA, 22 bp, Homo sapiens
tctctgggaattcacaagccct

SEQ ID NO: 9098837 - DNA, 22 bp, Homo sapiens
tctctgcccaagtttctcaagt

SEQ ID NO: 9098838 - DNA, 22 bp, Homo sapiens
tctctgccacagcttctgcctt

SEQ ID NO: 9098839 - DNA, 22 bp, Homo sapiens
tctctgccaccatgagatgggc

SEQ ID NO: 9098840 - DNA, 22 bp, Homo sapiens
tctctgggagccaggatgacac

SEQ ID NO: 9098841 - DNA, 22 bp, Homo sapiens
tctctgggagccaggatgacac

SEQ ID NO: 9098842 - DNA, 22 bp, Homo sapiens
tctctgggagcaattgtttgct

SEQ ID NO: 9098843 - DNA, 22 bp, Homo sapiens
tctctgggacactgggtcagtt

SEQ ID NO: 9098844 - DNA, 22 bp, Homo sapiens
tctctgggacactgggtcagtt

SEQ ID NO: 9098845 - DNA, 22 bp, Homo sapiens
tctctgggaattttttggacat

SEQ ID NO: 9098846 - DNA, 22 bp, Homo sapiens
tctctgggagttgagcagcagc

SEQ ID NO: 9098847 - DNA, 21 bp, Homo sapiens
tctctgggaggacttgtgaga

SEQ ID NO: 9098848 - DNA, 22 bp, Homo sapiens
cagggcaggaatttgacattgc

SEQ ID NO: 9098849 - DNA, 22 bp, Homo sapiens
taggaaattgccaatatatgac

SEQ ID NO: 9098850 - DNA, 22 bp, Homo sapiens
taggaaattgacacctgcttga

SEQ ID NO: 9098851 - DNA, 22 bp, Homo sapiens
taggaaattgacacctgcttga

SEQ ID NO: 9098852 - DNA, 22 bp, Homo sapiens
taggaaattctcttgctaagtt

SEQ ID NO: 9098853 - DNA, 22 bp, Homo sapiens
taggaaattagaacttggaaac

SEQ ID NO: 9098854 - DNA, 22 bp, Homo sapiens
taggaaattagaacttggaaac

SEQ ID NO: 9098855 - DNA, 22 bp, Homo sapiens
taggaaattaagtctcttttgt

SEQ ID NO: 9098856 - DNA, 22 bp, Homo sapiens
taggaaattctcttgctaagtt

SEQ ID NO: 9098857 - DNA, 22 bp, Homo sapiens
taggaacatatgcagtgctttt

SEQ ID NO: 9098858 - DNA, 22 bp, Homo sapiens
taggaacacacatgtgtagctg

SEQ ID NO: 9098859 - DNA, 22 bp, Homo sapiens
taggaacaagtttccttgctgt

SEQ ID NO: 9098860 - DNA, 22 bp, Homo sapiens
taggaacaactgcaggtacaag

SEQ ID NO: 9098861 - DNA, 22 bp, Homo sapiens
taggaaattggaaactcttcac

SEQ ID NO: 9098862 - DNA, 22 bp, Homo sapiens
taggaaatttcatttgaggtct

SEQ ID NO: 9098863 - DNA, 22 bp, Homo sapiens
taggaaatttatagaggtgttt

SEQ ID NO: 9098864 - DNA, 22 bp, Homo sapiens
taggaaattggaaactcttcac

SEQ ID NO: 9098865 - DNA, 22 bp, Homo sapiens
taggaaatttgaaatatgtggg

SEQ ID NO: 9098866 - DNA, 22 bp, Homo sapiens
taggaaattttactggtctggg

SEQ ID NO: 9098867 - DNA, 22 bp, Homo sapiens
taggaaattttactggtctggg

SEQ ID NO: 9098868 - DNA, 22 bp, Homo sapiens
tagctcctggctgcagggcctc

SEQ ID NO: 9098869 - DNA, 22 bp, Homo sapiens
tagctcagcaggtgggacaggt

SEQ ID NO: 9098870 - DNA, 22 bp, Homo sapiens
tagctaccattattgagcacct

SEQ ID NO: 9098871 - DNA, 22 bp, Homo sapiens
cagggcagccaggccccgtggg

SEQ ID NO: 9098872 - DNA, 18 bp, Homo sapiens
taggagagaatttattta

SEQ ID NO: 9098873 - DNA, 22 bp, Homo sapiens
taggagaagagtcagggcctaa

SEQ ID NO: 9098874 - DNA, 22 bp, Homo sapiens
taggagagctgaactattgtct

SEQ ID NO: 9098875 - DNA, 22 bp, Homo sapiens
taggagagctgaactattgtct

SEQ ID NO: 9098876 - DNA, 22 bp, Homo sapiens
taggagaggtgaatggcacact

SEQ ID NO: 9098877 - DNA, 22 bp, Homo sapiens
taggagaggtgaatggcacact

SEQ ID NO: 9098878 - DNA, 22 bp, Homo sapiens
taggactttgagaattgttatt

SEQ ID NO: 9098879 - DNA, 19 bp, Homo sapiens
taggaccctggtggccccc

SEQ ID NO: 9098880 - DNA, 19 bp, Homo sapiens
taggaccctggtggccccc

SEQ ID NO: 9098881 - DNA, 22 bp, Homo sapiens
cagggcctgcttccttcttgtt

SEQ ID NO: 9098882 - DNA, 22 bp, Homo sapiens
cagggcctcattgtcagtcctg

SEQ ID NO: 9098883 - DNA, 22 bp, Homo sapiens
taggagcctgctctgcagggac

SEQ ID NO: 9098884 - DNA, 22 bp, Homo sapiens
taggagcttttggagtcctgtg

SEQ ID NO: 9098885 - DNA, 22 bp, Homo sapiens
cagggctagggagccctcctgg

SEQ ID NO: 9098886 - DNA, 22 bp, Homo sapiens
cagggctcagaagacagacctc

SEQ ID NO: 9098887 - DNA, 22 bp, Homo sapiens
cagggctcactcggctggcgtc

SEQ ID NO: 9098888 - DNA, 22 bp, Homo sapiens
cagggctcagggactgcagaaa

SEQ ID NO: 9098889 - DNA, 22 bp, Homo sapiens
cagggctcagggactgcagaaa

SEQ ID NO: 9098890 - DNA, 22 bp, Homo sapiens
cagggctcaggctctgggattc

SEQ ID NO: 9098891 - DNA, 22 bp, Homo sapiens
cagggctcaggaaatcagacgt

SEQ ID NO: 9098892 - DNA, 22 bp, Homo sapiens
cagggcctgtacaagtcccacc

SEQ ID NO: 9098893 - DNA, 22 bp, Homo sapiens
cagggcctgtacaagtcccacc

SEQ ID NO: 9098894 - DNA, 22 bp, Homo sapiens
cagggccttgttcaggagtgaa

SEQ ID NO: 9098895 - DNA, 22 bp, Homo sapiens
cagggccttgttcaggagtgaa

SEQ ID NO: 9098896 - DNA, 22 bp, Homo sapiens
cagggccttttagcatcttctc

SEQ ID NO: 9098897 - DNA, 22 bp, Homo sapiens
cagggcggggtctgccggccct

SEQ ID NO: 9098898 - DNA, 22 bp, Homo sapiens
tatcatttaacagaatcattgc

SEQ ID NO: 9098899 - DNA, 22 bp, Homo sapiens
tatcatttaacagaatcattgc

SEQ ID NO: 9098900 - DNA, 22 bp, Homo sapiens
tatcatttaacagaatcattgc

SEQ ID NO: 9098901 - DNA, 22 bp, Homo sapiens
tatcatttaacagaatcattgc

SEQ ID NO: 9098902 - DNA, 22 bp, Homo sapiens
tatcatgtgcgcttattgattt

SEQ ID NO: 9098903 - DNA, 22 bp, Homo sapiens
tatcattcttctcacctttgaa

SEQ ID NO: 9098904 - DNA, 22 bp, Homo sapiens
tatcatcactgtaatccgttga

SEQ ID NO: 9098905 - DNA, 22 bp, Homo sapiens
tatcatcttgttgtcatgcagc

SEQ ID NO: 9098906 - DNA, 22 bp, Homo sapiens
tatcatctgcaaagcacatcta

SEQ ID NO: 9098907 - DNA, 22 bp, Homo sapiens
tagtcttttgagaagtatatct

SEQ ID NO: 9098908 - DNA, 22 bp, Homo sapiens
tagtctttttaataaataatgc

SEQ ID NO: 9098909 - DNA, 22 bp, Homo sapiens
tagtctttttaataaataatgc

SEQ ID NO: 9098910 - DNA, 22 bp, Homo sapiens
caggggagttttatgcaacaga

SEQ ID NO: 9098911 - DNA, 22 bp, Homo sapiens
tagtgaattcctaataggaaga

SEQ ID NO: 9098912 - DNA, 22 bp, Homo sapiens
tagtgaatagtccaatcccgca

SEQ ID NO: 9098913 - DNA, 22 bp, Homo sapiens
tagtgaaacctgacagatcatg

SEQ ID NO: 9098914 - DNA, 22 bp, Homo sapiens
tatattgttggtgggaatataa

SEQ ID NO: 9098915 - DNA, 22 bp, Homo sapiens
cagggctcatctgtgtgaccag

SEQ ID NO: 9098916 - DNA, 22 bp, Homo sapiens
tagggacaaagagctgaggcct

SEQ ID NO: 9098917 - DNA, 22 bp, Homo sapiens
tagggtccaagccttataatta

SEQ ID NO: 9098918 - DNA, 22 bp, Homo sapiens
tagggtagtaccatgctgccag

SEQ ID NO: 9098919 - DNA, 22 bp, Homo sapiens
tagggtcctcatctgtaaatga

SEQ ID NO: 9098920 - DNA, 22 bp, Homo sapiens
tagggtcctgcctacagagaca

SEQ ID NO: 9098921 - DNA, 22 bp, Homo sapiens
tagggtcccagataggagccag

SEQ ID NO: 9098922 - DNA, 22 bp, Homo sapiens
tagggtccatatggatgaatgg

SEQ ID NO: 9098923 - DNA, 22 bp, Homo sapiens
tagggccagataggcttcttga

SEQ ID NO: 9098924 - DNA, 22 bp, Homo sapiens
caggggaaggagccttgaaact

SEQ ID NO: 9098925 - DNA, 22 bp, Homo sapiens
caggggaagatgccaagggaga

SEQ ID NO: 9098926 - DNA, 22 bp, Homo sapiens
cagggcttggttggaaccaccc

SEQ ID NO: 9098927 - DNA, 22 bp, Homo sapiens
cagggcttggatctgtggtcag

SEQ ID NO: 9098928 - DNA, 22 bp, Homo sapiens
cagggctttgtgtgcctgggga

SEQ ID NO: 9098929 - DNA, 22 bp, Homo sapiens
cagggctttttattagctgcct

SEQ ID NO: 9098930 - DNA, 22 bp, Homo sapiens
cagggctttcctgagaagtgat

SEQ ID NO: 9098931 - DNA, 22 bp, Homo sapiens
cagggctttcctgagaagtgat

SEQ ID NO: 9098932 - DNA, 22 bp, Homo sapiens
taggtagctttggcgtttcttg

SEQ ID NO: 9098933 - DNA, 22 bp, Homo sapiens
taggtagggaccaccttgggga

SEQ ID NO: 9098934 - DNA, 22 bp, Homo sapiens
tagggtgcttaatactagattt

SEQ ID NO: 9098935 - DNA, 22 bp, Homo sapiens
tagggtcctgcctacagagaca

SEQ ID NO: 9098936 - DNA, 22 bp, Homo sapiens
tactcaaactcactaagacaga

SEQ ID NO: 9098937 - DNA, 22 bp, Homo sapiens
tactcaaaaagttatgaatcat

SEQ ID NO: 9098938 - DNA, 22 bp, Homo sapiens
tactcaaaaagttatgaatcat

SEQ ID NO: 9098939 - DNA, 22 bp, Homo sapiens
tactatttggaattttaaattg

SEQ ID NO: 9098940 - DNA, 22 bp, Homo sapiens
tactatttttgcaacgtataca

SEQ ID NO: 9098941 - DNA, 22 bp, Homo sapiens
tactatttttgcaacgtataca

SEQ ID NO: 9098942 - DNA, 22 bp, Homo sapiens
tactgtatgaattatgttattt

SEQ ID NO: 9098943 - DNA, 22 bp, Homo sapiens
gtgagggcaaattagaatcaaa

SEQ ID NO: 9098944 - DNA, 20 bp, Homo sapiens
cagccctgtgacctggccct

SEQ ID NO: 9098945 - DNA, 20 bp, Homo sapiens
cagccctgtgacctggccct

SEQ ID NO: 9098946 - DNA, 22 bp, Homo sapiens
cagccctgtctatgactgatga

SEQ ID NO: 9098947 - DNA, 20 bp, Homo sapiens
cagccctgtgacctggccct

SEQ ID NO: 9098948 - DNA, 22 bp, Homo sapiens
gtgaggggagtaaagccatgtt

SEQ ID NO: 9098949 - DNA, 22 bp, Homo sapiens
gtgaggggccaagagtagggca

SEQ ID NO: 9098950 - DNA, 22 bp, Homo sapiens
tacctgaaccaagcccagctct

SEQ ID NO: 9098951 - DNA, 22 bp, Homo sapiens
tactatttggaattttaaattg

SEQ ID NO: 9098952 - DNA, 22 bp, Homo sapiens
gtgaggggtggctgagcagttt

SEQ ID NO: 9098953 - DNA, 22 bp, Homo sapiens
gtgaggggtggctgagcagttt

SEQ ID NO: 9098954 - DNA, 22 bp, Homo sapiens
caggctggagtgagtgtagtgg

SEQ ID NO: 9098955 - DNA, 22 bp, Homo sapiens
caggctggagtacaattgtgtg

SEQ ID NO: 9098956 - DNA, 22 bp, Homo sapiens
caggctggagtgagtgtagtgg

SEQ ID NO: 9098957 - DNA, 22 bp, Homo sapiens
caggctggagtgagtgtagtgg

SEQ ID NO: 9098958 - DNA, 22 bp, Homo sapiens
caggctggagtgagtgtagtgg

SEQ ID NO: 9098959 - DNA, 22 bp, Homo sapiens
caggctggagtgcaatggtgct

SEQ ID NO: 9098960 - DNA, 22 bp, Homo sapiens
caggctggagtgcagtggcgcc

SEQ ID NO: 9098961 - DNA, 22 bp, Homo sapiens
caggctggagtgcaatggtgct

SEQ ID NO: 9098962 - DNA, 22 bp, Homo sapiens
caggctggagtgcaatgacgcc

SEQ ID NO: 9098963 - DNA, 22 bp, Homo sapiens
caggctggagtgagtgtagtgg

SEQ ID NO: 9098964 - DNA, 22 bp, Homo sapiens
caggctggagtgcaatgacgcc

SEQ ID NO: 9098965 - DNA, 22 bp, Homo sapiens
caggctggagtgcaatggcaca

SEQ ID NO: 9098966 - DNA, 22 bp, Homo sapiens
caggctggagtgcaatggcaca

SEQ ID NO: 9098967 - DNA, 22 bp, Homo sapiens
tagaatatacactacagcttaa

SEQ ID NO: 9098968 - DNA, 22 bp, Homo sapiens
tagaatacagtttaagaactac

SEQ ID NO: 9098969 - DNA, 22 bp, Homo sapiens
tagaataagttgatgatatatg

SEQ ID NO: 9098970 - DNA, 22 bp, Homo sapiens
caggctggagtgcagtggtgcc

SEQ ID NO: 9098971 - DNA, 22 bp, Homo sapiens
caggctggagtgcagtggcgcc

SEQ ID NO: 9098972 - DNA, 22 bp, Homo sapiens
caggctggagtgcagtggcgcc

SEQ ID NO: 9098973 - DNA, 22 bp, Homo sapiens
caggctggagtgcagtggcgct

SEQ ID NO: 9098974 - DNA, 22 bp, Homo sapiens
caggctggagtgcagtggcgct

SEQ ID NO: 9098975 - DNA, 22 bp, Homo sapiens
caggctggagtgcagtggcgct

SEQ ID NO: 9098976 - DNA, 22 bp, Homo sapiens
caggctggagtgcagtggggcg

SEQ ID NO: 9098977 - DNA, 22 bp, Homo sapiens
caggctggagtgcagtggggcg

SEQ ID NO: 9098978 - DNA, 22 bp, Homo sapiens
tagacattttaagacatatacc

SEQ ID NO: 9098979 - DNA, 22 bp, Homo sapiens
caggctggtcccagagcattgc

SEQ ID NO: 9098980 - DNA, 22 bp, Homo sapiens
caggctggtcccagagcattgc

SEQ ID NO: 9098981 - DNA, 22 bp, Homo sapiens
caggctgggctggtgttagagt

SEQ ID NO: 9098982 - DNA, 22 bp, Homo sapiens
caggctgggctggtgttagagt

SEQ ID NO: 9098983 - DNA, 22 bp, Homo sapiens
caggctgggctggtgttagagt

SEQ ID NO: 9098984 - DNA, 22 bp, Homo sapiens
caggctgggctccggagataaa

SEQ ID NO: 9098985 - DNA, 22 bp, Homo sapiens
caggctgggctccggagataaa

SEQ ID NO: 9098986 - DNA, 22 bp, Homo sapiens
caggctgggctccggagataaa

SEQ ID NO: 9098987 - DNA, 22 bp, Homo sapiens
caggctgggctccggagataaa

SEQ ID NO: 9098988 - DNA, 22 bp, Homo sapiens
caggctgggcagcctccccggc

SEQ ID NO: 9098989 - DNA, 22 bp, Homo sapiens
caggctgggcagcctccccggc

SEQ ID NO: 9098990 - DNA, 22 bp, Homo sapiens
caggctgggcagcctccccggc

SEQ ID NO: 9098991 - DNA, 22 bp, Homo sapiens
caggctgggcagcctccccggc

SEQ ID NO: 9098992 - DNA, 22 bp, Homo sapiens
caggctgggcagcctccccggc

SEQ ID NO: 9098993 - DNA, 22 bp, Homo sapiens
tagaatcaagcagtagagcaga

SEQ ID NO: 9098994 - DNA, 22 bp, Homo sapiens
tagagctggaaaactgcaggta

SEQ ID NO: 9098995 - DNA, 22 bp, Homo sapiens
tagagctggccgggacagctgg

SEQ ID NO: 9098996 - DNA, 22 bp, Homo sapiens
tagagctggaatttgcagcaag

SEQ ID NO: 9098997 - DNA, 22 bp, Homo sapiens
tagagctggaatttgcagcaag

SEQ ID NO: 9098998 - DNA, 17 bp, Homo sapiens
tagagctggttcaggag

SEQ ID NO: 9098999 - DNA, 22 bp, Homo sapiens
tagagctgtatcaaagagcctt

SEQ ID NO: 9099000 - DNA, 22 bp, Homo sapiens
tagagctgtatcaaagagcctt

SEQ ID NO: 9099001 - DNA, 22 bp, Homo sapiens
tagaggaaatttccaaggtgag

SEQ ID NO: 9099002 - DNA, 22 bp, Homo sapiens
tagataaattagaaagtttact

SEQ ID NO: 9099003 - DNA, 22 bp, Homo sapiens
tagataaaagggcaaagggcat

SEQ ID NO: 9099004 - DNA, 22 bp, Homo sapiens
tagaggaaccaggcaggctgag

SEQ ID NO: 9099005 - DNA, 22 bp, Homo sapiens
tagaggaactgcctttcttctg

SEQ ID NO: 9099006 - DNA, 19 bp, Homo sapiens
tagaggagaagggaagtgg

SEQ ID NO: 9099007 - DNA, 19 bp, Homo sapiens
tagataaggcatttaatct

SEQ ID NO: 9099008 - DNA, 22 bp, Homo sapiens
tagataaattagaaagtttact

SEQ ID NO: 9099009 - DNA, 22 bp, Homo sapiens
tagataaattagaaagtttact

SEQ ID NO: 9099010 - DNA, 22 bp, Homo sapiens
cagggcaaagagagcacatgct

SEQ ID NO: 9099011 - DNA, 21 bp, Homo sapiens
cagggcaaccaagtccagaga

SEQ ID NO: 9099012 - DNA, 20 bp, Homo sapiens
cagggcacactgcagcctcg

SEQ ID NO: 9099013 - DNA, 20 bp, Homo sapiens
cagggcacactgcagcctcg

SEQ ID NO: 9099014 - DNA, 22 bp, Homo sapiens
cagggcacagatcggggcgcac

SEQ ID NO: 9099015 - DNA, 22 bp, Homo sapiens
cagggcacttaaattgcctcgt

SEQ ID NO: 9099016 - DNA, 22 bp, Homo sapiens
cagggcacttaaattgcctcgt

SEQ ID NO: 9099017 - DNA, 22 bp, Homo sapiens
cagggcagaacatatagatagt

SEQ ID NO: 9099018 - DNA, 22 bp, Homo sapiens
cagggcacttaaattgcctcgt

SEQ ID NO: 9099019 - DNA, 22 bp, Homo sapiens
cagggcagaacatatagatagt

SEQ ID NO: 9099020 - DNA, 22 bp, Homo sapiens
tagcaaggtgaagtatgggtga

SEQ ID NO: 9099021 - DNA, 22 bp, Homo sapiens
tagcaagtatgatactccatga

SEQ ID NO: 9099022 - DNA, 22 bp, Homo sapiens
tagcaaggacgtccaaagaact

SEQ ID NO: 9099023 - DNA, 22 bp, Homo sapiens
tagcaaggacaacatatgagag

SEQ ID NO: 9099024 - DNA, 22 bp, Homo sapiens
tagcaaggcgtggcactcaaat

SEQ ID NO: 9099025 - DNA, 22 bp, Homo sapiens
tagcaaggcttccaatgaacag

SEQ ID NO: 9099026 - DNA, 22 bp, Homo sapiens
tagcaagatgtcactccaagtt

SEQ ID NO: 9099027 - DNA, 22 bp, Homo sapiens
tagcaatgtgtgtgtataaatt

SEQ ID NO: 9099028 - DNA, 22 bp, Homo sapiens
tagcaatagaaacatataaagt

SEQ ID NO: 9099029 - DNA, 22 bp, Homo sapiens
tagcaatagaaacatataaagt

SEQ ID NO: 9099030 - DNA, 22 bp, Homo sapiens
tagcaatgctctatgatgaaaa

SEQ ID NO: 9099031 - DNA, 22 bp, Homo sapiens
tagcattatttcctctttttgt

SEQ ID NO: 9099032 - DNA, 22 bp, Homo sapiens
tagctaaaccagtatgtgaagg

SEQ ID NO: 9099033 - DNA, 22 bp, Homo sapiens
tagctaaatttttcatgtaata

SEQ ID NO: 9099034 - DNA, 22 bp, Homo sapiens
tagctaatggtgaagattcaga

SEQ ID NO: 9099035 - DNA, 22 bp, Homo sapiens
tatttccagaggagtatagaag

SEQ ID NO: 9099036 - DNA, 22 bp, Homo sapiens
cagtagcttacttttcttgatc

SEQ ID NO: 9099037 - DNA, 22 bp, Homo sapiens
cagtcccagacccagaaggtgg

SEQ ID NO: 9099038 - DNA, 22 bp, Homo sapiens
tatttcttgttccctccaagtt

SEQ ID NO: 9099039 - DNA, 22 bp, Homo sapiens
tatttcttgttccctccaagtt

SEQ ID NO: 9099040 - DNA, 22 bp, Homo sapiens
cagtcccagacatagtaaggga

SEQ ID NO: 9099041 - DNA, 21 bp, Homo sapiens
tatttctttgactctctccct

SEQ ID NO: 9099042 - DNA, 22 bp, Homo sapiens
tatttcttttcgtgacttattg

SEQ ID NO: 9099043 - DNA, 22 bp, Homo sapiens
tatttctttcaggtatgtgttg

SEQ ID NO: 9099044 - DNA, 22 bp, Homo sapiens
tatttctttcaggtatgtgttg

SEQ ID NO: 9099045 - DNA, 18 bp, Homo sapiens
cagtcccaaaccttagga

SEQ ID NO: 9099046 - DNA, 22 bp, Homo sapiens
cagtcccaaggaggaagcagtc

SEQ ID NO: 9099047 - DNA, 20 bp, Homo sapiens
cagtcccaatccagggccag

SEQ ID NO: 9099048 - DNA, 20 bp, Homo sapiens
cagtcccaatccagggccag

SEQ ID NO: 9099049 - DNA, 22 bp, Homo sapiens
cagtcccaaggaggaagcagtc

SEQ ID NO: 9099050 - DNA, 22 bp, Homo sapiens
tatttccaaaaaggccatattc

SEQ ID NO: 9099051 - DNA, 22 bp, Homo sapiens
tatttataacagtgagaacggg

SEQ ID NO: 9099052 - DNA, 22 bp, Homo sapiens
cagtaaaaatgttgtcaaggca

SEQ ID NO: 9099053 - DNA, 21 bp, Homo sapiens
tatttagttttacaaatgtgg

SEQ ID NO: 9099054 - DNA, 22 bp, Homo sapiens
caggtttctagttctaagaata

SEQ ID NO: 9099055 - DNA, 22 bp, Homo sapiens
caggtttagttccacacagctc

SEQ ID NO: 9099056 - DNA, 22 bp, Homo sapiens
caggttcttaacttgttcttcc

SEQ ID NO: 9099057 - DNA, 22 bp, Homo sapiens
caggttctggggctccactgtg

SEQ ID NO: 9099058 - DNA, 22 bp, Homo sapiens
caggttctgggtcctgggtcct

SEQ ID NO: 9099059 - DNA, 22 bp, Homo sapiens
caggttctatactgaataattt

SEQ ID NO: 9099060 - DNA, 22 bp, Homo sapiens
caggttctcagaaggcagtcac

SEQ ID NO: 9099061 - DNA, 22 bp, Homo sapiens
caggttctcagaaggcagtcac

SEQ ID NO: 9099062 - DNA, 22 bp, Homo sapiens
caggttctgaggatggtgcctg

SEQ ID NO: 9099063 - DNA, 22 bp, Homo sapiens
caggttctggagatgcagagat

SEQ ID NO: 9099064 - DNA, 22 bp, Homo sapiens
caggttctggagatgcagagat

SEQ ID NO: 9099065 - DNA, 22 bp, Homo sapiens
cagggtggccctgtggtctcat

SEQ ID NO: 9099066 - DNA, 22 bp, Homo sapiens
cagggtgggcacccagcctcca

SEQ ID NO: 9099067 - DNA, 22 bp, Homo sapiens
caggttatctggattaatatca

SEQ ID NO: 9099068 - DNA, 22 bp, Homo sapiens
caggttcagcaggaggcatccc

SEQ ID NO: 9099069 - DNA, 22 bp, Homo sapiens
caggttccctagcagcaaagcc

SEQ ID NO: 9099070 - DNA, 22 bp, Homo sapiens
caggttcccttgcagctaagtg

SEQ ID NO: 9099071 - DNA, 22 bp, Homo sapiens
tcacacttcaaagggttagatc

SEQ ID NO: 9099072 - DNA, 22 bp, Homo sapiens
cagtgaagttctactgaatggt

SEQ ID NO: 9099073 - DNA, 22 bp, Homo sapiens
cagtgaagttctactgaatggt

SEQ ID NO: 9099074 - DNA, 22 bp, Homo sapiens
cagtgagagagaacgcattcat

SEQ ID NO: 9099075 - DNA, 22 bp, Homo sapiens
cagtgacgtaaactgcatgtgc

SEQ ID NO: 9099076 - DNA, 22 bp, Homo sapiens
cagtgaagtttaaagtgtagat

SEQ ID NO: 9099077 - DNA, 22 bp, Homo sapiens
cagtgacagcaagcagtgctgg

SEQ ID NO: 9099078 - DNA, 22 bp, Homo sapiens
tcacaaatgtctcctgtcctgt

SEQ ID NO: 9099079 - DNA, 22 bp, Homo sapiens
tcacaaatcattttatctgtgt

SEQ ID NO: 9099080 - DNA, 21 bp, Homo sapiens
tcacaactttgaatttcaata

SEQ ID NO: 9099081 - DNA, 22 bp, Homo sapiens
tcacaagaatttgtagatgaaa

SEQ ID NO: 9099082 - DNA, 22 bp, Homo sapiens
tcacaactctttccatttaata

SEQ ID NO: 9099083 - DNA, 22 bp, Homo sapiens
tcacaaatattttaacagtagg

SEQ ID NO: 9099084 - DNA, 22 bp, Homo sapiens
tcaatgagccagaatgtagtac

SEQ ID NO: 9099085 - DNA, 22 bp, Homo sapiens
tatttcttttcgtgacttattg

SEQ ID NO: 9099086 - DNA, 22 bp, Homo sapiens
tatttgaaagtgtacaaaaact

SEQ ID NO: 9099087 - DNA, 20 bp, Homo sapiens
tcacaggagggaaggcaggt

SEQ ID NO: 9099088 - DNA, 22 bp, Homo sapiens
tcacaggaggactgaaagatat

SEQ ID NO: 9099089 - DNA, 22 bp, Homo sapiens
tcacaggaggactgaaagatat

SEQ ID NO: 9099090 - DNA, 20 bp, Homo sapiens
tcacaggagggaaggcaggt

SEQ ID NO: 9099091 - DNA, 20 bp, Homo sapiens
tcacaggagggaaggcaggt

SEQ ID NO: 9099092 - DNA, 22 bp, Homo sapiens
tcacaggagggagagacaccca

SEQ ID NO: 9099093 - DNA, 22 bp, Homo sapiens
tcacaggagggagagacaccca

SEQ ID NO: 9099094 - DNA, 22 bp, Homo sapiens
tcacaggagtcaaggaatagta

SEQ ID NO: 9099095 - DNA, 22 bp, Homo sapiens
tcacaggagtcaaggaatagta

SEQ ID NO: 9099096 - DNA, 22 bp, Homo sapiens
tcacagtgtggcaactcacaga

SEQ ID NO: 9099097 - DNA, 22 bp, Homo sapiens
tcacagttcatctgataaacta

SEQ ID NO: 9099098 - DNA, 22 bp, Homo sapiens
cagtgcatgcacacacatggta

SEQ ID NO: 9099099 - DNA, 22 bp, Homo sapiens
tcacagttgattgaaacacagc

SEQ ID NO: 9099100 - DNA, 22 bp, Homo sapiens
tcacaggagagctgatgctggt

SEQ ID NO: 9099101 - DNA, 22 bp, Homo sapiens
tcacaggagaatgtacttacca

SEQ ID NO: 9099102 - DNA, 22 bp, Homo sapiens
tcacaggaccctgagggtggcg

SEQ ID NO: 9099103 - DNA, 22 bp, Homo sapiens
tcacaggaggaacctggcctgg

SEQ ID NO: 9099104 - DNA, 22 bp, Homo sapiens
tcacaggagcccaggggagctg

SEQ ID NO: 9099105 - DNA, 22 bp, Homo sapiens
tcacaggagcccaggggagctg

SEQ ID NO: 9099106 - DNA, 22 bp, Homo sapiens
tcacaggagattatgtgtgcta

SEQ ID NO: 9099107 - DNA, 22 bp, Homo sapiens
tcacaggaaccatcagagaaat

SEQ ID NO: 9099108 - DNA, 22 bp, Homo sapiens
tcacaggaagaggtgtctatct

SEQ ID NO: 9099109 - DNA, 22 bp, Homo sapiens
tcacaggaaccatcagagaaat

SEQ ID NO: 9099110 - DNA, 22 bp, Homo sapiens
tcacaggacagccttccacccg

SEQ ID NO: 9099111 - DNA, 22 bp, Homo sapiens
tcacaggaccctgagggtggcg

SEQ ID NO: 9099112 - DNA, 22 bp, Homo sapiens
tcacaggaccctgagggtggcg

SEQ ID NO: 9099113 - DNA, 22 bp, Homo sapiens
tcacaggaagggtaaatattta

SEQ ID NO: 9099114 - DNA, 22 bp, Homo sapiens
tcacaggacagccttccacccg

SEQ ID NO: 9099115 - DNA, 20 bp, Homo sapiens
tcacagctggctatgacagg

SEQ ID NO: 9099116 - DNA, 22 bp, Homo sapiens
tcacagagaaatgtggcacaaa

SEQ ID NO: 9099117 - DNA, 22 bp, Homo sapiens
tcacagagaaaagctatcacaa

SEQ ID NO: 9099118 - DNA, 22 bp, Homo sapiens
tcacagagaaaagctatcacaa

SEQ ID NO: 9099119 - DNA, 22 bp, Homo sapiens
tcacagacttgtctccagggat

SEQ ID NO: 9099120 - DNA, 18 bp, Homo sapiens
tcacagacttactgggcc

SEQ ID NO: 9099121 - DNA, 21 bp, Homo sapiens
tcacagactggtcagtgaggc

SEQ ID NO: 9099122 - DNA, 21 bp, Homo sapiens
tcacagactggtcagtgaggc

SEQ ID NO: 9099123 - DNA, 22 bp, Homo sapiens
tcacagactcttgattgtctaa

SEQ ID NO: 9099124 - DNA, 22 bp, Homo sapiens
cagtgggatatgggggcagcat

SEQ ID NO: 9099125 - DNA, 22 bp, Homo sapiens
cagtgggctgtgatggattcac

SEQ ID NO: 9099126 - DNA, 21 bp, Homo sapiens
cagtgggctgctgcgctccag

SEQ ID NO: 9099127 - DNA, 22 bp, Homo sapiens
cagtgggtaggaaaggctcttc

SEQ ID NO: 9099128 - DNA, 22 bp, Homo sapiens
cagtgggtcctaagtacagttc

SEQ ID NO: 9099129 - DNA, 22 bp, Homo sapiens
cagtggggtttctgtgggtgct

SEQ ID NO: 9099130 - DNA, 22 bp, Homo sapiens
cagtggggggactgaggcctga

SEQ ID NO: 9099131 - DNA, 23 bp, Homo sapiens
cagtgggcttctaactgctcctg

SEQ ID NO: 9099132 - DNA, 22 bp, Homo sapiens
cagtgccacttaatgaggctgc

SEQ ID NO: 9099133 - DNA, 21 bp, Homo sapiens
cagtgccagccacaggacgcc

SEQ ID NO: 9099134 - DNA, 22 bp, Homo sapiens
cagtgccagaggtactagtgga

SEQ ID NO: 9099135 - DNA, 22 bp, Homo sapiens
cagtgccatgtctgagccccta

SEQ ID NO: 9099136 - DNA, 22 bp, Homo sapiens
cagtgccatattgaaagacatt

SEQ ID NO: 9099137 - DNA, 22 bp, Homo sapiens
cagtggctggttagggacagga

SEQ ID NO: 9099138 - DNA, 22 bp, Homo sapiens
cagtggcaggggaagcaggtgt

SEQ ID NO: 9099139 - DNA, 22 bp, Homo sapiens
cagtggcttctcatgtcattca

SEQ ID NO: 9099140 - DNA, 22 bp, Homo sapiens
tcagagaaaggccaaaatatca

SEQ ID NO: 9099141 - DNA, 22 bp, Homo sapiens
tcagagaaaggccaaaatatca

SEQ ID NO: 9099142 - DNA, 22 bp, Homo sapiens
tcagagaaataattgctgagtt

SEQ ID NO: 9099143 - DNA, 22 bp, Homo sapiens
tcagagaaatgctgagctcatg

SEQ ID NO: 9099144 - DNA, 22 bp, Homo sapiens
tcagagaaatgctgagctcatg

SEQ ID NO: 9099145 - DNA, 22 bp, Homo sapiens
tcagagaaatgctgagctcatg

SEQ ID NO: 9099146 - DNA, 22 bp, Homo sapiens
tcagagaacacagaggtgatgt

SEQ ID NO: 9099147 - DNA, 22 bp, Homo sapiens
cagtgtctccagatgctccaat

SEQ ID NO: 9099148 - DNA, 22 bp, Homo sapiens
cagtgtctcagtttcacttgaa

SEQ ID NO: 9099149 - DNA, 21 bp, Homo sapiens
tcagaagtgcagcccaggaat

SEQ ID NO: 9099150 - DNA, 20 bp, Homo sapiens
tcagaagtgcagctgcccct

SEQ ID NO: 9099151 - DNA, 23 bp, Homo sapiens
tcagaagtgggatacaaagctga

SEQ ID NO: 9099152 - DNA, 22 bp, Homo sapiens
tcagactgctgtccctgcctgg

SEQ ID NO: 9099153 - DNA, 22 bp, Homo sapiens
tcagacttgactttgtaagttt

SEQ ID NO: 9099154 - DNA, 22 bp, Homo sapiens
cagtgtttgttgagaaaggcaa

SEQ ID NO: 9099155 - DNA, 22 bp, Homo sapiens
cagtgtttgcttaagttatatg

SEQ ID NO: 9099156 - DNA, 22 bp, Homo sapiens
cagttaaacagattgagtgtta

SEQ ID NO: 9099157 - DNA, 22 bp, Homo sapiens
cagttaaacgggccatgtgagt

SEQ ID NO: 9099158 - DNA, 22 bp, Homo sapiens
cagttaaaatgtgctataagaa

SEQ ID NO: 9099159 - DNA, 22 bp, Homo sapiens
cagttaaaagaagtctatctta

SEQ ID NO: 9099160 - DNA, 22 bp, Homo sapiens
cagtgtgcctgaatcaagtgtt

SEQ ID NO: 9099161 - DNA, 22 bp, Homo sapiens
cagtgtgacttctgagctgcca

SEQ ID NO: 9099162 - DNA, 22 bp, Homo sapiens
cagtgtgacttctgagctgcca

SEQ ID NO: 9099163 - DNA, 22 bp, Homo sapiens
cagtgtcttatttgtagctcag

SEQ ID NO: 9099164 - DNA, 22 bp, Homo sapiens
tcagcagaggggaaggcatctg

SEQ ID NO: 9099165 - DNA, 22 bp, Homo sapiens
tcagcagaggggaaggcatctg

SEQ ID NO: 9099166 - DNA, 22 bp, Homo sapiens
tcagcagagctcaggctccagc

SEQ ID NO: 9099167 - DNA, 22 bp, Homo sapiens
tcagcagaagtatagaggccat

SEQ ID NO: 9099168 - DNA, 20 bp, Homo sapiens
cagtttaactttgagcagtt

SEQ ID NO: 9099169 - DNA, 22 bp, Homo sapiens
cagttgttcccagcaatgaaag

SEQ ID NO: 9099170 - DNA, 22 bp, Homo sapiens
tcagcagccgcagctgactcag

SEQ ID NO: 9099171 - DNA, 22 bp, Homo sapiens
cagtttaaagaaggatgggagt

SEQ ID NO: 9099172 - DNA, 23 bp, Homo sapiens
tcagcagcagaagtgctgggatg

SEQ ID NO: 9099173 - DNA, 23 bp, Homo sapiens
tcagcagcagaagtgctgggatg

SEQ ID NO: 9099174 - DNA, 21 bp, Homo sapiens
tcagcagcatctgcctagagt

SEQ ID NO: 9099175 - DNA, 22 bp, Homo sapiens
tcagcagcagctcagcatgttt

SEQ ID NO: 9099176 - DNA, 22 bp, Homo sapiens
cagttaaattctccagttacca

SEQ ID NO: 9099177 - DNA, 22 bp, Homo sapiens
cagttaaatttggctgttttct

SEQ ID NO: 9099178 - DNA, 22 bp, Homo sapiens
cagttaaaggcccaatatctgg

SEQ ID NO: 9099179 - DNA, 22 bp, Homo sapiens
cagttaaagtgcttatcacaga

SEQ ID NO: 9099180 - DNA, 22 bp, Homo sapiens
cagttaaagctgcatgtgtcag

SEQ ID NO: 9099181 - DNA, 22 bp, Homo sapiens
cagttaaacgggccatgtgagt

SEQ ID NO: 9099182 - DNA, 22 bp, Homo sapiens
cagttaaacgggccatgtgagt

SEQ ID NO: 9099183 - DNA, 22 bp, Homo sapiens
cagttaaacgatgatggggtca

SEQ ID NO: 9099184 - DNA, 22 bp, Homo sapiens
cagttactcaataattcttgcg

SEQ ID NO: 9099185 - DNA, 22 bp, Homo sapiens
cagttaccagatcgcaggaggt

SEQ ID NO: 9099186 - DNA, 22 bp, Homo sapiens
cagttaccatcttcagtgatga

SEQ ID NO: 9099187 - DNA, 19 bp, Homo sapiens
cataaatgtacaagataca

SEQ ID NO: 9099188 - DNA, 21 bp, Homo sapiens
tcaggaaacacctcttaagga

SEQ ID NO: 9099189 - DNA, 21 bp, Homo sapiens
tcaggaaacacctcttaagga

SEQ ID NO: 9099190 - DNA, 21 bp, Homo sapiens
tcaggaaacacctcttaagga

SEQ ID NO: 9099191 - DNA, 21 bp, Homo sapiens
tcaggaaacacctcttaagga

SEQ ID NO: 9099192 - DNA, 22 bp, Homo sapiens
tcaggaaaatactgcttatcca

SEQ ID NO: 9099193 - DNA, 22 bp, Homo sapiens
tcaggaaaatactgcttatcca

SEQ ID NO: 9099194 - DNA, 22 bp, Homo sapiens
tcaggaaagaagatgctcagtg

SEQ ID NO: 9099195 - DNA, 22 bp, Homo sapiens
tcaggaaagagtaatgtataca

SEQ ID NO: 9099196 - DNA, 22 bp, Homo sapiens
tcaggaaagagtaatgtataca

SEQ ID NO: 9099197 - DNA, 22 bp, Homo sapiens
tcaggaaagaagatgctcagtg

SEQ ID NO: 9099198 - DNA, 22 bp, Homo sapiens
tcaggaaagaagatgctcagtg

SEQ ID NO: 9099199 - DNA, 22 bp, Homo sapiens
tcaggaaactgtcaagtgggat

SEQ ID NO: 9099200 - DNA, 22 bp, Homo sapiens
tcaggaaactacagttgaacta

SEQ ID NO: 9099201 - DNA, 22 bp, Homo sapiens
cagtttagtgttgcatttggag

SEQ ID NO: 9099202 - DNA, 22 bp, Homo sapiens
cagtttatagttgttatgtgtg

SEQ ID NO: 9099203 - DNA, 22 bp, Homo sapiens
cagtttagaagaatcatgaaca

SEQ ID NO: 9099204 - DNA, 22 bp, Homo sapiens
cagtttagcaaatttgtatcaa

SEQ ID NO: 9099205 - DNA, 22 bp, Homo sapiens
cagtttagcatttaccgtgatg

SEQ ID NO: 9099206 - DNA, 22 bp, Homo sapiens
cagtttaggagagacgcgttct

SEQ ID NO: 9099207 - DNA, 22 bp, Homo sapiens
cagtttaggtcatccttgcttt

SEQ ID NO: 9099208 - DNA, 22 bp, Homo sapiens
cagtttaggtcatccttgcttt

SEQ ID NO: 9099209 - DNA, 22 bp, Homo sapiens
cagtttagtcctgccaccatgg

SEQ ID NO: 9099210 - DNA, 22 bp, Homo sapiens
cagtttagtaggtgatatcaat

SEQ ID NO: 9099211 - DNA, 21 bp, Homo sapiens
cagtttaataacaaagaagga

SEQ ID NO: 9099212 - DNA, 22 bp, Homo sapiens
tcagctgccccagtggccccag

SEQ ID NO: 9099213 - DNA, 22 bp, Homo sapiens
tgctttcaaaggctttctagat

SEQ ID NO: 9099214 - DNA, 22 bp, Homo sapiens
tgctttcaatgaattgtatact

SEQ ID NO: 9099215 - DNA, 22 bp, Homo sapiens
tgctttcacaccatgcctataa

SEQ ID NO: 9099216 - DNA, 22 bp, Homo sapiens
tgctttcagatatctgtttcaa

SEQ ID NO: 9099217 - DNA, 22 bp, Homo sapiens
tgctttcagctggtaaagaaac

SEQ ID NO: 9099218 - DNA, 22 bp, Homo sapiens
tgctttcatgaagtctatagag

SEQ ID NO: 9099219 - DNA, 22 bp, Homo sapiens
tgctttcagtttacatcagaac

SEQ ID NO: 9099220 - DNA, 22 bp, Homo sapiens
tgctttatttataaaatagcaa

SEQ ID NO: 9099221 - DNA, 22 bp, Homo sapiens
tgctttattgcatcagtgtggg

SEQ ID NO: 9099222 - DNA, 19 bp, Homo sapiens
tgcctgctcctggcttcca

SEQ ID NO: 9099223 - DNA, 19 bp, Homo sapiens
tgcctgctcctggcttcca

SEQ ID NO: 9099224 - DNA, 22 bp, Homo sapiens
tgcctgctaggccctgctgggt

SEQ ID NO: 9099225 - DNA, 22 bp, Homo sapiens
tgcctgctagatatccaggtga

SEQ ID NO: 9099226 - DNA, 22 bp, Homo sapiens
tgcctgccctgaaaactgccca

SEQ ID NO: 9099227 - DNA, 20 bp, Homo sapiens
tgcctgcccctgctttttcc

SEQ ID NO: 9099228 - DNA, 22 bp, Homo sapiens
tgcctgcctaggaagctgtgaa

SEQ ID NO: 9099229 - DNA, 22 bp, Homo sapiens
tgcctgcctcaggccgagtgct

SEQ ID NO: 9099230 - DNA, 22 bp, Homo sapiens
tgcctgcctaggaagctgtgaa

SEQ ID NO: 9099231 - DNA, 22 bp, Homo sapiens
tgcctgcctctggcagccctgc

SEQ ID NO: 9099232 - DNA, 22 bp, Homo sapiens
tgcctgcctctggagcccatcc

SEQ ID NO: 9099233 - DNA, 22 bp, Homo sapiens
tgcctgccttgctgctggacag

SEQ ID NO: 9099234 - DNA, 22 bp, Homo sapiens
tgcctgccttgctgctggacag

SEQ ID NO: 9099235 - DNA, 22 bp, Homo sapiens
tgcctcagtttcatctgcagaa

SEQ ID NO: 9099236 - DNA, 22 bp, Homo sapiens
tgcctccatgtttcagcatcta

SEQ ID NO: 9099237 - DNA, 17 bp, Homo sapiens
cccgttctcttcgctgg

SEQ ID NO: 9099238 - DNA, 22 bp, Homo sapiens
cccgtttgcctctttatttact

SEQ ID NO: 9099239 - DNA, 22 bp, Homo sapiens
tggaaagacattcagccgctgg

SEQ ID NO: 9099240 - DNA, 22 bp, Homo sapiens
tggaaagacatgtccttcatta

SEQ ID NO: 9099241 - DNA, 22 bp, Homo sapiens
ccctagagagatcagatgggga

SEQ ID NO: 9099242 - DNA, 22 bp, Homo sapiens
tggaagggaacaggtgggtgtt

SEQ ID NO: 9099243 - DNA, 22 bp, Homo sapiens
tggaaggcttggaatacttcca

SEQ ID NO: 9099244 - DNA, 22 bp, Homo sapiens
tggaaggcttggaatacttcca

SEQ ID NO: 9099245 - DNA, 22 bp, Homo sapiens
tggaaggcttggaatacttcca

SEQ ID NO: 9099246 - DNA, 17 bp, Homo sapiens
tggaaggcttcaatatt

SEQ ID NO: 9099247 - DNA, 17 bp, Homo sapiens
tggaaggcttcaatatt

SEQ ID NO: 9099248 - DNA, 21 bp, Homo sapiens
tggaaggctgctctgccaggg

SEQ ID NO: 9099249 - DNA, 21 bp, Homo sapiens
tggaaggctgctctgccaggg

SEQ ID NO: 9099250 - DNA, 22 bp, Homo sapiens
tggaaggcgtctcgaaggccta

SEQ ID NO: 9099251 - DNA, 22 bp, Homo sapiens
tggaaggcatttcacacaggat

SEQ ID NO: 9099252 - DNA, 22 bp, Homo sapiens
tggaaggctaggtgctaggccc

SEQ ID NO: 9099253 - DNA, 19 bp, Homo sapiens
tggaaggctaagacacttg

SEQ ID NO: 9099254 - DNA, 19 bp, Homo sapiens
tggaaggctaagacacttg

SEQ ID NO: 9099255 - DNA, 19 bp, Homo sapiens
tggaaggctaagacacttg

SEQ ID NO: 9099256 - DNA, 20 bp, Homo sapiens
tggaagacactgaagggcca

SEQ ID NO: 9099257 - DNA, 22 bp, Homo sapiens
tggaagacaatttgaaaacatt

SEQ ID NO: 9099258 - DNA, 22 bp, Homo sapiens
tggaagacaatgtacatgcagt

SEQ ID NO: 9099259 - DNA, 22 bp, Homo sapiens
tggaaggcaggacctgccttgg

SEQ ID NO: 9099260 - DNA, 22 bp, Homo sapiens
tggaaggcactgggagaagact

SEQ ID NO: 9099261 - DNA, 22 bp, Homo sapiens
tggaaggcactgggagaagact

SEQ ID NO: 9099262 - DNA, 20 bp, Homo sapiens
tggaaggcatctgcattatt

SEQ ID NO: 9099263 - DNA, 22 bp, Homo sapiens
tggaaggcatgggaactgttct

SEQ ID NO: 9099264 - DNA, 22 bp, Homo sapiens
ccctgcagagaccactgacctt

SEQ ID NO: 9099265 - DNA, 22 bp, Homo sapiens
ccctgcagagagtgcttttgtg

SEQ ID NO: 9099266 - DNA, 22 bp, Homo sapiens
ccctgcagaaccacagacaaac

SEQ ID NO: 9099267 - DNA, 17 bp, Homo sapiens
ccctgcaccctactctc

SEQ ID NO: 9099268 - DNA, 22 bp, Homo sapiens
ccctgcagcattctctaactgg

SEQ ID NO: 9099269 - DNA, 22 bp, Homo sapiens
ccctgcagatctagggtccttc

SEQ ID NO: 9099270 - DNA, 22 bp, Homo sapiens
ccctgcagatcagtgagaactt

SEQ ID NO: 9099271 - DNA, 22 bp, Homo sapiens
ccctgcagagccagccctgacc

SEQ ID NO: 9099272 - DNA, 22 bp, Homo sapiens
ccctgcagagggatgggggcag

SEQ ID NO: 9099273 - DNA, 22 bp, Homo sapiens
ccctgcagccggccagctcatt

SEQ ID NO: 9099274 - DNA, 20 bp, Homo sapiens
ccctgcagccatgggagtgg

SEQ ID NO: 9099275 - DNA, 20 bp, Homo sapiens
ccctgcagccatgggagtgg

SEQ ID NO: 9099276 - DNA, 22 bp, Homo sapiens
ccctgcagtcctttcttggctc

SEQ ID NO: 9099277 - DNA, 19 bp, Homo sapiens
ccctgccctggtgactggg

SEQ ID NO: 9099278 - DNA, 22 bp, Homo sapiens
ccctgcctacagggttttcttt

SEQ ID NO: 9099279 - DNA, 22 bp, Homo sapiens
ccctgcctacagggttttcttt

SEQ ID NO: 9099280 - DNA, 22 bp, Homo sapiens
ccctgcctctgaagctgctcag

SEQ ID NO: 9099281 - DNA, 22 bp, Homo sapiens
ccctgcctgtgggcatcaacat

SEQ ID NO: 9099282 - DNA, 22 bp, Homo sapiens
ccctgcctgtgggcatcaacat

SEQ ID NO: 9099283 - DNA, 22 bp, Homo sapiens
ccctgcctctgaagctgctcag

SEQ ID NO: 9099284 - DNA, 23 bp, Homo sapiens
ccctgcagtcagggtgagatggt

SEQ ID NO: 9099285 - DNA, 22 bp, Homo sapiens
tggacagttgtcttgtagctaa

SEQ ID NO: 9099286 - DNA, 23 bp, Homo sapiens
tggacagtagggtagacagtgcc

SEQ ID NO: 9099287 - DNA, 22 bp, Homo sapiens
tggacaggttgagtaggaggag

SEQ ID NO: 9099288 - DNA, 23 bp, Homo sapiens
ccctgctcaggggtctgattctc

SEQ ID NO: 9099289 - DNA, 22 bp, Homo sapiens
ccctgctcttagtgcctgtgtg

SEQ ID NO: 9099290 - DNA, 22 bp, Homo sapiens
ccctgctcttagtgcctgtgtg

SEQ ID NO: 9099291 - DNA, 22 bp, Homo sapiens
ccctgccttggggtccacaccg

SEQ ID NO: 9099292 - DNA, 22 bp, Homo sapiens
ccctgccttggggtccacaccg

SEQ ID NO: 9099293 - DNA, 22 bp, Homo sapiens
ccctgccttcttggcctttaaa

SEQ ID NO: 9099294 - DNA, 22 bp, Homo sapiens
ccctgccttcttggcctttaaa

SEQ ID NO: 9099295 - DNA, 22 bp, Homo sapiens
ccctgccttgtctgggctaggt

SEQ ID NO: 9099296 - DNA, 22 bp, Homo sapiens
ccctgccttgtctgggctaggt

SEQ ID NO: 9099297 - DNA, 22 bp, Homo sapiens
ccctgccttgttggagcctatg

SEQ ID NO: 9099298 - DNA, 22 bp, Homo sapiens
ccctgccttgttggagcctatg

SEQ ID NO: 9099299 - DNA, 22 bp, Homo sapiens
tggaggtacataatgagagggt

SEQ ID NO: 9099300 - DNA, 22 bp, Homo sapiens
tggagggtcaccccttgctgag

SEQ ID NO: 9099301 - DNA, 22 bp, Homo sapiens
tggaggtctctgtctgggcagg

SEQ ID NO: 9099302 - DNA, 22 bp, Homo sapiens
tggaggtctgcaaggcgctgga

SEQ ID NO: 9099303 - DNA, 22 bp, Homo sapiens
tggaggtcttacccagggctat

SEQ ID NO: 9099304 - DNA, 22 bp, Homo sapiens
tggaggtctgcaaggcgctgga

SEQ ID NO: 9099305 - DNA, 22 bp, Homo sapiens
tggaggtcgcgcgggtgctgca

SEQ ID NO: 9099306 - DNA, 22 bp, Homo sapiens
tggaggtcctgcaggatggcac

SEQ ID NO: 9099307 - DNA, 23 bp, Homo sapiens
ccctggagctagtctgagcgggg

SEQ ID NO: 9099308 - DNA, 22 bp, Homo sapiens
tggaggtgaaatgagattttgt

SEQ ID NO: 9099309 - DNA, 22 bp, Homo sapiens
ccctgtggaggaggagagcagt

SEQ ID NO: 9099310 - DNA, 22 bp, Homo sapiens
ccctgtgcatattgccagatac

SEQ ID NO: 9099311 - DNA, 22 bp, Homo sapiens
ccggcaaaggccccttccccag

SEQ ID NO: 9099312 - DNA, 22 bp, Homo sapiens
ccggcgggcagcggcagtgagc

SEQ ID NO: 9099313 - DNA, 22 bp, Homo sapiens
ccggctactcgggaggctgacg

SEQ ID NO: 9099314 - DNA, 22 bp, Homo sapiens
ccggcgggcgcggtgacgtcag

SEQ ID NO: 9099315 - DNA, 22 bp, Homo sapiens
ccggcgtctcttccacttccta

SEQ ID NO: 9099316 - DNA, 22 bp, Homo sapiens
ccggctactcgggaggctgacg

SEQ ID NO: 9099317 - DNA, 22 bp, Homo sapiens
ccctgtggcaggaggaggagca

SEQ ID NO: 9099318 - DNA, 22 bp, Homo sapiens
ccctggtggtacggcactggca

SEQ ID NO: 9099319 - DNA, 22 bp, Homo sapiens
ccctggtggtacggcactggca

SEQ ID NO: 9099320 - DNA, 22 bp, Homo sapiens
ccctgtccttggctgtgaggct

SEQ ID NO: 9099321 - DNA, 22 bp, Homo sapiens
ccctgtctcattgatcacttgt

SEQ ID NO: 9099322 - DNA, 22 bp, Homo sapiens
ccctgtatagatacaggtcata

SEQ ID NO: 9099323 - DNA, 23 bp, Homo sapiens
ccctgtagcccaggacaggcttt

SEQ ID NO: 9099324 - DNA, 22 bp, Homo sapiens
ccctggaggaaaatctgaggct

SEQ ID NO: 9099325 - DNA, 22 bp, Homo sapiens
ccctggagctgcttgcatgttg

SEQ ID NO: 9099326 - DNA, 22 bp, Homo sapiens
cctcacccagtcacctaggtgg

SEQ ID NO: 9099327 - DNA, 22 bp, Homo sapiens
cctcacccactacactcaaggg

SEQ ID NO: 9099328 - DNA, 22 bp, Homo sapiens
cctcacatgaatgtaagctcca

SEQ ID NO: 9099329 - DNA, 22 bp, Homo sapiens
cctcacagtgttcgtgtcagat

SEQ ID NO: 9099330 - DNA, 17 bp, Homo sapiens
cctcacagggaccagac

SEQ ID NO: 9099331 - DNA, 20 bp, Homo sapiens
cctcacagggcagagagggg

SEQ ID NO: 9099332 - DNA, 22 bp, Homo sapiens
cctcacagggccaggcccctca

SEQ ID NO: 9099333 - DNA, 22 bp, Homo sapiens
cctcacagggccaggcccctca

SEQ ID NO: 9099334 - DNA, 22 bp, Homo sapiens
cctcacagcccttggcccagga

SEQ ID NO: 9099335 - DNA, 22 bp, Homo sapiens
cctcacagcccttggcccagga

SEQ ID NO: 9099336 - DNA, 22 bp, Homo sapiens
cctcacagaggggcagccatct

SEQ ID NO: 9099337 - DNA, 22 bp, Homo sapiens
cctcacagaggggcagccatct

SEQ ID NO: 9099338 - DNA, 22 bp, Homo sapiens
cctaaagaattttcatagagct

SEQ ID NO: 9099339 - DNA, 19 bp, Homo sapiens
cctaaagtttgaaccctgg

SEQ ID NO: 9099340 - DNA, 22 bp, Homo sapiens
ccggctactcgggaggctgacg

SEQ ID NO: 9099341 - DNA, 22 bp, Homo sapiens
ccggctactcgggaggctgacg

SEQ ID NO: 9099342 - DNA, 22 bp, Homo sapiens
ccgggagcaggcgccaccgcca

SEQ ID NO: 9099343 - DNA, 22 bp, Homo sapiens
ccgggagcaggcgccaccgcca

SEQ ID NO: 9099344 - DNA, 22 bp, Homo sapiens
ccgggcctcgggacaccgggta

SEQ ID NO: 9099345 - DNA, 22 bp, Homo sapiens
ccgggcctcgggacaccgggta

SEQ ID NO: 9099346 - DNA, 22 bp, Homo sapiens
ccgtggtcacctgagctccttg

SEQ ID NO: 9099347 - DNA, 22 bp, Homo sapiens
ccggtcccaggtgccccggtga

SEQ ID NO: 9099348 - DNA, 22 bp, Homo sapiens
ccgggctggagtgcaatggctc

SEQ ID NO: 9099349 - DNA, 18 bp, Homo sapiens
ccgggctttggtgacaca

SEQ ID NO: 9099350 - DNA, 22 bp, Homo sapiens
cctcactcttgtcctggcaggt

SEQ ID NO: 9099351 - DNA, 22 bp, Homo sapiens
cctcactcttgtcctggcaggt

SEQ ID NO: 9099352 - DNA, 22 bp, Homo sapiens
cctcactctgcaccctgcagca

SEQ ID NO: 9099353 - DNA, 22 bp, Homo sapiens
cctcactctgcaccctgcagca

SEQ ID NO: 9099354 - DNA, 19 bp, Homo sapiens
cctcaccctgcagaggagg

SEQ ID NO: 9099355 - DNA, 22 bp, Homo sapiens
cctcagaacggaaatggttttg

SEQ ID NO: 9099356 - DNA, 22 bp, Homo sapiens
cctcactggccagccaggggtg

SEQ ID NO: 9099357 - DNA, 22 bp, Homo sapiens
cctcactcttgtcctggcaggt

SEQ ID NO: 9099358 - DNA, 22 bp, Homo sapiens
tggcctcaagtctgagggcctt

SEQ ID NO: 9099359 - DNA, 22 bp, Homo sapiens
tggcctcaaccgtcctaagcac

SEQ ID NO: 9099360 - DNA, 22 bp, Homo sapiens
tggccctgcttatgtctctctt

SEQ ID NO: 9099361 - DNA, 22 bp, Homo sapiens
tggcctcaaccgtcctaagcac

SEQ ID NO: 9099362 - DNA, 22 bp, Homo sapiens
tggcctcaccactagctgggtg

SEQ ID NO: 9099363 - DNA, 22 bp, Homo sapiens
tggcctcagattattgcacagt

SEQ ID NO: 9099364 - DNA, 22 bp, Homo sapiens
tggcctcagatttcaggggtgg

SEQ ID NO: 9099365 - DNA, 22 bp, Homo sapiens
tggcctcccctaacagcctctt

SEQ ID NO: 9099366 - DNA, 22 bp, Homo sapiens
cctcagctgcttccctggagcc

SEQ ID NO: 9099367 - DNA, 22 bp, Homo sapiens
tggcctggggacctgtgagacc

SEQ ID NO: 9099368 - DNA, 22 bp, Homo sapiens
cctcagctgtcttttccgaggt

SEQ ID NO: 9099369 - DNA, 22 bp, Homo sapiens
tggctaacaaggtgaaaccccg

SEQ ID NO: 9099370 - DNA, 22 bp, Homo sapiens
cctcagctcccatgagatctgc

SEQ ID NO: 9099371 - DNA, 22 bp, Homo sapiens
cctcagccttggccccaggcag

SEQ ID NO: 9099372 - DNA, 22 bp, Homo sapiens
cctcagctgctgcacagctttt

SEQ ID NO: 9099373 - DNA, 22 bp, Homo sapiens
cctcagctgcttccctggagcc

SEQ ID NO: 9099374 - DNA, 23 bp, Homo sapiens
cctcagcatggcaggagcccagc

SEQ ID NO: 9099375 - DNA, 23 bp, Homo sapiens
cctcagcatggcaggagcccagc

SEQ ID NO: 9099376 - DNA, 22 bp, Homo sapiens
tggcctctctaccaggcagcct

SEQ ID NO: 9099377 - DNA, 22 bp, Homo sapiens
cctcagcatcctggtgaagtag

SEQ ID NO: 9099378 - DNA, 23 bp, Homo sapiens
tggcctctccccacctggcagaa

SEQ ID NO: 9099379 - DNA, 22 bp, Homo sapiens
tggcctcggcatccagcaagag

SEQ ID NO: 9099380 - DNA, 22 bp, Homo sapiens
tggctaatggcatttcctgggt

SEQ ID NO: 9099381 - DNA, 19 bp, Homo sapiens
tggctaattttatagaggc

SEQ ID NO: 9099382 - DNA, 22 bp, Homo sapiens
tggctacaaggtggctattcta

SEQ ID NO: 9099383 - DNA, 22 bp, Homo sapiens
tggctacagaattggccctgtt

SEQ ID NO: 9099384 - DNA, 22 bp, Homo sapiens
tggctacatttatactctcatt

SEQ ID NO: 9099385 - DNA, 22 bp, Homo sapiens
tggctagggcctttaacgagta

SEQ ID NO: 9099386 - DNA, 22 bp, Homo sapiens
tggctaggctggtgtcaagctc

SEQ ID NO: 9099387 - DNA, 22 bp, Homo sapiens
tggctaggaatccatgactctc

SEQ ID NO: 9099388 - DNA, 22 bp, Homo sapiens
cctccctctgttagagctgtct

SEQ ID NO: 9099389 - DNA, 22 bp, Homo sapiens
cctcccgtatatgtcctgggct

SEQ ID NO: 9099390 - DNA, 19 bp, Homo sapiens
cctccccttggaccagcaa

SEQ ID NO: 9099391 - DNA, 19 bp, Homo sapiens
cctccccttggaccagcaa

SEQ ID NO: 9099392 - DNA, 19 bp, Homo sapiens
cctccccttggaccagcaa

SEQ ID NO: 9099393 - DNA, 22 bp, Homo sapiens
cctcccctcagacagagactgg

SEQ ID NO: 9099394 - DNA, 22 bp, Homo sapiens
tggctcagcggtggcagcagac

SEQ ID NO: 9099395 - DNA, 22 bp, Homo sapiens
tggctcagcggtggcagcagac

SEQ ID NO: 9099396 - DNA, 22 bp, Homo sapiens
cctgaggccctggctgtgctga

SEQ ID NO: 9099397 - DNA, 22 bp, Homo sapiens
cctgaggccctggctgtgctga

SEQ ID NO: 9099398 - DNA, 22 bp, Homo sapiens
cctgagctggcagtgacctgga

SEQ ID NO: 9099399 - DNA, 22 bp, Homo sapiens
cctgaggctccacctccagaga

SEQ ID NO: 9099400 - DNA, 22 bp, Homo sapiens
cctgaggccctggctgtgctga

SEQ ID NO: 9099401 - DNA, 22 bp, Homo sapiens
cctgaggccctggctgtgctga

SEQ ID NO: 9099402 - DNA, 22 bp, Homo sapiens
cctgaggctggcccttccatcc

SEQ ID NO: 9099403 - DNA, 22 bp, Homo sapiens
cctgaggctggcccttccatcc

SEQ ID NO: 9099404 - DNA, 22 bp, Homo sapiens
cctgaggctcgcgcgcccctgg

SEQ ID NO: 9099405 - DNA, 22 bp, Homo sapiens
cctgaggctccacctccagaga

SEQ ID NO: 9099406 - DNA, 22 bp, Homo sapiens
cctgaggctccacctccagaga

SEQ ID NO: 9099407 - DNA, 22 bp, Homo sapiens
cctgaggcttaatctgtcccaa

SEQ ID NO: 9099408 - DNA, 22 bp, Homo sapiens
cctgaggcttgggagttccgcc

SEQ ID NO: 9099409 - DNA, 22 bp, Homo sapiens
cctgaggcttaatctgtcccaa

SEQ ID NO: 9099410 - DNA, 22 bp, Homo sapiens
cctgagggaaggatgctaccca

SEQ ID NO: 9099411 - DNA, 22 bp, Homo sapiens
cctgagggagggtataggctgt

SEQ ID NO: 9099412 - DNA, 22 bp, Homo sapiens
cctgaccacccttggacaaggt

SEQ ID NO: 9099413 - DNA, 19 bp, Homo sapiens
cctgaccagactttgcttc

SEQ ID NO: 9099414 - DNA, 23 bp, Homo sapiens
cctgaccctgtctccctcacatg

SEQ ID NO: 9099415 - DNA, 22 bp, Homo sapiens
cctgaccatttgccacatgggt

SEQ ID NO: 9099416 - DNA, 22 bp, Homo sapiens
cctgaccctttccagtgttggc

SEQ ID NO: 9099417 - DNA, 22 bp, Homo sapiens
cctgacaggagaagcgcagcat

SEQ ID NO: 9099418 - DNA, 21 bp, Homo sapiens
cctgaccaatacttgatcaaa

SEQ ID NO: 9099419 - DNA, 22 bp, Homo sapiens
cctgacaggcggaggctgcagt

SEQ ID NO: 9099420 - DNA, 22 bp, Homo sapiens
cctgagaagagcttatgagtga

SEQ ID NO: 9099421 - DNA, 22 bp, Homo sapiens
cctgagacatgaaccaggctcc

SEQ ID NO: 9099422 - DNA, 22 bp, Homo sapiens
cctgagacatgaaccaggctcc

SEQ ID NO: 9099423 - DNA, 22 bp, Homo sapiens
cctgagaatgtttaacagagaa

SEQ ID NO: 9099424 - DNA, 22 bp, Homo sapiens
cctgagaatgtttaacagagaa

SEQ ID NO: 9099425 - DNA, 22 bp, Homo sapiens
cctgagaatgtttaacagagaa

SEQ ID NO: 9099426 - DNA, 22 bp, Homo sapiens
cctgagaataattctccatagc

SEQ ID NO: 9099427 - DNA, 22 bp, Homo sapiens
cctgactctggccaggccagct

SEQ ID NO: 9099428 - DNA, 22 bp, Homo sapiens
cctgagaaacctggtgcaatta

SEQ ID NO: 9099429 - DNA, 22 bp, Homo sapiens
cctgagaaacctggtgcaatta

SEQ ID NO: 9099430 - DNA, 22 bp, Homo sapiens
tgggggtgtcctggtgcacaca

SEQ ID NO: 9099431 - DNA, 22 bp, Homo sapiens
tggggtaggagtcagcgagaga

SEQ ID NO: 9099432 - DNA, 22 bp, Homo sapiens
tggggtaggagtcagcgagaga

SEQ ID NO: 9099433 - DNA, 22 bp, Homo sapiens
tggggtagggaaaagaagtcga

SEQ ID NO: 9099434 - DNA, 22 bp, Homo sapiens
tggggtcagcaggcctggcctg

SEQ ID NO: 9099435 - DNA, 17 bp, Homo sapiens
tggggtccccgatggtg

SEQ ID NO: 9099436 - DNA, 21 bp, Homo sapiens
cctgagggtggttgtgaagat

SEQ ID NO: 9099437 - DNA, 22 bp, Homo sapiens
cctgccagagcagcttgtcctc

SEQ ID NO: 9099438 - DNA, 22 bp, Homo sapiens
cctgccaggagctggtgctgca

SEQ ID NO: 9099439 - DNA, 22 bp, Homo sapiens
cctgccaggccagtgagcttcc

SEQ ID NO: 9099440 - DNA, 22 bp, Homo sapiens
cctgccaggagctggtgctgca

SEQ ID NO: 9099441 - DNA, 22 bp, Homo sapiens
cctgcactacctggggctgctg

SEQ ID NO: 9099442 - DNA, 22 bp, Homo sapiens
cctgcaagagcggagaagccag

SEQ ID NO: 9099443 - DNA, 22 bp, Homo sapiens
cctgcaagactatttagttcca

SEQ ID NO: 9099444 - DNA, 22 bp, Homo sapiens
cctgcaagacctgagacacacc

SEQ ID NO: 9099445 - DNA, 22 bp, Homo sapiens
cctgcacatgtgtgcgcctgta

SEQ ID NO: 9099446 - DNA, 22 bp, Homo sapiens
cctgatgtccataatcctgtaa

SEQ ID NO: 9099447 - DNA, 22 bp, Homo sapiens
cctgattattgtaaatatattt

SEQ ID NO: 9099448 - DNA, 22 bp, Homo sapiens
tggggtcctctcacttggaggg

SEQ ID NO: 9099449 - DNA, 17 bp, Homo sapiens
tggggtccccgatggtg

SEQ ID NO: 9099450 - DNA, 20 bp, Homo sapiens
tggggtcctggaggggatcc

SEQ ID NO: 9099451 - DNA, 22 bp, Homo sapiens
tgggccactgctccaagtagct

SEQ ID NO: 9099452 - DNA, 22 bp, Homo sapiens
tgggccactgctgcggaaggcg

SEQ ID NO: 9099453 - DNA, 22 bp, Homo sapiens
tgggccactgctgcggaaggcg

SEQ ID NO: 9099454 - DNA, 22 bp, Homo sapiens
tgggccactcttccctgggtct

SEQ ID NO: 9099455 - DNA, 23 bp, Homo sapiens
tgggccactatagaaatctctca

SEQ ID NO: 9099456 - DNA, 22 bp, Homo sapiens
cctctggccattctttgatgga

SEQ ID NO: 9099457 - DNA, 22 bp, Homo sapiens
cctctggccattctttgatgga

SEQ ID NO: 9099458 - DNA, 22 bp, Homo sapiens
cctctggcctaggccgggagag

SEQ ID NO: 9099459 - DNA, 22 bp, Homo sapiens
cctctggcctaggccgggagag

SEQ ID NO: 9099460 - DNA, 22 bp, Homo sapiens
cctctggccacatgggacatag

SEQ ID NO: 9099461 - DNA, 22 bp, Homo sapiens
cctctggcatagcaagtggcct

SEQ ID NO: 9099462 - DNA, 22 bp, Homo sapiens
cctctggccacatgggacatag

SEQ ID NO: 9099463 - DNA, 22 bp, Homo sapiens
cctctggccatcccccattaag

SEQ ID NO: 9099464 - DNA, 22 bp, Homo sapiens
cctctggccagagaaaggccag

SEQ ID NO: 9099465 - DNA, 22 bp, Homo sapiens
tgggccagaggcatggagctat

SEQ ID NO: 9099466 - DNA, 21 bp, Homo sapiens
tgggccagatctgagtttcta

SEQ ID NO: 9099467 - DNA, 21 bp, Homo sapiens
tgggccagatctgagtttcta

SEQ ID NO: 9099468 - DNA, 18 bp, Homo sapiens
cctgaagcctgtgtcttt

SEQ ID NO: 9099469 - DNA, 22 bp, Homo sapiens
cctgaagcacccggagctggca

SEQ ID NO: 9099470 - DNA, 22 bp, Homo sapiens
cctgaagctcttaagaccttta

SEQ ID NO: 9099471 - DNA, 22 bp, Homo sapiens
cctgaaggaaactggaaataca

SEQ ID NO: 9099472 - DNA, 22 bp, Homo sapiens
cctgaagggactccagagagca

SEQ ID NO: 9099473 - DNA, 22 bp, Homo sapiens
cctctttgtgcctgcaggctgc

SEQ ID NO: 9099474 - DNA, 22 bp, Homo sapiens
cctctttgactctcaggtcttt

SEQ ID NO: 9099475 - DNA, 22 bp, Homo sapiens
cctctttgagattcagttttcc

SEQ ID NO: 9099476 - DNA, 22 bp, Homo sapiens
cctctttgttcaggctgctggc

SEQ ID NO: 9099477 - DNA, 22 bp, Homo sapiens
cctctttgtgcctgcaggctgc

SEQ ID NO: 9099478 - DNA, 22 bp, Homo sapiens
cctgaagcaagggtaggcaggt

SEQ ID NO: 9099479 - DNA, 22 bp, Homo sapiens
cctgaaaatcaaggtagtttgg

SEQ ID NO: 9099480 - DNA, 22 bp, Homo sapiens
cctgaagcaagggtaggcaggt

SEQ ID NO: 9099481 - DNA, 22 bp, Homo sapiens
cctgaagcacccggagctggca

SEQ ID NO: 9099482 - DNA, 22 bp, Homo sapiens
cctgaagcacaaaagcacagct

SEQ ID NO: 9099483 - DNA, 18 bp, Homo sapiens
cctgaagcctgtgtcttt

SEQ ID NO: 9099484 - DNA, 22 bp, Homo sapiens
cctcttgccaatcagctacaga

SEQ ID NO: 9099485 - DNA, 22 bp, Homo sapiens
cctcttgccaatcagctacaga

SEQ ID NO: 9099486 - DNA, 22 bp, Homo sapiens
cctctttgactatagtagttaa

SEQ ID NO: 9099487 - DNA, 22 bp, Homo sapiens
cctctttgacaagtacctgccc

SEQ ID NO: 9099488 - DNA, 22 bp, Homo sapiens
cctcttctgagtgagactccct

SEQ ID NO: 9099489 - DNA, 23 bp, Homo sapiens
tgggagctcaagggaggctgccc

SEQ ID NO: 9099490 - DNA, 22 bp, Homo sapiens
cctctggatctttctccacact

SEQ ID NO: 9099491 - DNA, 22 bp, Homo sapiens
cctctggcaacttcacagccca

SEQ ID NO: 9099492 - DNA, 22 bp, Homo sapiens
cctctggcaagtgatttatcat

SEQ ID NO: 9099493 - DNA, 22 bp, Homo sapiens
cctctggcaacttcacagccca

SEQ ID NO: 9099494 - DNA, 16 bp, Homo sapiens
cctctggcaattagat

SEQ ID NO: 9099495 - DNA, 22 bp, Homo sapiens
cctctggcatagcaagtggcct

SEQ ID NO: 9099496 - DNA, 22 bp, Homo sapiens
cctctggcatagcaagtggcct

SEQ ID NO: 9099497 - DNA, 22 bp, Homo sapiens
cctctggcagccagccagttgt

SEQ ID NO: 9099498 - DNA, 22 bp, Homo sapiens
cctctggcagccagccagttgt

SEQ ID NO: 9099499 - DNA, 22 bp, Homo sapiens
tgggagcagttcaggtgtggct

SEQ ID NO: 9099500 - DNA, 22 bp, Homo sapiens
tgggagcccaagggagctgccg

SEQ ID NO: 9099501 - DNA, 22 bp, Homo sapiens
tgggagcccaagggagctgccg

SEQ ID NO: 9099502 - DNA, 22 bp, Homo sapiens
tgggagccattttagaggctgc

SEQ ID NO: 9099503 - DNA, 22 bp, Homo sapiens
tgggagccattttagaggctgc

SEQ ID NO: 9099504 - DNA, 22 bp, Homo sapiens
tggctctccagctctaaggcct

SEQ ID NO: 9099505 - DNA, 22 bp, Homo sapiens
tggctctccagagcctatggta

SEQ ID NO: 9099506 - DNA, 22 bp, Homo sapiens
tggctctccagagcctatggta

SEQ ID NO: 9099507 - DNA, 23 bp, Homo sapiens
tggctctctcagtgctgcagagg

SEQ ID NO: 9099508 - DNA, 22 bp, Homo sapiens
tggctctcccaatacctttctg

SEQ ID NO: 9099509 - DNA, 22 bp, Homo sapiens
tggctctcaggcctgctgcgtt

SEQ ID NO: 9099510 - DNA, 23 bp, Homo sapiens
tggctctctcagtgctgcagagg

SEQ ID NO: 9099511 - DNA, 22 bp, Homo sapiens
tggctctctacaggtcaagacc

SEQ ID NO: 9099512 - DNA, 22 bp, Homo sapiens
cctccctgcgctcctgcggcgg

SEQ ID NO: 9099513 - DNA, 22 bp, Homo sapiens
tggctctcagctcccagcagcc

SEQ ID NO: 9099514 - DNA, 22 bp, Homo sapiens
tggctctcagctcccagcagcc

SEQ ID NO: 9099515 - DNA, 22 bp, Homo sapiens
tggctctcagctcccagcagcc

SEQ ID NO: 9099516 - DNA, 22 bp, Homo sapiens
tggctctcttgtaaggtagtag

SEQ ID NO: 9099517 - DNA, 22 bp, Homo sapiens
tggctctctgggaggtcctggc

SEQ ID NO: 9099518 - DNA, 20 bp, Homo sapiens
tggctctctctagtaagtgg

SEQ ID NO: 9099519 - DNA, 21 bp, Homo sapiens
tggctctgaaagagtgctgca

SEQ ID NO: 9099520 - DNA, 21 bp, Homo sapiens
tgggagagcgttgctgtcctc

SEQ ID NO: 9099521 - DNA, 21 bp, Homo sapiens
tgggagagcgttgctgtcctc

SEQ ID NO: 9099522 - DNA, 22 bp, Homo sapiens
cctgcctgtccctcagtccaca

SEQ ID NO: 9099523 - DNA, 20 bp, Homo sapiens
cctgcctgtgtttgtgatga

SEQ ID NO: 9099524 - DNA, 20 bp, Homo sapiens
cctgcctgtgtttgtgatga

SEQ ID NO: 9099525 - DNA, 22 bp, Homo sapiens
cctgcctgtaagatgggtacaa

SEQ ID NO: 9099526 - DNA, 22 bp, Homo sapiens
cctgcctgtaagatgggtacaa

SEQ ID NO: 9099527 - DNA, 22 bp, Homo sapiens
cctgcctgtactagagacccag

SEQ ID NO: 9099528 - DNA, 22 bp, Homo sapiens
cctgcctgtcatcgcctgcgcc

SEQ ID NO: 9099529 - DNA, 20 bp, Homo sapiens
cctgcctgcctcggctcatt

SEQ ID NO: 9099530 - DNA, 22 bp, Homo sapiens
cctgcctgggctcacttgccag

SEQ ID NO: 9099531 - DNA, 22 bp, Homo sapiens
cctgcctggtgtaagtctaagg

SEQ ID NO: 9099532 - DNA, 22 bp, Homo sapiens
cctgcctgggctcacttgccag

SEQ ID NO: 9099533 - DNA, 22 bp, Homo sapiens
cctgcctgggctcacttgccag

SEQ ID NO: 9099534 - DNA, 22 bp, Homo sapiens
tgggtcagaggacctcgtggcc

SEQ ID NO: 9099535 - DNA, 22 bp, Homo sapiens
tgggtatatatgttgctacaga

SEQ ID NO: 9099536 - DNA, 22 bp, Homo sapiens
tgggtcaaatggtaattctatg

SEQ ID NO: 9099537 - DNA, 22 bp, Homo sapiens
tgggtcagacagccagtgggcc

SEQ ID NO: 9099538 - DNA, 22 bp, Homo sapiens
cctgccaggcgagtctaggcca

SEQ ID NO: 9099539 - DNA, 22 bp, Homo sapiens
cctgccaggctttgggcttctg

SEQ ID NO: 9099540 - DNA, 22 bp, Homo sapiens
cctgccagggccagaggccagc

SEQ ID NO: 9099541 - DNA, 18 bp, Homo sapiens
cctgccagtctggagcag

SEQ ID NO: 9099542 - DNA, 18 bp, Homo sapiens
cctgccagtctggagcag

SEQ ID NO: 9099543 - DNA, 22 bp, Homo sapiens
cctgccagtcactatgtcacct

SEQ ID NO: 9099544 - DNA, 22 bp, Homo sapiens
cctgccagggccttggaagaaa

SEQ ID NO: 9099545 - DNA, 22 bp, Homo sapiens
cctgccagggccttggaagaaa

SEQ ID NO: 9099546 - DNA, 22 bp, Homo sapiens
cctgccagggccagaggccagc

SEQ ID NO: 9099547 - DNA, 22 bp, Homo sapiens
cctgctggccagtggagggctg

SEQ ID NO: 9099548 - DNA, 22 bp, Homo sapiens
cctgctgggcctgagcaatgag

SEQ ID NO: 9099549 - DNA, 22 bp, Homo sapiens
cctgctgggcctgagcaatgag

SEQ ID NO: 9099550 - DNA, 22 bp, Homo sapiens
cctgctgtcccctgagcctgga

SEQ ID NO: 9099551 - DNA, 22 bp, Homo sapiens
cctgctgtctctgggcaggcag

SEQ ID NO: 9099552 - DNA, 22 bp, Homo sapiens
cctgctgtgaaactggcatatg

SEQ ID NO: 9099553 - DNA, 22 bp, Homo sapiens
cctgctgtctgctgtgttaagc

SEQ ID NO: 9099554 - DNA, 22 bp, Homo sapiens
cctgctggacctcaacacattt

SEQ ID NO: 9099555 - DNA, 22 bp, Homo sapiens
cctgctggacaggggtgttcat

SEQ ID NO: 9099556 - DNA, 22 bp, Homo sapiens
cctgctgctatgaaggtgacag

SEQ ID NO: 9099557 - DNA, 22 bp, Homo sapiens
tggtctggggaccgagggttac

SEQ ID NO: 9099558 - DNA, 22 bp, Homo sapiens
tggtctgggcaaatccttctga

SEQ ID NO: 9099559 - DNA, 20 bp, Homo sapiens
tggtctggagccagtgagga

SEQ ID NO: 9099560 - DNA, 17 bp, Homo sapiens
tggtctggaagaactga

SEQ ID NO: 9099561 - DNA, 22 bp, Homo sapiens
tggtctgaggaacaccagcact

SEQ ID NO: 9099562 - DNA, 22 bp, Homo sapiens
cctgccttccagccttgggctc

SEQ ID NO: 9099563 - DNA, 22 bp, Homo sapiens
tggtctcttcttccaagatggc

SEQ ID NO: 9099564 - DNA, 22 bp, Homo sapiens
tggtctcttcttccaagatggc

SEQ ID NO: 9099565 - DNA, 22 bp, Homo sapiens
cctggaggcggaggttgcagtg

SEQ ID NO: 9099566 - DNA, 22 bp, Homo sapiens
cctggaggcggaggttgcagtg

SEQ ID NO: 9099567 - DNA, 22 bp, Homo sapiens
cctggaggcggaggttgcagtg

SEQ ID NO: 9099568 - DNA, 22 bp, Homo sapiens
cctggagggcgccgcacagtcc

SEQ ID NO: 9099569 - DNA, 22 bp, Homo sapiens
cctggagggcgccgcacagtcc

SEQ ID NO: 9099570 - DNA, 22 bp, Homo sapiens
cctggagggaccctggccctgt

SEQ ID NO: 9099571 - DNA, 18 bp, Homo sapiens
cctggagctccacagcaa

SEQ ID NO: 9099572 - DNA, 22 bp, Homo sapiens
cctggagcttttccagttgaca

SEQ ID NO: 9099573 - DNA, 22 bp, Homo sapiens
cctggagcttttccagttgaca

SEQ ID NO: 9099574 - DNA, 22 bp, Homo sapiens
cctggagcttggtcacgctgcg

SEQ ID NO: 9099575 - DNA, 22 bp, Homo sapiens
cctggagcttttccatcctgga

SEQ ID NO: 9099576 - DNA, 22 bp, Homo sapiens
cctggagcttttccatcctgga

SEQ ID NO: 9099577 - DNA, 22 bp, Homo sapiens
cctggagcttttccatcctgga

SEQ ID NO: 9099578 - DNA, 22 bp, Homo sapiens
cctggaggagcgctgaccagct

SEQ ID NO: 9099579 - DNA, 22 bp, Homo sapiens
cctggaggagcgctgaccagct

SEQ ID NO: 9099580 - DNA, 22 bp, Homo sapiens
cctggaggagcgctgaccagct

SEQ ID NO: 9099581 - DNA, 22 bp, Homo sapiens
cctggaggggaccaggaccagg

SEQ ID NO: 9099582 - DNA, 22 bp, Homo sapiens
cctggagggcgccgcacagtcc

SEQ ID NO: 9099583 - DNA, 19 bp, Homo sapiens
cctggaggtgaaggttctc

SEQ ID NO: 9099584 - DNA, 22 bp, Homo sapiens
tgtcaacaaaacggttcaaatg

SEQ ID NO: 9099585 - DNA, 22 bp, Homo sapiens
tgtcaacaaaacggttcaaatg

SEQ ID NO: 9099586 - DNA, 22 bp, Homo sapiens
tgtcaacaacagcattttctat

SEQ ID NO: 9099587 - DNA, 22 bp, Homo sapiens
tgtcaaattatgtaatgggaag

SEQ ID NO: 9099588 - DNA, 22 bp, Homo sapiens
tgtcaagagtagtttgaatagt

SEQ ID NO: 9099589 - DNA, 22 bp, Homo sapiens
tgtcaataacatttacttctat

SEQ ID NO: 9099590 - DNA, 22 bp, Homo sapiens
tgtcaataactggagtcattat

SEQ ID NO: 9099591 - DNA, 22 bp, Homo sapiens
tgtcaacacacctatctcaatt

SEQ ID NO: 9099592 - DNA, 22 bp, Homo sapiens
tgtcaaccaggtattttggtct

SEQ ID NO: 9099593 - DNA, 22 bp, Homo sapiens
tgtacatacatagatatacaca

SEQ ID NO: 9099594 - DNA, 22 bp, Homo sapiens
tgtaatttcctgatgttagaac

SEQ ID NO: 9099595 - DNA, 22 bp, Homo sapiens
tgtaattgctttgtaatgaaat

SEQ ID NO: 9099596 - DNA, 22 bp, Homo sapiens
tgtaattatttctgtgcagtca

SEQ ID NO: 9099597 - DNA, 22 bp, Homo sapiens
tgtacatacatagatatacaca

SEQ ID NO: 9099598 - DNA, 22 bp, Homo sapiens
tgtacatacatagatatacaca

SEQ ID NO: 9099599 - DNA, 22 bp, Homo sapiens
tgtacatagatcttgaaaatta

SEQ ID NO: 9099600 - DNA, 22 bp, Homo sapiens
tgtacatgtgtctgtatatctt

SEQ ID NO: 9099601 - DNA, 22 bp, Homo sapiens
cctggagcactctccctggctg

SEQ ID NO: 9099602 - DNA, 21 bp, Homo sapiens
tgtaagtttcatctgaattgg

SEQ ID NO: 9099603 - DNA, 22 bp, Homo sapiens
tgtaataccactgttggacatt

SEQ ID NO: 9099604 - DNA, 21 bp, Homo sapiens
tgtaagtttcatctgaattgg

SEQ ID NO: 9099605 - DNA, 22 bp, Homo sapiens
tgtaaagagaagaaacgtgagc

SEQ ID NO: 9099606 - DNA, 22 bp, Homo sapiens
cctggaaaacatgggaatcaca

SEQ ID NO: 9099607 - DNA, 22 bp, Homo sapiens
cctggaaaatgccactttcaca

SEQ ID NO: 9099608 - DNA, 22 bp, Homo sapiens
tgtaaagacagataaaacagca

SEQ ID NO: 9099609 - DNA, 22 bp, Homo sapiens
cctgctttggcaggcagctcct

SEQ ID NO: 9099610 - DNA, 22 bp, Homo sapiens
cctggaaaacatgggaatcaca

SEQ ID NO: 9099611 - DNA, 22 bp, Homo sapiens
cctgctttgagatgggcagcag

SEQ ID NO: 9099612 - DNA, 22 bp, Homo sapiens
cctgcttcagggatgatggcac

SEQ ID NO: 9099613 - DNA, 22 bp, Homo sapiens
cctgctttgagatgggcagcag

SEQ ID NO: 9099614 - DNA, 22 bp, Homo sapiens
cctgcttcagggatgatggcac

SEQ ID NO: 9099615 - DNA, 22 bp, Homo sapiens
ccagcccttgagatggaaggga

SEQ ID NO: 9099616 - DNA, 22 bp, Homo sapiens
ccagcccttgagatggaaggga

SEQ ID NO: 9099617 - DNA, 22 bp, Homo sapiens
ccagcccttgagatggaaggga

SEQ ID NO: 9099618 - DNA, 22 bp, Homo sapiens
ccagcccttgaggtctgtccat

SEQ ID NO: 9099619 - DNA, 22 bp, Homo sapiens
ccagcccttgaggtctgtccat

SEQ ID NO: 9099620 - DNA, 22 bp, Homo sapiens
ccagcccttgaggtctgtccat

SEQ ID NO: 9099621 - DNA, 22 bp, Homo sapiens
ccagcccttgagatggaaggga

SEQ ID NO: 9099622 - DNA, 22 bp, Homo sapiens
ccagcccttgctgaagggtggc

SEQ ID NO: 9099623 - DNA, 22 bp, Homo sapiens
ccagccctttgtggttcactga

SEQ ID NO: 9099624 - DNA, 22 bp, Homo sapiens
ccagccctttgtggttcactga

SEQ ID NO: 9099625 - DNA, 22 bp, Homo sapiens
ccagcccttgctgaagggtggc

SEQ ID NO: 9099626 - DNA, 22 bp, Homo sapiens
ccagcctcactggcatcaccta

SEQ ID NO: 9099627 - DNA, 22 bp, Homo sapiens
ccagccctttgtggttcactga

SEQ ID NO: 9099628 - DNA, 22 bp, Homo sapiens
tctgcagacactggggtctgga

SEQ ID NO: 9099629 - DNA, 22 bp, Homo sapiens
tctgcagaattcgaggaagaaa

SEQ ID NO: 9099630 - DNA, 22 bp, Homo sapiens
tctgcagagattctgggctgag

SEQ ID NO: 9099631 - DNA, 22 bp, Homo sapiens
tctgcagagattctgggctgag

SEQ ID NO: 9099632 - DNA, 22 bp, Homo sapiens
tctgcagagggagtgctgggtc

SEQ ID NO: 9099633 - DNA, 22 bp, Homo sapiens
tctttaaagttggagcttgcaa

SEQ ID NO: 9099634 - DNA, 22 bp, Homo sapiens
tcttgtcctaagagctggattc

SEQ ID NO: 9099635 - DNA, 22 bp, Homo sapiens
tcttgttatcaggaaaacagta

SEQ ID NO: 9099636 - DNA, 23 bp, Homo sapiens
tcttgtttcctttgcgctatcca

SEQ ID NO: 9099637 - DNA, 22 bp, Homo sapiens
tcttgggggactttggcatgga

SEQ ID NO: 9099638 - DNA, 22 bp, Homo sapiens
tcttgtatgtcttcatctggtt

SEQ ID NO: 9099639 - DNA, 22 bp, Homo sapiens
tcttgtaattaactagaaagat

SEQ ID NO: 9099640 - DNA, 22 bp, Homo sapiens
ccagcctcactggcatcaccta

SEQ ID NO: 9099641 - DNA, 22 bp, Homo sapiens
tctttaaggtgatttctgctac

SEQ ID NO: 9099642 - DNA, 22 bp, Homo sapiens
tctttaagggatgttctgcttt

SEQ ID NO: 9099643 - DNA, 22 bp, Homo sapiens
tctttaagccaagatatattta

SEQ ID NO: 9099644 - DNA, 22 bp, Homo sapiens
tctttatttctgaatcccccat

SEQ ID NO: 9099645 - DNA, 22 bp, Homo sapiens
tctttatttaagtctgttgtaa

SEQ ID NO: 9099646 - DNA, 22 bp, Homo sapiens
tctttatttaagtctgttgtaa

SEQ ID NO: 9099647 - DNA, 22 bp, Homo sapiens
tctttattttatgcttgtgcaa

SEQ ID NO: 9099648 - DNA, 19 bp, Homo sapiens
ccaggcctggcgtctccgc

SEQ ID NO: 9099649 - DNA, 22 bp, Homo sapiens
ccaggcgtggcttcagcagccc

SEQ ID NO: 9099650 - DNA, 19 bp, Homo sapiens
ccaggcctggcgtctccgc

SEQ ID NO: 9099651 - DNA, 22 bp, Homo sapiens
ccaggcctggccaggggatgcc

SEQ ID NO: 9099652 - DNA, 19 bp, Homo sapiens
ccaggcctggcgtctccgc

SEQ ID NO: 9099653 - DNA, 22 bp, Homo sapiens
ccaggctcagcgcgcacgtctg

SEQ ID NO: 9099654 - DNA, 22 bp, Homo sapiens
ccaggctcagcgcgcacgtctg

SEQ ID NO: 9099655 - DNA, 22 bp, Homo sapiens
ccaggctcagcgcgcacgtctg

SEQ ID NO: 9099656 - DNA, 22 bp, Homo sapiens
ccaggctcaggcctgctcgttg

SEQ ID NO: 9099657 - DNA, 17 bp, Homo sapiens
ccaggctccatcactgt

SEQ ID NO: 9099658 - DNA, 17 bp, Homo sapiens
ccaggctccatcactgt

SEQ ID NO: 9099659 - DNA, 22 bp, Homo sapiens
ccaggctcaggtgcgagagaca

SEQ ID NO: 9099660 - DNA, 22 bp, Homo sapiens
ccaggctcacagcatcccagga

SEQ ID NO: 9099661 - DNA, 22 bp, Homo sapiens
ccaggctcacctggagcccctg

SEQ ID NO: 9099662 - DNA, 22 bp, Homo sapiens
ccaggctcacagcatcccagga

SEQ ID NO: 9099663 - DNA, 22 bp, Homo sapiens
tgaaggaatgagtatactgttt

SEQ ID NO: 9099664 - DNA, 22 bp, Homo sapiens
tgaaggagaaatggaaagtggg

SEQ ID NO: 9099665 - DNA, 22 bp, Homo sapiens
tgaaggagaaatggaaagtggg

SEQ ID NO: 9099666 - DNA, 22 bp, Homo sapiens
tgaaggagaaatggaaagtggg

SEQ ID NO: 9099667 - DNA, 22 bp, Homo sapiens
tgaaggagaaatggaaagtggg

SEQ ID NO: 9099668 - DNA, 17 bp, Homo sapiens
tgaaggaaggatgatgt

SEQ ID NO: 9099669 - DNA, 22 bp, Homo sapiens
tgaaggaatgagggagtgggtc

SEQ ID NO: 9099670 - DNA, 22 bp, Homo sapiens
tgaagctttaggatgggttcat

SEQ ID NO: 9099671 - DNA, 22 bp, Homo sapiens
tgaagctttaggatgggttcat

SEQ ID NO: 9099672 - DNA, 22 bp, Homo sapiens
tgaaggaaagagggaacatccc

SEQ ID NO: 9099673 - DNA, 22 bp, Homo sapiens
tgaagatttccaccaaatcaca

SEQ ID NO: 9099674 - DNA, 22 bp, Homo sapiens
tgaagatcagttttgtgtctga

SEQ ID NO: 9099675 - DNA, 22 bp, Homo sapiens
tgaacagatggcccagcagagg

SEQ ID NO: 9099676 - DNA, 22 bp, Homo sapiens
tgaacagatggcccagcagagg

SEQ ID NO: 9099677 - DNA, 22 bp, Homo sapiens
tgaacagatcaatagaactgac

SEQ ID NO: 9099678 - DNA, 22 bp, Homo sapiens
tgaacagatcaatagaactgac

SEQ ID NO: 9099679 - DNA, 22 bp, Homo sapiens
tgaacagatggcccagcagagg

SEQ ID NO: 9099680 - DNA, 19 bp, Homo sapiens
tgaacagagaggactctgg

SEQ ID NO: 9099681 - DNA, 22 bp, Homo sapiens
tgaacactgtccagagccatta

SEQ ID NO: 9099682 - DNA, 22 bp, Homo sapiens
tgaagaggccgtgtgcaggtga

SEQ ID NO: 9099683 - DNA, 19 bp, Homo sapiens
tgaagagctgtcaaaagtg

SEQ ID NO: 9099684 - DNA, 19 bp, Homo sapiens
tgaagagctgtcaaaagtg

SEQ ID NO: 9099685 - DNA, 19 bp, Homo sapiens
tgaagagctgtcaaaagtg

SEQ ID NO: 9099686 - DNA, 20 bp, Homo sapiens
tgaagaggaagaggacggcc

SEQ ID NO: 9099687 - DNA, 22 bp, Homo sapiens
tgaagagatagaagtacatgct

SEQ ID NO: 9099688 - DNA, 22 bp, Homo sapiens
tgaaagcatatgctaaagacca

SEQ ID NO: 9099689 - DNA, 22 bp, Homo sapiens
tgaaagcagtgccatgattatg

SEQ ID NO: 9099690 - DNA, 22 bp, Homo sapiens
tgaaagcagtgatttctccttc

SEQ ID NO: 9099691 - DNA, 22 bp, Homo sapiens
tgaaagcaggcgggctacttta

SEQ ID NO: 9099692 - DNA, 22 bp, Homo sapiens
tgaaagcaggcgggctacttta

SEQ ID NO: 9099693 - DNA, 22 bp, Homo sapiens
tgaaagctgtacatgtggtaca

SEQ ID NO: 9099694 - DNA, 22 bp, Homo sapiens
tgaaagctgggcacaagattct

SEQ ID NO: 9099695 - DNA, 22 bp, Homo sapiens
tgaaagcttgttggaaatgtag

SEQ ID NO: 9099696 - DNA, 22 bp, Homo sapiens
tgaaagctgtccactaggctgt

SEQ ID NO: 9099697 - DNA, 22 bp, Homo sapiens
tgaaagctttgggacagtgtga

SEQ ID NO: 9099698 - DNA, 22 bp, Homo sapiens
tgaaagctttgggacagtgtga

SEQ ID NO: 9099699 - DNA, 22 bp, Homo sapiens
tgaaagcttgttggaaatgtag

SEQ ID NO: 9099700 - DNA, 22 bp, Homo sapiens
tgaaagcatgcttgccaagctt

SEQ ID NO: 9099701 - DNA, 20 bp, Homo sapiens
tgaaagcatgtggtatttgg

SEQ ID NO: 9099702 - DNA, 22 bp, Homo sapiens
tgaaagctgcccagtggaatta

SEQ ID NO: 9099703 - DNA, 22 bp, Homo sapiens
ccaggctccccaggaggccctt

SEQ ID NO: 9099704 - DNA, 22 bp, Homo sapiens
ccaggctccgcatagaccccac

SEQ ID NO: 9099705 - DNA, 22 bp, Homo sapiens
tgaaagcactgattctcaactc

SEQ ID NO: 9099706 - DNA, 22 bp, Homo sapiens
tgaaagcagatagctctgttgt

SEQ ID NO: 9099707 - DNA, 22 bp, Homo sapiens
tgaaagcagatagctctgttgt

SEQ ID NO: 9099708 - DNA, 22 bp, Homo sapiens
tgaaagcagatagctctgttgt

SEQ ID NO: 9099709 - DNA, 22 bp, Homo sapiens
tgaaagcagcaccaataccatt

SEQ ID NO: 9099710 - DNA, 22 bp, Homo sapiens
tgaaagcagcaccaataccatt

SEQ ID NO: 9099711 - DNA, 22 bp, Homo sapiens
ccaggctgagcatgattggagc

SEQ ID NO: 9099712 - DNA, 22 bp, Homo sapiens
ccaggctgcagtcaaggggcat

SEQ ID NO: 9099713 - DNA, 22 bp, Homo sapiens
tgaaaggaaagtacagtgatgc

SEQ ID NO: 9099714 - DNA, 22 bp, Homo sapiens
ccaggctgagcatgattggagc

SEQ ID NO: 9099715 - DNA, 22 bp, Homo sapiens
ccaggctgccgaggaaagaaag

SEQ ID NO: 9099716 - DNA, 22 bp, Homo sapiens
ccaggctgccgaggaaagaaag

SEQ ID NO: 9099717 - DNA, 22 bp, Homo sapiens
ccaggctgcagtcaaggggcat

SEQ ID NO: 9099718 - DNA, 22 bp, Homo sapiens
ccaggctgcagtcaaggggcat

SEQ ID NO: 9099719 - DNA, 22 bp, Homo sapiens
ccaggctgctcacaagctgccc

SEQ ID NO: 9099720 - DNA, 22 bp, Homo sapiens
ccaggctgctcacaagctgccc

SEQ ID NO: 9099721 - DNA, 22 bp, Homo sapiens
ccaggctgctcacaagctgccc

SEQ ID NO: 9099722 - DNA, 22 bp, Homo sapiens
ccaggctgctcacaagctgccc

SEQ ID NO: 9099723 - DNA, 22 bp, Homo sapiens
tgaacacagcatattttgttac

SEQ ID NO: 9099724 - DNA, 22 bp, Homo sapiens
tgagaaaacagtttgtaataat

SEQ ID NO: 9099725 - DNA, 22 bp, Homo sapiens
tgagaaaacagtttgtaataat

SEQ ID NO: 9099726 - DNA, 22 bp, Homo sapiens
tgactttggataagaaaatgag

SEQ ID NO: 9099727 - DNA, 22 bp, Homo sapiens
tgagaaaactcaaagacagatc

SEQ ID NO: 9099728 - DNA, 22 bp, Homo sapiens
ccagggtctctgctgcctgaga

SEQ ID NO: 9099729 - DNA, 22 bp, Homo sapiens
tgaccctgcttcttggtgcagg

SEQ ID NO: 9099730 - DNA, 22 bp, Homo sapiens
tgaccccactgtgctcagaggt

SEQ ID NO: 9099731 - DNA, 19 bp, Homo sapiens
tgaccccacgctccagagc

SEQ ID NO: 9099732 - DNA, 22 bp, Homo sapiens
tgaccccactgtgctcagaggt

SEQ ID NO: 9099733 - DNA, 19 bp, Homo sapiens
tgaccccacgctccagagc

SEQ ID NO: 9099734 - DNA, 22 bp, Homo sapiens
tgaccccactgtgctcagaggt

SEQ ID NO: 9099735 - DNA, 21 bp, Homo sapiens
tgactttatttgacagcccag

SEQ ID NO: 9099736 - DNA, 22 bp, Homo sapiens
tgactttccattctcacacagt

SEQ ID NO: 9099737 - DNA, 22 bp, Homo sapiens
ccagggcccacggccagaatag

SEQ ID NO: 9099738 - DNA, 22 bp, Homo sapiens
tgaccaaagagttgcttgtatt

SEQ ID NO: 9099739 - DNA, 22 bp, Homo sapiens
tgaccaatactgtggatgccag

SEQ ID NO: 9099740 - DNA, 22 bp, Homo sapiens
tgacagagtgacactcttgtct

SEQ ID NO: 9099741 - DNA, 22 bp, Homo sapiens
tgacagagtcggggcaagctgt

SEQ ID NO: 9099742 - DNA, 22 bp, Homo sapiens
tgacagagtcggggcaagctgt

SEQ ID NO: 9099743 - DNA, 22 bp, Homo sapiens
tgacagaggctgagttagtctg

SEQ ID NO: 9099744 - DNA, 22 bp, Homo sapiens
ccagggccaagagacctcgagg

SEQ ID NO: 9099745 - DNA, 23 bp, Homo sapiens
tgacagagcacagtgggggagat

SEQ ID NO: 9099746 - DNA, 23 bp, Homo sapiens
tgacagagcaagacttggtctca

SEQ ID NO: 9099747 - DNA, 22 bp, Homo sapiens
tgacagagaggtaagttatgaa

SEQ ID NO: 9099748 - DNA, 22 bp, Homo sapiens
tgacagaggagctggaatgatt

SEQ ID NO: 9099749 - DNA, 22 bp, Homo sapiens
tgacagagctgggatttgaagc

SEQ ID NO: 9099750 - DNA, 22 bp, Homo sapiens
tgacagagcatgtagtgacagc

SEQ ID NO: 9099751 - DNA, 22 bp, Homo sapiens
tgaaggagaattaataggcatt

SEQ ID NO: 9099752 - DNA, 21 bp, Homo sapiens
tgaaggagaggaccgagtgct

SEQ ID NO: 9099753 - DNA, 21 bp, Homo sapiens
tgaaggagaggaccgagtgct

SEQ ID NO: 9099754 - DNA, 22 bp, Homo sapiens
tgaaggagaattaataggcatt

SEQ ID NO: 9099755 - DNA, 22 bp, Homo sapiens
ccaggcttggtgtgtggtcagg

SEQ ID NO: 9099756 - DNA, 22 bp, Homo sapiens
ccaggctttaagaggtggaaac

SEQ ID NO: 9099757 - DNA, 19 bp, Homo sapiens
ccaggctttatgcaaatac

SEQ ID NO: 9099758 - DNA, 22 bp, Homo sapiens
ccagggaaaatcaacttctact

SEQ ID NO: 9099759 - DNA, 22 bp, Homo sapiens
ccagggaaacagcccagtgtga

SEQ ID NO: 9099760 - DNA, 22 bp, Homo sapiens
ccaggctttgtaccaggctttc

SEQ ID NO: 9099761 - DNA, 22 bp, Homo sapiens
ccaggcttttagctgcatggca

SEQ ID NO: 9099762 - DNA, 22 bp, Homo sapiens
tgacagagacttcagagccaaa

SEQ ID NO: 9099763 - DNA, 22 bp, Homo sapiens
tgacagagacagattgaagctt

SEQ ID NO: 9099764 - DNA, 22 bp, Homo sapiens
tgacaattgcagacacagaagt

SEQ ID NO: 9099765 - DNA, 21 bp, Homo sapiens
ccagggaagaaatgagggcag

SEQ ID NO: 9099766 - DNA, 22 bp, Homo sapiens
ccagggaaattaatgagttaat

SEQ ID NO: 9099767 - DNA, 22 bp, Homo sapiens
tgagagtgaaatgtcacatgtc

SEQ ID NO: 9099768 - DNA, 18 bp, Homo sapiens
tgagagtgtgtgctcttg

SEQ ID NO: 9099769 - DNA, 22 bp, Homo sapiens
ccaggtctatcaagttgggctc

SEQ ID NO: 9099770 - DNA, 22 bp, Homo sapiens
tgagaggtgaggcatgaggcat

SEQ ID NO: 9099771 - DNA, 19 bp, Homo sapiens
tgagactgggtgcagtact

SEQ ID NO: 9099772 - DNA, 22 bp, Homo sapiens
tgagataataaatagctttctt

SEQ ID NO: 9099773 - DNA, 22 bp, Homo sapiens
tgagataaggatgttatactcg

SEQ ID NO: 9099774 - DNA, 22 bp, Homo sapiens
tgagataactctgatttatgtt

SEQ ID NO: 9099775 - DNA, 21 bp, Homo sapiens
tgagataaatttccttactac

SEQ ID NO: 9099776 - DNA, 22 bp, Homo sapiens
tgagataacaaaattatcttca

SEQ ID NO: 9099777 - DNA, 22 bp, Homo sapiens
ccagggtgtgggcgtcggcacg

SEQ ID NO: 9099778 - DNA, 22 bp, Homo sapiens
ccagggtggggtccaggaacca

SEQ ID NO: 9099779 - DNA, 22 bp, Homo sapiens
ccagggtggggtccaggaacca

SEQ ID NO: 9099780 - DNA, 22 bp, Homo sapiens
ccagggtgtagggattccagat

SEQ ID NO: 9099781 - DNA, 22 bp, Homo sapiens
ccagggtgtgagaaggaagtag

SEQ ID NO: 9099782 - DNA, 22 bp, Homo sapiens
ccagggtgtgggcgtcggcacg

SEQ ID NO: 9099783 - DNA, 22 bp, Homo sapiens
ccagggtgggaggctgaaggcg

SEQ ID NO: 9099784 - DNA, 22 bp, Homo sapiens
ccagggtgggaggctgaaggcg

SEQ ID NO: 9099785 - DNA, 22 bp, Homo sapiens
ccagggtggcgtagatgctggg

SEQ ID NO: 9099786 - DNA, 22 bp, Homo sapiens
ccagggtggggcaggcccactg

SEQ ID NO: 9099787 - DNA, 22 bp, Homo sapiens
ccagggtgggaggctgaaggcg

SEQ ID NO: 9099788 - DNA, 22 bp, Homo sapiens
tgagcagacttgatgaggcagc

SEQ ID NO: 9099789 - DNA, 22 bp, Homo sapiens
tgagcagaaaagaatgctgagc

SEQ ID NO: 9099790 - DNA, 22 bp, Homo sapiens
tgagcactttaaaatattccca

SEQ ID NO: 9099791 - DNA, 22 bp, Homo sapiens
tgagcacttttcaaagagagct

SEQ ID NO: 9099792 - DNA, 22 bp, Homo sapiens
tgagcccaggagttggaggctg

SEQ ID NO: 9099793 - DNA, 22 bp, Homo sapiens
tgagctggcacttttcctggga

SEQ ID NO: 9099794 - DNA, 22 bp, Homo sapiens
tgagctggcaggggctcaggga

SEQ ID NO: 9099795 - DNA, 22 bp, Homo sapiens
tgagctggcaggggctcaggga

SEQ ID NO: 9099796 - DNA, 19 bp, Homo sapiens
tgagctggctgagcctctc

SEQ ID NO: 9099797 - DNA, 22 bp, Homo sapiens
tgagctggcttgtcaaccaggg

SEQ ID NO: 9099798 - DNA, 22 bp, Homo sapiens
tgagctgggaagagcagccaga

SEQ ID NO: 9099799 - DNA, 22 bp, Homo sapiens
tgagctgggaagagcagccaga

SEQ ID NO: 9099800 - DNA, 22 bp, Homo sapiens
tgagctggcttgtcaaccaggg

SEQ ID NO: 9099801 - DNA, 19 bp, Homo sapiens
tgagctggctgagcctctc

SEQ ID NO: 9099802 - DNA, 19 bp, Homo sapiens
tgagctggctgagcctctc

SEQ ID NO: 9099803 - DNA, 21 bp, Homo sapiens
tgagctgggagttctgaaaag

SEQ ID NO: 9099804 - DNA, 22 bp, Homo sapiens
tgagctgggagtggtgatgagg

SEQ ID NO: 9099805 - DNA, 22 bp, Homo sapiens
tgagctgggaagagcagccaga

SEQ ID NO: 9099806 - DNA, 22 bp, Homo sapiens
tgagctgggaagagcagccaga

SEQ ID NO: 9099807 - DNA, 22 bp, Homo sapiens
tgaggaatgttttgagtgccga

SEQ ID NO: 9099808 - DNA, 22 bp, Homo sapiens
tgaggaatgctgagcagaggaa

SEQ ID NO: 9099809 - DNA, 22 bp, Homo sapiens
tgaggaagttgtttctcttcta

SEQ ID NO: 9099810 - DNA, 23 bp, Homo sapiens
tgagctggtattgtccatctcca

SEQ ID NO: 9099811 - DNA, 23 bp, Homo sapiens
tgagctggtattgtccatctcca

SEQ ID NO: 9099812 - DNA, 23 bp, Homo sapiens
tgagctgggcctgcaggggtctc

SEQ ID NO: 9099813 - DNA, 22 bp, Homo sapiens
tgagctgggctgggctgagctg

SEQ ID NO: 9099814 - DNA, 22 bp, Homo sapiens
tgagctgggctgggctgagctg

SEQ ID NO: 9099815 - DNA, 22 bp, Homo sapiens
tgagctgggctgggctgagctg

SEQ ID NO: 9099816 - DNA, 22 bp, Homo sapiens
tgagctgggctgggctgagctg

SEQ ID NO: 9099817 - DNA, 22 bp, Homo sapiens
tgagctgggctgggctgagctg

SEQ ID NO: 9099818 - DNA, 22 bp, Homo sapiens
tgaggacattggtcaggacatg

SEQ ID NO: 9099819 - DNA, 22 bp, Homo sapiens
ccagtgtggccaggtgctggta

SEQ ID NO: 9099820 - DNA, 22 bp, Homo sapiens
ccagtgtggactctctcctttg

SEQ ID NO: 9099821 - DNA, 22 bp, Homo sapiens
tgaggacattaggaagtgaagg

SEQ ID NO: 9099822 - DNA, 22 bp, Homo sapiens
tgaggacattgagactggagac

SEQ ID NO: 9099823 - DNA, 22 bp, Homo sapiens
tgaggacatgagtgggacagag

SEQ ID NO: 9099824 - DNA, 22 bp, Homo sapiens
tgaggacatgagtgggacagag

SEQ ID NO: 9099825 - DNA, 22 bp, Homo sapiens
cccagcccagcgttcgaggggt

SEQ ID NO: 9099826 - DNA, 22 bp, Homo sapiens
cccagcccagcgttcgaggggt

SEQ ID NO: 9099827 - DNA, 22 bp, Homo sapiens
cccagcccagcgttcgaggggt

SEQ ID NO: 9099828 - DNA, 22 bp, Homo sapiens
cccagcccacggtcctgggtgg

SEQ ID NO: 9099829 - DNA, 22 bp, Homo sapiens
cccagcccacggtcctgggtgg

SEQ ID NO: 9099830 - DNA, 22 bp, Homo sapiens
cccagcccacggtcctgggtgg

SEQ ID NO: 9099831 - DNA, 22 bp, Homo sapiens
cccagcccacggtcctgggtgg

SEQ ID NO: 9099832 - DNA, 18 bp, Homo sapiens
cccagcccaccatttctc

SEQ ID NO: 9099833 - DNA, 18 bp, Homo sapiens
cccagcccaccatttctc

SEQ ID NO: 9099834 - DNA, 18 bp, Homo sapiens
cccagcccaccatttctc

SEQ ID NO: 9099835 - DNA, 19 bp, Homo sapiens
cccagccaggtcttgcatc

SEQ ID NO: 9099836 - DNA, 20 bp, Homo sapiens
cccagcccctacctgttgcc

SEQ ID NO: 9099837 - DNA, 20 bp, Homo sapiens
cccagcccctacctgttgcc

SEQ ID NO: 9099838 - DNA, 22 bp, Homo sapiens
cccagccctgacctattggaaa

SEQ ID NO: 9099839 - DNA, 20 bp, Homo sapiens
cccagcccgggccgcgctcg

SEQ ID NO: 9099840 - DNA, 20 bp, Homo sapiens
cccagcccgggccgcgctcg

SEQ ID NO: 9099841 - DNA, 22 bp, Homo sapiens
cccagcccccgagtgtctggaa

SEQ ID NO: 9099842 - DNA, 22 bp, Homo sapiens
cccagcccccgagtgtctggaa

SEQ ID NO: 9099843 - DNA, 22 bp, Homo sapiens
cccagcccatctcaaaggtcta

SEQ ID NO: 9099844 - DNA, 22 bp, Homo sapiens
cccagcccatctcaaaggtcta

SEQ ID NO: 9099845 - DNA, 22 bp, Homo sapiens
cccagcccatctcaaaggtcta

SEQ ID NO: 9099846 - DNA, 22 bp, Homo sapiens
cccagcatgcacgctgacactc

SEQ ID NO: 9099847 - DNA, 22 bp, Homo sapiens
cccagcatggagtgaggactca

SEQ ID NO: 9099848 - DNA, 22 bp, Homo sapiens
cccagcatggagtgaggactca

SEQ ID NO: 9099849 - DNA, 22 bp, Homo sapiens
cccagcatctccaggcatggcc

SEQ ID NO: 9099850 - DNA, 22 bp, Homo sapiens
cccagcatctccaggcatggcc

SEQ ID NO: 9099851 - DNA, 22 bp, Homo sapiens
cccagccagcctcttcccatat

SEQ ID NO: 9099852 - DNA, 22 bp, Homo sapiens
cccagccagcctcttcccatat

SEQ ID NO: 9099853 - DNA, 22 bp, Homo sapiens
cccagccaagtgatctgaccgc

SEQ ID NO: 9099854 - DNA, 22 bp, Homo sapiens
cccagcatttctgggctgcact

SEQ ID NO: 9099855 - DNA, 22 bp, Homo sapiens
cccagcatttctgggctgcact

SEQ ID NO: 9099856 - DNA, 22 bp, Homo sapiens
cccagccaaggtgctggtgttg

SEQ ID NO: 9099857 - DNA, 22 bp, Homo sapiens
cccagccaaggtgctggtgttg

SEQ ID NO: 9099858 - DNA, 17 bp, Homo sapiens
tgcagcagttcccatct

SEQ ID NO: 9099859 - DNA, 17 bp, Homo sapiens
tgcagcagttcccatct

SEQ ID NO: 9099860 - DNA, 22 bp, Homo sapiens
tgcagcagtgttccttggcttg

SEQ ID NO: 9099861 - DNA, 22 bp, Homo sapiens
tgcagcagtttaatgcagggtt

SEQ ID NO: 9099862 - DNA, 22 bp, Homo sapiens
tgcagcatttgctgaagcagga

SEQ ID NO: 9099863 - DNA, 22 bp, Homo sapiens
tgcagcattgcaaagcagtctt

SEQ ID NO: 9099864 - DNA, 22 bp, Homo sapiens
tgcagcatttgctgaagcagga

SEQ ID NO: 9099865 - DNA, 22 bp, Homo sapiens
cccagcaggtgccatcactctg

SEQ ID NO: 9099866 - DNA, 22 bp, Homo sapiens
tgcagcattatgtagctgtttt

SEQ ID NO: 9099867 - DNA, 18 bp, Homo sapiens
tgcagcatgttcccataa

SEQ ID NO: 9099868 - DNA, 22 bp, Homo sapiens
tgcagtggaaagactcagactt

SEQ ID NO: 9099869 - DNA, 22 bp, Homo sapiens
tgcagtggaaagactcagactt

SEQ ID NO: 9099870 - DNA, 22 bp, Homo sapiens
tgcagtgcctcggcagtgcagc

SEQ ID NO: 9099871 - DNA, 22 bp, Homo sapiens
tgcagtgcctcggcagtgcagc

SEQ ID NO: 9099872 - DNA, 22 bp, Homo sapiens
tgcagtgatttgtacaattaga

SEQ ID NO: 9099873 - DNA, 22 bp, Homo sapiens
tgcagtgattaaagtgttaaat

SEQ ID NO: 9099874 - DNA, 22 bp, Homo sapiens
tgcagtgatgcttctggctcag

SEQ ID NO: 9099875 - DNA, 21 bp, Homo sapiens
tgcagtgaggggagctgtcag

SEQ ID NO: 9099876 - DNA, 22 bp, Homo sapiens
tgcagtcttccagctgcacaaa

SEQ ID NO: 9099877 - DNA, 22 bp, Homo sapiens
tgcagtgaggcagttgggttgg

SEQ ID NO: 9099878 - DNA, 22 bp, Homo sapiens
tgcagtgagaagcagttatgat

SEQ ID NO: 9099879 - DNA, 22 bp, Homo sapiens
tgcagtgaaagtatcttaattt

SEQ ID NO: 9099880 - DNA, 22 bp, Homo sapiens
cccagccctgacctattggaaa

SEQ ID NO: 9099881 - DNA, 22 bp, Homo sapiens
tgcaggtgctgtgtcaagagag

SEQ ID NO: 9099882 - DNA, 22 bp, Homo sapiens
tgcagtggaatctggagagcag

SEQ ID NO: 9099883 - DNA, 22 bp, Homo sapiens
tgcagtggaagaggtggagatc

SEQ ID NO: 9099884 - DNA, 22 bp, Homo sapiens
tgcagtggaagaggtggagatc

SEQ ID NO: 9099885 - DNA, 22 bp, Homo sapiens
tgcagtggaagaggtggagatc

SEQ ID NO: 9099886 - DNA, 22 bp, Homo sapiens
tgcagtggaggccgtgagacag

SEQ ID NO: 9099887 - DNA, 22 bp, Homo sapiens
tgcagtggaggccgtgagacag

SEQ ID NO: 9099888 - DNA, 22 bp, Homo sapiens
cccagctcatcaggagccgccc

SEQ ID NO: 9099889 - DNA, 22 bp, Homo sapiens
cccagctccaagggacagcgaa

SEQ ID NO: 9099890 - DNA, 22 bp, Homo sapiens
cccagctcatcaggagccgccc

SEQ ID NO: 9099891 - DNA, 22 bp, Homo sapiens
cccagctcaagcagagagctaa

SEQ ID NO: 9099892 - DNA, 22 bp, Homo sapiens
cccagctcaagcagagagctaa

SEQ ID NO: 9099893 - DNA, 22 bp, Homo sapiens
cccaggagaatataatgttctt

SEQ ID NO: 9099894 - DNA, 21 bp, Homo sapiens
cccaggagaagaaaagatgca

SEQ ID NO: 9099895 - DNA, 22 bp, Homo sapiens
cccaggactctgacacccccaa

SEQ ID NO: 9099896 - DNA, 22 bp, Homo sapiens
cccaggactcttcactgcagcc

SEQ ID NO: 9099897 - DNA, 22 bp, Homo sapiens
cccaggactaatgagctctacg

SEQ ID NO: 9099898 - DNA, 22 bp, Homo sapiens
cccaggactcggcactctcctt

SEQ ID NO: 9099899 - DNA, 22 bp, Homo sapiens
cccaggaccatccttctgtgcc

SEQ ID NO: 9099900 - DNA, 18 bp, Homo sapiens
cccagctccacttccctc

SEQ ID NO: 9099901 - DNA, 22 bp, Homo sapiens
cccagctccagagccagaaaca

SEQ ID NO: 9099902 - DNA, 22 bp, Homo sapiens
cccagctccgagctccgagccg

SEQ ID NO: 9099903 - DNA, 22 bp, Homo sapiens
cccaggaattggaggctgcagt

SEQ ID NO: 9099904 - DNA, 22 bp, Homo sapiens
tgccctcattataagaggctca

SEQ ID NO: 9099905 - DNA, 22 bp, Homo sapiens
tgccctccacagtggctccacc

SEQ ID NO: 9099906 - DNA, 23 bp, Homo sapiens
tgccctcccaatgcttcggtcac

SEQ ID NO: 9099907 - DNA, 22 bp, Homo sapiens
tgccctcccacattatggctgt

SEQ ID NO: 9099908 - DNA, 22 bp, Homo sapiens
tgccctcttaggtctgcgcagc

SEQ ID NO: 9099909 - DNA, 22 bp, Homo sapiens
tgccctcttaggtctgcgcagc

SEQ ID NO: 9099910 - DNA, 22 bp, Homo sapiens
tgccctctgcctcctctgcaga

SEQ ID NO: 9099911 - DNA, 22 bp, Homo sapiens
tgccctctcaagttgagtcaga

SEQ ID NO: 9099912 - DNA, 22 bp, Homo sapiens
tgccctcagccacctccaagtt

SEQ ID NO: 9099913 - DNA, 22 bp, Homo sapiens
tgccctcagcagcagctcctgc

SEQ ID NO: 9099914 - DNA, 22 bp, Homo sapiens
tgccctcagaattgctccctgc

SEQ ID NO: 9099915 - DNA, 21 bp, Homo sapiens
cccaggaggctgagaagagca

SEQ ID NO: 9099916 - DNA, 22 bp, Homo sapiens
tgcccagcttcttacttttaaa

SEQ ID NO: 9099917 - DNA, 21 bp, Homo sapiens
cccaggaggctgagaagagca

SEQ ID NO: 9099918 - DNA, 22 bp, Homo sapiens
cccaggaggcggaggttgcagt

SEQ ID NO: 9099919 - DNA, 22 bp, Homo sapiens
cccaggaggcggaggttgcagt

SEQ ID NO: 9099920 - DNA, 23 bp, Homo sapiens
tgcctcagtggaatgtgagggtg

SEQ ID NO: 9099921 - DNA, 23 bp, Homo sapiens
tgcctcagtggaatgtgagggtg

SEQ ID NO: 9099922 - DNA, 22 bp, Homo sapiens
tgcctcagtctaaagtctctca

SEQ ID NO: 9099923 - DNA, 22 bp, Homo sapiens
tgcctcagtctaaagtctctca

SEQ ID NO: 9099924 - DNA, 20 bp, Homo sapiens
cccaggagtgagcagcttta

SEQ ID NO: 9099925 - DNA, 22 bp, Homo sapiens
tgccctggttacactggagtcc

SEQ ID NO: 9099926 - DNA, 22 bp, Homo sapiens
tgccctggttacactggagtcc

SEQ ID NO: 9099927 - DNA, 20 bp, Homo sapiens
cccaggagtgagcagcttta

SEQ ID NO: 9099928 - DNA, 21 bp, Homo sapiens
cccaggagtcctatttaaatg

SEQ ID NO: 9099929 - DNA, 22 bp, Homo sapiens
cccaggaggttggggctacagt

SEQ ID NO: 9099930 - DNA, 22 bp, Homo sapiens
cccaggaggttgaggctgcagt

SEQ ID NO: 9099931 - DNA, 22 bp, Homo sapiens
tgccctgatgatcctcctcgca

SEQ ID NO: 9099932 - DNA, 22 bp, Homo sapiens
tgccctgaagcaccctcaccct

SEQ ID NO: 9099933 - DNA, 22 bp, Homo sapiens
tgccctctttctgtacagctcc

SEQ ID NO: 9099934 - DNA, 22 bp, Homo sapiens
cccaggaggttgaggctgcagt

SEQ ID NO: 9099935 - DNA, 22 bp, Homo sapiens
tgcatattttctgattcagaag

SEQ ID NO: 9099936 - DNA, 22 bp, Homo sapiens
cccaggagataacgttcccaag

SEQ ID NO: 9099937 - DNA, 21 bp, Homo sapiens
cccaggaggagctccggctcc

SEQ ID NO: 9099938 - DNA, 22 bp, Homo sapiens
tgcatatttgattgagatacct

SEQ ID NO: 9099939 - DNA, 22 bp, Homo sapiens
tgcatatttgtatgatgtttag

SEQ ID NO: 9099940 - DNA, 22 bp, Homo sapiens
tgcatatttgattgagatacct

SEQ ID NO: 9099941 - DNA, 22 bp, Homo sapiens
tgcatattttataaagatggaa

SEQ ID NO: 9099942 - DNA, 22 bp, Homo sapiens
tgcatattttataaagatggaa

SEQ ID NO: 9099943 - DNA, 21 bp, Homo sapiens
tgcatattcttctggtggctg

SEQ ID NO: 9099944 - DNA, 22 bp, Homo sapiens
tgcatattgtccttgatattat

SEQ ID NO: 9099945 - DNA, 22 bp, Homo sapiens
tgcatattgtccttgatattat

SEQ ID NO: 9099946 - DNA, 22 bp, Homo sapiens
tgcatattgtccttgatattat

SEQ ID NO: 9099947 - DNA, 22 bp, Homo sapiens
tgcatattgtgaaaatgtagat

SEQ ID NO: 9099948 - DNA, 22 bp, Homo sapiens
tgcatattgtgaaaatgtagat

SEQ ID NO: 9099949 - DNA, 22 bp, Homo sapiens
tgcatatatcttatttttctgt

SEQ ID NO: 9099950 - DNA, 22 bp, Homo sapiens
tgcatatatcttatttttctgt

SEQ ID NO: 9099951 - DNA, 22 bp, Homo sapiens
tgcatatatcttatttttctgt

SEQ ID NO: 9099952 - DNA, 22 bp, Homo sapiens
tgcatatatcttatttttctgt

SEQ ID NO: 9099953 - DNA, 22 bp, Homo sapiens
tgcatattctcctttattttgt

SEQ ID NO: 9099954 - DNA, 22 bp, Homo sapiens
tgcatattctcctttattttgt

SEQ ID NO: 9099955 - DNA, 22 bp, Homo sapiens
tgcatattatgtgtatctgtct

SEQ ID NO: 9099956 - DNA, 22 bp, Homo sapiens
tgcatattataaagagaattag

SEQ ID NO: 9099957 - DNA, 22 bp, Homo sapiens
tgcatattatgtgtatctgtct

SEQ ID NO: 9099958 - DNA, 22 bp, Homo sapiens
tgcatattataaagagaattag

SEQ ID NO: 9099959 - DNA, 19 bp, Homo sapiens
tgcatatatctatgaaaga

SEQ ID NO: 9099960 - DNA, 22 bp, Homo sapiens
tgcatatccacaccttatctct

SEQ ID NO: 9099961 - DNA, 22 bp, Homo sapiens
cccaggagacagaaacagaggt

SEQ ID NO: 9099962 - DNA, 22 bp, Homo sapiens
cccaggagacagaaacagaggt

SEQ ID NO: 9099963 - DNA, 21 bp, Homo sapiens
tgcatatataagtgcatacac

SEQ ID NO: 9099964 - DNA, 22 bp, Homo sapiens
cccaggaggcagaagttgcagt

SEQ ID NO: 9099965 - DNA, 22 bp, Homo sapiens
cccaggaggcagaagttgcagt

SEQ ID NO: 9099966 - DNA, 22 bp, Homo sapiens
cccaggaggcagaagttgcagt

SEQ ID NO: 9099967 - DNA, 22 bp, Homo sapiens
cccaggaggcagaagttgcagt

SEQ ID NO: 9099968 - DNA, 22 bp, Homo sapiens
cccaggaggaggaaaaagctcg

SEQ ID NO: 9099969 - DNA, 22 bp, Homo sapiens
cccaggaggaggaaaaagctcg

SEQ ID NO: 9099970 - DNA, 22 bp, Homo sapiens
cccaggaggcagagcttgcagt

SEQ ID NO: 9099971 - DNA, 22 bp, Homo sapiens
cccaggaggcagagcttgcagt

SEQ ID NO: 9099972 - DNA, 22 bp, Homo sapiens
cccaggaggcagatgttgcagt

SEQ ID NO: 9099973 - DNA, 22 bp, Homo sapiens
cccaggaggcagaggttggagc

SEQ ID NO: 9099974 - DNA, 22 bp, Homo sapiens
cccaggaggcagaggttgcagt

SEQ ID NO: 9099975 - DNA, 22 bp, Homo sapiens
cccaggaggcagaggttgcagt

SEQ ID NO: 9099976 - DNA, 22 bp, Homo sapiens
cccaggaggccaaggttgcagt

SEQ ID NO: 9099977 - DNA, 22 bp, Homo sapiens
cccaggaggccaaggttgcagt

SEQ ID NO: 9099978 - DNA, 22 bp, Homo sapiens
tgcagaggtgttgctgagataa

SEQ ID NO: 9099979 - DNA, 22 bp, Homo sapiens
tgcagaggtgttgctgagataa

SEQ ID NO: 9099980 - DNA, 21 bp, Homo sapiens
cccaccccataaggcagaacc

SEQ ID NO: 9099981 - DNA, 21 bp, Homo sapiens
cccaccccataaggcagaacc

SEQ ID NO: 9099982 - DNA, 22 bp, Homo sapiens
cccacccagctgagccgctcac

SEQ ID NO: 9099983 - DNA, 22 bp, Homo sapiens
cccaccagtacagatggtagat

SEQ ID NO: 9099984 - DNA, 22 bp, Homo sapiens
cccaccagccatctgagagtgt

SEQ ID NO: 9099985 - DNA, 22 bp, Homo sapiens
cccacatttttgagtcttcatc

SEQ ID NO: 9099986 - DNA, 22 bp, Homo sapiens
cccaagggtgcccagcagagga

SEQ ID NO: 9099987 - DNA, 20 bp, Homo sapiens
cccaaggtcacagctagcag

SEQ ID NO: 9099988 - DNA, 22 bp, Homo sapiens
tgattcaactttcttgaatgca

SEQ ID NO: 9099989 - DNA, 22 bp, Homo sapiens
tgattcaactttcataacaaaa

SEQ ID NO: 9099990 - DNA, 22 bp, Homo sapiens
cccacagaatgccaatgagacc

SEQ ID NO: 9099991 - DNA, 22 bp, Homo sapiens
cccacaggcaggggcagagaca

SEQ ID NO: 9099992 - DNA, 22 bp, Homo sapiens
cccacaggcaggtgcatgggct

SEQ ID NO: 9099993 - DNA, 22 bp, Homo sapiens
cccacaggtccccatgaactcg

SEQ ID NO: 9099994 - DNA, 22 bp, Homo sapiens
cccacagtgatcgcattcgtac

SEQ ID NO: 9099995 - DNA, 22 bp, Homo sapiens
cccacagttaaccaaaggaatt

SEQ ID NO: 9099996 - DNA, 22 bp, Homo sapiens
cccacaggtggaagcctcggaa

SEQ ID NO: 9099997 - DNA, 22 bp, Homo sapiens
cccacagggctgctgatggcag

SEQ ID NO: 9099998 - DNA, 22 bp, Homo sapiens
cccacaggccctgctgccttga

SEQ ID NO: 9099999 - DNA, 22 bp, Homo sapiens
tgcagcagtcagtcaggcctgg

SEQ ID NO: 9100000 - DNA, 22 bp, Homo sapiens
tgcagcagtgttccttggcttg

SEQ ID NO: 9100001 - DNA, 22 bp, Homo sapiens
tgcagcagtcagtcaggcctgg

SEQ ID NO: 9100002 - DNA, 22 bp, Homo sapiens
tgcagcagtcagtcaggcctgg

SEQ ID NO: 9100003 - DNA, 22 bp, Homo sapiens
tgcagcagtcagtcaggcctgg

SEQ ID NO: 9100004 - DNA, 22 bp, Homo sapiens
tgcagcaggtatggcaagctcc

SEQ ID NO: 9100005 - DNA, 22 bp, Homo sapiens
tgcagcaggttccaaagggtta

SEQ ID NO: 9100006 - DNA, 22 bp, Homo sapiens
tgcagcaggtgacaacgagtgg

SEQ ID NO: 9100007 - DNA, 22 bp, Homo sapiens
cccagcagccagaatgaggagc

SEQ ID NO: 9100008 - DNA, 22 bp, Homo sapiens
cccagcagccagaatgaggagc

SEQ ID NO: 9100009 - DNA, 23 bp, Homo sapiens
cccagcagattgtaaagtgtcca

SEQ ID NO: 9100010 - DNA, 22 bp, Homo sapiens
cccagcagccagaatgaggagc

SEQ ID NO: 9100011 - DNA, 22 bp, Homo sapiens
cccagcagatggctatgtgcta

SEQ ID NO: 9100012 - DNA, 22 bp, Homo sapiens
cccagcagaccgctgtgatggc

SEQ ID NO: 9100013 - DNA, 22 bp, Homo sapiens
cccagcagaccgctgtgatggc

SEQ ID NO: 9100014 - DNA, 22 bp, Homo sapiens
cccagcactttgaatatgtcac

SEQ ID NO: 9100015 - DNA, 18 bp, Homo sapiens
cccagcactttgggagcc

SEQ ID NO: 9100016 - DNA, 22 bp, Homo sapiens
cccagcagaatctgatgagggc

SEQ ID NO: 9100017 - DNA, 22 bp, Homo sapiens
cccagcagaatctgatgagggc

SEQ ID NO: 9100018 - DNA, 22 bp, Homo sapiens
cccagagactttgtccgacgac

SEQ ID NO: 9100019 - DNA, 22 bp, Homo sapiens
cccagagaattccacatagagg

SEQ ID NO: 9100020 - DNA, 22 bp, Homo sapiens
cccagagactttgtccgacgac

SEQ ID NO: 9100021 - DNA, 19 bp, Homo sapiens
cccagagagatctcttgcc

SEQ ID NO: 9100022 - DNA, 22 bp, Homo sapiens
cccagagagcacaggtggtggg

SEQ ID NO: 9100023 - DNA, 22 bp, Homo sapiens
cccagagagcatttggacaaag

SEQ ID NO: 9100024 - DNA, 22 bp, Homo sapiens
cccagagagcacaggtggtggg

SEQ ID NO: 9100025 - DNA, 22 bp, Homo sapiens
cccagagagcatttggacaaag

SEQ ID NO: 9100026 - DNA, 22 bp, Homo sapiens
cccagagagcatttggacaaag

SEQ ID NO: 9100027 - DNA, 22 bp, Homo sapiens
cccagagaggtaaaacagcctt

SEQ ID NO: 9100028 - DNA, 22 bp, Homo sapiens
cccagagatctactgagcccag

SEQ ID NO: 9100029 - DNA, 22 bp, Homo sapiens
cccagagaggtaaaacagcctt

SEQ ID NO: 9100030 - DNA, 22 bp, Homo sapiens
cccagagagctttctttgtgct

SEQ ID NO: 9100031 - DNA, 22 bp, Homo sapiens
cccagagatcttgtcctttcca

SEQ ID NO: 9100032 - DNA, 17 bp, Homo sapiens
cccagagatgctgcctt

SEQ ID NO: 9100033 - DNA, 22 bp, Homo sapiens
cccagagatctactgagcccag

SEQ ID NO: 9100034 - DNA, 22 bp, Homo sapiens
cccagagatcttgtcctttcca

SEQ ID NO: 9100035 - DNA, 22 bp, Homo sapiens
cccagaggtgaaggaggtggga

SEQ ID NO: 9100036 - DNA, 22 bp, Homo sapiens
cccagagaagtgaagtgacttg

SEQ ID NO: 9100037 - DNA, 22 bp, Homo sapiens
cccagagaagtgaagtgacttg

SEQ ID NO: 9100038 - DNA, 22 bp, Homo sapiens
cccagactgcagagcgggcaga

SEQ ID NO: 9100039 - DNA, 22 bp, Homo sapiens
cccagactcctctggctggtgg

SEQ ID NO: 9100040 - DNA, 22 bp, Homo sapiens
cccagagaaccttctgtgccac

SEQ ID NO: 9100041 - DNA, 22 bp, Homo sapiens
cccagagaattccacatagagg

SEQ ID NO: 9100042 - DNA, 22 bp, Homo sapiens
cccagagaattccacatagagg

SEQ ID NO: 9100043 - DNA, 22 bp, Homo sapiens
cccagagaattccacatagagg

SEQ ID NO: 9100044 - DNA, 22 bp, Homo sapiens
cccagagaatctttcagaaagg

SEQ ID NO: 9100045 - DNA, 22 bp, Homo sapiens
cccagagaagtgaagtgacttg

SEQ ID NO: 9100046 - DNA, 22 bp, Homo sapiens
cccagagaatctttcagaaagg

SEQ ID NO: 9100047 - DNA, 22 bp, Homo sapiens
cccagagaagtgaagtgacttg

SEQ ID NO: 9100048 - DNA, 22 bp, Homo sapiens
tgcagaggtttgtggtgttgct

SEQ ID NO: 9100049 - DNA, 22 bp, Homo sapiens
ccatttttaaagagcttaagta

SEQ ID NO: 9100050 - DNA, 22 bp, Homo sapiens
ccatggcctcgctctacgtggg

SEQ ID NO: 9100051 - DNA, 22 bp, Homo sapiens
ccatggccgccgctgctcagga

SEQ ID NO: 9100052 - DNA, 22 bp, Homo sapiens
ccatggccgccgctgctcagga

SEQ ID NO: 9100053 - DNA, 22 bp, Homo sapiens
cccaaacatccaggtgctggac

SEQ ID NO: 9100054 - DNA, 22 bp, Homo sapiens
cccaaagaaaacagtacctcag

SEQ ID NO: 9100055 - DNA, 22 bp, Homo sapiens
ccatttttcacaagactcactt

SEQ ID NO: 9100056 - DNA, 22 bp, Homo sapiens
ccatttttcataaactatccaa

SEQ ID NO: 9100057 - DNA, 22 bp, Homo sapiens
cccaaaatgtgcatgttcgaat

SEQ ID NO: 9100058 - DNA, 22 bp, Homo sapiens
cccaaacagttcctgtggtact

SEQ ID NO: 9100059 - DNA, 21 bp, Homo sapiens
cccaaaagttctgagatggct

SEQ ID NO: 9100060 - DNA, 22 bp, Homo sapiens
ccatttttgacagaaggcctaa

SEQ ID NO: 9100061 - DNA, 23 bp, Homo sapiens
ccatggccaatgtcaagctacta

SEQ ID NO: 9100062 - DNA, 22 bp, Homo sapiens
ccatggcagcctggcctggctt

SEQ ID NO: 9100063 - DNA, 22 bp, Homo sapiens
ccatggccaggaaagccaaggt

SEQ ID NO: 9100064 - DNA, 22 bp, Homo sapiens
ccatggccaattgcaccttgct

SEQ ID NO: 9100065 - DNA, 22 bp, Homo sapiens
ccatggagttcctctggtctat

SEQ ID NO: 9100066 - DNA, 22 bp, Homo sapiens
ccatggagttcctctggtctat

SEQ ID NO: 9100067 - DNA, 19 bp, Homo sapiens
ccatggcaatgatctgatg

SEQ ID NO: 9100068 - DNA, 19 bp, Homo sapiens
ccatggcaatgatctgatg

SEQ ID NO: 9100069 - DNA, 22 bp, Homo sapiens
ccatggcaaaggagatgttttc

SEQ ID NO: 9100070 - DNA, 22 bp, Homo sapiens
cccaagagatcgcatgtagttg

SEQ ID NO: 9100071 - DNA, 22 bp, Homo sapiens
cccaaaggcattttgctgacca

SEQ ID NO: 9100072 - DNA, 22 bp, Homo sapiens
cccaagagatcgcatgtagttg

SEQ ID NO: 9100073 - DNA, 22 bp, Homo sapiens
cccaagatctttcgtgcactaa

SEQ ID NO: 9100074 - DNA, 22 bp, Homo sapiens
cccaagagcttctaggacgctg

SEQ ID NO: 9100075 - DNA, 22 bp, Homo sapiens
cccaagcagggtgcagaggcat

SEQ ID NO: 9100076 - DNA, 22 bp, Homo sapiens
cccaacaacatgaaactaccta

SEQ ID NO: 9100077 - DNA, 22 bp, Homo sapiens
cccaaaggttgaggctgcagtg

SEQ ID NO: 9100078 - DNA, 22 bp, Homo sapiens
cccaaaggttgaggctgcagtg

SEQ ID NO: 9100079 - DNA, 22 bp, Homo sapiens
cccaaaggtttggtagatatga

SEQ ID NO: 9100080 - DNA, 22 bp, Homo sapiens
tgattatattaactatgttcct

SEQ ID NO: 9100081 - DNA, 22 bp, Homo sapiens
tgattcaactttcataacaaaa

SEQ ID NO: 9100082 - DNA, 17 bp, Homo sapiens
tgattcaactagaaact

SEQ ID NO: 9100083 - DNA, 22 bp, Homo sapiens
tgattatattctaacttcataa

SEQ ID NO: 9100084 - DNA, 22 bp, Homo sapiens
tgatgacagcaaaaaatgctag

SEQ ID NO: 9100085 - DNA, 22 bp, Homo sapiens
tgatgaattagtaacaaatgag

SEQ ID NO: 9100086 - DNA, 18 bp, Homo sapiens
tgaggcagtcagtgatgg

SEQ ID NO: 9100087 - DNA, 18 bp, Homo sapiens
tgaggcagtcagtgatgg

SEQ ID NO: 9100088 - DNA, 18 bp, Homo sapiens
tgaggcagtcagtgatgg

SEQ ID NO: 9100089 - DNA, 22 bp, Homo sapiens
tgaggcagtgatgtttaagcac

SEQ ID NO: 9100090 - DNA, 22 bp, Homo sapiens
tgaggcagtgatgtttaagcac

SEQ ID NO: 9100091 - DNA, 22 bp, Homo sapiens
tgaggcagtgctgggaagcctg

SEQ ID NO: 9100092 - DNA, 22 bp, Homo sapiens
tgatgagggagatttgagccca

SEQ ID NO: 9100093 - DNA, 22 bp, Homo sapiens
tgatgagggcagttcttgttgc

SEQ ID NO: 9100094 - DNA, 22 bp, Homo sapiens
tgatgagggggaacagagattt

SEQ ID NO: 9100095 - DNA, 21 bp, Homo sapiens
tgatgaggtcatagcaccctc

SEQ ID NO: 9100096 - DNA, 22 bp, Homo sapiens
tgatgaggggctcagaggtcag

SEQ ID NO: 9100097 - DNA, 22 bp, Homo sapiens
tgatgaggacctggtctctgct

SEQ ID NO: 9100098 - DNA, 22 bp, Homo sapiens
tgatgaggagactgtggcttgg

SEQ ID NO: 9100099 - DNA, 22 bp, Homo sapiens
tgatgagggaactggttcatac

SEQ ID NO: 9100100 - DNA, 22 bp, Homo sapiens
tgatgaggcatatgctacacat

SEQ ID NO: 9100101 - DNA, 22 bp, Homo sapiens
tgatgaggcttcttggtgaaca

SEQ ID NO: 9100102 - DNA, 22 bp, Homo sapiens
tgatgaggacccatcacctggt

SEQ ID NO: 9100103 - DNA, 22 bp, Homo sapiens
ccagtgtgttccctgcctcact

SEQ ID NO: 9100104 - DNA, 22 bp, Homo sapiens
ccagtgtgtttttctctgactc

SEQ ID NO: 9100105 - DNA, 22 bp, Homo sapiens
ccagtgtgtttaatgcattcca

SEQ ID NO: 9100106 - DNA, 22 bp, Homo sapiens
ccagtgtgggcccggcctcctc

SEQ ID NO: 9100107 - DNA, 22 bp, Homo sapiens
ccagtgtggtaggtccacaggt

SEQ ID NO: 9100108 - DNA, 23 bp, Homo sapiens
ccagtgtggtaggtccacaggtg

SEQ ID NO: 9100109 - DNA, 23 bp, Homo sapiens
ccagtgtggtaggtccacaggtg

SEQ ID NO: 9100110 - DNA, 22 bp, Homo sapiens
ccagtgtgttccctgcctcact

SEQ ID NO: 9100111 - DNA, 21 bp, Homo sapiens
tgaggcaggggtgcttttgtc

SEQ ID NO: 9100112 - DNA, 22 bp, Homo sapiens
tgaggcagtattctccattcca

SEQ ID NO: 9100113 - DNA, 22 bp, Homo sapiens
tgaggcaggtggattacaaggt

SEQ ID NO: 9100114 - DNA, 22 bp, Homo sapiens
tgaggcagtattttagtgactt

SEQ ID NO: 9100115 - DNA, 22 bp, Homo sapiens
tgaggcagtattctccattcca

SEQ ID NO: 9100116 - DNA, 22 bp, Homo sapiens
tgaggcagtcaccccctcctgc

SEQ ID NO: 9100117 - DNA, 22 bp, Homo sapiens
tgaggcagtcaccccctcctgc

SEQ ID NO: 9100118 - DNA, 22 bp, Homo sapiens
ttattcagcagggacttccttt

SEQ ID NO: 9100119 - DNA, 22 bp, Homo sapiens
ttattgcaaaggaagagcttga

SEQ ID NO: 9100120 - DNA, 22 bp, Homo sapiens
ttattgcaaaggaagagcttga

SEQ ID NO: 9100121 - DNA, 22 bp, Homo sapiens
ttattgcaaccttttctggtgt

SEQ ID NO: 9100122 - DNA, 22 bp, Homo sapiens
cgaaatcagcatcttgaggcaa

SEQ ID NO: 9100123 - DNA, 22 bp, Homo sapiens
ccttttttctatgccaactctg

SEQ ID NO: 9100124 - DNA, 21 bp, Homo sapiens
cctttttgcttatggacagac

SEQ ID NO: 9100125 - DNA, 22 bp, Homo sapiens
cgagagatgggttggcaggggc

SEQ ID NO: 9100126 - DNA, 22 bp, Homo sapiens
cgagaaggtcttcccacagagc

SEQ ID NO: 9100127 - DNA, 22 bp, Homo sapiens
ttatccaagcagaagctgcaca

SEQ ID NO: 9100128 - DNA, 22 bp, Homo sapiens
ccttttctatccttctaggttc

SEQ ID NO: 9100129 - DNA, 22 bp, Homo sapiens
cctttttccctggagggacagc

SEQ ID NO: 9100130 - DNA, 22 bp, Homo sapiens
cctttttccctggagggacagc

SEQ ID NO: 9100131 - DNA, 22 bp, Homo sapiens
cctttttcaatatagaattgca

SEQ ID NO: 9100132 - DNA, 22 bp, Homo sapiens
ccttttgctctcccatccagaa

SEQ ID NO: 9100133 - DNA, 22 bp, Homo sapiens
ccttttgctctcccatccagaa

SEQ ID NO: 9100134 - DNA, 22 bp, Homo sapiens
ccttttggaaatatttatgacc

SEQ ID NO: 9100135 - DNA, 22 bp, Homo sapiens
ccttttggccaggtcagtgcag

SEQ ID NO: 9100136 - DNA, 22 bp, Homo sapiens
cgctccttgagcgtgtcggcct

SEQ ID NO: 9100137 - DNA, 22 bp, Homo sapiens
cgctccttgagcgtgtcggcct

SEQ ID NO: 9100138 - DNA, 22 bp, Homo sapiens
cgccggcttgaggcaggcggca

SEQ ID NO: 9100139 - DNA, 22 bp, Homo sapiens
cgctggcttcctcctggggcca

SEQ ID NO: 9100140 - DNA, 22 bp, Homo sapiens
cgctggccatagcctcctgtgt

SEQ ID NO: 9100141 - DNA, 22 bp, Homo sapiens
cgctgccaggtcaccaggggta

SEQ ID NO: 9100142 - DNA, 22 bp, Homo sapiens
cgctgccaggatcccctgccgg

SEQ ID NO: 9100143 - DNA, 17 bp, Homo sapiens
ttattgcagtgctgaag

SEQ ID NO: 9100144 - DNA, 22 bp, Homo sapiens
ttattgcagccgcagggcgctg

SEQ ID NO: 9100145 - DNA, 22 bp, Homo sapiens
ttattgcactattgattttcta

SEQ ID NO: 9100146 - DNA, 22 bp, Homo sapiens
ttattgcagatggtgtgagaga

SEQ ID NO: 9100147 - DNA, 23 bp, Homo sapiens
ttattgcatccaaatgcattcct

SEQ ID NO: 9100148 - DNA, 22 bp, Homo sapiens
ttattgcatagattatgccata

SEQ ID NO: 9100149 - DNA, 22 bp, Homo sapiens
ttattgcaactttagggataga

SEQ ID NO: 9100150 - DNA, 22 bp, Homo sapiens
ttattgcaactcctaaatagag

SEQ ID NO: 9100151 - DNA, 22 bp, Homo sapiens
ttattgcaccttcctcactaac

SEQ ID NO: 9100152 - DNA, 22 bp, Homo sapiens
ttattgcaccatgcctcagttt

SEQ ID NO: 9100153 - DNA, 23 bp, Homo sapiens
ttattgcaaggtaaaattgctga

SEQ ID NO: 9100154 - DNA, 22 bp, Homo sapiens
ttatttattcattctgtctgtc

SEQ ID NO: 9100155 - DNA, 22 bp, Homo sapiens
ttatttatgttaacagtcgaga

SEQ ID NO: 9100156 - DNA, 22 bp, Homo sapiens
ttatttattcattctgtctgtc

SEQ ID NO: 9100157 - DNA, 22 bp, Homo sapiens
ttatttattgtgtacctactgt

SEQ ID NO: 9100158 - DNA, 22 bp, Homo sapiens
cggggccctggggctgaaggtc

SEQ ID NO: 9100159 - DNA, 22 bp, Homo sapiens
cggggccctggggctgaaggtc

SEQ ID NO: 9100160 - DNA, 23 bp, Homo sapiens
cggggccagggtcaggaccggtc

SEQ ID NO: 9100161 - DNA, 22 bp, Homo sapiens
cggggagaacactgtgtccttc

SEQ ID NO: 9100162 - DNA, 21 bp, Homo sapiens
cgtgactgggtccgtctggct

SEQ ID NO: 9100163 - DNA, 22 bp, Homo sapiens
cgtggctggtggacctgagggc

SEQ ID NO: 9100164 - DNA, 22 bp, Homo sapiens
cgtgagcaaaatggacactccc

SEQ ID NO: 9100165 - DNA, 22 bp, Homo sapiens
cgtgagcaaaatggacactccc

SEQ ID NO: 9100166 - DNA, 22 bp, Homo sapiens
cgtggctggggcgactccacgg

SEQ ID NO: 9100167 - DNA, 21 bp, Homo sapiens
cgtgactgggtccgtctggct

SEQ ID NO: 9100168 - DNA, 22 bp, Homo sapiens
cgtggctggtggacctgagggc

SEQ ID NO: 9100169 - DNA, 22 bp, Homo sapiens
cgtgggaggaaaaatgggcttc

SEQ ID NO: 9100170 - DNA, 22 bp, Homo sapiens
cggggcctagtctacctcggca

SEQ ID NO: 9100171 - DNA, 22 bp, Homo sapiens
cggggcctagctgcacaccctc

SEQ ID NO: 9100172 - DNA, 22 bp, Homo sapiens
cggcacagccgggcaaggctgg

SEQ ID NO: 9100173 - DNA, 22 bp, Homo sapiens
cggcacagccgggcaaggctgg

SEQ ID NO: 9100174 - DNA, 22 bp, Homo sapiens
cggcagcaaaggaagccaggtc

SEQ ID NO: 9100175 - DNA, 22 bp, Homo sapiens
cggcagctgattgcagagcacc

SEQ ID NO: 9100176 - DNA, 22 bp, Homo sapiens
cggcagcatcgaaactacattc

SEQ ID NO: 9100177 - DNA, 22 bp, Homo sapiens
ttcaaatgcaagttactacttt

SEQ ID NO: 9100178 - DNA, 22 bp, Homo sapiens
ttcaaatggttagactgttagc

SEQ ID NO: 9100179 - DNA, 22 bp, Homo sapiens
cggagaggtgggggcagcatct

SEQ ID NO: 9100180 - DNA, 22 bp, Homo sapiens
cggagaggacctgcaactcgct

SEQ ID NO: 9100181 - DNA, 22 bp, Homo sapiens
cggagaggacctgcaactcgct

SEQ ID NO: 9100182 - DNA, 22 bp, Homo sapiens
cggagtcttgctatgttgccca

SEQ ID NO: 9100183 - DNA, 22 bp, Homo sapiens
cggagtcttgctatgttgccca

SEQ ID NO: 9100184 - DNA, 22 bp, Homo sapiens
cggaggttgaggctgcagtgag

SEQ ID NO: 9100185 - DNA, 22 bp, Homo sapiens
cggaggttgaggctgcagtgag

SEQ ID NO: 9100186 - DNA, 22 bp, Homo sapiens
ttcaaatgatggcagtcctggc

SEQ ID NO: 9100187 - DNA, 22 bp, Homo sapiens
ttcaaatcctagccctgtggcc

SEQ ID NO: 9100188 - DNA, 22 bp, Homo sapiens
ttcaaatccctgctccactatt

SEQ ID NO: 9100189 - DNA, 22 bp, Homo sapiens
ttcaaatcagaccgaaggcaac

SEQ ID NO: 9100190 - DNA, 22 bp, Homo sapiens
ttcaaagtttcaatctgtatca

SEQ ID NO: 9100191 - DNA, 21 bp, Homo sapiens
ttcaaagtttgcctaaagatt

SEQ ID NO: 9100192 - DNA, 22 bp, Homo sapiens
ttcaaagtgcatgttcctcaga

SEQ ID NO: 9100193 - DNA, 22 bp, Homo sapiens
ttagcaatatgaatgcatttgc

SEQ ID NO: 9100194 - DNA, 22 bp, Homo sapiens
ttagcaaatatcttgaaacagg

SEQ ID NO: 9100195 - DNA, 22 bp, Homo sapiens
ttagcaaatatcttgaaacagg

SEQ ID NO: 9100196 - DNA, 22 bp, Homo sapiens
ttagcactggattaatcaaagt

SEQ ID NO: 9100197 - DNA, 22 bp, Homo sapiens
ttagcaaatatcttgaaacagg

SEQ ID NO: 9100198 - DNA, 22 bp, Homo sapiens
ttagcaaagtttgccatctagt

SEQ ID NO: 9100199 - DNA, 22 bp, Homo sapiens
ttagacatagaatattgtctag

SEQ ID NO: 9100200 - DNA, 22 bp, Homo sapiens
ttagacagagctccttgagggc

SEQ ID NO: 9100201 - DNA, 18 bp, Homo sapiens
ccttcagctctgccagta

SEQ ID NO: 9100202 - DNA, 22 bp, Homo sapiens
ccttcaaatttagaacaagtga

SEQ ID NO: 9100203 - DNA, 22 bp, Homo sapiens
ccttcaaggcaaggagggctgg

SEQ ID NO: 9100204 - DNA, 22 bp, Homo sapiens
ccttcaagttcctggtccctgg

SEQ ID NO: 9100205 - DNA, 22 bp, Homo sapiens
ccttcacacaggtagaagcaga

SEQ ID NO: 9100206 - DNA, 20 bp, Homo sapiens
ccttcagaacttacatagta

SEQ ID NO: 9100207 - DNA, 22 bp, Homo sapiens
ccttcagccagttttctttgtt

SEQ ID NO: 9100208 - DNA, 22 bp, Homo sapiens
ccttcagaggtgtagattgcgt

SEQ ID NO: 9100209 - DNA, 23 bp, Homo sapiens
ccttcagaagaagtaacaggggc

SEQ ID NO: 9100210 - DNA, 22 bp, Homo sapiens
ccttcagaatgaaattctaatg

SEQ ID NO: 9100211 - DNA, 22 bp, Homo sapiens
ttacagtttatccaggaagagc

SEQ ID NO: 9100212 - DNA, 22 bp, Homo sapiens
ttacataaaagttcacgtaggc

SEQ ID NO: 9100213 - DNA, 22 bp, Homo sapiens
ttacataacggtatgaaaaatg

SEQ ID NO: 9100214 - DNA, 22 bp, Homo sapiens
ttacataacggtatgaaaaatg

SEQ ID NO: 9100215 - DNA, 22 bp, Homo sapiens
ttacataactttaaaatgccgt

SEQ ID NO: 9100216 - DNA, 22 bp, Homo sapiens
ttacataacggtatgaaaaatg

SEQ ID NO: 9100217 - DNA, 22 bp, Homo sapiens
ttacatacaaaggctgggttat

SEQ ID NO: 9100218 - DNA, 22 bp, Homo sapiens
ttacataactttaaaatgccgt

SEQ ID NO: 9100219 - DNA, 22 bp, Homo sapiens
ttacatagattcatttagttaa

SEQ ID NO: 9100220 - DNA, 22 bp, Homo sapiens
ttacataggtatgtttgctttg

SEQ ID NO: 9100221 - DNA, 22 bp, Homo sapiens
ttagttttcccatctttatggt

SEQ ID NO: 9100222 - DNA, 22 bp, Homo sapiens
ttataaaggtttgtgcatattt

SEQ ID NO: 9100223 - DNA, 22 bp, Homo sapiens
ttataaagattgttatgtatct

SEQ ID NO: 9100224 - DNA, 22 bp, Homo sapiens
ttataaagatccttccagagtt

SEQ ID NO: 9100225 - DNA, 22 bp, Homo sapiens
ccttgcctcattgtgcttctcc

SEQ ID NO: 9100226 - DNA, 22 bp, Homo sapiens
ttagttttcccatctttatggt

SEQ ID NO: 9100227 - DNA, 22 bp, Homo sapiens
ccttgactgccttcaggctggg

SEQ ID NO: 9100228 - DNA, 22 bp, Homo sapiens
ccttgcagacatcagtagtggc

SEQ ID NO: 9100229 - DNA, 22 bp, Homo sapiens
ttataacactgccttgtcacca

SEQ ID NO: 9100230 - DNA, 22 bp, Homo sapiens
ttataacaacagtttactttaa

SEQ ID NO: 9100231 - DNA, 22 bp, Homo sapiens
ttatattagttagacttgctgt

SEQ ID NO: 9100232 - DNA, 22 bp, Homo sapiens
ttataacattataaagtggaga

SEQ ID NO: 9100233 - DNA, 22 bp, Homo sapiens
ttataacatcaatcagagttaa

SEQ ID NO: 9100234 - DNA, 22 bp, Homo sapiens
ttataaagtgagaagtgctatg

SEQ ID NO: 9100235 - DNA, 22 bp, Homo sapiens
ttatccaaactggtgaatcatt

SEQ ID NO: 9100236 - DNA, 22 bp, Homo sapiens
ttatcatgggacctgaatttta

SEQ ID NO: 9100237 - DNA, 22 bp, Homo sapiens
ttatcatgggacctgaatttta

SEQ ID NO: 9100238 - DNA, 22 bp, Homo sapiens
ttatcatgacaggatgatagaa

SEQ ID NO: 9100239 - DNA, 22 bp, Homo sapiens
ttatcatagtgcagttttctga

SEQ ID NO: 9100240 - DNA, 23 bp, Homo sapiens
ttatcaggacatgctgtctcagg

SEQ ID NO: 9100241 - DNA, 22 bp, Homo sapiens
ttatcagttgtgtgtatacacg

SEQ ID NO: 9100242 - DNA, 22 bp, Homo sapiens
ttatcagtcggcttaggttatg

SEQ ID NO: 9100243 - DNA, 23 bp, Homo sapiens
ttatcaggacatgctgtctcagg

SEQ ID NO: 9100244 - DNA, 22 bp, Homo sapiens
ttatcacttatgagctttttgc

SEQ ID NO: 9100245 - DNA, 22 bp, Homo sapiens
ttatatttctggtagccttcag

SEQ ID NO: 9100246 - DNA, 22 bp, Homo sapiens
ttaaattttagaaacagactct

SEQ ID NO: 9100247 - DNA, 22 bp, Homo sapiens
ttaagagcaacatatggtgaca

SEQ ID NO: 9100248 - DNA, 22 bp, Homo sapiens
ttaagagtaatggaaggccact

SEQ ID NO: 9100249 - DNA, 22 bp, Homo sapiens
ttaagagttatttgcacataat

SEQ ID NO: 9100250 - DNA, 22 bp, Homo sapiens
ttaagagtttagtgccacctgg

SEQ ID NO: 9100251 - DNA, 22 bp, Homo sapiens
ttaagatcaagataagcaataa

SEQ ID NO: 9100252 - DNA, 22 bp, Homo sapiens
ttaaattccagcctcataatag

SEQ ID NO: 9100253 - DNA, 22 bp, Homo sapiens
ttaaattccagcctcataatag

SEQ ID NO: 9100254 - DNA, 22 bp, Homo sapiens
ttaaattatttctagtgaggtg

SEQ ID NO: 9100255 - DNA, 22 bp, Homo sapiens
ttaaatttctacgtgatccagg

SEQ ID NO: 9100256 - DNA, 22 bp, Homo sapiens
ttaaatttctacgtgatccagg

SEQ ID NO: 9100257 - DNA, 22 bp, Homo sapiens
ttaaattttagaaacagactct

SEQ ID NO: 9100258 - DNA, 22 bp, Homo sapiens
ttaaattttagaaacagactct

SEQ ID NO: 9100259 - DNA, 22 bp, Homo sapiens
ttaaattccagcctcataatag

SEQ ID NO: 9100260 - DNA, 22 bp, Homo sapiens
ttaaattccagcctcataatag

SEQ ID NO: 9100261 - DNA, 22 bp, Homo sapiens
ttaaattagtcaagcttctctg

SEQ ID NO: 9100262 - DNA, 22 bp, Homo sapiens
ttaaattattgagggattgtca

SEQ ID NO: 9100263 - DNA, 22 bp, Homo sapiens
ttaaatagtaggtctattttgg

SEQ ID NO: 9100264 - DNA, 22 bp, Homo sapiens
tgtcagcatgtcagccaaagat

SEQ ID NO: 9100265 - DNA, 22 bp, Homo sapiens
tgtcagcaggacattaaaagct

SEQ ID NO: 9100266 - DNA, 22 bp, Homo sapiens
tgtcagcaggacattaaaagct

SEQ ID NO: 9100267 - DNA, 22 bp, Homo sapiens
tgtcagcagtatctctatctca

SEQ ID NO: 9100268 - DNA, 22 bp, Homo sapiens
tgtcagagcaaggccaggccag

SEQ ID NO: 9100269 - DNA, 21 bp, Homo sapiens
tgtcagagcttgtaggacatt

SEQ ID NO: 9100270 - DNA, 21 bp, Homo sapiens
tgtcagagcttgtaggacatt

SEQ ID NO: 9100271 - DNA, 22 bp, Homo sapiens
tgtcaatagttttgagttctct

SEQ ID NO: 9100272 - DNA, 22 bp, Homo sapiens
tgtcagaactctattgatgtcc

SEQ ID NO: 9100273 - DNA, 22 bp, Homo sapiens
tgtcagcacatctgtaatcaca

SEQ ID NO: 9100274 - DNA, 22 bp, Homo sapiens
tgtcagaggctcagggtctcag

SEQ ID NO: 9100275 - DNA, 22 bp, Homo sapiens
tgtcagatgtgtctccaagtgc

SEQ ID NO: 9100276 - DNA, 22 bp, Homo sapiens
ttacaaagcgttgagacaagta

SEQ ID NO: 9100277 - DNA, 22 bp, Homo sapiens
ttacaaagcgctttacctctga

SEQ ID NO: 9100278 - DNA, 22 bp, Homo sapiens
ttacaaagattatattcagtta

SEQ ID NO: 9100279 - DNA, 22 bp, Homo sapiens
ttacaaagcaggtcagctgaaa

SEQ ID NO: 9100280 - DNA, 22 bp, Homo sapiens
ttacagttgttctatcagcatg

SEQ ID NO: 9100281 - DNA, 22 bp, Homo sapiens
ttacagtttacataagaattgt

SEQ ID NO: 9100282 - DNA, 22 bp, Homo sapiens
ttacagtttacataagaattgt

SEQ ID NO: 9100283 - DNA, 22 bp, Homo sapiens
ttacagtttagtccaagccaga

SEQ ID NO: 9100284 - DNA, 22 bp, Homo sapiens
ttacaaagagtgccagagtgtg

SEQ ID NO: 9100285 - DNA, 22 bp, Homo sapiens
ttacaaagagtgccagagtgtg

SEQ ID NO: 9100286 - DNA, 22 bp, Homo sapiens
ccttagtgtgcctgaggcagat

SEQ ID NO: 9100287 - DNA, 22 bp, Homo sapiens
ccttagtgaaacagaggcaatt

SEQ ID NO: 9100288 - DNA, 17 bp, Homo sapiens
ccttagggcagtgtggt

SEQ ID NO: 9100289 - DNA, 22 bp, Homo sapiens
ccttagcattagaagctgtggg

SEQ ID NO: 9100290 - DNA, 22 bp, Homo sapiens
ccttagaaatgtaccaaaggaa

SEQ ID NO: 9100291 - DNA, 22 bp, Homo sapiens
ccttagcatggctgtgctgtgt

SEQ ID NO: 9100292 - DNA, 22 bp, Homo sapiens
ccttagcagggagtctgtccag

SEQ ID NO: 9100293 - DNA, 22 bp, Homo sapiens
ccttagcaactgtcatagagca

SEQ ID NO: 9100294 - DNA, 22 bp, Homo sapiens
ccttagcaacacttagcaactg

SEQ ID NO: 9100295 - DNA, 22 bp, Homo sapiens
ccttagcaaattggcatcttct

SEQ ID NO: 9100296 - DNA, 22 bp, Homo sapiens
ttaagcagaaaatttgagcact

SEQ ID NO: 9100297 - DNA, 22 bp, Homo sapiens
cctgtgtgtctgtcactgcaca

SEQ ID NO: 9100298 - DNA, 21 bp, Homo sapiens
cctgtgtgtgtccctttaaga

SEQ ID NO: 9100299 - DNA, 22 bp, Homo sapiens
ccttaaagaataagtcttatct

SEQ ID NO: 9100300 - DNA, 22 bp, Homo sapiens
ctagagcagattgcagagtagg

SEQ ID NO: 9100301 - DNA, 22 bp, Homo sapiens
ctagagctgttctgtgcactca

SEQ ID NO: 9100302 - DNA, 22 bp, Homo sapiens
ctagagggatgttaggatagca

SEQ ID NO: 9100303 - DNA, 22 bp, Homo sapiens
ctagagaattgtcttgagagtt

SEQ ID NO: 9100304 - DNA, 22 bp, Homo sapiens
ctagataaggatttctcaactt

SEQ ID NO: 9100305 - DNA, 22 bp, Homo sapiens
ctagataaggtggcttggaatt

SEQ ID NO: 9100306 - DNA, 22 bp, Homo sapiens
ctagaggggaaaaaggtcttgt

SEQ ID NO: 9100307 - DNA, 22 bp, Homo sapiens
ctagaggtagaggcagtgggaa

SEQ ID NO: 9100308 - DNA, 22 bp, Homo sapiens
ctagaggggaaaaaggtcttgt

SEQ ID NO: 9100309 - DNA, 18 bp, Homo sapiens
ctagatgagcttggcaag

SEQ ID NO: 9100310 - DNA, 22 bp, Homo sapiens
ctagatctgcccactgaagttc

SEQ ID NO: 9100311 - DNA, 22 bp, Homo sapiens
ctagaaagatacttaaatcaag

SEQ ID NO: 9100312 - DNA, 22 bp, Homo sapiens
ctagagaaaatgttaatacagt

SEQ ID NO: 9100313 - DNA, 22 bp, Homo sapiens
ctagagaaacagtgctctgaac

SEQ ID NO: 9100314 - DNA, 22 bp, Homo sapiens
ctagagaaacagtgctctgaac

SEQ ID NO: 9100315 - DNA, 22 bp, Homo sapiens
ctagagaaaatgatagcaggaa

SEQ ID NO: 9100316 - DNA, 22 bp, Homo sapiens
ctagagaaaatgatagcaggaa

SEQ ID NO: 9100317 - DNA, 22 bp, Homo sapiens
ctagagaacaacattcatatgg

SEQ ID NO: 9100318 - DNA, 22 bp, Homo sapiens
ctagagaacaacattcatatgg

SEQ ID NO: 9100319 - DNA, 22 bp, Homo sapiens
ctagagaagaggttaagcatga

SEQ ID NO: 9100320 - DNA, 18 bp, Homo sapiens
ctagagaaggttactatg

SEQ ID NO: 9100321 - DNA, 22 bp, Homo sapiens
ctagagaattgtcttgagagtt

SEQ ID NO: 9100322 - DNA, 22 bp, Homo sapiens
ctagagaatggcaaagattaga

SEQ ID NO: 9100323 - DNA, 22 bp, Homo sapiens
ctagagaatcttttaagaagtg

SEQ ID NO: 9100324 - DNA, 22 bp, Homo sapiens
ctagagaatcttttaagaagtg

SEQ ID NO: 9100325 - DNA, 22 bp, Homo sapiens
cgtgtgtgtacctgcgcattta

SEQ ID NO: 9100326 - DNA, 22 bp, Homo sapiens
cgtttattttgaagattccact

SEQ ID NO: 9100327 - DNA, 22 bp, Homo sapiens
cgttgtgagcttggtagacact

SEQ ID NO: 9100328 - DNA, 22 bp, Homo sapiens
cgtgtggtcccggcaaggcaag

SEQ ID NO: 9100329 - DNA, 22 bp, Homo sapiens
cgtgtctgtgtatgcaggccgt

SEQ ID NO: 9100330 - DNA, 20 bp, Homo sapiens
cgtgtgtggctattttgggt

SEQ ID NO: 9100331 - DNA, 22 bp, Homo sapiens
cgtgtgtgtacctgcgcattta

SEQ ID NO: 9100332 - DNA, 22 bp, Homo sapiens
cgtgtctgggatagcagaagta

SEQ ID NO: 9100333 - DNA, 22 bp, Homo sapiens
cgtgtctgggctcccatggcag

SEQ ID NO: 9100334 - DNA, 22 bp, Homo sapiens
cgtgtctgtatgtcaatcagct

SEQ ID NO: 9100335 - DNA, 23 bp, Homo sapiens
cgtgtctgtgggcgatccggcct

SEQ ID NO: 9100336 - DNA, 22 bp, Homo sapiens
cgtgggtcgggactccgcctcg

SEQ ID NO: 9100337 - DNA, 22 bp, Homo sapiens
ttctgcatgccctctgtgtggc

SEQ ID NO: 9100338 - DNA, 22 bp, Homo sapiens
ttctggaagggtggagtagctt

SEQ ID NO: 9100339 - DNA, 23 bp, Homo sapiens
ttctggatgttctagtctgagag

SEQ ID NO: 9100340 - DNA, 22 bp, Homo sapiens
ttctggaagccccagagtcaga

SEQ ID NO: 9100341 - DNA, 23 bp, Homo sapiens
ttctggaagatttacttgagaca

SEQ ID NO: 9100342 - DNA, 22 bp, Homo sapiens
ttctgcagtgtgcagggcctgt

SEQ ID NO: 9100343 - DNA, 22 bp, Homo sapiens
ttctgcagtgttaacaatgtca

SEQ ID NO: 9100344 - DNA, 22 bp, Homo sapiens
ttctgcaggagccctagtgtat

SEQ ID NO: 9100345 - DNA, 22 bp, Homo sapiens
ttctgcaggatgctctggtggt

SEQ ID NO: 9100346 - DNA, 22 bp, Homo sapiens
ttctatttccagtccttcagag

SEQ ID NO: 9100347 - DNA, 22 bp, Homo sapiens
ttctgaagctcccttttgtagt

SEQ ID NO: 9100348 - DNA, 22 bp, Homo sapiens
ttctatgtgttgacaagcctga

SEQ ID NO: 9100349 - DNA, 22 bp, Homo sapiens
ttctattgcacacaaataatta

SEQ ID NO: 9100350 - DNA, 22 bp, Homo sapiens
ttctttctctactagcagagct

SEQ ID NO: 9100351 - DNA, 22 bp, Homo sapiens
ctcactgcaagctcagcctccc

SEQ ID NO: 9100352 - DNA, 22 bp, Homo sapiens
ctcactgcaagctccacctctt

SEQ ID NO: 9100353 - DNA, 22 bp, Homo sapiens
ttctttctctactagcagagct

SEQ ID NO: 9100354 - DNA, 22 bp, Homo sapiens
ttctttctggggtccttcggct

SEQ ID NO: 9100355 - DNA, 22 bp, Homo sapiens
ttctttctgtccataatgagac

SEQ ID NO: 9100356 - DNA, 22 bp, Homo sapiens
ctcagagaaatgtcacaacaat

SEQ ID NO: 9100357 - DNA, 22 bp, Homo sapiens
ctcagagaaaaggagcaagggt

SEQ ID NO: 9100358 - DNA, 22 bp, Homo sapiens
ctcagagaacctaagcggagga

SEQ ID NO: 9100359 - DNA, 22 bp, Homo sapiens
ctcagagctgaggccagggaca

SEQ ID NO: 9100360 - DNA, 17 bp, Homo sapiens
ctcagagcaggacagaa

SEQ ID NO: 9100361 - DNA, 21 bp, Homo sapiens
ctcagagcagttcagagggat

SEQ ID NO: 9100362 - DNA, 21 bp, Homo sapiens
ctcagagcagttcagagggat

SEQ ID NO: 9100363 - DNA, 22 bp, Homo sapiens
ctcagagcccagggtacacccg

SEQ ID NO: 9100364 - DNA, 22 bp, Homo sapiens
ctcagagccagttagcaggtgc

SEQ ID NO: 9100365 - DNA, 19 bp, Homo sapiens
ctcagagaggggcagtgcc

SEQ ID NO: 9100366 - DNA, 22 bp, Homo sapiens
ctcagagagtgaattcctgcct

SEQ ID NO: 9100367 - DNA, 22 bp, Homo sapiens
ctcagagaggttgaacaacttg

SEQ ID NO: 9100368 - DNA, 22 bp, Homo sapiens
ctcagagagttaagtgaattac

SEQ ID NO: 9100369 - DNA, 22 bp, Homo sapiens
ctcagagcaatgaacatgcaaa

SEQ ID NO: 9100370 - DNA, 22 bp, Homo sapiens
ttctggcttgacccctacttcc

SEQ ID NO: 9100371 - DNA, 22 bp, Homo sapiens
ttctggcttcatctgacaagcc

SEQ ID NO: 9100372 - DNA, 22 bp, Homo sapiens
ttctggcttcatctgacaagcc

SEQ ID NO: 9100373 - DNA, 22 bp, Homo sapiens
ttctggcttagttgttgtatat

SEQ ID NO: 9100374 - DNA, 22 bp, Homo sapiens
ttctggcttatcctaactctaa

SEQ ID NO: 9100375 - DNA, 22 bp, Homo sapiens
ctataaatctacccagcattgg

SEQ ID NO: 9100376 - DNA, 22 bp, Homo sapiens
ctataagacagatactgacttt

SEQ ID NO: 9100377 - DNA, 22 bp, Homo sapiens
ctatacagagcatccttaactt

SEQ ID NO: 9100378 - DNA, 22 bp, Homo sapiens
ttctggatgttgtagtctgaga

SEQ ID NO: 9100379 - DNA, 20 bp, Homo sapiens
ttctggcaaacagagttctt

SEQ ID NO: 9100380 - DNA, 22 bp, Homo sapiens
ttctggcatgagagatgggggt

SEQ ID NO: 9100381 - DNA, 22 bp, Homo sapiens
ttctggcatctgggggaggcct

SEQ ID NO: 9100382 - DNA, 22 bp, Homo sapiens
ttctggccaaggctgccagatt

SEQ ID NO: 9100383 - DNA, 18 bp, Homo sapiens
ttctggctcactcatgct

SEQ ID NO: 9100384 - DNA, 22 bp, Homo sapiens
ttctggctcatatgctaagaag

SEQ ID NO: 9100385 - DNA, 22 bp, Homo sapiens
ttctggctgaaagtttatttga

SEQ ID NO: 9100386 - DNA, 22 bp, Homo sapiens
ttctggctgcagtccctgtaat

SEQ ID NO: 9100387 - DNA, 22 bp, Homo sapiens
ttctggctctcccctgctgggt

SEQ ID NO: 9100388 - DNA, 22 bp, Homo sapiens
ttctggctcgattctctgaccg

SEQ ID NO: 9100389 - DNA, 22 bp, Homo sapiens
ttctggctccagatgcttctgt

SEQ ID NO: 9100390 - DNA, 22 bp, Homo sapiens
ttctggctcatatgctaagaag

SEQ ID NO: 9100391 - DNA, 22 bp, Homo sapiens
ctcacaggttagttgtgtggat

SEQ ID NO: 9100392 - DNA, 22 bp, Homo sapiens
ctcacaggttctgcagctcaca

SEQ ID NO: 9100393 - DNA, 22 bp, Homo sapiens
ctcacaggttctgcagctcaca

SEQ ID NO: 9100394 - DNA, 22 bp, Homo sapiens
ctatacagtgactagaagtaat

SEQ ID NO: 9100395 - DNA, 22 bp, Homo sapiens
ctatacagcagcttactagtta

SEQ ID NO: 9100396 - DNA, 19 bp, Homo sapiens
ctatacagcctctgaggaa

SEQ ID NO: 9100397 - DNA, 22 bp, Homo sapiens
ctatacagtaaccacagtgatt

SEQ ID NO: 9100398 - DNA, 22 bp, Homo sapiens
ctatacagtaaccacagtgatt

SEQ ID NO: 9100399 - DNA, 22 bp, Homo sapiens
ctcacccctgtaattccagcac

SEQ ID NO: 9100400 - DNA, 19 bp, Homo sapiens
ctcacctggaggtgctgat

SEQ ID NO: 9100401 - DNA, 22 bp, Homo sapiens
ctcacctataagtctcacagtc

SEQ ID NO: 9100402 - DNA, 22 bp, Homo sapiens
ctcacctgcaatcccttccagg

SEQ ID NO: 9100403 - DNA, 22 bp, Homo sapiens
ctcactcagacatccagtgcag

SEQ ID NO: 9100404 - DNA, 22 bp, Homo sapiens
ctcactgcaagctcagcctccc

SEQ ID NO: 9100405 - DNA, 22 bp, Homo sapiens
ttgcatagtgctgaggttcggg

SEQ ID NO: 9100406 - DNA, 22 bp, Homo sapiens
ctcaggagtagttcagcagctg

SEQ ID NO: 9100407 - DNA, 22 bp, Homo sapiens
ttgcagaacttaaagacagagt

SEQ ID NO: 9100408 - DNA, 22 bp, Homo sapiens
ctcaggaggccattctcaaggt

SEQ ID NO: 9100409 - DNA, 22 bp, Homo sapiens
ctcaggaggtggtagaggccct

SEQ ID NO: 9100410 - DNA, 22 bp, Homo sapiens
ctcaggaggtggtagaggccct

SEQ ID NO: 9100411 - DNA, 22 bp, Homo sapiens
ctcaggaaaatattgaagaagt

SEQ ID NO: 9100412 - DNA, 22 bp, Homo sapiens
ctcaggaaccgcggcagcagcc

SEQ ID NO: 9100413 - DNA, 19 bp, Homo sapiens
ctcagctgtagctcatgtg

SEQ ID NO: 9100414 - DNA, 22 bp, Homo sapiens
ctcagctggcaattctggctcc

SEQ ID NO: 9100415 - DNA, 22 bp, Homo sapiens
ctcagaggcaagcaaggagctg

SEQ ID NO: 9100416 - DNA, 22 bp, Homo sapiens
ctcagaggaggcagggtgtgcc

SEQ ID NO: 9100417 - DNA, 22 bp, Homo sapiens
ctcagaggcaagcaaggagctg

SEQ ID NO: 9100418 - DNA, 23 bp, Homo sapiens
ctcagaggcctgtccagggtggt

SEQ ID NO: 9100419 - DNA, 22 bp, Homo sapiens
ctcaggaaggaagcagggagcc

SEQ ID NO: 9100420 - DNA, 22 bp, Homo sapiens
ctcaggaagcctgtaatgtggg

SEQ ID NO: 9100421 - DNA, 22 bp, Homo sapiens
ctcaggaaccgcggcagcagcc

SEQ ID NO: 9100422 - DNA, 22 bp, Homo sapiens
ctcaggacccaccttattagga

SEQ ID NO: 9100423 - DNA, 22 bp, Homo sapiens
ctcaggacccggtccaggtggg

SEQ ID NO: 9100424 - DNA, 22 bp, Homo sapiens
ctcaggacttggttagtgtttt

SEQ ID NO: 9100425 - DNA, 22 bp, Homo sapiens
ctcaggagatgacagaaggtat

SEQ ID NO: 9100426 - DNA, 22 bp, Homo sapiens
ctcaggagacagtgtccacatg

SEQ ID NO: 9100427 - DNA, 22 bp, Homo sapiens
ttgccctgtcttaagctggcaa

SEQ ID NO: 9100428 - DNA, 22 bp, Homo sapiens
ttgccctgtctcactatgttaa

SEQ ID NO: 9100429 - DNA, 22 bp, Homo sapiens
ttgccctgtctcactatgttaa

SEQ ID NO: 9100430 - DNA, 22 bp, Homo sapiens
ttgccctgtcagtagaagtgca

SEQ ID NO: 9100431 - DNA, 22 bp, Homo sapiens
ttgccctggggctggcctggca

SEQ ID NO: 9100432 - DNA, 22 bp, Homo sapiens
ttgccctgcgttaccatctctt

SEQ ID NO: 9100433 - DNA, 22 bp, Homo sapiens
ttgccctgcgggtcctgcgcaa

SEQ ID NO: 9100434 - DNA, 22 bp, Homo sapiens
ttgccctgcgggtcctgcgcaa

SEQ ID NO: 9100435 - DNA, 22 bp, Homo sapiens
ttgccctgcgttaccatctctt

SEQ ID NO: 9100436 - DNA, 16 bp, Homo sapiens
ttgccctgaggggagg

SEQ ID NO: 9100437 - DNA, 17 bp, Homo sapiens
ttgccctgatttttaac

SEQ ID NO: 9100438 - DNA, 22 bp, Homo sapiens
ttgccctgaagaacgtcccaga

SEQ ID NO: 9100439 - DNA, 22 bp, Homo sapiens
ttgccctgaagaacgtcccaga

SEQ ID NO: 9100440 - DNA, 22 bp, Homo sapiens
ttgccctgcagcggtgagtggt

SEQ ID NO: 9100441 - DNA, 22 bp, Homo sapiens
ttgccctgcctccctgaggtga

SEQ ID NO: 9100442 - DNA, 22 bp, Homo sapiens
ttgccctgcctccctgaggtga

SEQ ID NO: 9100443 - DNA, 22 bp, Homo sapiens
ttgcccaggctggagtgcagtg

SEQ ID NO: 9100444 - DNA, 22 bp, Homo sapiens
ttgcccaggctggagtgcagta

SEQ ID NO: 9100445 - DNA, 22 bp, Homo sapiens
ttgcatatcctccaacacatgg

SEQ ID NO: 9100446 - DNA, 22 bp, Homo sapiens
ttgcatatcctccaacacatgg

SEQ ID NO: 9100447 - DNA, 22 bp, Homo sapiens
ttgcatatgaagctgacttaaa

SEQ ID NO: 9100448 - DNA, 22 bp, Homo sapiens
ttgcatatcctccaacacatgg

SEQ ID NO: 9100449 - DNA, 22 bp, Homo sapiens
ttgcatatatttctaaggaggt

SEQ ID NO: 9100450 - DNA, 22 bp, Homo sapiens
ttgcatcaggtagacaactata

SEQ ID NO: 9100451 - DNA, 22 bp, Homo sapiens
ttgcatcagaaaatatgggaag

SEQ ID NO: 9100452 - DNA, 23 bp, Homo sapiens
ctcagggatagaaaggaagacag

SEQ ID NO: 9100453 - DNA, 22 bp, Homo sapiens
ctcagggagtagcacatgtgga

SEQ ID NO: 9100454 - DNA, 22 bp, Homo sapiens
ctcagggatggtgaagcaccca

SEQ ID NO: 9100455 - DNA, 23 bp, Homo sapiens
ctcagggatagaaaggaagacag

SEQ ID NO: 9100456 - DNA, 22 bp, Homo sapiens
ctcagggatggtgaagcaccca

SEQ ID NO: 9100457 - DNA, 22 bp, Homo sapiens
ctcagggccaaggatgctgttg

SEQ ID NO: 9100458 - DNA, 22 bp, Homo sapiens
ctcaggtcttagttctgtcatc

SEQ ID NO: 9100459 - DNA, 22 bp, Homo sapiens
ctcagtactttatgtatatgat

SEQ ID NO: 9100460 - DNA, 22 bp, Homo sapiens
ctcagggtgcagcacagttcct

SEQ ID NO: 9100461 - DNA, 22 bp, Homo sapiens
ctcagggtgagaaattgatcca

SEQ ID NO: 9100462 - DNA, 21 bp, Homo sapiens
ctcagggcttggtgtcctcat

SEQ ID NO: 9100463 - DNA, 22 bp, Homo sapiens
ctccagagtcatcgagcattcc

SEQ ID NO: 9100464 - DNA, 22 bp, Homo sapiens
ctccagagtcacactgcctggg

SEQ ID NO: 9100465 - DNA, 22 bp, Homo sapiens
ctccagagtcacactgcctggg

SEQ ID NO: 9100466 - DNA, 22 bp, Homo sapiens
ttggctctgatggggatcagga

SEQ ID NO: 9100467 - DNA, 22 bp, Homo sapiens
ttggctctggaactatttctga

SEQ ID NO: 9100468 - DNA, 22 bp, Homo sapiens
ctccagaggatgcaggtgaggg

SEQ ID NO: 9100469 - DNA, 22 bp, Homo sapiens
ctccagaggatgcaggtgaggg

SEQ ID NO: 9100470 - DNA, 22 bp, Homo sapiens
ctccagaggaaagcacatagtg

SEQ ID NO: 9100471 - DNA, 22 bp, Homo sapiens
ctccagaggaaagcacatagtg

SEQ ID NO: 9100472 - DNA, 22 bp, Homo sapiens
ctccagaggaaagcacatagtg

SEQ ID NO: 9100473 - DNA, 22 bp, Homo sapiens
ctccaggacactaacccaggct

SEQ ID NO: 9100474 - DNA, 22 bp, Homo sapiens
ctccaggaccagggctcctgga

SEQ ID NO: 9100475 - DNA, 22 bp, Homo sapiens
ctccaggactcaggcccctggg

SEQ ID NO: 9100476 - DNA, 22 bp, Homo sapiens
ctccaggactcaggcccctggg

SEQ ID NO: 9100477 - DNA, 22 bp, Homo sapiens
ctccaggactgaggacagagct

SEQ ID NO: 9100478 - DNA, 22 bp, Homo sapiens
ctccaggactgaggacagagct

SEQ ID NO: 9100479 - DNA, 22 bp, Homo sapiens
ctccaggacccagtggctccag

SEQ ID NO: 9100480 - DNA, 22 bp, Homo sapiens
ctccaggacccagtggctccag

SEQ ID NO: 9100481 - DNA, 22 bp, Homo sapiens
ctccaggaccagggctcctgga

SEQ ID NO: 9100482 - DNA, 22 bp, Homo sapiens
ctccaggacccagtggctccag

SEQ ID NO: 9100483 - DNA, 22 bp, Homo sapiens
ttggctgaaagccatgagaccg

SEQ ID NO: 9100484 - DNA, 22 bp, Homo sapiens
ttggctgaccagaacctgcccc

SEQ ID NO: 9100485 - DNA, 22 bp, Homo sapiens
ctccagcctcatctcctggctg

SEQ ID NO: 9100486 - DNA, 22 bp, Homo sapiens
ttggctgccttcacccctggcc

SEQ ID NO: 9100487 - DNA, 22 bp, Homo sapiens
ctcagtctcttgggctgtgaag

SEQ ID NO: 9100488 - DNA, 19 bp, Homo sapiens
ctcagtctggctctgcctg

SEQ ID NO: 9100489 - DNA, 22 bp, Homo sapiens
ctcagtctgtcttgtctgtgtt

SEQ ID NO: 9100490 - DNA, 22 bp, Homo sapiens
ctcagtccgtcccgctaggtgc

SEQ ID NO: 9100491 - DNA, 22 bp, Homo sapiens
ctcagtccttatttgcctctac

SEQ ID NO: 9100492 - DNA, 22 bp, Homo sapiens
ctcagtccgtcccgctaggtgc

SEQ ID NO: 9100493 - DNA, 22 bp, Homo sapiens
ctcagtccttatttgcctctac

SEQ ID NO: 9100494 - DNA, 22 bp, Homo sapiens
ctcagtctcttgggctgtgaag

SEQ ID NO: 9100495 - DNA, 22 bp, Homo sapiens
ctcagtgcagctaggcatgaga

SEQ ID NO: 9100496 - DNA, 22 bp, Homo sapiens
ttggaaaagcgttctctgtagc

SEQ ID NO: 9100497 - DNA, 22 bp, Homo sapiens
ttggaaaagtgaaactagatgc

SEQ ID NO: 9100498 - DNA, 22 bp, Homo sapiens
ttggaaaagtgaaactagatgc

SEQ ID NO: 9100499 - DNA, 22 bp, Homo sapiens
ttggaaaagtgaaactagatgc

SEQ ID NO: 9100500 - DNA, 22 bp, Homo sapiens
ttggaaggagtctttggggatg

SEQ ID NO: 9100501 - DNA, 22 bp, Homo sapiens
ttggaaggatttagagatgtct

SEQ ID NO: 9100502 - DNA, 22 bp, Homo sapiens
ttggaaggatttagagatgtct

SEQ ID NO: 9100503 - DNA, 22 bp, Homo sapiens
ttggaaggccagcaccttgagt

SEQ ID NO: 9100504 - DNA, 22 bp, Homo sapiens
ttggaaggccctgcctagcagg

SEQ ID NO: 9100505 - DNA, 22 bp, Homo sapiens
ttggaaggcagcatttgtccat

SEQ ID NO: 9100506 - DNA, 22 bp, Homo sapiens
ttggaaggagtcaaccagctga

SEQ ID NO: 9100507 - DNA, 22 bp, Homo sapiens
ttggaaggagcctaaaagagac

SEQ ID NO: 9100508 - DNA, 19 bp, Homo sapiens
ttggaaggagccagagtgg

SEQ ID NO: 9100509 - DNA, 19 bp, Homo sapiens
ttggaaggagccagagtgg

SEQ ID NO: 9100510 - DNA, 22 bp, Homo sapiens
ttggaaggaagaaccgcggtag

SEQ ID NO: 9100511 - DNA, 22 bp, Homo sapiens
ttggaaggaccaggccttgatt

SEQ ID NO: 9100512 - DNA, 22 bp, Homo sapiens
ttggaaggaccaggccttgatt

SEQ ID NO: 9100513 - DNA, 22 bp, Homo sapiens
ttggaaggaattaaggtcatga

SEQ ID NO: 9100514 - DNA, 22 bp, Homo sapiens
ttggaagatctaacagaggcat

SEQ ID NO: 9100515 - DNA, 22 bp, Homo sapiens
ttggaaggccctgcctagcagg

SEQ ID NO: 9100516 - DNA, 22 bp, Homo sapiens
ttggaagggaacaccatttgac

SEQ ID NO: 9100517 - DNA, 22 bp, Homo sapiens
ttggaaggctgaatggcctctc

SEQ ID NO: 9100518 - DNA, 22 bp, Homo sapiens
ttggaagggaaccgagtttgct

SEQ ID NO: 9100519 - DNA, 23 bp, Homo sapiens
ttggaagggaagagcatttgaga

SEQ ID NO: 9100520 - DNA, 22 bp, Homo sapiens
ttggaagggatattggcatatg

SEQ ID NO: 9100521 - DNA, 22 bp, Homo sapiens
ttggaaggggcagagtggctgc

SEQ ID NO: 9100522 - DNA, 22 bp, Homo sapiens
ttggaaggtgagtccctgggtt

SEQ ID NO: 9100523 - DNA, 22 bp, Homo sapiens
ttggaagggtttcagttagtct

SEQ ID NO: 9100524 - DNA, 20 bp, Homo sapiens
ttggaaggtggagaagagga

SEQ ID NO: 9100525 - DNA, 20 bp, Homo sapiens
ttggaaggtggagaagagga

SEQ ID NO: 9100526 - DNA, 20 bp, Homo sapiens
ttggaaggtggagaagagga

SEQ ID NO: 9100527 - DNA, 22 bp, Homo sapiens
ttggaaggttctggtcatggtt

SEQ ID NO: 9100528 - DNA, 22 bp, Homo sapiens
ttggatccatctcaggcatagg

SEQ ID NO: 9100529 - DNA, 22 bp, Homo sapiens
ctccactcaacaagcccagtgt

SEQ ID NO: 9100530 - DNA, 22 bp, Homo sapiens
ttggagtgacagatgaggaaac

SEQ ID NO: 9100531 - DNA, 21 bp, Homo sapiens
ttggagtagcactatgtaaac

SEQ ID NO: 9100532 - DNA, 22 bp, Homo sapiens
ttggagtagatggttatggatt

SEQ ID NO: 9100533 - DNA, 22 bp, Homo sapiens
ttggagtagctggctttgtgct

SEQ ID NO: 9100534 - DNA, 22 bp, Homo sapiens
ttggagtagaaaaaatcatgct

SEQ ID NO: 9100535 - DNA, 22 bp, Homo sapiens
ctgcccccaggctgcatggctg

SEQ ID NO: 9100536 - DNA, 22 bp, Homo sapiens
ctgcccctgccaggcagctgtc

SEQ ID NO: 9100537 - DNA, 22 bp, Homo sapiens
ctgccccaccccaacctgaggt

SEQ ID NO: 9100538 - DNA, 22 bp, Homo sapiens
ctgcccaggaaccagaggggca

SEQ ID NO: 9100539 - DNA, 22 bp, Homo sapiens
ctgcccaggaaggagaggatgg

SEQ ID NO: 9100540 - DNA, 22 bp, Homo sapiens
ctgcccaggctgaaggaacatc

SEQ ID NO: 9100541 - DNA, 22 bp, Homo sapiens
ctgcccaggctgaaggaacatc

SEQ ID NO: 9100542 - DNA, 22 bp, Homo sapiens
ctgcccaggggagtgctgtcgg

SEQ ID NO: 9100543 - DNA, 22 bp, Homo sapiens
ctgcccaggggagtgctgtcgg

SEQ ID NO: 9100544 - DNA, 22 bp, Homo sapiens
ctgcccaggggagtgctgtcgg

SEQ ID NO: 9100545 - DNA, 22 bp, Homo sapiens
ctgcccagtttgggagcctttc

SEQ ID NO: 9100546 - DNA, 22 bp, Homo sapiens
ctgcccagtttgggagcctttc

SEQ ID NO: 9100547 - DNA, 21 bp, Homo sapiens
ctgcccatttgtgatgtcccc

SEQ ID NO: 9100548 - DNA, 20 bp, Homo sapiens
ctgcccagccactgagggat

SEQ ID NO: 9100549 - DNA, 20 bp, Homo sapiens
ctgcccagccactgagggat

SEQ ID NO: 9100550 - DNA, 22 bp, Homo sapiens
ctgcccagattttaccacctgc

SEQ ID NO: 9100551 - DNA, 20 bp, Homo sapiens
ctgcccagccactgagggat

SEQ ID NO: 9100552 - DNA, 20 bp, Homo sapiens
ctgcccagccactgagggat

SEQ ID NO: 9100553 - DNA, 22 bp, Homo sapiens
ctgccatgtgtgaaaggggagg

SEQ ID NO: 9100554 - DNA, 22 bp, Homo sapiens
ctgcccagattttaccacctgc

SEQ ID NO: 9100555 - DNA, 22 bp, Homo sapiens
ctgcaggagcaaagcctctgct

SEQ ID NO: 9100556 - DNA, 22 bp, Homo sapiens
ctgcaggatttcatgggctgac

SEQ ID NO: 9100557 - DNA, 21 bp, Homo sapiens
ctgcaggatgctgaagccagg

SEQ ID NO: 9100558 - DNA, 21 bp, Homo sapiens
ctgcaggatgctgaagccagg

SEQ ID NO: 9100559 - DNA, 22 bp, Homo sapiens
ctgcagcttatttgctgtgtga

SEQ ID NO: 9100560 - DNA, 22 bp, Homo sapiens
ctgcagctttcgctccatcagc

SEQ ID NO: 9100561 - DNA, 22 bp, Homo sapiens
ctgcagctttggaaacctgttt

SEQ ID NO: 9100562 - DNA, 22 bp, Homo sapiens
ctgcagctttggaaacctgttt

SEQ ID NO: 9100563 - DNA, 22 bp, Homo sapiens
ctgcagctttttgtgcttgtaa

SEQ ID NO: 9100564 - DNA, 22 bp, Homo sapiens
ctgcagctgtagaggacagtgg

SEQ ID NO: 9100565 - DNA, 22 bp, Homo sapiens
ctgcagctgtagaggacagtgg

SEQ ID NO: 9100566 - DNA, 22 bp, Homo sapiens
ctgcagctgtctctactgggca

SEQ ID NO: 9100567 - DNA, 22 bp, Homo sapiens
ctgcagctgtctctactgggca

SEQ ID NO: 9100568 - DNA, 22 bp, Homo sapiens
ctgcagcttaaaggagttcaat

SEQ ID NO: 9100569 - DNA, 22 bp, Homo sapiens
ctgcagcttaaaggagttcaat

SEQ ID NO: 9100570 - DNA, 22 bp, Homo sapiens
ctgcagcctaggtgcagctggg

SEQ ID NO: 9100571 - DNA, 22 bp, Homo sapiens
ctgcagcctaggtgcagctggg

SEQ ID NO: 9100572 - DNA, 22 bp, Homo sapiens
ctgcagcctcaacctcctgagc

SEQ ID NO: 9100573 - DNA, 22 bp, Homo sapiens
ctgcagcctcaacctcctgagc

SEQ ID NO: 9100574 - DNA, 22 bp, Homo sapiens
ctgcagcctcaacctcctgagc

SEQ ID NO: 9100575 - DNA, 22 bp, Homo sapiens
ctgcagctgggccagggccacc

SEQ ID NO: 9100576 - DNA, 22 bp, Homo sapiens
ctgaggtgagcttccctgggct

SEQ ID NO: 9100577 - DNA, 22 bp, Homo sapiens
ctgaggtgctagggtccctgct

SEQ ID NO: 9100578 - DNA, 22 bp, Homo sapiens
ctgaggtggaacagaggtgaag

SEQ ID NO: 9100579 - DNA, 19 bp, Homo sapiens
ctgaggtgcagtaagaggc

SEQ ID NO: 9100580 - DNA, 22 bp, Homo sapiens
ctgaggtggcatcctagctcta

SEQ ID NO: 9100581 - DNA, 22 bp, Homo sapiens
ctgaggtgttgatgacctatgc

SEQ ID NO: 9100582 - DNA, 22 bp, Homo sapiens
ctgaggtgtgagccacttcccc

SEQ ID NO: 9100583 - DNA, 22 bp, Homo sapiens
ctcttcctacagtctgctatgc

SEQ ID NO: 9100584 - DNA, 22 bp, Homo sapiens
ttttggaaccaacagtgcacct

SEQ ID NO: 9100585 - DNA, 22 bp, Homo sapiens
ttttgcttatctgagtgcagcc

SEQ ID NO: 9100586 - DNA, 22 bp, Homo sapiens
ttttgcttttgtaacacagtgt

SEQ ID NO: 9100587 - DNA, 22 bp, Homo sapiens
ttttgctttaagatggagagga

SEQ ID NO: 9100588 - DNA, 22 bp, Homo sapiens
ctcttccttaagactataaaga

SEQ ID NO: 9100589 - DNA, 22 bp, Homo sapiens
ctcttccttaagactataaaga

SEQ ID NO: 9100590 - DNA, 22 bp, Homo sapiens
ctcttcctctcatgcggtcata

SEQ ID NO: 9100591 - DNA, 22 bp, Homo sapiens
ctcttcttatggccgtggctga

SEQ ID NO: 9100592 - DNA, 22 bp, Homo sapiens
ctcttctctgcagcctttgaag

SEQ ID NO: 9100593 - DNA, 19 bp, Homo sapiens
ctgagcagcggcagcactt

SEQ ID NO: 9100594 - DNA, 19 bp, Homo sapiens
ctgagcagcggcagcactt

SEQ ID NO: 9100595 - DNA, 19 bp, Homo sapiens
ctgagcagcggcagcactt

SEQ ID NO: 9100596 - DNA, 19 bp, Homo sapiens
ctgagcagcggcagcactt

SEQ ID NO: 9100597 - DNA, 19 bp, Homo sapiens
ctgagcagcggcagcactt

SEQ ID NO: 9100598 - DNA, 22 bp, Homo sapiens
ctgagcagaagggtgcacgtgc

SEQ ID NO: 9100599 - DNA, 22 bp, Homo sapiens
ctgagcagctccctgagtggtc

SEQ ID NO: 9100600 - DNA, 22 bp, Homo sapiens
ctgagcagcgtggggagctggc

SEQ ID NO: 9100601 - DNA, 22 bp, Homo sapiens
ctgagcagtggttcttgagcgc

SEQ ID NO: 9100602 - DNA, 22 bp, Homo sapiens
ctgagcagtgctttgcagtggg

SEQ ID NO: 9100603 - DNA, 22 bp, Homo sapiens
ctgagcagtggttcttgagcgc

SEQ ID NO: 9100604 - DNA, 22 bp, Homo sapiens
ctgagcagtctagccaggtgtt

SEQ ID NO: 9100605 - DNA, 22 bp, Homo sapiens
ctgagcagggaccaaaagcatt

SEQ ID NO: 9100606 - DNA, 22 bp, Homo sapiens
ctgagcagtagagggtctcttt

SEQ ID NO: 9100607 - DNA, 22 bp, Homo sapiens
ctgagcaggatattcacagcag

SEQ ID NO: 9100608 - DNA, 22 bp, Homo sapiens
ctgagcaggatattcacagcag

SEQ ID NO: 9100609 - DNA, 18 bp, Homo sapiens
ctgaggctggcaggagcc

SEQ ID NO: 9100610 - DNA, 23 bp, Homo sapiens
ctgaggggaaaagggcttcaggc

SEQ ID NO: 9100611 - DNA, 22 bp, Homo sapiens
ctgaggctggagtgcagtggtg

SEQ ID NO: 9100612 - DNA, 22 bp, Homo sapiens
ctgaggctggagtgcagtggtg

SEQ ID NO: 9100613 - DNA, 22 bp, Homo sapiens
ctgaggctgaagagggcctacg

SEQ ID NO: 9100614 - DNA, 22 bp, Homo sapiens
ctgaggctgaagagggcctacg

SEQ ID NO: 9100615 - DNA, 22 bp, Homo sapiens
ctgaggctctgggtgtcactgt

SEQ ID NO: 9100616 - DNA, 22 bp, Homo sapiens
ctgaggctccctcgggtctgct

SEQ ID NO: 9100617 - DNA, 22 bp, Homo sapiens
ctgaggctccctcgggtctgct

SEQ ID NO: 9100618 - DNA, 22 bp, Homo sapiens
ctgaggctccctcgggtctgct

SEQ ID NO: 9100619 - DNA, 22 bp, Homo sapiens
ctgaggctgcccagggccaggt

SEQ ID NO: 9100620 - DNA, 22 bp, Homo sapiens
ctgaggctgcccagggccaggt

SEQ ID NO: 9100621 - DNA, 22 bp, Homo sapiens
ctgaggctggagtgcagtggtg

SEQ ID NO: 9100622 - DNA, 22 bp, Homo sapiens
ctgaggctcaagggcaggtggg

SEQ ID NO: 9100623 - DNA, 22 bp, Homo sapiens
ctgaggctcaagggcaggtggg

SEQ ID NO: 9100624 - DNA, 22 bp, Homo sapiens
ctgaggctcaagggcaggtggg

SEQ ID NO: 9100625 - DNA, 22 bp, Homo sapiens
ctgaggcctgtgttggggcagt

SEQ ID NO: 9100626 - DNA, 22 bp, Homo sapiens
ctgagccaaaaagcagagcttg

SEQ ID NO: 9100627 - DNA, 22 bp, Homo sapiens
ctgagccaaaaagcagagcttg

SEQ ID NO: 9100628 - DNA, 22 bp, Homo sapiens
ctgaggccgtctgggtctgcag

SEQ ID NO: 9100629 - DNA, 22 bp, Homo sapiens
ctgagccaaaaagcagagcttg

SEQ ID NO: 9100630 - DNA, 22 bp, Homo sapiens
ctgagccaaaaagcagagcttg

SEQ ID NO: 9100631 - DNA, 22 bp, Homo sapiens
ctgaggccgttggtgggcctta

SEQ ID NO: 9100632 - DNA, 22 bp, Homo sapiens
ctgaggccgttggtgggcctta

SEQ ID NO: 9100633 - DNA, 22 bp, Homo sapiens
ctgagccaaaaagcagagcttg

SEQ ID NO: 9100634 - DNA, 22 bp, Homo sapiens
ctgagcatttgtgcagcttctc

SEQ ID NO: 9100635 - DNA, 22 bp, Homo sapiens
ctgagccaaaaagcagagcttg

SEQ ID NO: 9100636 - DNA, 22 bp, Homo sapiens
ctgagcatccagcaggtactgc

SEQ ID NO: 9100637 - DNA, 22 bp, Homo sapiens
ctgctgtcctatctctttgttc

SEQ ID NO: 9100638 - DNA, 22 bp, Homo sapiens
ctgctgtccaggagtgccctgt

SEQ ID NO: 9100639 - DNA, 22 bp, Homo sapiens
ctgctgtccaacctgcactcgc

SEQ ID NO: 9100640 - DNA, 22 bp, Homo sapiens
ctgctggtgcagagtggggctg

SEQ ID NO: 9100641 - DNA, 22 bp, Homo sapiens
ctgctggtgatgtctgggcatg

SEQ ID NO: 9100642 - DNA, 22 bp, Homo sapiens
ctgctggttagtcttagtggga

SEQ ID NO: 9100643 - DNA, 22 bp, Homo sapiens
ctgctgtcaaaaatcactccat

SEQ ID NO: 9100644 - DNA, 22 bp, Homo sapiens
ctgctgtcaaaaatcactccat

SEQ ID NO: 9100645 - DNA, 22 bp, Homo sapiens
ctgctgggtctatgcaagtgga

SEQ ID NO: 9100646 - DNA, 22 bp, Homo sapiens
ctgctgggtctatgcaagtgga

SEQ ID NO: 9100647 - DNA, 22 bp, Homo sapiens
ctgctgggtccccctgctgatt

SEQ ID NO: 9100648 - DNA, 19 bp, Homo sapiens
ctgctgggtgctgagggag

SEQ ID NO: 9100649 - DNA, 22 bp, Homo sapiens
ctgctggtaccagtggccgtca

SEQ ID NO: 9100650 - DNA, 22 bp, Homo sapiens
ctgctgaagttgttggtctttt

SEQ ID NO: 9100651 - DNA, 22 bp, Homo sapiens
ctgctgaagttcagctcctttt

SEQ ID NO: 9100652 - DNA, 22 bp, Homo sapiens
ctgctgaaaacaataatgatga

SEQ ID NO: 9100653 - DNA, 22 bp, Homo sapiens
ctgctgaaaacaataatgatga

SEQ ID NO: 9100654 - DNA, 22 bp, Homo sapiens
ctgctgagatgccaggagctct

SEQ ID NO: 9100655 - DNA, 22 bp, Homo sapiens
ctgctgagagccccagctgaga

SEQ ID NO: 9100656 - DNA, 22 bp, Homo sapiens
ctgctgggaaggtctgctcagt

SEQ ID NO: 9100657 - DNA, 22 bp, Homo sapiens
ctgctgggaaggtctgctcagt

SEQ ID NO: 9100658 - DNA, 22 bp, Homo sapiens
ctgctgagcatcagggctgccc

SEQ ID NO: 9100659 - DNA, 22 bp, Homo sapiens
ctgcctttgcccttgacactgt

SEQ ID NO: 9100660 - DNA, 22 bp, Homo sapiens
ctgcctttgcccttgacactgt

SEQ ID NO: 9100661 - DNA, 22 bp, Homo sapiens
ctgccttgtcttgttttcaggg

SEQ ID NO: 9100662 - DNA, 22 bp, Homo sapiens
ctgccttgtcttgttttcaggg

SEQ ID NO: 9100663 - DNA, 22 bp, Homo sapiens
ctgccttggttcccagccagca

SEQ ID NO: 9100664 - DNA, 22 bp, Homo sapiens
ctgccttggccctagttcatgg

SEQ ID NO: 9100665 - DNA, 22 bp, Homo sapiens
ctgcgcaggggtggcgccagaa

SEQ ID NO: 9100666 - DNA, 21 bp, Homo sapiens
ctgctctgacagtgaggccag

SEQ ID NO: 9100667 - DNA, 21 bp, Homo sapiens
ctgctctgacagtgaggccag

SEQ ID NO: 9100668 - DNA, 22 bp, Homo sapiens
ctgcctttggggagttagaggg

SEQ ID NO: 9100669 - DNA, 22 bp, Homo sapiens
ctgccttttcatctgagctgga

SEQ ID NO: 9100670 - DNA, 22 bp, Homo sapiens
ctgccttttaaagccagtgtta

SEQ ID NO: 9100671 - DNA, 22 bp, Homo sapiens
ctgcctttgtgatcagttcttt

SEQ ID NO: 9100672 - DNA, 22 bp, Homo sapiens
ctgcctttgtgatcagttcttt

SEQ ID NO: 9100673 - DNA, 22 bp, Homo sapiens
ctgctctgttcccccatcatct

SEQ ID NO: 9100674 - DNA, 22 bp, Homo sapiens
ctgctctgttcccccatcatct

SEQ ID NO: 9100675 - DNA, 22 bp, Homo sapiens
ctgctctgttaattaaactttg

SEQ ID NO: 9100676 - DNA, 22 bp, Homo sapiens
ctgctctgtttcttagctgggt

SEQ ID NO: 9100677 - DNA, 22 bp, Homo sapiens
ctgctctgtttcttagctgggt

SEQ ID NO: 9100678 - DNA, 22 bp, Homo sapiens
ctgctctgtttcttagctgggt

SEQ ID NO: 9100679 - DNA, 22 bp, Homo sapiens
ctgctctgaccctttcaccttc

SEQ ID NO: 9100680 - DNA, 22 bp, Homo sapiens
ctgctctgtggtccatgagaca

SEQ ID NO: 9100681 - DNA, 22 bp, Homo sapiens
ctgctctgtggtccatgagaca

SEQ ID NO: 9100682 - DNA, 22 bp, Homo sapiens
ctgctctgtggtccatgagaca

SEQ ID NO: 9100683 - DNA, 22 bp, Homo sapiens
ctgctctgtatatgagcaggaa

SEQ ID NO: 9100684 - DNA, 22 bp, Homo sapiens
ctgctctgtgcacttgttcagg

SEQ ID NO: 9100685 - DNA, 22 bp, Homo sapiens
ctgcctgtggtctgtgatctaa

SEQ ID NO: 9100686 - DNA, 22 bp, Homo sapiens
ctgcctgtggtctgtgatctaa

SEQ ID NO: 9100687 - DNA, 22 bp, Homo sapiens
ctgcctgttagtctagcagtta

SEQ ID NO: 9100688 - DNA, 19 bp, Homo sapiens
ctgcctgttatggagagaa

SEQ ID NO: 9100689 - DNA, 22 bp, Homo sapiens
ctgcctgtgtgtgcctgcagaa

SEQ ID NO: 9100690 - DNA, 22 bp, Homo sapiens
ctgcctggggaatgtgaggatt

SEQ ID NO: 9100691 - DNA, 22 bp, Homo sapiens
ctgcctgtgccaccgcctcatt

SEQ ID NO: 9100692 - DNA, 22 bp, Homo sapiens
ctgccttgaaaatgaagcttta

SEQ ID NO: 9100693 - DNA, 22 bp, Homo sapiens
ctgccttctttcaagggtaagc

SEQ ID NO: 9100694 - DNA, 22 bp, Homo sapiens
ctgccttgaggaggttgtggga

SEQ ID NO: 9100695 - DNA, 22 bp, Homo sapiens
ctgcctgtttcctcttgctccc

SEQ ID NO: 9100696 - DNA, 18 bp, Homo sapiens
ctgcctgttgctgagagg

SEQ ID NO: 9100697 - DNA, 22 bp, Homo sapiens
ctgcctgttttctgatagattt

SEQ ID NO: 9100698 - DNA, 22 bp, Homo sapiens
ctgctgtgagtttggaggtcta

SEQ ID NO: 9100699 - DNA, 22 bp, Homo sapiens
ctgctgtctagtatcttaaaaa

SEQ ID NO: 9100700 - DNA, 22 bp, Homo sapiens
ctgctgtcgccgagctgcatgc

SEQ ID NO: 9100701 - DNA, 22 bp, Homo sapiens
ctgctgtctttatttcactgct

SEQ ID NO: 9100702 - DNA, 22 bp, Homo sapiens
ctgctgtgagtggttcttgcct

SEQ ID NO: 9100703 - DNA, 22 bp, Homo sapiens
ctggaagctggaacaggtgtgg

SEQ ID NO: 9100704 - DNA, 22 bp, Homo sapiens
ctggaaggagaaggaggctgtg

SEQ ID NO: 9100705 - DNA, 22 bp, Homo sapiens
ctggaaggtctgtccccactgc

SEQ ID NO: 9100706 - DNA, 22 bp, Homo sapiens
ctggaaggtaacaaggccatta

SEQ ID NO: 9100707 - DNA, 22 bp, Homo sapiens
ctggaaggtaacaaggccatta

SEQ ID NO: 9100708 - DNA, 22 bp, Homo sapiens
ctggaaggtgactgtcttgaat

SEQ ID NO: 9100709 - DNA, 22 bp, Homo sapiens
ctggaaggtggatggcgaggcc

SEQ ID NO: 9100710 - DNA, 22 bp, Homo sapiens
ctggaagggtcagagtgatgag

SEQ ID NO: 9100711 - DNA, 22 bp, Homo sapiens
ctggaagggtcagagtgatgag

SEQ ID NO: 9100712 - DNA, 22 bp, Homo sapiens
ctggaaggtaacaaggccatta

SEQ ID NO: 9100713 - DNA, 22 bp, Homo sapiens
ctggaagggtctacttagcaga

SEQ ID NO: 9100714 - DNA, 22 bp, Homo sapiens
ctggaagggtctacttagcaga

SEQ ID NO: 9100715 - DNA, 22 bp, Homo sapiens
ctggaaggttcctcccagctcc

SEQ ID NO: 9100716 - DNA, 22 bp, Homo sapiens
ctggagaactagttaaacacgt

SEQ ID NO: 9100717 - DNA, 22 bp, Homo sapiens
ctggaagggagcactgtagaga

SEQ ID NO: 9100718 - DNA, 22 bp, Homo sapiens
ctggaagggaaatctcttggca

SEQ ID NO: 9100719 - DNA, 22 bp, Homo sapiens
ctggaaggctctgctgcctgtc

SEQ ID NO: 9100720 - DNA, 22 bp, Homo sapiens
ctggaagggaaatctcttggca

SEQ ID NO: 9100721 - DNA, 22 bp, Homo sapiens
ctggaagggaaatctcttggca

SEQ ID NO: 9100722 - DNA, 22 bp, Homo sapiens
ctggaagggtacataggaaact

SEQ ID NO: 9100723 - DNA, 22 bp, Homo sapiens
ctggaagggtacataggaaact

SEQ ID NO: 9100724 - DNA, 22 bp, Homo sapiens
ctggaagggagcactgtagaga

SEQ ID NO: 9100725 - DNA, 22 bp, Homo sapiens
ctggaaggggcagtctttgggc

SEQ ID NO: 9100726 - DNA, 22 bp, Homo sapiens
ctggaagggggacagccacaca

SEQ ID NO: 9100727 - DNA, 22 bp, Homo sapiens
ctggaaggagcccgggcggatc

SEQ ID NO: 9100728 - DNA, 22 bp, Homo sapiens
ctggaaggagaaggaggctgtg

SEQ ID NO: 9100729 - DNA, 19 bp, Homo sapiens
ctggaaggagggactgttc

SEQ ID NO: 9100730 - DNA, 19 bp, Homo sapiens
ctggaaggagggactgttc

SEQ ID NO: 9100731 - DNA, 22 bp, Homo sapiens
ctggaaggcggaggttgtagtg

SEQ ID NO: 9100732 - DNA, 22 bp, Homo sapiens
ctggaaggcagaggttgcagtg

SEQ ID NO: 9100733 - DNA, 22 bp, Homo sapiens
ctggagcctaggttgacctggg

SEQ ID NO: 9100734 - DNA, 22 bp, Homo sapiens
ctggagccggcgagccccagcc

SEQ ID NO: 9100735 - DNA, 22 bp, Homo sapiens
ctggagcctaggttgacctggg

SEQ ID NO: 9100736 - DNA, 22 bp, Homo sapiens
ctggagcctgcagttttcactt

SEQ ID NO: 9100737 - DNA, 22 bp, Homo sapiens
ctggagccggaccagggacggt

SEQ ID NO: 9100738 - DNA, 22 bp, Homo sapiens
ctggagccggaccagggacggt

SEQ ID NO: 9100739 - DNA, 22 bp, Homo sapiens
ctggagccggaccagggacggt

SEQ ID NO: 9100740 - DNA, 22 bp, Homo sapiens
ctggagccggcgagccccagcc

SEQ ID NO: 9100741 - DNA, 22 bp, Homo sapiens
ctggagcaggtttaggagtccc

SEQ ID NO: 9100742 - DNA, 22 bp, Homo sapiens
ctggagcagcaggtggccaggg

SEQ ID NO: 9100743 - DNA, 22 bp, Homo sapiens
ctggagccctgaatgggcagga

SEQ ID NO: 9100744 - DNA, 22 bp, Homo sapiens
ctggagccctgaatgggcagga

SEQ ID NO: 9100745 - DNA, 22 bp, Homo sapiens
ctggagccccaggctgtgcaga

SEQ ID NO: 9100746 - DNA, 22 bp, Homo sapiens
ctggagccccaggctgtgcaga

SEQ ID NO: 9100747 - DNA, 22 bp, Homo sapiens
ctggagccccaggctgtgcaga

SEQ ID NO: 9100748 - DNA, 22 bp, Homo sapiens
ctggagcatccatgcccagggt

SEQ ID NO: 9100749 - DNA, 22 bp, Homo sapiens
ctggagataagtaaagaggcaa

SEQ ID NO: 9100750 - DNA, 22 bp, Homo sapiens
ctggagcaaaagtgactcctct

SEQ ID NO: 9100751 - DNA, 22 bp, Homo sapiens
ctggagagttggaagatggact

SEQ ID NO: 9100752 - DNA, 22 bp, Homo sapiens
ctggagagttggaagatggact

SEQ ID NO: 9100753 - DNA, 22 bp, Homo sapiens
ctggagagggagctgttggaag

SEQ ID NO: 9100754 - DNA, 22 bp, Homo sapiens
ctggagagggagccctggcagt

SEQ ID NO: 9100755 - DNA, 22 bp, Homo sapiens
ctggagaggctgggaacaggtt

SEQ ID NO: 9100756 - DNA, 22 bp, Homo sapiens
ctggagagaccgaaagaggctg

SEQ ID NO: 9100757 - DNA, 22 bp, Homo sapiens
ctggagaggctgggaacaggtt

SEQ ID NO: 9100758 - DNA, 22 bp, Homo sapiens
tttccacccagagcatttgttt

SEQ ID NO: 9100759 - DNA, 22 bp, Homo sapiens
tttctacagtactgatttcata

SEQ ID NO: 9100760 - DNA, 22 bp, Homo sapiens
tttctacagtactgatttcata

SEQ ID NO: 9100761 - DNA, 22 bp, Homo sapiens
tttctacagtactgatttcata

SEQ ID NO: 9100762 - DNA, 22 bp, Homo sapiens
tttctacagctggtgcaacttt

SEQ ID NO: 9100763 - DNA, 22 bp, Homo sapiens
tttctacagaagatacactgct

SEQ ID NO: 9100764 - DNA, 22 bp, Homo sapiens
ctctctttttcgtgtgccgaag

SEQ ID NO: 9100765 - DNA, 22 bp, Homo sapiens
ctctgaaaatgtggtggggaaa

SEQ ID NO: 9100766 - DNA, 22 bp, Homo sapiens
ctctgaaactcctgcaccttct

SEQ ID NO: 9100767 - DNA, 22 bp, Homo sapiens
ctctgaaactccagccccaggt

SEQ ID NO: 9100768 - DNA, 22 bp, Homo sapiens
ctctctttgatgtataaataat

SEQ ID NO: 9100769 - DNA, 22 bp, Homo sapiens
ctctctttctgaatgaggacta

SEQ ID NO: 9100770 - DNA, 22 bp, Homo sapiens
ctctgaaagcaaaactagagaa

SEQ ID NO: 9100771 - DNA, 22 bp, Homo sapiens
ctctgaaagcaaaactagagaa

SEQ ID NO: 9100772 - DNA, 22 bp, Homo sapiens
ctctgaaagttagagaaaatag

SEQ ID NO: 9100773 - DNA, 22 bp, Homo sapiens
ctctgaaattggccctcagcag

SEQ ID NO: 9100774 - DNA, 22 bp, Homo sapiens
ctctgaaagagtttagtattat

SEQ ID NO: 9100775 - DNA, 22 bp, Homo sapiens
ctctgaaagacaagctctcatt

SEQ ID NO: 9100776 - DNA, 18 bp, Homo sapiens
ctctgaaagacacaccag

SEQ ID NO: 9100777 - DNA, 18 bp, Homo sapiens
ctctctttccactctttg

SEQ ID NO: 9100778 - DNA, 22 bp, Homo sapiens
ctctctttcattggtcgccttg

SEQ ID NO: 9100779 - DNA, 22 bp, Homo sapiens
ctctcttcccgtgagtgttgca

SEQ ID NO: 9100780 - DNA, 22 bp, Homo sapiens
ctctctgttatgctttcatgaa

SEQ ID NO: 9100781 - DNA, 22 bp, Homo sapiens
ctctctgtggtggctgtcccat

SEQ ID NO: 9100782 - DNA, 22 bp, Homo sapiens
ctctctggtttcagcgaagggg

SEQ ID NO: 9100783 - DNA, 22 bp, Homo sapiens
ctctctggtttcagcgaagggg

SEQ ID NO: 9100784 - DNA, 22 bp, Homo sapiens
tttctcaaatactgttccagga

SEQ ID NO: 9100785 - DNA, 22 bp, Homo sapiens
tttctattttaaaggcatatgg

SEQ ID NO: 9100786 - DNA, 22 bp, Homo sapiens
tttctcaaaagacagaagtgaa

SEQ ID NO: 9100787 - DNA, 22 bp, Homo sapiens
tttctacatgtcagtaactgat

SEQ ID NO: 9100788 - DNA, 22 bp, Homo sapiens
tttctattttaaaggcatatgg

SEQ ID NO: 9100789 - DNA, 22 bp, Homo sapiens
tttctcaagtactgcacatgaa

SEQ ID NO: 9100790 - DNA, 22 bp, Homo sapiens
tttctcaactgtattatgcaga

SEQ ID NO: 9100791 - DNA, 22 bp, Homo sapiens
tttctcaagttcagatatttga

SEQ ID NO: 9100792 - DNA, 22 bp, Homo sapiens
tttctcaagttcagatatttga

SEQ ID NO: 9100793 - DNA, 18 bp, Homo sapiens
ctctctggtctggatccc

SEQ ID NO: 9100794 - DNA, 18 bp, Homo sapiens
ctctctggtctggatccc

SEQ ID NO: 9100795 - DNA, 19 bp, Homo sapiens
ctctctggcggtgtctgcg

SEQ ID NO: 9100796 - DNA, 22 bp, Homo sapiens
tttatgtaagtggaatgatgcc

SEQ ID NO: 9100797 - DNA, 22 bp, Homo sapiens
tttattcactcattcagccagt

SEQ ID NO: 9100798 - DNA, 19 bp, Homo sapiens
tttattcacctttaccttg

SEQ ID NO: 9100799 - DNA, 22 bp, Homo sapiens
tttattcacttcagtgccaaag

SEQ ID NO: 9100800 - DNA, 22 bp, Homo sapiens
tttattcactggggtctgcccg

SEQ ID NO: 9100801 - DNA, 22 bp, Homo sapiens
ctccaggatgttagacgtccag

SEQ ID NO: 9100802 - DNA, 22 bp, Homo sapiens
ctccaggagggcttcctgtgat

SEQ ID NO: 9100803 - DNA, 22 bp, Homo sapiens
ctccaggactgaggacagagct

SEQ ID NO: 9100804 - DNA, 22 bp, Homo sapiens
ctccaggaggttgctgcttcct

SEQ ID NO: 9100805 - DNA, 23 bp, Homo sapiens
tttatattcctaatgtcttgagc

SEQ ID NO: 9100806 - DNA, 22 bp, Homo sapiens
ctccaggccagggaagtggaca

SEQ ID NO: 9100807 - DNA, 22 bp, Homo sapiens
tttattcatcatctgttcatat

SEQ ID NO: 9100808 - DNA, 22 bp, Homo sapiens
tttattcattgtttcgtcgcag

SEQ ID NO: 9100809 - DNA, 22 bp, Homo sapiens
tttattcagcagcagcagtggt

SEQ ID NO: 9100810 - DNA, 20 bp, Homo sapiens
tttattcagcctaccctctt

SEQ ID NO: 9100811 - DNA, 22 bp, Homo sapiens
tttcagaaggggagaaaggtca

SEQ ID NO: 9100812 - DNA, 22 bp, Homo sapiens
tttcagaaccaagagagacatc

SEQ ID NO: 9100813 - DNA, 22 bp, Homo sapiens
tttcagaaccaagagagacatc

SEQ ID NO: 9100814 - DNA, 22 bp, Homo sapiens
ctccttcccttcaagtgttcct

SEQ ID NO: 9100815 - DNA, 19 bp, Homo sapiens
ctccttccctggtttctgt

SEQ ID NO: 9100816 - DNA, 22 bp, Homo sapiens
ctccttccctaccatcaatgtt

SEQ ID NO: 9100817 - DNA, 19 bp, Homo sapiens
ctccttccctggtttctgt

SEQ ID NO: 9100818 - DNA, 22 bp, Homo sapiens
ctccttcccatgagtgtgggca

SEQ ID NO: 9100819 - DNA, 22 bp, Homo sapiens
ctccttcccctactcagcatcc

SEQ ID NO: 9100820 - DNA, 22 bp, Homo sapiens
ctccttcctgccccagtgataa

SEQ ID NO: 9100821 - DNA, 22 bp, Homo sapiens
ctccttcctgcagatctgagat

SEQ ID NO: 9100822 - DNA, 22 bp, Homo sapiens
ctccttcctgcagatctgagat

SEQ ID NO: 9100823 - DNA, 22 bp, Homo sapiens
ctccttcctggttagcacctta

SEQ ID NO: 9100824 - DNA, 23 bp, Homo sapiens
tttcagaagtggtcctaggaagc

SEQ ID NO: 9100825 - DNA, 22 bp, Homo sapiens
tttcagaatagcaaagcaagct

SEQ ID NO: 9100826 - DNA, 22 bp, Homo sapiens
ctccttcagctgaatccctgct

SEQ ID NO: 9100827 - DNA, 22 bp, Homo sapiens
ctccttccaacaagagaaagag

SEQ ID NO: 9100828 - DNA, 22 bp, Homo sapiens
ctccttcatgtcatgtgtccgg

SEQ ID NO: 9100829 - DNA, 22 bp, Homo sapiens
ctctgggtctccctgaggctaa

SEQ ID NO: 9100830 - DNA, 22 bp, Homo sapiens
ctctgggtctccctgaggctaa

SEQ ID NO: 9100831 - DNA, 22 bp, Homo sapiens
ctctgggtctataatgcagctg

SEQ ID NO: 9100832 - DNA, 22 bp, Homo sapiens
ctctgggtcctggggctacaag

SEQ ID NO: 9100833 - DNA, 20 bp, Homo sapiens
ctctgggtcgagacagactt

SEQ ID NO: 9100834 - DNA, 22 bp, Homo sapiens
ctctgggtctacctgtggccag

SEQ ID NO: 9100835 - DNA, 22 bp, Homo sapiens
ctctgggtgtcttaggagctca

SEQ ID NO: 9100836 - DNA, 22 bp, Homo sapiens
ctctgggtggtctcactgagtg

SEQ ID NO: 9100837 - DNA, 22 bp, Homo sapiens
ctctgggtgggcagcagatgga

SEQ ID NO: 9100838 - DNA, 22 bp, Homo sapiens
ctctgggtgttaatgtcagtgt

SEQ ID NO: 9100839 - DNA, 22 bp, Homo sapiens
ctctgggtgtgacagcacctgg

SEQ ID NO: 9100840 - DNA, 21 bp, Homo sapiens
tttgttcaggggcaaagttaa

SEQ ID NO: 9100841 - DNA, 22 bp, Homo sapiens
tttggaatgaaacagcagagcc

SEQ ID NO: 9100842 - DNA, 22 bp, Homo sapiens
ctctggctccatttccctatgt

SEQ ID NO: 9100843 - DNA, 22 bp, Homo sapiens
ctctggctcccgcagcccccat

SEQ ID NO: 9100844 - DNA, 22 bp, Homo sapiens
tttggaatgtagtttaatcatc

SEQ ID NO: 9100845 - DNA, 22 bp, Homo sapiens
tttggaatggtaccttcagttg

SEQ ID NO: 9100846 - DNA, 22 bp, Homo sapiens
tttggaatggaatagagattgc

SEQ ID NO: 9100847 - DNA, 22 bp, Homo sapiens
tttggaattatgcttaaagttt

SEQ ID NO: 9100848 - DNA, 22 bp, Homo sapiens
tttggaattccatttctgcatt

SEQ ID NO: 9100849 - DNA, 20 bp, Homo sapiens
ctctgggctgcaccctcgcc

SEQ ID NO: 9100850 - DNA, 22 bp, Homo sapiens
tttgttctaacttctgcagaca

SEQ ID NO: 9100851 - DNA, 22 bp, Homo sapiens
ctctgtgcttatgctccatggg

SEQ ID NO: 9100852 - DNA, 22 bp, Homo sapiens
ctctgtgcgggccatggtcagg

SEQ ID NO: 9100853 - DNA, 22 bp, Homo sapiens
ctctgtgcctcagttttcttct

SEQ ID NO: 9100854 - DNA, 22 bp, Homo sapiens
ctctgtgggggagaggcagctg

SEQ ID NO: 9100855 - DNA, 22 bp, Homo sapiens
ctctgtggaagaagaaagaagg

SEQ ID NO: 9100856 - DNA, 17 bp, Homo sapiens
ctctgtggaggtgttta

SEQ ID NO: 9100857 - DNA, 22 bp, Homo sapiens
ctctgtgggccagagaggcccc

SEQ ID NO: 9100858 - DNA, 22 bp, Homo sapiens
ctctgtgggaggaggagtaggc

SEQ ID NO: 9100859 - DNA, 22 bp, Homo sapiens
ctctgtgggaagctgggtgtga

SEQ ID NO: 9100860 - DNA, 22 bp, Homo sapiens
ctctgtgttcagcctagcagaa

SEQ ID NO: 9100861 - DNA, 22 bp, Homo sapiens
ctctgtgttccgggttgctgct

SEQ ID NO: 9100862 - DNA, 22 bp, Homo sapiens
ctctgtggttagactatggctg

SEQ ID NO: 9100863 - DNA, 22 bp, Homo sapiens
ctctgtgtatccaagttcaggt

SEQ ID NO: 9100864 - DNA, 22 bp, Homo sapiens
ctctgtgtctgaagccctattt

SEQ ID NO: 9100865 - DNA, 22 bp, Homo sapiens
ctctgtgtctgagttatggtct

SEQ ID NO: 9100866 - DNA, 22 bp, Homo sapiens
ctctgtgtgctggtggggtcct

SEQ ID NO: 9100867 - DNA, 22 bp, Homo sapiens
ttttgcctgagagtgaaaataa

SEQ ID NO: 9100868 - DNA, 22 bp, Homo sapiens
ttttgcctagggttgacccgtt

SEQ ID NO: 9100869 - DNA, 22 bp, Homo sapiens
ttttctcttccctctggacctg

SEQ ID NO: 9100870 - DNA, 22 bp, Homo sapiens
ttttgcttaatctagattttgc

SEQ ID NO: 9100871 - DNA, 22 bp, Homo sapiens
ttttgcctgcactgtatatata

SEQ ID NO: 9100872 - DNA, 22 bp, Homo sapiens
ttttgcctgtgaatactatctt

SEQ ID NO: 9100873 - DNA, 22 bp, Homo sapiens
ttttgcctgagatccgagtctg

SEQ ID NO: 9100874 - DNA, 22 bp, Homo sapiens
tttgagaaaaagtgatgatgat

SEQ ID NO: 9100875 - DNA, 22 bp, Homo sapiens
tttgagaaaaccagaaagatct

SEQ ID NO: 9100876 - DNA, 22 bp, Homo sapiens
tttgagaaacagacgaaagaca

SEQ ID NO: 9100877 - DNA, 22 bp, Homo sapiens
tttgagaaaaccagaaagatct

SEQ ID NO: 9100878 - DNA, 22 bp, Homo sapiens
tttgacttctgggcattttggt

SEQ ID NO: 9100879 - DNA, 22 bp, Homo sapiens
tttgagaagcatctggtccact

SEQ ID NO: 9100880 - DNA, 22 bp, Homo sapiens
tttgcaaaatgaggtgaagagt

SEQ ID NO: 9100881 - DNA, 22 bp, Homo sapiens
tttgcaaaatgaggtgaagagt

SEQ ID NO: 9100882 - DNA, 22 bp, Homo sapiens
tttgcaaaatgtcttgtgttag

SEQ ID NO: 9100883 - DNA, 22 bp, Homo sapiens
tttgcaaaattattcccagcat

SEQ ID NO: 9100884 - DNA, 22 bp, Homo sapiens
tttgagaaatgggctctgtgct

SEQ ID NO: 9100885 - DNA, 22 bp, Homo sapiens
tttgagaagataggggaatact

SEQ ID NO: 9100886 - DNA, 22 bp, Homo sapiens
tttgagaagatgtaatgttaag

SEQ ID NO: 9100887 - DNA, 22 bp, Homo sapiens
tttgcaaaccggagctctgcaa

SEQ ID NO: 9100888 - DNA, 22 bp, Homo sapiens
tttgcaaacacttaagaagaga

SEQ ID NO: 9100889 - DNA, 22 bp, Homo sapiens
tttgcaaaccggagctctgcaa

SEQ ID NO: 9100890 - DNA, 22 bp, Homo sapiens
tttgcaaacattcagggctcca

SEQ ID NO: 9100891 - DNA, 22 bp, Homo sapiens
tttgcaaacggccctgagtccc

SEQ ID NO: 9100892 - DNA, 22 bp, Homo sapiens
tttgcaaactttcctctggacc

SEQ ID NO: 9100893 - DNA, 22 bp, Homo sapiens
tttgcaaacacttaagaagaga

SEQ ID NO: 9100894 - DNA, 22 bp, Homo sapiens
tttgcaaaattattcccagcat

SEQ ID NO: 9100895 - DNA, 22 bp, Homo sapiens
tttgcaaagaaattattgctgt

SEQ ID NO: 9100896 - DNA, 22 bp, Homo sapiens
tttgcaaactttcctctggacc

SEQ ID NO: 9100897 - DNA, 22 bp, Homo sapiens
tttgcaaactttcctctggacc

SEQ ID NO: 9100898 - DNA, 22 bp, Homo sapiens
tttgcaaagtccattgaagtta

SEQ ID NO: 9100899 - DNA, 22 bp, Homo sapiens
tttgcaaagtccctgggatgga

SEQ ID NO: 9100900 - DNA, 22 bp, Homo sapiens
tttgcaaagtccattgaagtta

SEQ ID NO: 9100901 - DNA, 18 bp, Homo sapiens
tttgcaaaggaagtatgg

SEQ ID NO: 9100902 - DNA, 18 bp, Homo sapiens
tttgcaaaggaagtatgg

SEQ ID NO: 9100903 - DNA, 22 bp, Homo sapiens
tttgcaaagtgactattatatg

SEQ ID NO: 9100904 - DNA, 22 bp, Homo sapiens
tttgcaaagtgactattatatg

SEQ ID NO: 9100905 - DNA, 22 bp, Homo sapiens
ctctggcacactccttccaggt

SEQ ID NO: 9100906 - DNA, 20 bp, Homo sapiens
ctctggcaaaggatgcctat

SEQ ID NO: 9100907 - DNA, 22 bp, Homo sapiens
ctctggagtgggtggccgggag

SEQ ID NO: 9100908 - DNA, 22 bp, Homo sapiens
ctctggccccagtggccccttg

SEQ ID NO: 9100909 - DNA, 22 bp, Homo sapiens
ctctggccgagcatgggggtta

SEQ ID NO: 9100910 - DNA, 22 bp, Homo sapiens
ctctggccgcagctcagctctg

SEQ ID NO: 9100911 - DNA, 22 bp, Homo sapiens
ctctggcctggggcctgctccc

SEQ ID NO: 9100912 - DNA, 22 bp, Homo sapiens
ctctggcctgcttcctcaggta

SEQ ID NO: 9100913 - DNA, 22 bp, Homo sapiens
ctctggcctgcttcctcaggta

SEQ ID NO: 9100914 - DNA, 22 bp, Homo sapiens
ctctggcctgcagatccatgct

SEQ ID NO: 9100915 - DNA, 22 bp, Homo sapiens
tttgaaaagaaccatcgcctta

SEQ ID NO: 9100916 - DNA, 22 bp, Homo sapiens
ctctgaagggagggccaagccc

SEQ ID NO: 9100917 - DNA, 22 bp, Homo sapiens
tttgaaacaggtgattcagcta

SEQ ID NO: 9100918 - DNA, 22 bp, Homo sapiens
tttgaaacctagttatatgact

SEQ ID NO: 9100919 - DNA, 22 bp, Homo sapiens
tttgaaagaaaccagtgagtga

SEQ ID NO: 9100920 - DNA, 22 bp, Homo sapiens
tttgaaactcatgatcatcact

SEQ ID NO: 9100921 - DNA, 22 bp, Homo sapiens
tttgaaagaatttatgtacttt

SEQ ID NO: 9100922 - DNA, 22 bp, Homo sapiens
tttgaaagaatttatgtacttt

SEQ ID NO: 9100923 - DNA, 22 bp, Homo sapiens
ctctgcagaggcccaaggctga

SEQ ID NO: 9100924 - DNA, 22 bp, Homo sapiens
tttgaataatcactgggcatta

SEQ ID NO: 9100925 - DNA, 21 bp, Homo sapiens
tttgaatagaaatagtgctta

SEQ ID NO: 9100926 - DNA, 22 bp, Homo sapiens
ctctgcagaatttgagctgctc

SEQ ID NO: 9100927 - DNA, 22 bp, Homo sapiens
ctctgcagaatttgagctgctc

SEQ ID NO: 9100928 - DNA, 22 bp, Homo sapiens
ctctgcagaggcccaaggctga

SEQ ID NO: 9100929 - DNA, 22 bp, Homo sapiens
ctgtggcactcaagaagcctcc

SEQ ID NO: 9100930 - DNA, 22 bp, Homo sapiens
ctgtggcaagtctgcctgtcac

SEQ ID NO: 9100931 - DNA, 22 bp, Homo sapiens
ctgtggcaagtctgcctgtcac

SEQ ID NO: 9100932 - DNA, 23 bp, Homo sapiens
ctgtggcaagtcctgcacctgcc

SEQ ID NO: 9100933 - DNA, 22 bp, Homo sapiens
ctgtggagtttgtggcgctgac

SEQ ID NO: 9100934 - DNA, 22 bp, Homo sapiens
ctgtggagtttgtggcgctgac

SEQ ID NO: 9100935 - DNA, 22 bp, Homo sapiens
ctgtggcattgccgaggctggc

SEQ ID NO: 9100936 - DNA, 20 bp, Homo sapiens
ctgtggcatctgtcatggtg

SEQ ID NO: 9100937 - DNA, 22 bp, Homo sapiens
ctgtggcagggaagaggccatg

SEQ ID NO: 9100938 - DNA, 22 bp, Homo sapiens
ctgtgggatgggacctcagctg

SEQ ID NO: 9100939 - DNA, 22 bp, Homo sapiens
ctgtgggcatttgagtgtgggt

SEQ ID NO: 9100940 - DNA, 22 bp, Homo sapiens
ctgtgggcctagtctggcctag

SEQ ID NO: 9100941 - DNA, 22 bp, Homo sapiens
ctgtgggctcccagcttctctc

SEQ ID NO: 9100942 - DNA, 22 bp, Homo sapiens
ctgtgggctcccagcttctctc

SEQ ID NO: 9100943 - DNA, 22 bp, Homo sapiens
ctgtgggctcctgcagctcagg

SEQ ID NO: 9100944 - DNA, 22 bp, Homo sapiens
ctgtgggcgcctgtcagcctca

SEQ ID NO: 9100945 - DNA, 22 bp, Homo sapiens
ctgtggctttctctgcctcctt

SEQ ID NO: 9100946 - DNA, 22 bp, Homo sapiens
ctgtggctttctctgcctcctt

SEQ ID NO: 9100947 - DNA, 22 bp, Homo sapiens
ctgtggctttgcagggcttgtt

SEQ ID NO: 9100948 - DNA, 22 bp, Homo sapiens
ctgtgggagcactggggaccga

SEQ ID NO: 9100949 - DNA, 22 bp, Homo sapiens
ctgtgggagggaaggcgcggcc

SEQ ID NO: 9100950 - DNA, 22 bp, Homo sapiens
ctgtggcttctgggtcagttca

SEQ ID NO: 9100951 - DNA, 22 bp, Homo sapiens
ctgtggcttctgggtcagttca

SEQ ID NO: 9100952 - DNA, 22 bp, Homo sapiens
ctgtggggaagatagaaccgac

SEQ ID NO: 9100953 - DNA, 22 bp, Homo sapiens
ctgtggggaagatagaaccgac

SEQ ID NO: 9100954 - DNA, 22 bp, Homo sapiens
ctgtggggagctgatcagatca

SEQ ID NO: 9100955 - DNA, 22 bp, Homo sapiens
ctgtggggccaaattctcctct

SEQ ID NO: 9100956 - DNA, 19 bp, Homo sapiens
ctgtgggtgtgcaagggtg

SEQ ID NO: 9100957 - DNA, 22 bp, Homo sapiens
ctgtgggctgaaagtgctcccg

SEQ ID NO: 9100958 - DNA, 22 bp, Homo sapiens
ctgtggggaaagggtcctgctc

SEQ ID NO: 9100959 - DNA, 18 bp, Homo sapiens
ctgtgggctggtgcatga

SEQ ID NO: 9100960 - DNA, 20 bp, Homo sapiens
ctgtggtgagcaggagagta

SEQ ID NO: 9100961 - DNA, 22 bp, Homo sapiens
ctgtggtgagcaactgactgaa

SEQ ID NO: 9100962 - DNA, 22 bp, Homo sapiens
ctgtggtggcacagcgggctgg

SEQ ID NO: 9100963 - DNA, 20 bp, Homo sapiens
ctgtggtgagcaggagagta

SEQ ID NO: 9100964 - DNA, 22 bp, Homo sapiens
ctgtggtgagcaactgactgaa

SEQ ID NO: 9100965 - DNA, 22 bp, Homo sapiens
ctgtggtgagcaactgactgaa

SEQ ID NO: 9100966 - DNA, 22 bp, Homo sapiens
ctgtgtgatgggaagaatgttt

SEQ ID NO: 9100967 - DNA, 22 bp, Homo sapiens
ctgtgtgtgtctgcagcatact

SEQ ID NO: 9100968 - DNA, 22 bp, Homo sapiens
ctgtgtgtgtctgcagcatact

SEQ ID NO: 9100969 - DNA, 22 bp, Homo sapiens
ctgtgtgtgtctgcagcatact

SEQ ID NO: 9100970 - DNA, 22 bp, Homo sapiens
ctgtgtgtgtctgcagcatact

SEQ ID NO: 9100971 - DNA, 22 bp, Homo sapiens
ctgtgtgtgctacaggcttcca

SEQ ID NO: 9100972 - DNA, 22 bp, Homo sapiens
ctgtgtgtgctacaggcttcca

SEQ ID NO: 9100973 - DNA, 22 bp, Homo sapiens
ctgtgtgtgctacaggcttcca

SEQ ID NO: 9100974 - DNA, 22 bp, Homo sapiens
ctgtgtgtgagaagcaggttga

SEQ ID NO: 9100975 - DNA, 22 bp, Homo sapiens
ctgtgtgtgaacacagcccagc

SEQ ID NO: 9100976 - DNA, 22 bp, Homo sapiens
ctgtgtgtgagaagcaggttga

SEQ ID NO: 9100977 - DNA, 23 bp, Homo sapiens
ctgtgtgtgccgagggtggccac

SEQ ID NO: 9100978 - DNA, 23 bp, Homo sapiens
ctgtgtgtgccgagggtggccac

SEQ ID NO: 9100979 - DNA, 22 bp, Homo sapiens
ctgtgtttctaagtaaaggagc

SEQ ID NO: 9100980 - DNA, 22 bp, Homo sapiens
ctgtgtgtttatatcatttcct

SEQ ID NO: 9100981 - DNA, 22 bp, Homo sapiens
ctgtgtgtttatatcatttcct

SEQ ID NO: 9100982 - DNA, 22 bp, Homo sapiens
ctgtgttttgagatattattaa

SEQ ID NO: 9100983 - DNA, 22 bp, Homo sapiens
ctgtgttttgattaaaaagcaa

SEQ ID NO: 9100984 - DNA, 22 bp, Homo sapiens
ctgtgtttggacaacttttcag

SEQ ID NO: 9100985 - DNA, 22 bp, Homo sapiens
ctgtgtttggacaacttttcag

SEQ ID NO: 9100986 - DNA, 22 bp, Homo sapiens
ctggttctgattttgctgcatt

SEQ ID NO: 9100987 - DNA, 22 bp, Homo sapiens
ctggttcatataggcaagttta

SEQ ID NO: 9100988 - DNA, 22 bp, Homo sapiens
ctggttcatggtggaatgacat

SEQ ID NO: 9100989 - DNA, 22 bp, Homo sapiens
ctggttcccagcaggagtgtag

SEQ ID NO: 9100990 - DNA, 22 bp, Homo sapiens
ctggtttattcgtcacaccgga

SEQ ID NO: 9100991 - DNA, 17 bp, Homo sapiens
ctggtttatgggcagtg

SEQ ID NO: 9100992 - DNA, 22 bp, Homo sapiens
ctggtttatgtatcatctagaa

SEQ ID NO: 9100993 - DNA, 22 bp, Homo sapiens
ctggtttagtgaaataggccag

SEQ ID NO: 9100994 - DNA, 22 bp, Homo sapiens
ctggtttataaatctgtggcca

SEQ ID NO: 9100995 - DNA, 22 bp, Homo sapiens
ctggtttatgagggaagggatg

SEQ ID NO: 9100996 - DNA, 22 bp, Homo sapiens
ctggtttagtcataatggagaa

SEQ ID NO: 9100997 - DNA, 22 bp, Homo sapiens
ctggtttagtaggggactgaag

SEQ ID NO: 9100998 - DNA, 19 bp, Homo sapiens
ctggtttaggtagtgagtc

SEQ ID NO: 9100999 - DNA, 22 bp, Homo sapiens
ctggttggtgccacatggtggc

SEQ ID NO: 9101000 - DNA, 22 bp, Homo sapiens
ctggtttaaaattactggttaa

SEQ ID NO: 9101001 - DNA, 22 bp, Homo sapiens
ctggtttaaccatgtatcctgg

SEQ ID NO: 9101002 - DNA, 22 bp, Homo sapiens
ctggtttactctgcactgctca

SEQ ID NO: 9101003 - DNA, 22 bp, Homo sapiens
ctggtttagctgtaaggttccc

SEQ ID NO: 9101004 - DNA, 22 bp, Homo sapiens
ctggtttaagcttatatagttg

SEQ ID NO: 9101005 - DNA, 22 bp, Homo sapiens
ctggtttacccaagatttgctg

SEQ ID NO: 9101006 - DNA, 22 bp, Homo sapiens
ctggtttaagcttatatagttg

SEQ ID NO: 9101007 - DNA, 22 bp, Homo sapiens
ctgtccagtgcagagaacagag

SEQ ID NO: 9101008 - DNA, 22 bp, Homo sapiens
ctgtcagttcttccagatagag

SEQ ID NO: 9101009 - DNA, 22 bp, Homo sapiens
ctgtcatcacagttgagcagcc

SEQ ID NO: 9101010 - DNA, 22 bp, Homo sapiens
ctgtcagttcttccagatagag

SEQ ID NO: 9101011 - DNA, 22 bp, Homo sapiens
ctgtcatcacagttgagcagcc

SEQ ID NO: 9101012 - DNA, 22 bp, Homo sapiens
ctgtcagtaggctcccatcatt

SEQ ID NO: 9101013 - DNA, 22 bp, Homo sapiens
ctggttttgtcagaagctttat

SEQ ID NO: 9101014 - DNA, 22 bp, Homo sapiens
ctggtttgcccacaccagccac

SEQ ID NO: 9101015 - DNA, 22 bp, Homo sapiens
ctggttttaatgttatgtttat

SEQ ID NO: 9101016 - DNA, 22 bp, Homo sapiens
ctggttttaatgttatgtttat

SEQ ID NO: 9101017 - DNA, 22 bp, Homo sapiens
ctggttttatgttatagatgga

SEQ ID NO: 9101018 - DNA, 22 bp, Homo sapiens
ctggttttccaatgttttgact

SEQ ID NO: 9101019 - DNA, 22 bp, Homo sapiens
ctgtccatattcaaggggtagg

SEQ ID NO: 9101020 - DNA, 22 bp, Homo sapiens
ctgtccatcagaaaggggctta

SEQ ID NO: 9101021 - DNA, 20 bp, Homo sapiens
ctgtccatatttgaaaatgc

SEQ ID NO: 9101022 - DNA, 22 bp, Homo sapiens
ctgtccatggtgctggacggtc

SEQ ID NO: 9101023 - DNA, 22 bp, Homo sapiens
ctgtccatggtgctggacggtc

SEQ ID NO: 9101024 - DNA, 22 bp, Homo sapiens
ctgtccattttcgtgcctcctt

SEQ ID NO: 9101025 - DNA, 22 bp, Homo sapiens
ctgtccattggtatattagggt

SEQ ID NO: 9101026 - DNA, 22 bp, Homo sapiens
ctgtcccagatgttctcagcac

SEQ ID NO: 9101027 - DNA, 22 bp, Homo sapiens
ctgtcccaggagctgtaagaca

SEQ ID NO: 9101028 - DNA, 19 bp, Homo sapiens
ctgtcccagactctgctct

SEQ ID NO: 9101029 - DNA, 22 bp, Homo sapiens
ctgtcccagatgttctcagcac

SEQ ID NO: 9101030 - DNA, 22 bp, Homo sapiens
ctgtcccagatgttctcagcac

SEQ ID NO: 9101031 - DNA, 19 bp, Homo sapiens
ctgtcccagactctgctct

SEQ ID NO: 9101032 - DNA, 22 bp, Homo sapiens
ctgtccccgcgagtccagagct

SEQ ID NO: 9101033 - DNA, 22 bp, Homo sapiens
ctgtccccgcgagtccagagct

SEQ ID NO: 9101034 - DNA, 20 bp, Homo sapiens
ctgtccccgaggtcaccagg

SEQ ID NO: 9101035 - DNA, 20 bp, Homo sapiens
ctgtccccgaggtcaccagg

SEQ ID NO: 9101036 - DNA, 18 bp, Homo sapiens
ctgtcccatcctcaggtt

SEQ ID NO: 9101037 - DNA, 22 bp, Homo sapiens
ctgtcccaggatcctgactcca

SEQ ID NO: 9101038 - DNA, 22 bp, Homo sapiens
ctgtcccaggatcctgactcca

SEQ ID NO: 9101039 - DNA, 22 bp, Homo sapiens
ctgtccccacccaaatctcatc

SEQ ID NO: 9101040 - DNA, 21 bp, Homo sapiens
ctgtccccagtgagcaccccc

SEQ ID NO: 9101041 - DNA, 22 bp, Homo sapiens
ctgtgagctgggtggccaggac

SEQ ID NO: 9101042 - DNA, 22 bp, Homo sapiens
ctgtgaggcctttggccagata

SEQ ID NO: 9101043 - DNA, 22 bp, Homo sapiens
ctgtgaggccctgggtgctgga

SEQ ID NO: 9101044 - DNA, 22 bp, Homo sapiens
ctgtgaggcgggtggagtggag

SEQ ID NO: 9101045 - DNA, 22 bp, Homo sapiens
ctgtgagggcagggaccagagg

SEQ ID NO: 9101046 - DNA, 22 bp, Homo sapiens
ctgtgagggcagggaccagagg

SEQ ID NO: 9101047 - DNA, 22 bp, Homo sapiens
ctgtgactgggtgacagtcctc

SEQ ID NO: 9101048 - DNA, 22 bp, Homo sapiens
ctgtgactgggtgacagtcctc

SEQ ID NO: 9101049 - DNA, 19 bp, Homo sapiens
ctgtccctcccaggtatga

SEQ ID NO: 9101050 - DNA, 22 bp, Homo sapiens
ctgtccctcatcacctctgggt

SEQ ID NO: 9101051 - DNA, 22 bp, Homo sapiens
ctgtccctcatcacctctgggt

SEQ ID NO: 9101052 - DNA, 22 bp, Homo sapiens
ctgtctgttcagattcattact

SEQ ID NO: 9101053 - DNA, 22 bp, Homo sapiens
ctgtgaaactggacagcacttg

SEQ ID NO: 9101054 - DNA, 22 bp, Homo sapiens
ctgtctgttatctcaccagtcc

SEQ ID NO: 9101055 - DNA, 22 bp, Homo sapiens
ctgtctgtggtctcagtaggcc

SEQ ID NO: 9101056 - DNA, 22 bp, Homo sapiens
ctgtctgttatctcaccagtcc

SEQ ID NO: 9101057 - DNA, 22 bp, Homo sapiens
ctgtgacaaaagcagcctgcct

SEQ ID NO: 9101058 - DNA, 22 bp, Homo sapiens
ctgtgaatttaaagcacacatc

SEQ ID NO: 9101059 - DNA, 22 bp, Homo sapiens
ctgtgaatgctagtaagagtgc

SEQ ID NO: 9101060 - DNA, 22 bp, Homo sapiens
ctgtgaaatgctttgcgatggt

SEQ ID NO: 9101061 - DNA, 22 bp, Homo sapiens
ctgtgaattgcaacaattgcaa

SEQ ID NO: 9101062 - DNA, 22 bp, Homo sapiens
ctgtgaattgaatatgactatg

SEQ ID NO: 9101063 - DNA, 22 bp, Homo sapiens
ctgtgaattgaatatgactatg

SEQ ID NO: 9101064 - DNA, 22 bp, Homo sapiens
ctgtgaatgttatatctcaatg

SEQ ID NO: 9101065 - DNA, 22 bp, Homo sapiens
ctggtacagtgttacaaaatgg

SEQ ID NO: 9101066 - DNA, 22 bp, Homo sapiens
ctggtacatagtaagaacacaa

SEQ ID NO: 9101067 - DNA, 22 bp, Homo sapiens
ctggtacatttgatgataatag

SEQ ID NO: 9101068 - DNA, 22 bp, Homo sapiens
ctggtacatagtaagaacacaa

SEQ ID NO: 9101069 - DNA, 22 bp, Homo sapiens
ctggtacaaaatgctgatatca

SEQ ID NO: 9101070 - DNA, 22 bp, Homo sapiens
ctggtacagggaaataaaggaa

SEQ ID NO: 9101071 - DNA, 22 bp, Homo sapiens
ctggtacagggaaataaaggaa

SEQ ID NO: 9101072 - DNA, 22 bp, Homo sapiens
ctgggttttattacagtgagct

SEQ ID NO: 9101073 - DNA, 22 bp, Homo sapiens
ctgggttctatttttggcttca

SEQ ID NO: 9101074 - DNA, 22 bp, Homo sapiens
ctgggttctctgcttagggcct

SEQ ID NO: 9101075 - DNA, 22 bp, Homo sapiens
ctgggttccatgtagccaagag

SEQ ID NO: 9101076 - DNA, 22 bp, Homo sapiens
ctgggttctatttttggcttca

SEQ ID NO: 9101077 - DNA, 22 bp, Homo sapiens
ctgggttctatttttggcttca

SEQ ID NO: 9101078 - DNA, 22 bp, Homo sapiens
ctgggttcttggcacagcagga

SEQ ID NO: 9101079 - DNA, 22 bp, Homo sapiens
ctgggtttagggtctccccttg

SEQ ID NO: 9101080 - DNA, 22 bp, Homo sapiens
ctgggtgttgggtactgaccgt

SEQ ID NO: 9101081 - DNA, 22 bp, Homo sapiens
ctgggttccatgtagccaagag

SEQ ID NO: 9101082 - DNA, 22 bp, Homo sapiens
ctgggttccatgtagccaagag

SEQ ID NO: 9101083 - DNA, 22 bp, Homo sapiens
ctgggttaccatgaggaaatga

SEQ ID NO: 9101084 - DNA, 22 bp, Homo sapiens
ctgggtgtagcccagtatgagg

SEQ ID NO: 9101085 - DNA, 22 bp, Homo sapiens
ctgggtgtcaggagacatgatg

SEQ ID NO: 9101086 - DNA, 22 bp, Homo sapiens
ctgggtgtagatggaagtttgg

SEQ ID NO: 9101087 - DNA, 22 bp, Homo sapiens
ctgggtggttctaactgttgat

SEQ ID NO: 9101088 - DNA, 22 bp, Homo sapiens
ctgggtggaaagtgctgagaat

SEQ ID NO: 9101089 - DNA, 22 bp, Homo sapiens
ctgggtggaaagtgctgagaat

SEQ ID NO: 9101090 - DNA, 22 bp, Homo sapiens
ctggtgtggactccgcgcggag

SEQ ID NO: 9101091 - DNA, 22 bp, Homo sapiens
ctggtgtccagcatgtgtggaa

SEQ ID NO: 9101092 - DNA, 22 bp, Homo sapiens
ctggtgtctgctccctcacagc

SEQ ID NO: 9101093 - DNA, 22 bp, Homo sapiens
ctggtgtgattgagcccaggtg

SEQ ID NO: 9101094 - DNA, 22 bp, Homo sapiens
ctggtgctggagcctagtccct

SEQ ID NO: 9101095 - DNA, 22 bp, Homo sapiens
ctggtgcctcctccctgtgctt

SEQ ID NO: 9101096 - DNA, 22 bp, Homo sapiens
ctggtcacctccttcccagcta

SEQ ID NO: 9101097 - DNA, 22 bp, Homo sapiens
ctggtcaccaggtagcattgta

SEQ ID NO: 9101098 - DNA, 22 bp, Homo sapiens
ctgggctccctcatgtgtctgc

SEQ ID NO: 9101099 - DNA, 22 bp, Homo sapiens
ctgggctcctaaccatccaggt

SEQ ID NO: 9101100 - DNA, 22 bp, Homo sapiens
ctgggctcctaaccatccaggt

SEQ ID NO: 9101101 - DNA, 22 bp, Homo sapiens
ctgggctcctaaccatccaggt

SEQ ID NO: 9101102 - DNA, 18 bp, Homo sapiens
ctgggctcgagagatcct

SEQ ID NO: 9101103 - DNA, 20 bp, Homo sapiens
ctgggctcggtggccctggc

SEQ ID NO: 9101104 - DNA, 22 bp, Homo sapiens
ctgggctctaagggagcaccgt

SEQ ID NO: 9101105 - DNA, 22 bp, Homo sapiens
ctgggctctaagggagcaccgt

SEQ ID NO: 9101106 - DNA, 22 bp, Homo sapiens
ctgggggcagcaagaagccatg

SEQ ID NO: 9101107 - DNA, 22 bp, Homo sapiens
ctgggggcagcaagaagccatg

SEQ ID NO: 9101108 - DNA, 22 bp, Homo sapiens
ctgggggcagcaagaagccatg

SEQ ID NO: 9101109 - DNA, 22 bp, Homo sapiens
ctgggggcaatggtcagagtgt

SEQ ID NO: 9101110 - DNA, 22 bp, Homo sapiens
ctgggggcagcaagaagccatg

SEQ ID NO: 9101111 - DNA, 22 bp, Homo sapiens
ctggggggagctgcgtccagca

SEQ ID NO: 9101112 - DNA, 22 bp, Homo sapiens
ctgggggccttacggaactcca

SEQ ID NO: 9101113 - DNA, 22 bp, Homo sapiens
ctgggggccttacggaactcca

SEQ ID NO: 9101114 - DNA, 22 bp, Homo sapiens
ctgggctctagaaaggaaagaa

SEQ ID NO: 9101115 - DNA, 22 bp, Homo sapiens
ctgggctctagaaaggaaagaa

SEQ ID NO: 9101116 - DNA, 22 bp, Homo sapiens
ctggggctggtgaggcaggctc

SEQ ID NO: 9101117 - DNA, 22 bp, Homo sapiens
ctgggctctagaaaggaaagaa

SEQ ID NO: 9101118 - DNA, 22 bp, Homo sapiens
ctggggctgtaggaggacttat

SEQ ID NO: 9101119 - DNA, 22 bp, Homo sapiens
ctgggggtcttgaaagggagag

SEQ ID NO: 9101120 - DNA, 22 bp, Homo sapiens
ctgggggtcgcgcctctgggca

SEQ ID NO: 9101121 - DNA, 22 bp, Homo sapiens
ctggggggctactgacagagga

SEQ ID NO: 9101122 - DNA, 22 bp, Homo sapiens
ctggggggctactgacagagga

SEQ ID NO: 9101123 - DNA, 22 bp, Homo sapiens
ctggggggctactgacagagga

SEQ ID NO: 9101124 - DNA, 22 bp, Homo sapiens
ctggggtgaaggattacctgag

SEQ ID NO: 9101125 - DNA, 22 bp, Homo sapiens
ctggggtctcaattctagcggg

SEQ ID NO: 9101126 - DNA, 22 bp, Homo sapiens
ctggggtccttgccatgtgtca

SEQ ID NO: 9101127 - DNA, 22 bp, Homo sapiens
ctggggtcagggatcagagagc

SEQ ID NO: 9101128 - DNA, 22 bp, Homo sapiens
ctggggtcagggatcagagagc

SEQ ID NO: 9101129 - DNA, 22 bp, Homo sapiens
ctggggtggtgcaggcctcatg

SEQ ID NO: 9101130 - DNA, 22 bp, Homo sapiens
ctgggctccactcccacagtgt

SEQ ID NO: 9101131 - DNA, 22 bp, Homo sapiens
ctgggctccactacttgctaac

SEQ ID NO: 9101132 - DNA, 22 bp, Homo sapiens
ctgggctcagtgtctcactcct

SEQ ID NO: 9101133 - DNA, 22 bp, Homo sapiens
ctgggctcagtgtctcactcct

SEQ ID NO: 9101134 - DNA, 22 bp, Homo sapiens
ctgggctcagcccatgctgtcc

SEQ ID NO: 9101135 - DNA, 22 bp, Homo sapiens
ctgggctcagtggctcatggct

SEQ ID NO: 9101136 - DNA, 22 bp, Homo sapiens
ctgggctcagcaggccaaggcc

SEQ ID NO: 9101137 - DNA, 22 bp, Homo sapiens
ctgggctcagcaggccaaggcc

SEQ ID NO: 9101138 - DNA, 22 bp, Homo sapiens
ctgggctcagcaggccaaggcc

SEQ ID NO: 9101139 - DNA, 22 bp, Homo sapiens
ctgggctcaaatcctggccctg

SEQ ID NO: 9101140 - DNA, 22 bp, Homo sapiens
ctgggcctccacgggccatcac

SEQ ID NO: 9101141 - DNA, 22 bp, Homo sapiens
ctgggcctccacgggccatcac

SEQ ID NO: 9101142 - DNA, 22 bp, Homo sapiens
ctgggcctccacgggccatcac

SEQ ID NO: 9101143 - DNA, 22 bp, Homo sapiens
ctgggcctcatgcacagagatg

SEQ ID NO: 9101144 - DNA, 22 bp, Homo sapiens
ctgggcctccacgggccatcac

SEQ ID NO: 9101145 - DNA, 22 bp, Homo sapiens
ctgggcctcatgcacagagatg

SEQ ID NO: 9101146 - DNA, 22 bp, Homo sapiens
ctgggcctagcaacagaggagt

SEQ ID NO: 9101147 - DNA, 22 bp, Homo sapiens
ctgggcctagcaacagaggagt

SEQ ID NO: 9101148 - DNA, 22 bp, Homo sapiens
ctgggcctagaggaagctgaca

SEQ ID NO: 9101149 - DNA, 22 bp, Homo sapiens
ctgggcctagaggaagctgaca

SEQ ID NO: 9101150 - DNA, 22 bp, Homo sapiens
ctgggcctaggatggaagggcc

SEQ ID NO: 9101151 - DNA, 22 bp, Homo sapiens
ctgggcctagcaacagaggagt

SEQ ID NO: 9101152 - DNA, 22 bp, Homo sapiens
ctgggcctagcaacagaggagt

SEQ ID NO: 9101153 - DNA, 22 bp, Homo sapiens
ctgggcccaggcggctctcgga

SEQ ID NO: 9101154 - DNA, 22 bp, Homo sapiens
ctgggccctatggaagaaaggg

SEQ ID NO: 9101155 - DNA, 22 bp, Homo sapiens
ctgggcctagaggaagctgaca

SEQ ID NO: 9101156 - DNA, 22 bp, Homo sapiens
ctgggcctaacccacagcgttt

SEQ ID NO: 9101157 - DNA, 22 bp, Homo sapiens
ctgggcctcatccccagagttt

SEQ ID NO: 9101158 - DNA, 22 bp, Homo sapiens
ctgggcctcatccagccacaac

SEQ ID NO: 9101159 - DNA, 22 bp, Homo sapiens
ctgggcctcatccagccacaac

SEQ ID NO: 9101160 - DNA, 22 bp, Homo sapiens
ctgggcctcatgcacagagatg

SEQ ID NO: 9101161 - DNA, 22 bp, Homo sapiens
ctgggcctcatcctcagagttt

SEQ ID NO: 9101162 - DNA, 22 bp, Homo sapiens
ctgggcctcatccccagagttt

SEQ ID NO: 9101163 - DNA, 22 bp, Homo sapiens
ctgggcctcatccccagagttt

SEQ ID NO: 9101164 - DNA, 22 bp, Homo sapiens
ctgggcctcaatctcagagttt

SEQ ID NO: 9101165 - DNA, 23 bp, Homo sapiens
ctgggcctatggtctgaatccaa

SEQ ID NO: 9101166 - DNA, 22 bp, Homo sapiens
ctgggcctcaagctcagatttc

SEQ ID NO: 9101167 - DNA, 22 bp, Homo sapiens
ctgggcctcaccctagaccaat

SEQ ID NO: 9101168 - DNA, 22 bp, Homo sapiens
ctgggcctcaccctagaccaat

SEQ ID NO: 9101169 - DNA, 22 bp, Homo sapiens
ctgggcctcacacccaccaaat

SEQ ID NO: 9101170 - DNA, 22 bp, Homo sapiens
ctgggcctcacacccaccaaat

SEQ ID NO: 9101171 - DNA, 22 bp, Homo sapiens
ctgggaggcggagcttgcagtg

SEQ ID NO: 9101172 - DNA, 22 bp, Homo sapiens
ctgggaggcggaggttgcagtg

SEQ ID NO: 9101173 - DNA, 22 bp, Homo sapiens
ctggagctccagggtctcctct

SEQ ID NO: 9101174 - DNA, 22 bp, Homo sapiens
ctggagctccagggtctcctct

SEQ ID NO: 9101175 - DNA, 22 bp, Homo sapiens
ctggagctccagggtctcctct

SEQ ID NO: 9101176 - DNA, 22 bp, Homo sapiens
ctggagctcagcccaggttcca

SEQ ID NO: 9101177 - DNA, 22 bp, Homo sapiens
ctggagctaggaagtccaagat

SEQ ID NO: 9101178 - DNA, 22 bp, Homo sapiens
ctggagccttcaccaggggaaa

SEQ ID NO: 9101179 - DNA, 22 bp, Homo sapiens
ctgggagtgaaaggagggctgc

SEQ ID NO: 9101180 - DNA, 22 bp, Homo sapiens
ctgggagtcaccaggagcaagg

SEQ ID NO: 9101181 - DNA, 22 bp, Homo sapiens
ctgggaggcggaggttgcagtg

SEQ ID NO: 9101182 - DNA, 22 bp, Homo sapiens
ctgggagtactgggggatgtca

SEQ ID NO: 9101183 - DNA, 19 bp, Homo sapiens
ctgggagttcactgctgcc

SEQ ID NO: 9101184 - DNA, 22 bp, Homo sapiens
ctgggatgatagtgctagtatt

SEQ ID NO: 9101185 - DNA, 22 bp, Homo sapiens
ctgggatccacgggctcccaag

SEQ ID NO: 9101186 - DNA, 22 bp, Homo sapiens
ctgggatcagcagtagtgatga

SEQ ID NO: 9101187 - DNA, 22 bp, Homo sapiens
ctgggagtttctagagaaagac

SEQ ID NO: 9101188 - DNA, 22 bp, Homo sapiens
ctgggccagatccagcctcaca

SEQ ID NO: 9101189 - DNA, 22 bp, Homo sapiens
ctgggccagcaactgcaatgga

SEQ ID NO: 9101190 - DNA, 22 bp, Homo sapiens
ctgggccaggaccagggttgaa

SEQ ID NO: 9101191 - DNA, 22 bp, Homo sapiens
ctgggccaggaccagggttgaa

SEQ ID NO: 9101192 - DNA, 22 bp, Homo sapiens
ctgggcccacgagggctctggg

SEQ ID NO: 9101193 - DNA, 22 bp, Homo sapiens
gaagaagacatggaacaatagt

SEQ ID NO: 9101194 - DNA, 22 bp, Homo sapiens
gaagaaggaagatcatgcttga

SEQ ID NO: 9101195 - DNA, 22 bp, Homo sapiens
gaagaagggagtgacaaatgca

SEQ ID NO: 9101196 - DNA, 22 bp, Homo sapiens
gaagaagggagtgacaaatgca

SEQ ID NO: 9101197 - DNA, 22 bp, Homo sapiens
gaagaagggagtgacaaatgca

SEQ ID NO: 9101198 - DNA, 22 bp, Homo sapiens
gaagaagcattctgctgttttg

SEQ ID NO: 9101199 - DNA, 19 bp, Homo sapiens
gaagaagcttgagaagtag

SEQ ID NO: 9101200 - DNA, 22 bp, Homo sapiens
gaagaagcctctgtggatctga

SEQ ID NO: 9101201 - DNA, 22 bp, Homo sapiens
gaacttgtgcactgctggtgat

SEQ ID NO: 9101202 - DNA, 22 bp, Homo sapiens
gaagaacacttcatgattcatt

SEQ ID NO: 9101203 - DNA, 22 bp, Homo sapiens
gaaattcactgtatttcttggg

SEQ ID NO: 9101204 - DNA, 22 bp, Homo sapiens
gaaattcaggacaaagactctt

SEQ ID NO: 9101205 - DNA, 22 bp, Homo sapiens
gaaattgtcagcttctttcagt

SEQ ID NO: 9101206 - DNA, 22 bp, Homo sapiens
gaaattcaccttttacgtggcc

SEQ ID NO: 9101207 - DNA, 22 bp, Homo sapiens
gaaattcaaataagatatgtag

SEQ ID NO: 9101208 - DNA, 22 bp, Homo sapiens
gaaattcaaaatgtcagtatag

SEQ ID NO: 9101209 - DNA, 22 bp, Homo sapiens
gaaattaagcaggggtctgtgg

SEQ ID NO: 9101210 - DNA, 22 bp, Homo sapiens
gaaatgttgtcctgtctcttga

SEQ ID NO: 9101211 - DNA, 22 bp, Homo sapiens
gaaatgttggacacttgaaatt

SEQ ID NO: 9101212 - DNA, 22 bp, Homo sapiens
gaaatgttgtcctgtctcttga

SEQ ID NO: 9101213 - DNA, 22 bp, Homo sapiens
gaaatgtttccttttgtatgct

SEQ ID NO: 9101214 - DNA, 22 bp, Homo sapiens
gaaatgttgtctctgcagcaat

SEQ ID NO: 9101215 - DNA, 22 bp, Homo sapiens
gaaatgttcctgatccctgatt

SEQ ID NO: 9101216 - DNA, 22 bp, Homo sapiens
gaaatgttatgagatatgtact

SEQ ID NO: 9101217 - DNA, 22 bp, Homo sapiens
gaaattaaccacctttggcttt

SEQ ID NO: 9101218 - DNA, 22 bp, Homo sapiens
gaaattaagcaggggtctgtgg

SEQ ID NO: 9101219 - DNA, 22 bp, Homo sapiens
gaaattaagcaggggtctgtgg

SEQ ID NO: 9101220 - DNA, 23 bp, Homo sapiens
gaaatgtttcttgattaatccta

SEQ ID NO: 9101221 - DNA, 22 bp, Homo sapiens
gaaatgtttgggaggagtcaac

SEQ ID NO: 9101222 - DNA, 22 bp, Homo sapiens
gaaattaaccacctttggcttt

SEQ ID NO: 9101223 - DNA, 22 bp, Homo sapiens
gaaatgttttacaaggcatact

SEQ ID NO: 9101224 - DNA, 22 bp, Homo sapiens
gaaagacatagttgcaagatgg

SEQ ID NO: 9101225 - DNA, 22 bp, Homo sapiens
gaaagacatagttgcaagatgg

SEQ ID NO: 9101226 - DNA, 22 bp, Homo sapiens
gaaagacatagttgcaagatgg

SEQ ID NO: 9101227 - DNA, 22 bp, Homo sapiens
gaaagactcttgatgtctttgg

SEQ ID NO: 9101228 - DNA, 22 bp, Homo sapiens
gaaagagaacctgggcctagat

SEQ ID NO: 9101229 - DNA, 22 bp, Homo sapiens
gaaagacttcctttgagagtac

SEQ ID NO: 9101230 - DNA, 22 bp, Homo sapiens
gaaatacaggaatgccacacag

SEQ ID NO: 9101231 - DNA, 22 bp, Homo sapiens
gaaatatacattgcaggaagag

SEQ ID NO: 9101232 - DNA, 22 bp, Homo sapiens
gaaatatacattgcaggaagag

SEQ ID NO: 9101233 - DNA, 22 bp, Homo sapiens
gaaatatacattgcaggaagag

SEQ ID NO: 9101234 - DNA, 22 bp, Homo sapiens
gaaatacagaaagggctgaatg

SEQ ID NO: 9101235 - DNA, 22 bp, Homo sapiens
gaaagagaacctgggcctagat

SEQ ID NO: 9101236 - DNA, 22 bp, Homo sapiens
gaaagagaacctgggcctagat

SEQ ID NO: 9101237 - DNA, 22 bp, Homo sapiens
gaaatattcttgtcttgttttc

SEQ ID NO: 9101238 - DNA, 22 bp, Homo sapiens
gaaatattcttgtcttgttttc

SEQ ID NO: 9101239 - DNA, 22 bp, Homo sapiens
gaaatattcttgtcttgttttc

SEQ ID NO: 9101240 - DNA, 22 bp, Homo sapiens
gaaatatacattgcaggaagag

SEQ ID NO: 9101241 - DNA, 22 bp, Homo sapiens
gaaatattacagtggaggggat

SEQ ID NO: 9101242 - DNA, 22 bp, Homo sapiens
gaaatattacagtggaggggat

SEQ ID NO: 9101243 - DNA, 22 bp, Homo sapiens
gaaatattgtactggagatgtt

SEQ ID NO: 9101244 - DNA, 22 bp, Homo sapiens
gaaatattgtactggagatgtt

SEQ ID NO: 9101245 - DNA, 22 bp, Homo sapiens
gaaatattgtactggagatgtt

SEQ ID NO: 9101246 - DNA, 22 bp, Homo sapiens
gaaatattgggactcagagctt

SEQ ID NO: 9101247 - DNA, 22 bp, Homo sapiens
gaaatattgggactcagagctt

SEQ ID NO: 9101248 - DNA, 22 bp, Homo sapiens
gaaatgtaggcataattatttt

SEQ ID NO: 9101249 - DNA, 22 bp, Homo sapiens
gaaatgtaggcataattatttt

SEQ ID NO: 9101250 - DNA, 20 bp, Homo sapiens
gaaatgtatctcttgattct

SEQ ID NO: 9101251 - DNA, 22 bp, Homo sapiens
gaaacagctttaagtgatactg

SEQ ID NO: 9101252 - DNA, 22 bp, Homo sapiens
gaaacagctagaaagccattgg

SEQ ID NO: 9101253 - DNA, 22 bp, Homo sapiens
gaaacagcccctgtgtgaagca

SEQ ID NO: 9101254 - DNA, 22 bp, Homo sapiens
gaaaaatgctccaaatctgtgg

SEQ ID NO: 9101255 - DNA, 22 bp, Homo sapiens
gaaaaatgctccaaatctgtgg

SEQ ID NO: 9101256 - DNA, 22 bp, Homo sapiens
gaaaaatgctccaaatctgtgg

SEQ ID NO: 9101257 - DNA, 22 bp, Homo sapiens
gaaaaatgagctgatgtcaggg

SEQ ID NO: 9101258 - DNA, 22 bp, Homo sapiens
gaaaaatgagctgatgtcaggg

SEQ ID NO: 9101259 - DNA, 22 bp, Homo sapiens
ctttttgttgtataagcccttt

SEQ ID NO: 9101260 - DNA, 22 bp, Homo sapiens
cttttttcctaaggcaacatga

SEQ ID NO: 9101261 - DNA, 22 bp, Homo sapiens
gaaaaaggataaatacagtgtt

SEQ ID NO: 9101262 - DNA, 22 bp, Homo sapiens
gaaaaaggataaatacagtgtt

SEQ ID NO: 9101263 - DNA, 22 bp, Homo sapiens
cttttttcctaaggcaacatga

SEQ ID NO: 9101264 - DNA, 22 bp, Homo sapiens
gaaaaaggataaatacagtgtt

SEQ ID NO: 9101265 - DNA, 22 bp, Homo sapiens
gaaaaatgagctgatgtcaggg

SEQ ID NO: 9101266 - DNA, 22 bp, Homo sapiens
gaaactggatgcagggatgcag

SEQ ID NO: 9101267 - DNA, 22 bp, Homo sapiens
gaaacccttcctagagggcaag

SEQ ID NO: 9101268 - DNA, 22 bp, Homo sapiens
gaaacctcttagcctctctttg

SEQ ID NO: 9101269 - DNA, 22 bp, Homo sapiens
gaaacctttgccgatggggtcc

SEQ ID NO: 9101270 - DNA, 22 bp, Homo sapiens
gaaagaagctttagatggctat

SEQ ID NO: 9101271 - DNA, 22 bp, Homo sapiens
gaaagaatgctatagtgacttc

SEQ ID NO: 9101272 - DNA, 22 bp, Homo sapiens
gaaagaatgctgggagccatct

SEQ ID NO: 9101273 - DNA, 22 bp, Homo sapiens
gaaagaatgctatagtgacttc

SEQ ID NO: 9101274 - DNA, 22 bp, Homo sapiens
gaaagaatcaactatgtctctg

SEQ ID NO: 9101275 - DNA, 22 bp, Homo sapiens
gaaagaatgagcatcatgactt

SEQ ID NO: 9101276 - DNA, 22 bp, Homo sapiens
ctttggaaggtcgtccgtgtgg

SEQ ID NO: 9101277 - DNA, 22 bp, Homo sapiens
ctttggaaggaacaggattctc

SEQ ID NO: 9101278 - DNA, 22 bp, Homo sapiens
ctttggaagccaggcagttcac

SEQ ID NO: 9101279 - DNA, 22 bp, Homo sapiens
ctttggaacacatgggcatggt

SEQ ID NO: 9101280 - DNA, 22 bp, Homo sapiens
ctttggaacatactgctgagct

SEQ ID NO: 9101281 - DNA, 22 bp, Homo sapiens
ctttggaagtgaccacaatcct

SEQ ID NO: 9101282 - DNA, 22 bp, Homo sapiens
ctttggaatattttattgagaa

SEQ ID NO: 9101283 - DNA, 22 bp, Homo sapiens
ctttggaataatcaagctctga

SEQ ID NO: 9101284 - DNA, 22 bp, Homo sapiens
ctttggatttttatcaggcaat

SEQ ID NO: 9101285 - DNA, 22 bp, Homo sapiens
ctttggatgactggtgcaggtt

SEQ ID NO: 9101286 - DNA, 19 bp, Homo sapiens
ctttggagtcttttactct

SEQ ID NO: 9101287 - DNA, 22 bp, Homo sapiens
ctttggaggtcatagccaagag

SEQ ID NO: 9101288 - DNA, 22 bp, Homo sapiens
ctttggcaacacatgtgggaca

SEQ ID NO: 9101289 - DNA, 21 bp, Homo sapiens
ctttggcaagggagaagtcac

SEQ ID NO: 9101290 - DNA, 22 bp, Homo sapiens
ctttggagaaaagttcttgggc

SEQ ID NO: 9101291 - DNA, 19 bp, Homo sapiens
ctttggagaatggtttgct

SEQ ID NO: 9101292 - DNA, 19 bp, Homo sapiens
ctttggaggatgaggctgg

SEQ ID NO: 9101293 - DNA, 22 bp, Homo sapiens
ctttggaggacctatgtgcaat

SEQ ID NO: 9101294 - DNA, 22 bp, Homo sapiens
cttttgttaggagaaaacatca

SEQ ID NO: 9101295 - DNA, 22 bp, Homo sapiens
cttttgttaggagaaaacatca

SEQ ID NO: 9101296 - DNA, 22 bp, Homo sapiens
cttttgttaggagaaaacatca

SEQ ID NO: 9101297 - DNA, 22 bp, Homo sapiens
cttttgttaggagaaaacatca

SEQ ID NO: 9101298 - DNA, 22 bp, Homo sapiens
cttttggcctcaaaggaaagaa

SEQ ID NO: 9101299 - DNA, 22 bp, Homo sapiens
ctttttctaatcataattgtct

SEQ ID NO: 9101300 - DNA, 16 bp, Homo sapiens
ctttttctcccctctt

SEQ ID NO: 9101301 - DNA, 21 bp, Homo sapiens
ctttgcatacagatgccaatt

SEQ ID NO: 9101302 - DNA, 22 bp, Homo sapiens
ctttgcatgtggtagaaggttc

SEQ ID NO: 9101303 - DNA, 22 bp, Homo sapiens
ctttggaacaagaagaaatggc

SEQ ID NO: 9101304 - DNA, 22 bp, Homo sapiens
ctttctctgtgtttcacatgct

SEQ ID NO: 9101305 - DNA, 22 bp, Homo sapiens
ctttctcttacccaaggatctg

SEQ ID NO: 9101306 - DNA, 22 bp, Homo sapiens
ctttctcttcactgtcatgatc

SEQ ID NO: 9101307 - DNA, 22 bp, Homo sapiens
ctttgcagtttcagaaccctga

SEQ ID NO: 9101308 - DNA, 22 bp, Homo sapiens
ctttctccagagctgcttattt

SEQ ID NO: 9101309 - DNA, 20 bp, Homo sapiens
ctttctctaatttataagta

SEQ ID NO: 9101310 - DNA, 22 bp, Homo sapiens
ctttctccctgtcccaaactgg

SEQ ID NO: 9101311 - DNA, 22 bp, Homo sapiens
ctttctcctactgggcgcggga

SEQ ID NO: 9101312 - DNA, 22 bp, Homo sapiens
ctttctaattctcccatagtct

SEQ ID NO: 9101313 - DNA, 22 bp, Homo sapiens
ctttctaattctcccatagtct

SEQ ID NO: 9101314 - DNA, 22 bp, Homo sapiens
ctttctagactgtccagatgat

SEQ ID NO: 9101315 - DNA, 22 bp, Homo sapiens
ctttctagttgacagcatgcca

SEQ ID NO: 9101316 - DNA, 22 bp, Homo sapiens
ctttctctgtgtttcacatgct

SEQ ID NO: 9101317 - DNA, 22 bp, Homo sapiens
ctttccttctcgtggttctcac

SEQ ID NO: 9101318 - DNA, 22 bp, Homo sapiens
ctttccttaataagcaggtata

SEQ ID NO: 9101319 - DNA, 22 bp, Homo sapiens
ctttccttaataagcaggtata

SEQ ID NO: 9101320 - DNA, 23 bp, Homo sapiens
ctttcctttctttgacacccagc

SEQ ID NO: 9101321 - DNA, 23 bp, Homo sapiens
ctttcctttctttgacacccagc

SEQ ID NO: 9101322 - DNA, 22 bp, Homo sapiens
ctttcctgaggagtatggctgt

SEQ ID NO: 9101323 - DNA, 22 bp, Homo sapiens
ctttcctctggcactgtctggt

SEQ ID NO: 9101324 - DNA, 22 bp, Homo sapiens
ctttcctccactccctaggctt

SEQ ID NO: 9101325 - DNA, 22 bp, Homo sapiens
cttggaggatgtgcggctgccc

SEQ ID NO: 9101326 - DNA, 22 bp, Homo sapiens
cttggaggaggtggtgcttgat

SEQ ID NO: 9101327 - DNA, 22 bp, Homo sapiens
cttggaattgatgattttcata

SEQ ID NO: 9101328 - DNA, 22 bp, Homo sapiens
cttggactttagtctctctcca

SEQ ID NO: 9101329 - DNA, 22 bp, Homo sapiens
cttggagatacagaggacattt

SEQ ID NO: 9101330 - DNA, 22 bp, Homo sapiens
cttgctttccaaatgactcact

SEQ ID NO: 9101331 - DNA, 22 bp, Homo sapiens
cttgctttgtccagaaattcag

SEQ ID NO: 9101332 - DNA, 22 bp, Homo sapiens
cttggaaactttccctgggcac

SEQ ID NO: 9101333 - DNA, 22 bp, Homo sapiens
cttgcttttgctgatgattaag

SEQ ID NO: 9101334 - DNA, 22 bp, Homo sapiens
cttggaaagttatcattttcct

SEQ ID NO: 9101335 - DNA, 22 bp, Homo sapiens
cttggaaaggttttacaaagcg

SEQ ID NO: 9101336 - DNA, 22 bp, Homo sapiens
cttggaaagaatatatgatgct

SEQ ID NO: 9101337 - DNA, 22 bp, Homo sapiens
cttggaaagaatatatgatgct

SEQ ID NO: 9101338 - DNA, 22 bp, Homo sapiens
cttgctttcagtctcggcctca

SEQ ID NO: 9101339 - DNA, 22 bp, Homo sapiens
cttgctttcagtctcggcctca

SEQ ID NO: 9101340 - DNA, 22 bp, Homo sapiens
cttgctttatctggtttctcat

SEQ ID NO: 9101341 - DNA, 22 bp, Homo sapiens
cttgctttatctggtttctcat

SEQ ID NO: 9101342 - DNA, 22 bp, Homo sapiens
cttcttcctgctgcagcctcca

SEQ ID NO: 9101343 - DNA, 20 bp, Homo sapiens
cttcttcattaaccctactg

SEQ ID NO: 9101344 - DNA, 22 bp, Homo sapiens
cttcttccagttataagagctt

SEQ ID NO: 9101345 - DNA, 22 bp, Homo sapiens
cttcttcccagcttccctcacc

SEQ ID NO: 9101346 - DNA, 22 bp, Homo sapiens
cttgcctccctcagctcacagc

SEQ ID NO: 9101347 - DNA, 22 bp, Homo sapiens
cttgcctgccactacagctgaa

SEQ ID NO: 9101348 - DNA, 22 bp, Homo sapiens
cttgcctgaggaacagagggta

SEQ ID NO: 9101349 - DNA, 22 bp, Homo sapiens
cttgcctctgctaatggtttct

SEQ ID NO: 9101350 - DNA, 22 bp, Homo sapiens
cttgcctgaggaacagagggta

SEQ ID NO: 9101351 - DNA, 22 bp, Homo sapiens
cttcacagtctttatttcctcc

SEQ ID NO: 9101352 - DNA, 20 bp, Homo sapiens
cttcactaggagaaagagaa

SEQ ID NO: 9101353 - DNA, 22 bp, Homo sapiens
cttcacagtctttatttcctcc

SEQ ID NO: 9101354 - DNA, 22 bp, Homo sapiens
cttcacagtctttatttcctcc

SEQ ID NO: 9101355 - DNA, 22 bp, Homo sapiens
cttcacttcacagatgccaaga

SEQ ID NO: 9101356 - DNA, 22 bp, Homo sapiens
cttcactttaagccaatcatga

SEQ ID NO: 9101357 - DNA, 22 bp, Homo sapiens
cttccaggacaccagggtagta

SEQ ID NO: 9101358 - DNA, 22 bp, Homo sapiens
cttccaggacaccagggtagta

SEQ ID NO: 9101359 - DNA, 22 bp, Homo sapiens
cttccagggtccaggaagagcc

SEQ ID NO: 9101360 - DNA, 22 bp, Homo sapiens
cttcaaatacaagtagattatg

SEQ ID NO: 9101361 - DNA, 22 bp, Homo sapiens
cttcaaatccccctgagtttga

SEQ ID NO: 9101362 - DNA, 22 bp, Homo sapiens
cttcaaatacaagtagattatg

SEQ ID NO: 9101363 - DNA, 22 bp, Homo sapiens
cttcaaatccccctgagtttga

SEQ ID NO: 9101364 - DNA, 22 bp, Homo sapiens
ctgttaaatgagaaagcagact

SEQ ID NO: 9101365 - DNA, 22 bp, Homo sapiens
ctgttaaaagcactgccatcct

SEQ ID NO: 9101366 - DNA, 20 bp, Homo sapiens
ctgttaaaaggtatgaattc

SEQ ID NO: 9101367 - DNA, 22 bp, Homo sapiens
cttcacagagtccctgattgtt

SEQ ID NO: 9101368 - DNA, 22 bp, Homo sapiens
cttcaaatcctgtgtagggcta

SEQ ID NO: 9101369 - DNA, 22 bp, Homo sapiens
cttcaaatgtgattttaataac

SEQ ID NO: 9101370 - DNA, 22 bp, Homo sapiens
cttcacagaataaactcattat

SEQ ID NO: 9101371 - DNA, 22 bp, Homo sapiens
cttcacagcatgagctttggag

SEQ ID NO: 9101372 - DNA, 22 bp, Homo sapiens
cttcacagccaacatgggcaca

SEQ ID NO: 9101373 - DNA, 22 bp, Homo sapiens
cttcacagccaacatgggcaca

SEQ ID NO: 9101374 - DNA, 22 bp, Homo sapiens
cttcacagtaaatccagaagaa

SEQ ID NO: 9101375 - DNA, 22 bp, Homo sapiens
cttcacaggcaagtctgttttt

SEQ ID NO: 9101376 - DNA, 22 bp, Homo sapiens
cttcacagtcaccctgctgtgt

SEQ ID NO: 9101377 - DNA, 22 bp, Homo sapiens
cttcacagtcaccctgctgtgt

SEQ ID NO: 9101378 - DNA, 22 bp, Homo sapiens
cttcacagtataggtccctgag

SEQ ID NO: 9101379 - DNA, 22 bp, Homo sapiens
cttcacagtaaatccagaagaa

SEQ ID NO: 9101380 - DNA, 22 bp, Homo sapiens
cttccccaagtagagaggggag

SEQ ID NO: 9101381 - DNA, 22 bp, Homo sapiens
cttccccaagtagagaggggag

SEQ ID NO: 9101382 - DNA, 22 bp, Homo sapiens
cttccccaaccccgactgtgtg

SEQ ID NO: 9101383 - DNA, 22 bp, Homo sapiens
cttcccagttctgcttgagggg

SEQ ID NO: 9101384 - DNA, 22 bp, Homo sapiens
cttcccaggtgctcttagcatg

SEQ ID NO: 9101385 - DNA, 22 bp, Homo sapiens
cttcccagaccttagagtgcag

SEQ ID NO: 9101386 - DNA, 22 bp, Homo sapiens
cttccaggtccttcttgagaag

SEQ ID NO: 9101387 - DNA, 22 bp, Homo sapiens
cttcccagcacctcagtctggc

SEQ ID NO: 9101388 - DNA, 22 bp, Homo sapiens
cttcccagacggggtggcagcc

SEQ ID NO: 9101389 - DNA, 22 bp, Homo sapiens
cttcccagacggggtggcagcc

SEQ ID NO: 9101390 - DNA, 19 bp, Homo sapiens
cttcccctgttacctcact

SEQ ID NO: 9101391 - DNA, 19 bp, Homo sapiens
cttcccctgttacctcact

SEQ ID NO: 9101392 - DNA, 19 bp, Homo sapiens
cttcccctgttacctcact

SEQ ID NO: 9101393 - DNA, 21 bp, Homo sapiens
cttccccaggctggtctgtat

SEQ ID NO: 9101394 - DNA, 22 bp, Homo sapiens
cttccctgataagagcctcaga

SEQ ID NO: 9101395 - DNA, 22 bp, Homo sapiens
cttccctgataagagcctcaga

SEQ ID NO: 9101396 - DNA, 22 bp, Homo sapiens
cttccctgataagagcctcaga

SEQ ID NO: 9101397 - DNA, 22 bp, Homo sapiens
cttccctgagctttctcaggct

SEQ ID NO: 9101398 - DNA, 22 bp, Homo sapiens
cttcttcataggcagtcctgtt

SEQ ID NO: 9101399 - DNA, 19 bp, Homo sapiens
cttctgtgatacatcagtc

SEQ ID NO: 9101400 - DNA, 22 bp, Homo sapiens
cttctgtgaatgaagtgtggga

SEQ ID NO: 9101401 - DNA, 22 bp, Homo sapiens
cttctgtgaccaccagcagccc

SEQ ID NO: 9101402 - DNA, 22 bp, Homo sapiens
cttctgtgacgtatgtgaggac

SEQ ID NO: 9101403 - DNA, 22 bp, Homo sapiens
cttctgtagccagtaacatata

SEQ ID NO: 9101404 - DNA, 22 bp, Homo sapiens
cttctgtagccagtaacatata

SEQ ID NO: 9101405 - DNA, 22 bp, Homo sapiens
cttcccttctgtgcagggcaga

SEQ ID NO: 9101406 - DNA, 22 bp, Homo sapiens
gacatctgaggccctcagagcc

SEQ ID NO: 9101407 - DNA, 22 bp, Homo sapiens
gacatcatgtcactaactgcta

SEQ ID NO: 9101408 - DNA, 22 bp, Homo sapiens
gacatatactatggatggttct

SEQ ID NO: 9101409 - DNA, 22 bp, Homo sapiens
gacatagtctctgtcttcatgg

SEQ ID NO: 9101410 - DNA, 22 bp, Homo sapiens
gacatcaggcctgcagtctggg

SEQ ID NO: 9101411 - DNA, 22 bp, Homo sapiens
gacatcaggaagacatgagagg

SEQ ID NO: 9101412 - DNA, 22 bp, Homo sapiens
gacagtctggcctaaagggtta

SEQ ID NO: 9101413 - DNA, 22 bp, Homo sapiens
gacagtctgggcacacatgaaa

SEQ ID NO: 9101414 - DNA, 22 bp, Homo sapiens
gacagctggcagtggaaaggtg

SEQ ID NO: 9101415 - DNA, 22 bp, Homo sapiens
gacagctggcagtggaaaggtg

SEQ ID NO: 9101416 - DNA, 22 bp, Homo sapiens
gacagctgcatcctcagacaca

SEQ ID NO: 9101417 - DNA, 22 bp, Homo sapiens
gacagccaggtctgatgaccca

SEQ ID NO: 9101418 - DNA, 22 bp, Homo sapiens
gacagcatctgtgtggcaggag

SEQ ID NO: 9101419 - DNA, 22 bp, Homo sapiens
gacagcatgatcaaggagccca

SEQ ID NO: 9101420 - DNA, 22 bp, Homo sapiens
gacagcatccaagagggaggga

SEQ ID NO: 9101421 - DNA, 22 bp, Homo sapiens
gacagcagtcctggagttccca

SEQ ID NO: 9101422 - DNA, 22 bp, Homo sapiens
gacagcagggacatgtaggaag

SEQ ID NO: 9101423 - DNA, 22 bp, Homo sapiens
gacagcagggacatgtaggaag

SEQ ID NO: 9101424 - DNA, 22 bp, Homo sapiens
gacagcaggtaattagttaaca

SEQ ID NO: 9101425 - DNA, 22 bp, Homo sapiens
gacagcaggtgcttgggaaagg

SEQ ID NO: 9101426 - DNA, 22 bp, Homo sapiens
gacagcaggtaattagttaaca

SEQ ID NO: 9101427 - DNA, 22 bp, Homo sapiens
gaccttcttgctgtgtcctaac

SEQ ID NO: 9101428 - DNA, 22 bp, Homo sapiens
gaccttcttgctgtgtcctaac

SEQ ID NO: 9101429 - DNA, 22 bp, Homo sapiens
gactatttatttacagaaagct

SEQ ID NO: 9101430 - DNA, 22 bp, Homo sapiens
gacctgggtaaggggctgacaa

SEQ ID NO: 9101431 - DNA, 22 bp, Homo sapiens
gacctggggtaagcttggcaac

SEQ ID NO: 9101432 - DNA, 22 bp, Homo sapiens
gacctggggtaagcttggcaac

SEQ ID NO: 9101433 - DNA, 22 bp, Homo sapiens
gacctggggtaagcttggcaac

SEQ ID NO: 9101434 - DNA, 22 bp, Homo sapiens
gacctggggtaagcttggcaac

SEQ ID NO: 9101435 - DNA, 22 bp, Homo sapiens
gacctggctttgggccccggca

SEQ ID NO: 9101436 - DNA, 22 bp, Homo sapiens
gacctggggtaagcttggcaac

SEQ ID NO: 9101437 - DNA, 22 bp, Homo sapiens
gacctggcctgcacagccctta

SEQ ID NO: 9101438 - DNA, 22 bp, Homo sapiens
gaccttcttgctgtgtcctaac

SEQ ID NO: 9101439 - DNA, 22 bp, Homo sapiens
gaccttcagtgtgtttctcaca

SEQ ID NO: 9101440 - DNA, 22 bp, Homo sapiens
gaccttcagtgtgtttctcaca

SEQ ID NO: 9101441 - DNA, 22 bp, Homo sapiens
gaccttcaagcaccatatttat

SEQ ID NO: 9101442 - DNA, 22 bp, Homo sapiens
gacctggtccttgtactttgaa

SEQ ID NO: 9101443 - DNA, 22 bp, Homo sapiens
gacatgatggaaaaaaatgctc

SEQ ID NO: 9101444 - DNA, 22 bp, Homo sapiens
gacatgaatgttatactttatt

SEQ ID NO: 9101445 - DNA, 22 bp, Homo sapiens
gacatgatggaaaaaaatgctc

SEQ ID NO: 9101446 - DNA, 22 bp, Homo sapiens
gacatgcagttctcaagggtag

SEQ ID NO: 9101447 - DNA, 22 bp, Homo sapiens
gacatgcattaagacacactga

SEQ ID NO: 9101448 - DNA, 22 bp, Homo sapiens
gacctgagattttgaggctcat

SEQ ID NO: 9101449 - DNA, 22 bp, Homo sapiens
gacctgcctgagctgcctctgc

SEQ ID NO: 9101450 - DNA, 22 bp, Homo sapiens
gaattacataataaaatgagag

SEQ ID NO: 9101451 - DNA, 22 bp, Homo sapiens
gaattacagccagaagaatgaa

SEQ ID NO: 9101452 - DNA, 22 bp, Homo sapiens
gaattacaaagtgagacaagct

SEQ ID NO: 9101453 - DNA, 19 bp, Homo sapiens
gaatgggttctgtagggag

SEQ ID NO: 9101454 - DNA, 22 bp, Homo sapiens
gaatgctggtgttcagaatttt

SEQ ID NO: 9101455 - DNA, 22 bp, Homo sapiens
gaatgctgtagacagactctat

SEQ ID NO: 9101456 - DNA, 22 bp, Homo sapiens
gaatggaaactgggagatggcc

SEQ ID NO: 9101457 - DNA, 22 bp, Homo sapiens
gaatggccccagagcaccactg

SEQ ID NO: 9101458 - DNA, 22 bp, Homo sapiens
gaatggaaactgggagatggcc

SEQ ID NO: 9101459 - DNA, 20 bp, Homo sapiens
gaatggagcctagtgtgtgg

SEQ ID NO: 9101460 - DNA, 22 bp, Homo sapiens
gaatggctgaatgtcttaaatt

SEQ ID NO: 9101461 - DNA, 19 bp, Homo sapiens
gaatgggaatgggaaagct

SEQ ID NO: 9101462 - DNA, 22 bp, Homo sapiens
gaatgtaagtgggcagaagaca

SEQ ID NO: 9101463 - DNA, 22 bp, Homo sapiens
gaagaatcaagcagtaatttgt

SEQ ID NO: 9101464 - DNA, 22 bp, Homo sapiens
gaagaatccatgctaatttacc

SEQ ID NO: 9101465 - DNA, 22 bp, Homo sapiens
gaagaatcctgtcctctttagg

SEQ ID NO: 9101466 - DNA, 22 bp, Homo sapiens
gaagaatcctgtcctctttagg

SEQ ID NO: 9101467 - DNA, 22 bp, Homo sapiens
gaagaatatataatgattttgt

SEQ ID NO: 9101468 - DNA, 22 bp, Homo sapiens
gaagaaggtggcccaggggtag

SEQ ID NO: 9101469 - DNA, 22 bp, Homo sapiens
gaagaaggtgctacacagggca

SEQ ID NO: 9101470 - DNA, 22 bp, Homo sapiens
gaatgcagtgacggaggcttac

SEQ ID NO: 9101471 - DNA, 22 bp, Homo sapiens
gaatgcatgtgaagcaaagaat

SEQ ID NO: 9101472 - DNA, 22 bp, Homo sapiens
gaatgctgagactaaagagctt

SEQ ID NO: 9101473 - DNA, 22 bp, Homo sapiens
gaatgctaagcatgtgggagtt

SEQ ID NO: 9101474 - DNA, 22 bp, Homo sapiens
gaatgcattctcttagcatcta

SEQ ID NO: 9101475 - DNA, 21 bp, Homo sapiens
gacaaagtgaagcaggcagga

SEQ ID NO: 9101476 - DNA, 22 bp, Homo sapiens
gacaaagtcaacagtactctca

SEQ ID NO: 9101477 - DNA, 21 bp, Homo sapiens
gacaaagtgaagcaggcagga

SEQ ID NO: 9101478 - DNA, 22 bp, Homo sapiens
gacagcagccacagggagaggg

SEQ ID NO: 9101479 - DNA, 22 bp, Homo sapiens
gacagcaggatgtgaggggatg

SEQ ID NO: 9101480 - DNA, 22 bp, Homo sapiens
gacagcaggagatcatgataga

SEQ ID NO: 9101481 - DNA, 22 bp, Homo sapiens
gacagcagggaaagtccagacc

SEQ ID NO: 9101482 - DNA, 22 bp, Homo sapiens
gacagcagggacatgtaggaag

SEQ ID NO: 9101483 - DNA, 22 bp, Homo sapiens
gaatttttctggaagcaattat

SEQ ID NO: 9101484 - DNA, 22 bp, Homo sapiens
gaattttattactagtcaactg

SEQ ID NO: 9101485 - DNA, 22 bp, Homo sapiens
gaattttattactagtcaactg

SEQ ID NO: 9101486 - DNA, 22 bp, Homo sapiens
gaatttacaagttgaataacaa

SEQ ID NO: 9101487 - DNA, 22 bp, Homo sapiens
gaatttacaagttgaataacaa

SEQ ID NO: 9101488 - DNA, 22 bp, Homo sapiens
gaatttacaagttgaataacaa

SEQ ID NO: 9101489 - DNA, 22 bp, Homo sapiens
gaatttacagggtgagcttcag

SEQ ID NO: 9101490 - DNA, 22 bp, Homo sapiens
gaatttatctacgttaagtatg

SEQ ID NO: 9101491 - DNA, 20 bp, Homo sapiens
gaattttatgaacactacca

SEQ ID NO: 9101492 - DNA, 20 bp, Homo sapiens
gaattttatgaacactacca

SEQ ID NO: 9101493 - DNA, 20 bp, Homo sapiens
gaattttatgaacactacca

SEQ ID NO: 9101494 - DNA, 22 bp, Homo sapiens
gacaaaagtgttttgaacaagg

SEQ ID NO: 9101495 - DNA, 22 bp, Homo sapiens
gacaaaagtgttttgaacaagg

SEQ ID NO: 9101496 - DNA, 21 bp, Homo sapiens
gacaaacatttcatagcttta

SEQ ID NO: 9101497 - DNA, 22 bp, Homo sapiens
gacaaactgaagtatatttaga

SEQ ID NO: 9101498 - DNA, 18 bp, Homo sapiens
gacaaaagtacagacaga

SEQ ID NO: 9101499 - DNA, 18 bp, Homo sapiens
gacaaaagtacagacaga

SEQ ID NO: 9101500 - DNA, 22 bp, Homo sapiens
gacaaaactgagatcacactgt

SEQ ID NO: 9101501 - DNA, 18 bp, Homo sapiens
gacaaaagtacagacaga

SEQ ID NO: 9101502 - DNA, 22 bp, Homo sapiens
gacaaaactgagatcacactgt

SEQ ID NO: 9101503 - DNA, 18 bp, Homo sapiens
gacaaaagtacagacaga

SEQ ID NO: 9101504 - DNA, 22 bp, Homo sapiens
gacaaaactgagatcacactgt

SEQ ID NO: 9101505 - DNA, 20 bp, Homo sapiens
gagcacagtaatgactgcta

SEQ ID NO: 9101506 - DNA, 22 bp, Homo sapiens
gagcacagtccttttgttaaaa

SEQ ID NO: 9101507 - DNA, 22 bp, Homo sapiens
gagcacagtgcagtttctgcta

SEQ ID NO: 9101508 - DNA, 22 bp, Homo sapiens
gagcaccaaggctctgccatgg

SEQ ID NO: 9101509 - DNA, 22 bp, Homo sapiens
gagcaccctttgcacatcagtc

SEQ ID NO: 9101510 - DNA, 22 bp, Homo sapiens
gagcagaactactcacatatcg

SEQ ID NO: 9101511 - DNA, 22 bp, Homo sapiens
gagcactgtactcatttgcact

SEQ ID NO: 9101512 - DNA, 22 bp, Homo sapiens
gagcactgtactcatttgcact

SEQ ID NO: 9101513 - DNA, 22 bp, Homo sapiens
gagcagaacaggccgggtggga

SEQ ID NO: 9101514 - DNA, 22 bp, Homo sapiens
gagcaccgcctccacgatgccc

SEQ ID NO: 9101515 - DNA, 22 bp, Homo sapiens
gagcacctcaaatgaacataaa

SEQ ID NO: 9101516 - DNA, 22 bp, Homo sapiens
gagcactgaggaaagctggtta

SEQ ID NO: 9101517 - DNA, 22 bp, Homo sapiens
gagcactgagctggaattggag

SEQ ID NO: 9101518 - DNA, 22 bp, Homo sapiens
gagcactgatttatttttgtct

SEQ ID NO: 9101519 - DNA, 22 bp, Homo sapiens
gagcactgatttatttttgtct

SEQ ID NO: 9101520 - DNA, 22 bp, Homo sapiens
gagcaggaactgaaaatgagac

SEQ ID NO: 9101521 - DNA, 22 bp, Homo sapiens
gagcaggaaggccagaagggtc

SEQ ID NO: 9101522 - DNA, 22 bp, Homo sapiens
gagcagcttgcgctgtcttcac

SEQ ID NO: 9101523 - DNA, 22 bp, Homo sapiens
gagcagcttgcgctgtcttcac

SEQ ID NO: 9101524 - DNA, 22 bp, Homo sapiens
gagcaggaactgaaaatgagac

SEQ ID NO: 9101525 - DNA, 22 bp, Homo sapiens
gagcaggaaggccagaagggtc

SEQ ID NO: 9101526 - DNA, 22 bp, Homo sapiens
gagcaggacgtgggaatgggaa

SEQ ID NO: 9101527 - DNA, 22 bp, Homo sapiens
gagcagagaatccagctaagtg

SEQ ID NO: 9101528 - DNA, 22 bp, Homo sapiens
gagcagagacagtacaactggc

SEQ ID NO: 9101529 - DNA, 22 bp, Homo sapiens
gagcagagacagtacaactggc

SEQ ID NO: 9101530 - DNA, 23 bp, Homo sapiens
gagcagagcgggcgggggtcctg

SEQ ID NO: 9101531 - DNA, 22 bp, Homo sapiens
gagcagagcttctcaaagtaaa

SEQ ID NO: 9101532 - DNA, 19 bp, Homo sapiens
gagcagcttcctatctggt

SEQ ID NO: 9101533 - DNA, 22 bp, Homo sapiens
gagcaacaggtgatggggctgt

SEQ ID NO: 9101534 - DNA, 22 bp, Homo sapiens
gagcaacagtttatggtttttc

SEQ ID NO: 9101535 - DNA, 22 bp, Homo sapiens
gagcaacagtttatggtttttc

SEQ ID NO: 9101536 - DNA, 22 bp, Homo sapiens
gagcaacagtttatggtttttc

SEQ ID NO: 9101537 - DNA, 19 bp, Homo sapiens
gagcaacatatgtaaactc

SEQ ID NO: 9101538 - DNA, 19 bp, Homo sapiens
gagcaacatatgtaaactc

SEQ ID NO: 9101539 - DNA, 22 bp, Homo sapiens
gagcaacactccacattgctag

SEQ ID NO: 9101540 - DNA, 22 bp, Homo sapiens
gagcaacagggcgaggagaact

SEQ ID NO: 9101541 - DNA, 22 bp, Homo sapiens
gagcaacagtggcagtggtggg

SEQ ID NO: 9101542 - DNA, 22 bp, Homo sapiens
gagcaacacgcagtagtatacg

SEQ ID NO: 9101543 - DNA, 22 bp, Homo sapiens
gagcaacacgcagtagtatacg

SEQ ID NO: 9101544 - DNA, 22 bp, Homo sapiens
gagcaacacattgaatgaggat

SEQ ID NO: 9101545 - DNA, 22 bp, Homo sapiens
gagcaacaaattagggggattt

SEQ ID NO: 9101546 - DNA, 22 bp, Homo sapiens
gagcaaagcttttagggccttt

SEQ ID NO: 9101547 - DNA, 22 bp, Homo sapiens
gagcaaacatcagtgatgtctg

SEQ ID NO: 9101548 - DNA, 22 bp, Homo sapiens
gagaggagtccctatcacagtt

SEQ ID NO: 9101549 - DNA, 22 bp, Homo sapiens
gagaggcagaggcctgaaaccg

SEQ ID NO: 9101550 - DNA, 22 bp, Homo sapiens
gagaggcaggaatcctgggtga

SEQ ID NO: 9101551 - DNA, 22 bp, Homo sapiens
gagaggcaggaatcctgggtga

SEQ ID NO: 9101552 - DNA, 22 bp, Homo sapiens
gagaggcagaggcctgaaaccg

SEQ ID NO: 9101553 - DNA, 22 bp, Homo sapiens
gagatttagctgcttaactcct

SEQ ID NO: 9101554 - DNA, 22 bp, Homo sapiens
gagcaagactcactgcatcttg

SEQ ID NO: 9101555 - DNA, 22 bp, Homo sapiens
gagcaaggatggccggggccgt

SEQ ID NO: 9101556 - DNA, 22 bp, Homo sapiens
gagcaaggatgggtctatagta

SEQ ID NO: 9101557 - DNA, 22 bp, Homo sapiens
gagcaaggagggtggggccttt

SEQ ID NO: 9101558 - DNA, 22 bp, Homo sapiens
gagcaaggtagctctctggggc

SEQ ID NO: 9101559 - DNA, 22 bp, Homo sapiens
gagcaaggcggcatctctctga

SEQ ID NO: 9101560 - DNA, 22 bp, Homo sapiens
gagcacagaactaaatgctggt

SEQ ID NO: 9101561 - DNA, 22 bp, Homo sapiens
gagcaatggaagatagataaca

SEQ ID NO: 9101562 - DNA, 22 bp, Homo sapiens
gagcacagatcctggagccaca

SEQ ID NO: 9101563 - DNA, 22 bp, Homo sapiens
gagcacagatcctggagccaca

SEQ ID NO: 9101564 - DNA, 22 bp, Homo sapiens
gagcacagaatcttcccatgca

SEQ ID NO: 9101565 - DNA, 22 bp, Homo sapiens
gagcacagaactaaatgctggt

SEQ ID NO: 9101566 - DNA, 22 bp, Homo sapiens
gagcacagaaggagaaatatgg

SEQ ID NO: 9101567 - DNA, 16 bp, Homo sapiens
gagaagagcccggcag

SEQ ID NO: 9101568 - DNA, 22 bp, Homo sapiens
gagaagaaaattccgtgaacac

SEQ ID NO: 9101569 - DNA, 22 bp, Homo sapiens
gagaacctctccacaagtctgg

SEQ ID NO: 9101570 - DNA, 22 bp, Homo sapiens
gagaacattgggaaagctagac

SEQ ID NO: 9101571 - DNA, 22 bp, Homo sapiens
gagaacagtgttgtattttttc

SEQ ID NO: 9101572 - DNA, 22 bp, Homo sapiens
gagaacaggctctggagtcaga

SEQ ID NO: 9101573 - DNA, 22 bp, Homo sapiens
gagaacaggctctggagtcaga

SEQ ID NO: 9101574 - DNA, 22 bp, Homo sapiens
gagaacaggctctggagtcaga

SEQ ID NO: 9101575 - DNA, 22 bp, Homo sapiens
gagaacaggctctggagtcaga

SEQ ID NO: 9101576 - DNA, 22 bp, Homo sapiens
gagaaagggaacttacagagtg

SEQ ID NO: 9101577 - DNA, 22 bp, Homo sapiens
gagaaagggaacttacagagtg

SEQ ID NO: 9101578 - DNA, 19 bp, Homo sapiens
gactccaactttaagcatg

SEQ ID NO: 9101579 - DNA, 22 bp, Homo sapiens
gagaagccgagtcagctgagcc

SEQ ID NO: 9101580 - DNA, 22 bp, Homo sapiens
gagaagccgagtcagctgagcc

SEQ ID NO: 9101581 - DNA, 22 bp, Homo sapiens
gagaagcaatttccaactgtgc

SEQ ID NO: 9101582 - DNA, 22 bp, Homo sapiens
gagaagcaatttccaactgtgc

SEQ ID NO: 9101583 - DNA, 22 bp, Homo sapiens
gagaagcaatcagtggccaccc

SEQ ID NO: 9101584 - DNA, 22 bp, Homo sapiens
gagaagcaatcgtgacatctcc

SEQ ID NO: 9101585 - DNA, 22 bp, Homo sapiens
gagaagcaatcgtgacatctcc

SEQ ID NO: 9101586 - DNA, 22 bp, Homo sapiens
gagagaagggacttctacactt

SEQ ID NO: 9101587 - DNA, 22 bp, Homo sapiens
gagagaagggggatatgagcct

SEQ ID NO: 9101588 - DNA, 22 bp, Homo sapiens
gagagaatgtacatgctagggg

SEQ ID NO: 9101589 - DNA, 22 bp, Homo sapiens
gagagaagaatgttccgaggcc

SEQ ID NO: 9101590 - DNA, 22 bp, Homo sapiens
gagagaagaatgttccgaggcc

SEQ ID NO: 9101591 - DNA, 22 bp, Homo sapiens
gagagaagaaagccatggtcct

SEQ ID NO: 9101592 - DNA, 22 bp, Homo sapiens
gagagaagaaagccatggtcct

SEQ ID NO: 9101593 - DNA, 22 bp, Homo sapiens
gagagaagaaagccatggtcct

SEQ ID NO: 9101594 - DNA, 22 bp, Homo sapiens
gagaaggaagttgagccagcat

SEQ ID NO: 9101595 - DNA, 22 bp, Homo sapiens
gagaagccgagtcagctgagcc

SEQ ID NO: 9101596 - DNA, 22 bp, Homo sapiens
gagagcaggctctcgggggcca

SEQ ID NO: 9101597 - DNA, 22 bp, Homo sapiens
gagagcaggctctcgggggcca

SEQ ID NO: 9101598 - DNA, 22 bp, Homo sapiens
gagagcatgtggtctagtttta

SEQ ID NO: 9101599 - DNA, 22 bp, Homo sapiens
gagagcaggaggcagcgggacg

SEQ ID NO: 9101600 - DNA, 22 bp, Homo sapiens
gagagcaggaggcagcgggacg

SEQ ID NO: 9101601 - DNA, 18 bp, Homo sapiens
gagagcccagcaggtggt

SEQ ID NO: 9101602 - DNA, 18 bp, Homo sapiens
gagagcccagcaggtggt

SEQ ID NO: 9101603 - DNA, 18 bp, Homo sapiens
gagagcccagcaggtggt

SEQ ID NO: 9101604 - DNA, 23 bp, Homo sapiens
gagagcccattggcaggggtacc

SEQ ID NO: 9101605 - DNA, 22 bp, Homo sapiens
gagagccatggtggagatgggg

SEQ ID NO: 9101606 - DNA, 22 bp, Homo sapiens
gagagagaaccccgtgcccttc

SEQ ID NO: 9101607 - DNA, 22 bp, Homo sapiens
gagagacccagacaccatgcat

SEQ ID NO: 9101608 - DNA, 22 bp, Homo sapiens
gagagaccttgctaagtgcctt

SEQ ID NO: 9101609 - DNA, 22 bp, Homo sapiens
gagagacctcagaaacaatcta

SEQ ID NO: 9101610 - DNA, 22 bp, Homo sapiens
gagagacagcagaacgtgcagc

SEQ ID NO: 9101611 - DNA, 22 bp, Homo sapiens
gagagacagcagaacgtgcagc

SEQ ID NO: 9101612 - DNA, 22 bp, Homo sapiens
gagagaatgtacatgctagggg

SEQ ID NO: 9101613 - DNA, 22 bp, Homo sapiens
gagaggaggtggctatgacagc

SEQ ID NO: 9101614 - DNA, 22 bp, Homo sapiens
gagaggaggtggctatgacagc

SEQ ID NO: 9101615 - DNA, 22 bp, Homo sapiens
gagaggagtccctatcacagtt

SEQ ID NO: 9101616 - DNA, 22 bp, Homo sapiens
gagaggagtaggctgatggtgc

SEQ ID NO: 9101617 - DNA, 22 bp, Homo sapiens
gagagctgtccggctgagcagc

SEQ ID NO: 9101618 - DNA, 22 bp, Homo sapiens
gagaggagaagcctgcgcttca

SEQ ID NO: 9101619 - DNA, 22 bp, Homo sapiens
gagaggagaagcctgcgcttca

SEQ ID NO: 9101620 - DNA, 22 bp, Homo sapiens
gagaggagacttatccagattg

SEQ ID NO: 9101621 - DNA, 22 bp, Homo sapiens
gagaggagacttatccagattg

SEQ ID NO: 9101622 - DNA, 22 bp, Homo sapiens
gagagctgtcagcgtagcaccg

SEQ ID NO: 9101623 - DNA, 22 bp, Homo sapiens
gagagctgtaatagtcatgtct

SEQ ID NO: 9101624 - DNA, 22 bp, Homo sapiens
gagagctgtaatagtcatgtct

SEQ ID NO: 9101625 - DNA, 22 bp, Homo sapiens
gagagctgtaatagtcatgtct

SEQ ID NO: 9101626 - DNA, 22 bp, Homo sapiens
gaggccagaagtctgagatcag

SEQ ID NO: 9101627 - DNA, 22 bp, Homo sapiens
gaggccagaatgagctgaatgc

SEQ ID NO: 9101628 - DNA, 22 bp, Homo sapiens
gaggccagaagtgcctcgggct

SEQ ID NO: 9101629 - DNA, 22 bp, Homo sapiens
gaggccagagttccccgagtca

SEQ ID NO: 9101630 - DNA, 22 bp, Homo sapiens
gaggcctggaattccagcctgg

SEQ ID NO: 9101631 - DNA, 22 bp, Homo sapiens
gaggcctggaccagccacagag

SEQ ID NO: 9101632 - DNA, 21 bp, Homo sapiens
gaggccactaataggggcaga

SEQ ID NO: 9101633 - DNA, 21 bp, Homo sapiens
gaggccactaataggggcaga

SEQ ID NO: 9101634 - DNA, 22 bp, Homo sapiens
gaggcatggcctgaggctagga

SEQ ID NO: 9101635 - DNA, 22 bp, Homo sapiens
gaggcatggcctgaggctagga

SEQ ID NO: 9101636 - DNA, 22 bp, Homo sapiens
gaggcatgcagagctggagcag

SEQ ID NO: 9101637 - DNA, 22 bp, Homo sapiens
gaggcatgcagagctggagcag

SEQ ID NO: 9101638 - DNA, 22 bp, Homo sapiens
gaggatggaggtgtgagctatg

SEQ ID NO: 9101639 - DNA, 22 bp, Homo sapiens
gaggatggaggtgtgagctatg

SEQ ID NO: 9101640 - DNA, 22 bp, Homo sapiens
gaggcaagaaaggactttctag

SEQ ID NO: 9101641 - DNA, 22 bp, Homo sapiens
gaggatttgatggctttctccc

SEQ ID NO: 9101642 - DNA, 18 bp, Homo sapiens
gaggatggaaggagatgc

SEQ ID NO: 9101643 - DNA, 20 bp, Homo sapiens
gaggatgcagacagagggca

SEQ ID NO: 9101644 - DNA, 22 bp, Homo sapiens
gaggagtggagttgctgggttg

SEQ ID NO: 9101645 - DNA, 22 bp, Homo sapiens
gaggagtgccagccgtggagtc

SEQ ID NO: 9101646 - DNA, 22 bp, Homo sapiens
gaggagtgccagccgtggagtc

SEQ ID NO: 9101647 - DNA, 22 bp, Homo sapiens
gaggagagaagctaacggtgct

SEQ ID NO: 9101648 - DNA, 22 bp, Homo sapiens
gaggaggtggagtcatgcagag

SEQ ID NO: 9101649 - DNA, 22 bp, Homo sapiens
gaggagactgacagcagattct

SEQ ID NO: 9101650 - DNA, 22 bp, Homo sapiens
gaggagagaacattcctccata

SEQ ID NO: 9101651 - DNA, 22 bp, Homo sapiens
gaggagagaacattcctccata

SEQ ID NO: 9101652 - DNA, 22 bp, Homo sapiens
gaggagagaagctaacggtgct

SEQ ID NO: 9101653 - DNA, 22 bp, Homo sapiens
gaggagagaagctaacggtgct

SEQ ID NO: 9101654 - DNA, 22 bp, Homo sapiens
gaggagagaagctaacggtgct

SEQ ID NO: 9101655 - DNA, 22 bp, Homo sapiens
gaggacagtgtgatctgccagc

SEQ ID NO: 9101656 - DNA, 22 bp, Homo sapiens
gaggacagtgtgatctgccagc

SEQ ID NO: 9101657 - DNA, 22 bp, Homo sapiens
gaggacagtgtgatctgccagc

SEQ ID NO: 9101658 - DNA, 22 bp, Homo sapiens
gaggaccacagatgagcctgca

SEQ ID NO: 9101659 - DNA, 22 bp, Homo sapiens
gaggaccacagatgagcctgca

SEQ ID NO: 9101660 - DNA, 22 bp, Homo sapiens
gagctgtggaaggcagggacca

SEQ ID NO: 9101661 - DNA, 22 bp, Homo sapiens
gagctgtgcttataccaattca

SEQ ID NO: 9101662 - DNA, 22 bp, Homo sapiens
gagctgtgcttataccaattca

SEQ ID NO: 9101663 - DNA, 22 bp, Homo sapiens
gagctgtgattggtgtctcact

SEQ ID NO: 9101664 - DNA, 20 bp, Homo sapiens
gagctgtgctctcaggagcc

SEQ ID NO: 9101665 - DNA, 20 bp, Homo sapiens
gagctgtgctctcaggagcc

SEQ ID NO: 9101666 - DNA, 22 bp, Homo sapiens
gagctgtgccaatctgtctggg

SEQ ID NO: 9101667 - DNA, 17 bp, Homo sapiens
gaggacagggaagtagg

SEQ ID NO: 9101668 - DNA, 17 bp, Homo sapiens
gaggacagggaagtagg

SEQ ID NO: 9101669 - DNA, 22 bp, Homo sapiens
gagctgtgtgcctggatggtct

SEQ ID NO: 9101670 - DNA, 22 bp, Homo sapiens
gaggacaggagactcactgttt

SEQ ID NO: 9101671 - DNA, 18 bp, Homo sapiens
gagctgtctgagctggtc

SEQ ID NO: 9101672 - DNA, 18 bp, Homo sapiens
gagctgtctgagctggtc

SEQ ID NO: 9101673 - DNA, 22 bp, Homo sapiens
gagctgtctggggactctgggt

SEQ ID NO: 9101674 - DNA, 22 bp, Homo sapiens
gagctgtgaaaagtgcctgggg

SEQ ID NO: 9101675 - DNA, 22 bp, Homo sapiens
gagctgtgagggacacattgct

SEQ ID NO: 9101676 - DNA, 22 bp, Homo sapiens
gagctgtgacacgcagcccagg

SEQ ID NO: 9101677 - DNA, 22 bp, Homo sapiens
gagctggttttaggctatgtct

SEQ ID NO: 9101678 - DNA, 22 bp, Homo sapiens
gagctgtccaagatggtcgtaa

SEQ ID NO: 9101679 - DNA, 22 bp, Homo sapiens
gagctggttctgtccagggaat

SEQ ID NO: 9101680 - DNA, 22 bp, Homo sapiens
gagctggtgtgtgcccgagcac

SEQ ID NO: 9101681 - DNA, 22 bp, Homo sapiens
gagctggttctgtccagggaat

SEQ ID NO: 9101682 - DNA, 22 bp, Homo sapiens
gagctggttctgtccagggaat

SEQ ID NO: 9101683 - DNA, 22 bp, Homo sapiens
gagctgtccgcccctgggccga

SEQ ID NO: 9101684 - DNA, 22 bp, Homo sapiens
gagctgtccgcccctgggccga

SEQ ID NO: 9101685 - DNA, 22 bp, Homo sapiens
gagctgtcctaccaggagtcct

SEQ ID NO: 9101686 - DNA, 22 bp, Homo sapiens
gagctgtcctaccaggagtcct

SEQ ID NO: 9101687 - DNA, 22 bp, Homo sapiens
gagctgtctctttgggcctttt

SEQ ID NO: 9101688 - DNA, 22 bp, Homo sapiens
gagctgtctctatatgaatgct

SEQ ID NO: 9101689 - DNA, 22 bp, Homo sapiens
gagctgggcacacgccacttga

SEQ ID NO: 9101690 - DNA, 22 bp, Homo sapiens
gagctgggatttgaacctggga

SEQ ID NO: 9101691 - DNA, 22 bp, Homo sapiens
gagctccagggaacagcagcta

SEQ ID NO: 9101692 - DNA, 22 bp, Homo sapiens
gagctccagcatctctgccaaa

SEQ ID NO: 9101693 - DNA, 22 bp, Homo sapiens
gagctccctggaggttcagata

SEQ ID NO: 9101694 - DNA, 22 bp, Homo sapiens
gagctcccaggccccagcaagg

SEQ ID NO: 9101695 - DNA, 22 bp, Homo sapiens
gagctggtggtgagaaagctct

SEQ ID NO: 9101696 - DNA, 22 bp, Homo sapiens
gagctggtgtgtgcccgagcac

SEQ ID NO: 9101697 - DNA, 22 bp, Homo sapiens
gagctggtgtgtgcccgagcac

SEQ ID NO: 9101698 - DNA, 22 bp, Homo sapiens
gagctggtgctcttgtcaagac

SEQ ID NO: 9101699 - DNA, 22 bp, Homo sapiens
gagctggtgctgtgcctgttct

SEQ ID NO: 9101700 - DNA, 22 bp, Homo sapiens
gagctggtgatcagctggagga

SEQ ID NO: 9101701 - DNA, 22 bp, Homo sapiens
gagctggtgatcagctggagga

SEQ ID NO: 9101702 - DNA, 22 bp, Homo sapiens
gagctggtgatcagctggagga

SEQ ID NO: 9101703 - DNA, 22 bp, Homo sapiens
gagctggtcgaaatgggctgac

SEQ ID NO: 9101704 - DNA, 22 bp, Homo sapiens
gagctggtcgaaatgggctgac

SEQ ID NO: 9101705 - DNA, 22 bp, Homo sapiens
gagctggtcgaaatgggctgac

SEQ ID NO: 9101706 - DNA, 22 bp, Homo sapiens
gagctggtccacaatctgcagg

SEQ ID NO: 9101707 - DNA, 22 bp, Homo sapiens
gagctggtcagtttcaggagag

SEQ ID NO: 9101708 - DNA, 22 bp, Homo sapiens
gagctggtattccagtttagtt

SEQ ID NO: 9101709 - DNA, 22 bp, Homo sapiens
gagctggtaaaggatcttgtct

SEQ ID NO: 9101710 - DNA, 22 bp, Homo sapiens
gagctggtcagtttcaggagag

SEQ ID NO: 9101711 - DNA, 22 bp, Homo sapiens
gagctggtcagtttcagggcca

SEQ ID NO: 9101712 - DNA, 22 bp, Homo sapiens
gagctggtcagtttcagggcca

SEQ ID NO: 9101713 - DNA, 22 bp, Homo sapiens
gagctgggtgtttatttgccaa

SEQ ID NO: 9101714 - DNA, 22 bp, Homo sapiens
gagctccagagttagacacccg

SEQ ID NO: 9101715 - DNA, 22 bp, Homo sapiens
gagctccaccaccttcaggcag

SEQ ID NO: 9101716 - DNA, 22 bp, Homo sapiens
gagctcagggcattgagcaaga

SEQ ID NO: 9101717 - DNA, 22 bp, Homo sapiens
gagctcagcccaaagagcagtg

SEQ ID NO: 9101718 - DNA, 22 bp, Homo sapiens
gagctcagcccaaagagcagtg

SEQ ID NO: 9101719 - DNA, 22 bp, Homo sapiens
gagctcaggagcatcagaagaa

SEQ ID NO: 9101720 - DNA, 22 bp, Homo sapiens
gagcaggcaaagatgaaaggag

SEQ ID NO: 9101721 - DNA, 22 bp, Homo sapiens
gagcaggcaaagatgaaaggag

SEQ ID NO: 9101722 - DNA, 19 bp, Homo sapiens
gagcaggccacacatgtgt

SEQ ID NO: 9101723 - DNA, 19 bp, Homo sapiens
gagcaggccacacatgtgt

SEQ ID NO: 9101724 - DNA, 22 bp, Homo sapiens
gagcaggcattctagtggctga

SEQ ID NO: 9101725 - DNA, 22 bp, Homo sapiens
gagcaggcattctagtggctga

SEQ ID NO: 9101726 - DNA, 22 bp, Homo sapiens
gagcaggcattctagtggctga

SEQ ID NO: 9101727 - DNA, 22 bp, Homo sapiens
gagcaggcattctagtggctga

SEQ ID NO: 9101728 - DNA, 22 bp, Homo sapiens
gagcaggcaactctgcagtgcc

SEQ ID NO: 9101729 - DNA, 22 bp, Homo sapiens
gagcaggccagcaatggaaggg

SEQ ID NO: 9101730 - DNA, 22 bp, Homo sapiens
gagcaggccagcaatggaaggg

SEQ ID NO: 9101731 - DNA, 22 bp, Homo sapiens
gagcaggcctggggtgaggcct

SEQ ID NO: 9101732 - DNA, 22 bp, Homo sapiens
gagctcagagcctatagttggt

SEQ ID NO: 9101733 - DNA, 22 bp, Homo sapiens
gagcaggctctgcctgtgtgtc

SEQ ID NO: 9101734 - DNA, 22 bp, Homo sapiens
gagcaggcctggggtgaggcct

SEQ ID NO: 9101735 - DNA, 22 bp, Homo sapiens
gagggaagaaagaattgatgcg

SEQ ID NO: 9101736 - DNA, 22 bp, Homo sapiens
gagggaagaggcctgacatttt

SEQ ID NO: 9101737 - DNA, 22 bp, Homo sapiens
gaggctggtttgccttttggca

SEQ ID NO: 9101738 - DNA, 22 bp, Homo sapiens
gaggctggtttgccttttggca

SEQ ID NO: 9101739 - DNA, 22 bp, Homo sapiens
gagggaagattccccatatggg

SEQ ID NO: 9101740 - DNA, 22 bp, Homo sapiens
gagggaagaggcctgacatttt

SEQ ID NO: 9101741 - DNA, 22 bp, Homo sapiens
gagggaagaggcctgacatttt

SEQ ID NO: 9101742 - DNA, 22 bp, Homo sapiens
gagggaagagggtttgaattca

SEQ ID NO: 9101743 - DNA, 22 bp, Homo sapiens
gagggaaggagagttgtagctg

SEQ ID NO: 9101744 - DNA, 22 bp, Homo sapiens
gagggaaggacccattttaagt

SEQ ID NO: 9101745 - DNA, 22 bp, Homo sapiens
gagggaagattccccatatggg

SEQ ID NO: 9101746 - DNA, 22 bp, Homo sapiens
gagggaaggtcacccttgtagc

SEQ ID NO: 9101747 - DNA, 22 bp, Homo sapiens
gagggccacgttcagggctctc

SEQ ID NO: 9101748 - DNA, 22 bp, Homo sapiens
gagggagaaggactatcaggct

SEQ ID NO: 9101749 - DNA, 22 bp, Homo sapiens
gagggccagagtcctggggtca

SEQ ID NO: 9101750 - DNA, 22 bp, Homo sapiens
gagggaatggtgtgcaagaggt

SEQ ID NO: 9101751 - DNA, 22 bp, Homo sapiens
gagggacagctaaagagaaatt

SEQ ID NO: 9101752 - DNA, 22 bp, Homo sapiens
gagggaagtcataatgttctag

SEQ ID NO: 9101753 - DNA, 22 bp, Homo sapiens
gagggaagtcataatgttctag

SEQ ID NO: 9101754 - DNA, 22 bp, Homo sapiens
gagggaatggtgtgcaagaggt

SEQ ID NO: 9101755 - DNA, 22 bp, Homo sapiens
gagggaatggtgtgcaagaggt

SEQ ID NO: 9101756 - DNA, 22 bp, Homo sapiens
gagggaccccaggctggccctt

SEQ ID NO: 9101757 - DNA, 22 bp, Homo sapiens
gagggccagatcccaggaggaa

SEQ ID NO: 9101758 - DNA, 22 bp, Homo sapiens
gagggccagcagcctcagcatg

SEQ ID NO: 9101759 - DNA, 22 bp, Homo sapiens
gagggccagcagcctcagcatg

SEQ ID NO: 9101760 - DNA, 22 bp, Homo sapiens
gagggccaggcggagacaggcg

SEQ ID NO: 9101761 - DNA, 22 bp, Homo sapiens
gagggccaggcagcaagaaggc

SEQ ID NO: 9101762 - DNA, 22 bp, Homo sapiens
gagggccaggcagcaagaaggc

SEQ ID NO: 9101763 - DNA, 22 bp, Homo sapiens
gagggcctactggacatgtcag

SEQ ID NO: 9101764 - DNA, 22 bp, Homo sapiens
gagggcctactggacatgtcag

SEQ ID NO: 9101765 - DNA, 22 bp, Homo sapiens
gagggccctggctggctccagc

SEQ ID NO: 9101766 - DNA, 22 bp, Homo sapiens
gagggcctctgtgggtgctcac

SEQ ID NO: 9101767 - DNA, 22 bp, Homo sapiens
gagggcctctgctgctccacat

SEQ ID NO: 9101768 - DNA, 22 bp, Homo sapiens
gagggcctctgctgctccacat

SEQ ID NO: 9101769 - DNA, 22 bp, Homo sapiens
gagggcctctgctgctccacat

SEQ ID NO: 9101770 - DNA, 22 bp, Homo sapiens
gaggctagatgtttgctgggag

SEQ ID NO: 9101771 - DNA, 22 bp, Homo sapiens
gaggctagagcaggggctcaat

SEQ ID NO: 9101772 - DNA, 22 bp, Homo sapiens
gaggctaaggttctgccagaag

SEQ ID NO: 9101773 - DNA, 22 bp, Homo sapiens
gaggctaaggtgccagacgaat

SEQ ID NO: 9101774 - DNA, 22 bp, Homo sapiens
gaggctaagcactggcatttct

SEQ ID NO: 9101775 - DNA, 22 bp, Homo sapiens
gaggctggggtctgcctttctg

SEQ ID NO: 9101776 - DNA, 22 bp, Homo sapiens
gaggctggtaggaaaggaaaca

SEQ ID NO: 9101777 - DNA, 22 bp, Homo sapiens
gaggctggttcccttgatcttt

SEQ ID NO: 9101778 - DNA, 22 bp, Homo sapiens
gaggctggttcccttgatcttt

SEQ ID NO: 9101779 - DNA, 22 bp, Homo sapiens
gaggctggttctgaagtactgt

SEQ ID NO: 9101780 - DNA, 22 bp, Homo sapiens
gaggctggttcccttgatcttt

SEQ ID NO: 9101781 - DNA, 22 bp, Homo sapiens
gaggctggttctgaagtactgt

SEQ ID NO: 9101782 - DNA, 22 bp, Homo sapiens
gaggctggtaggaaaggaaaca

SEQ ID NO: 9101783 - DNA, 22 bp, Homo sapiens
gaggctggtcagccctaagatc

SEQ ID NO: 9101784 - DNA, 22 bp, Homo sapiens
gaggctggtggttagttccatt

SEQ ID NO: 9101785 - DNA, 22 bp, Homo sapiens
gaggcctggtttgcatgagaat

SEQ ID NO: 9101786 - DNA, 22 bp, Homo sapiens
gaggcctggtttgcatgagaat

SEQ ID NO: 9101787 - DNA, 22 bp, Homo sapiens
gaggcctggtttgcatgagaat

SEQ ID NO: 9101788 - DNA, 22 bp, Homo sapiens
gaggcctggtttgcatgagaat

SEQ ID NO: 9101789 - DNA, 22 bp, Homo sapiens
gaggcctggtttccagcatcct

SEQ ID NO: 9101790 - DNA, 22 bp, Homo sapiens
gaggcctggtctatgagatgtt

SEQ ID NO: 9101791 - DNA, 22 bp, Homo sapiens
gaggcctggtgctgtgtccaca

SEQ ID NO: 9101792 - DNA, 19 bp, Homo sapiens
gaggcgaggcgtgcaggag

SEQ ID NO: 9101793 - DNA, 19 bp, Homo sapiens
gaggcgaggcgtgcaggag

SEQ ID NO: 9101794 - DNA, 22 bp, Homo sapiens
gaggcgagaagctggagatggt

SEQ ID NO: 9101795 - DNA, 22 bp, Homo sapiens
gaggccttcctctcaagcacat

SEQ ID NO: 9101796 - DNA, 22 bp, Homo sapiens
gaggccttgggatgtgccacgg

SEQ ID NO: 9101797 - DNA, 22 bp, Homo sapiens
gaggccttgggatgtgccacgg

SEQ ID NO: 9101798 - DNA, 22 bp, Homo sapiens
gaggccttgggatgtgccacgg

SEQ ID NO: 9101799 - DNA, 22 bp, Homo sapiens
gaggcctttatgtacatctagt

SEQ ID NO: 9101800 - DNA, 22 bp, Homo sapiens
gaggcgagaagctggagatggt

SEQ ID NO: 9101801 - DNA, 22 bp, Homo sapiens
gaggcctgtagtcatggatgta

SEQ ID NO: 9101802 - DNA, 22 bp, Homo sapiens
gaggccttagagcttttctaga

SEQ ID NO: 9101803 - DNA, 22 bp, Homo sapiens
gaggccttcacttatttaaggg

SEQ ID NO: 9101804 - DNA, 22 bp, Homo sapiens
gaggccttcctctcaagcacat

SEQ ID NO: 9101805 - DNA, 22 bp, Homo sapiens
gaggccttcagaaggcattagt

SEQ ID NO: 9101806 - DNA, 22 bp, Homo sapiens
gagggctgataacaggaataca

SEQ ID NO: 9101807 - DNA, 22 bp, Homo sapiens
gagggtcctggctaagtctgac

SEQ ID NO: 9101808 - DNA, 22 bp, Homo sapiens
gagggtgctctgagcccttttg

SEQ ID NO: 9101809 - DNA, 22 bp, Homo sapiens
gagggtgggctcctatctgggt

SEQ ID NO: 9101810 - DNA, 22 bp, Homo sapiens
gagggtgggctcctatctgggt

SEQ ID NO: 9101811 - DNA, 22 bp, Homo sapiens
gagggtggggaatagactgcta

SEQ ID NO: 9101812 - DNA, 22 bp, Homo sapiens
gaggtcctgtctgagaatggag

SEQ ID NO: 9101813 - DNA, 22 bp, Homo sapiens
gaggtcctctgtgtccgcgggc

SEQ ID NO: 9101814 - DNA, 22 bp, Homo sapiens
gaggtctggaccaagtcgcccc

SEQ ID NO: 9101815 - DNA, 22 bp, Homo sapiens
gaggtctgggcttgggcctggt

SEQ ID NO: 9101816 - DNA, 22 bp, Homo sapiens
gaggtctgggatggggcctgaa

SEQ ID NO: 9101817 - DNA, 22 bp, Homo sapiens
gaggtggaaggcaggaacaaat

SEQ ID NO: 9101818 - DNA, 22 bp, Homo sapiens
gaggtggatgttgcagtgagct

SEQ ID NO: 9101819 - DNA, 22 bp, Homo sapiens
gaggtggctgcttgctgggaaa

SEQ ID NO: 9101820 - DNA, 22 bp, Homo sapiens
gaggtggctccttcagggaata

SEQ ID NO: 9101821 - DNA, 22 bp, Homo sapiens
gaggtggctggctcagagccag

SEQ ID NO: 9101822 - DNA, 22 bp, Homo sapiens
gaggtgagaagggggtcagatg

SEQ ID NO: 9101823 - DNA, 22 bp, Homo sapiens
gaggtgaaagttattcatttat

SEQ ID NO: 9101824 - DNA, 22 bp, Homo sapiens
gaggtcttcacaaagaacagca

SEQ ID NO: 9101825 - DNA, 22 bp, Homo sapiens
gaggtgagtggatcacgaggtc

SEQ ID NO: 9101826 - DNA, 22 bp, Homo sapiens
gaggtgattttcaaaagaactt

SEQ ID NO: 9101827 - DNA, 22 bp, Homo sapiens
gaggtgcttcctttgggctctg

SEQ ID NO: 9101828 - DNA, 22 bp, Homo sapiens
gaggtgctgctgtacttcttgc

SEQ ID NO: 9101829 - DNA, 22 bp, Homo sapiens
gaggtgcctggcgatgtctctg

SEQ ID NO: 9101830 - DNA, 22 bp, Homo sapiens
gagtaaggctgctgatggagtg

SEQ ID NO: 9101831 - DNA, 22 bp, Homo sapiens
gagtaagagctggctttggtgt

SEQ ID NO: 9101832 - DNA, 22 bp, Homo sapiens
gagtaaaagttggattacaaag

SEQ ID NO: 9101833 - DNA, 22 bp, Homo sapiens
gagtaaaataggtgagaatcaa

SEQ ID NO: 9101834 - DNA, 19 bp, Homo sapiens
gagtacaggtgcagaaatg

SEQ ID NO: 9101835 - DNA, 19 bp, Homo sapiens
gagtacaggtgcagaaatg

SEQ ID NO: 9101836 - DNA, 22 bp, Homo sapiens
gaggttggtgaggggacacggt

SEQ ID NO: 9101837 - DNA, 22 bp, Homo sapiens
gaggttggtgaggggacacggt

SEQ ID NO: 9101838 - DNA, 22 bp, Homo sapiens
gaggtttcactgtgttgtccag

SEQ ID NO: 9101839 - DNA, 22 bp, Homo sapiens
gagtaaaagatgaggcagtaga

SEQ ID NO: 9101840 - DNA, 22 bp, Homo sapiens
gaggtttcttatcaagaaagct

SEQ ID NO: 9101841 - DNA, 22 bp, Homo sapiens
gaggtgggagggcagtccctaa

SEQ ID NO: 9101842 - DNA, 22 bp, Homo sapiens
tcctgcctgcaatcccagcact

SEQ ID NO: 9101843 - DNA, 22 bp, Homo sapiens
tcctgcctgcaatcccagcact

SEQ ID NO: 9101844 - DNA, 22 bp, Homo sapiens
tcctgcctgagcgtggaggagg

SEQ ID NO: 9101845 - DNA, 22 bp, Homo sapiens
tcctgcctgagcgtggaggagg

SEQ ID NO: 9101846 - DNA, 22 bp, Homo sapiens
tcctgcctgagcgtggaggagg

SEQ ID NO: 9101847 - DNA, 22 bp, Homo sapiens
tcctgcctcttgccttcttcac

SEQ ID NO: 9101848 - DNA, 22 bp, Homo sapiens
tcctgcctctccatgctaacta

SEQ ID NO: 9101849 - DNA, 22 bp, Homo sapiens
tcctgcctcttttcttattcca

SEQ ID NO: 9101850 - DNA, 22 bp, Homo sapiens
tcctgcctcttttcttattcca

SEQ ID NO: 9101851 - DNA, 22 bp, Homo sapiens
tcctgcctcttgccttcttcac

SEQ ID NO: 9101852 - DNA, 22 bp, Homo sapiens
tcctgcctaccttgcggaggtg

SEQ ID NO: 9101853 - DNA, 22 bp, Homo sapiens
tcctgcctaccttgcggaggtg

SEQ ID NO: 9101854 - DNA, 22 bp, Homo sapiens
tcctgccgtcctccggggcctc

SEQ ID NO: 9101855 - DNA, 22 bp, Homo sapiens
tcctgcctagcaggtgacctat

SEQ ID NO: 9101856 - DNA, 22 bp, Homo sapiens
tcctgcctagcaggtgacctat

SEQ ID NO: 9101857 - DNA, 22 bp, Homo sapiens
tcctgcctcacagttgaagttt

SEQ ID NO: 9101858 - DNA, 22 bp, Homo sapiens
tcctgcctcacagttgaagttt

SEQ ID NO: 9101859 - DNA, 22 bp, Homo sapiens
tcctgcctcaggctctggagta

SEQ ID NO: 9101860 - DNA, 22 bp, Homo sapiens
tcctgcctcacagttgaagttt

SEQ ID NO: 9101861 - DNA, 22 bp, Homo sapiens
tcctgcctcaggctctggagta

SEQ ID NO: 9101862 - DNA, 22 bp, Homo sapiens
tcctgcctctccatgctaacta

SEQ ID NO: 9101863 - DNA, 22 bp, Homo sapiens
tcctgcagctgcagacctgggg

SEQ ID NO: 9101864 - DNA, 22 bp, Homo sapiens
tcctgcagctgaagctcatgtg

SEQ ID NO: 9101865 - DNA, 22 bp, Homo sapiens
tcctgcagctctgagaagcatc

SEQ ID NO: 9101866 - DNA, 22 bp, Homo sapiens
tcctgcaggccagaggggtgag

SEQ ID NO: 9101867 - DNA, 22 bp, Homo sapiens
tcctgcaggcctgttcccagta

SEQ ID NO: 9101868 - DNA, 22 bp, Homo sapiens
tcctgcaggcttgagtcctcag

SEQ ID NO: 9101869 - DNA, 18 bp, Homo sapiens
tcctgcagcttctatgta

SEQ ID NO: 9101870 - DNA, 20 bp, Homo sapiens
tcctgcagtcgctagcgccc

SEQ ID NO: 9101871 - DNA, 20 bp, Homo sapiens
tcctgcagtcgctagcgccc

SEQ ID NO: 9101872 - DNA, 22 bp, Homo sapiens
tcctgcaggtggatgattctct

SEQ ID NO: 9101873 - DNA, 19 bp, Homo sapiens
tcctgcaggtggcttgcag

SEQ ID NO: 9101874 - DNA, 21 bp, Homo sapiens
tcctgcagggcagcagagtgg

SEQ ID NO: 9101875 - DNA, 22 bp, Homo sapiens
tcctgcagccattagaggtcaa

SEQ ID NO: 9101876 - DNA, 22 bp, Homo sapiens
tcctgcagccactgcaggcaga

SEQ ID NO: 9101877 - DNA, 22 bp, Homo sapiens
tcctgcagccactgcaggcaga

SEQ ID NO: 9101878 - DNA, 22 bp, Homo sapiens
tcctgcagatcaaagcctttga

SEQ ID NO: 9101879 - DNA, 22 bp, Homo sapiens
tcctgcagccaagggtcatcga

SEQ ID NO: 9101880 - DNA, 22 bp, Homo sapiens
tcctgcagccactgcaggcaga

SEQ ID NO: 9101881 - DNA, 23 bp, Homo sapiens
tcctgcagataagctggttgaca

SEQ ID NO: 9101882 - DNA, 22 bp, Homo sapiens
tcctgcagagtcccactgattt

SEQ ID NO: 9101883 - DNA, 22 bp, Homo sapiens
tcctgcagagccgccctcaggt

SEQ ID NO: 9101884 - DNA, 22 bp, Homo sapiens
tcctgcagagccgccctcaggt

SEQ ID NO: 9101885 - DNA, 22 bp, Homo sapiens
tcctgcagagccgccctcaggt

SEQ ID NO: 9101886 - DNA, 19 bp, Homo sapiens
tcctgcagaccagacctgt

SEQ ID NO: 9101887 - DNA, 22 bp, Homo sapiens
tcctgcacattagtatttttta

SEQ ID NO: 9101888 - DNA, 20 bp, Homo sapiens
tcctgcaaaaggacaagttt

SEQ ID NO: 9101889 - DNA, 22 bp, Homo sapiens
tcctgcagacctcagtcaggtc

SEQ ID NO: 9101890 - DNA, 22 bp, Homo sapiens
tcctgcagagacagaggcctca

SEQ ID NO: 9101891 - DNA, 22 bp, Homo sapiens
tcctgcagagacagaggcctca

SEQ ID NO: 9101892 - DNA, 19 bp, Homo sapiens
tcctgcagaccagacctgt

SEQ ID NO: 9101893 - DNA, 22 bp, Homo sapiens
tcctgcagacctcagtcaggtc

SEQ ID NO: 9101894 - DNA, 22 bp, Homo sapiens
tcctctggggcgtggtcctgga

SEQ ID NO: 9101895 - DNA, 22 bp, Homo sapiens
tcctctggggcgtggtcctgga

SEQ ID NO: 9101896 - DNA, 22 bp, Homo sapiens
tcctctgggctccctgcaacag

SEQ ID NO: 9101897 - DNA, 22 bp, Homo sapiens
tcctcagtaaggatcgtcagct

SEQ ID NO: 9101898 - DNA, 22 bp, Homo sapiens
tcctcagtaaggcatggctttg

SEQ ID NO: 9101899 - DNA, 22 bp, Homo sapiens
tcctctggtcttcggtgtggac

SEQ ID NO: 9101900 - DNA, 22 bp, Homo sapiens
tcctcttctgcccatcagaggc

SEQ ID NO: 9101901 - DNA, 19 bp, Homo sapiens
tcctgaagatttcctcagc

SEQ ID NO: 9101902 - DNA, 22 bp, Homo sapiens
tcctgaagatgaaaagagaggt

SEQ ID NO: 9101903 - DNA, 22 bp, Homo sapiens
tcctgaagatgaaaagagaggt

SEQ ID NO: 9101904 - DNA, 22 bp, Homo sapiens
tcctgaagaggttgtctttata

SEQ ID NO: 9101905 - DNA, 22 bp, Homo sapiens
tcctgaagaggctacactgctt

SEQ ID NO: 9101906 - DNA, 22 bp, Homo sapiens
tcctgaagaacgaagtcatgta

SEQ ID NO: 9101907 - DNA, 22 bp, Homo sapiens
tcctgaagaacgaagtcatgta

SEQ ID NO: 9101908 - DNA, 22 bp, Homo sapiens
tcctgaagagccctgctctgtg

SEQ ID NO: 9101909 - DNA, 22 bp, Homo sapiens
tcctgaagaaggcagatatttg

SEQ ID NO: 9101910 - DNA, 22 bp, Homo sapiens
tcctgagaatagagttgcatgt

SEQ ID NO: 9101911 - DNA, 22 bp, Homo sapiens
tcctgagacatctctgctggtc

SEQ ID NO: 9101912 - DNA, 22 bp, Homo sapiens
tcctgaagctctcttaaggaaa

SEQ ID NO: 9101913 - DNA, 22 bp, Homo sapiens
tcctgaagcctgagtgatgact

SEQ ID NO: 9101914 - DNA, 22 bp, Homo sapiens
tcctgaagcagttagcatgagc

SEQ ID NO: 9101915 - DNA, 22 bp, Homo sapiens
tcctgaaggcagatggggatca

SEQ ID NO: 9101916 - DNA, 22 bp, Homo sapiens
tcctgaaggcagatggggatca

SEQ ID NO: 9101917 - DNA, 22 bp, Homo sapiens
tcctgaaggagcagttgctggg

SEQ ID NO: 9101918 - DNA, 20 bp, Homo sapiens
tcctgagaggctcttggaga

SEQ ID NO: 9101919 - DNA, 22 bp, Homo sapiens
tcctgagagccttggcttcaga

SEQ ID NO: 9101920 - DNA, 22 bp, Homo sapiens
tcctgagagcagctgctttgga

SEQ ID NO: 9101921 - DNA, 22 bp, Homo sapiens
tcctgagagcagagtccaggtg

SEQ ID NO: 9101922 - DNA, 20 bp, Homo sapiens
tcctgagacctgggaaggtt

SEQ ID NO: 9101923 - DNA, 20 bp, Homo sapiens
tcctgagatttaaggggttc

SEQ ID NO: 9101924 - DNA, 22 bp, Homo sapiens
tcctgagatgtggagctccatg

SEQ ID NO: 9101925 - DNA, 22 bp, Homo sapiens
tcctgagattctgcatttctaa

SEQ ID NO: 9101926 - DNA, 22 bp, Homo sapiens
tcctgagcacagagacaaggaa

SEQ ID NO: 9101927 - DNA, 22 bp, Homo sapiens
tcctgagcacctatgccatggc

SEQ ID NO: 9101928 - DNA, 22 bp, Homo sapiens
tcctgagccctggggtcagtgt

SEQ ID NO: 9101929 - DNA, 22 bp, Homo sapiens
tcctgagcacctatgccatggc

SEQ ID NO: 9101930 - DNA, 22 bp, Homo sapiens
tcctgagccctgtaggaccctg

SEQ ID NO: 9101931 - DNA, 22 bp, Homo sapiens
tcctgagccctggggtcagtgt

SEQ ID NO: 9101932 - DNA, 22 bp, Homo sapiens
tcctgagccctgtaggaccctg

SEQ ID NO: 9101933 - DNA, 22 bp, Homo sapiens
tcctgagcctgacaatcaccat

SEQ ID NO: 9101934 - DNA, 22 bp, Homo sapiens
tcctgagatgagacagtgctgc

SEQ ID NO: 9101935 - DNA, 22 bp, Homo sapiens
tcctgagatgagacagtgctgc

SEQ ID NO: 9101936 - DNA, 22 bp, Homo sapiens
tcctgagatccttttagggatc

SEQ ID NO: 9101937 - DNA, 22 bp, Homo sapiens
tcctgagatgagacagtgctgc

SEQ ID NO: 9101938 - DNA, 23 bp, Homo sapiens
tcctgagatgagacagtgctgcc

SEQ ID NO: 9101939 - DNA, 22 bp, Homo sapiens
tcctgagataaatctcatgtga

SEQ ID NO: 9101940 - DNA, 22 bp, Homo sapiens
tcctgagagtcaagaatgcagg

SEQ ID NO: 9101941 - DNA, 22 bp, Homo sapiens
tcctgagataggagttgaaggc

SEQ ID NO: 9101942 - DNA, 22 bp, Homo sapiens
tcctgagaggtttataacgcag

SEQ ID NO: 9101943 - DNA, 20 bp, Homo sapiens
tcctgagaggctcttggaga

SEQ ID NO: 9101944 - DNA, 22 bp, Homo sapiens
tcctgagaggggtgggtttccc

SEQ ID NO: 9101945 - DNA, 22 bp, Homo sapiens
tcctgagaggtgtgaggtgcag

SEQ ID NO: 9101946 - DNA, 22 bp, Homo sapiens
tcctgaggctaaagtgcagtgg

SEQ ID NO: 9101947 - DNA, 22 bp, Homo sapiens
tcctgaggcctctgtgatgtga

SEQ ID NO: 9101948 - DNA, 22 bp, Homo sapiens
tcctgaggccctgttagggtct

SEQ ID NO: 9101949 - DNA, 22 bp, Homo sapiens
tcctgaggatggttgaagtgca

SEQ ID NO: 9101950 - DNA, 22 bp, Homo sapiens
tcctgaggagaagagtgctagg

SEQ ID NO: 9101951 - DNA, 22 bp, Homo sapiens
tcctgaggctaaagtgcagtgg

SEQ ID NO: 9101952 - DNA, 22 bp, Homo sapiens
tcctgaggctaaagtgcagtgg

SEQ ID NO: 9101953 - DNA, 22 bp, Homo sapiens
tcctgaggtggattgagcagag

SEQ ID NO: 9101954 - DNA, 22 bp, Homo sapiens
tcctgagtgagagctgggaggt

SEQ ID NO: 9101955 - DNA, 20 bp, Homo sapiens
tcctgagtgcagttggcttg

SEQ ID NO: 9101956 - DNA, 22 bp, Homo sapiens
tcctgaggaccctgtcaggggc

SEQ ID NO: 9101957 - DNA, 20 bp, Homo sapiens
tcctgagcctccaccatgtc

SEQ ID NO: 9101958 - DNA, 22 bp, Homo sapiens
tcctgaggaccctgtcaggggc

SEQ ID NO: 9101959 - DNA, 22 bp, Homo sapiens
tcctgaggactaacaggaagga

SEQ ID NO: 9101960 - DNA, 22 bp, Homo sapiens
tcctgaggactaacaggaagga

SEQ ID NO: 9101961 - DNA, 22 bp, Homo sapiens
tcctgaggaaagttcatgaatg

SEQ ID NO: 9101962 - DNA, 22 bp, Homo sapiens
tcctgagcttcaaaacactttg

SEQ ID NO: 9101963 - DNA, 22 bp, Homo sapiens
tcctgagctgccgcatcagcag

SEQ ID NO: 9101964 - DNA, 22 bp, Homo sapiens
tcctgagctttacagtaaggac

SEQ ID NO: 9101965 - DNA, 22 bp, Homo sapiens
tcctgagctcccatgaacaggc

SEQ ID NO: 9101966 - DNA, 22 bp, Homo sapiens
tcctgagctgacacttggggag

SEQ ID NO: 9101967 - DNA, 22 bp, Homo sapiens
tcctcagacttccctttgtgta

SEQ ID NO: 9101968 - DNA, 22 bp, Homo sapiens
tcctcagacaccctgctggctt

SEQ ID NO: 9101969 - DNA, 22 bp, Homo sapiens
tcctcagatgctcttggacgcc

SEQ ID NO: 9101970 - DNA, 22 bp, Homo sapiens
tcctcagcatggaatctggact

SEQ ID NO: 9101971 - DNA, 22 bp, Homo sapiens
tcctcagcaggtctgtgtacca

SEQ ID NO: 9101972 - DNA, 22 bp, Homo sapiens
tcctcagcaaacacttcactct

SEQ ID NO: 9101973 - DNA, 23 bp, Homo sapiens
tcctcagcatgttttgtcatgta

SEQ ID NO: 9101974 - DNA, 23 bp, Homo sapiens
tcctcagcatgttttgtcatgta

SEQ ID NO: 9101975 - DNA, 22 bp, Homo sapiens
tcctcagcattagcacagacat

SEQ ID NO: 9101976 - DNA, 21 bp, Homo sapiens
tcctcagggccccagagcact

SEQ ID NO: 9101977 - DNA, 22 bp, Homo sapiens
tcctcacagctggttcattcag

SEQ ID NO: 9101978 - DNA, 22 bp, Homo sapiens
tcctcacactatagatgaggat

SEQ ID NO: 9101979 - DNA, 22 bp, Homo sapiens
tcctcacaagcaagcacaggta

SEQ ID NO: 9101980 - DNA, 22 bp, Homo sapiens
tcctcaaatatttacttactga

SEQ ID NO: 9101981 - DNA, 22 bp, Homo sapiens
tcctcaaagttgtataaatatt

SEQ ID NO: 9101982 - DNA, 22 bp, Homo sapiens
tcctcagaaacccctgtgaggt

SEQ ID NO: 9101983 - DNA, 22 bp, Homo sapiens
tcctcacatggtgagccacaca

SEQ ID NO: 9101984 - DNA, 22 bp, Homo sapiens
tcctcacagggcaggaaggagg

SEQ ID NO: 9101985 - DNA, 22 bp, Homo sapiens
tcctcacagctggttcattcag

SEQ ID NO: 9101986 - DNA, 20 bp, Homo sapiens
tcctcagaagacatttgggg

SEQ ID NO: 9101987 - DNA, 18 bp, Homo sapiens
tccctgggatataattac

SEQ ID NO: 9101988 - DNA, 16 bp, Homo sapiens
tccctgggagtggtgg

SEQ ID NO: 9101989 - DNA, 15 bp, Homo sapiens
tccctgggagatggt

SEQ ID NO: 9101990 - DNA, 22 bp, Homo sapiens
tccctgggactcagacatggaa

SEQ ID NO: 9101991 - DNA, 22 bp, Homo sapiens
tccctgggagatgatgatgagg

SEQ ID NO: 9101992 - DNA, 22 bp, Homo sapiens
tccctgggactcagacatggaa

SEQ ID NO: 9101993 - DNA, 22 bp, Homo sapiens
tccctgggacggccttttggag

SEQ ID NO: 9101994 - DNA, 22 bp, Homo sapiens
tccctgggaccggcagctcaca

SEQ ID NO: 9101995 - DNA, 22 bp, Homo sapiens
tcctaggcagttggtgctccat

SEQ ID NO: 9101996 - DNA, 22 bp, Homo sapiens
tcctagaatgcacctctgctgt

SEQ ID NO: 9101997 - DNA, 22 bp, Homo sapiens
tcctagagcctccagagggaga

SEQ ID NO: 9101998 - DNA, 22 bp, Homo sapiens
tcctagagatgcaatttgattt

SEQ ID NO: 9101999 - DNA, 22 bp, Homo sapiens
tcctagagaatattttagcttc

SEQ ID NO: 9102000 - DNA, 22 bp, Homo sapiens
tccctggcacaagaaggctgtc

SEQ ID NO: 9102001 - DNA, 22 bp, Homo sapiens
tccctggcagctaagggtggtc

SEQ ID NO: 9102002 - DNA, 22 bp, Homo sapiens
tccctggcacaagaaggctgtc

SEQ ID NO: 9102003 - DNA, 22 bp, Homo sapiens
tccctggaggtgtttgctcagg

SEQ ID NO: 9102004 - DNA, 22 bp, Homo sapiens
tccctgggaacaaaggatgaga

SEQ ID NO: 9102005 - DNA, 22 bp, Homo sapiens
tccctgggaattaatatttgga

SEQ ID NO: 9102006 - DNA, 22 bp, Homo sapiens
tccctgggaccggcagctcaca

SEQ ID NO: 9102007 - DNA, 22 bp, Homo sapiens
tccctgggaaatgtcagtttca

SEQ ID NO: 9102008 - DNA, 22 bp, Homo sapiens
tccctggcagctgtcctttcag

SEQ ID NO: 9102009 - DNA, 22 bp, Homo sapiens
tccctggctgggggctgccttg

SEQ ID NO: 9102010 - DNA, 22 bp, Homo sapiens
tccctctgtgttgggcatgcct

SEQ ID NO: 9102011 - DNA, 22 bp, Homo sapiens
tccctctgtgttgggcatgcct

SEQ ID NO: 9102012 - DNA, 22 bp, Homo sapiens
tccctgaaacatctctgtggat

SEQ ID NO: 9102013 - DNA, 20 bp, Homo sapiens
tccctccctccagctctggg

SEQ ID NO: 9102014 - DNA, 22 bp, Homo sapiens
tccctctggaggctctagggga

SEQ ID NO: 9102015 - DNA, 22 bp, Homo sapiens
tccctctgctagtgcttgagct

SEQ ID NO: 9102016 - DNA, 19 bp, Homo sapiens
tccctccctgtaatctcac

SEQ ID NO: 9102017 - DNA, 22 bp, Homo sapiens
tccctctgggctggagcagggt

SEQ ID NO: 9102018 - DNA, 22 bp, Homo sapiens
tccctctggtcctcggtggaga

SEQ ID NO: 9102019 - DNA, 22 bp, Homo sapiens
tccctcagcttgtctccatgca

SEQ ID NO: 9102020 - DNA, 22 bp, Homo sapiens
tccctcagcttgtctccatgca

SEQ ID NO: 9102021 - DNA, 22 bp, Homo sapiens
tccctcagtccctggacaggca

SEQ ID NO: 9102022 - DNA, 22 bp, Homo sapiens
tccctcagtccctggacaggca

SEQ ID NO: 9102023 - DNA, 22 bp, Homo sapiens
tccctcagtccctggacaggca

SEQ ID NO: 9102024 - DNA, 22 bp, Homo sapiens
tccctcagggtgcagttgcttt

SEQ ID NO: 9102025 - DNA, 20 bp, Homo sapiens
tccctcagtttccagccctg

SEQ ID NO: 9102026 - DNA, 19 bp, Homo sapiens
tccctcagtctgccaggcc

SEQ ID NO: 9102027 - DNA, 19 bp, Homo sapiens
tccctcagtctgccaggcc

SEQ ID NO: 9102028 - DNA, 19 bp, Homo sapiens
tccctcagtctgccaggcc

SEQ ID NO: 9102029 - DNA, 20 bp, Homo sapiens
tccctcagtcctggctttgt

SEQ ID NO: 9102030 - DNA, 22 bp, Homo sapiens
tccctccccacttctgagcttt

SEQ ID NO: 9102031 - DNA, 22 bp, Homo sapiens
tccctccccacttctgagcttt

SEQ ID NO: 9102032 - DNA, 22 bp, Homo sapiens
tcccaggctggggccaggtgac

SEQ ID NO: 9102033 - DNA, 22 bp, Homo sapiens
tcccaggctgggggcctgaagt

SEQ ID NO: 9102034 - DNA, 23 bp, Homo sapiens
tcccagggaaggtgagcgaggct

SEQ ID NO: 9102035 - DNA, 22 bp, Homo sapiens
tcccagggacaccaagctgttt

SEQ ID NO: 9102036 - DNA, 20 bp, Homo sapiens
tcccaggctccaccctagac

SEQ ID NO: 9102037 - DNA, 20 bp, Homo sapiens
tcccaggctccaccctagac

SEQ ID NO: 9102038 - DNA, 22 bp, Homo sapiens
tcccaggctggcaggcagcagt

SEQ ID NO: 9102039 - DNA, 22 bp, Homo sapiens
tcccaggctaggcctctgcgtt

SEQ ID NO: 9102040 - DNA, 22 bp, Homo sapiens
tcccaggctaccagtgaggtca

SEQ ID NO: 9102041 - DNA, 22 bp, Homo sapiens
tcccaggctaggcctctgcgtt

SEQ ID NO: 9102042 - DNA, 22 bp, Homo sapiens
tcccagggactctctgccttcc

SEQ ID NO: 9102043 - DNA, 22 bp, Homo sapiens
tcccagggacaccaagctgttt

SEQ ID NO: 9102044 - DNA, 22 bp, Homo sapiens
tcccagggacccagcctgatac

SEQ ID NO: 9102045 - DNA, 22 bp, Homo sapiens
tcccgcttcttccgaatcgcga

SEQ ID NO: 9102046 - DNA, 22 bp, Homo sapiens
tcccctttgtaagatggaaacg

SEQ ID NO: 9102047 - DNA, 22 bp, Homo sapiens
tccccttggcttggtcaagagg

SEQ ID NO: 9102048 - DNA, 22 bp, Homo sapiens
tcccctttgtaagatggaaacg

SEQ ID NO: 9102049 - DNA, 22 bp, Homo sapiens
tcccctttgtcttcctgtgggt

SEQ ID NO: 9102050 - DNA, 22 bp, Homo sapiens
tccctcagatgagctcctagca

SEQ ID NO: 9102051 - DNA, 20 bp, Homo sapiens
tccctcagcacttctacctc

SEQ ID NO: 9102052 - DNA, 22 bp, Homo sapiens
tccctcagagggcaagcgcaga

SEQ ID NO: 9102053 - DNA, 22 bp, Homo sapiens
tccctcagagaccgtggtgcag

SEQ ID NO: 9102054 - DNA, 21 bp, Homo sapiens
tccctcagacagggtgcctat

SEQ ID NO: 9102055 - DNA, 21 bp, Homo sapiens
tccctcagacagggtgcctat

SEQ ID NO: 9102056 - DNA, 18 bp, Homo sapiens
tccagggcttcctcctct

SEQ ID NO: 9102057 - DNA, 22 bp, Homo sapiens
tccaggtctggcctgctaggca

SEQ ID NO: 9102058 - DNA, 22 bp, Homo sapiens
tccaggtgtgctctgtgccctg

SEQ ID NO: 9102059 - DNA, 19 bp, Homo sapiens
tccatgcccaggcaccaag

SEQ ID NO: 9102060 - DNA, 22 bp, Homo sapiens
tccaggtcttcctattccaggt

SEQ ID NO: 9102061 - DNA, 22 bp, Homo sapiens
tccaggtctggttggacaggtt

SEQ ID NO: 9102062 - DNA, 22 bp, Homo sapiens
tccagggctgttactttacata

SEQ ID NO: 9102063 - DNA, 21 bp, Homo sapiens
tccagggaatttcaactttta

SEQ ID NO: 9102064 - DNA, 22 bp, Homo sapiens
tccagggaaggtgtgaggctgg

SEQ ID NO: 9102065 - DNA, 18 bp, Homo sapiens
tccaggcgttgctttctc

SEQ ID NO: 9102066 - DNA, 22 bp, Homo sapiens
tccaggctaattttgcattgtt

SEQ ID NO: 9102067 - DNA, 22 bp, Homo sapiens
tccaggcctggctccattcagt

SEQ ID NO: 9102068 - DNA, 18 bp, Homo sapiens
tccaggcctgaagtgtcc

SEQ ID NO: 9102069 - DNA, 22 bp, Homo sapiens
tccaggcctctagccctctctt

SEQ ID NO: 9102070 - DNA, 22 bp, Homo sapiens
tccacaaggcagctcctccagg

SEQ ID NO: 9102071 - DNA, 22 bp, Homo sapiens
tccaggctaggtttacaggaca

SEQ ID NO: 9102072 - DNA, 22 bp, Homo sapiens
tccaggctggacatgaggcggg

SEQ ID NO: 9102073 - DNA, 21 bp, Homo sapiens
tccaggctggaaggggcgttg

SEQ ID NO: 9102074 - DNA, 22 bp, Homo sapiens
tccaggctggacatgaggcggg

SEQ ID NO: 9102075 - DNA, 22 bp, Homo sapiens
tccattatacttctgattcaaa

SEQ ID NO: 9102076 - DNA, 19 bp, Homo sapiens
tccatggctcttcatcctt

SEQ ID NO: 9102077 - DNA, 22 bp, Homo sapiens
tcccaagagctctgggataagg

SEQ ID NO: 9102078 - DNA, 22 bp, Homo sapiens
tcccagagacagagcctcctcc

SEQ ID NO: 9102079 - DNA, 22 bp, Homo sapiens
tcccagagaagagctggatgga

SEQ ID NO: 9102080 - DNA, 22 bp, Homo sapiens
tcccaaagtattagcatttcaa

SEQ ID NO: 9102081 - DNA, 22 bp, Homo sapiens
tcccaaatataatgcaagagac

SEQ ID NO: 9102082 - DNA, 22 bp, Homo sapiens
tcccagagatttcctctccttc

SEQ ID NO: 9102083 - DNA, 22 bp, Homo sapiens
tcccagagatttcctctccttc

SEQ ID NO: 9102084 - DNA, 22 bp, Homo sapiens
tcccagagacatcatttctccg

SEQ ID NO: 9102085 - DNA, 22 bp, Homo sapiens
tcccagagacatcatttctccg

SEQ ID NO: 9102086 - DNA, 22 bp, Homo sapiens
tcccagagacagagcctcctcc

SEQ ID NO: 9102087 - DNA, 22 bp, Homo sapiens
tcccagagccaagctatggatg

SEQ ID NO: 9102088 - DNA, 22 bp, Homo sapiens
tcccagagccaagctatggatg

SEQ ID NO: 9102089 - DNA, 22 bp, Homo sapiens
tcccagagccaagctatggatg

SEQ ID NO: 9102090 - DNA, 22 bp, Homo sapiens
tcccagagcagatgtgctaaag

SEQ ID NO: 9102091 - DNA, 22 bp, Homo sapiens
tcccagagcagatgtgctaaag

SEQ ID NO: 9102092 - DNA, 22 bp, Homo sapiens
tcccagagcagtactccaggag

SEQ ID NO: 9102093 - DNA, 22 bp, Homo sapiens
tcccagagcagtactccaggag

SEQ ID NO: 9102094 - DNA, 22 bp, Homo sapiens
tcccagagcagtactccaggag

SEQ ID NO: 9102095 - DNA, 22 bp, Homo sapiens
tcccagccttatctcccctggc

SEQ ID NO: 9102096 - DNA, 22 bp, Homo sapiens
tcccagccttatctcccctggc

SEQ ID NO: 9102097 - DNA, 22 bp, Homo sapiens
tcccagccttatctcccctggc

SEQ ID NO: 9102098 - DNA, 22 bp, Homo sapiens
tcccagccttccagtctggttt

SEQ ID NO: 9102099 - DNA, 22 bp, Homo sapiens
tcccagccttccagtctggttt

SEQ ID NO: 9102100 - DNA, 22 bp, Homo sapiens
tcccagcctgacagtgcatcaa

SEQ ID NO: 9102101 - DNA, 22 bp, Homo sapiens
tcccagcctgacagtgcatcaa

SEQ ID NO: 9102102 - DNA, 22 bp, Homo sapiens
tcccagcctggaccctgccagt

SEQ ID NO: 9102103 - DNA, 22 bp, Homo sapiens
tcccagcctggaccctgccagt

SEQ ID NO: 9102104 - DNA, 22 bp, Homo sapiens
tcccagcctggaccctgccagt

SEQ ID NO: 9102105 - DNA, 22 bp, Homo sapiens
tcccagcctggaccctgccagt

SEQ ID NO: 9102106 - DNA, 22 bp, Homo sapiens
tcccagcctggaccctgccagt

SEQ ID NO: 9102107 - DNA, 22 bp, Homo sapiens
tcccaggcaggtgacaggggga

SEQ ID NO: 9102108 - DNA, 22 bp, Homo sapiens
tcccagcctttctttctccagc

SEQ ID NO: 9102109 - DNA, 22 bp, Homo sapiens
tcccagcctttctttctccagc

SEQ ID NO: 9102110 - DNA, 22 bp, Homo sapiens
tcccagccttccttgtggtgaa

SEQ ID NO: 9102111 - DNA, 22 bp, Homo sapiens
tcccagccttccttgtggtgaa

SEQ ID NO: 9102112 - DNA, 22 bp, Homo sapiens
tcccagccttccttgtggtgaa

SEQ ID NO: 9102113 - DNA, 22 bp, Homo sapiens
tcccagaggcagttggtaactt

SEQ ID NO: 9102114 - DNA, 22 bp, Homo sapiens
tcccagaggctccagtctctat

SEQ ID NO: 9102115 - DNA, 22 bp, Homo sapiens
tcccagaggctccagtctctat

SEQ ID NO: 9102116 - DNA, 22 bp, Homo sapiens
tcccagagtattagcaattgct

SEQ ID NO: 9102117 - DNA, 22 bp, Homo sapiens
tcccagagtattagcaattgct

SEQ ID NO: 9102118 - DNA, 22 bp, Homo sapiens
tcccagaggtctctgctggttc

SEQ ID NO: 9102119 - DNA, 22 bp, Homo sapiens
tcccagaggttgagtcacttat

SEQ ID NO: 9102120 - DNA, 22 bp, Homo sapiens
tcccagaggttgagtcacttat

SEQ ID NO: 9102121 - DNA, 23 bp, Homo sapiens
tcccagcctcttctcttgcatac

SEQ ID NO: 9102122 - DNA, 23 bp, Homo sapiens
tcccagcctcttctcttgcatac

SEQ ID NO: 9102123 - DNA, 23 bp, Homo sapiens
tcccagcctcttctcttgcatac

SEQ ID NO: 9102124 - DNA, 23 bp, Homo sapiens
tcccagcctcttctcttgcatac

SEQ ID NO: 9102125 - DNA, 22 bp, Homo sapiens
tcccagcctcctgacagttttg

SEQ ID NO: 9102126 - DNA, 22 bp, Homo sapiens
tcccagcctcctgacagttttg

SEQ ID NO: 9102127 - DNA, 22 bp, Homo sapiens
tcccagccggtgcctgggtccc

SEQ ID NO: 9102128 - DNA, 22 bp, Homo sapiens
tcccagccggtgcctgggtccc

SEQ ID NO: 9102129 - DNA, 22 bp, Homo sapiens
tcccagccggtgcctgggtccc

SEQ ID NO: 9102130 - DNA, 22 bp, Homo sapiens
tcccagcccaggtatgatgata

SEQ ID NO: 9102131 - DNA, 22 bp, Homo sapiens
tcccagcccaggtatgatgata

SEQ ID NO: 9102132 - DNA, 22 bp, Homo sapiens
tcccagcattaatgcctgtcag

SEQ ID NO: 9102133 - DNA, 22 bp, Homo sapiens
tcccagcattaatgcctgtcag

SEQ ID NO: 9102134 - DNA, 22 bp, Homo sapiens
tcccagcataacaaactgcccg

SEQ ID NO: 9102135 - DNA, 22 bp, Homo sapiens
tcatttttcacacagggtcacc

SEQ ID NO: 9102136 - DNA, 22 bp, Homo sapiens
tcatttttctcttacacgtaga

SEQ ID NO: 9102137 - DNA, 22 bp, Homo sapiens
tcatttttgtctccggtttgtg

SEQ ID NO: 9102138 - DNA, 22 bp, Homo sapiens
tcatttttgaccatgggtagga

SEQ ID NO: 9102139 - DNA, 22 bp, Homo sapiens
tcattttttgcatacctgtgtc

SEQ ID NO: 9102140 - DNA, 22 bp, Homo sapiens
tcatttttttccggtaggaata

SEQ ID NO: 9102141 - DNA, 18 bp, Homo sapiens
tccaaaatcatgtatttt

SEQ ID NO: 9102142 - DNA, 22 bp, Homo sapiens
tccaaaacagaactctgtgaat

SEQ ID NO: 9102143 - DNA, 22 bp, Homo sapiens
tcatttgttcatctgctcttct

SEQ ID NO: 9102144 - DNA, 22 bp, Homo sapiens
tcatttgttctcattctctact

SEQ ID NO: 9102145 - DNA, 21 bp, Homo sapiens
tcatttttattgctaccttgc

SEQ ID NO: 9102146 - DNA, 21 bp, Homo sapiens
tcatttttattgctaccttgc

SEQ ID NO: 9102147 - DNA, 21 bp, Homo sapiens
tcatttttattgctaccttgc

SEQ ID NO: 9102148 - DNA, 22 bp, Homo sapiens
tcatttgtaccattttttaaga

SEQ ID NO: 9102149 - DNA, 21 bp, Homo sapiens
tcatttgtgatctgatttcca

SEQ ID NO: 9102150 - DNA, 22 bp, Homo sapiens
tcatttgtgtgagtgatttgac

SEQ ID NO: 9102151 - DNA, 22 bp, Homo sapiens
tcatttgtggaagtgattgtgg

SEQ ID NO: 9102152 - DNA, 22 bp, Homo sapiens
tccaaacaccctccatgctgca

SEQ ID NO: 9102153 - DNA, 18 bp, Homo sapiens
tccaaaatcatgtatttt

SEQ ID NO: 9102154 - DNA, 22 bp, Homo sapiens
tccaaagaacattgctgagacc

SEQ ID NO: 9102155 - DNA, 22 bp, Homo sapiens
tccaaagaacattgctgagacc

SEQ ID NO: 9102156 - DNA, 22 bp, Homo sapiens
tccaaagaacctggctactgtc

SEQ ID NO: 9102157 - DNA, 22 bp, Homo sapiens
tccaaagccgactgacatctga

SEQ ID NO: 9102158 - DNA, 18 bp, Homo sapiens
tccaaagccagagaagtt

SEQ ID NO: 9102159 - DNA, 18 bp, Homo sapiens
tccaaagccagagaagtt

SEQ ID NO: 9102160 - DNA, 22 bp, Homo sapiens
tccaaagcatctgagtgtgcat

SEQ ID NO: 9102161 - DNA, 22 bp, Homo sapiens
tccaaagacttgctgtatgtaa

SEQ ID NO: 9102162 - DNA, 19 bp, Homo sapiens
tccaaagaagttcacattt

SEQ ID NO: 9102163 - DNA, 18 bp, Homo sapiens
tccaaagctgctggtttt

SEQ ID NO: 9102164 - DNA, 22 bp, Homo sapiens
tccaaaggaagaggctgtcagt

SEQ ID NO: 9102165 - DNA, 22 bp, Homo sapiens
tccaaaggccctaataagcttg

SEQ ID NO: 9102166 - DNA, 22 bp, Homo sapiens
tccaaaggggcagtgtccagcc

SEQ ID NO: 9102167 - DNA, 22 bp, Homo sapiens
tccaaatattatgattatagga

SEQ ID NO: 9102168 - DNA, 22 bp, Homo sapiens
tccaacatgcagtcaggcctag

SEQ ID NO: 9102169 - DNA, 22 bp, Homo sapiens
tccaacatttatcaaggttgtt

SEQ ID NO: 9102170 - DNA, 22 bp, Homo sapiens
tccaaccaaaaatgacaatgtg

SEQ ID NO: 9102171 - DNA, 22 bp, Homo sapiens
tccaacatttatcaaggttgtt

SEQ ID NO: 9102172 - DNA, 22 bp, Homo sapiens
tccaactttctcctccggcttg

SEQ ID NO: 9102173 - DNA, 22 bp, Homo sapiens
tccaaggacgctggacccctgc

SEQ ID NO: 9102174 - DNA, 19 bp, Homo sapiens
tccaatttctattcatgtt

SEQ ID NO: 9102175 - DNA, 22 bp, Homo sapiens
tccaatttgaaatggtatatgt

SEQ ID NO: 9102176 - DNA, 22 bp, Homo sapiens
tccaatttgtttgatgatggaa

SEQ ID NO: 9102177 - DNA, 22 bp, Homo sapiens
tccaattttacgtctgtataaa

SEQ ID NO: 9102178 - DNA, 20 bp, Homo sapiens
tccaatttaagaatttagag

SEQ ID NO: 9102179 - DNA, 20 bp, Homo sapiens
tccaattaaaaattgtatgc

SEQ ID NO: 9102180 - DNA, 22 bp, Homo sapiens
tccaatgttcctgctttcagct

SEQ ID NO: 9102181 - DNA, 22 bp, Homo sapiens
tccaatcagctcctatgagaat

SEQ ID NO: 9102182 - DNA, 22 bp, Homo sapiens
tccaatcaattgttctacctga

SEQ ID NO: 9102183 - DNA, 22 bp, Homo sapiens
tccaatcatgagtctatactag

SEQ ID NO: 9102184 - DNA, 22 bp, Homo sapiens
tccaataaaactcttgaattaa

SEQ ID NO: 9102185 - DNA, 22 bp, Homo sapiens
tccaagttgatgtttcttaaat

SEQ ID NO: 9102186 - DNA, 22 bp, Homo sapiens
tccaaggccgcaggctgggcct

SEQ ID NO: 9102187 - DNA, 22 bp, Homo sapiens
tccaagtataaattagatactg

SEQ ID NO: 9102188 - DNA, 22 bp, Homo sapiens
tccaagtcttccttcccaaacc

SEQ ID NO: 9102189 - DNA, 22 bp, Homo sapiens
tcattgccatggcatttgcaga

SEQ ID NO: 9102190 - DNA, 22 bp, Homo sapiens
tcatgcagtttgaagttcaggg

SEQ ID NO: 9102191 - DNA, 22 bp, Homo sapiens
tcatgcagttttgccacctaag

SEQ ID NO: 9102192 - DNA, 22 bp, Homo sapiens
tcatgcagtttcttatctgcca

SEQ ID NO: 9102193 - DNA, 22 bp, Homo sapiens
tcatgcagttactgttatgcaa

SEQ ID NO: 9102194 - DNA, 19 bp, Homo sapiens
tcatgcagtggggggtgtg

SEQ ID NO: 9102195 - DNA, 22 bp, Homo sapiens
tcatgcagtgaatctttcttgc

SEQ ID NO: 9102196 - DNA, 22 bp, Homo sapiens
tcatgcagcaatatgcattagg

SEQ ID NO: 9102197 - DNA, 22 bp, Homo sapiens
tcatgcagcttttccattcagc

SEQ ID NO: 9102198 - DNA, 23 bp, Homo sapiens
tcatgcagcctggaacctcccag

SEQ ID NO: 9102199 - DNA, 22 bp, Homo sapiens
tcatgcaggacttacaagagat

SEQ ID NO: 9102200 - DNA, 22 bp, Homo sapiens
tcatgcaggaccaccccagcat

SEQ ID NO: 9102201 - DNA, 22 bp, Homo sapiens
tcatgcaggacttacgagagat

SEQ ID NO: 9102202 - DNA, 21 bp, Homo sapiens
tcatgcaggcagagtttggta

SEQ ID NO: 9102203 - DNA, 22 bp, Homo sapiens
tcatgcaggtttccagccagat

SEQ ID NO: 9102204 - DNA, 22 bp, Homo sapiens
tcatgcaggcagcctttagtaa

SEQ ID NO: 9102205 - DNA, 20 bp, Homo sapiens
tcatgcaggtgttctaggtt

SEQ ID NO: 9102206 - DNA, 22 bp, Homo sapiens
tcattgttaattgtatgatctg

SEQ ID NO: 9102207 - DNA, 22 bp, Homo sapiens
tcattgtcgctctgcggtgttc

SEQ ID NO: 9102208 - DNA, 22 bp, Homo sapiens
tcattggtaattatttttgaca

SEQ ID NO: 9102209 - DNA, 22 bp, Homo sapiens
tcattgtaattatctgtggtat

SEQ ID NO: 9102210 - DNA, 21 bp, Homo sapiens
tcattggtcattaagctctgt

SEQ ID NO: 9102211 - DNA, 22 bp, Homo sapiens
tcattgccatggcatttgcaga

SEQ ID NO: 9102212 - DNA, 22 bp, Homo sapiens
tcatttacacttcacaaatgga

SEQ ID NO: 9102213 - DNA, 22 bp, Homo sapiens
tcattgttgcgttaatgtcttc

SEQ ID NO: 9102214 - DNA, 22 bp, Homo sapiens
tcattgtttctgcttttcatga

SEQ ID NO: 9102215 - DNA, 22 bp, Homo sapiens
tcatttataaggatgcaattaa

SEQ ID NO: 9102216 - DNA, 22 bp, Homo sapiens
tcatttactggatccataagca

SEQ ID NO: 9102217 - DNA, 22 bp, Homo sapiens
tcatttactgtaggcaaaaatt

SEQ ID NO: 9102218 - DNA, 22 bp, Homo sapiens
tcatttacttctatgacaacat

SEQ ID NO: 9102219 - DNA, 22 bp, Homo sapiens
tcatttacatagaaacaatata

SEQ ID NO: 9102220 - DNA, 22 bp, Homo sapiens
tcatttacgcgcctccttcctt

SEQ ID NO: 9102221 - DNA, 22 bp, Homo sapiens
tcatttcagccatttttaaatg

SEQ ID NO: 9102222 - DNA, 23 bp, Homo sapiens
tcatttcatccagccttgagagt

SEQ ID NO: 9102223 - DNA, 22 bp, Homo sapiens
tcatttccctcctacaaagagg

SEQ ID NO: 9102224 - DNA, 17 bp, Homo sapiens
tcatttcagtaaatcca

SEQ ID NO: 9102225 - DNA, 22 bp, Homo sapiens
tcatttctgagccttccatgat

SEQ ID NO: 9102226 - DNA, 22 bp, Homo sapiens
tcatttcttaactagagtgaac

SEQ ID NO: 9102227 - DNA, 22 bp, Homo sapiens
tcatttggagccttcctgtttt

SEQ ID NO: 9102228 - DNA, 22 bp, Homo sapiens
tcatttggccttctttgcattg

SEQ ID NO: 9102229 - DNA, 21 bp, Homo sapiens
tcatttctctatgtatttcac

SEQ ID NO: 9102230 - DNA, 22 bp, Homo sapiens
tcagtaaatgaatgaatatatg

SEQ ID NO: 9102231 - DNA, 22 bp, Homo sapiens
tcagtaaataactcagatgctc

SEQ ID NO: 9102232 - DNA, 22 bp, Homo sapiens
tcagtaaataactcagatgctc

SEQ ID NO: 9102233 - DNA, 21 bp, Homo sapiens
tcagtaaacctaaagattgta

SEQ ID NO: 9102234 - DNA, 22 bp, Homo sapiens
tcagtacttctgcatcttccag

SEQ ID NO: 9102235 - DNA, 22 bp, Homo sapiens
tcagtacttcagtagatggagc

SEQ ID NO: 9102236 - DNA, 22 bp, Homo sapiens
tcagtacttcccattctgagct

SEQ ID NO: 9102237 - DNA, 18 bp, Homo sapiens
tcagtactgcagagagaa

SEQ ID NO: 9102238 - DNA, 23 bp, Homo sapiens
tcagtactctgctgggtatagag

SEQ ID NO: 9102239 - DNA, 22 bp, Homo sapiens
tcagtacttgcatcctctcctt

SEQ ID NO: 9102240 - DNA, 22 bp, Homo sapiens
tcagggctcaccagcctctgcc

SEQ ID NO: 9102241 - DNA, 22 bp, Homo sapiens
tcagggcctttgcagttgtttt

SEQ ID NO: 9102242 - DNA, 22 bp, Homo sapiens
tcagggctgcagaagaggcagg

SEQ ID NO: 9102243 - DNA, 22 bp, Homo sapiens
tcaggctgtaaatggtgtgggt

SEQ ID NO: 9102244 - DNA, 22 bp, Homo sapiens
tcaggctggtccccacagtgga

SEQ ID NO: 9102245 - DNA, 20 bp, Homo sapiens
tcaggctggtgggctttccc

SEQ ID NO: 9102246 - DNA, 22 bp, Homo sapiens
tcaggctggtccccacagtgga

SEQ ID NO: 9102247 - DNA, 22 bp, Homo sapiens
tcaggctggtggtcagatggct

SEQ ID NO: 9102248 - DNA, 22 bp, Homo sapiens
tcaggctggtggtcagatggct

SEQ ID NO: 9102249 - DNA, 17 bp, Homo sapiens
tcaggctgggtgcagtg

SEQ ID NO: 9102250 - DNA, 17 bp, Homo sapiens
tcaggctgggtgcagtg

SEQ ID NO: 9102251 - DNA, 17 bp, Homo sapiens
tcaggctgggtgcagtg

SEQ ID NO: 9102252 - DNA, 17 bp, Homo sapiens
tcaggctgggtgcagtg

SEQ ID NO: 9102253 - DNA, 21 bp, Homo sapiens
tcaggagagcccatctacaaa

SEQ ID NO: 9102254 - DNA, 22 bp, Homo sapiens
tcaggagacttatgtcacagtg

SEQ ID NO: 9102255 - DNA, 22 bp, Homo sapiens
tcagggcaggacagtgtaggcc

SEQ ID NO: 9102256 - DNA, 19 bp, Homo sapiens
tcagggcagtccggtcccc

SEQ ID NO: 9102257 - DNA, 22 bp, Homo sapiens
tcagggcaggcgagcagctgct

SEQ ID NO: 9102258 - DNA, 22 bp, Homo sapiens
tcaggctgtagggcccctggag

SEQ ID NO: 9102259 - DNA, 22 bp, Homo sapiens
tcaggctgtatatcttgcactc

SEQ ID NO: 9102260 - DNA, 22 bp, Homo sapiens
tcaggctgttcctgtccaaaat

SEQ ID NO: 9102261 - DNA, 22 bp, Homo sapiens
tcatacatctgtcctggagctc

SEQ ID NO: 9102262 - DNA, 22 bp, Homo sapiens
tcataaattgattatgtgcttt

SEQ ID NO: 9102263 - DNA, 22 bp, Homo sapiens
tcataaattgattatgtgcttt

SEQ ID NO: 9102264 - DNA, 22 bp, Homo sapiens
tcataaattagctgtctttgaa

SEQ ID NO: 9102265 - DNA, 22 bp, Homo sapiens
tcataaatgcagtgtcataaat

SEQ ID NO: 9102266 - DNA, 22 bp, Homo sapiens
tcatagaagtagtatccacatt

SEQ ID NO: 9102267 - DNA, 22 bp, Homo sapiens
tcatagaaggaactgggagata

SEQ ID NO: 9102268 - DNA, 18 bp, Homo sapiens
tcatagaagtgaatcaga

SEQ ID NO: 9102269 - DNA, 22 bp, Homo sapiens
tcatctcttttgtattggggtt

SEQ ID NO: 9102270 - DNA, 23 bp, Homo sapiens
tcatctgtaacagcctatgaaat

SEQ ID NO: 9102271 - DNA, 23 bp, Homo sapiens
tcatctgtaagtatctgtggagt

SEQ ID NO: 9102272 - DNA, 22 bp, Homo sapiens
tcatctgaggcaccagagcata

SEQ ID NO: 9102273 - DNA, 22 bp, Homo sapiens
tcatctgaggcaccagagcata

SEQ ID NO: 9102274 - DNA, 22 bp, Homo sapiens
tcatctgttatttatgcctgag

SEQ ID NO: 9102275 - DNA, 22 bp, Homo sapiens
tcatctgtgaataatgaactgg

SEQ ID NO: 9102276 - DNA, 22 bp, Homo sapiens
tcatctgttatgggagtttttg

SEQ ID NO: 9102277 - DNA, 22 bp, Homo sapiens
tcatctgtggctgcttttgtgc

SEQ ID NO: 9102278 - DNA, 22 bp, Homo sapiens
tcatcttctattaatagggaga

SEQ ID NO: 9102279 - DNA, 22 bp, Homo sapiens
tcatgaaaatagatcagaaatt

SEQ ID NO: 9102280 - DNA, 23 bp, Homo sapiens
tcatgcagagaaggactgcttac

SEQ ID NO: 9102281 - DNA, 22 bp, Homo sapiens
tcatgcagagccagtcaggata

SEQ ID NO: 9102282 - DNA, 22 bp, Homo sapiens
tcatgcagatttggaggtattt

SEQ ID NO: 9102283 - DNA, 22 bp, Homo sapiens
tcatgcagataagaataagtaa

SEQ ID NO: 9102284 - DNA, 22 bp, Homo sapiens
tcatgcagagtagaaagggcaa

SEQ ID NO: 9102285 - DNA, 22 bp, Homo sapiens
tcatgcagaggaaggctagttt

SEQ ID NO: 9102286 - DNA, 22 bp, Homo sapiens
tcatgcagagtagaaagggcaa

SEQ ID NO: 9102287 - DNA, 22 bp, Homo sapiens
tcatgcagaggaaggctagttt

SEQ ID NO: 9102288 - DNA, 22 bp, Homo sapiens
tcatctttaccccttgcttcaa

SEQ ID NO: 9102289 - DNA, 22 bp, Homo sapiens
tcatctttgtatccctaacaca

SEQ ID NO: 9102290 - DNA, 22 bp, Homo sapiens
tcagtcctctctgggtttctta

SEQ ID NO: 9102291 - DNA, 22 bp, Homo sapiens
tcagtcctctctgggtttctta

SEQ ID NO: 9102292 - DNA, 22 bp, Homo sapiens
tcagtcctgatgacaggcccaa

SEQ ID NO: 9102293 - DNA, 23 bp, Homo sapiens
tcagtcctgtaggggctccaggt

SEQ ID NO: 9102294 - DNA, 21 bp, Homo sapiens
tcagtcctgttagcctttggg

SEQ ID NO: 9102295 - DNA, 18 bp, Homo sapiens
tcagtctattgtataaga

SEQ ID NO: 9102296 - DNA, 22 bp, Homo sapiens
tcagtctatccagctcagatcc

SEQ ID NO: 9102297 - DNA, 18 bp, Homo sapiens
tcagtctattgtataaga

SEQ ID NO: 9102298 - DNA, 19 bp, Homo sapiens
tcagtctaggaatgagcta

SEQ ID NO: 9102299 - DNA, 22 bp, Homo sapiens
tcagtcctcacttggttctaag

SEQ ID NO: 9102300 - DNA, 22 bp, Homo sapiens
tcagtattcctggaaatacaag

SEQ ID NO: 9102301 - DNA, 18 bp, Homo sapiens
tcagtcctccatagagct

SEQ ID NO: 9102302 - DNA, 22 bp, Homo sapiens
tcagtcctcctctcatagagag

SEQ ID NO: 9102303 - DNA, 22 bp, Homo sapiens
tcagtcctcacttggttctaag

SEQ ID NO: 9102304 - DNA, 22 bp, Homo sapiens
tcagtcctccacacaggcaccc

SEQ ID NO: 9102305 - DNA, 22 bp, Homo sapiens
tcagtctcatcaactctattcc

SEQ ID NO: 9102306 - DNA, 22 bp, Homo sapiens
tcagtgttggcattcagaaatg

SEQ ID NO: 9102307 - DNA, 22 bp, Homo sapiens
tcagtgttcttatttaattagg

SEQ ID NO: 9102308 - DNA, 22 bp, Homo sapiens
tcagtgttctggatttggggca

SEQ ID NO: 9102309 - DNA, 22 bp, Homo sapiens
tcataaagttatcaccaaatcc

SEQ ID NO: 9102310 - DNA, 22 bp, Homo sapiens
tcataaagtgaaggatgatggg

SEQ ID NO: 9102311 - DNA, 23 bp, Homo sapiens
tcataaatattagcacagtagga

SEQ ID NO: 9102312 - DNA, 23 bp, Homo sapiens
tcataaatattagcacagtagga

SEQ ID NO: 9102313 - DNA, 22 bp, Homo sapiens
tcagtgttttccagggtctact

SEQ ID NO: 9102314 - DNA, 22 bp, Homo sapiens
tcagtgtttttaaagcaatata

SEQ ID NO: 9102315 - DNA, 22 bp, Homo sapiens
tcagtgtttcctgtggtacagc

SEQ ID NO: 9102316 - DNA, 22 bp, Homo sapiens
tcagtgtttgtggcaaatgtta

SEQ ID NO: 9102317 - DNA, 22 bp, Homo sapiens
tcagctctgcactccactgtgg

SEQ ID NO: 9102318 - DNA, 20 bp, Homo sapiens
tcagccagctaacatgggga

SEQ ID NO: 9102319 - DNA, 22 bp, Homo sapiens
tcagccagccagctacaggctt

SEQ ID NO: 9102320 - DNA, 22 bp, Homo sapiens
tcagctgccccgggcactgccc

SEQ ID NO: 9102321 - DNA, 22 bp, Homo sapiens
tcagctgccccgggcactgccc

SEQ ID NO: 9102322 - DNA, 22 bp, Homo sapiens
tcagctgcctttcccatgctag

SEQ ID NO: 9102323 - DNA, 22 bp, Homo sapiens
tcagctgcctttcccatgctag

SEQ ID NO: 9102324 - DNA, 22 bp, Homo sapiens
tcagctgcctctccctggaaga

SEQ ID NO: 9102325 - DNA, 22 bp, Homo sapiens
tcagctgctctgttgagctgaa

SEQ ID NO: 9102326 - DNA, 23 bp, Homo sapiens
tcagctgcttcctcctgcctgcc

SEQ ID NO: 9102327 - DNA, 22 bp, Homo sapiens
tcagctgctctgttgagctgaa

SEQ ID NO: 9102328 - DNA, 22 bp, Homo sapiens
tcagcatttcagaagtggcata

SEQ ID NO: 9102329 - DNA, 22 bp, Homo sapiens
tcagcattgtggcagagaatgg

SEQ ID NO: 9102330 - DNA, 22 bp, Homo sapiens
tcagccagaggtggatgagtca

SEQ ID NO: 9102331 - DNA, 22 bp, Homo sapiens
tcagccagcattacccctgact

SEQ ID NO: 9102332 - DNA, 22 bp, Homo sapiens
tcagcagttcaaccccgtcaga

SEQ ID NO: 9102333 - DNA, 22 bp, Homo sapiens
tcagcagttgccccctcccagc

SEQ ID NO: 9102334 - DNA, 22 bp, Homo sapiens
tcagcagttattcccctacaga

SEQ ID NO: 9102335 - DNA, 22 bp, Homo sapiens
tcagcagtgtcagttcccagag

SEQ ID NO: 9102336 - DNA, 22 bp, Homo sapiens
tcagcagtgtgcccagaggctg

SEQ ID NO: 9102337 - DNA, 22 bp, Homo sapiens
tcagcagtgtgcttggaatgga

SEQ ID NO: 9102338 - DNA, 19 bp, Homo sapiens
tcagcatcaatttggtcct

SEQ ID NO: 9102339 - DNA, 22 bp, Homo sapiens
tcagcattcctgaagacaagca

SEQ ID NO: 9102340 - DNA, 22 bp, Homo sapiens
tcagcatcaggttgtctgaatt

SEQ ID NO: 9102341 - DNA, 22 bp, Homo sapiens
tcaggacaccctgtgcttcctt

SEQ ID NO: 9102342 - DNA, 22 bp, Homo sapiens
tcaggacacttggcacaaggtc

SEQ ID NO: 9102343 - DNA, 22 bp, Homo sapiens
tcaggacagaaggctgccaggg

SEQ ID NO: 9102344 - DNA, 22 bp, Homo sapiens
tcaggacagaaggctgccaggg

SEQ ID NO: 9102345 - DNA, 22 bp, Homo sapiens
tcaggacagactagactagcgt

SEQ ID NO: 9102346 - DNA, 22 bp, Homo sapiens
tcaggacagggatcacatcatc

SEQ ID NO: 9102347 - DNA, 22 bp, Homo sapiens
tcaggacagttccctgcaaatt

SEQ ID NO: 9102348 - DNA, 18 bp, Homo sapiens
tcaggagacacagacgca

SEQ ID NO: 9102349 - DNA, 22 bp, Homo sapiens
tcaggagactggcagtgcccac

SEQ ID NO: 9102350 - DNA, 18 bp, Homo sapiens
tcaggagacacagacgca

SEQ ID NO: 9102351 - DNA, 22 bp, Homo sapiens
tcaggacatttgtcagcaggag

SEQ ID NO: 9102352 - DNA, 22 bp, Homo sapiens
tcagctggtgtttcttctcctt

SEQ ID NO: 9102353 - DNA, 22 bp, Homo sapiens
tcaggaagggctcagtctgtgc

SEQ ID NO: 9102354 - DNA, 22 bp, Homo sapiens
tcaggaagggtggtccacaggg

SEQ ID NO: 9102355 - DNA, 22 bp, Homo sapiens
tcaggaagggtggtccacaggg

SEQ ID NO: 9102356 - DNA, 22 bp, Homo sapiens
tcagctggtgccactcagtcaa

SEQ ID NO: 9102357 - DNA, 22 bp, Homo sapiens
tcagctggtgagtggatagaca

SEQ ID NO: 9102358 - DNA, 22 bp, Homo sapiens
tcagctggtgagtggatagaca

SEQ ID NO: 9102359 - DNA, 22 bp, Homo sapiens
tcagctggtgccactcagtcaa

SEQ ID NO: 9102360 - DNA, 19 bp, Homo sapiens
tcagctggcaggcctcctc

SEQ ID NO: 9102361 - DNA, 22 bp, Homo sapiens
tcagctggatgtggaagtgcta

SEQ ID NO: 9102362 - DNA, 22 bp, Homo sapiens
tcagctggatgtggaagtgcta

SEQ ID NO: 9102363 - DNA, 22 bp, Homo sapiens
tcagctggagatgagaaccgaa

SEQ ID NO: 9102364 - DNA, 22 bp, Homo sapiens
tcagctggagatccttgttgtg

SEQ ID NO: 9102365 - DNA, 22 bp, Homo sapiens
tcagctggaagatggtgcagaa

SEQ ID NO: 9102366 - DNA, 22 bp, Homo sapiens
tcagctggaagatggtgcagaa

SEQ ID NO: 9102367 - DNA, 22 bp, Homo sapiens
tcagctggcagttcagaggctg

SEQ ID NO: 9102368 - DNA, 19 bp, Homo sapiens
tcagctggcaggcctcctc

SEQ ID NO: 9102369 - DNA, 22 bp, Homo sapiens
tcagctggcaggttctgggaag

SEQ ID NO: 9102370 - DNA, 18 bp, Homo sapiens
tcagctggggctgcagcc

SEQ ID NO: 9102371 - DNA, 22 bp, Homo sapiens
tcagctggggccccctctgtcc

SEQ ID NO: 9102372 - DNA, 18 bp, Homo sapiens
tcagacaagttagacagg

SEQ ID NO: 9102373 - DNA, 22 bp, Homo sapiens
tcagagtgtggtgagatgtgca

SEQ ID NO: 9102374 - DNA, 21 bp, Homo sapiens
tcagagtgtgttacagcaagc

SEQ ID NO: 9102375 - DNA, 22 bp, Homo sapiens
tcagagttcctcatagatccag

SEQ ID NO: 9102376 - DNA, 22 bp, Homo sapiens
tcagacagaggagctcgtgcag

SEQ ID NO: 9102377 - DNA, 22 bp, Homo sapiens
tcagaattctagctcttccctt

SEQ ID NO: 9102378 - DNA, 22 bp, Homo sapiens
tcagaattctacaatagatcag

SEQ ID NO: 9102379 - DNA, 22 bp, Homo sapiens
tcagaattctgaagggcacaaa

SEQ ID NO: 9102380 - DNA, 22 bp, Homo sapiens
tcagaattctgaccttgggtca

SEQ ID NO: 9102381 - DNA, 22 bp, Homo sapiens
tcagaattcagagggagtgggg

SEQ ID NO: 9102382 - DNA, 22 bp, Homo sapiens
tcagaattatgtaggcctggtt

SEQ ID NO: 9102383 - DNA, 22 bp, Homo sapiens
tcagaattagagctcttcttga

SEQ ID NO: 9102384 - DNA, 23 bp, Homo sapiens
tcagaattccagtttctttgaag

SEQ ID NO: 9102385 - DNA, 21 bp, Homo sapiens
tcagaattacccctggatctg

SEQ ID NO: 9102386 - DNA, 22 bp, Homo sapiens
tcagaattacacagggccttga

SEQ ID NO: 9102387 - DNA, 22 bp, Homo sapiens
tcagaattaagctcttggtcag

SEQ ID NO: 9102388 - DNA, 22 bp, Homo sapiens
tcagaatgtgcagaggaacagt

SEQ ID NO: 9102389 - DNA, 22 bp, Homo sapiens
tcagaattttaaaccaaggaaa

SEQ ID NO: 9102390 - DNA, 22 bp, Homo sapiens
tcagaattttctggaatggagc

SEQ ID NO: 9102391 - DNA, 22 bp, Homo sapiens
tcagaatttttgttacccttga

SEQ ID NO: 9102392 - DNA, 22 bp, Homo sapiens
tcagaattttggtttggttggt

SEQ ID NO: 9102393 - DNA, 22 bp, Homo sapiens
tcagaattgtggagaaagggga

SEQ ID NO: 9102394 - DNA, 22 bp, Homo sapiens
tcagaattggacaatagaagca

SEQ ID NO: 9102395 - DNA, 22 bp, Homo sapiens
tcagaatttaaaatgtgtagat

SEQ ID NO: 9102396 - DNA, 22 bp, Homo sapiens
tcagaatttgattcctgggata

SEQ ID NO: 9102397 - DNA, 22 bp, Homo sapiens
tcagaattgcagggagggcagg

SEQ ID NO: 9102398 - DNA, 22 bp, Homo sapiens
tcagaattggaacgtgaagatt

SEQ ID NO: 9102399 - DNA, 22 bp, Homo sapiens
tcagaattgtctggggaatgtt

SEQ ID NO: 9102400 - DNA, 19 bp, Homo sapiens
tcagaattctgtctcttga

SEQ ID NO: 9102401 - DNA, 22 bp, Homo sapiens
tcagaattgattttcaaaacag

SEQ ID NO: 9102402 - DNA, 22 bp, Homo sapiens
tcagagttctctgtccagatga

SEQ ID NO: 9102403 - DNA, 22 bp, Homo sapiens
tcagatttactgcagagcagat

SEQ ID NO: 9102404 - DNA, 22 bp, Homo sapiens
tcagattttattttcctgttac

SEQ ID NO: 9102405 - DNA, 22 bp, Homo sapiens
tcagattttccagcctttctct

SEQ ID NO: 9102406 - DNA, 22 bp, Homo sapiens
tcagatttgaatattcctttcg

SEQ ID NO: 9102407 - DNA, 22 bp, Homo sapiens
tcagatttccttgcagtttgga

SEQ ID NO: 9102408 - DNA, 17 bp, Homo sapiens
tcagcaggggccaagct

SEQ ID NO: 9102409 - DNA, 17 bp, Homo sapiens
tcagcaggggccaagct

SEQ ID NO: 9102410 - DNA, 22 bp, Homo sapiens
tcagcaggggccgttgggtgga

SEQ ID NO: 9102411 - DNA, 22 bp, Homo sapiens
tcagcagggcctccttgtgcag

SEQ ID NO: 9102412 - DNA, 22 bp, Homo sapiens
tcagcagggctgggagctgtga

SEQ ID NO: 9102413 - DNA, 22 bp, Homo sapiens
tcagcagggctgggagctgtga

SEQ ID NO: 9102414 - DNA, 22 bp, Homo sapiens
tcagcagggctgtggtgtggct

SEQ ID NO: 9102415 - DNA, 22 bp, Homo sapiens
tcagcagggctgtggtgtggct

SEQ ID NO: 9102416 - DNA, 22 bp, Homo sapiens
tcagcagggagaggagaatgca

SEQ ID NO: 9102417 - DNA, 22 bp, Homo sapiens
tcagcagggaggctctgtgccc

SEQ ID NO: 9102418 - DNA, 22 bp, Homo sapiens
tcagcagggaggctctgtgccc

SEQ ID NO: 9102419 - DNA, 22 bp, Homo sapiens
tcagcagggcatactgagccta

SEQ ID NO: 9102420 - DNA, 22 bp, Homo sapiens
tcagcagggccatgctctctct

SEQ ID NO: 9102421 - DNA, 22 bp, Homo sapiens
tcagcaaaatgtggctagtgct

SEQ ID NO: 9102422 - DNA, 22 bp, Homo sapiens
tcagcaaaggcaattcattatt

SEQ ID NO: 9102423 - DNA, 22 bp, Homo sapiens
tcagcaaccaggggcacagtcc

SEQ ID NO: 9102424 - DNA, 22 bp, Homo sapiens
tcagcaagaagctgtgggcttc

SEQ ID NO: 9102425 - DNA, 22 bp, Homo sapiens
tcagcaggcggttccttgtggg

SEQ ID NO: 9102426 - DNA, 22 bp, Homo sapiens
tcagcaggctctggttgaccat

SEQ ID NO: 9102427 - DNA, 22 bp, Homo sapiens
tcagcaggcaggaggcatgcca

SEQ ID NO: 9102428 - DNA, 22 bp, Homo sapiens
tcagcaggcccatcctccaggc

SEQ ID NO: 9102429 - DNA, 22 bp, Homo sapiens
tcagcaggcccatcctccaggc

SEQ ID NO: 9102430 - DNA, 22 bp, Homo sapiens
tcacatttgttcctctgcactt

SEQ ID NO: 9102431 - DNA, 22 bp, Homo sapiens
tcacatttgttcctctgcactt

SEQ ID NO: 9102432 - DNA, 22 bp, Homo sapiens
tcacattttagtaccatgattt

SEQ ID NO: 9102433 - DNA, 22 bp, Homo sapiens
tcacatttgcaattgcattgtt

SEQ ID NO: 9102434 - DNA, 22 bp, Homo sapiens
tcacattttatctattttaagt

SEQ ID NO: 9102435 - DNA, 22 bp, Homo sapiens
tcacattttatctattttaagt

SEQ ID NO: 9102436 - DNA, 22 bp, Homo sapiens
tcactgcaacctccacctcccg

SEQ ID NO: 9102437 - DNA, 22 bp, Homo sapiens
tcactgcaacctccacctcccg

SEQ ID NO: 9102438 - DNA, 22 bp, Homo sapiens
tcactgcaacctccacctcccg

SEQ ID NO: 9102439 - DNA, 22 bp, Homo sapiens
tcactgcaacctccacctcccg

SEQ ID NO: 9102440 - DNA, 22 bp, Homo sapiens
tcactgcaacctccacctcctg

SEQ ID NO: 9102441 - DNA, 22 bp, Homo sapiens
tcactgcaacctccacctcctg

SEQ ID NO: 9102442 - DNA, 22 bp, Homo sapiens
tcactgcaacctccacctcctg

SEQ ID NO: 9102443 - DNA, 22 bp, Homo sapiens
tcactgcaacctccacctcctg

SEQ ID NO: 9102444 - DNA, 22 bp, Homo sapiens
tcactgcaacctccacctcctg

SEQ ID NO: 9102445 - DNA, 22 bp, Homo sapiens
tcactgcaacctccacctcccg

SEQ ID NO: 9102446 - DNA, 22 bp, Homo sapiens
tcagaaaataactgttagtttg

SEQ ID NO: 9102447 - DNA, 22 bp, Homo sapiens
tcactgctctctaagcatcgcc

SEQ ID NO: 9102448 - DNA, 22 bp, Homo sapiens
tcagaacaattcctttataaca

SEQ ID NO: 9102449 - DNA, 22 bp, Homo sapiens
tcagaacaattcctttataaca

SEQ ID NO: 9102450 - DNA, 22 bp, Homo sapiens
tcagaacagaagaaggaacacg

SEQ ID NO: 9102451 - DNA, 22 bp, Homo sapiens
tcagaacagaagctggctataa

SEQ ID NO: 9102452 - DNA, 22 bp, Homo sapiens
tcagaaaggccacatggtgcag

SEQ ID NO: 9102453 - DNA, 22 bp, Homo sapiens
tcagaaaggagttagaggtctc

SEQ ID NO: 9102454 - DNA, 22 bp, Homo sapiens
tcagaaagctatatggtgtgtc

SEQ ID NO: 9102455 - DNA, 22 bp, Homo sapiens
tcagaaagacgaaacagatggg

SEQ ID NO: 9102456 - DNA, 22 bp, Homo sapiens
tcagaaaccagctctctcaatt

SEQ ID NO: 9102457 - DNA, 23 bp, Homo sapiens
tcagaataataacctagtaactg

SEQ ID NO: 9102458 - DNA, 22 bp, Homo sapiens
tcagaatatgctaatgacattt

SEQ ID NO: 9102459 - DNA, 22 bp, Homo sapiens
tcagaagttgataaagtagttg

SEQ ID NO: 9102460 - DNA, 22 bp, Homo sapiens
tcagaagtttcaatcccagctg

SEQ ID NO: 9102461 - DNA, 22 bp, Homo sapiens
tcagaatggacccagactatag

SEQ ID NO: 9102462 - DNA, 22 bp, Homo sapiens
tcagaatggcccataaatagtc

SEQ ID NO: 9102463 - DNA, 21 bp, Homo sapiens
tcagaatgaaaaggcaatctg

SEQ ID NO: 9102464 - DNA, 22 bp, Homo sapiens
tcagaatatgctaatgacattt

SEQ ID NO: 9102465 - DNA, 22 bp, Homo sapiens
tcagaatatgctaatgacattt

SEQ ID NO: 9102466 - DNA, 22 bp, Homo sapiens
tcagaacaggttgtactatgtc

SEQ ID NO: 9102467 - DNA, 22 bp, Homo sapiens
tcagaagccggaagtgctcctc

SEQ ID NO: 9102468 - DNA, 22 bp, Homo sapiens
tcagaagttaatacgaggagaa

SEQ ID NO: 9102469 - DNA, 23 bp, Homo sapiens
tcacataatccttcatccacagg

SEQ ID NO: 9102470 - DNA, 22 bp, Homo sapiens
tcacagttttagaaaatagata

SEQ ID NO: 9102471 - DNA, 22 bp, Homo sapiens
tcacagtttccataggtcagca

SEQ ID NO: 9102472 - DNA, 22 bp, Homo sapiens
tcacagtgaggcagttcttgta

SEQ ID NO: 9102473 - DNA, 22 bp, Homo sapiens
tcacagtgatgacgtgggagca

SEQ ID NO: 9102474 - DNA, 18 bp, Homo sapiens
tcacagtgctcttgccta

SEQ ID NO: 9102475 - DNA, 22 bp, Homo sapiens
tcacagtgcacccctcacaggg

SEQ ID NO: 9102476 - DNA, 22 bp, Homo sapiens
tcacatacattgcctttggaag

SEQ ID NO: 9102477 - DNA, 22 bp, Homo sapiens
tcacatgctcacctaagccaca

SEQ ID NO: 9102478 - DNA, 21 bp, Homo sapiens
tcacatgcttattcctggaat

SEQ ID NO: 9102479 - DNA, 21 bp, Homo sapiens
tcacatttctcatgggtaaat

SEQ ID NO: 9102480 - DNA, 22 bp, Homo sapiens
tcacatttatttcaaagttact

SEQ ID NO: 9102481 - DNA, 22 bp, Homo sapiens
tcacatttcaagtgctcaaaag

SEQ ID NO: 9102482 - DNA, 22 bp, Homo sapiens
tcacatttctcagcactgatga

SEQ ID NO: 9102483 - DNA, 22 bp, Homo sapiens
tcaagaacttaggagcaagcca

SEQ ID NO: 9102484 - DNA, 22 bp, Homo sapiens
tcaagaactggaaattgatatg

SEQ ID NO: 9102485 - DNA, 22 bp, Homo sapiens
tcaagaaatgtgcttggatata

SEQ ID NO: 9102486 - DNA, 22 bp, Homo sapiens
tcacagtatagagttattttgg

SEQ ID NO: 9102487 - DNA, 22 bp, Homo sapiens
tcacagtatcacacaaggatta

SEQ ID NO: 9102488 - DNA, 22 bp, Homo sapiens
tcacagtatctagaaatgaggg

SEQ ID NO: 9102489 - DNA, 22 bp, Homo sapiens
tcaagaaactgtgctacagagt

SEQ ID NO: 9102490 - DNA, 22 bp, Homo sapiens
tcaagaaactgtagcaatgggt

SEQ ID NO: 9102491 - DNA, 22 bp, Homo sapiens
tcaagaaaatgcctgctggtgt

SEQ ID NO: 9102492 - DNA, 22 bp, Homo sapiens
tcaagaaactgtagcaatgggt

SEQ ID NO: 9102493 - DNA, 22 bp, Homo sapiens
tcaactttagtgtagctattta

SEQ ID NO: 9102494 - DNA, 22 bp, Homo sapiens
tcaactttagtgtagctattta

SEQ ID NO: 9102495 - DNA, 22 bp, Homo sapiens
tcaaccttgtgagaactgagtc

SEQ ID NO: 9102496 - DNA, 19 bp, Homo sapiens
tcaaccctctttgcctagc

SEQ ID NO: 9102497 - DNA, 22 bp, Homo sapiens
tcaacactggctacagttatgc

SEQ ID NO: 9102498 - DNA, 22 bp, Homo sapiens
tcaacactctttggcacagtta

SEQ ID NO: 9102499 - DNA, 22 bp, Homo sapiens
tcaacagacatttttaagcact

SEQ ID NO: 9102500 - DNA, 22 bp, Homo sapiens
tcaacatttatgaagctgtggc

SEQ ID NO: 9102501 - DNA, 22 bp, Homo sapiens
tcaacattggaggcaacattca

SEQ ID NO: 9102502 - DNA, 22 bp, Homo sapiens
tcaacattgagtccctgggtct

SEQ ID NO: 9102503 - DNA, 22 bp, Homo sapiens
tcaaatgcacctctcatttgtt

SEQ ID NO: 9102504 - DNA, 22 bp, Homo sapiens
tcaacaagtatttttcaaggct

SEQ ID NO: 9102505 - DNA, 22 bp, Homo sapiens
tcaacaagcattggtggtaaaa

SEQ ID NO: 9102506 - DNA, 22 bp, Homo sapiens
tcaacaagaataccatcctcct

SEQ ID NO: 9102507 - DNA, 19 bp, Homo sapiens
tcaaatgccaatgtcacag

SEQ ID NO: 9102508 - DNA, 22 bp, Homo sapiens
tcaacaatgggtctgtaatgga

SEQ ID NO: 9102509 - DNA, 23 bp, Homo sapiens
gttaacatggtccatggaagagc

SEQ ID NO: 9102510 - DNA, 22 bp, Homo sapiens
gttaacataggcttaggggttt

SEQ ID NO: 9102511 - DNA, 22 bp, Homo sapiens
gttaacattcaattaaacagtc

SEQ ID NO: 9102512 - DNA, 22 bp, Homo sapiens
gttaacataggagtttgttgta

SEQ ID NO: 9102513 - DNA, 22 bp, Homo sapiens
gttaacaagaattactctggaa

SEQ ID NO: 9102514 - DNA, 22 bp, Homo sapiens
gttaacaaccaaacagaagttc

SEQ ID NO: 9102515 - DNA, 22 bp, Homo sapiens
gttaacaaatgtaaagcaatta

SEQ ID NO: 9102516 - DNA, 22 bp, Homo sapiens
gttaaattcgatgatggataaa

SEQ ID NO: 9102517 - DNA, 22 bp, Homo sapiens
gttaaattcgatgatggataaa

SEQ ID NO: 9102518 - DNA, 22 bp, Homo sapiens
gttaaataacctcatgtccgtt

SEQ ID NO: 9102519 - DNA, 22 bp, Homo sapiens
gtgttattagagcattaatttt

SEQ ID NO: 9102520 - DNA, 21 bp, Homo sapiens
gtgctgggacacagccaggct

SEQ ID NO: 9102521 - DNA, 21 bp, Homo sapiens
gtgctgggacacagccaggct

SEQ ID NO: 9102522 - DNA, 21 bp, Homo sapiens
gtgctgggacacagccaggct

SEQ ID NO: 9102523 - DNA, 21 bp, Homo sapiens
gtgctgggacacagccaggct

SEQ ID NO: 9102524 - DNA, 22 bp, Homo sapiens
gtgctggctggacatggagcac

SEQ ID NO: 9102525 - DNA, 22 bp, Homo sapiens
gtgctggctggacatggagcac

SEQ ID NO: 9102526 - DNA, 17 bp, Homo sapiens
gtgctggcctggggctc

SEQ ID NO: 9102527 - DNA, 22 bp, Homo sapiens
gtgctggcctcagagggtcatg

SEQ ID NO: 9102528 - DNA, 22 bp, Homo sapiens
gtgttcatggatgtcaatttga

SEQ ID NO: 9102529 - DNA, 22 bp, Homo sapiens
gtgttgatgacattttagaaac

SEQ ID NO: 9102530 - DNA, 22 bp, Homo sapiens
gtgttcttttgcttcacagaaa

SEQ ID NO: 9102531 - DNA, 22 bp, Homo sapiens
gttatattcaaaatgaggctgt

SEQ ID NO: 9102532 - DNA, 22 bp, Homo sapiens
gttatatatagtatttctctga

SEQ ID NO: 9102533 - DNA, 22 bp, Homo sapiens
gttatataagacaaatcagagt

SEQ ID NO: 9102534 - DNA, 22 bp, Homo sapiens
gttatataattcctgtggtagt

SEQ ID NO: 9102535 - DNA, 22 bp, Homo sapiens
gttatacatatgtgttaacaaa

SEQ ID NO: 9102536 - DNA, 22 bp, Homo sapiens
gttatattggcagaagagaaga

SEQ ID NO: 9102537 - DNA, 22 bp, Homo sapiens
gttatattgccaagtatattgt

SEQ ID NO: 9102538 - DNA, 22 bp, Homo sapiens
gttatattgccaagtatattgt

SEQ ID NO: 9102539 - DNA, 22 bp, Homo sapiens
gttatcttagggtacaaaggac

SEQ ID NO: 9102540 - DNA, 22 bp, Homo sapiens
gttatccatagaataagtcatc

SEQ ID NO: 9102541 - DNA, 22 bp, Homo sapiens
gttatcatgcttcatcatcact

SEQ ID NO: 9102542 - DNA, 22 bp, Homo sapiens
gttatgtaatctaacactcagt

SEQ ID NO: 9102543 - DNA, 22 bp, Homo sapiens
gttatgatggcaccactgcact

SEQ ID NO: 9102544 - DNA, 22 bp, Homo sapiens
gttattgtccagcacagttggg

SEQ ID NO: 9102545 - DNA, 22 bp, Homo sapiens
gttcttcagtcacatcacagaa

SEQ ID NO: 9102546 - DNA, 22 bp, Homo sapiens
gttcttcatcattttagatagg

SEQ ID NO: 9102547 - DNA, 22 bp, Homo sapiens
gttcttcatcattaacactctg

SEQ ID NO: 9102548 - DNA, 22 bp, Homo sapiens
gttctgctgtaatatctctgct

SEQ ID NO: 9102549 - DNA, 22 bp, Homo sapiens
gttctgctgtgtctcagcaggt

SEQ ID NO: 9102550 - DNA, 22 bp, Homo sapiens
gtttgcaggaactctggggaga

SEQ ID NO: 9102551 - DNA, 22 bp, Homo sapiens
gtttgcataaagtggatgcagg

SEQ ID NO: 9102552 - DNA, 22 bp, Homo sapiens
gtttgcagggagagatgtggtg

SEQ ID NO: 9102553 - DNA, 22 bp, Homo sapiens
gtttgcaggaactctggggaga

SEQ ID NO: 9102554 - DNA, 22 bp, Homo sapiens
gtttgcagggagagatgtggtg

SEQ ID NO: 9102555 - DNA, 22 bp, Homo sapiens
gtttgacactgagataaataaa

SEQ ID NO: 9102556 - DNA, 22 bp, Homo sapiens
gtttgaatgcagtatgcatttt

SEQ ID NO: 9102557 - DNA, 17 bp, Homo sapiens
gtttgcatggtgttaac

SEQ ID NO: 9102558 - DNA, 22 bp, Homo sapiens
gtttgtgtaacatgatgatgat

SEQ ID NO: 9102559 - DNA, 21 bp, Homo sapiens
gttttaagggagaaaacctag

SEQ ID NO: 9102560 - DNA, 22 bp, Homo sapiens
gtttgttttaagataggatgga

SEQ ID NO: 9102561 - DNA, 22 bp, Homo sapiens
gtttgtttgtagggaagccgtg

SEQ ID NO: 9102562 - DNA, 22 bp, Homo sapiens
gtttgtttatacaaaagatcct

SEQ ID NO: 9102563 - DNA, 22 bp, Homo sapiens
gtttgtttatacaaaagatcct

SEQ ID NO: 9102564 - DNA, 22 bp, Homo sapiens
gtttgtgtcaatgacttctgca

SEQ ID NO: 9102565 - DNA, 22 bp, Homo sapiens
gtttcttttaaaatatgtagac

SEQ ID NO: 9102566 - DNA, 22 bp, Homo sapiens
gtttcttagacagacattatct

SEQ ID NO: 9102567 - DNA, 22 bp, Homo sapiens
gtttcagaaatggtttatgcaa

SEQ ID NO: 9102568 - DNA, 22 bp, Homo sapiens
gtttcttaggtaaattctttga

SEQ ID NO: 9102569 - DNA, 22 bp, Homo sapiens
gtttcttagacatatgccatga

SEQ ID NO: 9102570 - DNA, 22 bp, Homo sapiens
gtttcttatttgcaggttgctt

SEQ ID NO: 9102571 - DNA, 22 bp, Homo sapiens
gtttcttatttcaactggaaca

SEQ ID NO: 9102572 - DNA, 22 bp, Homo sapiens
gtttcacataattttaaattgt

SEQ ID NO: 9102573 - DNA, 22 bp, Homo sapiens
gtttcacatgaaacttggggaa

SEQ ID NO: 9102574 - DNA, 22 bp, Homo sapiens
gtttcacataattttaaattgt

SEQ ID NO: 9102575 - DNA, 22 bp, Homo sapiens
gtttcacagtctgcagaatttt

SEQ ID NO: 9102576 - DNA, 22 bp, Homo sapiens
gtttcacagatggggagacacg

SEQ ID NO: 9102577 - DNA, 22 bp, Homo sapiens
gttcttcctcattgctttgaag

SEQ ID NO: 9102578 - DNA, 21 bp, Homo sapiens
gttcttgcaggatttccttcc

SEQ ID NO: 9102579 - DNA, 22 bp, Homo sapiens
gttctttgactccaagaaagta

SEQ ID NO: 9102580 - DNA, 22 bp, Homo sapiens
gttctttaagtggagaaggaaa

SEQ ID NO: 9102581 - DNA, 22 bp, Homo sapiens
gttctttaggggcccaatttcc

SEQ ID NO: 9102582 - DNA, 22 bp, Homo sapiens
gttgaatattttaagagttttg

SEQ ID NO: 9102583 - DNA, 22 bp, Homo sapiens
gttgaatatcgtgttcttgttt

SEQ ID NO: 9102584 - DNA, 21 bp, Homo sapiens
gttgaatatccatgtatgtgt

SEQ ID NO: 9102585 - DNA, 22 bp, Homo sapiens
gttgaatatcccgtatcttaaa

SEQ ID NO: 9102586 - DNA, 22 bp, Homo sapiens
gttgaaatcctaaccccctagt

SEQ ID NO: 9102587 - DNA, 22 bp, Homo sapiens
gttgaaatcctaaccccctagt

SEQ ID NO: 9102588 - DNA, 22 bp, Homo sapiens
gtttatattcaacggagtatct

SEQ ID NO: 9102589 - DNA, 22 bp, Homo sapiens
gtttattaactgtcaagtgatt

SEQ ID NO: 9102590 - DNA, 22 bp, Homo sapiens
gtttattaactgtcaagtgatt

SEQ ID NO: 9102591 - DNA, 22 bp, Homo sapiens
gtttattaactgtcaagtgatt

SEQ ID NO: 9102592 - DNA, 22 bp, Homo sapiens
gtttattagagttttctgtctg

SEQ ID NO: 9102593 - DNA, 22 bp, Homo sapiens
gtttattatacaacaaaagcta

SEQ ID NO: 9102594 - DNA, 22 bp, Homo sapiens
gtttattatacaacaaaagcta

SEQ ID NO: 9102595 - DNA, 22 bp, Homo sapiens
taaaagattttataggaacaag

SEQ ID NO: 9102596 - DNA, 21 bp, Homo sapiens
taaaagatgacaagacagctc

SEQ ID NO: 9102597 - DNA, 22 bp, Homo sapiens
taaaagattttataggaacaag

SEQ ID NO: 9102598 - DNA, 22 bp, Homo sapiens
taaaagattttataggaacaag

SEQ ID NO: 9102599 - DNA, 22 bp, Homo sapiens
taaaagattttataggaacaag

SEQ ID NO: 9102600 - DNA, 19 bp, Homo sapiens
taaaaggatgtggaaggat

SEQ ID NO: 9102601 - DNA, 22 bp, Homo sapiens
taaaagtaggaatgaaacgcat

SEQ ID NO: 9102602 - DNA, 22 bp, Homo sapiens
taaaagtaggaatgaaacgcat

SEQ ID NO: 9102603 - DNA, 22 bp, Homo sapiens
taaaaggattagcaggatgggc

SEQ ID NO: 9102604 - DNA, 22 bp, Homo sapiens
taaaagtatactttcaaaggag

SEQ ID NO: 9102605 - DNA, 22 bp, Homo sapiens
taaaagtaggaatgaaacgcat

SEQ ID NO: 9102606 - DNA, 22 bp, Homo sapiens
taaaagtaggaatgaaacgcat

SEQ ID NO: 9102607 - DNA, 22 bp, Homo sapiens
taaaagtatactttcaaaggag

SEQ ID NO: 9102608 - DNA, 22 bp, Homo sapiens
taaaagtatactttcaaaggag

SEQ ID NO: 9102609 - DNA, 22 bp, Homo sapiens
taaaagtatactttcaaaggag

SEQ ID NO: 9102610 - DNA, 22 bp, Homo sapiens
taaagacactggttttaatcat

SEQ ID NO: 9102611 - DNA, 22 bp, Homo sapiens
taaagacactggttttaatcat

SEQ ID NO: 9102612 - DNA, 23 bp, Homo sapiens
taaagacagccttcaggattctg

SEQ ID NO: 9102613 - DNA, 22 bp, Homo sapiens
taaagacagatggaccagccat

SEQ ID NO: 9102614 - DNA, 22 bp, Homo sapiens
taaagacatgcaaagtctaatt

SEQ ID NO: 9102615 - DNA, 20 bp, Homo sapiens
taaagacataagctactatc

SEQ ID NO: 9102616 - DNA, 22 bp, Homo sapiens
taaagacataggatcagggaga

SEQ ID NO: 9102617 - DNA, 22 bp, Homo sapiens
taaagacataggatcagggaga

SEQ ID NO: 9102618 - DNA, 22 bp, Homo sapiens
gttttacaaatgacggcattca

SEQ ID NO: 9102619 - DNA, 22 bp, Homo sapiens
taaaactgcttggtatggtcta

SEQ ID NO: 9102620 - DNA, 22 bp, Homo sapiens
taaaacttctcatttttatggt

SEQ ID NO: 9102621 - DNA, 22 bp, Homo sapiens
taaaacttctcatttttatggt

SEQ ID NO: 9102622 - DNA, 22 bp, Homo sapiens
taaaacttctcatttttatggt

SEQ ID NO: 9102623 - DNA, 22 bp, Homo sapiens
taaaacttctcatttttatggt

SEQ ID NO: 9102624 - DNA, 22 bp, Homo sapiens
taaaacttaactatccagatta

SEQ ID NO: 9102625 - DNA, 22 bp, Homo sapiens
taaaagaccacaaggtggtaat

SEQ ID NO: 9102626 - DNA, 22 bp, Homo sapiens
taaaagaccctctagagtccca

SEQ ID NO: 9102627 - DNA, 22 bp, Homo sapiens
taaaagacatataactgtagga

SEQ ID NO: 9102628 - DNA, 22 bp, Homo sapiens
taaaagaagcttcaaggccggc

SEQ ID NO: 9102629 - DNA, 22 bp, Homo sapiens
taaaagaagcttcaaggccggc

SEQ ID NO: 9102630 - DNA, 21 bp, Homo sapiens
taaaagatgacaagacagctc

SEQ ID NO: 9102631 - DNA, 21 bp, Homo sapiens
taaaagatgacaagacagctc

SEQ ID NO: 9102632 - DNA, 22 bp, Homo sapiens
taaaagagaatggataacagag

SEQ ID NO: 9102633 - DNA, 22 bp, Homo sapiens
taaaagatatcttagggatttg

SEQ ID NO: 9102634 - DNA, 22 bp, Homo sapiens
taaaagagaatggataacagag

SEQ ID NO: 9102635 - DNA, 20 bp, Homo sapiens
taaatgcatgaatgtaaggc

SEQ ID NO: 9102636 - DNA, 20 bp, Homo sapiens
taaatgcatgaatgtaaggc

SEQ ID NO: 9102637 - DNA, 22 bp, Homo sapiens
taaatgcagttagtacttgcca

SEQ ID NO: 9102638 - DNA, 20 bp, Homo sapiens
taaatgcatctgttcaactg

SEQ ID NO: 9102639 - DNA, 20 bp, Homo sapiens
taaatgcatctgttcaactg

SEQ ID NO: 9102640 - DNA, 22 bp, Homo sapiens
taaatgcagttagtacttgcca

SEQ ID NO: 9102641 - DNA, 22 bp, Homo sapiens
taaatgcagttagtacttgcca

SEQ ID NO: 9102642 - DNA, 22 bp, Homo sapiens
taaatgcagttagtacttgcca

SEQ ID NO: 9102643 - DNA, 22 bp, Homo sapiens
taaatgcaatgtgctttaccag

SEQ ID NO: 9102644 - DNA, 22 bp, Homo sapiens
taaatgcagattcctgagccta

SEQ ID NO: 9102645 - DNA, 22 bp, Homo sapiens
taaatgcagcagtttctgttct

SEQ ID NO: 9102646 - DNA, 22 bp, Homo sapiens
taaatgcagtacaaattgttct

SEQ ID NO: 9102647 - DNA, 22 bp, Homo sapiens
taaatgcagcagtttctgttct

SEQ ID NO: 9102648 - DNA, 22 bp, Homo sapiens
taaatgatttatgtatgtgaaa

SEQ ID NO: 9102649 - DNA, 22 bp, Homo sapiens
taaatgatttatgtatgtgaaa

SEQ ID NO: 9102650 - DNA, 22 bp, Homo sapiens
taaagcagccagggtctaagcc

SEQ ID NO: 9102651 - DNA, 22 bp, Homo sapiens
taaagcagccagggtctaagcc

SEQ ID NO: 9102652 - DNA, 22 bp, Homo sapiens
taaagcacgtctatttaatgat

SEQ ID NO: 9102653 - DNA, 22 bp, Homo sapiens
taaagcacatatcttacaataa

SEQ ID NO: 9102654 - DNA, 22 bp, Homo sapiens
taaatgcaaagcttggcgctta

SEQ ID NO: 9102655 - DNA, 22 bp, Homo sapiens
taaatgcaagtgctcctgggag

SEQ ID NO: 9102656 - DNA, 22 bp, Homo sapiens
taaatgcaagggaaaggcaaga

SEQ ID NO: 9102657 - DNA, 22 bp, Homo sapiens
taaatgcaagggaaaggcaaga

SEQ ID NO: 9102658 - DNA, 23 bp, Homo sapiens
taaagcaaagtcaagtgcactcc

SEQ ID NO: 9102659 - DNA, 23 bp, Homo sapiens
taaagcaaagtcaagtgcactcc

SEQ ID NO: 9102660 - DNA, 22 bp, Homo sapiens
taaagcaagacacacccatagc

SEQ ID NO: 9102661 - DNA, 22 bp, Homo sapiens
taaagcaagacacacccatagc

SEQ ID NO: 9102662 - DNA, 22 bp, Homo sapiens
taaagcaaggaatagagtagtc

SEQ ID NO: 9102663 - DNA, 22 bp, Homo sapiens
taaagcaaggaatagagtagtc

SEQ ID NO: 9102664 - DNA, 22 bp, Homo sapiens
taaagcaaggaatagagtagtc

SEQ ID NO: 9102665 - DNA, 22 bp, Homo sapiens
taaagcaaggaatagagtagtc

SEQ ID NO: 9102666 - DNA, 22 bp, Homo sapiens
taaagcaatgaaagttttgcag

SEQ ID NO: 9102667 - DNA, 22 bp, Homo sapiens
taaagcaatgaaagttttgcag

SEQ ID NO: 9102668 - DNA, 22 bp, Homo sapiens
taaagcaaggcaaattgttggt

SEQ ID NO: 9102669 - DNA, 22 bp, Homo sapiens
taaagcaaggcaaattgttggt

SEQ ID NO: 9102670 - DNA, 22 bp, Homo sapiens
taaagcaatttgagcaagttct

SEQ ID NO: 9102671 - DNA, 22 bp, Homo sapiens
taaagcaattactcagtggctt

SEQ ID NO: 9102672 - DNA, 22 bp, Homo sapiens
taaagcaatttgagcaagttct

SEQ ID NO: 9102673 - DNA, 22 bp, Homo sapiens
taaagcaatttgagcaagttct

SEQ ID NO: 9102674 - DNA, 22 bp, Homo sapiens
taaagatgcccacattgcaggt

SEQ ID NO: 9102675 - DNA, 22 bp, Homo sapiens
taaagatgctatagtgaaggag

SEQ ID NO: 9102676 - DNA, 22 bp, Homo sapiens
taaagatggagatgacctagga

SEQ ID NO: 9102677 - DNA, 17 bp, Homo sapiens
taaagatcagccatgta

SEQ ID NO: 9102678 - DNA, 22 bp, Homo sapiens
taaagcaaaaatgaactgccat

SEQ ID NO: 9102679 - DNA, 22 bp, Homo sapiens
taaagcaaaaatgaactgccat

SEQ ID NO: 9102680 - DNA, 23 bp, Homo sapiens
taaagcaaagtcaagtgcactcc

SEQ ID NO: 9102681 - DNA, 22 bp, Homo sapiens
taaagacatggtgtaggtgaac

SEQ ID NO: 9102682 - DNA, 19 bp, Homo sapiens
taaagagaataccggtggc

SEQ ID NO: 9102683 - DNA, 22 bp, Homo sapiens
taaagacatggtgtaggtgaac

SEQ ID NO: 9102684 - DNA, 18 bp, Homo sapiens
taacatcggctatgcatc

SEQ ID NO: 9102685 - DNA, 20 bp, Homo sapiens
taacagttgtagagggtttt

SEQ ID NO: 9102686 - DNA, 22 bp, Homo sapiens
taacagttttgagttttgcttc

SEQ ID NO: 9102687 - DNA, 22 bp, Homo sapiens
taacagttttgagttttgcttc

SEQ ID NO: 9102688 - DNA, 20 bp, Homo sapiens
taacagttgaagaacaagga

SEQ ID NO: 9102689 - DNA, 22 bp, Homo sapiens
taacagttggtgtaatttcttg

SEQ ID NO: 9102690 - DNA, 22 bp, Homo sapiens
taacagttggtgtaatttcttg

SEQ ID NO: 9102691 - DNA, 22 bp, Homo sapiens
taacatctaagggagagaaagt

SEQ ID NO: 9102692 - DNA, 22 bp, Homo sapiens
taacatctccctgacttttgct

SEQ ID NO: 9102693 - DNA, 22 bp, Homo sapiens
taacatctaagggagagaaagt

SEQ ID NO: 9102694 - DNA, 22 bp, Homo sapiens
taacatcttgcagtagcagaac

SEQ ID NO: 9102695 - DNA, 22 bp, Homo sapiens
taacatctttagcagctcgaac

SEQ ID NO: 9102696 - DNA, 22 bp, Homo sapiens
taacatcttattggcaaagata

SEQ ID NO: 9102697 - DNA, 22 bp, Homo sapiens
taacatcttaactggatacttc

SEQ ID NO: 9102698 - DNA, 22 bp, Homo sapiens
taacatgaaactccaaatggta

SEQ ID NO: 9102699 - DNA, 22 bp, Homo sapiens
taacagtatagcctaacatttc

SEQ ID NO: 9102700 - DNA, 22 bp, Homo sapiens
taacagtatagcctaacatttc

SEQ ID NO: 9102701 - DNA, 22 bp, Homo sapiens
taacagtatatttaccaaacct

SEQ ID NO: 9102702 - DNA, 22 bp, Homo sapiens
taacagtattgaagataaacta

SEQ ID NO: 9102703 - DNA, 22 bp, Homo sapiens
taacagtcatgtgctactgcta

SEQ ID NO: 9102704 - DNA, 22 bp, Homo sapiens
taaatgttgtaagtacatctaa

SEQ ID NO: 9102705 - DNA, 22 bp, Homo sapiens
taaatgttggcattggaggccg

SEQ ID NO: 9102706 - DNA, 22 bp, Homo sapiens
taaatgtttagtcttatttggg

SEQ ID NO: 9102707 - DNA, 22 bp, Homo sapiens
taaatgttttgtgggttgagtt

SEQ ID NO: 9102708 - DNA, 22 bp, Homo sapiens
taaattaaagattggagaagga

SEQ ID NO: 9102709 - DNA, 22 bp, Homo sapiens
taacagctggcgttataggaat

SEQ ID NO: 9102710 - DNA, 22 bp, Homo sapiens
taacagctctgtgtggctgtaa

SEQ ID NO: 9102711 - DNA, 22 bp, Homo sapiens
taaattaaagattggagaagga

SEQ ID NO: 9102712 - DNA, 22 bp, Homo sapiens
taacagcagtcctcttctcatg

SEQ ID NO: 9102713 - DNA, 22 bp, Homo sapiens
taaatgttatgcccatcatcca

SEQ ID NO: 9102714 - DNA, 22 bp, Homo sapiens
taaatgttactttcctttcaca

SEQ ID NO: 9102715 - DNA, 22 bp, Homo sapiens
taaatgttactttcctttcaca

SEQ ID NO: 9102716 - DNA, 22 bp, Homo sapiens
taaatgtgtgtagccatctgtg

SEQ ID NO: 9102717 - DNA, 18 bp, Homo sapiens
taaatgcatgttaataac

SEQ ID NO: 9102718 - DNA, 18 bp, Homo sapiens
taaatgcatgttaataac

SEQ ID NO: 9102719 - DNA, 22 bp, Homo sapiens
taaatgccattcgtttcataca

SEQ ID NO: 9102720 - DNA, 22 bp, Homo sapiens
taaatgctatcgcataaaacct

SEQ ID NO: 9102721 - DNA, 18 bp, Homo sapiens
taacatgttttcattaag

SEQ ID NO: 9102722 - DNA, 22 bp, Homo sapiens
taacatgctaatttgcagatag

SEQ ID NO: 9102723 - DNA, 22 bp, Homo sapiens
taagacaagcctcgcatttgta

SEQ ID NO: 9102724 - DNA, 22 bp, Homo sapiens
taagacaaatactatttcaaga

SEQ ID NO: 9102725 - DNA, 22 bp, Homo sapiens
taagacaattcttcagtcacaa

SEQ ID NO: 9102726 - DNA, 21 bp, Homo sapiens
taagacagtatgaatactttc

SEQ ID NO: 9102727 - DNA, 22 bp, Homo sapiens
taagacatagccaagagcatcc

SEQ ID NO: 9102728 - DNA, 22 bp, Homo sapiens
taagacatagccaagagcatcc

SEQ ID NO: 9102729 - DNA, 22 bp, Homo sapiens
taagacatcctggatgttcaaa

SEQ ID NO: 9102730 - DNA, 22 bp, Homo sapiens
taagacatcattaaacagcaat

SEQ ID NO: 9102731 - DNA, 22 bp, Homo sapiens
taagacttaggtcgagtttggc

SEQ ID NO: 9102732 - DNA, 22 bp, Homo sapiens
taagacatttgacaaaccattt

SEQ ID NO: 9102733 - DNA, 22 bp, Homo sapiens
taagacatggttgatctagtgt

SEQ ID NO: 9102734 - DNA, 21 bp, Homo sapiens
taagcatatcagatagactct

SEQ ID NO: 9102735 - DNA, 22 bp, Homo sapiens
taagagctaggattttaaatca

SEQ ID NO: 9102736 - DNA, 18 bp, Homo sapiens
taagagcagactgtaggc

SEQ ID NO: 9102737 - DNA, 22 bp, Homo sapiens
taagagcagaggttgaataaat

SEQ ID NO: 9102738 - DNA, 22 bp, Homo sapiens
taagagatgcttttctaaataa

SEQ ID NO: 9102739 - DNA, 22 bp, Homo sapiens
taagagactattgagcatcttg

SEQ ID NO: 9102740 - DNA, 22 bp, Homo sapiens
taagagatggttatcaaaagca

SEQ ID NO: 9102741 - DNA, 22 bp, Homo sapiens
taagagattctaaagctactgg

SEQ ID NO: 9102742 - DNA, 22 bp, Homo sapiens
taagagcagaacagcaacatat

SEQ ID NO: 9102743 - DNA, 22 bp, Homo sapiens
taagacttcattagtaatatgg

SEQ ID NO: 9102744 - DNA, 22 bp, Homo sapiens
taagagaactggatagatagga

SEQ ID NO: 9102745 - DNA, 22 bp, Homo sapiens
taagagaaggatctgttccagg

SEQ ID NO: 9102746 - DNA, 22 bp, Homo sapiens
taccaaatgtaatcattctaat

SEQ ID NO: 9102747 - DNA, 19 bp, Homo sapiens
taccaaattgcattatggc

SEQ ID NO: 9102748 - DNA, 22 bp, Homo sapiens
tacatgtatgtttatcttgaga

SEQ ID NO: 9102749 - DNA, 22 bp, Homo sapiens
tacatgcatgtcacagaatgaa

SEQ ID NO: 9102750 - DNA, 18 bp, Homo sapiens
tacatgccagagagttac

SEQ ID NO: 9102751 - DNA, 22 bp, Homo sapiens
tacatggtggtggtgtctcggc

SEQ ID NO: 9102752 - DNA, 22 bp, Homo sapiens
tacatggttggcccattcttct

SEQ ID NO: 9102753 - DNA, 22 bp, Homo sapiens
tacatgaatttgagtcagagga

SEQ ID NO: 9102754 - DNA, 21 bp, Homo sapiens
tacatgagtgtatgagcatat

SEQ ID NO: 9102755 - DNA, 21 bp, Homo sapiens
tacatgaagctggtgtttgtc

SEQ ID NO: 9102756 - DNA, 22 bp, Homo sapiens
tacatgaagttgtctaaactgg

SEQ ID NO: 9102757 - DNA, 22 bp, Homo sapiens
tacatgaagaaaattaagcagt

SEQ ID NO: 9102758 - DNA, 22 bp, Homo sapiens
tacatgaagatgaatgtatggc

SEQ ID NO: 9102759 - DNA, 22 bp, Homo sapiens
tacatgaacctttatgtgtgat

SEQ ID NO: 9102760 - DNA, 22 bp, Homo sapiens
tacatgaacaaaatagcagaaa

SEQ ID NO: 9102761 - DNA, 22 bp, Homo sapiens
tacagttaaaaagttcaatggt

SEQ ID NO: 9102762 - DNA, 20 bp, Homo sapiens
tacagacatgacaataatgg

SEQ ID NO: 9102763 - DNA, 22 bp, Homo sapiens
tacagaggagaccaaggctcag

SEQ ID NO: 9102764 - DNA, 22 bp, Homo sapiens
tacagaggagaccaaggctcag

SEQ ID NO: 9102765 - DNA, 22 bp, Homo sapiens
tacagaggaggggattttaata

SEQ ID NO: 9102766 - DNA, 22 bp, Homo sapiens
tacagaggaggtggttgggagt

SEQ ID NO: 9102767 - DNA, 22 bp, Homo sapiens
tacagtagtcgtcttattttga

SEQ ID NO: 9102768 - DNA, 22 bp, Homo sapiens
tacagagggtaattgatcaagg

SEQ ID NO: 9102769 - DNA, 22 bp, Homo sapiens
tacagaggggacatggaagaca

SEQ ID NO: 9102770 - DNA, 22 bp, Homo sapiens
tacagaggcacatgcaattttc

SEQ ID NO: 9102771 - DNA, 22 bp, Homo sapiens
tacagaggctgggttttcaggg

SEQ ID NO: 9102772 - DNA, 22 bp, Homo sapiens
tacagagggattatctaagggt

SEQ ID NO: 9102773 - DNA, 18 bp, Homo sapiens
tacagtattttctcgcct

SEQ ID NO: 9102774 - DNA, 22 bp, Homo sapiens
tacagtgacagatagggataga

SEQ ID NO: 9102775 - DNA, 22 bp, Homo sapiens
tacagtgtatgtatttgtaggt

SEQ ID NO: 9102776 - DNA, 22 bp, Homo sapiens
tacagtgcatagaggcatgata

SEQ ID NO: 9102777 - DNA, 22 bp, Homo sapiens
tactgtgtgcccagccgagctg

SEQ ID NO: 9102778 - DNA, 22 bp, Homo sapiens
tactgtgttgtgctgaaaggga

SEQ ID NO: 9102779 - DNA, 22 bp, Homo sapiens
tactgtgtgcccagccgagctg

SEQ ID NO: 9102780 - DNA, 22 bp, Homo sapiens
tactgtgtcttaggatgtggaa

SEQ ID NO: 9102781 - DNA, 22 bp, Homo sapiens
tactgaaacttttcttcaactg

SEQ ID NO: 9102782 - DNA, 22 bp, Homo sapiens
tactgaaaaagaatccagacct

SEQ ID NO: 9102783 - DNA, 22 bp, Homo sapiens
tactgaaactcttgtaaatatc

SEQ ID NO: 9102784 - DNA, 22 bp, Homo sapiens
tactcctgctgatcctgccagc

SEQ ID NO: 9102785 - DNA, 22 bp, Homo sapiens
tactgttttctttatagtacag

SEQ ID NO: 9102786 - DNA, 22 bp, Homo sapiens
tactgtttcctgaagcagatgc

SEQ ID NO: 9102787 - DNA, 22 bp, Homo sapiens
tactgttttaaaaggtacttgt

SEQ ID NO: 9102788 - DNA, 22 bp, Homo sapiens
tacttaaataattgctgctatt

SEQ ID NO: 9102789 - DNA, 22 bp, Homo sapiens
tacttaatgccactgaattgta

SEQ ID NO: 9102790 - DNA, 22 bp, Homo sapiens
tacttaaaactgatagaatctc

SEQ ID NO: 9102791 - DNA, 22 bp, Homo sapiens
tacttaaaactgatagaatctc

SEQ ID NO: 9102792 - DNA, 22 bp, Homo sapiens
tacttacagaaggaagcaattg

SEQ ID NO: 9102793 - DNA, 22 bp, Homo sapiens
taccaggcagctgcacagaggc

SEQ ID NO: 9102794 - DNA, 22 bp, Homo sapiens
taccagcctcagttgtgagccc

SEQ ID NO: 9102795 - DNA, 19 bp, Homo sapiens
taccagcctcctgcctgat

SEQ ID NO: 9102796 - DNA, 22 bp, Homo sapiens
taccagccttttaacatgggcc

SEQ ID NO: 9102797 - DNA, 22 bp, Homo sapiens
taccagcctctgttgggggtgg

SEQ ID NO: 9102798 - DNA, 22 bp, Homo sapiens
taccagcctgaccctgtctgac

SEQ ID NO: 9102799 - DNA, 22 bp, Homo sapiens
taccatgtcttcaataagtcta

SEQ ID NO: 9102800 - DNA, 19 bp, Homo sapiens
taccatgttgactttcctg

SEQ ID NO: 9102801 - DNA, 22 bp, Homo sapiens
taccattgtaccaaggtaattt

SEQ ID NO: 9102802 - DNA, 22 bp, Homo sapiens
taccatgatgtttgagttacta

SEQ ID NO: 9102803 - DNA, 22 bp, Homo sapiens
taccatttcagtaaaaacttag

SEQ ID NO: 9102804 - DNA, 22 bp, Homo sapiens
taccatttcagtaaaaacttag

SEQ ID NO: 9102805 - DNA, 22 bp, Homo sapiens
taccagggaacagggatattaa

SEQ ID NO: 9102806 - DNA, 22 bp, Homo sapiens
taccataacgtaatgaacttga

SEQ ID NO: 9102807 - DNA, 22 bp, Homo sapiens
taccatgatcaggctcatcctt

SEQ ID NO: 9102808 - DNA, 22 bp, Homo sapiens
taccataacgtaatgaacttga

SEQ ID NO: 9102809 - DNA, 19 bp, Homo sapiens
taccatccaagctggtttg

SEQ ID NO: 9102810 - DNA, 20 bp, Homo sapiens
taccataaaatgctgatgga

SEQ ID NO: 9102811 - DNA, 22 bp, Homo sapiens
taccagtaatgtaactttgcaa

SEQ ID NO: 9102812 - DNA, 22 bp, Homo sapiens
tactacattaataaaacattca

SEQ ID NO: 9102813 - DNA, 22 bp, Homo sapiens
tactacatacagaatttagaga

SEQ ID NO: 9102814 - DNA, 22 bp, Homo sapiens
taccattttgaaacatttcatc

SEQ ID NO: 9102815 - DNA, 22 bp, Homo sapiens
taccatttgagagagaacataa

SEQ ID NO: 9102816 - DNA, 22 bp, Homo sapiens
taccatttgagagagaacataa

SEQ ID NO: 9102817 - DNA, 22 bp, Homo sapiens
tactagaacctcacaacaatcc

SEQ ID NO: 9102818 - DNA, 22 bp, Homo sapiens
tactagaaaaacacatgctctg

SEQ ID NO: 9102819 - DNA, 22 bp, Homo sapiens
tactaggaagcagctgcattgg

SEQ ID NO: 9102820 - DNA, 22 bp, Homo sapiens
tactagtttctaccttacagaa

SEQ ID NO: 9102821 - DNA, 22 bp, Homo sapiens
tactataaagtcttaatgagtc

SEQ ID NO: 9102822 - DNA, 22 bp, Homo sapiens
tactagtttttaggaaaagtga

SEQ ID NO: 9102823 - DNA, 23 bp, Homo sapiens
tactataacgctgtgtcagctcc

SEQ ID NO: 9102824 - DNA, 22 bp, Homo sapiens
tactataacttcgaagtcctgg

SEQ ID NO: 9102825 - DNA, 22 bp, Homo sapiens
tactatactctccattttatag

SEQ ID NO: 9102826 - DNA, 22 bp, Homo sapiens
tactccacacgctattataatg

SEQ ID NO: 9102827 - DNA, 22 bp, Homo sapiens
tacagaatgttatgaagcatag

SEQ ID NO: 9102828 - DNA, 22 bp, Homo sapiens
tacagaatgttatgaagcatag

SEQ ID NO: 9102829 - DNA, 22 bp, Homo sapiens
tacagacaaagtgctatagggt

SEQ ID NO: 9102830 - DNA, 22 bp, Homo sapiens
tacagaattagattattagaga

SEQ ID NO: 9102831 - DNA, 22 bp, Homo sapiens
tacagaattagattattagaga

SEQ ID NO: 9102832 - DNA, 22 bp, Homo sapiens
tacagaattagattattagaga

SEQ ID NO: 9102833 - DNA, 22 bp, Homo sapiens
tacagaatctatgcttcacagt

SEQ ID NO: 9102834 - DNA, 22 bp, Homo sapiens
tacagaatatagaagctggaag

SEQ ID NO: 9102835 - DNA, 20 bp, Homo sapiens
tacagaatgcaataaaatgg

SEQ ID NO: 9102836 - DNA, 22 bp, Homo sapiens
tacacataggtctgaataaaaa

SEQ ID NO: 9102837 - DNA, 22 bp, Homo sapiens
tacacataggagggtaataaaa

SEQ ID NO: 9102838 - DNA, 22 bp, Homo sapiens
tacacactgtgataatgaagca

SEQ ID NO: 9102839 - DNA, 22 bp, Homo sapiens
tacacacagaggccatgggatt

SEQ ID NO: 9102840 - DNA, 22 bp, Homo sapiens
tacacacatgcatttgccttat

SEQ ID NO: 9102841 - DNA, 22 bp, Homo sapiens
tacacaatgacttaagatgtca

SEQ ID NO: 9102842 - DNA, 22 bp, Homo sapiens
tacacataaaatgctcatggta

SEQ ID NO: 9102843 - DNA, 22 bp, Homo sapiens
tacacagaacctggtgtacagt

SEQ ID NO: 9102844 - DNA, 22 bp, Homo sapiens
tacacacttactggagatgaag

SEQ ID NO: 9102845 - DNA, 22 bp, Homo sapiens
tacaacataacgggcattcagt

SEQ ID NO: 9102846 - DNA, 22 bp, Homo sapiens
tacaacatgtggtcctttatga

SEQ ID NO: 9102847 - DNA, 22 bp, Homo sapiens
taatttatggtatgtgtgtaat

SEQ ID NO: 9102848 - DNA, 21 bp, Homo sapiens
taatttattcagcacagtgtt

SEQ ID NO: 9102849 - DNA, 21 bp, Homo sapiens
taatttattcagcacagtgtt

SEQ ID NO: 9102850 - DNA, 21 bp, Homo sapiens
taatttattcagcacagtgtt

SEQ ID NO: 9102851 - DNA, 21 bp, Homo sapiens
taatttattcagcacagtgtt

SEQ ID NO: 9102852 - DNA, 22 bp, Homo sapiens
taatttatttcaactgccaagg

SEQ ID NO: 9102853 - DNA, 22 bp, Homo sapiens
tacaacctctgcctcccaagtt

SEQ ID NO: 9102854 - DNA, 22 bp, Homo sapiens
tacaaccttctccccaaaagct

SEQ ID NO: 9102855 - DNA, 22 bp, Homo sapiens
tacaaccagatcctctaagtca

SEQ ID NO: 9102856 - DNA, 22 bp, Homo sapiens
tacaaccatagacatatactag

SEQ ID NO: 9102857 - DNA, 22 bp, Homo sapiens
tacaacttacttgaatggcttt

SEQ ID NO: 9102858 - DNA, 17 bp, Homo sapiens
tacaactgttgtttata

SEQ ID NO: 9102859 - DNA, 22 bp, Homo sapiens
tacaactgtcagatgttttgag

SEQ ID NO: 9102860 - DNA, 22 bp, Homo sapiens
tacaagaaactacatgaatgca

SEQ ID NO: 9102861 - DNA, 22 bp, Homo sapiens
tacaagaaagtccagtgggttt

SEQ ID NO: 9102862 - DNA, 22 bp, Homo sapiens
tacaagaaactacatgaatgca

SEQ ID NO: 9102863 - DNA, 22 bp, Homo sapiens
tacaagaaactacatgaatgca

SEQ ID NO: 9102864 - DNA, 22 bp, Homo sapiens
tacaacttacttgaatggcttt

SEQ ID NO: 9102865 - DNA, 22 bp, Homo sapiens
tacaagaaatttctgcatatat

SEQ ID NO: 9102866 - DNA, 22 bp, Homo sapiens
tacaagaaagtccagtgggttt

SEQ ID NO: 9102867 - DNA, 22 bp, Homo sapiens
tacaagaaggaaaactagcaat

SEQ ID NO: 9102868 - DNA, 22 bp, Homo sapiens
tacaagaaggaaaactagcaat

SEQ ID NO: 9102869 - DNA, 22 bp, Homo sapiens
tacaagaagaggcagagctgga

SEQ ID NO: 9102870 - DNA, 20 bp, Homo sapiens
tacaagaatccccagttgtc

SEQ ID NO: 9102871 - DNA, 22 bp, Homo sapiens
tacaagaaggatggagcccact

SEQ ID NO: 9102872 - DNA, 22 bp, Homo sapiens
tacaagagacaccagggaggct

SEQ ID NO: 9102873 - DNA, 22 bp, Homo sapiens
tacaagagaactaatgtaagtc

SEQ ID NO: 9102874 - DNA, 22 bp, Homo sapiens
tacaagaatgtcttaaaagctc

SEQ ID NO: 9102875 - DNA, 22 bp, Homo sapiens
tacaagaatgtcttaaaagctc

SEQ ID NO: 9102876 - DNA, 22 bp, Homo sapiens
tacaagaatttctttctggttg

SEQ ID NO: 9102877 - DNA, 21 bp, Homo sapiens
tacaagaccggattcgggccc

SEQ ID NO: 9102878 - DNA, 22 bp, Homo sapiens
tacaagacgagggaagttcttt

SEQ ID NO: 9102879 - DNA, 22 bp, Homo sapiens
tacaagaggtatatagaaacag

SEQ ID NO: 9102880 - DNA, 21 bp, Homo sapiens
tacaagatagaggtaatatat

SEQ ID NO: 9102881 - DNA, 22 bp, Homo sapiens
tacacaactgacaaccattctg

SEQ ID NO: 9102882 - DNA, 22 bp, Homo sapiens
tacacaatctgtttttccattt

SEQ ID NO: 9102883 - DNA, 22 bp, Homo sapiens
tacacaatgacttaagatgtca

SEQ ID NO: 9102884 - DNA, 22 bp, Homo sapiens
taatatatttctgctaagctca

SEQ ID NO: 9102885 - DNA, 22 bp, Homo sapiens
taatatatttctgctaagctca

SEQ ID NO: 9102886 - DNA, 22 bp, Homo sapiens
taatctctctaagtttccattt

SEQ ID NO: 9102887 - DNA, 22 bp, Homo sapiens
taatcctttatggttttcctcc

SEQ ID NO: 9102888 - DNA, 22 bp, Homo sapiens
taattattctagtcacatagca

SEQ ID NO: 9102889 - DNA, 22 bp, Homo sapiens
taattattatgacaacaattgc

SEQ ID NO: 9102890 - DNA, 22 bp, Homo sapiens
taatttacttgcaaataacaat

SEQ ID NO: 9102891 - DNA, 22 bp, Homo sapiens
taatttatatggaattgttgct

SEQ ID NO: 9102892 - DNA, 22 bp, Homo sapiens
taatttagtccaatgtgaatat

SEQ ID NO: 9102893 - DNA, 22 bp, Homo sapiens
taatttatgatgcaaagaaaag

SEQ ID NO: 9102894 - DNA, 22 bp, Homo sapiens
taatttatgatgcaaagaaaag

SEQ ID NO: 9102895 - DNA, 22 bp, Homo sapiens
taatttatgatgcaaagaaaag

SEQ ID NO: 9102896 - DNA, 22 bp, Homo sapiens
taattcttgttcagaggtagta

SEQ ID NO: 9102897 - DNA, 22 bp, Homo sapiens
taattctagattgacattttga

SEQ ID NO: 9102898 - DNA, 22 bp, Homo sapiens
taagctcactgtaagaactgat

SEQ ID NO: 9102899 - DNA, 22 bp, Homo sapiens
taagcctgcatgaaccatgaga

SEQ ID NO: 9102900 - DNA, 22 bp, Homo sapiens
taagctggggctatgctaaata

SEQ ID NO: 9102901 - DNA, 22 bp, Homo sapiens
taaggaaaatggacatcaaaca

SEQ ID NO: 9102902 - DNA, 22 bp, Homo sapiens
taagcatggtggtaaaagaggt

SEQ ID NO: 9102903 - DNA, 22 bp, Homo sapiens
taagccatacatttcagactct

SEQ ID NO: 9102904 - DNA, 22 bp, Homo sapiens
taagcccacatttttctgaaga

SEQ ID NO: 9102905 - DNA, 22 bp, Homo sapiens
taagcccaggaatgcacttcag

SEQ ID NO: 9102906 - DNA, 22 bp, Homo sapiens
taagccagatacaccactgaaa

SEQ ID NO: 9102907 - DNA, 22 bp, Homo sapiens
taaggaaacaacttgtattttt

SEQ ID NO: 9102908 - DNA, 22 bp, Homo sapiens
taaggaaacaacttgtattttt

SEQ ID NO: 9102909 - DNA, 22 bp, Homo sapiens
taaggaaaatggacatcaaaca

SEQ ID NO: 9102910 - DNA, 22 bp, Homo sapiens
taaggaaaatggacatcaaaca

SEQ ID NO: 9102911 - DNA, 22 bp, Homo sapiens
taaggaaagtacatgttttgac

SEQ ID NO: 9102912 - DNA, 22 bp, Homo sapiens
taaggaaagtgccatgatttct

SEQ ID NO: 9102913 - DNA, 22 bp, Homo sapiens
taaggaaagtgccatgatttct

SEQ ID NO: 9102914 - DNA, 22 bp, Homo sapiens
taaggaagagcttggtaatagg

SEQ ID NO: 9102915 - DNA, 22 bp, Homo sapiens
taatagttgtgactttgtaaag

SEQ ID NO: 9102916 - DNA, 22 bp, Homo sapiens
taaggattaaataagaatattt

SEQ ID NO: 9102917 - DNA, 22 bp, Homo sapiens
taaggaggtgcccactctcagg

SEQ ID NO: 9102918 - DNA, 22 bp, Homo sapiens
taaggagagaatttagaggttt

SEQ ID NO: 9102919 - DNA, 22 bp, Homo sapiens
taaggacattagaaatgatgct

SEQ ID NO: 9102920 - DNA, 22 bp, Homo sapiens
taatataccaaactgtaatttt

SEQ ID NO: 9102921 - DNA, 22 bp, Homo sapiens
taatatacttcccatagtttga

SEQ ID NO: 9102922 - DNA, 22 bp, Homo sapiens
taatatacttcccatagtttga

SEQ ID NO: 9102923 - DNA, 22 bp, Homo sapiens
taatagtttcataatgtgcttc

SEQ ID NO: 9102924 - DNA, 19 bp, Homo sapiens
taatatacagacccatctg

SEQ ID NO: 9102925 - DNA, 22 bp, Homo sapiens
taatatatacctttgttaggaa

SEQ ID NO: 9102926 - DNA, 21 bp, Homo sapiens
taatataggttcacaactagt

SEQ ID NO: 9102927 - DNA, 22 bp, Homo sapiens
tagaacttaaatatgttttccc

SEQ ID NO: 9102928 - DNA, 22 bp, Homo sapiens
tagaacttgaatgtgaaatcag

SEQ ID NO: 9102929 - DNA, 22 bp, Homo sapiens
tagaactaaagaacaactttga

SEQ ID NO: 9102930 - DNA, 22 bp, Homo sapiens
tagaaatggggaagtagttagg

SEQ ID NO: 9102931 - DNA, 22 bp, Homo sapiens
tagaaatggggaagtagttagg

SEQ ID NO: 9102932 - DNA, 22 bp, Homo sapiens
tagaaatggggaagtagttagg

SEQ ID NO: 9102933 - DNA, 22 bp, Homo sapiens
tagaaatggggaagtagttagg

SEQ ID NO: 9102934 - DNA, 22 bp, Homo sapiens
tagaaatgggttacatttagag

SEQ ID NO: 9102935 - DNA, 22 bp, Homo sapiens
tagaaatgggttacatttagag

SEQ ID NO: 9102936 - DNA, 22 bp, Homo sapiens
tagaaatgggttacatttagag

SEQ ID NO: 9102937 - DNA, 22 bp, Homo sapiens
tagaaatgggttacatttagag

SEQ ID NO: 9102938 - DNA, 22 bp, Homo sapiens
tagaacatgctcatgtataaat

SEQ ID NO: 9102939 - DNA, 22 bp, Homo sapiens
tagaacatttgtagcagctgag

SEQ ID NO: 9102940 - DNA, 22 bp, Homo sapiens
tagaacatgtgaaaatatagcc

SEQ ID NO: 9102941 - DNA, 22 bp, Homo sapiens
tagaacatcaggttgaatttgg

SEQ ID NO: 9102942 - DNA, 23 bp, Homo sapiens
tagaacatcggtgtcttggagca

SEQ ID NO: 9102943 - DNA, 22 bp, Homo sapiens
tagaagattctaaagtggagag

SEQ ID NO: 9102944 - DNA, 22 bp, Homo sapiens
tagaagcacagcctgatggaca

SEQ ID NO: 9102945 - DNA, 22 bp, Homo sapiens
tagaagaaagtgaagctgggga

SEQ ID NO: 9102946 - DNA, 22 bp, Homo sapiens
tagaacttgtgaaatatcaatg

SEQ ID NO: 9102947 - DNA, 22 bp, Homo sapiens
tagaagataagacaagtgctgc

SEQ ID NO: 9102948 - DNA, 22 bp, Homo sapiens
tagaagaacatgtcaaactata

SEQ ID NO: 9102949 - DNA, 22 bp, Homo sapiens
tagactatagctcacagtgctt

SEQ ID NO: 9102950 - DNA, 22 bp, Homo sapiens
tagacaggaaacattaggatgg

SEQ ID NO: 9102951 - DNA, 22 bp, Homo sapiens
tagacagatttcttgttagaca

SEQ ID NO: 9102952 - DNA, 22 bp, Homo sapiens
tagacaggagtcaggctagaat

SEQ ID NO: 9102953 - DNA, 22 bp, Homo sapiens
tagaccaggttgaccaggtagg

SEQ ID NO: 9102954 - DNA, 22 bp, Homo sapiens
tagactaaaagtatcagagggc

SEQ ID NO: 9102955 - DNA, 23 bp, Homo sapiens
tagatactgcatataggtggaat

SEQ ID NO: 9102956 - DNA, 22 bp, Homo sapiens
tagatacttataatcttccaag

SEQ ID NO: 9102957 - DNA, 22 bp, Homo sapiens
tagatacttattcgttgtttac

SEQ ID NO: 9102958 - DNA, 22 bp, Homo sapiens
tagatactgcccattgagcaat

SEQ ID NO: 9102959 - DNA, 21 bp, Homo sapiens
tagatactgtattaaacctag

SEQ ID NO: 9102960 - DNA, 22 bp, Homo sapiens
tagatactgttcaatgatgata

SEQ ID NO: 9102961 - DNA, 22 bp, Homo sapiens
tagatactcagaaatgctttca

SEQ ID NO: 9102962 - DNA, 19 bp, Homo sapiens
tagatactgatgaactcca

SEQ ID NO: 9102963 - DNA, 22 bp, Homo sapiens
tagagtctagtgtatacaaagt

SEQ ID NO: 9102964 - DNA, 22 bp, Homo sapiens
tagagtcctgtgtgctctgtgg

SEQ ID NO: 9102965 - DNA, 22 bp, Homo sapiens
tagagtccttcattctgtgcag

SEQ ID NO: 9102966 - DNA, 22 bp, Homo sapiens
tagatacatttttctttcctgt

SEQ ID NO: 9102967 - DNA, 22 bp, Homo sapiens
tagagacaccagtaccattctg

SEQ ID NO: 9102968 - DNA, 22 bp, Homo sapiens
tagagacaccagtaccattctg

SEQ ID NO: 9102969 - DNA, 22 bp, Homo sapiens
tagagacaccagtaccattctg

SEQ ID NO: 9102970 - DNA, 22 bp, Homo sapiens
tagagaatggccttgaagtagt

SEQ ID NO: 9102971 - DNA, 22 bp, Homo sapiens
tagagagagatatatacacaca

SEQ ID NO: 9102972 - DNA, 20 bp, Homo sapiens
tagagagaggatattaaagt

SEQ ID NO: 9102973 - DNA, 22 bp, Homo sapiens
tagagaggtttgaattggctgc

SEQ ID NO: 9102974 - DNA, 22 bp, Homo sapiens
tagacttttcaaaatctagacc

SEQ ID NO: 9102975 - DNA, 21 bp, Homo sapiens
tagagaaaagaagctgttcct

SEQ ID NO: 9102976 - DNA, 22 bp, Homo sapiens
tagagaaaagcagggatcagga

SEQ ID NO: 9102977 - DNA, 22 bp, Homo sapiens
tagagaaataagctttgccttg

SEQ ID NO: 9102978 - DNA, 22 bp, Homo sapiens
tagcaacatggttatcacatta

SEQ ID NO: 9102979 - DNA, 22 bp, Homo sapiens
tagcagctcctaaacagtggtg

SEQ ID NO: 9102980 - DNA, 22 bp, Homo sapiens
tagcaagaagctgtcacaggtg

SEQ ID NO: 9102981 - DNA, 22 bp, Homo sapiens
tagcagctctgattctgggccc

SEQ ID NO: 9102982 - DNA, 22 bp, Homo sapiens
tagcagctctttactaaccagt

SEQ ID NO: 9102983 - DNA, 22 bp, Homo sapiens
tagcaacaagtgactatctata

SEQ ID NO: 9102984 - DNA, 22 bp, Homo sapiens
tagcaacaagtgactatctata

SEQ ID NO: 9102985 - DNA, 22 bp, Homo sapiens
tagcaacataagaaacattttg

SEQ ID NO: 9102986 - DNA, 22 bp, Homo sapiens
tagcaacagcaatagtggtatt

SEQ ID NO: 9102987 - DNA, 22 bp, Homo sapiens
tagcaacagcaatagtggtatt

SEQ ID NO: 9102988 - DNA, 22 bp, Homo sapiens
tagcaacagaaaataggagtgc

SEQ ID NO: 9102989 - DNA, 22 bp, Homo sapiens
tagcaacaatggaagtaacttc

SEQ ID NO: 9102990 - DNA, 22 bp, Homo sapiens
tagcaacaccatctggtgagaa

SEQ ID NO: 9102991 - DNA, 22 bp, Homo sapiens
tagcaacagaaaataggagtgc

SEQ ID NO: 9102992 - DNA, 22 bp, Homo sapiens
tagcaaaggccttggacacgct

SEQ ID NO: 9102993 - DNA, 22 bp, Homo sapiens
tagcaaagggaaagaagggcct

SEQ ID NO: 9102994 - DNA, 22 bp, Homo sapiens
tagcaaataaaacagtattgaa

SEQ ID NO: 9102995 - DNA, 23 bp, Homo sapiens
tagcaaagttgtttgggaaattt

SEQ ID NO: 9102996 - DNA, 22 bp, Homo sapiens
tagcaaatacatgatgtaattt

SEQ ID NO: 9102997 - DNA, 21 bp, Homo sapiens
tagcaaatggagagtaagaga

SEQ ID NO: 9102998 - DNA, 22 bp, Homo sapiens
tagatgaaggggttcagcatgg

SEQ ID NO: 9102999 - DNA, 22 bp, Homo sapiens
tagatgaatgacttatatgtca

SEQ ID NO: 9103000 - DNA, 22 bp, Homo sapiens
tagatgaattagcaattatctt

SEQ ID NO: 9103001 - DNA, 21 bp, Homo sapiens
tagatgaaatcagagtatttc

SEQ ID NO: 9103002 - DNA, 22 bp, Homo sapiens
tagatctgatacaattcatctg

SEQ ID NO: 9103003 - DNA, 22 bp, Homo sapiens
tagatctgatacaattcatctg

SEQ ID NO: 9103004 - DNA, 22 bp, Homo sapiens
tagatctgatacaattcatctg

SEQ ID NO: 9103005 - DNA, 22 bp, Homo sapiens
tagcaggcatctcagagataat

SEQ ID NO: 9103006 - DNA, 22 bp, Homo sapiens
tagcaggctcgcaataaaatgt

SEQ ID NO: 9103007 - DNA, 23 bp, Homo sapiens
tagcaggctttcttttctctcac

SEQ ID NO: 9103008 - DNA, 22 bp, Homo sapiens
tagcagctgcatcattttacag

SEQ ID NO: 9103009 - DNA, 19 bp, Homo sapiens
tagcagctgccaaaggaga

SEQ ID NO: 9103010 - DNA, 19 bp, Homo sapiens
tagcagctgccaaaggaga

SEQ ID NO: 9103011 - DNA, 22 bp, Homo sapiens
tagcagctggggctattcatca

SEQ ID NO: 9103012 - DNA, 19 bp, Homo sapiens
tagcagctgccaaaggaga

SEQ ID NO: 9103013 - DNA, 22 bp, Homo sapiens
tagcagctgcatcattttacag

SEQ ID NO: 9103014 - DNA, 22 bp, Homo sapiens
tagcagcttaagtaattagaat

SEQ ID NO: 9103015 - DNA, 22 bp, Homo sapiens
tagcagctgtggaggggctgtg

SEQ ID NO: 9103016 - DNA, 22 bp, Homo sapiens
tagcagctgtcagtttcacata

SEQ ID NO: 9103017 - DNA, 22 bp, Homo sapiens
tagcagctgtgagtaaaagcca

SEQ ID NO: 9103018 - DNA, 22 bp, Homo sapiens
tagcagcttccagagagggcag

SEQ ID NO: 9103019 - DNA, 22 bp, Homo sapiens
tagcagggtccaatgtgaggca

SEQ ID NO: 9103020 - DNA, 22 bp, Homo sapiens
tagcagggtctcaggagtcagg

SEQ ID NO: 9103021 - DNA, 22 bp, Homo sapiens
tagctgccaaaagggtgggcta

SEQ ID NO: 9103022 - DNA, 22 bp, Homo sapiens
tagctgagaggccaattgaact

SEQ ID NO: 9103023 - DNA, 22 bp, Homo sapiens
tagctgagagctcacttgagga

SEQ ID NO: 9103024 - DNA, 17 bp, Homo sapiens
tagctgccccgaatgct

SEQ ID NO: 9103025 - DNA, 22 bp, Homo sapiens
tagctgcccatctttcctttag

SEQ ID NO: 9103026 - DNA, 22 bp, Homo sapiens
tagctgcctagacagctatagc

SEQ ID NO: 9103027 - DNA, 22 bp, Homo sapiens
tagctgccattgctccaggaag

SEQ ID NO: 9103028 - DNA, 22 bp, Homo sapiens
tagctgccagaccattcttact

SEQ ID NO: 9103029 - DNA, 22 bp, Homo sapiens
tagctgcctatgtgataagaga

SEQ ID NO: 9103030 - DNA, 19 bp, Homo sapiens
tagctgcctgttacctcca

SEQ ID NO: 9103031 - DNA, 22 bp, Homo sapiens
tagctgcctttgggctcctgct

SEQ ID NO: 9103032 - DNA, 22 bp, Homo sapiens
tagctggcaaaacattatttct

SEQ ID NO: 9103033 - DNA, 22 bp, Homo sapiens
tagctggcaaaggggaattagg

SEQ ID NO: 9103034 - DNA, 22 bp, Homo sapiens
tagctgcttcagtctaggtctc

SEQ ID NO: 9103035 - DNA, 22 bp, Homo sapiens
tagctgcttctcacatgggcaa

SEQ ID NO: 9103036 - DNA, 22 bp, Homo sapiens
tagctggcatggccctgtggga

SEQ ID NO: 9103037 - DNA, 17 bp, Homo sapiens
tagctggcactggggtt

SEQ ID NO: 9103038 - DNA, 22 bp, Homo sapiens
tagctggccctgggactcccgg

SEQ ID NO: 9103039 - DNA, 22 bp, Homo sapiens
tagctggctaatagtatgaata

SEQ ID NO: 9103040 - DNA, 22 bp, Homo sapiens
tagctgggaattatctggttgc

SEQ ID NO: 9103041 - DNA, 17 bp, Homo sapiens
tagctgtgtttcagcta

SEQ ID NO: 9103042 - DNA, 22 bp, Homo sapiens
tagctgtgtagacactcagagc

SEQ ID NO: 9103043 - DNA, 22 bp, Homo sapiens
tagctgtgtagacactcagagc

SEQ ID NO: 9103044 - DNA, 22 bp, Homo sapiens
tagctgtggccttgctggtctg

SEQ ID NO: 9103045 - DNA, 20 bp, Homo sapiens
taggcagagctgtgcagcct

SEQ ID NO: 9103046 - DNA, 22 bp, Homo sapiens
taggcagagaggccataagaat

SEQ ID NO: 9103047 - DNA, 22 bp, Homo sapiens
tagctgtggagcagaggtctcc

SEQ ID NO: 9103048 - DNA, 22 bp, Homo sapiens
tagctgtgacgtatctctatgg

SEQ ID NO: 9103049 - DNA, 22 bp, Homo sapiens
tagctgtgacgtatctctatgg

SEQ ID NO: 9103050 - DNA, 22 bp, Homo sapiens
tagctgtcagcaatcaagtggt

SEQ ID NO: 9103051 - DNA, 22 bp, Homo sapiens
tagctgtcaccagaaatggcca

SEQ ID NO: 9103052 - DNA, 22 bp, Homo sapiens
tagctgggttgaggtcatctac

SEQ ID NO: 9103053 - DNA, 22 bp, Homo sapiens
tagctggttaatgcagaaggag

SEQ ID NO: 9103054 - DNA, 22 bp, Homo sapiens
tagctgggtctctgttttctca

SEQ ID NO: 9103055 - DNA, 22 bp, Homo sapiens
tagctgggactactggccctgc

SEQ ID NO: 9103056 - DNA, 22 bp, Homo sapiens
tagctggcttatataaaagggc

SEQ ID NO: 9103057 - DNA, 22 bp, Homo sapiens
tagctgggagtgtctgatgggt

SEQ ID NO: 9103058 - DNA, 21 bp, Homo sapiens
taggcagaggagcaggtatct

SEQ ID NO: 9103059 - DNA, 22 bp, Homo sapiens
taggcagcttaggttagaagtg

SEQ ID NO: 9103060 - DNA, 20 bp, Homo sapiens
taggcagcttgacccttggt

SEQ ID NO: 9103061 - DNA, 22 bp, Homo sapiens
taggcagccagcatcagttggg

SEQ ID NO: 9103062 - DNA, 22 bp, Homo sapiens
taggcagctgcaaacttcggtc

SEQ ID NO: 9103063 - DNA, 22 bp, Homo sapiens
taggcagcgcttggctgtgctt

SEQ ID NO: 9103064 - DNA, 22 bp, Homo sapiens
taggcagcgcttggctgtgctt

SEQ ID NO: 9103065 - DNA, 22 bp, Homo sapiens
taggcagcagtgctatgattct

SEQ ID NO: 9103066 - DNA, 22 bp, Homo sapiens
taggcagcatggattctgaata

SEQ ID NO: 9103067 - DNA, 22 bp, Homo sapiens
taggcagattccatattttggc

SEQ ID NO: 9103068 - DNA, 22 bp, Homo sapiens
taggccagtggcaggttgtgtg

SEQ ID NO: 9103069 - DNA, 23 bp, Homo sapiens
taggccagggtgacctggggaga

SEQ ID NO: 9103070 - DNA, 22 bp, Homo sapiens
taggccaggacagagcttccag

SEQ ID NO: 9103071 - DNA, 22 bp, Homo sapiens
taggccagcccttagtcctgtc

SEQ ID NO: 9103072 - DNA, 22 bp, Homo sapiens
taggccagattactagagtagg

SEQ ID NO: 9103073 - DNA, 22 bp, Homo sapiens
taggcccagttccgcctcccgg

SEQ ID NO: 9103074 - DNA, 22 bp, Homo sapiens
tagggcagagtccaggatgggc

SEQ ID NO: 9103075 - DNA, 22 bp, Homo sapiens
tagggcttcaggtgtgaggcag

SEQ ID NO: 9103076 - DNA, 22 bp, Homo sapiens
taggggaggggatcatgtgctg

SEQ ID NO: 9103077 - DNA, 22 bp, Homo sapiens
taggggcagaagcggcggtcca

SEQ ID NO: 9103078 - DNA, 21 bp, Homo sapiens
tagggggcagtgggatgctta

SEQ ID NO: 9103079 - DNA, 22 bp, Homo sapiens
tagtgcagaggaggagcctctg

SEQ ID NO: 9103080 - DNA, 22 bp, Homo sapiens
tagtgcaattccccatactaac

SEQ ID NO: 9103081 - DNA, 22 bp, Homo sapiens
tagtgcaatctcttcctcagca

SEQ ID NO: 9103082 - DNA, 22 bp, Homo sapiens
tagtgcaatgtgaggcagtacc

SEQ ID NO: 9103083 - DNA, 22 bp, Homo sapiens
tagtgcatacctaacatttttg

SEQ ID NO: 9103084 - DNA, 22 bp, Homo sapiens
tagtgcaaaggtcttgcaccag

SEQ ID NO: 9103085 - DNA, 22 bp, Homo sapiens
tagtgcaaaggccctgagatgg

SEQ ID NO: 9103086 - DNA, 22 bp, Homo sapiens
tagtgcaacagggaaagagtgt

SEQ ID NO: 9103087 - DNA, 22 bp, Homo sapiens
tagtgcaaggttttgccaactt

SEQ ID NO: 9103088 - DNA, 22 bp, Homo sapiens
tagtgcaaggattgctgcagag

SEQ ID NO: 9103089 - DNA, 19 bp, Homo sapiens
tagtctctgatgaggcttt

SEQ ID NO: 9103090 - DNA, 22 bp, Homo sapiens
tagtggaggggatgcaaagctt

SEQ ID NO: 9103091 - DNA, 22 bp, Homo sapiens
tagtggaactgtgtcatacaaa

SEQ ID NO: 9103092 - DNA, 22 bp, Homo sapiens
tagtggagaagtggagtctgtg

SEQ ID NO: 9103093 - DNA, 22 bp, Homo sapiens
tagttacaattatgcatggaaa

SEQ ID NO: 9103094 - DNA, 22 bp, Homo sapiens
tagttacaaaccaacaggcagc

SEQ ID NO: 9103095 - DNA, 22 bp, Homo sapiens
tagttacagagaaatgatttga

SEQ ID NO: 9103096 - DNA, 18 bp, Homo sapiens
tagtggaactgctctggg

SEQ ID NO: 9103097 - DNA, 22 bp, Homo sapiens
tagtgccaccttccaagtatca

SEQ ID NO: 9103098 - DNA, 22 bp, Homo sapiens
tagtgccattcaagaggtagtt

SEQ ID NO: 9103099 - DNA, 22 bp, Homo sapiens
tagttttgattagtattgtctt

SEQ ID NO: 9103100 - DNA, 22 bp, Homo sapiens
tagtttttaagtgtacaatttc

SEQ ID NO: 9103101 - DNA, 22 bp, Homo sapiens
tagtttttaagtgtacaatttc

SEQ ID NO: 9103102 - DNA, 22 bp, Homo sapiens
tagtttttaagtgtacaatttc

SEQ ID NO: 9103103 - DNA, 22 bp, Homo sapiens
tagttttatgaattggtataat

SEQ ID NO: 9103104 - DNA, 22 bp, Homo sapiens
tagtttcatctccaccctgccc

SEQ ID NO: 9103105 - DNA, 22 bp, Homo sapiens
tagtttcatctccaccctgccc

SEQ ID NO: 9103106 - DNA, 22 bp, Homo sapiens
tagtttcatatgcaaaatagta

SEQ ID NO: 9103107 - DNA, 22 bp, Homo sapiens
tagtttaggatcttttttgtgc

SEQ ID NO: 9103108 - DNA, 22 bp, Homo sapiens
tagtttaggatccaatctaaga

SEQ ID NO: 9103109 - DNA, 22 bp, Homo sapiens
tagtttagcttagccttctggt

SEQ ID NO: 9103110 - DNA, 22 bp, Homo sapiens
tagtttaggaacaagtagtgga

SEQ ID NO: 9103111 - DNA, 22 bp, Homo sapiens
tagtttaggaattatgagggtg

SEQ ID NO: 9103112 - DNA, 22 bp, Homo sapiens
tagtttagtaagaggagagctg

SEQ ID NO: 9103113 - DNA, 22 bp, Homo sapiens
tagtttagtaagaggagagctg

SEQ ID NO: 9103114 - DNA, 22 bp, Homo sapiens
tagtttagtgaatggttaaaga

SEQ ID NO: 9103115 - DNA, 22 bp, Homo sapiens
tagtttaggtggggtagacaga

SEQ ID NO: 9103116 - DNA, 22 bp, Homo sapiens
tagtttaggtcgtacaagcaaa

SEQ ID NO: 9103117 - DNA, 22 bp, Homo sapiens
tagtttaggtcgtacaagcaaa

SEQ ID NO: 9103118 - DNA, 22 bp, Homo sapiens
tagttctactcaaagtgtgatc

SEQ ID NO: 9103119 - DNA, 22 bp, Homo sapiens
tagttctacagatggtttgtaa

SEQ ID NO: 9103120 - DNA, 22 bp, Homo sapiens
tagttctactcaaagtgtgatc

SEQ ID NO: 9103121 - DNA, 21 bp, Homo sapiens
tagttctacttcagtctcatg

SEQ ID NO: 9103122 - DNA, 22 bp, Homo sapiens
tagttctataagcagatagagt

SEQ ID NO: 9103123 - DNA, 22 bp, Homo sapiens
tagttcacccctctttattttc

SEQ ID NO: 9103124 - DNA, 22 bp, Homo sapiens
tagttcacccctctttattttc

SEQ ID NO: 9103125 - DNA, 22 bp, Homo sapiens
tagttcaaccgtcttctcccct

SEQ ID NO: 9103126 - DNA, 22 bp, Homo sapiens
tagttacagcaggcaggatata

SEQ ID NO: 9103127 - DNA, 22 bp, Homo sapiens
tagttacaggagtttctgaaat

SEQ ID NO: 9103128 - DNA, 22 bp, Homo sapiens
tagttacagtgcatagcaagat

SEQ ID NO: 9103129 - DNA, 22 bp, Homo sapiens
tagttacagtgcatagcaagat

SEQ ID NO: 9103130 - DNA, 22 bp, Homo sapiens
tagttacaggagtttctgaaat

SEQ ID NO: 9103131 - DNA, 22 bp, Homo sapiens
tagttgaagagatgaatgacca

SEQ ID NO: 9103132 - DNA, 22 bp, Homo sapiens
tagttgacatcatcagcctgga

SEQ ID NO: 9103133 - DNA, 22 bp, Homo sapiens
tagttcttggttcttagttctt

SEQ ID NO: 9103134 - DNA, 22 bp, Homo sapiens
tagttctagaccagttaatagt

SEQ ID NO: 9103135 - DNA, 22 bp, Homo sapiens
tagtttactcatctataaaatg

SEQ ID NO: 9103136 - DNA, 22 bp, Homo sapiens
tagtttaatggtcaactaatga

SEQ ID NO: 9103137 - DNA, 22 bp, Homo sapiens
tagtttagcactaagaaaaaca

SEQ ID NO: 9103138 - DNA, 22 bp, Homo sapiens
tagtttagcactaagaaaaaca

SEQ ID NO: 9103139 - DNA, 22 bp, Homo sapiens
tagtttagagaattggggatga

SEQ ID NO: 9103140 - DNA, 22 bp, Homo sapiens
tagtttagcatacatcttcagg

SEQ ID NO: 9103141 - DNA, 22 bp, Homo sapiens
tagtttagccatttaggaattg

SEQ ID NO: 9103142 - DNA, 22 bp, Homo sapiens
tagtttagccccacgtgtgctt

SEQ ID NO: 9103143 - DNA, 22 bp, Homo sapiens
tagtttactgttcactttgccc

SEQ ID NO: 9103144 - DNA, 22 bp, Homo sapiens
tagtttagaatgttgcaataca

SEQ ID NO: 9103145 - DNA, 22 bp, Homo sapiens
tagtttagacttcaaccctttg

SEQ ID NO: 9103146 - DNA, 22 bp, Homo sapiens
tatgaaaaggtggccaatgtag

SEQ ID NO: 9103147 - DNA, 22 bp, Homo sapiens
tatgaaaatttagctgaagcat

SEQ ID NO: 9103148 - DNA, 22 bp, Homo sapiens
tatcttttgagttctcaagatg

SEQ ID NO: 9103149 - DNA, 18 bp, Homo sapiens
tatcttttccagtggtat

SEQ ID NO: 9103150 - DNA, 22 bp, Homo sapiens
tatcttttgagttctcaagatg

SEQ ID NO: 9103151 - DNA, 23 bp, Homo sapiens
tatctttttcaatgttggaaata

SEQ ID NO: 9103152 - DNA, 23 bp, Homo sapiens
tatctttttcaatgttggaaata

SEQ ID NO: 9103153 - DNA, 22 bp, Homo sapiens
tatccaaaggaacaatcacagc

SEQ ID NO: 9103154 - DNA, 22 bp, Homo sapiens
tatccaaagagattcatgttct

SEQ ID NO: 9103155 - DNA, 22 bp, Homo sapiens
tatcattttactgtgacatttt

SEQ ID NO: 9103156 - DNA, 22 bp, Homo sapiens
tatcattttactgtgacatttt

SEQ ID NO: 9103157 - DNA, 22 bp, Homo sapiens
tatcatttagagtatttcttca

SEQ ID NO: 9103158 - DNA, 22 bp, Homo sapiens
tatcatttgttattattagtgg

SEQ ID NO: 9103159 - DNA, 22 bp, Homo sapiens
tatcatttagagtatttcttca

SEQ ID NO: 9103160 - DNA, 22 bp, Homo sapiens
tatcatttgttattattagtgg

SEQ ID NO: 9103161 - DNA, 22 bp, Homo sapiens
tatcatttgttattattagtgg

SEQ ID NO: 9103162 - DNA, 22 bp, Homo sapiens
tatgacaaggtggagtatgagt

SEQ ID NO: 9103163 - DNA, 22 bp, Homo sapiens
tatgacaagaaatacagaggta

SEQ ID NO: 9103164 - DNA, 22 bp, Homo sapiens
tatgacaaatgatatatttggc

SEQ ID NO: 9103165 - DNA, 22 bp, Homo sapiens
tatgacaaatgatatatttggc

SEQ ID NO: 9103166 - DNA, 22 bp, Homo sapiens
tatgaatgctccagtaactttc

SEQ ID NO: 9103167 - DNA, 22 bp, Homo sapiens
tatgaatataccacaatttagg

SEQ ID NO: 9103168 - DNA, 22 bp, Homo sapiens
tatgaatataccacaatttagg

SEQ ID NO: 9103169 - DNA, 22 bp, Homo sapiens
tatgaagattgcggtctggaat

SEQ ID NO: 9103170 - DNA, 22 bp, Homo sapiens
tatgaagctttgaaaagcttac

SEQ ID NO: 9103171 - DNA, 22 bp, Homo sapiens
tatgaaatttctagttctgctt

SEQ ID NO: 9103172 - DNA, 22 bp, Homo sapiens
tatgaaatttaaacacagatca

SEQ ID NO: 9103173 - DNA, 22 bp, Homo sapiens
tatgaaattgccatttttatgg

SEQ ID NO: 9103174 - DNA, 22 bp, Homo sapiens
tataaagagtctcaaagaagtt

SEQ ID NO: 9103175 - DNA, 22 bp, Homo sapiens
tataaagagtctcaaagaagtt

SEQ ID NO: 9103176 - DNA, 22 bp, Homo sapiens
tataaagctgactcatgaaact

SEQ ID NO: 9103177 - DNA, 22 bp, Homo sapiens
tataaaatggcatcagctccaa

SEQ ID NO: 9103178 - DNA, 22 bp, Homo sapiens
tataaaattctcagtttggggt

SEQ ID NO: 9103179 - DNA, 22 bp, Homo sapiens
tataaagaaggcacagcaagac

SEQ ID NO: 9103180 - DNA, 22 bp, Homo sapiens
tataaagaaatgatttccagaa

SEQ ID NO: 9103181 - DNA, 22 bp, Homo sapiens
tataaactatatgttagccaga

SEQ ID NO: 9103182 - DNA, 21 bp, Homo sapiens
tatcagaagagaaagaatgat

SEQ ID NO: 9103183 - DNA, 21 bp, Homo sapiens
tatcagactcctagtaaccac

SEQ ID NO: 9103184 - DNA, 22 bp, Homo sapiens
tatcagcaccgcggacagcatc

SEQ ID NO: 9103185 - DNA, 22 bp, Homo sapiens
tatcagcaccgcggacagcatc

SEQ ID NO: 9103186 - DNA, 22 bp, Homo sapiens
tatcagcaccgcggacagcatc

SEQ ID NO: 9103187 - DNA, 22 bp, Homo sapiens
tatcagcaggccaaagctgcaa

SEQ ID NO: 9103188 - DNA, 22 bp, Homo sapiens
tatcagcatatttactttcttg

SEQ ID NO: 9103189 - DNA, 19 bp, Homo sapiens
tatcactgggcactgagga

SEQ ID NO: 9103190 - DNA, 22 bp, Homo sapiens
tatcactgacctgtatcagttg

SEQ ID NO: 9103191 - DNA, 22 bp, Homo sapiens
tatggcttctgggccaaattta

SEQ ID NO: 9103192 - DNA, 22 bp, Homo sapiens
tatggcttcttttgcaactact

SEQ ID NO: 9103193 - DNA, 22 bp, Homo sapiens
tatggcttgagtttcagactat

SEQ ID NO: 9103194 - DNA, 22 bp, Homo sapiens
tatggaaagctctttttgattg

SEQ ID NO: 9103195 - DNA, 22 bp, Homo sapiens
tatggaaagtgttttcttctgt

SEQ ID NO: 9103196 - DNA, 22 bp, Homo sapiens
tatggaaagggagtttaatttg

SEQ ID NO: 9103197 - DNA, 22 bp, Homo sapiens
tatggaaaaatgtatcttgtca

SEQ ID NO: 9103198 - DNA, 22 bp, Homo sapiens
tatggaaactaattcatttttc

SEQ ID NO: 9103199 - DNA, 22 bp, Homo sapiens
tatgcttttaacctgtaactga

SEQ ID NO: 9103200 - DNA, 22 bp, Homo sapiens
tatgtactacactagaacattt

SEQ ID NO: 9103201 - DNA, 22 bp, Homo sapiens
tatgtacatatacacgtgtgtg

SEQ ID NO: 9103202 - DNA, 22 bp, Homo sapiens
tatgtacatacatgtgcatacg

SEQ ID NO: 9103203 - DNA, 22 bp, Homo sapiens
tatgtacatacatgtgcatacg

SEQ ID NO: 9103204 - DNA, 22 bp, Homo sapiens
tatggtcagaccaaactgttct

SEQ ID NO: 9103205 - DNA, 22 bp, Homo sapiens
tatggtaaatgagcatatgttc

SEQ ID NO: 9103206 - DNA, 22 bp, Homo sapiens
tatggctttttattcatcttac

SEQ ID NO: 9103207 - DNA, 22 bp, Homo sapiens
tatggcttttctttcctagtgt

SEQ ID NO: 9103208 - DNA, 22 bp, Homo sapiens
tatggcttttcattcctatgtg

SEQ ID NO: 9103209 - DNA, 22 bp, Homo sapiens
tatggctttcaaaggaactcgg

SEQ ID NO: 9103210 - DNA, 22 bp, Homo sapiens
tatgtattctgagtacaagttc

SEQ ID NO: 9103211 - DNA, 22 bp, Homo sapiens
tatgtattctcagatttactaa

SEQ ID NO: 9103212 - DNA, 22 bp, Homo sapiens
tatgtattctcagatttactaa

SEQ ID NO: 9103213 - DNA, 22 bp, Homo sapiens
tatgtatagagtcttttaaatt

SEQ ID NO: 9103214 - DNA, 22 bp, Homo sapiens
tattaacacgtataaagtgttt

SEQ ID NO: 9103215 - DNA, 22 bp, Homo sapiens
tattaaattatggatttaggag

SEQ ID NO: 9103216 - DNA, 21 bp, Homo sapiens
tattaatatgtctaagctgat

SEQ ID NO: 9103217 - DNA, 22 bp, Homo sapiens
tattaattcttgccaattctcc

SEQ ID NO: 9103218 - DNA, 22 bp, Homo sapiens
tattaattcttgccaattctcc

SEQ ID NO: 9103219 - DNA, 22 bp, Homo sapiens
tattaagagatgtatgaagaga

SEQ ID NO: 9103220 - DNA, 22 bp, Homo sapiens
tattaagagatgtatgaagaga

SEQ ID NO: 9103221 - DNA, 22 bp, Homo sapiens
tattaagtatcttgatgacaaa

SEQ ID NO: 9103222 - DNA, 22 bp, Homo sapiens
tattaacattttatgaaaataa

SEQ ID NO: 9103223 - DNA, 22 bp, Homo sapiens
tcaaatcccagctcagcctctc

SEQ ID NO: 9103224 - DNA, 22 bp, Homo sapiens
tcaaatctcactctgcatttct

SEQ ID NO: 9103225 - DNA, 17 bp, Homo sapiens
tcaaatcctctgtctgg

SEQ ID NO: 9103226 - DNA, 22 bp, Homo sapiens
tcaaatcagcaagcagcttccc

SEQ ID NO: 9103227 - DNA, 22 bp, Homo sapiens
tcaaatcaccaaactcactggc

SEQ ID NO: 9103228 - DNA, 22 bp, Homo sapiens
tcaaatacatggtcaatcaact

SEQ ID NO: 9103229 - DNA, 22 bp, Homo sapiens
tcaaatacatggtcaatcaact

SEQ ID NO: 9103230 - DNA, 22 bp, Homo sapiens
tcaaataccagcaatttcatgt

SEQ ID NO: 9103231 - DNA, 22 bp, Homo sapiens
tcaaatatgtgatagaagctaa

SEQ ID NO: 9103232 - DNA, 22 bp, Homo sapiens
tcaaatatgtgatagaagctaa

SEQ ID NO: 9103233 - DNA, 22 bp, Homo sapiens
tcaaataccagcttttccagaa

SEQ ID NO: 9103234 - DNA, 22 bp, Homo sapiens
tcaaagggtccttaacatgaga

SEQ ID NO: 9103235 - DNA, 22 bp, Homo sapiens
tcaaagggtagcccagggaaga

SEQ ID NO: 9103236 - DNA, 22 bp, Homo sapiens
tcaaagggtaatgtaatagtct

SEQ ID NO: 9103237 - DNA, 22 bp, Homo sapiens
tcaaataatgccattcatcatc

SEQ ID NO: 9103238 - DNA, 22 bp, Homo sapiens
tattttgaggtatttttgagct

SEQ ID NO: 9103239 - DNA, 22 bp, Homo sapiens
tattttgagcccctgacatcta

SEQ ID NO: 9103240 - DNA, 22 bp, Homo sapiens
tattttgcaaacctgagtttga

SEQ ID NO: 9103241 - DNA, 22 bp, Homo sapiens
tattttgcaaacctgagtttga

SEQ ID NO: 9103242 - DNA, 22 bp, Homo sapiens
tattttgctttagctgactgtt

SEQ ID NO: 9103243 - DNA, 20 bp, Homo sapiens
tattttgcaattatggttca

SEQ ID NO: 9103244 - DNA, 22 bp, Homo sapiens
tattttggctgattcatcatgt

SEQ ID NO: 9103245 - DNA, 22 bp, Homo sapiens
tattttgtaattggtcatagct

SEQ ID NO: 9103246 - DNA, 22 bp, Homo sapiens
tatttttgcctctcagataaaa

SEQ ID NO: 9103247 - DNA, 22 bp, Homo sapiens
tatttttgcctctcagataaaa

SEQ ID NO: 9103248 - DNA, 22 bp, Homo sapiens
tatttttgcctctcagataaaa

SEQ ID NO: 9103249 - DNA, 22 bp, Homo sapiens
tcaaaaataagatattctggac

SEQ ID NO: 9103250 - DNA, 22 bp, Homo sapiens
tattttgttttgtatccactgt

SEQ ID NO: 9103251 - DNA, 22 bp, Homo sapiens
tattttgtgccatgcactgcct

SEQ ID NO: 9103252 - DNA, 22 bp, Homo sapiens
tcaaactgtttacagtgagata

SEQ ID NO: 9103253 - DNA, 22 bp, Homo sapiens
tcaaactgttcagaactccttt

SEQ ID NO: 9103254 - DNA, 22 bp, Homo sapiens
tcaaactgttagatttcagctc

SEQ ID NO: 9103255 - DNA, 23 bp, Homo sapiens
tcaaactgttatattgccagagt

SEQ ID NO: 9103256 - DNA, 22 bp, Homo sapiens
tcaaaaatggtctttgagctgc

SEQ ID NO: 9103257 - DNA, 22 bp, Homo sapiens
tcaaactgaactaagatccaac

SEQ ID NO: 9103258 - DNA, 22 bp, Homo sapiens
tcaaactgaactaagatccaac

SEQ ID NO: 9103259 - DNA, 22 bp, Homo sapiens
tcaaactgaattaaacacttgt

SEQ ID NO: 9103260 - DNA, 22 bp, Homo sapiens
tcaaactgctaccttttatgtg

SEQ ID NO: 9103261 - DNA, 22 bp, Homo sapiens
tcaaactgaattaaacacttgt

SEQ ID NO: 9103262 - DNA, 18 bp, Homo sapiens
tcaaactgtcattggtga

SEQ ID NO: 9103263 - DNA, 22 bp, Homo sapiens
tcaaactggggaacttatttat

SEQ ID NO: 9103264 - DNA, 22 bp, Homo sapiens
tcaaactggcagacttctactt

SEQ ID NO: 9103265 - DNA, 20 bp, Homo sapiens
tcaaagaagattcagctcaa

SEQ ID NO: 9103266 - DNA, 22 bp, Homo sapiens
tcaaagagctattcagttgtgg

SEQ ID NO: 9103267 - DNA, 19 bp, Homo sapiens
tcaaagcaagcatgttctg

SEQ ID NO: 9103268 - DNA, 20 bp, Homo sapiens
tcaaagcaaagggagatgat

SEQ ID NO: 9103269 - DNA, 20 bp, Homo sapiens
tcaaagcaaagggagatgat

SEQ ID NO: 9103270 - DNA, 20 bp, Homo sapiens
tcaaagcaaagggagatgat

SEQ ID NO: 9103271 - DNA, 20 bp, Homo sapiens
tcaaagcaaagggagatgat

SEQ ID NO: 9103272 - DNA, 22 bp, Homo sapiens
tcaaagatgataggaaatcata

SEQ ID NO: 9103273 - DNA, 22 bp, Homo sapiens
tattgtgtttgcaagtcctatt

SEQ ID NO: 9103274 - DNA, 22 bp, Homo sapiens
tattgtttctggctgtggcagc

SEQ ID NO: 9103275 - DNA, 22 bp, Homo sapiens
tattgtgagtataactgcattt

SEQ ID NO: 9103276 - DNA, 22 bp, Homo sapiens
tattgtgaagggaaaaatagtg

SEQ ID NO: 9103277 - DNA, 22 bp, Homo sapiens
tatttaaccagttaaatttcca

SEQ ID NO: 9103278 - DNA, 22 bp, Homo sapiens
tatttaataaaactatggcatg

SEQ ID NO: 9103279 - DNA, 22 bp, Homo sapiens
tattgtattaaggattcaagta

SEQ ID NO: 9103280 - DNA, 22 bp, Homo sapiens
tattacaatttacattgcactt

SEQ ID NO: 9103281 - DNA, 22 bp, Homo sapiens
tattacaatttacattgcactt

SEQ ID NO: 9103282 - DNA, 22 bp, Homo sapiens
tattgtctcacagttttggagg

SEQ ID NO: 9103283 - DNA, 22 bp, Homo sapiens
tattgtctgcaaaggtttataa

SEQ ID NO: 9103284 - DNA, 22 bp, Homo sapiens
tattgtcacgtcttaattctag

SEQ ID NO: 9103285 - DNA, 22 bp, Homo sapiens
tattacaaattataatgggaga

SEQ ID NO: 9103286 - DNA, 22 bp, Homo sapiens
tattacaaattataatgggaga

SEQ ID NO: 9103287 - DNA, 22 bp, Homo sapiens
tattacaagaaagggcatgaat

SEQ ID NO: 9103288 - DNA, 22 bp, Homo sapiens
tattacaagaaagggcatgaat

SEQ ID NO: 9103289 - DNA, 22 bp, Homo sapiens
tattacaatttacattgcactt

SEQ ID NO: 9103290 - DNA, 23 bp, Homo sapiens
tattacaattggtcttattaaga

SEQ ID NO: 9103291 - DNA, 22 bp, Homo sapiens
tatttgatagagataaatgata

SEQ ID NO: 9103292 - DNA, 22 bp, Homo sapiens
tatttgcaacataaaactctga

SEQ ID NO: 9103293 - DNA, 22 bp, Homo sapiens
tatttgctcaataatagtttta

SEQ ID NO: 9103294 - DNA, 22 bp, Homo sapiens
tatttgcaggcttttgtcatgg

SEQ ID NO: 9103295 - DNA, 22 bp, Homo sapiens
tatttgcaggacatagatatgg

SEQ ID NO: 9103296 - DNA, 22 bp, Homo sapiens
tatttgcaggcttttgtcatgg

SEQ ID NO: 9103297 - DNA, 22 bp, Homo sapiens
tatttgcaggacatagatatgg

SEQ ID NO: 9103298 - DNA, 22 bp, Homo sapiens
tatttgaataaaggataaggaa

SEQ ID NO: 9103299 - DNA, 22 bp, Homo sapiens
tatttgaagggagaaagtgcca

SEQ ID NO: 9103300 - DNA, 22 bp, Homo sapiens
tatttgaagggagaaagtgcca

SEQ ID NO: 9103301 - DNA, 22 bp, Homo sapiens
tatttcttgttattctcgttga

SEQ ID NO: 9103302 - DNA, 22 bp, Homo sapiens
tatttcttgttattctcgttga

SEQ ID NO: 9103303 - DNA, 22 bp, Homo sapiens
tatttaattagtgattgtagag

SEQ ID NO: 9103304 - DNA, 22 bp, Homo sapiens
tatttgctttgctttatagaga

SEQ ID NO: 9103305 - DNA, 22 bp, Homo sapiens
tattttgaaagtctgttttgaa

SEQ ID NO: 9103306 - DNA, 22 bp, Homo sapiens
tattttctgtggaggaccagat

SEQ ID NO: 9103307 - DNA, 22 bp, Homo sapiens
tattttctggggagagtgaacc

SEQ ID NO: 9103308 - DNA, 22 bp, Homo sapiens
tattttctggggagagtgaacc

SEQ ID NO: 9103309 - DNA, 22 bp, Homo sapiens
tattttctgtggaggaccagat

SEQ ID NO: 9103310 - DNA, 22 bp, Homo sapiens
tattttctggggagagtgaacc

SEQ ID NO: 9103311 - DNA, 22 bp, Homo sapiens
tattttctggacagtcttgctt

SEQ ID NO: 9103312 - DNA, 22 bp, Homo sapiens
tattttctggacagtcttgctt

SEQ ID NO: 9103313 - DNA, 22 bp, Homo sapiens
gggagccactcagctgagagtt

SEQ ID NO: 9103314 - DNA, 19 bp, Homo sapiens
gggagccagaccctttgct

SEQ ID NO: 9103315 - DNA, 22 bp, Homo sapiens
gggagccagcagggcatggagc

SEQ ID NO: 9103316 - DNA, 23 bp, Homo sapiens
gggagccatgggtggtcatggag

SEQ ID NO: 9103317 - DNA, 23 bp, Homo sapiens
gggagccaggacctcgcgcccca

SEQ ID NO: 9103318 - DNA, 22 bp, Homo sapiens
gggagccacagtagcagctact

SEQ ID NO: 9103319 - DNA, 22 bp, Homo sapiens
gggagccacagtgaggtgcatg

SEQ ID NO: 9103320 - DNA, 22 bp, Homo sapiens
gggaaggccggtccagtcaggt

SEQ ID NO: 9103321 - DNA, 22 bp, Homo sapiens
gggaaggcaggcctctgttgga

SEQ ID NO: 9103322 - DNA, 22 bp, Homo sapiens
gggaaggcaggattctctggtg

SEQ ID NO: 9103323 - DNA, 22 bp, Homo sapiens
gggaaggcaccatggtgttcca

SEQ ID NO: 9103324 - DNA, 22 bp, Homo sapiens
gggaaggcatacctgagggaga

SEQ ID NO: 9103325 - DNA, 22 bp, Homo sapiens
gggaaggcatacctgagggaga

SEQ ID NO: 9103326 - DNA, 22 bp, Homo sapiens
gggaaggcagtgggaggaactg

SEQ ID NO: 9103327 - DNA, 22 bp, Homo sapiens
gggaaggcagtgggaggaactg

SEQ ID NO: 9103328 - DNA, 22 bp, Homo sapiens
gggaaggcagtgggaggaactg

SEQ ID NO: 9103329 - DNA, 22 bp, Homo sapiens
gggaaggcagtgtctggttgaa

SEQ ID NO: 9103330 - DNA, 22 bp, Homo sapiens
gggaagatagtgttgagggccc

SEQ ID NO: 9103331 - DNA, 22 bp, Homo sapiens
gggaagatagtgttgagggccc

SEQ ID NO: 9103332 - DNA, 22 bp, Homo sapiens
gggaagatagtgttgagggccc

SEQ ID NO: 9103333 - DNA, 22 bp, Homo sapiens
gggaagatagtgttgagggccc

SEQ ID NO: 9103334 - DNA, 22 bp, Homo sapiens
gggaagcaggtgcagctcgcct

SEQ ID NO: 9103335 - DNA, 22 bp, Homo sapiens
gggaagcagatcataccagacc

SEQ ID NO: 9103336 - DNA, 22 bp, Homo sapiens
gggaagagtaactagcccatgt

SEQ ID NO: 9103337 - DNA, 22 bp, Homo sapiens
gggaagagtaactagcccatgt

SEQ ID NO: 9103338 - DNA, 22 bp, Homo sapiens
gggaagagtaactagcccatgt

SEQ ID NO: 9103339 - DNA, 22 bp, Homo sapiens
gggaagagtaactagcccatgt

SEQ ID NO: 9103340 - DNA, 22 bp, Homo sapiens
ggctgtggcattaggtgaggcc

SEQ ID NO: 9103341 - DNA, 22 bp, Homo sapiens
ggctgtggcattaggtgaggcc

SEQ ID NO: 9103342 - DNA, 22 bp, Homo sapiens
ggctgtggcagctggaagtggt

SEQ ID NO: 9103343 - DNA, 21 bp, Homo sapiens
ggctgtggagccatgactcac

SEQ ID NO: 9103344 - DNA, 18 bp, Homo sapiens
ggctgtgcgtggaggctg

SEQ ID NO: 9103345 - DNA, 22 bp, Homo sapiens
ggctgtgcgggcagccgtggga

SEQ ID NO: 9103346 - DNA, 22 bp, Homo sapiens
ggctggccagggccctcgctgg

SEQ ID NO: 9103347 - DNA, 22 bp, Homo sapiens
gggaagagggagctggaatgat

SEQ ID NO: 9103348 - DNA, 22 bp, Homo sapiens
ggctgtggtcattaggaggttg

SEQ ID NO: 9103349 - DNA, 22 bp, Homo sapiens
ggctgtggtctgggtgctcccc

SEQ ID NO: 9103350 - DNA, 22 bp, Homo sapiens
ggctgtggtctgggtgctcccc

SEQ ID NO: 9103351 - DNA, 22 bp, Homo sapiens
ggctgtggtctcatctagcctt

SEQ ID NO: 9103352 - DNA, 22 bp, Homo sapiens
ggctgtggggccgggtacagtg

SEQ ID NO: 9103353 - DNA, 22 bp, Homo sapiens
ggctgtggccagcggggctgag

SEQ ID NO: 9103354 - DNA, 22 bp, Homo sapiens
ggctgtggccagcggggctgag

SEQ ID NO: 9103355 - DNA, 22 bp, Homo sapiens
ggctgcctctggaagctggaga

SEQ ID NO: 9103356 - DNA, 22 bp, Homo sapiens
ggctgcctctgatgtgcagacg

SEQ ID NO: 9103357 - DNA, 22 bp, Homo sapiens
ggctgcctgaggcagtgagaga

SEQ ID NO: 9103358 - DNA, 22 bp, Homo sapiens
ggctggagacaacgtcctgccc

SEQ ID NO: 9103359 - DNA, 22 bp, Homo sapiens
ggctggagatatgtctggaaca

SEQ ID NO: 9103360 - DNA, 17 bp, Homo sapiens
ggctggagcagctcccc

SEQ ID NO: 9103361 - DNA, 17 bp, Homo sapiens
ggctggagcagctcccc

SEQ ID NO: 9103362 - DNA, 17 bp, Homo sapiens
ggctggagcagctcccc

SEQ ID NO: 9103363 - DNA, 22 bp, Homo sapiens
ggctggcatttacacaatgcat

SEQ ID NO: 9103364 - DNA, 19 bp, Homo sapiens
ggctggagtggccatctgt

SEQ ID NO: 9103365 - DNA, 19 bp, Homo sapiens
ggctggagtggccatctgt

SEQ ID NO: 9103366 - DNA, 19 bp, Homo sapiens
ggctggagtggccatctgt

SEQ ID NO: 9103367 - DNA, 22 bp, Homo sapiens
ggctggagtgggctccagagtt

SEQ ID NO: 9103368 - DNA, 22 bp, Homo sapiens
ggctggagtgggctccagagtt

SEQ ID NO: 9103369 - DNA, 22 bp, Homo sapiens
ggctggagtgggctccagagtt

SEQ ID NO: 9103370 - DNA, 22 bp, Homo sapiens
ggctggagtgggctccagagtt

SEQ ID NO: 9103371 - DNA, 17 bp, Homo sapiens
ggctggaggggacccgg

SEQ ID NO: 9103372 - DNA, 17 bp, Homo sapiens
ggctggaggggacccgg

SEQ ID NO: 9103373 - DNA, 22 bp, Homo sapiens
ggctgcagtttgtcttttgctt

SEQ ID NO: 9103374 - DNA, 22 bp, Homo sapiens
ggctgcataggcagaagctgtg

SEQ ID NO: 9103375 - DNA, 22 bp, Homo sapiens
ggctgccaggagaagctcagtg

SEQ ID NO: 9103376 - DNA, 22 bp, Homo sapiens
ggctgccacgtcgagggtccaa

SEQ ID NO: 9103377 - DNA, 22 bp, Homo sapiens
ggctgccagtgagtgcagaccg

SEQ ID NO: 9103378 - DNA, 22 bp, Homo sapiens
ggctgccaggagggaggccagt

SEQ ID NO: 9103379 - DNA, 21 bp, Homo sapiens
ggctgcagggagccctggggt

SEQ ID NO: 9103380 - DNA, 22 bp, Homo sapiens
ggctgcaggcttccctccagca

SEQ ID NO: 9103381 - DNA, 22 bp, Homo sapiens
ggctgcaggcttccctccagca

SEQ ID NO: 9103382 - DNA, 22 bp, Homo sapiens
ggctgcaggcttccctccagca

SEQ ID NO: 9103383 - DNA, 22 bp, Homo sapiens
ggctgcaggcttccctccagca

SEQ ID NO: 9103384 - DNA, 22 bp, Homo sapiens
ggctgcaggcagggtatccact

SEQ ID NO: 9103385 - DNA, 22 bp, Homo sapiens
ggctgcaggttggttggcagct

SEQ ID NO: 9103386 - DNA, 22 bp, Homo sapiens
ggctgcaggttggttggcagct

SEQ ID NO: 9103387 - DNA, 22 bp, Homo sapiens
ggctgcagggcagctggtgtgg

SEQ ID NO: 9103388 - DNA, 22 bp, Homo sapiens
ggctgcaggttggttggcagct

SEQ ID NO: 9103389 - DNA, 17 bp, Homo sapiens
ggctgcagtccaggagg

SEQ ID NO: 9103390 - DNA, 22 bp, Homo sapiens
gggctccaactacatcagcctt

SEQ ID NO: 9103391 - DNA, 22 bp, Homo sapiens
gggctccaactacatcagcctt

SEQ ID NO: 9103392 - DNA, 22 bp, Homo sapiens
gggctccaactacatcagcctt

SEQ ID NO: 9103393 - DNA, 22 bp, Homo sapiens
gggctctgaatcccaggtctgc

SEQ ID NO: 9103394 - DNA, 22 bp, Homo sapiens
gggctccaaggaggccagcctg

SEQ ID NO: 9103395 - DNA, 22 bp, Homo sapiens
gggctccaaaatctatgtcttc

SEQ ID NO: 9103396 - DNA, 22 bp, Homo sapiens
gggctccaaaatctatgtcttc

SEQ ID NO: 9103397 - DNA, 22 bp, Homo sapiens
gggctccaaaatcctgtagcct

SEQ ID NO: 9103398 - DNA, 22 bp, Homo sapiens
gggctccaaaatcctgtagcct

SEQ ID NO: 9103399 - DNA, 22 bp, Homo sapiens
gggctccaaaatctatgtcttc

SEQ ID NO: 9103400 - DNA, 22 bp, Homo sapiens
gggctccaaccccagtgaactc

SEQ ID NO: 9103401 - DNA, 22 bp, Homo sapiens
gggctccaaagtaagctttagt

SEQ ID NO: 9103402 - DNA, 22 bp, Homo sapiens
gggctccaacggtgagcatgga

SEQ ID NO: 9103403 - DNA, 22 bp, Homo sapiens
gggctccaacggtgagcatgga

SEQ ID NO: 9103404 - DNA, 22 bp, Homo sapiens
gggctccaacggtgagcatgga

SEQ ID NO: 9103405 - DNA, 22 bp, Homo sapiens
gggctctggatggagcctgcag

SEQ ID NO: 9103406 - DNA, 22 bp, Homo sapiens
gggctctggagttctagaaaga

SEQ ID NO: 9103407 - DNA, 22 bp, Homo sapiens
gggctctggacccaggcaagag

SEQ ID NO: 9103408 - DNA, 21 bp, Homo sapiens
gggctcagtggaaaagagtgt

SEQ ID NO: 9103409 - DNA, 23 bp, Homo sapiens
gggctcagatttcattctgtgcc

SEQ ID NO: 9103410 - DNA, 22 bp, Homo sapiens
gggccctctgcagctgcccagg

SEQ ID NO: 9103411 - DNA, 22 bp, Homo sapiens
gggccctcagtcccaggccttc

SEQ ID NO: 9103412 - DNA, 22 bp, Homo sapiens
gggccctgccccgtggctctga

SEQ ID NO: 9103413 - DNA, 22 bp, Homo sapiens
gggccctgggattcagagcaag

SEQ ID NO: 9103414 - DNA, 22 bp, Homo sapiens
gggctatagcactatgtatggg

SEQ ID NO: 9103415 - DNA, 22 bp, Homo sapiens
gggctaggtctgatcagagaag

SEQ ID NO: 9103416 - DNA, 22 bp, Homo sapiens
gggccctggggcctgatttgca

SEQ ID NO: 9103417 - DNA, 22 bp, Homo sapiens
gggccggagctgggtcccgcgc

SEQ ID NO: 9103418 - DNA, 22 bp, Homo sapiens
gggcaggtggagggcccagcca

SEQ ID NO: 9103419 - DNA, 22 bp, Homo sapiens
gggcaggtgtgcagagctgttg

SEQ ID NO: 9103420 - DNA, 22 bp, Homo sapiens
gggcaggtgtgcagagctgttg

SEQ ID NO: 9103421 - DNA, 22 bp, Homo sapiens
gggccccttgctgctctgctgg

SEQ ID NO: 9103422 - DNA, 22 bp, Homo sapiens
gggccccttgtatctctggctc

SEQ ID NO: 9103423 - DNA, 22 bp, Homo sapiens
gggccccagtcctcccacgtgg

SEQ ID NO: 9103424 - DNA, 22 bp, Homo sapiens
gggcccctgggaattctgtgat

SEQ ID NO: 9103425 - DNA, 22 bp, Homo sapiens
gggcactgtacactgtgcatgg

SEQ ID NO: 9103426 - DNA, 20 bp, Homo sapiens
gggcagagccagccagtccc

SEQ ID NO: 9103427 - DNA, 20 bp, Homo sapiens
gggcagagccagccagtccc

SEQ ID NO: 9103428 - DNA, 22 bp, Homo sapiens
gggcagagagctggaactcctt

SEQ ID NO: 9103429 - DNA, 17 bp, Homo sapiens
gggcagggactcctggg

SEQ ID NO: 9103430 - DNA, 21 bp, Homo sapiens
gggcagaggggcctcctgggt

SEQ ID NO: 9103431 - DNA, 21 bp, Homo sapiens
gggcagaggggcctcctgggt

SEQ ID NO: 9103432 - DNA, 21 bp, Homo sapiens
gggcagaggggcctcctgggt

SEQ ID NO: 9103433 - DNA, 22 bp, Homo sapiens
gggcagaggctctggcccatcc

SEQ ID NO: 9103434 - DNA, 22 bp, Homo sapiens
gggcaggtctgggtcagcctga

SEQ ID NO: 9103435 - DNA, 17 bp, Homo sapiens
gggcagggactcctggg

SEQ ID NO: 9103436 - DNA, 22 bp, Homo sapiens
gggagtggagagcaatggatga

SEQ ID NO: 9103437 - DNA, 22 bp, Homo sapiens
gggagtccaaattggtacaata

SEQ ID NO: 9103438 - DNA, 22 bp, Homo sapiens
gggagtcagtgaaggagtcaga

SEQ ID NO: 9103439 - DNA, 22 bp, Homo sapiens
gggagtaaactatggtgaggat

SEQ ID NO: 9103440 - DNA, 22 bp, Homo sapiens
gggagtcagagaggtaatggga

SEQ ID NO: 9103441 - DNA, 22 bp, Homo sapiens
gggaggttgaggctgcagtgag

SEQ ID NO: 9103442 - DNA, 22 bp, Homo sapiens
gggaggttgaggctgcagtgag

SEQ ID NO: 9103443 - DNA, 22 bp, Homo sapiens
gggaggttgaggctgcagtgag

SEQ ID NO: 9103444 - DNA, 22 bp, Homo sapiens
gggaggttgaggctgcagtgag

SEQ ID NO: 9103445 - DNA, 22 bp, Homo sapiens
gggagctgaatggcaatggaga

SEQ ID NO: 9103446 - DNA, 22 bp, Homo sapiens
gggagctgaatggcaatggaga

SEQ ID NO: 9103447 - DNA, 22 bp, Homo sapiens
gggagctgaaggagccggcggg

SEQ ID NO: 9103448 - DNA, 22 bp, Homo sapiens
gggagctgaactgctgaagttg

SEQ ID NO: 9103449 - DNA, 22 bp, Homo sapiens
gggagccttgggagtgccagcc

SEQ ID NO: 9103450 - DNA, 20 bp, Homo sapiens
gggagtggtggtagcctgtg

SEQ ID NO: 9103451 - DNA, 22 bp, Homo sapiens
gggatcagaaacatagccctga

SEQ ID NO: 9103452 - DNA, 19 bp, Homo sapiens
gggatcagcccagggctct

SEQ ID NO: 9103453 - DNA, 21 bp, Homo sapiens
ggcactaggcccggaggaagc

SEQ ID NO: 9103454 - DNA, 22 bp, Homo sapiens
ggcagatggggtgacaagagag

SEQ ID NO: 9103455 - DNA, 22 bp, Homo sapiens
ggcagatggagaagcagcaggt

SEQ ID NO: 9103456 - DNA, 22 bp, Homo sapiens
ggcagaggtgaagttcacaagg

SEQ ID NO: 9103457 - DNA, 22 bp, Homo sapiens
ggcagcaattcttcagaatcat

SEQ ID NO: 9103458 - DNA, 22 bp, Homo sapiens
ggcagcagaactggccctgtat

SEQ ID NO: 9103459 - DNA, 22 bp, Homo sapiens
ggcagcagaactggccctgtat

SEQ ID NO: 9103460 - DNA, 22 bp, Homo sapiens
ggcagcactgcagcttgttggg

SEQ ID NO: 9103461 - DNA, 22 bp, Homo sapiens
ggcagcaactcggagagaagag

SEQ ID NO: 9103462 - DNA, 22 bp, Homo sapiens
ggcagcaactcggagagaagag

SEQ ID NO: 9103463 - DNA, 22 bp, Homo sapiens
ggcagcaagtggtgggagactt

SEQ ID NO: 9103464 - DNA, 23 bp, Homo sapiens
ggcagatttggtttgttttaata

SEQ ID NO: 9103465 - DNA, 22 bp, Homo sapiens
ggcagcaaaaagcctggttgaa

SEQ ID NO: 9103466 - DNA, 22 bp, Homo sapiens
ggcagatgttgcagtgagcaga

SEQ ID NO: 9103467 - DNA, 22 bp, Homo sapiens
ggcacctggtaagtgctcagta

SEQ ID NO: 9103468 - DNA, 22 bp, Homo sapiens
ggcacctgtgtaagatctggaa

SEQ ID NO: 9103469 - DNA, 19 bp, Homo sapiens
ggcaccttggctatgcctg

SEQ ID NO: 9103470 - DNA, 19 bp, Homo sapiens
ggcacctttctgctgtgtc

SEQ ID NO: 9103471 - DNA, 19 bp, Homo sapiens
ggcaccttggtcttggact

SEQ ID NO: 9103472 - DNA, 22 bp, Homo sapiens
ggcacctggatgtagcagtgaa

SEQ ID NO: 9103473 - DNA, 22 bp, Homo sapiens
ggcacctggatgtagcagtgaa

SEQ ID NO: 9103474 - DNA, 22 bp, Homo sapiens
ggcacctggaggtttactggat

SEQ ID NO: 9103475 - DNA, 22 bp, Homo sapiens
ggcacctgctcatctggactca

SEQ ID NO: 9103476 - DNA, 22 bp, Homo sapiens
ggcacctctgggctctgttagg

SEQ ID NO: 9103477 - DNA, 22 bp, Homo sapiens
ggcacctgatgactgcttccct

SEQ ID NO: 9103478 - DNA, 22 bp, Homo sapiens
ggaggcagaacttcccgtcagt

SEQ ID NO: 9103479 - DNA, 22 bp, Homo sapiens
ggcaccaggctgggcataggcc

SEQ ID NO: 9103480 - DNA, 22 bp, Homo sapiens
ggcaccaggctgggcataggcc

SEQ ID NO: 9103481 - DNA, 22 bp, Homo sapiens
ggaggcagaacttcccgtcagt

SEQ ID NO: 9103482 - DNA, 22 bp, Homo sapiens
ggcaccaggggatgtaatgtcc

SEQ ID NO: 9103483 - DNA, 22 bp, Homo sapiens
ggcaccaggggatgtaatgtcc

SEQ ID NO: 9103484 - DNA, 16 bp, Homo sapiens
ggcaccagtgaacaca

SEQ ID NO: 9103485 - DNA, 18 bp, Homo sapiens
ggcacctctcttgcctta

SEQ ID NO: 9103486 - DNA, 22 bp, Homo sapiens
ggcaccagggacaatcctcttc

SEQ ID NO: 9103487 - DNA, 22 bp, Homo sapiens
ggcaccagggcaagggtctttc

SEQ ID NO: 9103488 - DNA, 22 bp, Homo sapiens
ggcaccagggcaagggtctttc

SEQ ID NO: 9103489 - DNA, 22 bp, Homo sapiens
ggcaccagggacaatcctcttc

SEQ ID NO: 9103490 - DNA, 22 bp, Homo sapiens
ggcaccagggaaggaaggctgg

SEQ ID NO: 9103491 - DNA, 22 bp, Homo sapiens
ggcaccagggaaggaaggctgg

SEQ ID NO: 9103492 - DNA, 22 bp, Homo sapiens
ggaggcaaagcactttgcttgg

SEQ ID NO: 9103493 - DNA, 22 bp, Homo sapiens
ggaggatgccaagctgtgcaca

SEQ ID NO: 9103494 - DNA, 22 bp, Homo sapiens
ggaggcacacctcagactggga

SEQ ID NO: 9103495 - DNA, 22 bp, Homo sapiens
ggaggcacacctcagactggga

SEQ ID NO: 9103496 - DNA, 17 bp, Homo sapiens
ggaggcaacagacaggg

SEQ ID NO: 9103497 - DNA, 23 bp, Homo sapiens
ggaggcacttaggcagagcagag

SEQ ID NO: 9103498 - DNA, 23 bp, Homo sapiens
ggaggcacttaggcagagcagag

SEQ ID NO: 9103499 - DNA, 23 bp, Homo sapiens
ggaggcacttaggcagagcagag

SEQ ID NO: 9103500 - DNA, 22 bp, Homo sapiens
ggaggcaccctatttgaggcct

SEQ ID NO: 9103501 - DNA, 22 bp, Homo sapiens
ggaggatgagctacgaggagct

SEQ ID NO: 9103502 - DNA, 22 bp, Homo sapiens
ggaggaggtgggttaagttgta

SEQ ID NO: 9103503 - DNA, 22 bp, Homo sapiens
ggcaggcttggtggcaccggtt

SEQ ID NO: 9103504 - DNA, 20 bp, Homo sapiens
ggcaggctttatatggaggg

SEQ ID NO: 9103505 - DNA, 22 bp, Homo sapiens
ggcaggctttgagaaagagcat

SEQ ID NO: 9103506 - DNA, 18 bp, Homo sapiens
ggcagggaaaagataggg

SEQ ID NO: 9103507 - DNA, 18 bp, Homo sapiens
ggcagggaaaagataggg

SEQ ID NO: 9103508 - DNA, 22 bp, Homo sapiens
ggcagcgcccgagtccgcagct

SEQ ID NO: 9103509 - DNA, 21 bp, Homo sapiens
ggcagcccgccctctcctggc

SEQ ID NO: 9103510 - DNA, 22 bp, Homo sapiens
ggcagccctttctggccagctc

SEQ ID NO: 9103511 - DNA, 17 bp, Homo sapiens
ggcagcctcaggcgttt

SEQ ID NO: 9103512 - DNA, 17 bp, Homo sapiens
ggcagcctcaggcgttt

SEQ ID NO: 9103513 - DNA, 21 bp, Homo sapiens
ggcagcccgccctctcctggc

SEQ ID NO: 9103514 - DNA, 22 bp, Homo sapiens
ggcagccccagaaacagttcag

SEQ ID NO: 9103515 - DNA, 22 bp, Homo sapiens
ggcagcccaccagcccacgtct

SEQ ID NO: 9103516 - DNA, 22 bp, Homo sapiens
ggcagccatgtgggcagcgagt

SEQ ID NO: 9103517 - DNA, 22 bp, Homo sapiens
ggcagcccaccagcccacgtct

SEQ ID NO: 9103518 - DNA, 22 bp, Homo sapiens
ggcagccatgtcccagggcttc

SEQ ID NO: 9103519 - DNA, 22 bp, Homo sapiens
ggcagccatgtcccagggcttc

SEQ ID NO: 9103520 - DNA, 22 bp, Homo sapiens
ggcagcctccagggcactggtg

SEQ ID NO: 9103521 - DNA, 22 bp, Homo sapiens
ggcagcctccagggcactggtg

SEQ ID NO: 9103522 - DNA, 22 bp, Homo sapiens
ggcagcctccagggcactggtg

SEQ ID NO: 9103523 - DNA, 22 bp, Homo sapiens
ggcagcctggagactttgtgaa

SEQ ID NO: 9103524 - DNA, 18 bp, Homo sapiens
ggcagcctggacatgctc

SEQ ID NO: 9103525 - DNA, 18 bp, Homo sapiens
ggcagcctggacatgctc

SEQ ID NO: 9103526 - DNA, 22 bp, Homo sapiens
ggcaggggtcctggtgttgact

SEQ ID NO: 9103527 - DNA, 20 bp, Homo sapiens
ggcagggcatcaacagctct

SEQ ID NO: 9103528 - DNA, 22 bp, Homo sapiens
ggcagggccctgattcctgggg

SEQ ID NO: 9103529 - DNA, 22 bp, Homo sapiens
ggcagggagagcatgctgataa

SEQ ID NO: 9103530 - DNA, 22 bp, Homo sapiens
ggcagggagagcatgctgataa

SEQ ID NO: 9103531 - DNA, 22 bp, Homo sapiens
ggcagggactttgcaaatcttt

SEQ ID NO: 9103532 - DNA, 22 bp, Homo sapiens
ggcagggactatgtttcatgga

SEQ ID NO: 9103533 - DNA, 22 bp, Homo sapiens
ggcagggaagctggcatcacgg

SEQ ID NO: 9103534 - DNA, 22 bp, Homo sapiens
ggcagggacaggatagggtttt

SEQ ID NO: 9103535 - DNA, 22 bp, Homo sapiens
ggcagggaaacagctgatccca

SEQ ID NO: 9103536 - DNA, 22 bp, Homo sapiens
ggcagggaaacagctgatccca

SEQ ID NO: 9103537 - DNA, 22 bp, Homo sapiens
ggcagtgagaggtctcctggtc

SEQ ID NO: 9103538 - DNA, 22 bp, Homo sapiens
ggcagtgagctggagggaagga

SEQ ID NO: 9103539 - DNA, 19 bp, Homo sapiens
ggcagtgagaagactcctg

SEQ ID NO: 9103540 - DNA, 22 bp, Homo sapiens
ggcagtgactgttcagacgtcc

SEQ ID NO: 9103541 - DNA, 22 bp, Homo sapiens
ggcagtgactggggacccccaa

SEQ ID NO: 9103542 - DNA, 22 bp, Homo sapiens
ggcagtgactggggacccccaa

SEQ ID NO: 9103543 - DNA, 22 bp, Homo sapiens
ggcagtgactgttcagacgtcc

SEQ ID NO: 9103544 - DNA, 22 bp, Homo sapiens
ggcagtgatgtcaaacagtgaa

SEQ ID NO: 9103545 - DNA, 21 bp, Homo sapiens
ggcagtgatgtgaagtgcatc

SEQ ID NO: 9103546 - DNA, 22 bp, Homo sapiens
ggcagtgcaaggcagcctggat

SEQ ID NO: 9103547 - DNA, 22 bp, Homo sapiens
ggcagtgagtcccggagaggcc

SEQ ID NO: 9103548 - DNA, 17 bp, Homo sapiens
ggcagtggaggaagaga

SEQ ID NO: 9103549 - DNA, 17 bp, Homo sapiens
ggcagtggaggaagaga

SEQ ID NO: 9103550 - DNA, 22 bp, Homo sapiens
ggcagtgcctgatgctgcagga

SEQ ID NO: 9103551 - DNA, 22 bp, Homo sapiens
ggcagtgcaaggctggcacagt

SEQ ID NO: 9103552 - DNA, 18 bp, Homo sapiens
ggcagtgcagtctcaggg

SEQ ID NO: 9103553 - DNA, 22 bp, Homo sapiens
ggcagtgccactaagctctgct

SEQ ID NO: 9103554 - DNA, 18 bp, Homo sapiens
ggcagtgcagtctcaggg

SEQ ID NO: 9103555 - DNA, 22 bp, Homo sapiens
ggcccatctcttgctctgggtt

SEQ ID NO: 9103556 - DNA, 22 bp, Homo sapiens
ggcctccatcttatcttactct

SEQ ID NO: 9103557 - DNA, 20 bp, Homo sapiens
ggcctctgaggacaaggaga

SEQ ID NO: 9103558 - DNA, 19 bp, Homo sapiens
ggcctctgcaggccgcccc

SEQ ID NO: 9103559 - DNA, 22 bp, Homo sapiens
ggcctctgcaactggctgtggc

SEQ ID NO: 9103560 - DNA, 22 bp, Homo sapiens
ggcctctgcaactggctgtggc

SEQ ID NO: 9103561 - DNA, 22 bp, Homo sapiens
ggcctctgcaactggctgtggc

SEQ ID NO: 9103562 - DNA, 22 bp, Homo sapiens
ggcctctgccccagccacacct

SEQ ID NO: 9103563 - DNA, 22 bp, Homo sapiens
ggcctctgccccagccacacct

SEQ ID NO: 9103564 - DNA, 21 bp, Homo sapiens
ggcctctgccttgccccactc

SEQ ID NO: 9103565 - DNA, 22 bp, Homo sapiens
ggcctctgcctcatctgggcac

SEQ ID NO: 9103566 - DNA, 18 bp, Homo sapiens
ggcctctggactggcagc

SEQ ID NO: 9103567 - DNA, 22 bp, Homo sapiens
ggcctctggcaggcaggccctc

SEQ ID NO: 9103568 - DNA, 22 bp, Homo sapiens
ggcctctgcttatgctgatgac

SEQ ID NO: 9103569 - DNA, 18 bp, Homo sapiens
ggcctctggactggcagc

SEQ ID NO: 9103570 - DNA, 22 bp, Homo sapiens
ggcctctggtcaagacaagcat

SEQ ID NO: 9103571 - DNA, 22 bp, Homo sapiens
ggcctctggggtcctgagccca

SEQ ID NO: 9103572 - DNA, 22 bp, Homo sapiens
ggcctctggtcaagacaagcat

SEQ ID NO: 9103573 - DNA, 22 bp, Homo sapiens
ggctcacgcaattatcccggcc

SEQ ID NO: 9103574 - DNA, 22 bp, Homo sapiens
ggctcactgcaaactgtgcctc

SEQ ID NO: 9103575 - DNA, 22 bp, Homo sapiens
ggctcactgcaacttccgcctc

SEQ ID NO: 9103576 - DNA, 22 bp, Homo sapiens
ggctcactgcaacttccgcctc

SEQ ID NO: 9103577 - DNA, 22 bp, Homo sapiens
ggctagggactcctcctcaggg

SEQ ID NO: 9103578 - DNA, 22 bp, Homo sapiens
ggctagggaaatcctgatccaa

SEQ ID NO: 9103579 - DNA, 22 bp, Homo sapiens
ggctagggacacagctctgctc

SEQ ID NO: 9103580 - DNA, 22 bp, Homo sapiens
ggctagggaaaatgattggata

SEQ ID NO: 9103581 - DNA, 22 bp, Homo sapiens
ggctctgcccgcggctgcccac

SEQ ID NO: 9103582 - DNA, 22 bp, Homo sapiens
ggctctgccatttcctagctgc

SEQ ID NO: 9103583 - DNA, 22 bp, Homo sapiens
ggctctgccatttcctagctgc

SEQ ID NO: 9103584 - DNA, 22 bp, Homo sapiens
ggctctgcctgcccagcagcac

SEQ ID NO: 9103585 - DNA, 22 bp, Homo sapiens
ggctctgccgtgtgctcacatg

SEQ ID NO: 9103586 - DNA, 22 bp, Homo sapiens
ggctctgcatgcaggttgtcag

SEQ ID NO: 9103587 - DNA, 22 bp, Homo sapiens
ggctctgaggcagatcgatggg

SEQ ID NO: 9103588 - DNA, 22 bp, Homo sapiens
ggctcagaaggccatgctctgc

SEQ ID NO: 9103589 - DNA, 22 bp, Homo sapiens
ggctcactgcaacttccgcctc

SEQ ID NO: 9103590 - DNA, 22 bp, Homo sapiens
ggctcagacctcccagctccag

SEQ ID NO: 9103591 - DNA, 22 bp, Homo sapiens
ggctcagcaatgatgagcccct

SEQ ID NO: 9103592 - DNA, 22 bp, Homo sapiens
ggctctctccttggctttcaga

SEQ ID NO: 9103593 - DNA, 22 bp, Homo sapiens
ggctcagcacagggctggcatc

SEQ ID NO: 9103594 - DNA, 22 bp, Homo sapiens
ggctcagcacagggctggcatc

SEQ ID NO: 9103595 - DNA, 22 bp, Homo sapiens
ggctcagattccgagtggccct

SEQ ID NO: 9103596 - DNA, 17 bp, Homo sapiens
ggctctcttccagactt

SEQ ID NO: 9103597 - DNA, 22 bp, Homo sapiens
ggctctctgaggaaacccttcc

SEQ ID NO: 9103598 - DNA, 22 bp, Homo sapiens
ggctctctggaggagctcaccc

SEQ ID NO: 9103599 - DNA, 22 bp, Homo sapiens
ggctctctggaggagctcaccc

SEQ ID NO: 9103600 - DNA, 22 bp, Homo sapiens
ggctctcttaactggccatcct

SEQ ID NO: 9103601 - DNA, 22 bp, Homo sapiens
ggctctctggaggagctcaccc

SEQ ID NO: 9103602 - DNA, 22 bp, Homo sapiens
ggcagtgggaaataagtgagaa

SEQ ID NO: 9103603 - DNA, 22 bp, Homo sapiens
ggcagtgggtggatctcaggga

SEQ ID NO: 9103604 - DNA, 17 bp, Homo sapiens
ggccacagagcttgggg

SEQ ID NO: 9103605 - DNA, 17 bp, Homo sapiens
ggccacagagcttgggg

SEQ ID NO: 9103606 - DNA, 17 bp, Homo sapiens
ggccacagagcttgggg

SEQ ID NO: 9103607 - DNA, 22 bp, Homo sapiens
ggccacagagggcgggatgctg

SEQ ID NO: 9103608 - DNA, 22 bp, Homo sapiens
ggcagtggctcctctctactcc

SEQ ID NO: 9103609 - DNA, 22 bp, Homo sapiens
ggcagtggctgtagtctcttgg

SEQ ID NO: 9103610 - DNA, 22 bp, Homo sapiens
ggcagtggcatgtgggtagtgg

SEQ ID NO: 9103611 - DNA, 22 bp, Homo sapiens
ggccacagagggcgggatgctg

SEQ ID NO: 9103612 - DNA, 22 bp, Homo sapiens
ggccacagcagatgcttcagat

SEQ ID NO: 9103613 - DNA, 20 bp, Homo sapiens
ggccacagggtgctggtgga

SEQ ID NO: 9103614 - DNA, 22 bp, Homo sapiens
ggccacagtctctggaaggatg

SEQ ID NO: 9103615 - DNA, 22 bp, Homo sapiens
ggccacagtgggaaatcctggg

SEQ ID NO: 9103616 - DNA, 21 bp, Homo sapiens
ggccacagttagggctcagga

SEQ ID NO: 9103617 - DNA, 22 bp, Homo sapiens
ggccacagtgggaaatcctggg

SEQ ID NO: 9103618 - DNA, 21 bp, Homo sapiens
ggccacagttagggctcagga

SEQ ID NO: 9103619 - DNA, 22 bp, Homo sapiens
ggccaccaaagtcctgtggctt

SEQ ID NO: 9103620 - DNA, 22 bp, Homo sapiens
ggccaccaaagtcctgtggctt

SEQ ID NO: 9103621 - DNA, 22 bp, Homo sapiens
ggccaccagtcctctggcaggg

SEQ ID NO: 9103622 - DNA, 22 bp, Homo sapiens
ggccaccagtcctctggcaggg

SEQ ID NO: 9103623 - DNA, 22 bp, Homo sapiens
ggccacctaggagccacagtga

SEQ ID NO: 9103624 - DNA, 22 bp, Homo sapiens
ggccacatgtggctgctcgtat

SEQ ID NO: 9103625 - DNA, 22 bp, Homo sapiens
ggccaccaaagtcctgtggctt

SEQ ID NO: 9103626 - DNA, 22 bp, Homo sapiens
ggccagagtctatatgcagaca

SEQ ID NO: 9103627 - DNA, 22 bp, Homo sapiens
ggccacctctgccctaccgagt

SEQ ID NO: 9103628 - DNA, 22 bp, Homo sapiens
ggccacctaggagccacagtga

SEQ ID NO: 9103629 - DNA, 19 bp, Homo sapiens
ggccacctctcttcccagg

SEQ ID NO: 9103630 - DNA, 19 bp, Homo sapiens
ggccacctctcttcccagg

SEQ ID NO: 9103631 - DNA, 22 bp, Homo sapiens
ggccacctccgtgaaggaatga

SEQ ID NO: 9103632 - DNA, 22 bp, Homo sapiens
ggccagagttgatggcatcttg

SEQ ID NO: 9103633 - DNA, 21 bp, Homo sapiens
ggccagcagcgtccactgtgg

SEQ ID NO: 9103634 - DNA, 22 bp, Homo sapiens
ggccagcagacctcagggactc

SEQ ID NO: 9103635 - DNA, 22 bp, Homo sapiens
ggccagcagacctcagggactc

SEQ ID NO: 9103636 - DNA, 22 bp, Homo sapiens
ggccagctggatgtgggtgacg

SEQ ID NO: 9103637 - DNA, 19 bp, Homo sapiens
ggccagccacctcgcctgg

SEQ ID NO: 9103638 - DNA, 22 bp, Homo sapiens
ggccagcagtcacagggtcaga

SEQ ID NO: 9103639 - DNA, 22 bp, Homo sapiens
ggccagcagtatatagctaatt

SEQ ID NO: 9103640 - DNA, 20 bp, Homo sapiens
ggcccagtgaaccaggacgg

SEQ ID NO: 9103641 - DNA, 22 bp, Homo sapiens
ggcccagtctggggccctgtga

SEQ ID NO: 9103642 - DNA, 22 bp, Homo sapiens
ggcccaggctggagtgcggtgg

SEQ ID NO: 9103643 - DNA, 22 bp, Homo sapiens
ggcccaggtccagcgagtacct

SEQ ID NO: 9103644 - DNA, 22 bp, Homo sapiens
ggcccagtgtaccccaggcagt

SEQ ID NO: 9103645 - DNA, 22 bp, Homo sapiens
ggcccagtgttgccagacctga

SEQ ID NO: 9103646 - DNA, 22 bp, Homo sapiens
ggcccagtgtgggtggatgttg

SEQ ID NO: 9103647 - DNA, 22 bp, Homo sapiens
ggcccatctcttgctctgggtt

SEQ ID NO: 9103648 - DNA, 22 bp, Homo sapiens
ggcccatccatgctgctggtct

SEQ ID NO: 9103649 - DNA, 22 bp, Homo sapiens
ggcccaggctggagtgcagtgg

SEQ ID NO: 9103650 - DNA, 22 bp, Homo sapiens
ggcccagctgtgcttccagccc

SEQ ID NO: 9103651 - DNA, 22 bp, Homo sapiens
gtcagaaaccagtcaaacaaga

SEQ ID NO: 9103652 - DNA, 22 bp, Homo sapiens
gtcagaagcatttgtggctgaa

SEQ ID NO: 9103653 - DNA, 22 bp, Homo sapiens
gtcagaatttacttaatagcca

SEQ ID NO: 9103654 - DNA, 22 bp, Homo sapiens
gtcacttggggtaagccaagag

SEQ ID NO: 9103655 - DNA, 22 bp, Homo sapiens
gtcactttattaattttggtga

SEQ ID NO: 9103656 - DNA, 18 bp, Homo sapiens
gtcacctggatcagatta

SEQ ID NO: 9103657 - DNA, 22 bp, Homo sapiens
gtcactcttccccatagcctac

SEQ ID NO: 9103658 - DNA, 22 bp, Homo sapiens
gtcaccctgctgtttgtccatt

SEQ ID NO: 9103659 - DNA, 22 bp, Homo sapiens
gtcaccctgctggctgttcagc

SEQ ID NO: 9103660 - DNA, 22 bp, Homo sapiens
gtcactgtatccaggttccagc

SEQ ID NO: 9103661 - DNA, 22 bp, Homo sapiens
gtcactgtatccaggttccagc

SEQ ID NO: 9103662 - DNA, 21 bp, Homo sapiens
gtccagagagccggctcctga

SEQ ID NO: 9103663 - DNA, 22 bp, Homo sapiens
gtccagagagatcttctgatag

SEQ ID NO: 9103664 - DNA, 21 bp, Homo sapiens
gtccagagagccggctcctga

SEQ ID NO: 9103665 - DNA, 22 bp, Homo sapiens
gtcagaggaggctgagtaggaa

SEQ ID NO: 9103666 - DNA, 22 bp, Homo sapiens
gtccagaagctcaagttgaact

SEQ ID NO: 9103667 - DNA, 22 bp, Homo sapiens
gtccagaaggaggtcaagttgg

SEQ ID NO: 9103668 - DNA, 22 bp, Homo sapiens
gtcagaggaggctgagtaggaa

SEQ ID NO: 9103669 - DNA, 22 bp, Homo sapiens
gtccagagaagggaggggactc

SEQ ID NO: 9103670 - DNA, 21 bp, Homo sapiens
gtcagagatgcccaactgcct

SEQ ID NO: 9103671 - DNA, 22 bp, Homo sapiens
gtcagaggaatggatgagtgat

SEQ ID NO: 9103672 - DNA, 22 bp, Homo sapiens
gtcagaggaatggatgagtgat

SEQ ID NO: 9103673 - DNA, 22 bp, Homo sapiens
gtcagaggaatggatgagtgat

SEQ ID NO: 9103674 - DNA, 20 bp, Homo sapiens
gtcagaggaccctagagcga

SEQ ID NO: 9103675 - DNA, 22 bp, Homo sapiens
gtccagccaggctgcagcaccc

SEQ ID NO: 9103676 - DNA, 22 bp, Homo sapiens
gtccagccagctggtccttgcc

SEQ ID NO: 9103677 - DNA, 22 bp, Homo sapiens
gtccagcccctgactcccaggc

SEQ ID NO: 9103678 - DNA, 22 bp, Homo sapiens
gtccagcccctgactcccaggc

SEQ ID NO: 9103679 - DNA, 22 bp, Homo sapiens
gtccagccctctgcctccaggt

SEQ ID NO: 9103680 - DNA, 22 bp, Homo sapiens
gtccagccctctgcctccaggt

SEQ ID NO: 9103681 - DNA, 22 bp, Homo sapiens
gtccagcccgggctccgccagc

SEQ ID NO: 9103682 - DNA, 22 bp, Homo sapiens
gtccagcccgggctccgccagc

SEQ ID NO: 9103683 - DNA, 22 bp, Homo sapiens
gtccagctccagggaggcaggc

SEQ ID NO: 9103684 - DNA, 22 bp, Homo sapiens
gtccagcctgaagagtgggggc

SEQ ID NO: 9103685 - DNA, 22 bp, Homo sapiens
gtccagcctgaagagtgggggc

SEQ ID NO: 9103686 - DNA, 22 bp, Homo sapiens
gtccagcccttgcagcttcttt

SEQ ID NO: 9103687 - DNA, 22 bp, Homo sapiens
gtccagctgcagctgggcagaa

SEQ ID NO: 9103688 - DNA, 22 bp, Homo sapiens
gtcctctggcctttcccaggac

SEQ ID NO: 9103689 - DNA, 22 bp, Homo sapiens
gtcctctggcctttcccaggac

SEQ ID NO: 9103690 - DNA, 22 bp, Homo sapiens
gtcctctgcttcatgccctgat

SEQ ID NO: 9103691 - DNA, 22 bp, Homo sapiens
gtccaggctgacccctagagga

SEQ ID NO: 9103692 - DNA, 22 bp, Homo sapiens
gtccaggccatggtggacacag

SEQ ID NO: 9103693 - DNA, 20 bp, Homo sapiens
gtccaggacccagcaggagg

SEQ ID NO: 9103694 - DNA, 22 bp, Homo sapiens
gtcctggaatcctagaacagtg

SEQ ID NO: 9103695 - DNA, 22 bp, Homo sapiens
gtcctgcggcctcagtggtgag

SEQ ID NO: 9103696 - DNA, 22 bp, Homo sapiens
gtcctggcccactggcaggctg

SEQ ID NO: 9103697 - DNA, 22 bp, Homo sapiens
gtcgtggagctcacagtgtgcc

SEQ ID NO: 9103698 - DNA, 22 bp, Homo sapiens
gtcctggctggttctgtggggc

SEQ ID NO: 9103699 - DNA, 22 bp, Homo sapiens
gtattttcaagagcagtagtat

SEQ ID NO: 9103700 - DNA, 22 bp, Homo sapiens
gtatttttaggtaaggaaagta

SEQ ID NO: 9103701 - DNA, 22 bp, Homo sapiens
gtatttttaggtaaggaaagta

SEQ ID NO: 9103702 - DNA, 22 bp, Homo sapiens
gtattttgttagggtgtggtat

SEQ ID NO: 9103703 - DNA, 22 bp, Homo sapiens
gtatttttaggtaaggaaagta

SEQ ID NO: 9103704 - DNA, 22 bp, Homo sapiens
gtattttatggcatgcagtggc

SEQ ID NO: 9103705 - DNA, 22 bp, Homo sapiens
gtatacagatacttagacgtgc

SEQ ID NO: 9103706 - DNA, 22 bp, Homo sapiens
gtagttctttctcaatgttcaa

SEQ ID NO: 9103707 - DNA, 22 bp, Homo sapiens
gtatttttcagttaggagctta

SEQ ID NO: 9103708 - DNA, 22 bp, Homo sapiens
gtatttttagtagagtcggggt

SEQ ID NO: 9103709 - DNA, 22 bp, Homo sapiens
gtatttttagtagagtcggggt

SEQ ID NO: 9103710 - DNA, 22 bp, Homo sapiens
gtatttttcagttaggagctta

SEQ ID NO: 9103711 - DNA, 22 bp, Homo sapiens
gtatttttcagttaggagctta

SEQ ID NO: 9103712 - DNA, 22 bp, Homo sapiens
gtatttttcagttaggagctta

SEQ ID NO: 9103713 - DNA, 22 bp, Homo sapiens
gtatttttaggtaaggaaagta

SEQ ID NO: 9103714 - DNA, 22 bp, Homo sapiens
gtatttttaggtaaggaaagta

SEQ ID NO: 9103715 - DNA, 22 bp, Homo sapiens
gtatttttaggtaaggaaagta

SEQ ID NO: 9103716 - DNA, 22 bp, Homo sapiens
gtatttttagtagagtcggggt

SEQ ID NO: 9103717 - DNA, 22 bp, Homo sapiens
gtatttttcattccaagtgaga

SEQ ID NO: 9103718 - DNA, 22 bp, Homo sapiens
gtatttttcattccaagtgaga

SEQ ID NO: 9103719 - DNA, 22 bp, Homo sapiens
gtatttttcattccaagtgaga

SEQ ID NO: 9103720 - DNA, 22 bp, Homo sapiens
gtcaaatgcacagaaccattaa

SEQ ID NO: 9103721 - DNA, 22 bp, Homo sapiens
gtacaataactagtcttatagt

SEQ ID NO: 9103722 - DNA, 22 bp, Homo sapiens
gtacaaattttgacatctagga

SEQ ID NO: 9103723 - DNA, 22 bp, Homo sapiens
gtacaaaagttattgcggtttt

SEQ ID NO: 9103724 - DNA, 22 bp, Homo sapiens
gtacaaaagttattgcggtttt

SEQ ID NO: 9103725 - DNA, 22 bp, Homo sapiens
gtacaaaagttattgcggtttt

SEQ ID NO: 9103726 - DNA, 22 bp, Homo sapiens
gtacaaaagttattgcggtttt

SEQ ID NO: 9103727 - DNA, 22 bp, Homo sapiens
gtagtcccagctaccccggagg

SEQ ID NO: 9103728 - DNA, 22 bp, Homo sapiens
gtaggtcagacataagaggaca

SEQ ID NO: 9103729 - DNA, 22 bp, Homo sapiens
gtagtaaagcggaaagggtgat

SEQ ID NO: 9103730 - DNA, 22 bp, Homo sapiens
gtacaatagcagttttcccttt

SEQ ID NO: 9103731 - DNA, 22 bp, Homo sapiens
gtacaattaagtgcacaaatag

SEQ ID NO: 9103732 - DNA, 22 bp, Homo sapiens
gtacaattatttaaatggtgaa

SEQ ID NO: 9103733 - DNA, 22 bp, Homo sapiens
gtaggaagctctgaggctagtt

SEQ ID NO: 9103734 - DNA, 22 bp, Homo sapiens
gtaggcagataggagtgcagcc

SEQ ID NO: 9103735 - DNA, 22 bp, Homo sapiens
gtaggcagaccagtggatgggt

SEQ ID NO: 9103736 - DNA, 22 bp, Homo sapiens
gtaggcagaccagtggatgggt

SEQ ID NO: 9103737 - DNA, 22 bp, Homo sapiens
gtgctgagtgcagagtgcagag

SEQ ID NO: 9103738 - DNA, 22 bp, Homo sapiens
gtgctgagaacaaaagtggaca

SEQ ID NO: 9103739 - DNA, 22 bp, Homo sapiens
gtgctgaattggagatgctcct

SEQ ID NO: 9103740 - DNA, 22 bp, Homo sapiens
gtgctgacaggagcctggcggt

SEQ ID NO: 9103741 - DNA, 22 bp, Homo sapiens
gtgcccaggcccaaggcaccac

SEQ ID NO: 9103742 - DNA, 22 bp, Homo sapiens
gtgctgctcacatctggaggta

SEQ ID NO: 9103743 - DNA, 22 bp, Homo sapiens
gtgctggccctgtcctcgagct

SEQ ID NO: 9103744 - DNA, 22 bp, Homo sapiens
gtgctggcacccctctccagtt

SEQ ID NO: 9103745 - DNA, 22 bp, Homo sapiens
gtgcccagctccacctcacaga

SEQ ID NO: 9103746 - DNA, 22 bp, Homo sapiens
gtgcccagctccacctcacaga

SEQ ID NO: 9103747 - DNA, 22 bp, Homo sapiens
gtgccagggggcactgaacaga

SEQ ID NO: 9103748 - DNA, 22 bp, Homo sapiens
gtgccagggagtggaggagctt

SEQ ID NO: 9103749 - DNA, 22 bp, Homo sapiens
gtgccaggtgctaagctgtgct

SEQ ID NO: 9103750 - DNA, 22 bp, Homo sapiens
gtgccaggtgctaagctgtgct

SEQ ID NO: 9103751 - DNA, 22 bp, Homo sapiens
gtgccagccgcaccccaggaga

SEQ ID NO: 9103752 - DNA, 22 bp, Homo sapiens
gtgccagctctccccacatctg

SEQ ID NO: 9103753 - DNA, 22 bp, Homo sapiens
gtgccagctgtccatgttcctc

SEQ ID NO: 9103754 - DNA, 22 bp, Homo sapiens
gtgccagagatgacaggcctgc

SEQ ID NO: 9103755 - DNA, 22 bp, Homo sapiens
gtgccagcagttatggtgattt

SEQ ID NO: 9103756 - DNA, 22 bp, Homo sapiens
gtgccagaggcagtgaggagtt

SEQ ID NO: 9103757 - DNA, 22 bp, Homo sapiens
gtgcagggtagcgacggcagga

SEQ ID NO: 9103758 - DNA, 22 bp, Homo sapiens
gtgccacttacctgggaggagt

SEQ ID NO: 9103759 - DNA, 22 bp, Homo sapiens
gtgcagggctggcaccggaggc

SEQ ID NO: 9103760 - DNA, 17 bp, Homo sapiens
gtgcagggatgaaggat

SEQ ID NO: 9103761 - DNA, 22 bp, Homo sapiens
gtgcagggcagccgaatgggct

SEQ ID NO: 9103762 - DNA, 22 bp, Homo sapiens
gtgcagggagcccagaaggtcc

SEQ ID NO: 9103763 - DNA, 22 bp, Homo sapiens
gtgcaggctctcgttcttgaca

SEQ ID NO: 9103764 - DNA, 22 bp, Homo sapiens
gtgcaggctagatccttcctac

SEQ ID NO: 9103765 - DNA, 22 bp, Homo sapiens
gtgcaggatgttgggaatcagg

SEQ ID NO: 9103766 - DNA, 22 bp, Homo sapiens
gtgcagcaaagtttgagatata

SEQ ID NO: 9103767 - DNA, 22 bp, Homo sapiens
gtgcagcaaagtttgagatata

SEQ ID NO: 9103768 - DNA, 22 bp, Homo sapiens
gtgaggcaggcattctcctttc

SEQ ID NO: 9103769 - DNA, 22 bp, Homo sapiens
gtgaggcagcaggagcctctgt

SEQ ID NO: 9103770 - DNA, 22 bp, Homo sapiens
gtgaggcagcaggagcctctgt

SEQ ID NO: 9103771 - DNA, 22 bp, Homo sapiens
gtgaggcagagatgccaaaact

SEQ ID NO: 9103772 - DNA, 22 bp, Homo sapiens
gtgaggcagagatgccaaaact

SEQ ID NO: 9103773 - DNA, 22 bp, Homo sapiens
gtgaggcaagggcatactaggc

SEQ ID NO: 9103774 - DNA, 22 bp, Homo sapiens
gtgaggcagaagttccctttta

SEQ ID NO: 9103775 - DNA, 22 bp, Homo sapiens
gtgaggatacttaagagaacac

SEQ ID NO: 9103776 - DNA, 22 bp, Homo sapiens
gtcttgtttgggatgtggatgg

SEQ ID NO: 9103777 - DNA, 22 bp, Homo sapiens
gtcttggccgtgcagatgaaga

SEQ ID NO: 9103778 - DNA, 22 bp, Homo sapiens
gtctttattacaaatccttttc

SEQ ID NO: 9103779 - DNA, 22 bp, Homo sapiens
gtctttatggtatgaaaactga

SEQ ID NO: 9103780 - DNA, 22 bp, Homo sapiens
gtctttatctttgaaattagtc

SEQ ID NO: 9103781 - DNA, 23 bp, Homo sapiens
gtctttatagtggggcactttgt

SEQ ID NO: 9103782 - DNA, 22 bp, Homo sapiens
gtctcccaatccgggacagcct

SEQ ID NO: 9103783 - DNA, 21 bp, Homo sapiens
gtcttggcaccaggagagaga

SEQ ID NO: 9103784 - DNA, 22 bp, Homo sapiens
gtctccagtgttcaggtgactg

SEQ ID NO: 9103785 - DNA, 22 bp, Homo sapiens
gtctccagggctgctggcgcct

SEQ ID NO: 9103786 - DNA, 22 bp, Homo sapiens
gtctccagggctgctggcgcct

SEQ ID NO: 9103787 - DNA, 22 bp, Homo sapiens
gtctataagcaggggaaaactt

SEQ ID NO: 9103788 - DNA, 22 bp, Homo sapiens
gtctaggccatcacaggcgcca

SEQ ID NO: 9103789 - DNA, 22 bp, Homo sapiens
gtctccagaattcttgggaggg

SEQ ID NO: 9103790 - DNA, 22 bp, Homo sapiens
gtctccagatatcctacacaac

SEQ ID NO: 9103791 - DNA, 22 bp, Homo sapiens
gtctccagcccactctagatat

SEQ ID NO: 9103792 - DNA, 22 bp, Homo sapiens
gtctacaaagcatataaaagag

SEQ ID NO: 9103793 - DNA, 22 bp, Homo sapiens
gtctaaggatctgttagctttt

SEQ ID NO: 9103794 - DNA, 22 bp, Homo sapiens
gtctaaactttacagagtcaag

SEQ ID NO: 9103795 - DNA, 22 bp, Homo sapiens
gtctagaatggatgagcatttt

SEQ ID NO: 9103796 - DNA, 22 bp, Homo sapiens
gtgaggagctctttgactcacg

SEQ ID NO: 9103797 - DNA, 22 bp, Homo sapiens
gtgaggagtctgaagcacataa

SEQ ID NO: 9103798 - DNA, 22 bp, Homo sapiens
gtgagccgagtatagttcatag

SEQ ID NO: 9103799 - DNA, 22 bp, Homo sapiens
gtgagcagttgtgagccccaaa

SEQ ID NO: 9103800 - DNA, 21 bp, Homo sapiens
gtctttttaattgcgatttcc

SEQ ID NO: 9103801 - DNA, 22 bp, Homo sapiens
gtcttttgctagccagagagct

SEQ ID NO: 9103802 - DNA, 21 bp, Homo sapiens
gtcttttaagtgaagagaggc

SEQ ID NO: 9103803 - DNA, 22 bp, Homo sapiens
gtctttcatggatattcagttt

SEQ ID NO: 9103804 - DNA, 22 bp, Homo sapiens
gtctttctatgatgaactgttg

SEQ ID NO: 9103805 - DNA, 22 bp, Homo sapiens
gtgaaaaatgatttgttaactg

SEQ ID NO: 9103806 - DNA, 22 bp, Homo sapiens
gtgagcagggcaggactgggga

SEQ ID NO: 9103807 - DNA, 22 bp, Homo sapiens
gtcttttttacaccttacatca

SEQ ID NO: 9103808 - DNA, 22 bp, Homo sapiens
gtgaaaaatcatcatgacttga

SEQ ID NO: 9103809 - DNA, 22 bp, Homo sapiens
gtctttttgtctggcagaggtc

SEQ ID NO: 9103810 - DNA, 22 bp, Homo sapiens
gtcttttttacaccttacatca

SEQ ID NO: 9103811 - DNA, 22 bp, Homo sapiens
gtcttttttacaccttacatca

SEQ ID NO: 9103812 - DNA, 22 bp, Homo sapiens
gtctttttattatagagtggag

SEQ ID NO: 9103813 - DNA, 22 bp, Homo sapiens
gtctttttctacgatagcgcct

SEQ ID NO: 9103814 - DNA, 22 bp, Homo sapiens
ggggatgagactagagctaaag

SEQ ID NO: 9103815 - DNA, 22 bp, Homo sapiens
ggggcaggaggtgttctctttt

SEQ ID NO: 9103816 - DNA, 21 bp, Homo sapiens
ggggatgcgaccacaggctcc

SEQ ID NO: 9103817 - DNA, 22 bp, Homo sapiens
ggggaggctgatgtgggcaaag

SEQ ID NO: 9103818 - DNA, 22 bp, Homo sapiens
ggggcagggaggttatcgccga

SEQ ID NO: 9103819 - DNA, 22 bp, Homo sapiens
ggggccactggcaggaccttgg

SEQ ID NO: 9103820 - DNA, 22 bp, Homo sapiens
ggggccactggcaggaccttgg

SEQ ID NO: 9103821 - DNA, 19 bp, Homo sapiens
ggggagaactagagacagc

SEQ ID NO: 9103822 - DNA, 22 bp, Homo sapiens
ggggagaattacatggcgtgga

SEQ ID NO: 9103823 - DNA, 22 bp, Homo sapiens
ggggaggaagctggaacacggg

SEQ ID NO: 9103824 - DNA, 22 bp, Homo sapiens
ggggaggaagctggaacacggg

SEQ ID NO: 9103825 - DNA, 22 bp, Homo sapiens
ggggaggaagctggaacacggg

SEQ ID NO: 9103826 - DNA, 22 bp, Homo sapiens
ggggaggccagtggaccgtccc

SEQ ID NO: 9103827 - DNA, 22 bp, Homo sapiens
ggggaggccagtggaccgtccc

SEQ ID NO: 9103828 - DNA, 22 bp, Homo sapiens
ggggaggacctttccaaggctt

SEQ ID NO: 9103829 - DNA, 22 bp, Homo sapiens
ggggaggagtgtacaggtttat

SEQ ID NO: 9103830 - DNA, 22 bp, Homo sapiens
gggctggtgaggctgccctgca

SEQ ID NO: 9103831 - DNA, 22 bp, Homo sapiens
gggctggtctggcttagtcagg

SEQ ID NO: 9103832 - DNA, 22 bp, Homo sapiens
gggctctgggattcagagcaag

SEQ ID NO: 9103833 - DNA, 22 bp, Homo sapiens
gggctctgggattcagagcaag

SEQ ID NO: 9103834 - DNA, 22 bp, Homo sapiens
gggcttctctttagtgagctga

SEQ ID NO: 9103835 - DNA, 22 bp, Homo sapiens
gggcttctctcaggggcatgag

SEQ ID NO: 9103836 - DNA, 22 bp, Homo sapiens
gggcttctccctaaggactctg

SEQ ID NO: 9103837 - DNA, 22 bp, Homo sapiens
gggtggagccagttgactctgt

SEQ ID NO: 9103838 - DNA, 22 bp, Homo sapiens
gggtggagccagttgactctgt

SEQ ID NO: 9103839 - DNA, 22 bp, Homo sapiens
gggtggagaggctaagtccagt

SEQ ID NO: 9103840 - DNA, 22 bp, Homo sapiens
gggtggtgagatgtagctgatg

SEQ ID NO: 9103841 - DNA, 22 bp, Homo sapiens
gggtggtgtattagagctgcag

SEQ ID NO: 9103842 - DNA, 22 bp, Homo sapiens
gggtgaggcccatttgaggcca

SEQ ID NO: 9103843 - DNA, 20 bp, Homo sapiens
gggtgaggatggagaatttg

SEQ ID NO: 9103844 - DNA, 22 bp, Homo sapiens
gggtgaggagctgccagtcatg

SEQ ID NO: 9103845 - DNA, 22 bp, Homo sapiens
gggtgcagcagagctcctctgt

SEQ ID NO: 9103846 - DNA, 22 bp, Homo sapiens
gggtgcaggcagcccaggcagg

SEQ ID NO: 9103847 - DNA, 22 bp, Homo sapiens
gggtgcaggcagcccaggcagg

SEQ ID NO: 9103848 - DNA, 18 bp, Homo sapiens
gggtgcaggcactgactg

SEQ ID NO: 9103849 - DNA, 22 bp, Homo sapiens
gggtgcagcagagctcctctgt

SEQ ID NO: 9103850 - DNA, 21 bp, Homo sapiens
gggtgctgtggtcatgcagga

SEQ ID NO: 9103851 - DNA, 21 bp, Homo sapiens
gggtgctgtggtcatgcagga

SEQ ID NO: 9103852 - DNA, 22 bp, Homo sapiens
gggtgctgggaggctgacatct

SEQ ID NO: 9103853 - DNA, 18 bp, Homo sapiens
gggtgctggggccccttg

SEQ ID NO: 9103854 - DNA, 22 bp, Homo sapiens
gggtgctgggaggctgacatct

SEQ ID NO: 9103855 - DNA, 22 bp, Homo sapiens
ggggccagtaggagtgatgtac

SEQ ID NO: 9103856 - DNA, 22 bp, Homo sapiens
ggggtgagtgctcagccccgga

SEQ ID NO: 9103857 - DNA, 22 bp, Homo sapiens
ggggcccagggcagcagtgcag

SEQ ID NO: 9103858 - DNA, 22 bp, Homo sapiens
ggggcccagcacccctcctcgc

SEQ ID NO: 9103859 - DNA, 22 bp, Homo sapiens
ggggcccctgtggcttgatgcc

SEQ ID NO: 9103860 - DNA, 22 bp, Homo sapiens
ggggtgctagagtggggccact

SEQ ID NO: 9103861 - DNA, 22 bp, Homo sapiens
ggggtgggagtgccatccttga

SEQ ID NO: 9103862 - DNA, 22 bp, Homo sapiens
ggggtgggcgtgcagggacacc

SEQ ID NO: 9103863 - DNA, 19 bp, Homo sapiens
ggggtggctggggctccag

SEQ ID NO: 9103864 - DNA, 22 bp, Homo sapiens
ggggtgggagtgccatccttga

SEQ ID NO: 9103865 - DNA, 22 bp, Homo sapiens
ggtggagagctggatgagaggt

SEQ ID NO: 9103866 - DNA, 22 bp, Homo sapiens
ggtggacttctgtttttctctc

SEQ ID NO: 9103867 - DNA, 22 bp, Homo sapiens
ggtggagagctggatgagaggt

SEQ ID NO: 9103868 - DNA, 22 bp, Homo sapiens
ggtggcagagacataggacata

SEQ ID NO: 9103869 - DNA, 22 bp, Homo sapiens
ggtggcagagacataggacata

SEQ ID NO: 9103870 - DNA, 22 bp, Homo sapiens
ggtggcagagacataggacata

SEQ ID NO: 9103871 - DNA, 22 bp, Homo sapiens
ggtgggcaggcgaggcccaggt

SEQ ID NO: 9103872 - DNA, 22 bp, Homo sapiens
ggtggcagaataattgaaggtc

SEQ ID NO: 9103873 - DNA, 19 bp, Homo sapiens
ggtggcagaacgtgggtcc

SEQ ID NO: 9103874 - DNA, 22 bp, Homo sapiens
ggtgggcaggtcactctgcctc

SEQ ID NO: 9103875 - DNA, 22 bp, Homo sapiens
ggtggggattcctgatcactgt

SEQ ID NO: 9103876 - DNA, 22 bp, Homo sapiens
ggtggggccagggctccaacct

SEQ ID NO: 9103877 - DNA, 22 bp, Homo sapiens
ggtggggccagggctccaacct

SEQ ID NO: 9103878 - DNA, 22 bp, Homo sapiens
ggtggggcccaggcatctgatg

SEQ ID NO: 9103879 - DNA, 22 bp, Homo sapiens
ggtgggtgagccctgggagctg

SEQ ID NO: 9103880 - DNA, 22 bp, Homo sapiens
ggtggggcctgctccagcggcc

SEQ ID NO: 9103881 - DNA, 22 bp, Homo sapiens
gtaatgctacaggagtctacat

SEQ ID NO: 9103882 - DNA, 22 bp, Homo sapiens
gtaatgctgtacaccattaaca

SEQ ID NO: 9103883 - DNA, 22 bp, Homo sapiens
ggtttaaaagccatgcatgggg

SEQ ID NO: 9103884 - DNA, 22 bp, Homo sapiens
ggttcagagaaggctaaatagt

SEQ ID NO: 9103885 - DNA, 22 bp, Homo sapiens
ggttcagagtcaggatctaagt

SEQ ID NO: 9103886 - DNA, 22 bp, Homo sapiens
ggttggggcgagctggaggccc

SEQ ID NO: 9103887 - DNA, 22 bp, Homo sapiens
ggttggtaactccctgtgcagt

SEQ ID NO: 9103888 - DNA, 22 bp, Homo sapiens
ggttggtaactccctgtgcagt

SEQ ID NO: 9103889 - DNA, 22 bp, Homo sapiens
ggttaaaaataatttacttggc

SEQ ID NO: 9103890 - DNA, 22 bp, Homo sapiens
ggttaaaactgatattatgggt

SEQ ID NO: 9103891 - DNA, 21 bp, Homo sapiens
ggttaaaagacacatctgttt

SEQ ID NO: 9103892 - DNA, 22 bp, Homo sapiens
ggtggtggagccagctgggagt

SEQ ID NO: 9103893 - DNA, 22 bp, Homo sapiens
ggtggtggagccagctgggagt

SEQ ID NO: 9103894 - DNA, 22 bp, Homo sapiens
ggttacatctcaagtggagtct

SEQ ID NO: 9103895 - DNA, 22 bp, Homo sapiens
ggttacatagtaaggtcctatt

SEQ ID NO: 9103896 - DNA, 22 bp, Homo sapiens
ggttacatgtatgtttggtata

SEQ ID NO: 9103897 - DNA, 22 bp, Homo sapiens
ggttacatggaagaaatataat

SEQ ID NO: 9103898 - DNA, 20 bp, Homo sapiens
ggttacattgtctacatgtg

SEQ ID NO: 9103899 - DNA, 22 bp, Homo sapiens
ggttcacatattgagagtattc

SEQ ID NO: 9103900 - DNA, 22 bp, Homo sapiens
ggttcacactttcatgatttca

SEQ ID NO: 9103901 - DNA, 22 bp, Homo sapiens
ggtgacagcgggtcaagaggag

SEQ ID NO: 9103902 - DNA, 22 bp, Homo sapiens
ggtgagaggcagtgctgtggaa

SEQ ID NO: 9103903 - DNA, 22 bp, Homo sapiens
ggtgacagccgcttggcgctag

SEQ ID NO: 9103904 - DNA, 22 bp, Homo sapiens
ggtgaggcagagggagtaacct

SEQ ID NO: 9103905 - DNA, 18 bp, Homo sapiens
ggtgagggagctggaagc

SEQ ID NO: 9103906 - DNA, 18 bp, Homo sapiens
ggtgagggagctggaagc

SEQ ID NO: 9103907 - DNA, 22 bp, Homo sapiens
ggtgaggcaggtggctgctgag

SEQ ID NO: 9103908 - DNA, 22 bp, Homo sapiens
ggtgaggcccagtgatctgtgt

SEQ ID NO: 9103909 - DNA, 22 bp, Homo sapiens
ggtgaggcctgtacaaagctgc

SEQ ID NO: 9103910 - DNA, 18 bp, Homo sapiens
ggtgaggcggcggccagc

SEQ ID NO: 9103911 - DNA, 22 bp, Homo sapiens
ggtgaggctggcttgccttctt

SEQ ID NO: 9103912 - DNA, 22 bp, Homo sapiens
ggtgaggcgtccccaccatggg

SEQ ID NO: 9103913 - DNA, 22 bp, Homo sapiens
ggtgaggctaagtgacacaggg

SEQ ID NO: 9103914 - DNA, 21 bp, Homo sapiens
ggtgctcgctgatgaggagtg

SEQ ID NO: 9103915 - DNA, 22 bp, Homo sapiens
ggtgctcaaggtgacaggacat

SEQ ID NO: 9103916 - DNA, 22 bp, Homo sapiens
ggtcccaggctgcgggctggtg

SEQ ID NO: 9103917 - DNA, 22 bp, Homo sapiens
ggtcccaggttgacagggagac

SEQ ID NO: 9103918 - DNA, 22 bp, Homo sapiens
ggtcccagtcctctccctgcta

SEQ ID NO: 9103919 - DNA, 23 bp, Homo sapiens
ggtcccagtggagaggcctcacc

SEQ ID NO: 9103920 - DNA, 23 bp, Homo sapiens
ggtcccagtggagaggcctcacc

SEQ ID NO: 9103921 - DNA, 22 bp, Homo sapiens
ggtcccagttgcccaggtcagg

SEQ ID NO: 9103922 - DNA, 22 bp, Homo sapiens
ggtcccagttgcccaggtcagg

SEQ ID NO: 9103923 - DNA, 22 bp, Homo sapiens
ggtcccatgactgacacagcag

SEQ ID NO: 9103924 - DNA, 22 bp, Homo sapiens
ggtccccagcagtggctgcttc

SEQ ID NO: 9103925 - DNA, 22 bp, Homo sapiens
ggtccccccatggtgagcactg

SEQ ID NO: 9103926 - DNA, 22 bp, Homo sapiens
ggtccccgtggaggctggagcg

SEQ ID NO: 9103927 - DNA, 22 bp, Homo sapiens
ggtccccgtggaggctggagcg

SEQ ID NO: 9103928 - DNA, 22 bp, Homo sapiens
ggtccctgaagaggcctggggt

SEQ ID NO: 9103929 - DNA, 22 bp, Homo sapiens
ggtccctgcccacctgggagct

SEQ ID NO: 9103930 - DNA, 23 bp, Homo sapiens
ggtccctgacagcgggcaagttg

SEQ ID NO: 9103931 - DNA, 22 bp, Homo sapiens
gggttggggcccagcagtctgc

SEQ ID NO: 9103932 - DNA, 22 bp, Homo sapiens
gggttgaggcggatgtcggcgg

SEQ ID NO: 9103933 - DNA, 22 bp, Homo sapiens
gggtgtcctgtgccaagctggg

SEQ ID NO: 9103934 - DNA, 22 bp, Homo sapiens
gggtgtccagggcgtgtctgga

SEQ ID NO: 9103935 - DNA, 22 bp, Homo sapiens
gggtgtccagggcgtgtctgga

SEQ ID NO: 9103936 - DNA, 22 bp, Homo sapiens
gggttggggcccagcagtctgc

SEQ ID NO: 9103937 - DNA, 22 bp, Homo sapiens
ggtaaaaatcacaaatacttta

SEQ ID NO: 9103938 - DNA, 22 bp, Homo sapiens
ggtcccagctgctcaagaggct

SEQ ID NO: 9103939 - DNA, 22 bp, Homo sapiens
ggtcccaggaatctgtgttcta

SEQ ID NO: 9103940 - DNA, 22 bp, Homo sapiens
ggtcccaggaagtgcggcggcg

SEQ ID NO: 9103941 - DNA, 22 bp, Homo sapiens
ggtcccaggattggttgcgcag

SEQ ID NO: 9103942 - DNA, 22 bp, Homo sapiens
ggtcccaggctccctcttgtcc

SEQ ID NO: 9103943 - DNA, 22 bp, Homo sapiens
ggtcccaggagaataggtgcaa

SEQ ID NO: 9103944 - DNA, 22 bp, Homo sapiens
ggtcccagctggtcactgtcag

SEQ ID NO: 9103945 - DNA, 22 bp, Homo sapiens
ggtcccagctggtcactgtcag

SEQ ID NO: 9103946 - DNA, 22 bp, Homo sapiens
gctgtcccgaacccctggtaat

SEQ ID NO: 9103947 - DNA, 22 bp, Homo sapiens
gctgtcccgaacccctggtaat

SEQ ID NO: 9103948 - DNA, 22 bp, Homo sapiens
gctgtcccgaacccctggtaat

SEQ ID NO: 9103949 - DNA, 22 bp, Homo sapiens
gctgtcccatggttgcaagatg

SEQ ID NO: 9103950 - DNA, 23 bp, Homo sapiens
gctgtccccatgctccatccctg

SEQ ID NO: 9103951 - DNA, 23 bp, Homo sapiens
gctgtccccatgctccatccctg

SEQ ID NO: 9103952 - DNA, 22 bp, Homo sapiens
gctgtccatgtctggcctcagt

SEQ ID NO: 9103953 - DNA, 22 bp, Homo sapiens
gctgtccatccacttcccagcg

SEQ ID NO: 9103954 - DNA, 22 bp, Homo sapiens
gctgtccatgtctggcctcagt

SEQ ID NO: 9103955 - DNA, 22 bp, Homo sapiens
gctgtcagttttacccacagac

SEQ ID NO: 9103956 - DNA, 22 bp, Homo sapiens
gctgtcagttttacccacagac

SEQ ID NO: 9103957 - DNA, 22 bp, Homo sapiens
gctgtccagagcatgggagcaa

SEQ ID NO: 9103958 - DNA, 22 bp, Homo sapiens
gctgtccagctccagccagcca

SEQ ID NO: 9103959 - DNA, 22 bp, Homo sapiens
gctgtccagagcatgggagcaa

SEQ ID NO: 9103960 - DNA, 22 bp, Homo sapiens
gctgtcccgctgacttccagct

SEQ ID NO: 9103961 - DNA, 23 bp, Homo sapiens
gctgtcctcctgggcccagcagc

SEQ ID NO: 9103962 - DNA, 22 bp, Homo sapiens
gctgtcccttgtcccaccttgc

SEQ ID NO: 9103963 - DNA, 22 bp, Homo sapiens
gctgtccctttcacaaggtttt

SEQ ID NO: 9103964 - DNA, 22 bp, Homo sapiens
gctgtcctggggagggagaatg

SEQ ID NO: 9103965 - DNA, 22 bp, Homo sapiens
gctgtctcatacaaggccctgc

SEQ ID NO: 9103966 - DNA, 22 bp, Homo sapiens
gctgtctgctgggtcgctcagg

SEQ ID NO: 9103967 - DNA, 22 bp, Homo sapiens
gctgtctgtcttcacatctcgc

SEQ ID NO: 9103968 - DNA, 22 bp, Homo sapiens
gctgtctgtctctgtgacttaa

SEQ ID NO: 9103969 - DNA, 22 bp, Homo sapiens
gctgtgtgaccctagccagtag

SEQ ID NO: 9103970 - DNA, 22 bp, Homo sapiens
gctgtctgtggtgtcagctgac

SEQ ID NO: 9103971 - DNA, 23 bp, Homo sapiens
gctgtctgtcatctctgcgggag

SEQ ID NO: 9103972 - DNA, 22 bp, Homo sapiens
gctgtctgctgtgcactgagca

SEQ ID NO: 9103973 - DNA, 22 bp, Homo sapiens
gctgtctgctgtgcactgagca

SEQ ID NO: 9103974 - DNA, 22 bp, Homo sapiens
gctgtctggaggctctgaggga

SEQ ID NO: 9103975 - DNA, 22 bp, Homo sapiens
gctgtctgggatgtcactgctg

SEQ ID NO: 9103976 - DNA, 22 bp, Homo sapiens
gctgtctgggaggcctccactt

SEQ ID NO: 9103977 - DNA, 22 bp, Homo sapiens
gctgtgtgctcacgtagtggaa

SEQ ID NO: 9103978 - DNA, 22 bp, Homo sapiens
gctgtgtgctcacgtagtggaa

SEQ ID NO: 9103979 - DNA, 22 bp, Homo sapiens
gctgtgtgctaggatatgtttt

SEQ ID NO: 9103980 - DNA, 22 bp, Homo sapiens
gctgtgtgactgagagcctggc

SEQ ID NO: 9103981 - DNA, 22 bp, Homo sapiens
gctgtgtgactgagagcctggc

SEQ ID NO: 9103982 - DNA, 22 bp, Homo sapiens
gctgtgtgactgagagcctggc

SEQ ID NO: 9103983 - DNA, 19 bp, Homo sapiens
gctgtgtgaccttgggcaa

SEQ ID NO: 9103984 - DNA, 19 bp, Homo sapiens
gctgtgtgaccttgggcaa

SEQ ID NO: 9103985 - DNA, 19 bp, Homo sapiens
gctgtgtgaccttgggcaa

SEQ ID NO: 9103986 - DNA, 19 bp, Homo sapiens
gctgtgtgaccttgggcaa

SEQ ID NO: 9103987 - DNA, 22 bp, Homo sapiens
gctgtgtgacctgggcaagtct

SEQ ID NO: 9103988 - DNA, 22 bp, Homo sapiens
gctgtatttaacaactggctca

SEQ ID NO: 9103989 - DNA, 22 bp, Homo sapiens
gctgtattggaacacatccatg

SEQ ID NO: 9103990 - DNA, 22 bp, Homo sapiens
gctgtcacaaatatttctcagc

SEQ ID NO: 9103991 - DNA, 22 bp, Homo sapiens
gctgtatttatatgaaggcatg

SEQ ID NO: 9103992 - DNA, 22 bp, Homo sapiens
gctgtatttattttctagggtt

SEQ ID NO: 9103993 - DNA, 22 bp, Homo sapiens
gctgtattcctgcactgtatag

SEQ ID NO: 9103994 - DNA, 22 bp, Homo sapiens
gctgtattcctgcactgtatag

SEQ ID NO: 9103995 - DNA, 19 bp, Homo sapiens
gctgtattaaagatacatg

SEQ ID NO: 9103996 - DNA, 22 bp, Homo sapiens
gctgtagtgaatggccgcgttc

SEQ ID NO: 9103997 - DNA, 22 bp, Homo sapiens
gctgtcagtgaggtgagacatg

SEQ ID NO: 9103998 - DNA, 23 bp, Homo sapiens
gctgtcagttgtttttgtctcta

SEQ ID NO: 9103999 - DNA, 22 bp, Homo sapiens
gctgtcagtgaggtgagacatg

SEQ ID NO: 9104000 - DNA, 22 bp, Homo sapiens
gctgtcaggaacatgccttggt

SEQ ID NO: 9104001 - DNA, 22 bp, Homo sapiens
gctgtcaggccatgtgggcctt

SEQ ID NO: 9104002 - DNA, 22 bp, Homo sapiens
gctgtcactcaccaggcctgca

SEQ ID NO: 9104003 - DNA, 22 bp, Homo sapiens
gctgtcactctccggccttccc

SEQ ID NO: 9104004 - DNA, 22 bp, Homo sapiens
gctgtcagaaggtgaagggtaa

SEQ ID NO: 9104005 - DNA, 22 bp, Homo sapiens
gctgtcagcgcccaaggagctc

SEQ ID NO: 9104006 - DNA, 22 bp, Homo sapiens
gctgtcacacatgggatctcag

SEQ ID NO: 9104007 - DNA, 22 bp, Homo sapiens
gctgtcacacatggccccagct

SEQ ID NO: 9104008 - DNA, 22 bp, Homo sapiens
gctgtcacaagcatctggggca

SEQ ID NO: 9104009 - DNA, 22 bp, Homo sapiens
gctgtcacatttggagcactgg

SEQ ID NO: 9104010 - DNA, 22 bp, Homo sapiens
gctgtcacatcaaggcactaaa

SEQ ID NO: 9104011 - DNA, 22 bp, Homo sapiens
gctgtcaccaaagcaggcactg

SEQ ID NO: 9104012 - DNA, 22 bp, Homo sapiens
gctgtacagtttactaggtggg

SEQ ID NO: 9104013 - DNA, 22 bp, Homo sapiens
gctggtccagggcctctgtggg

SEQ ID NO: 9104014 - DNA, 22 bp, Homo sapiens
gctggtccacatcctggtacgt

SEQ ID NO: 9104015 - DNA, 22 bp, Homo sapiens
gctggccaggaagagtctcaga

SEQ ID NO: 9104016 - DNA, 22 bp, Homo sapiens
gctggccacagatccccaggga

SEQ ID NO: 9104017 - DNA, 22 bp, Homo sapiens
gctggccacagatccccaggga

SEQ ID NO: 9104018 - DNA, 22 bp, Homo sapiens
gctggccacagatccccaggga

SEQ ID NO: 9104019 - DNA, 22 bp, Homo sapiens
gctggccacactgctgatggag

SEQ ID NO: 9104020 - DNA, 22 bp, Homo sapiens
gctggccacactgctgatggag

SEQ ID NO: 9104021 - DNA, 22 bp, Homo sapiens
gctggccaaagtgtacctggag

SEQ ID NO: 9104022 - DNA, 22 bp, Homo sapiens
gctggccacattgtgccgtcct

SEQ ID NO: 9104023 - DNA, 19 bp, Homo sapiens
gctggccacgccccagttg

SEQ ID NO: 9104024 - DNA, 22 bp, Homo sapiens
gctggccagccctcttcctcca

SEQ ID NO: 9104025 - DNA, 19 bp, Homo sapiens
gctggccacgccccagttg

SEQ ID NO: 9104026 - DNA, 22 bp, Homo sapiens
gctggccaggaagagtctcaga

SEQ ID NO: 9104027 - DNA, 22 bp, Homo sapiens
gcttttaattagttgcttccat

SEQ ID NO: 9104028 - DNA, 22 bp, Homo sapiens
gcttttcatagataaaattcta

SEQ ID NO: 9104029 - DNA, 22 bp, Homo sapiens
gctttttcaaatgaaagctggt

SEQ ID NO: 9104030 - DNA, 20 bp, Homo sapiens
gctttttctaatagcagtcc

SEQ ID NO: 9104031 - DNA, 20 bp, Homo sapiens
gctttttctaatagcagtcc

SEQ ID NO: 9104032 - DNA, 21 bp, Homo sapiens
gctttttgtatggcccaggaa

SEQ ID NO: 9104033 - DNA, 19 bp, Homo sapiens
gctttttgttgtcaaaggt

SEQ ID NO: 9104034 - DNA, 22 bp, Homo sapiens
gctttgggagtcagatttgcgc

SEQ ID NO: 9104035 - DNA, 22 bp, Homo sapiens
gctttatagccctattacatga

SEQ ID NO: 9104036 - DNA, 22 bp, Homo sapiens
gctttagatactcccaatgtcc

SEQ ID NO: 9104037 - DNA, 22 bp, Homo sapiens
gctttagaaatatcactgtgga

SEQ ID NO: 9104038 - DNA, 22 bp, Homo sapiens
gctttacacagatgaatatttc

SEQ ID NO: 9104039 - DNA, 22 bp, Homo sapiens
gctttacagagaaagtttgcct

SEQ ID NO: 9104040 - DNA, 22 bp, Homo sapiens
gcttggttactgatggaaagga

SEQ ID NO: 9104041 - DNA, 21 bp, Homo sapiens
gcttggttttggttacttgcc

SEQ ID NO: 9104042 - DNA, 22 bp, Homo sapiens
gctgtgtgctcacgtagtggaa

SEQ ID NO: 9104043 - DNA, 22 bp, Homo sapiens
gctgtgtgctgggcatggcact

SEQ ID NO: 9104044 - DNA, 22 bp, Homo sapiens
gctgtgtgttcaataatgtgat

SEQ ID NO: 9104045 - DNA, 22 bp, Homo sapiens
gctgtgtgttcaataatgtgat

SEQ ID NO: 9104046 - DNA, 22 bp, Homo sapiens
gctgttggcgaggagctcagct

SEQ ID NO: 9104047 - DNA, 22 bp, Homo sapiens
gctgtttcgggtggaggtggag

SEQ ID NO: 9104048 - DNA, 22 bp, Homo sapiens
gctgtttcggcctcctggggaa

SEQ ID NO: 9104049 - DNA, 22 bp, Homo sapiens
gctgtttctaagctggttccta

SEQ ID NO: 9104050 - DNA, 22 bp, Homo sapiens
gctgtttctaccagaagaatca

SEQ ID NO: 9104051 - DNA, 23 bp, Homo sapiens
gctgtttccccatgtgctgaagg

SEQ ID NO: 9104052 - DNA, 22 bp, Homo sapiens
gctgtttccatttaagtgaatc

SEQ ID NO: 9104053 - DNA, 22 bp, Homo sapiens
gctgtttcccgtgcgctgcgtc

SEQ ID NO: 9104054 - DNA, 22 bp, Homo sapiens
gctgtttcctacatggtgttat

SEQ ID NO: 9104055 - DNA, 22 bp, Homo sapiens
gctgtttccccttcacagtggc

SEQ ID NO: 9104056 - DNA, 23 bp, Homo sapiens
gctgtttcacaacagccgtgttt

SEQ ID NO: 9104057 - DNA, 22 bp, Homo sapiens
gctgtttccagttacgtggata

SEQ ID NO: 9104058 - DNA, 22 bp, Homo sapiens
gctgtttccagacaatgtcttt

SEQ ID NO: 9104059 - DNA, 22 bp, Homo sapiens
gctgtttctgtggtgtatagcc

SEQ ID NO: 9104060 - DNA, 22 bp, Homo sapiens
gctgtttctggttctgttccta

SEQ ID NO: 9104061 - DNA, 22 bp, Homo sapiens
gctgtttctgagtagctaggct

SEQ ID NO: 9104062 - DNA, 22 bp, Homo sapiens
gctgtttcttgaggctactcct

SEQ ID NO: 9104063 - DNA, 22 bp, Homo sapiens
gctgtttctttcctggcacttg

SEQ ID NO: 9104064 - DNA, 22 bp, Homo sapiens
gctgtttctttgatgatggaat

SEQ ID NO: 9104065 - DNA, 22 bp, Homo sapiens
gctgtttctctcccaccccttc

SEQ ID NO: 9104066 - DNA, 22 bp, Homo sapiens
gctgtttctcttgagtcaaaat

SEQ ID NO: 9104067 - DNA, 22 bp, Homo sapiens
gctgtttctccaggtcaggaag

SEQ ID NO: 9104068 - DNA, 17 bp, Homo sapiens
gctgtttctccagaagt

SEQ ID NO: 9104069 - DNA, 22 bp, Homo sapiens
gctgtttctttggcaaactgat

SEQ ID NO: 9104070 - DNA, 22 bp, Homo sapiens
ggagcctggcaatgctgcgtcc

SEQ ID NO: 9104071 - DNA, 23 bp, Homo sapiens
ggagcctggcatatgagacgcat

SEQ ID NO: 9104072 - DNA, 23 bp, Homo sapiens
ggagcctggcatatgagacgcat

SEQ ID NO: 9104073 - DNA, 22 bp, Homo sapiens
ggagcctggcccggcccttggc

SEQ ID NO: 9104074 - DNA, 22 bp, Homo sapiens
ggagcctggcccggcccttggc

SEQ ID NO: 9104075 - DNA, 22 bp, Homo sapiens
ggagccccaattgagcagtacg

SEQ ID NO: 9104076 - DNA, 22 bp, Homo sapiens
ggagccccaattgagcagtacg

SEQ ID NO: 9104077 - DNA, 18 bp, Homo sapiens
ggagcccagaggtgagtt

SEQ ID NO: 9104078 - DNA, 19 bp, Homo sapiens
ggagcctggagcacgtgcc

SEQ ID NO: 9104079 - DNA, 22 bp, Homo sapiens
ggagccctcaccggcgagtgcc

SEQ ID NO: 9104080 - DNA, 22 bp, Homo sapiens
ggagccctcaccggcgagtgcc

SEQ ID NO: 9104081 - DNA, 22 bp, Homo sapiens
ggagccagtttagacctcagtt

SEQ ID NO: 9104082 - DNA, 22 bp, Homo sapiens
ggagccagtatttagtggtctt

SEQ ID NO: 9104083 - DNA, 18 bp, Homo sapiens
ggagccagtctgtctctg

SEQ ID NO: 9104084 - DNA, 18 bp, Homo sapiens
ggagcccagaggacagga

SEQ ID NO: 9104085 - DNA, 22 bp, Homo sapiens
ggagccatgttttcagcatgat

SEQ ID NO: 9104086 - DNA, 22 bp, Homo sapiens
ggagcccaagtctgcactcggc

SEQ ID NO: 9104087 - DNA, 18 bp, Homo sapiens
ggagcccacggcgtccca

SEQ ID NO: 9104088 - DNA, 22 bp, Homo sapiens
ggagaagcagcttcttgatgaa

SEQ ID NO: 9104089 - DNA, 22 bp, Homo sapiens
ggagaagaggagctggaagcct

SEQ ID NO: 9104090 - DNA, 22 bp, Homo sapiens
ggagaaaggcatagcagaacct

SEQ ID NO: 9104091 - DNA, 22 bp, Homo sapiens
ggagctgtgggacgctgtccca

SEQ ID NO: 9104092 - DNA, 22 bp, Homo sapiens
ggagctgtgggacgctgtccca

SEQ ID NO: 9104093 - DNA, 22 bp, Homo sapiens
ggagctgttatggcataagcat

SEQ ID NO: 9104094 - DNA, 22 bp, Homo sapiens
ggagctgttaaatgcagaattt

SEQ ID NO: 9104095 - DNA, 22 bp, Homo sapiens
ggagctgtctgtagggcacagg

SEQ ID NO: 9104096 - DNA, 22 bp, Homo sapiens
ggagctgtaacgagccattgct

SEQ ID NO: 9104097 - DNA, 22 bp, Homo sapiens
ggagctgtaacgagccattgct

SEQ ID NO: 9104098 - DNA, 22 bp, Homo sapiens
ggagctgtgcagtgactacaga

SEQ ID NO: 9104099 - DNA, 22 bp, Homo sapiens
ggagctgtaacgagccattgct

SEQ ID NO: 9104100 - DNA, 22 bp, Homo sapiens
ggagctggtcagccttgagcat

SEQ ID NO: 9104101 - DNA, 22 bp, Homo sapiens
ggagctggtcagccttgagcat

SEQ ID NO: 9104102 - DNA, 22 bp, Homo sapiens
ggagctggggttggcatcttcc

SEQ ID NO: 9104103 - DNA, 22 bp, Homo sapiens
ggagctggggttggcatcttcc

SEQ ID NO: 9104104 - DNA, 21 bp, Homo sapiens
ggagctggggagctggcccca

SEQ ID NO: 9104105 - DNA, 21 bp, Homo sapiens
ggagctggggagctggcccca

SEQ ID NO: 9104106 - DNA, 19 bp, Homo sapiens
ggagcttggtggctgtggc

SEQ ID NO: 9104107 - DNA, 22 bp, Homo sapiens
ggagctgttggcagctatcttg

SEQ ID NO: 9104108 - DNA, 22 bp, Homo sapiens
ggagctgttgcgcatgcgctcg

SEQ ID NO: 9104109 - DNA, 22 bp, Homo sapiens
ggagctgttgcgcatgcgctcg

SEQ ID NO: 9104110 - DNA, 22 bp, Homo sapiens
ggaggaggggcgctttgtctat

SEQ ID NO: 9104111 - DNA, 22 bp, Homo sapiens
ggagctggccgcctatgtgcag

SEQ ID NO: 9104112 - DNA, 20 bp, Homo sapiens
ggagctgccctgggctggag

SEQ ID NO: 9104113 - DNA, 22 bp, Homo sapiens
ggagctgcatttagggagcctt

SEQ ID NO: 9104114 - DNA, 22 bp, Homo sapiens
ggagctgctcagagccagtccc

SEQ ID NO: 9104115 - DNA, 22 bp, Homo sapiens
ggagctggctacagagaactcc

SEQ ID NO: 9104116 - DNA, 22 bp, Homo sapiens
ggagcctgggcattagtaattt

SEQ ID NO: 9104117 - DNA, 22 bp, Homo sapiens
ggagcctggcctggctctgtgt

SEQ ID NO: 9104118 - DNA, 22 bp, Homo sapiens
ggagcctgggcctcctgccctt

SEQ ID NO: 9104119 - DNA, 22 bp, Homo sapiens
ggagcctgggcctcctgccctt

SEQ ID NO: 9104120 - DNA, 22 bp, Homo sapiens
ggagctgcatttagggagcctt

SEQ ID NO: 9104121 - DNA, 22 bp, Homo sapiens
ggagctgggaactatgtagtat

SEQ ID NO: 9104122 - DNA, 22 bp, Homo sapiens
ggagctgggaattggatcatct

SEQ ID NO: 9104123 - DNA, 22 bp, Homo sapiens
ggagctgggaattggatcatct

SEQ ID NO: 9104124 - DNA, 22 bp, Homo sapiens
ggagctgggaccctgtcatctg

SEQ ID NO: 9104125 - DNA, 22 bp, Homo sapiens
ggagctgggaccctgtcatctg

SEQ ID NO: 9104126 - DNA, 22 bp, Homo sapiens
ggagctgggaccctgtcatctg

SEQ ID NO: 9104127 - DNA, 22 bp, Homo sapiens
ggagctgggaccctgtcatctg

SEQ ID NO: 9104128 - DNA, 18 bp, Homo sapiens
ggagctgggccccactcc

SEQ ID NO: 9104129 - DNA, 18 bp, Homo sapiens
ggagctgggcctggttcc

SEQ ID NO: 9104130 - DNA, 18 bp, Homo sapiens
ggagctgggcctggttcc

SEQ ID NO: 9104131 - DNA, 21 bp, Homo sapiens
ggagctggggagctggcccca

SEQ ID NO: 9104132 - DNA, 22 bp, Homo sapiens
ggactgggtcactaagatagta

SEQ ID NO: 9104133 - DNA, 21 bp, Homo sapiens
ggacttggatggtggcagtag

SEQ ID NO: 9104134 - DNA, 21 bp, Homo sapiens
ggacttggatggtggcagtag

SEQ ID NO: 9104135 - DNA, 22 bp, Homo sapiens
ggacttgcaggggagactgcgt

SEQ ID NO: 9104136 - DNA, 22 bp, Homo sapiens
ggactgggaatcagggagatgc

SEQ ID NO: 9104137 - DNA, 22 bp, Homo sapiens
ggagaaagctgtagtggaatgt

SEQ ID NO: 9104138 - DNA, 22 bp, Homo sapiens
ggagaaaggcatagcagaacct

SEQ ID NO: 9104139 - DNA, 22 bp, Homo sapiens
ggagaaaggcatagcagaacct

SEQ ID NO: 9104140 - DNA, 22 bp, Homo sapiens
ggagaaaattgatgaagttggc

SEQ ID NO: 9104141 - DNA, 22 bp, Homo sapiens
ggagaaagaagacgaacattgt

SEQ ID NO: 9104142 - DNA, 22 bp, Homo sapiens
ggagaaagaaatttttgattgg

SEQ ID NO: 9104143 - DNA, 22 bp, Homo sapiens
ggacttggggaaggcacagtta

SEQ ID NO: 9104144 - DNA, 22 bp, Homo sapiens
ggacaggatgctgaagatgaag

SEQ ID NO: 9104145 - DNA, 22 bp, Homo sapiens
ggacaggcccggggagcctgga

SEQ ID NO: 9104146 - DNA, 22 bp, Homo sapiens
ggacaggcccggggagcctgga

SEQ ID NO: 9104147 - DNA, 22 bp, Homo sapiens
ggacaggccctctggtcagctt

SEQ ID NO: 9104148 - DNA, 22 bp, Homo sapiens
ggacaggctgcatctgagcatg

SEQ ID NO: 9104149 - DNA, 22 bp, Homo sapiens
ggacaggctgcatctgagcatg

SEQ ID NO: 9104150 - DNA, 22 bp, Homo sapiens
ggacagggctcttggcactcct

SEQ ID NO: 9104151 - DNA, 23 bp, Homo sapiens
ggacagggccctgccctatggcc

SEQ ID NO: 9104152 - DNA, 22 bp, Homo sapiens
ggacagggatcattatctgagc

SEQ ID NO: 9104153 - DNA, 22 bp, Homo sapiens
ggacaggggcgtggggattgtt

SEQ ID NO: 9104154 - DNA, 22 bp, Homo sapiens
ggaaggagcatttgccagttta

SEQ ID NO: 9104155 - DNA, 22 bp, Homo sapiens
ggaaggagcatttgccagttta

SEQ ID NO: 9104156 - DNA, 19 bp, Homo sapiens
ggaaggagagaaatgcatg

SEQ ID NO: 9104157 - DNA, 22 bp, Homo sapiens
ggaaaaatagagtatactttaa

SEQ ID NO: 9104158 - DNA, 22 bp, Homo sapiens
ggaaaaatagagtatactttaa

SEQ ID NO: 9104159 - DNA, 22 bp, Homo sapiens
ggaaggagggcggcaatgatga

SEQ ID NO: 9104160 - DNA, 22 bp, Homo sapiens
ggaaggagggcggcaatgatga

SEQ ID NO: 9104161 - DNA, 22 bp, Homo sapiens
ggaaggagccatatcatatcca

SEQ ID NO: 9104162 - DNA, 22 bp, Homo sapiens
ggaaggaggatgctctggcctt

SEQ ID NO: 9104163 - DNA, 22 bp, Homo sapiens
ggaaggatctggctgaaatcca

SEQ ID NO: 9104164 - DNA, 18 bp, Homo sapiens
ggaaggagtggaccccag

SEQ ID NO: 9104165 - DNA, 22 bp, Homo sapiens
ggaaggagtctttaacacccat

SEQ ID NO: 9104166 - DNA, 19 bp, Homo sapiens
ggaaggcagaggggctgtg

SEQ ID NO: 9104167 - DNA, 19 bp, Homo sapiens
ggaaggcagaggggctgtg

SEQ ID NO: 9104168 - DNA, 22 bp, Homo sapiens
ggaaggaggggcaaagcagttc

SEQ ID NO: 9104169 - DNA, 22 bp, Homo sapiens
ggacaggatgctgaagatgaag

SEQ ID NO: 9104170 - DNA, 22 bp, Homo sapiens
ggacagagggttgacagagtat

SEQ ID NO: 9104171 - DNA, 22 bp, Homo sapiens
ggacagagggttgacagagtat

SEQ ID NO: 9104172 - DNA, 22 bp, Homo sapiens
ggaaggctttgtagaagtgcca

SEQ ID NO: 9104173 - DNA, 22 bp, Homo sapiens
ggaagggaaaattcattcggct

SEQ ID NO: 9104174 - DNA, 22 bp, Homo sapiens
ggaagggaatccatctggttag

SEQ ID NO: 9104175 - DNA, 22 bp, Homo sapiens
ggaaggcagaggtgtcgtgggg

SEQ ID NO: 9104176 - DNA, 22 bp, Homo sapiens
ggaaggcagaggtgtcgtgggg

SEQ ID NO: 9104177 - DNA, 19 bp, Homo sapiens
ggaaggcagaggggctgtg

SEQ ID NO: 9104178 - DNA, 22 bp, Homo sapiens
ggaaggcagtgaaggggctgat

SEQ ID NO: 9104179 - DNA, 22 bp, Homo sapiens
ggaaggcagtgaaggggctgat

SEQ ID NO: 9104180 - DNA, 22 bp, Homo sapiens
ggaaggcagtgaaggggctgat

SEQ ID NO: 9104181 - DNA, 19 bp, Homo sapiens
ggaaggccacggcaggctt

SEQ ID NO: 9104182 - DNA, 19 bp, Homo sapiens
ggaaggccacggcaggctt

SEQ ID NO: 9104183 - DNA, 22 bp, Homo sapiens
gcctggagttcagccaagtccc

SEQ ID NO: 9104184 - DNA, 22 bp, Homo sapiens
gcctggagttcagccaagtccc

SEQ ID NO: 9104185 - DNA, 20 bp, Homo sapiens
gcctggcacccggggctggc

SEQ ID NO: 9104186 - DNA, 22 bp, Homo sapiens
gcctggagtggtcctgctgccc

SEQ ID NO: 9104187 - DNA, 22 bp, Homo sapiens
gcctggagtggtcctgctgccc

SEQ ID NO: 9104188 - DNA, 22 bp, Homo sapiens
gcctggcaggcctcatgagggg

SEQ ID NO: 9104189 - DNA, 22 bp, Homo sapiens
gcctggcactcactgaagaggc

SEQ ID NO: 9104190 - DNA, 22 bp, Homo sapiens
gctagaagttgggcctggtgct

SEQ ID NO: 9104191 - DNA, 19 bp, Homo sapiens
gctagaagatagaatgaaa

SEQ ID NO: 9104192 - DNA, 22 bp, Homo sapiens
gctagcctgcagtggctatggt

SEQ ID NO: 9104193 - DNA, 22 bp, Homo sapiens
gctaggaaaggaagaactttga

SEQ ID NO: 9104194 - DNA, 22 bp, Homo sapiens
gctagctttataatgctgggcg

SEQ ID NO: 9104195 - DNA, 22 bp, Homo sapiens
gctagctttataatgctgggcg

SEQ ID NO: 9104196 - DNA, 22 bp, Homo sapiens
gctaggaagaagggtgcttgaa

SEQ ID NO: 9104197 - DNA, 22 bp, Homo sapiens
gctaggaagaagggtgcttgaa

SEQ ID NO: 9104198 - DNA, 22 bp, Homo sapiens
gctaggaagctggggagaagtc

SEQ ID NO: 9104199 - DNA, 22 bp, Homo sapiens
gctaggaatcggacccaggaag

SEQ ID NO: 9104200 - DNA, 22 bp, Homo sapiens
gctaggctgaatatggtgctta

SEQ ID NO: 9104201 - DNA, 22 bp, Homo sapiens
gctaggctcggaagcagcaggg

SEQ ID NO: 9104202 - DNA, 16 bp, Homo sapiens
gctaggcaacaggctg

SEQ ID NO: 9104203 - DNA, 22 bp, Homo sapiens
gctcagtgaagggtgccaagta

SEQ ID NO: 9104204 - DNA, 22 bp, Homo sapiens
gctcagtgaatttttgcccatg

SEQ ID NO: 9104205 - DNA, 22 bp, Homo sapiens
gctcagtgagatattgactcca

SEQ ID NO: 9104206 - DNA, 22 bp, Homo sapiens
gctcagtgaaacatcaaatagt

SEQ ID NO: 9104207 - DNA, 22 bp, Homo sapiens
gctcagggcgcgagggacgtgg

SEQ ID NO: 9104208 - DNA, 22 bp, Homo sapiens
gctcagtgcatcattccaggct

SEQ ID NO: 9104209 - DNA, 20 bp, Homo sapiens
gctcagtggagaaatgcacc

SEQ ID NO: 9104210 - DNA, 22 bp, Homo sapiens
gctcagtgcagcctttctgtat

SEQ ID NO: 9104211 - DNA, 22 bp, Homo sapiens
gctcagtgcatcattccaggct

SEQ ID NO: 9104212 - DNA, 19 bp, Homo sapiens
gctcagtgatgccagacca

SEQ ID NO: 9104213 - DNA, 22 bp, Homo sapiens
gctcagtgtttctggtagaaaa

SEQ ID NO: 9104214 - DNA, 22 bp, Homo sapiens
gctcagtgttcatctgtatgca

SEQ ID NO: 9104215 - DNA, 22 bp, Homo sapiens
gctcagtgtgttcaagggctca

SEQ ID NO: 9104216 - DNA, 22 bp, Homo sapiens
gctcagtgtgcacgagtactct

SEQ ID NO: 9104217 - DNA, 22 bp, Homo sapiens
gctcagtggtattcggaaactg

SEQ ID NO: 9104218 - DNA, 18 bp, Homo sapiens
gctcagtgtgttaacact

SEQ ID NO: 9104219 - DNA, 22 bp, Homo sapiens
gctcagtgtggtcctcagatgt

SEQ ID NO: 9104220 - DNA, 23 bp, Homo sapiens
gctcatcaggcttagagtcaagg

SEQ ID NO: 9104221 - DNA, 22 bp, Homo sapiens
gctcccagactgaccagaggtg

SEQ ID NO: 9104222 - DNA, 22 bp, Homo sapiens
gctcccagactgaccagaggtg

SEQ ID NO: 9104223 - DNA, 22 bp, Homo sapiens
gctcccagcaattgaggcagcc

SEQ ID NO: 9104224 - DNA, 22 bp, Homo sapiens
gctcccagcaattgaggcagcc

SEQ ID NO: 9104225 - DNA, 22 bp, Homo sapiens
gctcccagcaattgaggcagcc

SEQ ID NO: 9104226 - DNA, 22 bp, Homo sapiens
gctcccagatttcagccttgtg

SEQ ID NO: 9104227 - DNA, 22 bp, Homo sapiens
gctcagggagagagggcagccg

SEQ ID NO: 9104228 - DNA, 22 bp, Homo sapiens
gctcagggagtttcacagtgta

SEQ ID NO: 9104229 - DNA, 20 bp, Homo sapiens
gctcagggcctgggtctgga

SEQ ID NO: 9104230 - DNA, 20 bp, Homo sapiens
gctcagggcctgggtctgga

SEQ ID NO: 9104231 - DNA, 22 bp, Homo sapiens
gctcagggccatggaccagcag

SEQ ID NO: 9104232 - DNA, 22 bp, Homo sapiens
gctcagggcctggctgcggact

SEQ ID NO: 9104233 - DNA, 22 bp, Homo sapiens
gctagtccacagccatccaggc

SEQ ID NO: 9104234 - DNA, 22 bp, Homo sapiens
gctcagggaaggccacgtgaga

SEQ ID NO: 9104235 - DNA, 22 bp, Homo sapiens
gctcagggaatgagaagatgtt

SEQ ID NO: 9104236 - DNA, 22 bp, Homo sapiens
gctcagggaactttttgcaggc

SEQ ID NO: 9104237 - DNA, 20 bp, Homo sapiens
gctcagggaattcaggaagc

SEQ ID NO: 9104238 - DNA, 22 bp, Homo sapiens
gctctcccgcagcctggtgggc

SEQ ID NO: 9104239 - DNA, 19 bp, Homo sapiens
gctctccctctcagttgag

SEQ ID NO: 9104240 - DNA, 19 bp, Homo sapiens
gctctccctctcagttgag

SEQ ID NO: 9104241 - DNA, 19 bp, Homo sapiens
gctctccctctcagttgag

SEQ ID NO: 9104242 - DNA, 22 bp, Homo sapiens
gctccctctgctcaggcacttg

SEQ ID NO: 9104243 - DNA, 21 bp, Homo sapiens
gctctccagggccagcccagg

SEQ ID NO: 9104244 - DNA, 22 bp, Homo sapiens
gctctctgaggtgctggcagag

SEQ ID NO: 9104245 - DNA, 22 bp, Homo sapiens
gctctctgcaagtcagcagcct

SEQ ID NO: 9104246 - DNA, 21 bp, Homo sapiens
gctctctgcatggtggctcag

SEQ ID NO: 9104247 - DNA, 22 bp, Homo sapiens
gctctctgaggtgctggcagag

SEQ ID NO: 9104248 - DNA, 22 bp, Homo sapiens
gctcccaggaagagaagggcca

SEQ ID NO: 9104249 - DNA, 22 bp, Homo sapiens
gctcccaggaagagaagggcca

SEQ ID NO: 9104250 - DNA, 22 bp, Homo sapiens
gctcccaggaagagaagggcca

SEQ ID NO: 9104251 - DNA, 22 bp, Homo sapiens
gctcccagctggagcctcaaca

SEQ ID NO: 9104252 - DNA, 22 bp, Homo sapiens
gctcccagcattgcttcccagg

SEQ ID NO: 9104253 - DNA, 22 bp, Homo sapiens
gctcccagcattgctgctgaat

SEQ ID NO: 9104254 - DNA, 22 bp, Homo sapiens
gctcccagcattgctgctgaat

SEQ ID NO: 9104255 - DNA, 22 bp, Homo sapiens
gctccccattgatctgcaggct

SEQ ID NO: 9104256 - DNA, 22 bp, Homo sapiens
gctcccaggatgaggagccagg

SEQ ID NO: 9104257 - DNA, 22 bp, Homo sapiens
gctccccattgatctgcaggct

SEQ ID NO: 9104258 - DNA, 22 bp, Homo sapiens
gctccccttggtcctcctggga

SEQ ID NO: 9104259 - DNA, 22 bp, Homo sapiens
gctccctcccaccagcctgcag

SEQ ID NO: 9104260 - DNA, 22 bp, Homo sapiens
gctccctccatgaggcagaccg

SEQ ID NO: 9104261 - DNA, 22 bp, Homo sapiens
gctctgggtagccactgcctgg

SEQ ID NO: 9104262 - DNA, 22 bp, Homo sapiens
gctctgggtagccactgcctgg

SEQ ID NO: 9104263 - DNA, 22 bp, Homo sapiens
gctctctgtcgttatgcttcat

SEQ ID NO: 9104264 - DNA, 22 bp, Homo sapiens
gctctctgttattaagatcttt

SEQ ID NO: 9104265 - DNA, 22 bp, Homo sapiens
gctctcttgacagcttgctgtt

SEQ ID NO: 9104266 - DNA, 22 bp, Homo sapiens
gctctggggttggaaagtgatc

SEQ ID NO: 9104267 - DNA, 22 bp, Homo sapiens
gctctcttggtggctgtcctgg

SEQ ID NO: 9104268 - DNA, 22 bp, Homo sapiens
gctctctgggtggtgggcaaca

SEQ ID NO: 9104269 - DNA, 22 bp, Homo sapiens
gctctctggaggccatggacag

SEQ ID NO: 9104270 - DNA, 22 bp, Homo sapiens
gctctctggaggccatggacag

SEQ ID NO: 9104271 - DNA, 22 bp, Homo sapiens
gctctctgcctttctcaatgac

SEQ ID NO: 9104272 - DNA, 22 bp, Homo sapiens
gctctctgcctttctcaatgac

SEQ ID NO: 9104273 - DNA, 22 bp, Homo sapiens
gctctctgccatatgaggatac

SEQ ID NO: 9104274 - DNA, 22 bp, Homo sapiens
gctctgtcttcagcacacagta

SEQ ID NO: 9104275 - DNA, 20 bp, Homo sapiens
gctctgtctggcctactttt

SEQ ID NO: 9104276 - DNA, 22 bp, Homo sapiens
gctctgtccagcgtgcacagaa

SEQ ID NO: 9104277 - DNA, 21 bp, Homo sapiens
gctctgtccctgctgtgtgtc

SEQ ID NO: 9104278 - DNA, 21 bp, Homo sapiens
gctctgtccctgctgtgtgtc

SEQ ID NO: 9104279 - DNA, 22 bp, Homo sapiens
gctctgtcattttgcagacact

SEQ ID NO: 9104280 - DNA, 22 bp, Homo sapiens
gctctgtcaacagctagctgtg

SEQ ID NO: 9104281 - DNA, 22 bp, Homo sapiens
gctctgtcaacagctagctgtg

SEQ ID NO: 9104282 - DNA, 22 bp, Homo sapiens
gctctgtgagtattggccctgg

SEQ ID NO: 9104283 - DNA, 22 bp, Homo sapiens
gctctgtggcaggaggtcttgt

SEQ ID NO: 9104284 - DNA, 19 bp, Homo sapiens
gctctgtgatgctgagggg

SEQ ID NO: 9104285 - DNA, 22 bp, Homo sapiens
gctgagtcttgagcactgagca

SEQ ID NO: 9104286 - DNA, 22 bp, Homo sapiens
gctgagtcttgagcactgagca

SEQ ID NO: 9104287 - DNA, 22 bp, Homo sapiens
gctgaggttttctgcctgctca

SEQ ID NO: 9104288 - DNA, 18 bp, Homo sapiens
gctgaggtggtgtcagag

SEQ ID NO: 9104289 - DNA, 22 bp, Homo sapiens
gctgaggtggctgccttagtaa

SEQ ID NO: 9104290 - DNA, 18 bp, Homo sapiens
gctgaggtggtgtcagag

SEQ ID NO: 9104291 - DNA, 22 bp, Homo sapiens
gctgagggggaaggaaagctga

SEQ ID NO: 9104292 - DNA, 22 bp, Homo sapiens
gctgagggctgtaacagcagag

SEQ ID NO: 9104293 - DNA, 20 bp, Homo sapiens
gctgaggggtctatggcata

SEQ ID NO: 9104294 - DNA, 23 bp, Homo sapiens
gctgaggtacatttacaggaaga

SEQ ID NO: 9104295 - DNA, 22 bp, Homo sapiens
gctgagtgaggtccagagcttg

SEQ ID NO: 9104296 - DNA, 22 bp, Homo sapiens
gctgagtgaggtccagagcttg

SEQ ID NO: 9104297 - DNA, 22 bp, Homo sapiens
gctgagtgattgatattttagt

SEQ ID NO: 9104298 - DNA, 22 bp, Homo sapiens
gctgagtgtaatgatggcagag

SEQ ID NO: 9104299 - DNA, 22 bp, Homo sapiens
gctgagtgtaatgatggcagag

SEQ ID NO: 9104300 - DNA, 17 bp, Homo sapiens
gctgagtgcagggagtc

SEQ ID NO: 9104301 - DNA, 17 bp, Homo sapiens
gctgagtgcagggagtc

SEQ ID NO: 9104302 - DNA, 21 bp, Homo sapiens
gctgcagggcccagggcaccc

SEQ ID NO: 9104303 - DNA, 22 bp, Homo sapiens
gctgcagggagctggaaggctc

SEQ ID NO: 9104304 - DNA, 22 bp, Homo sapiens
gctgcagggctctcacaggggg

SEQ ID NO: 9104305 - DNA, 21 bp, Homo sapiens
gctgcagggcccagggcaccc

SEQ ID NO: 9104306 - DNA, 22 bp, Homo sapiens
gctgcaggggggtctggacttg

SEQ ID NO: 9104307 - DNA, 22 bp, Homo sapiens
gctgcaggctctgcaggaattg

SEQ ID NO: 9104308 - DNA, 22 bp, Homo sapiens
gctgcaggctctgcaggaattg

SEQ ID NO: 9104309 - DNA, 22 bp, Homo sapiens
gctgcagggagctggaaggctc

SEQ ID NO: 9104310 - DNA, 22 bp, Homo sapiens
gctgcctctgcacagctcactc

SEQ ID NO: 9104311 - DNA, 22 bp, Homo sapiens
gctgcctctgcgactctgggcg

SEQ ID NO: 9104312 - DNA, 22 bp, Homo sapiens
gctgcctctgcgactctgggcg

SEQ ID NO: 9104313 - DNA, 22 bp, Homo sapiens
gctgcctcctgaaagcgctctg

SEQ ID NO: 9104314 - DNA, 18 bp, Homo sapiens
gctgctggtggagggagc

SEQ ID NO: 9104315 - DNA, 22 bp, Homo sapiens
gctgctgtcagcaggccttgtt

SEQ ID NO: 9104316 - DNA, 22 bp, Homo sapiens
gctgctgggtccctctgtgcca

SEQ ID NO: 9104317 - DNA, 22 bp, Homo sapiens
gctgctgggtccctctgtgcca

SEQ ID NO: 9104318 - DNA, 22 bp, Homo sapiens
gctgctgggtccctctgtgcca

SEQ ID NO: 9104319 - DNA, 22 bp, Homo sapiens
gctgctggggtggagaaacgct

SEQ ID NO: 9104320 - DNA, 22 bp, Homo sapiens
gctgctggtcctcagagctcat

SEQ ID NO: 9104321 - DNA, 22 bp, Homo sapiens
gctggaggggtaataggatggg

SEQ ID NO: 9104322 - DNA, 22 bp, Homo sapiens
gctggagcttgagaggacaggg

SEQ ID NO: 9104323 - DNA, 22 bp, Homo sapiens
gctggagcttgagaggacaggg

SEQ ID NO: 9104324 - DNA, 22 bp, Homo sapiens
gctggagctgcagcctgggcct

SEQ ID NO: 9104325 - DNA, 22 bp, Homo sapiens
gctgctgggaatgaacagtgtt

SEQ ID NO: 9104326 - DNA, 22 bp, Homo sapiens
gctgctgggatcctgggtctca

SEQ ID NO: 9104327 - DNA, 22 bp, Homo sapiens
gctgctgggcaccccctgagct

SEQ ID NO: 9104328 - DNA, 22 bp, Homo sapiens
gctgctggggtcacatggtaag

SEQ ID NO: 9104329 - DNA, 22 bp, Homo sapiens
gctgctgggggaacagttaaaa

SEQ ID NO: 9104330 - DNA, 22 bp, Homo sapiens
gctgctgcttgaaggctcggag

SEQ ID NO: 9104331 - DNA, 22 bp, Homo sapiens
gctgctggaacaaatcacccca

SEQ ID NO: 9104332 - DNA, 19 bp, Homo sapiens
gctgctggctctggctgga

SEQ ID NO: 9104333 - DNA, 22 bp, Homo sapiens
gctgctggcgctgggcgtccgg

SEQ ID NO: 9104334 - DNA, 23 bp, Homo sapiens
gctgcctctgttggtcttcagtt

SEQ ID NO: 9104335 - DNA, 22 bp, Homo sapiens
gctgcctctgtagctttggacc

SEQ ID NO: 9104336 - DNA, 22 bp, Homo sapiens
gctgcctgaagtgtctacactg

SEQ ID NO: 9104337 - DNA, 22 bp, Homo sapiens
gctggaggtggtgagaaaaggt

SEQ ID NO: 9104338 - DNA, 22 bp, Homo sapiens
gctggaggtagggaggtcctgt

SEQ ID NO: 9104339 - DNA, 22 bp, Homo sapiens
gctggaggtagggaggtcctgt

SEQ ID NO: 9104340 - DNA, 22 bp, Homo sapiens
gctggagtctggaggtgtgcca

SEQ ID NO: 9104341 - DNA, 22 bp, Homo sapiens
gctggagtctggaggtgtgcca

SEQ ID NO: 9104342 - DNA, 22 bp, Homo sapiens
gctggagttaggtgggcttgaa

SEQ ID NO: 9104343 - DNA, 22 bp, Homo sapiens
gctggagttagaactagcctgg

SEQ ID NO: 9104344 - DNA, 22 bp, Homo sapiens
gctggagtgctgaggtgcagtg

SEQ ID NO: 9104345 - DNA, 22 bp, Homo sapiens
gctggagtgatgcctgtgtctc

SEQ ID NO: 9104346 - DNA, 22 bp, Homo sapiens
gctggagtgcagttgcacagtc

SEQ ID NO: 9104347 - DNA, 22 bp, Homo sapiens
gctggcaggtccaagatagagc

SEQ ID NO: 9104348 - DNA, 22 bp, Homo sapiens
gctggcaggtaaagccccgggg

SEQ ID NO: 9104349 - DNA, 22 bp, Homo sapiens
gctggcagggttctcactgaaa

SEQ ID NO: 9104350 - DNA, 22 bp, Homo sapiens
gctggcagtttcctcaccgagg

SEQ ID NO: 9104351 - DNA, 22 bp, Homo sapiens
gctggcattacaggagagaacc

SEQ ID NO: 9104352 - DNA, 22 bp, Homo sapiens
gctggcagtgtattgttagctg

SEQ ID NO: 9104353 - DNA, 22 bp, Homo sapiens
gctggcagtgtgaatgacaagc

SEQ ID NO: 9104354 - DNA, 22 bp, Homo sapiens
gcaatactgagattattgtact

SEQ ID NO: 9104355 - DNA, 22 bp, Homo sapiens
gcaatactaagtgacttttggg

SEQ ID NO: 9104356 - DNA, 22 bp, Homo sapiens
gcaatactcaacacttttgctt

SEQ ID NO: 9104357 - DNA, 22 bp, Homo sapiens
gcacagaaccagacatgaggca

SEQ ID NO: 9104358 - DNA, 22 bp, Homo sapiens
gcacagaaccagacatgaggca

SEQ ID NO: 9104359 - DNA, 22 bp, Homo sapiens
gcacagaaccagacatgaggca

SEQ ID NO: 9104360 - DNA, 22 bp, Homo sapiens
gcacagaaccctatctttcgga

SEQ ID NO: 9104361 - DNA, 22 bp, Homo sapiens
gcacagaacttctcttagtagg

SEQ ID NO: 9104362 - DNA, 22 bp, Homo sapiens
gcacagaagagctttggaatga

SEQ ID NO: 9104363 - DNA, 22 bp, Homo sapiens
gcacagaacttctcttagtagg

SEQ ID NO: 9104364 - DNA, 22 bp, Homo sapiens
gcacagaataacactctgggct

SEQ ID NO: 9104365 - DNA, 22 bp, Homo sapiens
gcacagaataacactctgggct

SEQ ID NO: 9104366 - DNA, 22 bp, Homo sapiens
gcacagaagtaaaatacaagtc

SEQ ID NO: 9104367 - DNA, 22 bp, Homo sapiens
gcacagaagtaaaatacaagtc

SEQ ID NO: 9104368 - DNA, 22 bp, Homo sapiens
gcacagagggcagtgagcctct

SEQ ID NO: 9104369 - DNA, 22 bp, Homo sapiens
gcacagagggcagtgagcctct

SEQ ID NO: 9104370 - DNA, 22 bp, Homo sapiens
gcacagagagtcccgggtgccc

SEQ ID NO: 9104371 - DNA, 22 bp, Homo sapiens
gcacagagagcagtgggggaca

SEQ ID NO: 9104372 - DNA, 22 bp, Homo sapiens
gcacagactttgattgcagtca

SEQ ID NO: 9104373 - DNA, 22 bp, Homo sapiens
gcacagagacagtcctgagatc

SEQ ID NO: 9104374 - DNA, 22 bp, Homo sapiens
gcacattgttactcttactgtg

SEQ ID NO: 9104375 - DNA, 22 bp, Homo sapiens
gcacagcacagcaacatgtttt

SEQ ID NO: 9104376 - DNA, 22 bp, Homo sapiens
gcacagcacagcaacatgtttt

SEQ ID NO: 9104377 - DNA, 22 bp, Homo sapiens
gcacagaggtggaggacaaata

SEQ ID NO: 9104378 - DNA, 22 bp, Homo sapiens
gcacagagtgggtgagatgtgg

SEQ ID NO: 9104379 - DNA, 22 bp, Homo sapiens
gcaatacagtaagagtactgta

SEQ ID NO: 9104380 - DNA, 22 bp, Homo sapiens
gcaataaataacatggaagaca

SEQ ID NO: 9104381 - DNA, 22 bp, Homo sapiens
gcaataaagattttactgtcag

SEQ ID NO: 9104382 - DNA, 22 bp, Homo sapiens
gcaataaagtagcagctcatca

SEQ ID NO: 9104383 - DNA, 22 bp, Homo sapiens
gcaataaataacatggaagaca

SEQ ID NO: 9104384 - DNA, 20 bp, Homo sapiens
gcaaggctccaaggggtgtg

SEQ ID NO: 9104385 - DNA, 22 bp, Homo sapiens
gcaaggctcccgcagcccaggg

SEQ ID NO: 9104386 - DNA, 22 bp, Homo sapiens
gcaataaaatgtaatgattggg

SEQ ID NO: 9104387 - DNA, 22 bp, Homo sapiens
gcaataaacatgtttgatgcgc

SEQ ID NO: 9104388 - DNA, 22 bp, Homo sapiens
gcaataaactctctcaagccac

SEQ ID NO: 9104389 - DNA, 22 bp, Homo sapiens
gcaaggctcacattgaactgaa

SEQ ID NO: 9104390 - DNA, 18 bp, Homo sapiens
gcaaggctcaggccaggc

SEQ ID NO: 9104391 - DNA, 21 bp, Homo sapiens
gcaaggcctatcatggcagct

SEQ ID NO: 9104392 - DNA, 20 bp, Homo sapiens
gcaaggcacagtgaggaggg

SEQ ID NO: 9104393 - DNA, 20 bp, Homo sapiens
gcaaggcacagtgaggaggg

SEQ ID NO: 9104394 - DNA, 20 bp, Homo sapiens
gcaaggcacagtgaggaggg

SEQ ID NO: 9104395 - DNA, 21 bp, Homo sapiens
gcaaggcaatgccatgatttc

SEQ ID NO: 9104396 - DNA, 20 bp, Homo sapiens
gcaaggcaggttgaccaaga

SEQ ID NO: 9104397 - DNA, 22 bp, Homo sapiens
gcaaggcagcgcggagtagcta

SEQ ID NO: 9104398 - DNA, 22 bp, Homo sapiens
gcaaggcagcatccttttgagg

SEQ ID NO: 9104399 - DNA, 22 bp, Homo sapiens
gcaaggagactgtagggccaag

SEQ ID NO: 9104400 - DNA, 22 bp, Homo sapiens
gcaaggaagagcaggtggtgct

SEQ ID NO: 9104401 - DNA, 22 bp, Homo sapiens
gcaaggaagcagagttgctatc

SEQ ID NO: 9104402 - DNA, 22 bp, Homo sapiens
gagtcaacaagtcagatctcac

SEQ ID NO: 9104403 - DNA, 22 bp, Homo sapiens
gagtagaaggaagttatctacc

SEQ ID NO: 9104404 - DNA, 22 bp, Homo sapiens
gagtagaactggttatctaata

SEQ ID NO: 9104405 - DNA, 22 bp, Homo sapiens
gagtaggaatgttctgccatct

SEQ ID NO: 9104406 - DNA, 17 bp, Homo sapiens
gagtagttacaacagac

SEQ ID NO: 9104407 - DNA, 22 bp, Homo sapiens
gagtattcaatatatacaaatg

SEQ ID NO: 9104408 - DNA, 22 bp, Homo sapiens
gcagagtgggagcccagggctg

SEQ ID NO: 9104409 - DNA, 22 bp, Homo sapiens
gcagatttctaataagcaatgt

SEQ ID NO: 9104410 - DNA, 22 bp, Homo sapiens
gcagcaagaataatttgggtag

SEQ ID NO: 9104411 - DNA, 21 bp, Homo sapiens
gcagcaaatgacaacagtgag

SEQ ID NO: 9104412 - DNA, 21 bp, Homo sapiens
gcagcaaatgacaacagtgag

SEQ ID NO: 9104413 - DNA, 22 bp, Homo sapiens
gcagcaaagctcttcatgtgat

SEQ ID NO: 9104414 - DNA, 22 bp, Homo sapiens
gcagcaaacttccacaagtaga

SEQ ID NO: 9104415 - DNA, 19 bp, Homo sapiens
gcagcaaacaaaacaggta

SEQ ID NO: 9104416 - DNA, 22 bp, Homo sapiens
gcagcaaaaaagtaatatttat

SEQ ID NO: 9104417 - DNA, 18 bp, Homo sapiens
gcagagtgcgtctctgtg

SEQ ID NO: 9104418 - DNA, 22 bp, Homo sapiens
gcagagtgagccgaggctgctc

SEQ ID NO: 9104419 - DNA, 22 bp, Homo sapiens
gcagagtgaagggagaggtgtg

SEQ ID NO: 9104420 - DNA, 23 bp, Homo sapiens
gcagaggtttttcagtatggttt

SEQ ID NO: 9104421 - DNA, 22 bp, Homo sapiens
gcagaggttggattggtgactt

SEQ ID NO: 9104422 - DNA, 19 bp, Homo sapiens
gcagagtcaagagctgctg

SEQ ID NO: 9104423 - DNA, 22 bp, Homo sapiens
gcagacagggctacagaggtac

SEQ ID NO: 9104424 - DNA, 22 bp, Homo sapiens
gcagacagggctacagaggtac

SEQ ID NO: 9104425 - DNA, 22 bp, Homo sapiens
gcagaggtgagtttctcagctg

SEQ ID NO: 9104426 - DNA, 22 bp, Homo sapiens
gcagaggtgctcagtggcagaa

SEQ ID NO: 9104427 - DNA, 22 bp, Homo sapiens
gcagaggtggcatctgggctct

SEQ ID NO: 9104428 - DNA, 22 bp, Homo sapiens
gcagaggtgtcaccttccagga

SEQ ID NO: 9104429 - DNA, 22 bp, Homo sapiens
gcagaggtgtagccccctccat

SEQ ID NO: 9104430 - DNA, 22 bp, Homo sapiens
gcagaggtgtgggaggggccac

SEQ ID NO: 9104431 - DNA, 22 bp, Homo sapiens
gcagaggtgtgggaggggccac

SEQ ID NO: 9104432 - DNA, 22 bp, Homo sapiens
gcagacacttgaggtgggcttt

SEQ ID NO: 9104433 - DNA, 22 bp, Homo sapiens
gcagacagactgcagtgatttt

SEQ ID NO: 9104434 - DNA, 23 bp, Homo sapiens
gcagacagagcagactaagacaa

SEQ ID NO: 9104435 - DNA, 23 bp, Homo sapiens
gcagacagagcagactaagacaa

SEQ ID NO: 9104436 - DNA, 22 bp, Homo sapiens
gcagacagcatgttgggctatt

SEQ ID NO: 9104437 - DNA, 22 bp, Homo sapiens
gcagacagcatgttgggctatt

SEQ ID NO: 9104438 - DNA, 22 bp, Homo sapiens
gcagacagcatgttgggctatt

SEQ ID NO: 9104439 - DNA, 22 bp, Homo sapiens
gcagacagatgagggtgctggg

SEQ ID NO: 9104440 - DNA, 22 bp, Homo sapiens
gcagacagccagactgcactgg

SEQ ID NO: 9104441 - DNA, 22 bp, Homo sapiens
gcagacagccagactgcactgg

SEQ ID NO: 9104442 - DNA, 22 bp, Homo sapiens
gcagacagccagactgcactgg

SEQ ID NO: 9104443 - DNA, 22 bp, Homo sapiens
gcagacaggcccagtggaggga

SEQ ID NO: 9104444 - DNA, 22 bp, Homo sapiens
gcagacaggcccagtggaggga

SEQ ID NO: 9104445 - DNA, 22 bp, Homo sapiens
gcagacaggattgggttaatag

SEQ ID NO: 9104446 - DNA, 22 bp, Homo sapiens
gcacccagcccagggcgtgatg

SEQ ID NO: 9104447 - DNA, 22 bp, Homo sapiens
gcacccagccagcatctcagag

SEQ ID NO: 9104448 - DNA, 22 bp, Homo sapiens
gcacccagaggtcagcagtgct

SEQ ID NO: 9104449 - DNA, 19 bp, Homo sapiens
gcaccagattgagtgacac

SEQ ID NO: 9104450 - DNA, 22 bp, Homo sapiens
gcaccagcctgagcctcttgca

SEQ ID NO: 9104451 - DNA, 22 bp, Homo sapiens
gcagccagaagactcagaacaa

SEQ ID NO: 9104452 - DNA, 21 bp, Homo sapiens
gcagccagacgggattcagtt

SEQ ID NO: 9104453 - DNA, 22 bp, Homo sapiens
gcagccagcccctctgacctct

SEQ ID NO: 9104454 - DNA, 22 bp, Homo sapiens
gcagccagcccctctgacctct

SEQ ID NO: 9104455 - DNA, 22 bp, Homo sapiens
gcagccagcccctctgacctct

SEQ ID NO: 9104456 - DNA, 22 bp, Homo sapiens
gcagccagcccctctgacctct

SEQ ID NO: 9104457 - DNA, 22 bp, Homo sapiens
gcagccaggaaagctggaccct

SEQ ID NO: 9104458 - DNA, 22 bp, Homo sapiens
gcagccaggaaagctggaccct

SEQ ID NO: 9104459 - DNA, 22 bp, Homo sapiens
gcagccaggaaagctggaccct

SEQ ID NO: 9104460 - DNA, 21 bp, Homo sapiens
gcagccagccgagaccatgcc

SEQ ID NO: 9104461 - DNA, 21 bp, Homo sapiens
gcagccagccgagaccatgcc

SEQ ID NO: 9104462 - DNA, 21 bp, Homo sapiens
gcagccacagccaccaagcta

SEQ ID NO: 9104463 - DNA, 22 bp, Homo sapiens
gcagcagcccagggctctcaga

SEQ ID NO: 9104464 - DNA, 22 bp, Homo sapiens
gcagcagccactattctggcat

SEQ ID NO: 9104465 - DNA, 22 bp, Homo sapiens
gcagcagcccagggctctcaga

SEQ ID NO: 9104466 - DNA, 22 bp, Homo sapiens
gcagcagcccagggctctcaga

SEQ ID NO: 9104467 - DNA, 22 bp, Homo sapiens
gcagccagaagactcagaacaa

SEQ ID NO: 9104468 - DNA, 22 bp, Homo sapiens
gcagccactagttttcctgttt

SEQ ID NO: 9104469 - DNA, 19 bp, Homo sapiens
gcagcaatagaagacaaat

SEQ ID NO: 9104470 - DNA, 22 bp, Homo sapiens
gcagcaagaggtttctgttgac

SEQ ID NO: 9104471 - DNA, 22 bp, Homo sapiens
gcagcaaggatgaagcacttgg

SEQ ID NO: 9104472 - DNA, 22 bp, Homo sapiens
gcagcaagtctagtttgtaggc

SEQ ID NO: 9104473 - DNA, 22 bp, Homo sapiens
gcagcacaaagtccccagggac

SEQ ID NO: 9104474 - DNA, 22 bp, Homo sapiens
gcagcaccaaccagggcctgtt

SEQ ID NO: 9104475 - DNA, 22 bp, Homo sapiens
gcagcactgatcctaaacttag

SEQ ID NO: 9104476 - DNA, 22 bp, Homo sapiens
gcagcagaaggccaaggggagc

SEQ ID NO: 9104477 - DNA, 22 bp, Homo sapiens
gcagcagaagtagaagtacagg

SEQ ID NO: 9104478 - DNA, 22 bp, Homo sapiens
gcagcagaagtagaagtacagg

SEQ ID NO: 9104479 - DNA, 22 bp, Homo sapiens
gcagcagcagcaattttctgtc

SEQ ID NO: 9104480 - DNA, 22 bp, Homo sapiens
gcagcagcaggcgctcggccgt

SEQ ID NO: 9104481 - DNA, 22 bp, Homo sapiens
gcagcagcaggcgctcggccgt

SEQ ID NO: 9104482 - DNA, 19 bp, Homo sapiens
gcagcagcatttggtaata

SEQ ID NO: 9104483 - DNA, 22 bp, Homo sapiens
gcagcagcagggagtctgactt

SEQ ID NO: 9104484 - DNA, 22 bp, Homo sapiens
gcagctggctctgggaaaaact

SEQ ID NO: 9104485 - DNA, 22 bp, Homo sapiens
gcagctggctcagagaggtggg

SEQ ID NO: 9104486 - DNA, 22 bp, Homo sapiens
gcagctgggacactgaggccag

SEQ ID NO: 9104487 - DNA, 22 bp, Homo sapiens
gcagctgggacactgaggccag

SEQ ID NO: 9104488 - DNA, 22 bp, Homo sapiens
gcagctggctctgggaaaaact

SEQ ID NO: 9104489 - DNA, 22 bp, Homo sapiens
gcagctggccctgacacgcaga

SEQ ID NO: 9104490 - DNA, 22 bp, Homo sapiens
gcagctggctcagagaggtggg

SEQ ID NO: 9104491 - DNA, 22 bp, Homo sapiens
gcagcccaagcctgagcatcct

SEQ ID NO: 9104492 - DNA, 22 bp, Homo sapiens
gcagcccaatggactgagacag

SEQ ID NO: 9104493 - DNA, 22 bp, Homo sapiens
gcagcccaatggactgagacag

SEQ ID NO: 9104494 - DNA, 22 bp, Homo sapiens
gcagcccaatggactgagacag

SEQ ID NO: 9104495 - DNA, 22 bp, Homo sapiens
gcagccaggaagcccaggacac

SEQ ID NO: 9104496 - DNA, 17 bp, Homo sapiens
gcagccagtgcagcagg

SEQ ID NO: 9104497 - DNA, 17 bp, Homo sapiens
gcagccagtgcagcagg

SEQ ID NO: 9104498 - DNA, 22 bp, Homo sapiens
gcagccagtatcctctgagatt

SEQ ID NO: 9104499 - DNA, 22 bp, Homo sapiens
gcagcccaagcctgagcatcct

SEQ ID NO: 9104500 - DNA, 17 bp, Homo sapiens
gcagccagtgcagcagg

SEQ ID NO: 9104501 - DNA, 22 bp, Homo sapiens
gcagccagtgggatgagaaaga

SEQ ID NO: 9104502 - DNA, 23 bp, Homo sapiens
gcagccatgttcccgtctcagct

SEQ ID NO: 9104503 - DNA, 23 bp, Homo sapiens
gcagccatgttcccgtctcagct

SEQ ID NO: 9104504 - DNA, 23 bp, Homo sapiens
gcagctggttagaagggaaggag

SEQ ID NO: 9104505 - DNA, 23 bp, Homo sapiens
gcagctggttagaagggaaggag

SEQ ID NO: 9104506 - DNA, 23 bp, Homo sapiens
gcagctggttagaagggaaggag

SEQ ID NO: 9104507 - DNA, 22 bp, Homo sapiens
gcagctggtgcaaatgtcactc

SEQ ID NO: 9104508 - DNA, 22 bp, Homo sapiens
gcagctggtctggcctagagta

SEQ ID NO: 9104509 - DNA, 22 bp, Homo sapiens
gcagctggttaatgggagaatt

SEQ ID NO: 9104510 - DNA, 22 bp, Homo sapiens
gcagctggttaatgggagaatt

SEQ ID NO: 9104511 - DNA, 22 bp, Homo sapiens
gcagctggttaatgggagaatt

SEQ ID NO: 9104512 - DNA, 22 bp, Homo sapiens
gcagctggtgcaaatgtcactc

SEQ ID NO: 9104513 - DNA, 22 bp, Homo sapiens
gcagctggtctggcctagagta

SEQ ID NO: 9104514 - DNA, 22 bp, Homo sapiens
gcagctggtctggcctagagta

SEQ ID NO: 9104515 - DNA, 21 bp, Homo sapiens
gcagctggtctcagagcttgc

SEQ ID NO: 9104516 - DNA, 21 bp, Homo sapiens
gcagctggtctcagagcttgc

SEQ ID NO: 9104517 - DNA, 21 bp, Homo sapiens
gcagctggtctcagagcttgc

SEQ ID NO: 9104518 - DNA, 21 bp, Homo sapiens
gcagctggtctcagagcttgc

SEQ ID NO: 9104519 - DNA, 22 bp, Homo sapiens
gcagctgggtctgtgtgggctg

SEQ ID NO: 9104520 - DNA, 22 bp, Homo sapiens
gcagctggggccacacttaggc

SEQ ID NO: 9104521 - DNA, 22 bp, Homo sapiens
gcagctggggccacacttaggc

SEQ ID NO: 9104522 - DNA, 22 bp, Homo sapiens
gcagctggggaggtcgtgggga

SEQ ID NO: 9104523 - DNA, 22 bp, Homo sapiens
gcagctggggaggtcgtgggga

SEQ ID NO: 9104524 - DNA, 22 bp, Homo sapiens
gcagctggggaggtcgtgggga

SEQ ID NO: 9104525 - DNA, 22 bp, Homo sapiens
gcagctgggccccagcctctcc

SEQ ID NO: 9104526 - DNA, 22 bp, Homo sapiens
gcagctgggccccagcctctcc

SEQ ID NO: 9104527 - DNA, 22 bp, Homo sapiens
gcagctgggccccagcctctcc

SEQ ID NO: 9104528 - DNA, 22 bp, Homo sapiens
gcagctgggccccagcctctcc

SEQ ID NO: 9104529 - DNA, 22 bp, Homo sapiens
gcagctgggacactgaggccag

SEQ ID NO: 9104530 - DNA, 23 bp, Homo sapiens
gcagctggttagaagggaaggag

SEQ ID NO: 9104531 - DNA, 22 bp, Homo sapiens
gcagctgtactggcagcattgt

SEQ ID NO: 9104532 - DNA, 22 bp, Homo sapiens
gcagctgtaaagcagaaatagt

SEQ ID NO: 9104533 - DNA, 22 bp, Homo sapiens
gcagctgtactggcagcattgt

SEQ ID NO: 9104534 - DNA, 22 bp, Homo sapiens
gcaggcagttgcagttttctag

SEQ ID NO: 9104535 - DNA, 22 bp, Homo sapiens
gcaggcagttgcagttttctag

SEQ ID NO: 9104536 - DNA, 22 bp, Homo sapiens
gcagctgtcagaagttggaatc

SEQ ID NO: 9104537 - DNA, 22 bp, Homo sapiens
gcaggcagttgcagttttctag

SEQ ID NO: 9104538 - DNA, 22 bp, Homo sapiens
gcagctgtcactttcacaatgc

SEQ ID NO: 9104539 - DNA, 22 bp, Homo sapiens
gcagctgtcactttcacaatgc

SEQ ID NO: 9104540 - DNA, 22 bp, Homo sapiens
gcagctgtatcacttttaaaca

SEQ ID NO: 9104541 - DNA, 22 bp, Homo sapiens
gcagctgtagaggggagaaaga

SEQ ID NO: 9104542 - DNA, 22 bp, Homo sapiens
gcaggcagtttgcttttccctc

SEQ ID NO: 9104543 - DNA, 22 bp, Homo sapiens
gcaggcagtttgcttttccctc

SEQ ID NO: 9104544 - DNA, 22 bp, Homo sapiens
gcaggcatggtcgctgccaggt

SEQ ID NO: 9104545 - DNA, 22 bp, Homo sapiens
gcaggcattagcccccatggct

SEQ ID NO: 9104546 - DNA, 22 bp, Homo sapiens
gcaggccagctgtgcagatggg

SEQ ID NO: 9104547 - DNA, 19 bp, Homo sapiens
gcaggccaggaggcggagg

SEQ ID NO: 9104548 - DNA, 22 bp, Homo sapiens
gcagggcagcttagtccctgtc

SEQ ID NO: 9104549 - DNA, 22 bp, Homo sapiens
gcagggcagctgaagctaggtg

SEQ ID NO: 9104550 - DNA, 22 bp, Homo sapiens
gcagggcagctgaagctaggtg

SEQ ID NO: 9104551 - DNA, 22 bp, Homo sapiens
gcagggcagctcactgtggttc

SEQ ID NO: 9104552 - DNA, 22 bp, Homo sapiens
gcaggcctaagagaaggcattg

SEQ ID NO: 9104553 - DNA, 18 bp, Homo sapiens
gcaggcctagaacttggt

SEQ ID NO: 9104554 - DNA, 22 bp, Homo sapiens
gcaggcctcccctgctggagct

SEQ ID NO: 9104555 - DNA, 22 bp, Homo sapiens
gcaggcctcccctgctggagct

SEQ ID NO: 9104556 - DNA, 18 bp, Homo sapiens
gcaggccctgtttctggg

SEQ ID NO: 9104557 - DNA, 18 bp, Homo sapiens
gcaggccctgtttctggg

SEQ ID NO: 9104558 - DNA, 20 bp, Homo sapiens
gcaggccctctctctagtct

SEQ ID NO: 9104559 - DNA, 19 bp, Homo sapiens
gcaggcccagtcgggctgg

SEQ ID NO: 9104560 - DNA, 22 bp, Homo sapiens
gcaggtctagaagctgcctctg

SEQ ID NO: 9104561 - DNA, 19 bp, Homo sapiens
gcaggtcattaggctaggt

SEQ ID NO: 9104562 - DNA, 22 bp, Homo sapiens
gcaggtagtgatcgagggtgac

SEQ ID NO: 9104563 - DNA, 19 bp, Homo sapiens
gcagggtgttgactgtccc

SEQ ID NO: 9104564 - DNA, 19 bp, Homo sapiens
gcagggtgttgactgtccc

SEQ ID NO: 9104565 - DNA, 22 bp, Homo sapiens
gcaggtctggcatagagcctgc

SEQ ID NO: 9104566 - DNA, 22 bp, Homo sapiens
gcaggtctgttgattacagtca

SEQ ID NO: 9104567 - DNA, 22 bp, Homo sapiens
gcaggtcttgaaggtgtgattt

SEQ ID NO: 9104568 - DNA, 22 bp, Homo sapiens
gcaggtctcaatctgagcaggc

SEQ ID NO: 9104569 - DNA, 22 bp, Homo sapiens
gcaggtctggagggcactgggg

SEQ ID NO: 9104570 - DNA, 22 bp, Homo sapiens
gcaggtctatcaggctgcaggt

SEQ ID NO: 9104571 - DNA, 22 bp, Homo sapiens
gcaggtgatgtgatgtgagcat

SEQ ID NO: 9104572 - DNA, 22 bp, Homo sapiens
gcagggccagggctcaggctgt

SEQ ID NO: 9104573 - DNA, 22 bp, Homo sapiens
gcagggtgtgtctcatacagtt

SEQ ID NO: 9104574 - DNA, 22 bp, Homo sapiens
gcagggtgtgtctcatacagtt

SEQ ID NO: 9104575 - DNA, 22 bp, Homo sapiens
gcagggccttagcagcggctgc

SEQ ID NO: 9104576 - DNA, 22 bp, Homo sapiens
gcagggccaggtacaagaagca

SEQ ID NO: 9104577 - DNA, 22 bp, Homo sapiens
gcagggccagtgcagagaggaa

SEQ ID NO: 9104578 - DNA, 22 bp, Homo sapiens
gcagggccagtgcagagaggaa

SEQ ID NO: 9104579 - DNA, 22 bp, Homo sapiens
gccctgctaatttcgtactttt

SEQ ID NO: 9104580 - DNA, 22 bp, Homo sapiens
gccctgcctgtctgctgggagg

SEQ ID NO: 9104581 - DNA, 17 bp, Homo sapiens
gccctgcctgctgccct

SEQ ID NO: 9104582 - DNA, 17 bp, Homo sapiens
gccctgcctgctgccct

SEQ ID NO: 9104583 - DNA, 22 bp, Homo sapiens
gccctgctccaggagaataccc

SEQ ID NO: 9104584 - DNA, 23 bp, Homo sapiens
gccctgctcctggctgggaggga

SEQ ID NO: 9104585 - DNA, 22 bp, Homo sapiens
gccctgctctggtctctgcccg

SEQ ID NO: 9104586 - DNA, 22 bp, Homo sapiens
gccctgctgctggcagaggcgc

SEQ ID NO: 9104587 - DNA, 22 bp, Homo sapiens
gccctgctgctggcagaggcgc

SEQ ID NO: 9104588 - DNA, 22 bp, Homo sapiens
gccctgctgtttagagagctac

SEQ ID NO: 9104589 - DNA, 22 bp, Homo sapiens
gccctgctgtcttcagagtata

SEQ ID NO: 9104590 - DNA, 22 bp, Homo sapiens
gccctgctgtttagagagctac

SEQ ID NO: 9104591 - DNA, 22 bp, Homo sapiens
gccctgctgtcttcagagtata

SEQ ID NO: 9104592 - DNA, 23 bp, Homo sapiens
gccctgctgggacctcctgctac

SEQ ID NO: 9104593 - DNA, 18 bp, Homo sapiens
gcctcagtttcctcacct

SEQ ID NO: 9104594 - DNA, 22 bp, Homo sapiens
gcctcagttgatctgtgtgagc

SEQ ID NO: 9104595 - DNA, 22 bp, Homo sapiens
gcctcagtttatacacctgtaa

SEQ ID NO: 9104596 - DNA, 22 bp, Homo sapiens
gcctcatgagggatctgccctc

SEQ ID NO: 9104597 - DNA, 22 bp, Homo sapiens
gcctcagtgtcctcctccatgt

SEQ ID NO: 9104598 - DNA, 22 bp, Homo sapiens
gcctcagttgatctgtgtgagc

SEQ ID NO: 9104599 - DNA, 22 bp, Homo sapiens
gcctcagtggctttaggagttc

SEQ ID NO: 9104600 - DNA, 22 bp, Homo sapiens
gcctcagtaaccttaggggata

SEQ ID NO: 9104601 - DNA, 22 bp, Homo sapiens
gcctcaggtgcatctctcattc

SEQ ID NO: 9104602 - DNA, 20 bp, Homo sapiens
gcctcagtcacatggcctac

SEQ ID NO: 9104603 - DNA, 22 bp, Homo sapiens
gcctcagtctcccgagtagctg

SEQ ID NO: 9104604 - DNA, 22 bp, Homo sapiens
gcctcagtctcccgagtagctg

SEQ ID NO: 9104605 - DNA, 22 bp, Homo sapiens
gcctcagtgatatgtgggacaa

SEQ ID NO: 9104606 - DNA, 20 bp, Homo sapiens
gcctccaccccaggcttcag

SEQ ID NO: 9104607 - DNA, 19 bp, Homo sapiens
gcctcatttccacctcccc

SEQ ID NO: 9104608 - DNA, 22 bp, Homo sapiens
gcctcagggggagaggccagct

SEQ ID NO: 9104609 - DNA, 22 bp, Homo sapiens
gccctggagagggatatggcat

SEQ ID NO: 9104610 - DNA, 22 bp, Homo sapiens
gccctgcttctggcatgcagaa

SEQ ID NO: 9104611 - DNA, 22 bp, Homo sapiens
gccctggaatctctccatggga

SEQ ID NO: 9104612 - DNA, 22 bp, Homo sapiens
gccctggaatctctccatggga

SEQ ID NO: 9104613 - DNA, 22 bp, Homo sapiens
gccctagcgccagctcagcacc

SEQ ID NO: 9104614 - DNA, 22 bp, Homo sapiens
gccccttgtctccaggccccaa

SEQ ID NO: 9104615 - DNA, 22 bp, Homo sapiens
gcccgcagagatctttaacaaa

SEQ ID NO: 9104616 - DNA, 22 bp, Homo sapiens
gccccttcgtggaagtgcattc

SEQ ID NO: 9104617 - DNA, 22 bp, Homo sapiens
gccccttccatcatgtgaggac

SEQ ID NO: 9104618 - DNA, 22 bp, Homo sapiens
gccccttccatcatgtgaggac

SEQ ID NO: 9104619 - DNA, 22 bp, Homo sapiens
gcccctgggagcagagccacca

SEQ ID NO: 9104620 - DNA, 22 bp, Homo sapiens
gccctgagtggtacctgtgggt

SEQ ID NO: 9104621 - DNA, 22 bp, Homo sapiens
gccctcagaggacagctgactt

SEQ ID NO: 9104622 - DNA, 22 bp, Homo sapiens
gccctcagaggacagctgactt

SEQ ID NO: 9104623 - DNA, 21 bp, Homo sapiens
gccctaggctacctggagcgc

SEQ ID NO: 9104624 - DNA, 22 bp, Homo sapiens
gccctcagaggacagctgactt

SEQ ID NO: 9104625 - DNA, 22 bp, Homo sapiens
gccctatcattcattgagtgct

SEQ ID NO: 9104626 - DNA, 22 bp, Homo sapiens
gccctagggggaaccgaggact

SEQ ID NO: 9104627 - DNA, 22 bp, Homo sapiens
gccccaggtggtaaacctaaga

SEQ ID NO: 9104628 - DNA, 22 bp, Homo sapiens
gcccctcccagtcaggagcact

SEQ ID NO: 9104629 - DNA, 22 bp, Homo sapiens
gcccctcccagtcaggagcact

SEQ ID NO: 9104630 - DNA, 22 bp, Homo sapiens
gcccctctccttgtgcacctgc

SEQ ID NO: 9104631 - DNA, 22 bp, Homo sapiens
gcccctctcccttgaggcaggc

SEQ ID NO: 9104632 - DNA, 22 bp, Homo sapiens
gcccctccgggcgcgtcatagc

SEQ ID NO: 9104633 - DNA, 22 bp, Homo sapiens
gcccctggctggccagctcctc

SEQ ID NO: 9104634 - DNA, 22 bp, Homo sapiens
gcccctgcctttgaacctggag

SEQ ID NO: 9104635 - DNA, 22 bp, Homo sapiens
gcccacacaccagctcaggagg

SEQ ID NO: 9104636 - DNA, 22 bp, Homo sapiens
gcccaaggtcccatggcagcac

SEQ ID NO: 9104637 - DNA, 22 bp, Homo sapiens
gcccacagctcgttcctctcct

SEQ ID NO: 9104638 - DNA, 22 bp, Homo sapiens
gcccacagaggcaccaccaggc

SEQ ID NO: 9104639 - DNA, 22 bp, Homo sapiens
gccccaggggaggtgccctgca

SEQ ID NO: 9104640 - DNA, 22 bp, Homo sapiens
gcccacagctcgttcctctcct

SEQ ID NO: 9104641 - DNA, 18 bp, Homo sapiens
gcctccctggctacactt

SEQ ID NO: 9104642 - DNA, 22 bp, Homo sapiens
gcctccctgtttcctgctccaa

SEQ ID NO: 9104643 - DNA, 22 bp, Homo sapiens
gcctccctgtttcctgctccaa

SEQ ID NO: 9104644 - DNA, 22 bp, Homo sapiens
gcctccctgttcttccacaata

SEQ ID NO: 9104645 - DNA, 22 bp, Homo sapiens
gcctgaggaatgctcctgactt

SEQ ID NO: 9104646 - DNA, 22 bp, Homo sapiens
gcctgagggctcctagcaggct

SEQ ID NO: 9104647 - DNA, 22 bp, Homo sapiens
gcctcccctgcaattgtccttg

SEQ ID NO: 9104648 - DNA, 22 bp, Homo sapiens
gcctccctccaccactgcaggt

SEQ ID NO: 9104649 - DNA, 22 bp, Homo sapiens
gcctccctggcccacagcagcg

SEQ ID NO: 9104650 - DNA, 22 bp, Homo sapiens
gcctccctgagtcacccaagca

SEQ ID NO: 9104651 - DNA, 22 bp, Homo sapiens
gcctccaccgaacgctctcttg

SEQ ID NO: 9104652 - DNA, 22 bp, Homo sapiens
gcctccaccgaacgctctcttg

SEQ ID NO: 9104653 - DNA, 22 bp, Homo sapiens
gcctccccaggggtgtcatgag

SEQ ID NO: 9104654 - DNA, 22 bp, Homo sapiens
gcctgcagaggtgctgctagct

SEQ ID NO: 9104655 - DNA, 22 bp, Homo sapiens
gcctgcagaactgtgaggcaat

SEQ ID NO: 9104656 - DNA, 22 bp, Homo sapiens
gcctgcagaggtgctgctagct

SEQ ID NO: 9104657 - DNA, 22 bp, Homo sapiens
gcctgagtgcatctgcagacat

SEQ ID NO: 9104658 - DNA, 22 bp, Homo sapiens
gcctgagtttgaactctagctc

SEQ ID NO: 9104659 - DNA, 22 bp, Homo sapiens
gcctgagtgcatctgcagacat

SEQ ID NO: 9104660 - DNA, 19 bp, Homo sapiens
gcctgcagaaaaggcaggg

SEQ ID NO: 9104661 - DNA, 22 bp, Homo sapiens
gcctggagcccagtgtggggct

SEQ ID NO: 9104662 - DNA, 22 bp, Homo sapiens
gcctggagcccagtgtggggct

SEQ ID NO: 9104663 - DNA, 22 bp, Homo sapiens
gcctggagtagcatggcaagcc

SEQ ID NO: 9104664 - DNA, 22 bp, Homo sapiens
gcctggagtagcatggcaagcc

SEQ ID NO: 9104665 - DNA, 16 bp, Homo sapiens
gcctggagtggcaggg

SEQ ID NO: 9104666 - DNA, 16 bp, Homo sapiens
gcctggagtggcaggg

SEQ ID NO: 9104667 - DNA, 22 bp, Homo sapiens
gcctggagtggacttggcccct

SEQ ID NO: 9104668 - DNA, 22 bp, Homo sapiens
gcctggagtgcagtggcgtgat

SEQ ID NO: 9104669 - DNA, 22 bp, Homo sapiens
gcctggagtgcagtggcgtgat

SEQ ID NO: 9104670 - DNA, 22 bp, Homo sapiens
gcctggagtgcagtggcgtgat

SEQ ID NO: 9104671 - DNA, 22 bp, Homo sapiens
gcctggagagcactgtgcgctt

SEQ ID NO: 9104672 - DNA, 22 bp, Homo sapiens
gcctggagagcactgtgcgctt

SEQ ID NO: 9104673 - DNA, 22 bp, Homo sapiens
gcctggagacctgctcctctac

SEQ ID NO: 9104674 - DNA, 22 bp, Homo sapiens
gcctggagacagcagaggcggc

SEQ ID NO: 9104675 - DNA, 22 bp, Homo sapiens
gcctggagacagcagaggcggc

SEQ ID NO: 9104676 - DNA, 22 bp, Homo sapiens
gcctggagacagcagaggcggc

SEQ ID NO: 9104677 - DNA, 22 bp, Homo sapiens
gcctggagacagcagaggcggc

SEQ ID NO: 9104678 - DNA, 22 bp, Homo sapiens
gcctggagcagacgtgtcccgg

SEQ ID NO: 9104679 - DNA, 22 bp, Homo sapiens
gcctggagcagacgtgtcccgg

SEQ ID NO: 9104680 - DNA, 22 bp, Homo sapiens
gcctggagaggaagccggtgga

SEQ ID NO: 9104681 - DNA, 22 bp, Homo sapiens
gcctggagaggaagccggtgga

SEQ ID NO: 9104682 - DNA, 22 bp, Homo sapiens
gcctggagaagatggaactagc

SEQ ID NO: 9104683 - DNA, 22 bp, Homo sapiens
gcctggagaagatggaactagc

SEQ ID NO: 9104684 - DNA, 22 bp, Homo sapiens
gcctggagaagatggaactagc

SEQ ID NO: 9104685 - DNA, 22 bp, Homo sapiens
gcctggagaaaggaaggtggga

SEQ ID NO: 9104686 - DNA, 22 bp, Homo sapiens
gcctggagaaaggaaggtggga

SEQ ID NO: 9104687 - DNA, 22 bp, Homo sapiens
gcctggagacaaggacaaaggg

SEQ ID NO: 9104688 - DNA, 22 bp, Homo sapiens
gcctggagacaaggacaaaggg

SEQ ID NO: 9104689 - DNA, 22 bp, Homo sapiens
gcctggagacagcagaggcggc

SEQ ID NO: 9104690 - DNA, 22 bp, Homo sapiens
gcctggagaattaaaaggaagg

SEQ ID NO: 9104691 - DNA, 22 bp, Homo sapiens
gcctggagacaaggacaaaggg

SEQ ID NO: 9104692 - DNA, 22 bp, Homo sapiens
gcctggagaattaaaaggaagg

SEQ ID NO: 9104693 - DNA, 22 bp, Homo sapiens
gcctggagaattaaaaggaagg

SEQ ID NO: 9104694 - DNA, 21 bp, Homo sapiens
gcctgcagttttgaagccctt

SEQ ID NO: 9104695 - DNA, 22 bp, Homo sapiens
gcctgcagtgagtgcagaaggt

SEQ ID NO: 9104696 - DNA, 23 bp, Homo sapiens
gcctggagaaaagctgcagttca

SEQ ID NO: 9104697 - DNA, 23 bp, Homo sapiens
gcctggagaaaagctgcagttca

SEQ ID NO: 9104698 - DNA, 22 bp, Homo sapiens
gcctgcagggtgatgggctgcc

SEQ ID NO: 9104699 - DNA, 22 bp, Homo sapiens
gccagaaacatacacatcactt

SEQ ID NO: 9104700 - DNA, 22 bp, Homo sapiens
gccagaagactggagtcagctg

SEQ ID NO: 9104701 - DNA, 22 bp, Homo sapiens
gccagacactcccctgggcagg

SEQ ID NO: 9104702 - DNA, 22 bp, Homo sapiens
gccagaattttgagactacttg

SEQ ID NO: 9104703 - DNA, 22 bp, Homo sapiens
gccagacactcccctgggcagg

SEQ ID NO: 9104704 - DNA, 22 bp, Homo sapiens
gccagagaatgaaaatcagatt

SEQ ID NO: 9104705 - DNA, 22 bp, Homo sapiens
gccagctgaggccgtgcaggct

SEQ ID NO: 9104706 - DNA, 22 bp, Homo sapiens
gccagctgagcaaattccagct

SEQ ID NO: 9104707 - DNA, 22 bp, Homo sapiens
gccagctgtatctttggccagc

SEQ ID NO: 9104708 - DNA, 22 bp, Homo sapiens
gccagctgaggccgtgcaggct

SEQ ID NO: 9104709 - DNA, 22 bp, Homo sapiens
gccagctggctgcaggtcccag

SEQ ID NO: 9104710 - DNA, 21 bp, Homo sapiens
gccagctgggtcttgcaggag

SEQ ID NO: 9104711 - DNA, 22 bp, Homo sapiens
gccagctggtaggcacctagcc

SEQ ID NO: 9104712 - DNA, 22 bp, Homo sapiens
gccaggaatgcataaatgacct

SEQ ID NO: 9104713 - DNA, 22 bp, Homo sapiens
gccaggaatgcataaatgacct

SEQ ID NO: 9104714 - DNA, 22 bp, Homo sapiens
gccaggaaggctgaagccagaa

SEQ ID NO: 9104715 - DNA, 22 bp, Homo sapiens
gccaggaacacaatgccaagct

SEQ ID NO: 9104716 - DNA, 18 bp, Homo sapiens
gccaggaagaggaatgtg

SEQ ID NO: 9104717 - DNA, 18 bp, Homo sapiens
gccaggaagaggaatgtg

SEQ ID NO: 9104718 - DNA, 23 bp, Homo sapiens
gccagctttggtctgtctcctag

SEQ ID NO: 9104719 - DNA, 19 bp, Homo sapiens
gccaggaaagaatcaggcg

SEQ ID NO: 9104720 - DNA, 22 bp, Homo sapiens
gccagctgttcagacattcttt

SEQ ID NO: 9104721 - DNA, 22 bp, Homo sapiens
gccagctgtgcttttcctaaaa

SEQ ID NO: 9104722 - DNA, 22 bp, Homo sapiens
gccagctgtctaagagagtaaa

SEQ ID NO: 9104723 - DNA, 22 bp, Homo sapiens
gccagctgtctaagagagtaaa

SEQ ID NO: 9104724 - DNA, 22 bp, Homo sapiens
gcccaagctccgcctcctgtcg

SEQ ID NO: 9104725 - DNA, 22 bp, Homo sapiens
gcccaagctccgcctcctgtcg

SEQ ID NO: 9104726 - DNA, 22 bp, Homo sapiens
gcccaaggtatatcagagacag

SEQ ID NO: 9104727 - DNA, 22 bp, Homo sapiens
gcccaagggcatcaagttctac

SEQ ID NO: 9104728 - DNA, 20 bp, Homo sapiens
gcccaaggtccagaaggggg

SEQ ID NO: 9104729 - DNA, 20 bp, Homo sapiens
gcccaaggtccagaaggggg

SEQ ID NO: 9104730 - DNA, 22 bp, Homo sapiens
gcccaaagccagtgtgctctcc

SEQ ID NO: 9104731 - DNA, 22 bp, Homo sapiens
gcccaaagtcactcagctagga

SEQ ID NO: 9104732 - DNA, 22 bp, Homo sapiens
gcccaaagtcactcagctagga

SEQ ID NO: 9104733 - DNA, 22 bp, Homo sapiens
gcccaaagccagtgtgctctcc

SEQ ID NO: 9104734 - DNA, 22 bp, Homo sapiens
gcccaagatcagtggggcagat

SEQ ID NO: 9104735 - DNA, 23 bp, Homo sapiens
gccaggctccggtctgtggccac

SEQ ID NO: 9104736 - DNA, 23 bp, Homo sapiens
gccaggctccggtctgtggccac

SEQ ID NO: 9104737 - DNA, 22 bp, Homo sapiens
gccaggctctcagtgactgccc

SEQ ID NO: 9104738 - DNA, 21 bp, Homo sapiens
gccatttcacacagacatttg

SEQ ID NO: 9104739 - DNA, 22 bp, Homo sapiens
gccaggctctcagtgactgccc

SEQ ID NO: 9104740 - DNA, 21 bp, Homo sapiens
gccatttcacacagacatttg

SEQ ID NO: 9104741 - DNA, 21 bp, Homo sapiens
gccatttcacacagacatttg

SEQ ID NO: 9104742 - DNA, 22 bp, Homo sapiens
gccaggctcagcagtcaacctg

SEQ ID NO: 9104743 - DNA, 22 bp, Homo sapiens
gccaggctaagaaaggtgtgat

SEQ ID NO: 9104744 - DNA, 22 bp, Homo sapiens
gccaggctaagaaaggtgtgat

SEQ ID NO: 9104745 - DNA, 22 bp, Homo sapiens
gccaggctcagcagtcaacctg

SEQ ID NO: 9104746 - DNA, 22 bp, Homo sapiens
gccaggcgggtctcaaactcct

SEQ ID NO: 9104747 - DNA, 22 bp, Homo sapiens
gccaggcgggtctcaaactcct

SEQ ID NO: 9104748 - DNA, 22 bp, Homo sapiens
gccaggcgggtctcaaactcct

SEQ ID NO: 9104749 - DNA, 22 bp, Homo sapiens
gccaggcatgtcctctgcagaa

SEQ ID NO: 9104750 - DNA, 22 bp, Homo sapiens
gccaggcatgtcctctgcagaa

SEQ ID NO: 9104751 - DNA, 23 bp, Homo sapiens
gccaggctccggtctgtggccac

SEQ ID NO: 9104752 - DNA, 23 bp, Homo sapiens
gccaggctccggtctgtggccac

SEQ ID NO: 9104753 - DNA, 22 bp, Homo sapiens
gccaggctccccggatccctgg

SEQ ID NO: 9104754 - DNA, 22 bp, Homo sapiens
gccaggctccccggatccctgg

SEQ ID NO: 9104755 - DNA, 19 bp, Homo sapiens
gccaggctccatagccggc

SEQ ID NO: 9104756 - DNA, 22 bp, Homo sapiens
gccaggctccaggccctcctga

SEQ ID NO: 9104757 - DNA, 22 bp, Homo sapiens
gccaggctccaggccctcctga

SEQ ID NO: 9104758 - DNA, 18 bp, Homo sapiens
gcaggtgccactgctgtt

SEQ ID NO: 9104759 - DNA, 22 bp, Homo sapiens
gcagtgttgtgatccaggtctt

SEQ ID NO: 9104760 - DNA, 22 bp, Homo sapiens
gcagtgtttgtgttctcacatg

SEQ ID NO: 9104761 - DNA, 22 bp, Homo sapiens
gcagtgtttttcaatgcttcca

SEQ ID NO: 9104762 - DNA, 22 bp, Homo sapiens
gcagttatgtatgtgtttgaga

SEQ ID NO: 9104763 - DNA, 22 bp, Homo sapiens
gcagtttagtagatgacattat

SEQ ID NO: 9104764 - DNA, 22 bp, Homo sapiens
gcagtttactgtcaataactct

SEQ ID NO: 9104765 - DNA, 22 bp, Homo sapiens
gcattgaaatggcaaaaagaga

SEQ ID NO: 9104766 - DNA, 20 bp, Homo sapiens
gcattgagtatagacagatg

SEQ ID NO: 9104767 - DNA, 22 bp, Homo sapiens
gcagttttattatgatggaaat

SEQ ID NO: 9104768 - DNA, 22 bp, Homo sapiens
gcattacacatagacattcgtt

SEQ ID NO: 9104769 - DNA, 22 bp, Homo sapiens
gcattacagcagttcaacttgg

SEQ ID NO: 9104770 - DNA, 22 bp, Homo sapiens
gcattacaggaatttgttactg

SEQ ID NO: 9104771 - DNA, 22 bp, Homo sapiens
gcattacaggctgtaagatgca

SEQ ID NO: 9104772 - DNA, 19 bp, Homo sapiens
gcataaaatgtcaatgtgt

SEQ ID NO: 9104773 - DNA, 22 bp, Homo sapiens
gcattaatgtaagacccactcc

SEQ ID NO: 9104774 - DNA, 22 bp, Homo sapiens
gccacctgccaacttgctggaa

SEQ ID NO: 9104775 - DNA, 22 bp, Homo sapiens
gccacctgcgggccgtggtgga

SEQ ID NO: 9104776 - DNA, 22 bp, Homo sapiens
gccacctggacagctgtgccct

SEQ ID NO: 9104777 - DNA, 22 bp, Homo sapiens
gccacctggacagctgtgccct

SEQ ID NO: 9104778 - DNA, 22 bp, Homo sapiens
gccacctggactcagagccagg

SEQ ID NO: 9104779 - DNA, 22 bp, Homo sapiens
gccacctggtggcatcttctgg

SEQ ID NO: 9104780 - DNA, 22 bp, Homo sapiens
gccacctgtgtgggcctttgtg

SEQ ID NO: 9104781 - DNA, 22 bp, Homo sapiens
gccacctgtaagccattaggcc

SEQ ID NO: 9104782 - DNA, 22 bp, Homo sapiens
gccactgtggtcctcccatgat

SEQ ID NO: 9104783 - DNA, 22 bp, Homo sapiens
gccacctgtttcagatgtggtt

SEQ ID NO: 9104784 - DNA, 22 bp, Homo sapiens
gccacctgtttcgcttgcccag

SEQ ID NO: 9104785 - DNA, 22 bp, Homo sapiens
gccacctcggctttctctgctc

SEQ ID NO: 9104786 - DNA, 22 bp, Homo sapiens
gccacctccttattccacctgt

SEQ ID NO: 9104787 - DNA, 22 bp, Homo sapiens
gccacctcccaggacgaggctg

SEQ ID NO: 9104788 - DNA, 22 bp, Homo sapiens
gccacctctttgtctctgccgc

SEQ ID NO: 9104789 - DNA, 21 bp, Homo sapiens
gccacccctggcacaggtgct

SEQ ID NO: 9104790 - DNA, 22 bp, Homo sapiens
gcatttagctttaaaatatttc

SEQ ID NO: 9104791 - DNA, 22 bp, Homo sapiens
tttttatatgaaggatagtgcg

SEQ ID NO: 9104792 - DNA, 22 bp, Homo sapiens
tttttatatgaaggatagtgcg

SEQ ID NO: 9104793 - DNA, 22 bp, Homo sapiens
tttttatactttgctcaagatt

SEQ ID NO: 9104794 - DNA, 22 bp, Homo sapiens
tttttataccacctctcactta

SEQ ID NO: 9104795 - DNA, 22 bp, Homo sapiens
tttttataggtcagggcaagtc

SEQ ID NO: 9104796 - DNA, 22 bp, Homo sapiens
tttttataggtcagggcaagtc

SEQ ID NO: 9104797 - DNA, 22 bp, Homo sapiens
tttttatactttgctcaagatt

SEQ ID NO: 9104798 - DNA, 22 bp, Homo sapiens
tttttatactttgctcaagatt

SEQ ID NO: 9104799 - DNA, 22 bp, Homo sapiens
ttttgtttgtgtccactgcagt

SEQ ID NO: 9104800 - DNA, 22 bp, Homo sapiens
tttttacacttagcattgagcg

SEQ ID NO: 9104801 - DNA, 22 bp, Homo sapiens
tttttacagtcatggtcactca

SEQ ID NO: 9104802 - DNA, 22 bp, Homo sapiens
tttttacacttagcattgagcg

SEQ ID NO: 9104803 - DNA, 22 bp, Homo sapiens
tttttacacttagcattgagcg

SEQ ID NO: 9104804 - DNA, 22 bp, Homo sapiens
ttttgtttaaaatcctggatgg

SEQ ID NO: 9104805 - DNA, 22 bp, Homo sapiens
ttttgtttgtgtccactgcagt

SEQ ID NO: 9104806 - DNA, 22 bp, Homo sapiens
ttttgtttaaaatcctggatgg

SEQ ID NO: 9104807 - DNA, 22 bp, Homo sapiens
ttttgttggcttaagaaataca

SEQ ID NO: 9104808 - DNA, 22 bp, Homo sapiens
ttttgttggcttaagaaataca

SEQ ID NO: 9104809 - DNA, 22 bp, Homo sapiens
tttttataccacctctcactta

SEQ ID NO: 9104810 - DNA, 22 bp, Homo sapiens
tttttataactcttttgtgaca

SEQ ID NO: 9104811 - DNA, 22 bp, Homo sapiens
tttttataactcttttgtgaca

SEQ ID NO: 9104812 - DNA, 22 bp, Homo sapiens
tttttataactcttttgtgaca

SEQ ID NO: 9104813 - DNA, 22 bp, Homo sapiens
tttttagaattggctgagaatt

SEQ ID NO: 9104814 - DNA, 22 bp, Homo sapiens
tttttagagtgttaccagtata

SEQ ID NO: 9104815 - DNA, 22 bp, Homo sapiens
tttttagattactcagccacca

SEQ ID NO: 9104816 - DNA, 22 bp, Homo sapiens
tttttagattactcagccacca

SEQ ID NO: 9104817 - DNA, 22 bp, Homo sapiens
ttttcttatgtgcagctatatg

SEQ ID NO: 9104818 - DNA, 22 bp, Homo sapiens
ttttcttatgtgcagctatatg

SEQ ID NO: 9104819 - DNA, 22 bp, Homo sapiens
ttttcttatgtgcagctatatg

SEQ ID NO: 9104820 - DNA, 22 bp, Homo sapiens
ttttcttatggtgaagcacaaa

SEQ ID NO: 9104821 - DNA, 22 bp, Homo sapiens
ttttcttatggtgaagcacaaa

SEQ ID NO: 9104822 - DNA, 22 bp, Homo sapiens
ttttcttatggtgaagcacaaa

SEQ ID NO: 9104823 - DNA, 22 bp, Homo sapiens
ttttcttatggtgaagcacaaa

SEQ ID NO: 9104824 - DNA, 22 bp, Homo sapiens
ttttcttatagagcttaaagtt

SEQ ID NO: 9104825 - DNA, 22 bp, Homo sapiens
ttttcttaggtgctccaagtag

SEQ ID NO: 9104826 - DNA, 22 bp, Homo sapiens
ttttcttaggtgctccaagtag

SEQ ID NO: 9104827 - DNA, 22 bp, Homo sapiens
ttttcttaggtgctccaagtag

SEQ ID NO: 9104828 - DNA, 22 bp, Homo sapiens
ttttcttatagagcttaaagtt

SEQ ID NO: 9104829 - DNA, 22 bp, Homo sapiens
ttttcttatagagcttaaagtt

SEQ ID NO: 9104830 - DNA, 22 bp, Homo sapiens
ttttcttactgtctgtgatcct

SEQ ID NO: 9104831 - DNA, 22 bp, Homo sapiens
ttttcttactgtctgtgatcct

SEQ ID NO: 9104832 - DNA, 22 bp, Homo sapiens
ttttcttactgtctgtgatcct

SEQ ID NO: 9104833 - DNA, 22 bp, Homo sapiens
ttttcttactgtctgtgatcct

SEQ ID NO: 9104834 - DNA, 22 bp, Homo sapiens
ttttcttactgtctgtgatcct

SEQ ID NO: 9104835 - DNA, 20 bp, Homo sapiens
ttttctgtgccaagaaaact

SEQ ID NO: 9104836 - DNA, 20 bp, Homo sapiens
ttttctgtgccaagaaaact

SEQ ID NO: 9104837 - DNA, 22 bp, Homo sapiens
ttttctgttacaaagtacagcg

SEQ ID NO: 9104838 - DNA, 22 bp, Homo sapiens
ttttctgacctatctacattta

SEQ ID NO: 9104839 - DNA, 22 bp, Homo sapiens
ttttctgacctatctacattta

SEQ ID NO: 9104840 - DNA, 19 bp, Homo sapiens
ttttctcagcttctagcgg

SEQ ID NO: 9104841 - DNA, 22 bp, Homo sapiens
ttttctcttgttaatgtactga

SEQ ID NO: 9104842 - DNA, 22 bp, Homo sapiens
ttttctcagctgcactgtatta

SEQ ID NO: 9104843 - DNA, 22 bp, Homo sapiens
ttttctcagctgcactgtatta

SEQ ID NO: 9104844 - DNA, 22 bp, Homo sapiens
ttttctcaagatccaatgcact

SEQ ID NO: 9104845 - DNA, 22 bp, Homo sapiens
ttttcatttacattagggaaga

SEQ ID NO: 9104846 - DNA, 22 bp, Homo sapiens
ttttcatttacattagggaaga

SEQ ID NO: 9104847 - DNA, 22 bp, Homo sapiens
ttttcatttacattagggaaga

SEQ ID NO: 9104848 - DNA, 22 bp, Homo sapiens
ttttcatttacattagggaaga

SEQ ID NO: 9104849 - DNA, 22 bp, Homo sapiens
ttttcatttttgtagatgcaag

SEQ ID NO: 9104850 - DNA, 22 bp, Homo sapiens
ttttcatttttgtagatgcaag

SEQ ID NO: 9104851 - DNA, 22 bp, Homo sapiens
ttttatgttgctataataggta

SEQ ID NO: 9104852 - DNA, 22 bp, Homo sapiens
ttttatgttcctgaagctatct

SEQ ID NO: 9104853 - DNA, 22 bp, Homo sapiens
ttttatgtgtgaaatgctgtct

SEQ ID NO: 9104854 - DNA, 22 bp, Homo sapiens
ttttatgtgtgaaatgctgtct

SEQ ID NO: 9104855 - DNA, 22 bp, Homo sapiens
ttttatgtgtcaaagcagtggt

SEQ ID NO: 9104856 - DNA, 22 bp, Homo sapiens
ttttatgttcctctttatgcga

SEQ ID NO: 9104857 - DNA, 22 bp, Homo sapiens
ttttatgttcctgaagctatct

SEQ ID NO: 9104858 - DNA, 22 bp, Homo sapiens
ttttattatctttgaatgggac

SEQ ID NO: 9104859 - DNA, 22 bp, Homo sapiens
ttttattgcaataaagtgtgta

SEQ ID NO: 9104860 - DNA, 22 bp, Homo sapiens
ttttattggagtgataccaagc

SEQ ID NO: 9104861 - DNA, 22 bp, Homo sapiens
ttttattggagtgataccaagc

SEQ ID NO: 9104862 - DNA, 22 bp, Homo sapiens
ttttattgcaataaagtgtgta

SEQ ID NO: 9104863 - DNA, 22 bp, Homo sapiens
ttttcacattgtcccagcacta

SEQ ID NO: 9104864 - DNA, 22 bp, Homo sapiens
ttttcagtttgcactgcagtgc

SEQ ID NO: 9104865 - DNA, 22 bp, Homo sapiens
ttttcacacaaggtgataagtt

SEQ ID NO: 9104866 - DNA, 22 bp, Homo sapiens
ttttcatggccaccgcaagtga

SEQ ID NO: 9104867 - DNA, 22 bp, Homo sapiens
ttttcatgtcatgtccttgagg

SEQ ID NO: 9104868 - DNA, 22 bp, Homo sapiens
ttttcatgtcatgtccttgagg

SEQ ID NO: 9104869 - DNA, 22 bp, Homo sapiens
ttttcatgaggaaatactgccc

SEQ ID NO: 9104870 - DNA, 22 bp, Homo sapiens
ttttcattgtaaatcaggaaac

SEQ ID NO: 9104871 - DNA, 22 bp, Homo sapiens
ttttcattgttactatgagcta

SEQ ID NO: 9104872 - DNA, 22 bp, Homo sapiens
ttttcattgttactatgagcta

SEQ ID NO: 9104873 - DNA, 22 bp, Homo sapiens
ttttcattgttcctcgagcatt

SEQ ID NO: 9104874 - DNA, 22 bp, Homo sapiens
ttttcattgttcctcgagcatt

SEQ ID NO: 9104875 - DNA, 22 bp, Homo sapiens
ttttcattgttcctcgagcatt

SEQ ID NO: 9104876 - DNA, 22 bp, Homo sapiens
ttttcattagaatgactgagaa

SEQ ID NO: 9104877 - DNA, 22 bp, Homo sapiens
ttttcattagaatgactgagaa

SEQ ID NO: 9104878 - DNA, 22 bp, Homo sapiens
ttttcattagaatgactgagaa

SEQ ID NO: 9104879 - DNA, 22 bp, Homo sapiens
ttttcatgttccttgttaagtg

SEQ ID NO: 9104880 - DNA, 22 bp, Homo sapiens
ttttcatgtgatgtgacatttc

SEQ ID NO: 9104881 - DNA, 22 bp, Homo sapiens
ttttcattgagcacctgagtaa

SEQ ID NO: 9104882 - DNA, 22 bp, Homo sapiens
ttttaattcaaagtgaatagtg

SEQ ID NO: 9104883 - DNA, 22 bp, Homo sapiens
ttttaattcaaagtgaatagtg

SEQ ID NO: 9104884 - DNA, 22 bp, Homo sapiens
ttttaattcaaagtgaatagtg

SEQ ID NO: 9104885 - DNA, 22 bp, Homo sapiens
ttttaatgggcgactattatgg

SEQ ID NO: 9104886 - DNA, 22 bp, Homo sapiens
ttttatgtcataaggacactca

SEQ ID NO: 9104887 - DNA, 22 bp, Homo sapiens
ttttatgtcataaggacactca

SEQ ID NO: 9104888 - DNA, 22 bp, Homo sapiens
ttttatgtgctggactggcagt

SEQ ID NO: 9104889 - DNA, 22 bp, Homo sapiens
ttttatgtaatccttactgtcg

SEQ ID NO: 9104890 - DNA, 22 bp, Homo sapiens
ttttaaactgcagaatttagaa

SEQ ID NO: 9104891 - DNA, 22 bp, Homo sapiens
ttttaaactgcagaatttagaa

SEQ ID NO: 9104892 - DNA, 22 bp, Homo sapiens
ttttaaactgcagaatttagaa

SEQ ID NO: 9104893 - DNA, 22 bp, Homo sapiens
ttttaaaggatactcttgtcta

SEQ ID NO: 9104894 - DNA, 22 bp, Homo sapiens
ttttaacactcagcactatctc

SEQ ID NO: 9104895 - DNA, 21 bp, Homo sapiens
ttttaacaaggatttccctag

SEQ ID NO: 9104896 - DNA, 22 bp, Homo sapiens
ttttaagaaatgtatgactgtc

SEQ ID NO: 9104897 - DNA, 22 bp, Homo sapiens
tttgttaaggagtattgcttct

SEQ ID NO: 9104898 - DNA, 22 bp, Homo sapiens
tttgttataacaataaaaagtc

SEQ ID NO: 9104899 - DNA, 22 bp, Homo sapiens
tttgtgttgttttaagccacta

SEQ ID NO: 9104900 - DNA, 22 bp, Homo sapiens
tttgtgtttgtacaatgcacta

SEQ ID NO: 9104901 - DNA, 22 bp, Homo sapiens
tttgtgttgtacttctgtgcat

SEQ ID NO: 9104902 - DNA, 22 bp, Homo sapiens
tttgtgttttagctggtgaggc

SEQ ID NO: 9104903 - DNA, 22 bp, Homo sapiens
tttgtaaatagcagtactcatg

SEQ ID NO: 9104904 - DNA, 22 bp, Homo sapiens
tttgtaaagtctgttctgagtt

SEQ ID NO: 9104905 - DNA, 22 bp, Homo sapiens
tttgtaaaggcctgaatttcag

SEQ ID NO: 9104906 - DNA, 22 bp, Homo sapiens
tttgtaaaggcctgaatttcag

SEQ ID NO: 9104907 - DNA, 22 bp, Homo sapiens
tttgtaaatagcagtactcatg

SEQ ID NO: 9104908 - DNA, 22 bp, Homo sapiens
tttgtaaatagcagtactcatg

SEQ ID NO: 9104909 - DNA, 22 bp, Homo sapiens
tttgtaaaaggaggaagcatgg

SEQ ID NO: 9104910 - DNA, 22 bp, Homo sapiens
tttgtaaaaggaggaagcatgg

SEQ ID NO: 9104911 - DNA, 22 bp, Homo sapiens
tttgtaaaaggaggaagcatgg

SEQ ID NO: 9104912 - DNA, 22 bp, Homo sapiens
tttgtaaaggcctgaatttcag

SEQ ID NO: 9104913 - DNA, 22 bp, Homo sapiens
tttgtaaaggcctgaatttcag

SEQ ID NO: 9104914 - DNA, 22 bp, Homo sapiens
tttgtaaggaatattcttggtg

SEQ ID NO: 9104915 - DNA, 22 bp, Homo sapiens
tttgtaagagcatatgtaaagg

SEQ ID NO: 9104916 - DNA, 22 bp, Homo sapiens
tttgtgtgtatatgtatataga

SEQ ID NO: 9104917 - DNA, 22 bp, Homo sapiens
tttgtgtgtatatgtatataga

SEQ ID NO: 9104918 - DNA, 22 bp, Homo sapiens
tttgtgtgcttggtattgaaga

SEQ ID NO: 9104919 - DNA, 22 bp, Homo sapiens
tttgtgtggtggatactgggta

SEQ ID NO: 9104920 - DNA, 22 bp, Homo sapiens
tttgatagttgattaaattcca

SEQ ID NO: 9104921 - DNA, 22 bp, Homo sapiens
tttgatactttgtgcaatttct

SEQ ID NO: 9104922 - DNA, 22 bp, Homo sapiens
tttgataattaaaaattgtagt

SEQ ID NO: 9104923 - DNA, 22 bp, Homo sapiens
tttgatcagcaagataaataga

SEQ ID NO: 9104924 - DNA, 19 bp, Homo sapiens
tttgatatctgaattatgc

SEQ ID NO: 9104925 - DNA, 22 bp, Homo sapiens
tttgaggttagctagcagatca

SEQ ID NO: 9104926 - DNA, 22 bp, Homo sapiens
tttgaggttagctagcagatca

SEQ ID NO: 9104927 - DNA, 22 bp, Homo sapiens
tttgataacagtgaatatcatg

SEQ ID NO: 9104928 - DNA, 22 bp, Homo sapiens
tttgataacagtgaatatcatg

SEQ ID NO: 9104929 - DNA, 22 bp, Homo sapiens
tttgagtgcccatgtttcccag

SEQ ID NO: 9104930 - DNA, 22 bp, Homo sapiens
tttgctttcccttgtagaaagt

SEQ ID NO: 9104931 - DNA, 22 bp, Homo sapiens
tttgctttctgttgaacagagt

SEQ ID NO: 9104932 - DNA, 18 bp, Homo sapiens
tttgctttccttcttcag

SEQ ID NO: 9104933 - DNA, 18 bp, Homo sapiens
tttgctttccttcttcag

SEQ ID NO: 9104934 - DNA, 22 bp, Homo sapiens
tttgctttgactgtcagcaagt

SEQ ID NO: 9104935 - DNA, 22 bp, Homo sapiens
tttgctttcttgattcagatta

SEQ ID NO: 9104936 - DNA, 22 bp, Homo sapiens
tttgctttcttgattcagatta

SEQ ID NO: 9104937 - DNA, 22 bp, Homo sapiens
tttgctttgggaggttgtctgg

SEQ ID NO: 9104938 - DNA, 22 bp, Homo sapiens
tttgctttgactgtcagcaagt

SEQ ID NO: 9104939 - DNA, 22 bp, Homo sapiens
tttggaaattactcattgtcct

SEQ ID NO: 9104940 - DNA, 22 bp, Homo sapiens
tttggaaattactcattgtcct

SEQ ID NO: 9104941 - DNA, 22 bp, Homo sapiens
tttggaaataattccatctcat

SEQ ID NO: 9104942 - DNA, 22 bp, Homo sapiens
tttggaaatacgcgtaggcaga

SEQ ID NO: 9104943 - DNA, 22 bp, Homo sapiens
tttggaaagtgtgatttcaagg

SEQ ID NO: 9104944 - DNA, 22 bp, Homo sapiens
tttggaaagtgtgatttcaagg

SEQ ID NO: 9104945 - DNA, 22 bp, Homo sapiens
tttggaaagacacacagtttta

SEQ ID NO: 9104946 - DNA, 22 bp, Homo sapiens
tttgcttttgtgctctagtggt

SEQ ID NO: 9104947 - DNA, 22 bp, Homo sapiens
tttgctttgtttaaaagtggta

SEQ ID NO: 9104948 - DNA, 22 bp, Homo sapiens
tttggaaaatattgaactggtt

SEQ ID NO: 9104949 - DNA, 22 bp, Homo sapiens
tttggaaaatattgaactggtt

SEQ ID NO: 9104950 - DNA, 22 bp, Homo sapiens
tttggaaaaagcctgaacatag

SEQ ID NO: 9104951 - DNA, 22 bp, Homo sapiens
tttggaaaattttctaagtctg

SEQ ID NO: 9104952 - DNA, 22 bp, Homo sapiens
tttggaaactgcctcagctctt

SEQ ID NO: 9104953 - DNA, 22 bp, Homo sapiens
tttggaaacatctcagaaaata

SEQ ID NO: 9104954 - DNA, 22 bp, Homo sapiens
tttggaaacatctcagaaaata

SEQ ID NO: 9104955 - DNA, 22 bp, Homo sapiens
tttggtctggaatcttcagggt

SEQ ID NO: 9104956 - DNA, 22 bp, Homo sapiens
tttggtcttttatttaaagcag

SEQ ID NO: 9104957 - DNA, 22 bp, Homo sapiens
tttggttaaacgagagaacata

SEQ ID NO: 9104958 - DNA, 22 bp, Homo sapiens
tttggtgtctggctgtatggac

SEQ ID NO: 9104959 - DNA, 22 bp, Homo sapiens
tttggtttagggtcatttaaca

SEQ ID NO: 9104960 - DNA, 22 bp, Homo sapiens
tttggtttattaaattgtaggc

SEQ ID NO: 9104961 - DNA, 22 bp, Homo sapiens
tttgtaaaagcccaagctgtag

SEQ ID NO: 9104962 - DNA, 22 bp, Homo sapiens
tttggtttttaatacaaagtac

SEQ ID NO: 9104963 - DNA, 22 bp, Homo sapiens
tttggtttttacctgctgagag

SEQ ID NO: 9104964 - DNA, 22 bp, Homo sapiens
tttggtctctgtgcatcctcct

SEQ ID NO: 9104965 - DNA, 22 bp, Homo sapiens
tttggtcagggtaggacagttg

SEQ ID NO: 9104966 - DNA, 22 bp, Homo sapiens
tttggtcataagcttttggggt

SEQ ID NO: 9104967 - DNA, 22 bp, Homo sapiens
tttggtcagcagttggtggcgt

SEQ ID NO: 9104968 - DNA, 22 bp, Homo sapiens
tttggtcagcaatattgtgggg

SEQ ID NO: 9104969 - DNA, 22 bp, Homo sapiens
tttggtcagataagtcaatgta

SEQ ID NO: 9104970 - DNA, 22 bp, Homo sapiens
tttggtcatttgcactgccaat

SEQ ID NO: 9104971 - DNA, 22 bp, Homo sapiens
tttggtcattgaggaagtaaag

SEQ ID NO: 9104972 - DNA, 22 bp, Homo sapiens
tttggtcatgtcgtcatttggg

SEQ ID NO: 9104973 - DNA, 22 bp, Homo sapiens
tttggtcatgtgcccacccctg

SEQ ID NO: 9104974 - DNA, 22 bp, Homo sapiens
tttggtcatagattgcgaacat

SEQ ID NO: 9104975 - DNA, 22 bp, Homo sapiens
tttggtattgcacactgtcttc

SEQ ID NO: 9104976 - DNA, 22 bp, Homo sapiens
tttggtcaaatattatcctgag

SEQ ID NO: 9104977 - DNA, 22 bp, Homo sapiens
tttggtcaatatggtagcagca

SEQ ID NO: 9104978 - DNA, 22 bp, Homo sapiens
tttggtcactggatttggctgt

SEQ ID NO: 9104979 - DNA, 22 bp, Homo sapiens
tttggtattgcacactgtcttc

SEQ ID NO: 9104980 - DNA, 22 bp, Homo sapiens
tttggtaagtacccacctgggt

SEQ ID NO: 9104981 - DNA, 22 bp, Homo sapiens
tttggtaagtacccacctgggt

SEQ ID NO: 9104982 - DNA, 22 bp, Homo sapiens
tttggaaattttcatccagaca

SEQ ID NO: 9104983 - DNA, 22 bp, Homo sapiens
tttcctcctagcctccagccgc

SEQ ID NO: 9104984 - DNA, 22 bp, Homo sapiens
tttcctcctagcctccagccgc

SEQ ID NO: 9104985 - DNA, 22 bp, Homo sapiens
tttcctctaaacgcatttgctt

SEQ ID NO: 9104986 - DNA, 22 bp, Homo sapiens
tttcctctaaacgcatttgctt

SEQ ID NO: 9104987 - DNA, 22 bp, Homo sapiens
tttcctctaaacgcatttgctt

SEQ ID NO: 9104988 - DNA, 22 bp, Homo sapiens
tttcctcacttcatgagagttt

SEQ ID NO: 9104989 - DNA, 22 bp, Homo sapiens
tttcctcagaagtgtctactat

SEQ ID NO: 9104990 - DNA, 22 bp, Homo sapiens
tttcctcatttatctgctggga

SEQ ID NO: 9104991 - DNA, 22 bp, Homo sapiens
tttcctctgactgctcccctgc

SEQ ID NO: 9104992 - DNA, 22 bp, Homo sapiens
tttcctctgagtgagctgggag

SEQ ID NO: 9104993 - DNA, 22 bp, Homo sapiens
tttcctctccggggcctccagg

SEQ ID NO: 9104994 - DNA, 22 bp, Homo sapiens
tttcctaacacaatgcatgaga

SEQ ID NO: 9104995 - DNA, 22 bp, Homo sapiens
tttccctctgtgccagcttctc

SEQ ID NO: 9104996 - DNA, 21 bp, Homo sapiens
tttccctcattgtgttggcac

SEQ ID NO: 9104997 - DNA, 22 bp, Homo sapiens
tttccctacttgtaactggaaa

SEQ ID NO: 9104998 - DNA, 22 bp, Homo sapiens
tttcttttgaatagtgtgtggt

SEQ ID NO: 9104999 - DNA, 22 bp, Homo sapiens
tttcttttccaatatccctact

SEQ ID NO: 9105000 - DNA, 22 bp, Homo sapiens
tttcttttgccctgtgggttag

SEQ ID NO: 9105001 - DNA, 22 bp, Homo sapiens
tttcttttgccctgtgggttag

SEQ ID NO: 9105002 - DNA, 22 bp, Homo sapiens
tttcctctgatgctgacttgga

SEQ ID NO: 9105003 - DNA, 22 bp, Homo sapiens
tttctttgagtctcagtttgct

SEQ ID NO: 9105004 - DNA, 22 bp, Homo sapiens
tttcttttacagtgtggctatt

SEQ ID NO: 9105005 - DNA, 22 bp, Homo sapiens
tttctttgttgttatcacatca

SEQ ID NO: 9105006 - DNA, 22 bp, Homo sapiens
tttgaaagggttatgagactga

SEQ ID NO: 9105007 - DNA, 22 bp, Homo sapiens
tttgaagataaatatggagaaa

SEQ ID NO: 9105008 - DNA, 22 bp, Homo sapiens
tttgaatatacttcaaacaaag

SEQ ID NO: 9105009 - DNA, 17 bp, Homo sapiens
tttgaaaggatgtcagt

SEQ ID NO: 9105010 - DNA, 22 bp, Homo sapiens
tttgaaaggaagttaatacttt

SEQ ID NO: 9105011 - DNA, 22 bp, Homo sapiens
tttgaaaggaattaggatgaca

SEQ ID NO: 9105012 - DNA, 22 bp, Homo sapiens
tttgaaagggaaataaactcct

SEQ ID NO: 9105013 - DNA, 21 bp, Homo sapiens
tttgaaagctacatctatagc

SEQ ID NO: 9105014 - DNA, 22 bp, Homo sapiens
tttgacaagagggcatcttcag

SEQ ID NO: 9105015 - DNA, 22 bp, Homo sapiens
tttgacaagagcaaatgttctt

SEQ ID NO: 9105016 - DNA, 22 bp, Homo sapiens
tttgacaacgttgttgtgagga

SEQ ID NO: 9105017 - DNA, 22 bp, Homo sapiens
tttgacaaccaggcaggtaaga

SEQ ID NO: 9105018 - DNA, 22 bp, Homo sapiens
tttgacaaccaggcaggtaaga

SEQ ID NO: 9105019 - DNA, 19 bp, Homo sapiens
tttgacagagtttgagcat

SEQ ID NO: 9105020 - DNA, 22 bp, Homo sapiens
tttgacaattcatgacatttat

SEQ ID NO: 9105021 - DNA, 22 bp, Homo sapiens
tttgacaattcatgacatttat

SEQ ID NO: 9105022 - DNA, 22 bp, Homo sapiens
tttgacaaatccttcagcaatg

SEQ ID NO: 9105023 - DNA, 22 bp, Homo sapiens
tttgacaaatatttattggcac

SEQ ID NO: 9105024 - DNA, 22 bp, Homo sapiens
tttgacaaatatttattggcac

SEQ ID NO: 9105025 - DNA, 22 bp, Homo sapiens
tttgacaaatgtatctgcatta

SEQ ID NO: 9105026 - DNA, 22 bp, Homo sapiens
tttgacaaatgtatctgcatta

SEQ ID NO: 9105027 - DNA, 22 bp, Homo sapiens
tttgacaacacgttatttgcct

SEQ ID NO: 9105028 - DNA, 22 bp, Homo sapiens
tttgacaacagcaaatgtcaca

SEQ ID NO: 9105029 - DNA, 22 bp, Homo sapiens
tttgacaaaggaaaaatgcaca

SEQ ID NO: 9105030 - DNA, 22 bp, Homo sapiens
tttgacaaaggaaaaatgcaca

SEQ ID NO: 9105031 - DNA, 22 bp, Homo sapiens
tttgacaaatatttattggcac

SEQ ID NO: 9105032 - DNA, 22 bp, Homo sapiens
tttgacaaataggggaataagg

SEQ ID NO: 9105033 - DNA, 22 bp, Homo sapiens
tttgaatgagaattattgtcat

SEQ ID NO: 9105034 - DNA, 22 bp, Homo sapiens
tttgaatgtgtgagttaacttt

SEQ ID NO: 9105035 - DNA, 22 bp, Homo sapiens
ttcttactacatttgcaggcta

SEQ ID NO: 9105036 - DNA, 22 bp, Homo sapiens
ttcttacattactttacatgtg

SEQ ID NO: 9105037 - DNA, 22 bp, Homo sapiens
ttctgtgttctgtgcaatgagc

SEQ ID NO: 9105038 - DNA, 22 bp, Homo sapiens
ttctgtgttctgtgcaatgagc

SEQ ID NO: 9105039 - DNA, 22 bp, Homo sapiens
ttctgtgtgggtagctcctgtt

SEQ ID NO: 9105040 - DNA, 22 bp, Homo sapiens
ttctgtgtgctgtcttggcttt

SEQ ID NO: 9105041 - DNA, 22 bp, Homo sapiens
ttctgtgtgggtagctcctgtt

SEQ ID NO: 9105042 - DNA, 22 bp, Homo sapiens
ttctgtgtgtctcagcaagctg

SEQ ID NO: 9105043 - DNA, 22 bp, Homo sapiens
ttcttactagtatgtttcagca

SEQ ID NO: 9105044 - DNA, 22 bp, Homo sapiens
ttcttagaagaaacatctaaaa

SEQ ID NO: 9105045 - DNA, 22 bp, Homo sapiens
ttcttagtggtagtcatctttg

SEQ ID NO: 9105046 - DNA, 22 bp, Homo sapiens
ttcttagatgattaatgatggg

SEQ ID NO: 9105047 - DNA, 22 bp, Homo sapiens
ttcttagctccagcttcatgtt

SEQ ID NO: 9105048 - DNA, 20 bp, Homo sapiens
ttcttagtagagcatgtatt

SEQ ID NO: 9105049 - DNA, 22 bp, Homo sapiens
ttcttatattgggtcatggata

SEQ ID NO: 9105050 - DNA, 22 bp, Homo sapiens
ttcttatagaagcaaccattgt

SEQ ID NO: 9105051 - DNA, 22 bp, Homo sapiens
ttcttatgttcacataattcca

SEQ ID NO: 9105052 - DNA, 22 bp, Homo sapiens
ttcttataagataggcctcagg

SEQ ID NO: 9105053 - DNA, 22 bp, Homo sapiens
ttcttataagttaatatttcca

SEQ ID NO: 9105054 - DNA, 22 bp, Homo sapiens
ttctgtaagggatttattctga

SEQ ID NO: 9105055 - DNA, 22 bp, Homo sapiens
ttctgtcttctcggttgtttac

SEQ ID NO: 9105056 - DNA, 22 bp, Homo sapiens
ttctgtcttcccactgaggagc

SEQ ID NO: 9105057 - DNA, 22 bp, Homo sapiens
ttctgtggtctcccatgtctgt

SEQ ID NO: 9105058 - DNA, 22 bp, Homo sapiens
ttctgtggtctcccatgtctgt

SEQ ID NO: 9105059 - DNA, 22 bp, Homo sapiens
ttctgtgaggacttctcaagga

SEQ ID NO: 9105060 - DNA, 22 bp, Homo sapiens
ttctgtgactcctcagagattt

SEQ ID NO: 9105061 - DNA, 22 bp, Homo sapiens
ttctgtggaatatgaactagca

SEQ ID NO: 9105062 - DNA, 22 bp, Homo sapiens
ttctgtgattcctccagccagc

SEQ ID NO: 9105063 - DNA, 22 bp, Homo sapiens
ttctggaagtggaatttttgta

SEQ ID NO: 9105064 - DNA, 22 bp, Homo sapiens
ttctggaagtggaatttttgta

SEQ ID NO: 9105065 - DNA, 22 bp, Homo sapiens
ttctggaagtgttagaatctgg

SEQ ID NO: 9105066 - DNA, 22 bp, Homo sapiens
ttctggaatatttgacacaatt

SEQ ID NO: 9105067 - DNA, 22 bp, Homo sapiens
ttctggaatactaagttccttt

SEQ ID NO: 9105068 - DNA, 21 bp, Homo sapiens
ttctctggtcaagcacacata

SEQ ID NO: 9105069 - DNA, 22 bp, Homo sapiens
ttctggaacatagcaagaagtt

SEQ ID NO: 9105070 - DNA, 22 bp, Homo sapiens
ttctctgggatctggcaaaagg

SEQ ID NO: 9105071 - DNA, 22 bp, Homo sapiens
ttctctggggactgtctctatt

SEQ ID NO: 9105072 - DNA, 22 bp, Homo sapiens
ttctctgggcttttcggatccg

SEQ ID NO: 9105073 - DNA, 22 bp, Homo sapiens
ttctctggacagtgaagagagg

SEQ ID NO: 9105074 - DNA, 22 bp, Homo sapiens
ttctctgggacaggaacagttt

SEQ ID NO: 9105075 - DNA, 16 bp, Homo sapiens
ttctctggggttgtgc

SEQ ID NO: 9105076 - DNA, 22 bp, Homo sapiens
ttctctgggttaggggaactat

SEQ ID NO: 9105077 - DNA, 22 bp, Homo sapiens
ttctctggtaaacacatgcgta

SEQ ID NO: 9105078 - DNA, 22 bp, Homo sapiens
ttctctggggttcagtatctct

SEQ ID NO: 9105079 - DNA, 22 bp, Homo sapiens
ttctctggggttcagtatctct

SEQ ID NO: 9105080 - DNA, 22 bp, Homo sapiens
ttctctggggacttggttggag

SEQ ID NO: 9105081 - DNA, 22 bp, Homo sapiens
ttctggacttccaaatggcttc

SEQ ID NO: 9105082 - DNA, 22 bp, Homo sapiens
ttctggaattcttgcagccact

SEQ ID NO: 9105083 - DNA, 22 bp, Homo sapiens
ttctggagacccagcaacaggg

SEQ ID NO: 9105084 - DNA, 22 bp, Homo sapiens
ttctggagaatcaccaccaggc

SEQ ID NO: 9105085 - DNA, 22 bp, Homo sapiens
ttctggagccccaagatctgta

SEQ ID NO: 9105086 - DNA, 22 bp, Homo sapiens
ttctggagatctgcctatggga

SEQ ID NO: 9105087 - DNA, 22 bp, Homo sapiens
ttctggagaggaacagaaaggt

SEQ ID NO: 9105088 - DNA, 22 bp, Homo sapiens
ttctggagaggaacagaaaggt

SEQ ID NO: 9105089 - DNA, 22 bp, Homo sapiens
ttctggagattgagaaggcatt

SEQ ID NO: 9105090 - DNA, 22 bp, Homo sapiens
ttctttgtggcagtgagctggg

SEQ ID NO: 9105091 - DNA, 20 bp, Homo sapiens
ttctttgttccttacatttg

SEQ ID NO: 9105092 - DNA, 19 bp, Homo sapiens
ttctttggtggtggtgacc

SEQ ID NO: 9105093 - DNA, 22 bp, Homo sapiens
ttctttgtaacctttgggaact

SEQ ID NO: 9105094 - DNA, 22 bp, Homo sapiens
ttcttttaatgtctggctttca

SEQ ID NO: 9105095 - DNA, 22 bp, Homo sapiens
ttcttttaaaagagagcagaaa

SEQ ID NO: 9105096 - DNA, 22 bp, Homo sapiens
ttcttttaatagagatcctgtg

SEQ ID NO: 9105097 - DNA, 22 bp, Homo sapiens
ttcttttaatgttctgaagttt

SEQ ID NO: 9105098 - DNA, 17 bp, Homo sapiens
ttcttttctgagccttg

SEQ ID NO: 9105099 - DNA, 22 bp, Homo sapiens
ttcttttctgcagctggtattt

SEQ ID NO: 9105100 - DNA, 22 bp, Homo sapiens
ttcttcaaaatccagcatgatt

SEQ ID NO: 9105101 - DNA, 22 bp, Homo sapiens
ttcttcaattattggaaagaaa

SEQ ID NO: 9105102 - DNA, 22 bp, Homo sapiens
ttcttcaacaaggacactgtta

SEQ ID NO: 9105103 - DNA, 22 bp, Homo sapiens
ttcttcaaccatctacataaac

SEQ ID NO: 9105104 - DNA, 22 bp, Homo sapiens
ttctttttaaagtgtgtatgca

SEQ ID NO: 9105105 - DNA, 22 bp, Homo sapiens
ttgaaaggcacaggcacctggg

SEQ ID NO: 9105106 - DNA, 22 bp, Homo sapiens
ttctttttaaagtgtgtatgca

SEQ ID NO: 9105107 - DNA, 22 bp, Homo sapiens
ttcttttctttaggcattgtgt

SEQ ID NO: 9105108 - DNA, 22 bp, Homo sapiens
ttcttttcttggcaggagtaga

SEQ ID NO: 9105109 - DNA, 22 bp, Homo sapiens
ttcttttggactcaaagagaac

SEQ ID NO: 9105110 - DNA, 20 bp, Homo sapiens
ttcttttgataagcttgaca

SEQ ID NO: 9105111 - DNA, 22 bp, Homo sapiens
ttgaaatgagcaaactgtcagc

SEQ ID NO: 9105112 - DNA, 22 bp, Homo sapiens
ttgaaatatggattgaccttga

SEQ ID NO: 9105113 - DNA, 19 bp, Homo sapiens
ttgaaattgtttgatatgg

SEQ ID NO: 9105114 - DNA, 22 bp, Homo sapiens
ttgaacaatttggtatacaaac

SEQ ID NO: 9105115 - DNA, 22 bp, Homo sapiens
ttgaacaatcaaaagaattcat

SEQ ID NO: 9105116 - DNA, 22 bp, Homo sapiens
ttgaaattttaggccttgcaat

SEQ ID NO: 9105117 - DNA, 22 bp, Homo sapiens
ttgaacataaatcactggtcag

SEQ ID NO: 9105118 - DNA, 22 bp, Homo sapiens
ttgaacagttttgtcaggttca

SEQ ID NO: 9105119 - DNA, 22 bp, Homo sapiens
ttgaacagctgttacattgtta

SEQ ID NO: 9105120 - DNA, 23 bp, Homo sapiens
ttgaatttctcttgcaatattta

SEQ ID NO: 9105121 - DNA, 22 bp, Homo sapiens
ttgaatttagattgtatgttga

SEQ ID NO: 9105122 - DNA, 22 bp, Homo sapiens
ttgaagaaagtcatatataatg

SEQ ID NO: 9105123 - DNA, 22 bp, Homo sapiens
ttgaactgtaagcatgtctgcc

SEQ ID NO: 9105124 - DNA, 17 bp, Homo sapiens
ttgaactgctgagtcag

SEQ ID NO: 9105125 - DNA, 22 bp, Homo sapiens
ttgaacattggcaatttcatat

SEQ ID NO: 9105126 - DNA, 22 bp, Homo sapiens
ttgaacattaacttcagtctat

SEQ ID NO: 9105127 - DNA, 22 bp, Homo sapiens
ttcctggtagtaagacatctgg

SEQ ID NO: 9105128 - DNA, 22 bp, Homo sapiens
ttcctggtaaattatgtccagg

SEQ ID NO: 9105129 - DNA, 22 bp, Homo sapiens
ttcctggtctatttagaattgc

SEQ ID NO: 9105130 - DNA, 22 bp, Homo sapiens
ttcctggtgacctcactggtag

SEQ ID NO: 9105131 - DNA, 22 bp, Homo sapiens
ttcctggtggctttgccaactg

SEQ ID NO: 9105132 - DNA, 22 bp, Homo sapiens
ttcctggtggtggtgacagcac

SEQ ID NO: 9105133 - DNA, 22 bp, Homo sapiens
ttcctggttggattctgattaa

SEQ ID NO: 9105134 - DNA, 22 bp, Homo sapiens
ttcctggtttatacctgtatca

SEQ ID NO: 9105135 - DNA, 20 bp, Homo sapiens
ttcctgtaaccggcagctgc

SEQ ID NO: 9105136 - DNA, 22 bp, Homo sapiens
ttcctggtttgcctggaatcca

SEQ ID NO: 9105137 - DNA, 22 bp, Homo sapiens
ttcctggtttatggaaagcatg

SEQ ID NO: 9105138 - DNA, 22 bp, Homo sapiens
ttcctggtttgcctggaatcca

SEQ ID NO: 9105139 - DNA, 22 bp, Homo sapiens
ttcctgtagttgtgcaatgtac

SEQ ID NO: 9105140 - DNA, 22 bp, Homo sapiens
ttcctggggtactggagaaaat

SEQ ID NO: 9105141 - DNA, 22 bp, Homo sapiens
ttcctgggtggtcctggtagag

SEQ ID NO: 9105142 - DNA, 22 bp, Homo sapiens
ttccttggccccatgcccaggg

SEQ ID NO: 9105143 - DNA, 22 bp, Homo sapiens
ttccttggccacactggtgctt

SEQ ID NO: 9105144 - DNA, 22 bp, Homo sapiens
ttccttggatacaagtaacttt

SEQ ID NO: 9105145 - DNA, 22 bp, Homo sapiens
ttccttggagttaagaccctgg

SEQ ID NO: 9105146 - DNA, 22 bp, Homo sapiens
ttccttggaaagagacgtcgct

SEQ ID NO: 9105147 - DNA, 22 bp, Homo sapiens
ttcctgtatctgcttcttacta

SEQ ID NO: 9105148 - DNA, 18 bp, Homo sapiens
ttccttctgatgtatatg

SEQ ID NO: 9105149 - DNA, 22 bp, Homo sapiens
ttccttcttccagaggctgccc

SEQ ID NO: 9105150 - DNA, 22 bp, Homo sapiens
ttcctgctccatttgctgagct

SEQ ID NO: 9105151 - DNA, 22 bp, Homo sapiens
ttcctgcatggattgaggctat

SEQ ID NO: 9105152 - DNA, 22 bp, Homo sapiens
ttcctggcagaggccccgacag

SEQ ID NO: 9105153 - DNA, 21 bp, Homo sapiens
ttcctggggacttccgtggga

SEQ ID NO: 9105154 - DNA, 22 bp, Homo sapiens
ttcctggcctcttccaccacca

SEQ ID NO: 9105155 - DNA, 22 bp, Homo sapiens
ttcctgcaaagccagatgtcga

SEQ ID NO: 9105156 - DNA, 23 bp, Homo sapiens
ttcctgagtgctggagagagtgc

SEQ ID NO: 9105157 - DNA, 22 bp, Homo sapiens
ttcctgagtcgccgagtctatg

SEQ ID NO: 9105158 - DNA, 22 bp, Homo sapiens
ttcctgataatgagattttccc

SEQ ID NO: 9105159 - DNA, 22 bp, Homo sapiens
ttcctgataatgagattttccc

SEQ ID NO: 9105160 - DNA, 22 bp, Homo sapiens
ttcctgagcaccagacactgca

SEQ ID NO: 9105161 - DNA, 22 bp, Homo sapiens
ttcctgagcttttaacctagtc

SEQ ID NO: 9105162 - DNA, 22 bp, Homo sapiens
ttcctgagggccccagaggagg

SEQ ID NO: 9105163 - DNA, 22 bp, Homo sapiens
ttcctgagggccccagaggagg

SEQ ID NO: 9105164 - DNA, 22 bp, Homo sapiens
ttcctgagtcccgggtaaagat

SEQ ID NO: 9105165 - DNA, 22 bp, Homo sapiens
ttcctgaattgagctttagaaa

SEQ ID NO: 9105166 - DNA, 22 bp, Homo sapiens
ttcctgaatgctgttgtgctgt

SEQ ID NO: 9105167 - DNA, 22 bp, Homo sapiens
ttcctgaatcccaaggagagct

SEQ ID NO: 9105168 - DNA, 22 bp, Homo sapiens
ttcctgaatataaagacactag

SEQ ID NO: 9105169 - DNA, 22 bp, Homo sapiens
ttcctgaatataaagacactag

SEQ ID NO: 9105170 - DNA, 22 bp, Homo sapiens
ttcctgagaccctcacagtgat

SEQ ID NO: 9105171 - DNA, 22 bp, Homo sapiens
ttcctgagaacatggcagctta

SEQ ID NO: 9105172 - DNA, 22 bp, Homo sapiens
ttcctgagaaatttgtacctgg

SEQ ID NO: 9105173 - DNA, 17 bp, Homo sapiens
ttccagtttagtattgt

SEQ ID NO: 9105174 - DNA, 22 bp, Homo sapiens
ttccagttctggctttgccact

SEQ ID NO: 9105175 - DNA, 22 bp, Homo sapiens
ttccttgtggaaactatggacg

SEQ ID NO: 9105176 - DNA, 17 bp, Homo sapiens
ttccttgggtgctgggt

SEQ ID NO: 9105177 - DNA, 22 bp, Homo sapiens
ttccttggtacagagtagcttt

SEQ ID NO: 9105178 - DNA, 22 bp, Homo sapiens
ttccttgggttctgatgtgttt

SEQ ID NO: 9105179 - DNA, 22 bp, Homo sapiens
ttccttggtacagagtagcttt

SEQ ID NO: 9105180 - DNA, 22 bp, Homo sapiens
ttccttggtagggacaactctg

SEQ ID NO: 9105181 - DNA, 22 bp, Homo sapiens
ttccttggtgcgcctgctgcag

SEQ ID NO: 9105182 - DNA, 22 bp, Homo sapiens
ttccttggtgtaactgctccta

SEQ ID NO: 9105183 - DNA, 21 bp, Homo sapiens
ttctcagatcgagtagtgaga

SEQ ID NO: 9105184 - DNA, 22 bp, Homo sapiens
ttctcaggaactcagtgtcagc

SEQ ID NO: 9105185 - DNA, 22 bp, Homo sapiens
ttctcaggactcctgcctgctt

SEQ ID NO: 9105186 - DNA, 22 bp, Homo sapiens
ttctcagggtctggatggcctg

SEQ ID NO: 9105187 - DNA, 22 bp, Homo sapiens
ttctcagggcatctcatgaccc

SEQ ID NO: 9105188 - DNA, 22 bp, Homo sapiens
ttctcaggcctttgggatggga

SEQ ID NO: 9105189 - DNA, 23 bp, Homo sapiens
ttctcaggagcccccaggtcagg

SEQ ID NO: 9105190 - DNA, 22 bp, Homo sapiens
ttctcaggcccctgcctggact

SEQ ID NO: 9105191 - DNA, 22 bp, Homo sapiens
ttctccagaccctcctgcagac

SEQ ID NO: 9105192 - DNA, 22 bp, Homo sapiens
ttctctaagagatgcagaagtt

SEQ ID NO: 9105193 - DNA, 22 bp, Homo sapiens
ttctctaagagttatatgaatt

SEQ ID NO: 9105194 - DNA, 18 bp, Homo sapiens
ttctccagaaaacatagc

SEQ ID NO: 9105195 - DNA, 22 bp, Homo sapiens
ttctccaaggatacagtcctgt

SEQ ID NO: 9105196 - DNA, 22 bp, Homo sapiens
ttctcaggtagtgctgatgctg

SEQ ID NO: 9105197 - DNA, 22 bp, Homo sapiens
ttctcaggtcaccagggtgcca

SEQ ID NO: 9105198 - DNA, 22 bp, Homo sapiens
ttctctgcattgtaaagagcca

SEQ ID NO: 9105199 - DNA, 22 bp, Homo sapiens
ttctctgctacatactagggct

SEQ ID NO: 9105200 - DNA, 22 bp, Homo sapiens
ttctctgctctcacatacagaa

SEQ ID NO: 9105201 - DNA, 22 bp, Homo sapiens
ttctctggaactgaaacaagat

SEQ ID NO: 9105202 - DNA, 22 bp, Homo sapiens
ttctctggaactgaaacaagat

SEQ ID NO: 9105203 - DNA, 22 bp, Homo sapiens
ttctctggaaggctctacggga

SEQ ID NO: 9105204 - DNA, 22 bp, Homo sapiens
ttctctgcagcttaggcccagt

SEQ ID NO: 9105205 - DNA, 22 bp, Homo sapiens
ttctctcattcaaattaaagtg

SEQ ID NO: 9105206 - DNA, 22 bp, Homo sapiens
ttctctcctcctagaggctttt

SEQ ID NO: 9105207 - DNA, 22 bp, Homo sapiens
ttctctcctacccagtatccat

SEQ ID NO: 9105208 - DNA, 22 bp, Homo sapiens
ttctctaggttttagatgaaga

SEQ ID NO: 9105209 - DNA, 22 bp, Homo sapiens
ttctctaggttttagatgaaga

SEQ ID NO: 9105210 - DNA, 22 bp, Homo sapiens
ttctctcagttaaactttgtga

SEQ ID NO: 9105211 - DNA, 22 bp, Homo sapiens
ttctctaatggtgatgattaga

SEQ ID NO: 9105212 - DNA, 22 bp, Homo sapiens
ttctctaatggtgatgattaga

SEQ ID NO: 9105213 - DNA, 22 bp, Homo sapiens
ttctctaatggtgatgattaga

SEQ ID NO: 9105214 - DNA, 22 bp, Homo sapiens
ttctctacttcacaagggatgg

SEQ ID NO: 9105215 - DNA, 22 bp, Homo sapiens
ttctctaagagttatatgaatt

SEQ ID NO: 9105216 - DNA, 22 bp, Homo sapiens
ttctctaagccttagtttcttc

SEQ ID NO: 9105217 - DNA, 22 bp, Homo sapiens
ttctctaagccttagtttcttc

SEQ ID NO: 9105218 - DNA, 22 bp, Homo sapiens
ttctctaatacattttgacaaa

SEQ ID NO: 9105219 - DNA, 22 bp, Homo sapiens
ttctctaatacattttgacaaa

SEQ ID NO: 9105220 - DNA, 22 bp, Homo sapiens
ttctctaaggtcccgttctgga

SEQ ID NO: 9105221 - DNA, 22 bp, Homo sapiens
ttctctaagctggctgaggtct

SEQ ID NO: 9105222 - DNA, 22 bp, Homo sapiens
ttctctaaggcttggcttccct

SEQ ID NO: 9105223 - DNA, 22 bp, Homo sapiens
ttagctgctgattaaatatgtt

SEQ ID NO: 9105224 - DNA, 22 bp, Homo sapiens
ttagccttagaagcttagcaaa

SEQ ID NO: 9105225 - DNA, 22 bp, Homo sapiens
ttagctaaactgtaactagaat

SEQ ID NO: 9105226 - DNA, 21 bp, Homo sapiens
tcctgctgctcctgtcgtgtt

SEQ ID NO: 9105227 - DNA, 22 bp, Homo sapiens
tcctgctggactctgagtacaa

SEQ ID NO: 9105228 - DNA, 22 bp, Homo sapiens
ttagccaaacaggtgaaattga

SEQ ID NO: 9105229 - DNA, 18 bp, Homo sapiens
tcctgcctgcgggctccc

SEQ ID NO: 9105230 - DNA, 18 bp, Homo sapiens
tcctgcctgcgggctccc

SEQ ID NO: 9105231 - DNA, 19 bp, Homo sapiens
tcctgcctggggccgcctg

SEQ ID NO: 9105232 - DNA, 19 bp, Homo sapiens
tcctgcctggggccgcctg

SEQ ID NO: 9105233 - DNA, 18 bp, Homo sapiens
tcctgcctgtgccccagg

SEQ ID NO: 9105234 - DNA, 18 bp, Homo sapiens
tcctgcctgtgccccagg

SEQ ID NO: 9105235 - DNA, 22 bp, Homo sapiens
tcctgcctgtttacctgtactt

SEQ ID NO: 9105236 - DNA, 22 bp, Homo sapiens
tcctgcctgtttacctgtactt

SEQ ID NO: 9105237 - DNA, 22 bp, Homo sapiens
tcctgctgagcatgttctgccc

SEQ ID NO: 9105238 - DNA, 22 bp, Homo sapiens
tcctgctgagcgtctgtcattt

SEQ ID NO: 9105239 - DNA, 22 bp, Homo sapiens
tcctgctgccatttcaagtgct

SEQ ID NO: 9105240 - DNA, 23 bp, Homo sapiens
tcctgctgaaagctccagctggc

SEQ ID NO: 9105241 - DNA, 22 bp, Homo sapiens
ttatagcaggtgactaatgagt

SEQ ID NO: 9105242 - DNA, 22 bp, Homo sapiens
ttatagtatgtgcatatgtgtg

SEQ ID NO: 9105243 - DNA, 22 bp, Homo sapiens
ttatagtgggcccaacatggcg

SEQ ID NO: 9105244 - DNA, 22 bp, Homo sapiens
ttatagcaggtgactaatgagt

SEQ ID NO: 9105245 - DNA, 22 bp, Homo sapiens
ttatatactgtggtagtactgt

SEQ ID NO: 9105246 - DNA, 22 bp, Homo sapiens
ttatagttatgaaagactgagg

SEQ ID NO: 9105247 - DNA, 22 bp, Homo sapiens
ttatagaaaatgtgggaaatga

SEQ ID NO: 9105248 - DNA, 22 bp, Homo sapiens
ttatagaaggagcattcactta

SEQ ID NO: 9105249 - DNA, 22 bp, Homo sapiens
ttatagcagcatgatttacaat

SEQ ID NO: 9105250 - DNA, 22 bp, Homo sapiens
ttatagcagcatgatttacaat

SEQ ID NO: 9105251 - DNA, 22 bp, Homo sapiens
ttaggaaagggttttctaacag

SEQ ID NO: 9105252 - DNA, 22 bp, Homo sapiens
ttaggaaagtctcttggctggg

SEQ ID NO: 9105253 - DNA, 22 bp, Homo sapiens
ttaggaaagttcttcagacatg

SEQ ID NO: 9105254 - DNA, 22 bp, Homo sapiens
ttaggaaaggaacattgaaacg

SEQ ID NO: 9105255 - DNA, 22 bp, Homo sapiens
ttaggaaagggttttctaacag

SEQ ID NO: 9105256 - DNA, 22 bp, Homo sapiens
ttaggaaagaagcagctaggag

SEQ ID NO: 9105257 - DNA, 22 bp, Homo sapiens
ttaggaaacgctgctattgact

SEQ ID NO: 9105258 - DNA, 22 bp, Homo sapiens
ttaggaaaggaacattgaaacg

SEQ ID NO: 9105259 - DNA, 22 bp, Homo sapiens
ttaggaaagcattgtgtaaaag

SEQ ID NO: 9105260 - DNA, 22 bp, Homo sapiens
ttatacagtttatacttagaat

SEQ ID NO: 9105261 - DNA, 22 bp, Homo sapiens
ttaggaaatcactttgctcacc

SEQ ID NO: 9105262 - DNA, 22 bp, Homo sapiens
ttatacagtttatacttagaat

SEQ ID NO: 9105263 - DNA, 22 bp, Homo sapiens
ttatacagtttatacttagaat

SEQ ID NO: 9105264 - DNA, 22 bp, Homo sapiens
ttaggaaagttcttcagacatg

SEQ ID NO: 9105265 - DNA, 21 bp, Homo sapiens
ttatacatatgttctctgcct

SEQ ID NO: 9105266 - DNA, 21 bp, Homo sapiens
ttatacatatgttctctgcct

SEQ ID NO: 9105267 - DNA, 22 bp, Homo sapiens
ttatacatgtgttttgagatga

SEQ ID NO: 9105268 - DNA, 22 bp, Homo sapiens
ttatacgctcaatcctatcatc

SEQ ID NO: 9105269 - DNA, 22 bp, Homo sapiens
ttataccctccatacctggcct

SEQ ID NO: 9105270 - DNA, 22 bp, Homo sapiens
ttatacctgaagcaggtgatgt

SEQ ID NO: 9105271 - DNA, 19 bp, Homo sapiens
ttaggaaaccactttcctt

SEQ ID NO: 9105272 - DNA, 19 bp, Homo sapiens
ttaggaaaccactttcctt

SEQ ID NO: 9105273 - DNA, 22 bp, Homo sapiens
ttaggaaacatcatttttgctg

SEQ ID NO: 9105274 - DNA, 22 bp, Homo sapiens
ttaggaaacaaatacacccagt

SEQ ID NO: 9105275 - DNA, 22 bp, Homo sapiens
ttaggaaacagtagcctttgct

SEQ ID NO: 9105276 - DNA, 22 bp, Homo sapiens
ttaggaaaatggagtcctttta

SEQ ID NO: 9105277 - DNA, 22 bp, Homo sapiens
ttaggaaacagtagcctttgct

SEQ ID NO: 9105278 - DNA, 22 bp, Homo sapiens
ttaggaaacagtagcctttgct

SEQ ID NO: 9105279 - DNA, 22 bp, Homo sapiens
ttaggaaacatcatttttgctg

SEQ ID NO: 9105280 - DNA, 22 bp, Homo sapiens
ttaggaaaagaagacatttcta

SEQ ID NO: 9105281 - DNA, 22 bp, Homo sapiens
ttaggaaaagaagacatttcta

SEQ ID NO: 9105282 - DNA, 22 bp, Homo sapiens
ttaggaaaatcatgagagatga

SEQ ID NO: 9105283 - DNA, 22 bp, Homo sapiens
ttaggaaaagaagacatttcta

SEQ ID NO: 9105284 - DNA, 22 bp, Homo sapiens
ttaggaaaatcatgagagatga

SEQ ID NO: 9105285 - DNA, 22 bp, Homo sapiens
ttaggaaaatgaaattacctgt

SEQ ID NO: 9105286 - DNA, 22 bp, Homo sapiens
ttaggaaaatggagtcctttta

SEQ ID NO: 9105287 - DNA, 22 bp, Homo sapiens
ttaggaaaatgaaattacctgt

SEQ ID NO: 9105288 - DNA, 22 bp, Homo sapiens
ttagcttttaagtgtgctacat

SEQ ID NO: 9105289 - DNA, 22 bp, Homo sapiens
ttattatggcagttttctaggt

SEQ ID NO: 9105290 - DNA, 22 bp, Homo sapiens
ttattatggtatttctttgcag

SEQ ID NO: 9105291 - DNA, 22 bp, Homo sapiens
ttattatagattatgcaagatt

SEQ ID NO: 9105292 - DNA, 22 bp, Homo sapiens
ttattatagattatgcaagatt

SEQ ID NO: 9105293 - DNA, 22 bp, Homo sapiens
ttattctttaaacatatatgtt

SEQ ID NO: 9105294 - DNA, 22 bp, Homo sapiens
ttattatgtggatgaaagatgt

SEQ ID NO: 9105295 - DNA, 22 bp, Homo sapiens
ttattatgccattacctccctg

SEQ ID NO: 9105296 - DNA, 22 bp, Homo sapiens
ttattatgtgctagagaatgta

SEQ ID NO: 9105297 - DNA, 22 bp, Homo sapiens
ttattacactgaaagaattgcg

SEQ ID NO: 9105298 - DNA, 22 bp, Homo sapiens
ttattagagatatttggttagg

SEQ ID NO: 9105299 - DNA, 22 bp, Homo sapiens
ttattagtgttgatattaggat

SEQ ID NO: 9105300 - DNA, 22 bp, Homo sapiens
ttattagtgttgatattaggat

SEQ ID NO: 9105301 - DNA, 22 bp, Homo sapiens
ttattaataaagtggcatagcc

SEQ ID NO: 9105302 - DNA, 22 bp, Homo sapiens
ttattaatgagtacaagttatt

SEQ ID NO: 9105303 - DNA, 22 bp, Homo sapiens
ttattaatgagtacaagttatt

SEQ ID NO: 9105304 - DNA, 22 bp, Homo sapiens
ttattacaatgcagaaaataga

SEQ ID NO: 9105305 - DNA, 22 bp, Homo sapiens
ttatatatatgtagaggtcacg

SEQ ID NO: 9105306 - DNA, 22 bp, Homo sapiens
ttatatatcttgatttgttcca

SEQ ID NO: 9105307 - DNA, 22 bp, Homo sapiens
ttatatatcttgatttgttcca

SEQ ID NO: 9105308 - DNA, 22 bp, Homo sapiens
ttatatccaaaggcaaggagga

SEQ ID NO: 9105309 - DNA, 22 bp, Homo sapiens
ttatatctttttacatctctcc

SEQ ID NO: 9105310 - DNA, 22 bp, Homo sapiens
ttattgaaatggaagctataac

SEQ ID NO: 9105311 - DNA, 22 bp, Homo sapiens
ttattgaaggaactgaaataaa

SEQ ID NO: 9105312 - DNA, 22 bp, Homo sapiens
ttattgtagcactttggcagtg

SEQ ID NO: 9105313 - DNA, 22 bp, Homo sapiens
ttattgtaggcctattgtagaa

SEQ ID NO: 9105314 - DNA, 22 bp, Homo sapiens
ttattgtaggcctattgtagaa

SEQ ID NO: 9105315 - DNA, 22 bp, Homo sapiens
ttcaaacacagacagcagcatg

SEQ ID NO: 9105316 - DNA, 22 bp, Homo sapiens
ttattgttaggcttttggaatt

SEQ ID NO: 9105317 - DNA, 22 bp, Homo sapiens
ttattgtgtgcgttagcctatg

SEQ ID NO: 9105318 - DNA, 22 bp, Homo sapiens
ttattgtgaggaataagtgaga

SEQ ID NO: 9105319 - DNA, 22 bp, Homo sapiens
ttcaaactatgacttcagctac

SEQ ID NO: 9105320 - DNA, 22 bp, Homo sapiens
ttcaaactcacactagggagac

SEQ ID NO: 9105321 - DNA, 22 bp, Homo sapiens
ttcaaactcttgctctgctagt

SEQ ID NO: 9105322 - DNA, 22 bp, Homo sapiens
ttcaaactctgagtagttctgc

SEQ ID NO: 9105323 - DNA, 22 bp, Homo sapiens
ttcaaactctgagtagttctgc

SEQ ID NO: 9105324 - DNA, 22 bp, Homo sapiens
ttcaaactcttgctctgctagt

SEQ ID NO: 9105325 - DNA, 22 bp, Homo sapiens
ttcaaactgaggagaggatggc

SEQ ID NO: 9105326 - DNA, 22 bp, Homo sapiens
ttcaaactcttgctctgctagt

SEQ ID NO: 9105327 - DNA, 22 bp, Homo sapiens
ttcaaaccttcacttgcagagt

SEQ ID NO: 9105328 - DNA, 22 bp, Homo sapiens
ttcaaacctatctaagaaatag

SEQ ID NO: 9105329 - DNA, 22 bp, Homo sapiens
ttcaaactagttaaaagtcaga

SEQ ID NO: 9105330 - DNA, 22 bp, Homo sapiens
ttcaaactagttaaaagtcaga

SEQ ID NO: 9105331 - DNA, 21 bp, Homo sapiens
ttcataaaccattctcatgca

SEQ ID NO: 9105332 - DNA, 22 bp, Homo sapiens
ttcagtgttaaattcaaagagt

SEQ ID NO: 9105333 - DNA, 22 bp, Homo sapiens
ttcagtgttaatcttgggagaa

SEQ ID NO: 9105334 - DNA, 22 bp, Homo sapiens
ttcagtgttcttttctgttagc

SEQ ID NO: 9105335 - DNA, 22 bp, Homo sapiens
ttcagtgtttgtagagataact

SEQ ID NO: 9105336 - DNA, 22 bp, Homo sapiens
ttcagtgtgcttcaggacgtta

SEQ ID NO: 9105337 - DNA, 22 bp, Homo sapiens
ttcagtgtggcccatgaagagg

SEQ ID NO: 9105338 - DNA, 22 bp, Homo sapiens
ttcagtgtgtgatacctgctgt

SEQ ID NO: 9105339 - DNA, 22 bp, Homo sapiens
ttcagtgtggtgcacagttttg

SEQ ID NO: 9105340 - DNA, 22 bp, Homo sapiens
ttcattgtactttaagagatgc

SEQ ID NO: 9105341 - DNA, 22 bp, Homo sapiens
ttcatttaatcagaatctctaa

SEQ ID NO: 9105342 - DNA, 22 bp, Homo sapiens
ttcatacaatgggatattatga

SEQ ID NO: 9105343 - DNA, 22 bp, Homo sapiens
ttcatacaatgggatattatga

SEQ ID NO: 9105344 - DNA, 22 bp, Homo sapiens
ttcatacaatgggatattatga

SEQ ID NO: 9105345 - DNA, 22 bp, Homo sapiens
ttccagtaatgtgactttgagc

SEQ ID NO: 9105346 - DNA, 22 bp, Homo sapiens
ttccagtctagtacctggatgc

SEQ ID NO: 9105347 - DNA, 22 bp, Homo sapiens
ttccagtctggcctgtgcttag

SEQ ID NO: 9105348 - DNA, 22 bp, Homo sapiens
ttccagggctaattcctgtgga

SEQ ID NO: 9105349 - DNA, 19 bp, Homo sapiens
ttccaggtgctgtggggag

SEQ ID NO: 9105350 - DNA, 22 bp, Homo sapiens
ttccaggaagctctcggcctct

SEQ ID NO: 9105351 - DNA, 22 bp, Homo sapiens
ttccaggaagcagttagcagcc

SEQ ID NO: 9105352 - DNA, 22 bp, Homo sapiens
ttccaggaagacatctcaggaa

SEQ ID NO: 9105353 - DNA, 22 bp, Homo sapiens
ttccaggaacactctgtgtccc

SEQ ID NO: 9105354 - DNA, 22 bp, Homo sapiens
ttcagagacagcaaccaggaca

SEQ ID NO: 9105355 - DNA, 22 bp, Homo sapiens
ttcagagagtccagtatgcagt

SEQ ID NO: 9105356 - DNA, 22 bp, Homo sapiens
ttcagagagaaaccagtgggaa

SEQ ID NO: 9105357 - DNA, 22 bp, Homo sapiens
ttcagagatggaaggcagaatg

SEQ ID NO: 9105358 - DNA, 22 bp, Homo sapiens
ttcagagccacttcaagtctaa

SEQ ID NO: 9105359 - DNA, 22 bp, Homo sapiens
ttcagagcatctctaaagccag

SEQ ID NO: 9105360 - DNA, 22 bp, Homo sapiens
ttcagagatgacacctggtgtt

SEQ ID NO: 9105361 - DNA, 22 bp, Homo sapiens
ttcagagatgacacctggtgtt

SEQ ID NO: 9105362 - DNA, 22 bp, Homo sapiens
ttcagagagtttgtgagtcctt

SEQ ID NO: 9105363 - DNA, 22 bp, Homo sapiens
ttcagagagtttgtgagtcctt

SEQ ID NO: 9105364 - DNA, 22 bp, Homo sapiens
ttcacaggcttggaggtggggg

SEQ ID NO: 9105365 - DNA, 23 bp, Homo sapiens
ttcagactgccttcagcattgtc

SEQ ID NO: 9105366 - DNA, 22 bp, Homo sapiens
ttcagagaagcaaaggcagatt

SEQ ID NO: 9105367 - DNA, 22 bp, Homo sapiens
ttcagagaagcaaaggcagatt

SEQ ID NO: 9105368 - DNA, 22 bp, Homo sapiens
ttcagagaacttcatggaagag

SEQ ID NO: 9105369 - DNA, 22 bp, Homo sapiens
ttcagagaacttcatggaagag

SEQ ID NO: 9105370 - DNA, 22 bp, Homo sapiens
ttcagcaaggcatgtgcaggag

SEQ ID NO: 9105371 - DNA, 22 bp, Homo sapiens
ttcagcaaggcatgtgcaggag

SEQ ID NO: 9105372 - DNA, 22 bp, Homo sapiens
ttcagcaagtgtctctactgtc

SEQ ID NO: 9105373 - DNA, 21 bp, Homo sapiens
ttcagcaagcactctggacac

SEQ ID NO: 9105374 - DNA, 22 bp, Homo sapiens
ttcagcaagaccaccatgtacc

SEQ ID NO: 9105375 - DNA, 22 bp, Homo sapiens
ttcagagctcagaaaagtgtct

SEQ ID NO: 9105376 - DNA, 22 bp, Homo sapiens
ttcagagcatctctaaagccag

SEQ ID NO: 9105377 - DNA, 22 bp, Homo sapiens
ttcagagccagcaacactaggc

SEQ ID NO: 9105378 - DNA, 22 bp, Homo sapiens
ttcagcaacatttgttgagtgc

SEQ ID NO: 9105379 - DNA, 22 bp, Homo sapiens
ttcagcaaatggactgttcagg

SEQ ID NO: 9105380 - DNA, 22 bp, Homo sapiens
ttcagcaaatggcttgagataa

SEQ ID NO: 9105381 - DNA, 22 bp, Homo sapiens
ttcagagcttagaatggactac

SEQ ID NO: 9105382 - DNA, 22 bp, Homo sapiens
ttcagcactttgttttgctcat

SEQ ID NO: 9105383 - DNA, 22 bp, Homo sapiens
ttcagcactttgttttgctcat

SEQ ID NO: 9105384 - DNA, 22 bp, Homo sapiens
ttcagcactggacagcgagtct

SEQ ID NO: 9105385 - DNA, 22 bp, Homo sapiens
ttcagcactgttatggatttgc

SEQ ID NO: 9105386 - DNA, 22 bp, Homo sapiens
ttcagcactggacagcgagtct

SEQ ID NO: 9105387 - DNA, 22 bp, Homo sapiens
ttcagcacctggaatagcacct

SEQ ID NO: 9105388 - DNA, 22 bp, Homo sapiens
ttcagcacctggaatagcacct

SEQ ID NO: 9105389 - DNA, 22 bp, Homo sapiens
ttcagcaccctctgaggcatcc

SEQ ID NO: 9105390 - DNA, 22 bp, Homo sapiens
ttcagcaatgggatggtgcagg

SEQ ID NO: 9105391 - DNA, 22 bp, Homo sapiens
ttcagcacagttcaagatggta

SEQ ID NO: 9105392 - DNA, 22 bp, Homo sapiens
ttcagtgtgaagcttctgaaag

SEQ ID NO: 9105393 - DNA, 22 bp, Homo sapiens
ttcagtgtgcctaagtcagttg

SEQ ID NO: 9105394 - DNA, 22 bp, Homo sapiens
ttcagtgtccctagtagaagtt

SEQ ID NO: 9105395 - DNA, 18 bp, Homo sapiens
ttcagcagcagacacact

SEQ ID NO: 9105396 - DNA, 18 bp, Homo sapiens
ttcagcagcagacacact

SEQ ID NO: 9105397 - DNA, 22 bp, Homo sapiens
ttcagtgtcacaagagcaagcc

SEQ ID NO: 9105398 - DNA, 22 bp, Homo sapiens
ttcacagagcactgccaagtac

SEQ ID NO: 9105399 - DNA, 20 bp, Homo sapiens
ttcacagaggactcaggtca

SEQ ID NO: 9105400 - DNA, 21 bp, Homo sapiens
ttcacagatgggaaaactgag

SEQ ID NO: 9105401 - DNA, 22 bp, Homo sapiens
ttcacagatgagaaaattgagg

SEQ ID NO: 9105402 - DNA, 22 bp, Homo sapiens
ttcacagatgtattggaactcc

SEQ ID NO: 9105403 - DNA, 22 bp, Homo sapiens
ttcacagatgtattggaactcc

SEQ ID NO: 9105404 - DNA, 21 bp, Homo sapiens
ttcaaagacttgatgctgacc

SEQ ID NO: 9105405 - DNA, 20 bp, Homo sapiens
ttcaaagaccctcaggtcca

SEQ ID NO: 9105406 - DNA, 22 bp, Homo sapiens
ttcaaacttaaggagcagcaga

SEQ ID NO: 9105407 - DNA, 22 bp, Homo sapiens
ttcaaacttaaggagcagcaga

SEQ ID NO: 9105408 - DNA, 22 bp, Homo sapiens
ttcaaactgtgtaatttataaa

SEQ ID NO: 9105409 - DNA, 22 bp, Homo sapiens
ttcaaactgtgtaatttataaa

SEQ ID NO: 9105410 - DNA, 22 bp, Homo sapiens
ttcacagactttccatagattg

SEQ ID NO: 9105411 - DNA, 22 bp, Homo sapiens
ttcaaagcagagggtcaataca

SEQ ID NO: 9105412 - DNA, 22 bp, Homo sapiens
ttcaaagcaagacacaattcct

SEQ ID NO: 9105413 - DNA, 22 bp, Homo sapiens
ttcaaagattttcccaaagctc

SEQ ID NO: 9105414 - DNA, 23 bp, Homo sapiens
ttcaaagatcttctgaaatctgt

SEQ ID NO: 9105415 - DNA, 22 bp, Homo sapiens
ttgtcatgatccttctgttagg

SEQ ID NO: 9105416 - DNA, 22 bp, Homo sapiens
ttgtcaggcctatgagagatct

SEQ ID NO: 9105417 - DNA, 22 bp, Homo sapiens
ttgtcattggggttatttgtta

SEQ ID NO: 9105418 - DNA, 22 bp, Homo sapiens
ttgtccaagtggatgttctcag

SEQ ID NO: 9105419 - DNA, 22 bp, Homo sapiens
ttgtcagccagctcgcactctt

SEQ ID NO: 9105420 - DNA, 22 bp, Homo sapiens
ttgtcacctatactgagcttaa

SEQ ID NO: 9105421 - DNA, 22 bp, Homo sapiens
ttgtcaccatatttcattttga

SEQ ID NO: 9105422 - DNA, 22 bp, Homo sapiens
ttgtcacccctagaggaattct

SEQ ID NO: 9105423 - DNA, 22 bp, Homo sapiens
ttgtcaaatccttgtcatctgc

SEQ ID NO: 9105424 - DNA, 22 bp, Homo sapiens
ttgtccatctgtatttcccatg

SEQ ID NO: 9105425 - DNA, 22 bp, Homo sapiens
ttgtccagagccaggctgtcgg

SEQ ID NO: 9105426 - DNA, 23 bp, Homo sapiens
ttgtcctgccgatctctgagaat

SEQ ID NO: 9105427 - DNA, 22 bp, Homo sapiens
ttgtgtcctgatttgacacaat

SEQ ID NO: 9105428 - DNA, 22 bp, Homo sapiens
ttgtgtccccctttgagagcca

SEQ ID NO: 9105429 - DNA, 22 bp, Homo sapiens
ttgtcctgtttagggataagga

SEQ ID NO: 9105430 - DNA, 22 bp, Homo sapiens
ttgtaacaggtactaaataact

SEQ ID NO: 9105431 - DNA, 22 bp, Homo sapiens
ttgtaacaggtactaaataact

SEQ ID NO: 9105432 - DNA, 22 bp, Homo sapiens
ttgtaacatcaccatcaaaatc

SEQ ID NO: 9105433 - DNA, 22 bp, Homo sapiens
ttgtaacacttttctattaata

SEQ ID NO: 9105434 - DNA, 22 bp, Homo sapiens
ttgtaacagctgcttaatagag

SEQ ID NO: 9105435 - DNA, 22 bp, Homo sapiens
ttgtaacagctgtttatatagt

SEQ ID NO: 9105436 - DNA, 22 bp, Homo sapiens
ttgtaacagctgtttatatagt

SEQ ID NO: 9105437 - DNA, 22 bp, Homo sapiens
ttgtaacaggcactctgtgcca

SEQ ID NO: 9105438 - DNA, 22 bp, Homo sapiens
ttgtaacaaagacactccaaaa

SEQ ID NO: 9105439 - DNA, 22 bp, Homo sapiens
ttgtaacactcccactcttctt

SEQ ID NO: 9105440 - DNA, 22 bp, Homo sapiens
ttgtaacaatctgtcataaatg

SEQ ID NO: 9105441 - DNA, 23 bp, Homo sapiens
ttgtaaaacagtgtgacggttcc

SEQ ID NO: 9105442 - DNA, 22 bp, Homo sapiens
ttgtaaactggatagacctatt

SEQ ID NO: 9105443 - DNA, 22 bp, Homo sapiens
ttgtaaagctgattagaaagcc

SEQ ID NO: 9105444 - DNA, 22 bp, Homo sapiens
ttgtaaagctttgagactacat

SEQ ID NO: 9105445 - DNA, 22 bp, Homo sapiens
ttgtaaagttcttaggaagctc

SEQ ID NO: 9105446 - DNA, 22 bp, Homo sapiens
ttgtaaatagtagtaagatgcc

SEQ ID NO: 9105447 - DNA, 22 bp, Homo sapiens
ttgtaaatgaccttttctaatt

SEQ ID NO: 9105448 - DNA, 22 bp, Homo sapiens
ttgtaaatgaccttttctaatt

SEQ ID NO: 9105449 - DNA, 22 bp, Homo sapiens
ttgtaagagagaattgcaaatt

SEQ ID NO: 9105450 - DNA, 22 bp, Homo sapiens
ttgtaagtcacaccagggcagg

SEQ ID NO: 9105451 - DNA, 22 bp, Homo sapiens
ttgtacaagttttgagcttaag

SEQ ID NO: 9105452 - DNA, 22 bp, Homo sapiens
ttgtacaagttttgagcttaag

SEQ ID NO: 9105453 - DNA, 22 bp, Homo sapiens
ttgtacaagtattatgtgaaca

SEQ ID NO: 9105454 - DNA, 22 bp, Homo sapiens
ttgtacaagtattatgtgaaca

SEQ ID NO: 9105455 - DNA, 22 bp, Homo sapiens
ttgtacaagtattatgtgaaca

SEQ ID NO: 9105456 - DNA, 22 bp, Homo sapiens
ttgtacagaaaaaattcttggt

SEQ ID NO: 9105457 - DNA, 22 bp, Homo sapiens
ttgtacagaaaaaattcttggt

SEQ ID NO: 9105458 - DNA, 22 bp, Homo sapiens
ttgtacagaaaaaattcttggt

SEQ ID NO: 9105459 - DNA, 22 bp, Homo sapiens
ttgtacacacaggaacaaacgt

SEQ ID NO: 9105460 - DNA, 22 bp, Homo sapiens
ttgtacaatggatgccagatga

SEQ ID NO: 9105461 - DNA, 22 bp, Homo sapiens
ttgtacacaattcttaacatac

SEQ ID NO: 9105462 - DNA, 23 bp, Homo sapiens
ttgtatttttagtagagacaggg

SEQ ID NO: 9105463 - DNA, 23 bp, Homo sapiens
ttgtatttttagtagagacaggg

SEQ ID NO: 9105464 - DNA, 22 bp, Homo sapiens
ttgtatttcgatgcacgtgtag

SEQ ID NO: 9105465 - DNA, 22 bp, Homo sapiens
ttgtacagggaagtaatacaag

SEQ ID NO: 9105466 - DNA, 18 bp, Homo sapiens
ttggacctgtgtcagggc

SEQ ID NO: 9105467 - DNA, 22 bp, Homo sapiens
ttggaccaattcctgatatttt

SEQ ID NO: 9105468 - DNA, 22 bp, Homo sapiens
ttggagaatgttttcctgcagt

SEQ ID NO: 9105469 - DNA, 22 bp, Homo sapiens
ttggagagattatcagaccagc

SEQ ID NO: 9105470 - DNA, 22 bp, Homo sapiens
ttggagagattatcagaccagc

SEQ ID NO: 9105471 - DNA, 22 bp, Homo sapiens
ttggagagaggctgctcaggct

SEQ ID NO: 9105472 - DNA, 22 bp, Homo sapiens
ttggagagaggctgctcaggct

SEQ ID NO: 9105473 - DNA, 22 bp, Homo sapiens
ttggagagttaattgacagtta

SEQ ID NO: 9105474 - DNA, 22 bp, Homo sapiens
ttggagagatttaggtctcagt

SEQ ID NO: 9105475 - DNA, 22 bp, Homo sapiens
ttggagagtgatattcagatgc

SEQ ID NO: 9105476 - DNA, 22 bp, Homo sapiens
ttggaggactagttaagagacc

SEQ ID NO: 9105477 - DNA, 22 bp, Homo sapiens
ttggcagcattccagccaagca

SEQ ID NO: 9105478 - DNA, 22 bp, Homo sapiens
ttggcagggcatcagacacgtg

SEQ ID NO: 9105479 - DNA, 22 bp, Homo sapiens
ttgggcagtgattagttcatga

SEQ ID NO: 9105480 - DNA, 22 bp, Homo sapiens
ttgggccactttagtttcctta

SEQ ID NO: 9105481 - DNA, 22 bp, Homo sapiens
ttgggccaaagatgtccttgtt

SEQ ID NO: 9105482 - DNA, 22 bp, Homo sapiens
ttgggccaaatagctatttact

SEQ ID NO: 9105483 - DNA, 22 bp, Homo sapiens
ttgggccaaggcagatctccaa

SEQ ID NO: 9105484 - DNA, 22 bp, Homo sapiens
ttgggaggtaatggagccaagt

SEQ ID NO: 9105485 - DNA, 22 bp, Homo sapiens
ttgggcagggaaaggacaggca

SEQ ID NO: 9105486 - DNA, 22 bp, Homo sapiens
ttgggcaggtgaagagagggct

SEQ ID NO: 9105487 - DNA, 22 bp, Homo sapiens
ttgggcaggtgtggctctcctt

SEQ ID NO: 9105488 - DNA, 22 bp, Homo sapiens
ttgggaaggcgtggaagcagaa

SEQ ID NO: 9105489 - DNA, 22 bp, Homo sapiens
ttgggaagaggcccctggattc

SEQ ID NO: 9105490 - DNA, 22 bp, Homo sapiens
ttgggaaggcgtggaagcagaa

SEQ ID NO: 9105491 - DNA, 22 bp, Homo sapiens
ttgggaagtaatatggtggtct

SEQ ID NO: 9105492 - DNA, 22 bp, Homo sapiens
ttgggacagaaaaggagaagat

SEQ ID NO: 9105493 - DNA, 22 bp, Homo sapiens
ttgggaagtttaatgacagact

SEQ ID NO: 9105494 - DNA, 22 bp, Homo sapiens
ttgggaagtttaatgacagact

SEQ ID NO: 9105495 - DNA, 22 bp, Homo sapiens
ttggccagtgaaccaggcctgg

SEQ ID NO: 9105496 - DNA, 22 bp, Homo sapiens
ttggccaggtgtccagcccagg

SEQ ID NO: 9105497 - DNA, 22 bp, Homo sapiens
ttggccaggtgtaggtcacacc

SEQ ID NO: 9105498 - DNA, 22 bp, Homo sapiens
ttggccagtggaaagaggagga

SEQ ID NO: 9105499 - DNA, 22 bp, Homo sapiens
ttggccagtggaaagaggagga

SEQ ID NO: 9105500 - DNA, 22 bp, Homo sapiens
ttggccagctctggaaagtggt

SEQ ID NO: 9105501 - DNA, 22 bp, Homo sapiens
ttgcagggcaggaccatggaca

SEQ ID NO: 9105502 - DNA, 22 bp, Homo sapiens
ttgcaggggaaggagcagagct

SEQ ID NO: 9105503 - DNA, 22 bp, Homo sapiens
ttgcaggggaaggagcagagct

SEQ ID NO: 9105504 - DNA, 22 bp, Homo sapiens
ttgcagcttcttgcatcagaaa

SEQ ID NO: 9105505 - DNA, 22 bp, Homo sapiens
ttgcagcttcttgcatcagaaa

SEQ ID NO: 9105506 - DNA, 22 bp, Homo sapiens
ttgcagcttctaccactgtttc

SEQ ID NO: 9105507 - DNA, 22 bp, Homo sapiens
ttgcagcttctaccactgtttc

SEQ ID NO: 9105508 - DNA, 22 bp, Homo sapiens
ttgcagcttctaacagcttcag

SEQ ID NO: 9105509 - DNA, 22 bp, Homo sapiens
ttgcagcttctaccactgtttc

SEQ ID NO: 9105510 - DNA, 22 bp, Homo sapiens
ttgcagggacctgcagaaagct

SEQ ID NO: 9105511 - DNA, 22 bp, Homo sapiens
ttgcagctagaagattcactgt

SEQ ID NO: 9105512 - DNA, 22 bp, Homo sapiens
ttgcagctgaggaaattgaagc

SEQ ID NO: 9105513 - DNA, 22 bp, Homo sapiens
ttgcagctccattttaatggct

SEQ ID NO: 9105514 - DNA, 22 bp, Homo sapiens
ttgcagctctctgaaggttgca

SEQ ID NO: 9105515 - DNA, 22 bp, Homo sapiens
ttgcagctgttactgatagata

SEQ ID NO: 9105516 - DNA, 22 bp, Homo sapiens
ttgcagctgtgagctttacacg

SEQ ID NO: 9105517 - DNA, 22 bp, Homo sapiens
ttgcagctgcagtaaatgttca

SEQ ID NO: 9105518 - DNA, 22 bp, Homo sapiens
ttgcagctggtggtggccgtgt

SEQ ID NO: 9105519 - DNA, 22 bp, Homo sapiens
ttgcagctgtgagctttacacg

SEQ ID NO: 9105520 - DNA, 22 bp, Homo sapiens
ttgcagctgctgttcctcatgg

SEQ ID NO: 9105521 - DNA, 22 bp, Homo sapiens
ttgcagctgcagtaaatgttca

SEQ ID NO: 9105522 - DNA, 22 bp, Homo sapiens
ttgcagctgaggaaattgaagc

SEQ ID NO: 9105523 - DNA, 22 bp, Homo sapiens
ttgcagctctgatccagggacc

SEQ ID NO: 9105524 - DNA, 22 bp, Homo sapiens
ttgcagctgcagtaaatgttca

SEQ ID NO: 9105525 - DNA, 22 bp, Homo sapiens
ttgcagcttagtgatgttatct

SEQ ID NO: 9105526 - DNA, 22 bp, Homo sapiens
ttgcagctgttgcaaagtctct

SEQ ID NO: 9105527 - DNA, 22 bp, Homo sapiens
ttgcagctgttgcaaagtctct

SEQ ID NO: 9105528 - DNA, 22 bp, Homo sapiens
ttgcagcttagtgatgttatct

SEQ ID NO: 9105529 - DNA, 22 bp, Homo sapiens
ttgcagcttcaagcaggttgac

SEQ ID NO: 9105530 - DNA, 22 bp, Homo sapiens
ttgcagcttagtgatgttatct

SEQ ID NO: 9105531 - DNA, 22 bp, Homo sapiens
ttgcagcttcgagtctatctgt

SEQ ID NO: 9105532 - DNA, 22 bp, Homo sapiens
ttgcagcttcaagcaggttgac

SEQ ID NO: 9105533 - DNA, 22 bp, Homo sapiens
ttgcagcttcgagtctatctgt

SEQ ID NO: 9105534 - DNA, 22 bp, Homo sapiens
ttgcagagatcagcaggtttga

SEQ ID NO: 9105535 - DNA, 22 bp, Homo sapiens
ttgcagagatcagcaggtttga

SEQ ID NO: 9105536 - DNA, 22 bp, Homo sapiens
ttgcagagccatgaggctggct

SEQ ID NO: 9105537 - DNA, 22 bp, Homo sapiens
ttgcagatatttccgatgctat

SEQ ID NO: 9105538 - DNA, 21 bp, Homo sapiens
ttgcacagaaaaccatagaga

SEQ ID NO: 9105539 - DNA, 22 bp, Homo sapiens
ttgcagaacttaaagacagagt

SEQ ID NO: 9105540 - DNA, 22 bp, Homo sapiens
ttgcagaacttaaagacagagt

SEQ ID NO: 9105541 - DNA, 22 bp, Homo sapiens
ttgcagaagggcacagtgatca

SEQ ID NO: 9105542 - DNA, 22 bp, Homo sapiens
ttgcagaagggcacagtgatca

SEQ ID NO: 9105543 - DNA, 22 bp, Homo sapiens
ttgcagaattaagcagagagcc

SEQ ID NO: 9105544 - DNA, 22 bp, Homo sapiens
ttgcagaatctcaggaaggaga

SEQ ID NO: 9105545 - DNA, 22 bp, Homo sapiens
ttgcaattgctatggagagcgt

SEQ ID NO: 9105546 - DNA, 22 bp, Homo sapiens
ttgcaattgctatggagagcgt

SEQ ID NO: 9105547 - DNA, 22 bp, Homo sapiens
ttgcaattgctatggagagcgt

SEQ ID NO: 9105548 - DNA, 22 bp, Homo sapiens
ttgcaattgctatggagagcgt

SEQ ID NO: 9105549 - DNA, 22 bp, Homo sapiens
ttgacaaagatatattcatgct

SEQ ID NO: 9105550 - DNA, 22 bp, Homo sapiens
ttgacaaagatatattcatgct

SEQ ID NO: 9105551 - DNA, 22 bp, Homo sapiens
ttgacaaaggaccttgctattt

SEQ ID NO: 9105552 - DNA, 22 bp, Homo sapiens
ttgacaaaacaacacagatttc

SEQ ID NO: 9105553 - DNA, 22 bp, Homo sapiens
ttgacaaaacaacacagatttc

SEQ ID NO: 9105554 - DNA, 22 bp, Homo sapiens
ttgacaaatacccattagacca

SEQ ID NO: 9105555 - DNA, 22 bp, Homo sapiens
ttgacaaagtttagtaataatc

SEQ ID NO: 9105556 - DNA, 22 bp, Homo sapiens
ttgacaaagtttagtaataatc

SEQ ID NO: 9105557 - DNA, 22 bp, Homo sapiens
ttgacacaatgtatattttcaa

SEQ ID NO: 9105558 - DNA, 22 bp, Homo sapiens
ttgacaatgtcctttgaatttc

SEQ ID NO: 9105559 - DNA, 22 bp, Homo sapiens
ttgcatttcactttcagtaggc

SEQ ID NO: 9105560 - DNA, 22 bp, Homo sapiens
ttgcattgaaaatatattttaa

SEQ ID NO: 9105561 - DNA, 22 bp, Homo sapiens
ttgcattgaatgcacattttta

SEQ ID NO: 9105562 - DNA, 22 bp, Homo sapiens
ttgcattgtaggatgttagaag

SEQ ID NO: 9105563 - DNA, 22 bp, Homo sapiens
ttgcattgttgcaatgaagtat

SEQ ID NO: 9105564 - DNA, 22 bp, Homo sapiens
ttgctgagagcgtgtcaacaag

SEQ ID NO: 9105565 - DNA, 23 bp, Homo sapiens
ttgcttagagacctcctcatcag

SEQ ID NO: 9105566 - DNA, 21 bp, Homo sapiens
ttgctgttttcccaatgcagt

SEQ ID NO: 9105567 - DNA, 22 bp, Homo sapiens
ttgctgaaagtggcaagaagta

SEQ ID NO: 9105568 - DNA, 22 bp, Homo sapiens
ttgctgaagttgctcagctcca

SEQ ID NO: 9105569 - DNA, 22 bp, Homo sapiens
ttgctgaagtatgaaaaagaca

SEQ ID NO: 9105570 - DNA, 22 bp, Homo sapiens
ttggaaaatgaggcacagagag

SEQ ID NO: 9105571 - DNA, 22 bp, Homo sapiens
ttggaaaatgaggcacagagag

SEQ ID NO: 9105572 - DNA, 22 bp, Homo sapiens
ttgctttccgtcatgtgctaat

SEQ ID NO: 9105573 - DNA, 23 bp, Homo sapiens
ttgctttcatcatgagatgctcc

SEQ ID NO: 9105574 - DNA, 22 bp, Homo sapiens
ttggaaaatgtatttctagaag

SEQ ID NO: 9105575 - DNA, 22 bp, Homo sapiens
ttggaaaatgtatttctagaag

SEQ ID NO: 9105576 - DNA, 22 bp, Homo sapiens
ttgcttcactacttctaggctc

SEQ ID NO: 9105577 - DNA, 22 bp, Homo sapiens
ttgcttcaccccaccttgttgc

SEQ ID NO: 9105578 - DNA, 22 bp, Homo sapiens
ttgcttcagagaggaggaggtg

SEQ ID NO: 9105579 - DNA, 22 bp, Homo sapiens
ttgcttcagagacagggctcac

SEQ ID NO: 9105580 - DNA, 22 bp, Homo sapiens
ttgcttcactgagttatgcctg

SEQ ID NO: 9105581 - DNA, 23 bp, Homo sapiens
ttgctttcatcatgagatgctcc

SEQ ID NO: 9105582 - DNA, 22 bp, Homo sapiens
ttgctttattgggtttactgcc

SEQ ID NO: 9105583 - DNA, 22 bp, Homo sapiens
ttggaaagggaggaatgtagac

SEQ ID NO: 9105584 - DNA, 22 bp, Homo sapiens
ttggaaaggagattctattgtg

SEQ ID NO: 9105585 - DNA, 22 bp, Homo sapiens
ttggaaaggagattctattgtg

SEQ ID NO: 9105586 - DNA, 22 bp, Homo sapiens
ttggaaagcccattatttggac

SEQ ID NO: 9105587 - DNA, 22 bp, Homo sapiens
ttggaaagaagggctgagcaag

SEQ ID NO: 9105588 - DNA, 22 bp, Homo sapiens
ttggaaagaccgaattcctgtt

SEQ ID NO: 9105589 - DNA, 22 bp, Homo sapiens
ttggaaactttcaagcataatg

SEQ ID NO: 9105590 - DNA, 22 bp, Homo sapiens
ttggaaacttggatggaaaacc

SEQ ID NO: 9105591 - DNA, 21 bp, Homo sapiens
ttggaatttgggagctatgtg

SEQ ID NO: 9105592 - DNA, 22 bp, Homo sapiens
ttggaatttcatgtaagtgact

SEQ ID NO: 9105593 - DNA, 22 bp, Homo sapiens
ttggaattgtgaactaagtgat

SEQ ID NO: 9105594 - DNA, 22 bp, Homo sapiens
ttggaattcctgttgtttcgtc

SEQ ID NO: 9105595 - DNA, 22 bp, Homo sapiens
ttggaattgaggatttacatag

SEQ ID NO: 9105596 - DNA, 22 bp, Homo sapiens
ttggaaatggctgtagttatga

SEQ ID NO: 9105597 - DNA, 22 bp, Homo sapiens
ttggaaatggctgtagttatga

SEQ ID NO: 9105598 - DNA, 22 bp, Homo sapiens
ttggaaatgcaaatatattgaa

SEQ ID NO: 9105599 - DNA, 22 bp, Homo sapiens
ttggaaatgcaaatatattgaa

SEQ ID NO: 9105600 - DNA, 22 bp, Homo sapiens
ttggaaatgatttctattatta

SEQ ID NO: 9105601 - DNA, 22 bp, Homo sapiens
ttggaaatgatttctattatta

SEQ ID NO: 9105602 - DNA, 22 bp, Homo sapiens
ttggaaatacgagtagtatcat

SEQ ID NO: 9105603 - DNA, 22 bp, Homo sapiens
ttggaaatacagcagttacttt

SEQ ID NO: 9105604 - DNA, 22 bp, Homo sapiens
ttggaaagtttttactgaagac

SEQ ID NO: 9105605 - DNA, 20 bp, Homo sapiens
tttcacaatgaacatgtctc

SEQ ID NO: 9105606 - DNA, 20 bp, Homo sapiens
tttcacaatgaacatgtctc

SEQ ID NO: 9105607 - DNA, 23 bp, Homo sapiens
tttcacaatgagcattacagaat

SEQ ID NO: 9105608 - DNA, 22 bp, Homo sapiens
tttcacaattttaaggagcaaa

SEQ ID NO: 9105609 - DNA, 22 bp, Homo sapiens
tttcacacaacgtgaatatact

SEQ ID NO: 9105610 - DNA, 22 bp, Homo sapiens
tttcacactgcagcatcagaga

SEQ ID NO: 9105611 - DNA, 22 bp, Homo sapiens
tttcacactagtcagaatacca

SEQ ID NO: 9105612 - DNA, 22 bp, Homo sapiens
tttcacagaaaggataacatta

SEQ ID NO: 9105613 - DNA, 22 bp, Homo sapiens
tttcacagagaaatataacagg

SEQ ID NO: 9105614 - DNA, 22 bp, Homo sapiens
tttcaacatcacctagcagttc

SEQ ID NO: 9105615 - DNA, 22 bp, Homo sapiens
tttcaacatcacctagcagttc

SEQ ID NO: 9105616 - DNA, 22 bp, Homo sapiens
tttcaacatataccataatgcc

SEQ ID NO: 9105617 - DNA, 22 bp, Homo sapiens
tttcaacaggatgataataggc

SEQ ID NO: 9105618 - DNA, 22 bp, Homo sapiens
tttcaacaggatgataataggc

SEQ ID NO: 9105619 - DNA, 22 bp, Homo sapiens
tttcaacaggatgataataggc

SEQ ID NO: 9105620 - DNA, 22 bp, Homo sapiens
tttcaagaacagcagcattcca

SEQ ID NO: 9105621 - DNA, 22 bp, Homo sapiens
tttcaagaacaacattcattca

SEQ ID NO: 9105622 - DNA, 22 bp, Homo sapiens
tttcaacttgtttgcttccata

SEQ ID NO: 9105623 - DNA, 22 bp, Homo sapiens
tttcaactcatgctaaaggaag

SEQ ID NO: 9105624 - DNA, 22 bp, Homo sapiens
tttcaagactcattgagtattg

SEQ ID NO: 9105625 - DNA, 22 bp, Homo sapiens
tttattctagctcagaatagtt

SEQ ID NO: 9105626 - DNA, 22 bp, Homo sapiens
tttattcaagatgaggttcatg

SEQ ID NO: 9105627 - DNA, 20 bp, Homo sapiens
tttattcacagagaagagtt

SEQ ID NO: 9105628 - DNA, 22 bp, Homo sapiens
tttattctgtgctacatgaaga

SEQ ID NO: 9105629 - DNA, 22 bp, Homo sapiens
tttattcttgagagtgagaaga

SEQ ID NO: 9105630 - DNA, 22 bp, Homo sapiens
tttattcttgagagtgagaaga

SEQ ID NO: 9105631 - DNA, 22 bp, Homo sapiens
tttcaacagaatatgatcagag

SEQ ID NO: 9105632 - DNA, 22 bp, Homo sapiens
tttcaacagaatatgatcagag

SEQ ID NO: 9105633 - DNA, 23 bp, Homo sapiens
tttcaaattactctgcagatgac

SEQ ID NO: 9105634 - DNA, 22 bp, Homo sapiens
tttcacctcagtctttttatat

SEQ ID NO: 9105635 - DNA, 22 bp, Homo sapiens
tttcaccatcttggccaggctg

SEQ ID NO: 9105636 - DNA, 20 bp, Homo sapiens
tttcaccatcttggccaggc

SEQ ID NO: 9105637 - DNA, 22 bp, Homo sapiens
tttcacagcgtctttctcttgc

SEQ ID NO: 9105638 - DNA, 22 bp, Homo sapiens
tttcacagctgggaagagatat

SEQ ID NO: 9105639 - DNA, 22 bp, Homo sapiens
tttcacagatgttttggagtct

SEQ ID NO: 9105640 - DNA, 22 bp, Homo sapiens
tttcagaaatggcactgaaatc

SEQ ID NO: 9105641 - DNA, 22 bp, Homo sapiens
tttcagaaatcaaaaccagggt

SEQ ID NO: 9105642 - DNA, 22 bp, Homo sapiens
tttcagaaagcatcatcaaagt

SEQ ID NO: 9105643 - DNA, 22 bp, Homo sapiens
tttcagagaaagcccaaagact

SEQ ID NO: 9105644 - DNA, 22 bp, Homo sapiens
tttcagagaactgagtccttgc

SEQ ID NO: 9105645 - DNA, 19 bp, Homo sapiens
tttcagactcatctccagc

SEQ ID NO: 9105646 - DNA, 22 bp, Homo sapiens
tttcagagatgtctagcctatt

SEQ ID NO: 9105647 - DNA, 22 bp, Homo sapiens
tttcagagcctgcaatcccaat

SEQ ID NO: 9105648 - DNA, 22 bp, Homo sapiens
tttcagagcctttatctctcta

SEQ ID NO: 9105649 - DNA, 22 bp, Homo sapiens
tttcagagatgcagaattcagg

SEQ ID NO: 9105650 - DNA, 22 bp, Homo sapiens
tttcagagatgcagaattcagg

SEQ ID NO: 9105651 - DNA, 22 bp, Homo sapiens
tttcagagaactgagtccttgc

SEQ ID NO: 9105652 - DNA, 22 bp, Homo sapiens
tttcagagaattagaagctgat

SEQ ID NO: 9105653 - DNA, 22 bp, Homo sapiens
tttcagagaattagaagctgat

SEQ ID NO: 9105654 - DNA, 22 bp, Homo sapiens
tttcagagaggcttcaaatctt

SEQ ID NO: 9105655 - DNA, 22 bp, Homo sapiens
tttcagagaggcttcaaatctt

SEQ ID NO: 9105656 - DNA, 22 bp, Homo sapiens
tttcagagagatcaacatagct

SEQ ID NO: 9105657 - DNA, 22 bp, Homo sapiens
tttcattcattatacagtagag

SEQ ID NO: 9105658 - DNA, 22 bp, Homo sapiens
tttcattgagactatagacatc

SEQ ID NO: 9105659 - DNA, 22 bp, Homo sapiens
tttcccagcctcctttgcagct

SEQ ID NO: 9105660 - DNA, 19 bp, Homo sapiens
tttcccagtcccaggagtg

SEQ ID NO: 9105661 - DNA, 22 bp, Homo sapiens
tttcatgtcattccatttcaga

SEQ ID NO: 9105662 - DNA, 22 bp, Homo sapiens
tttcatggctaggactagagtg

SEQ ID NO: 9105663 - DNA, 22 bp, Homo sapiens
tttcagagctctaggctctcag

SEQ ID NO: 9105664 - DNA, 22 bp, Homo sapiens
tttcagagctcagcagctagag

SEQ ID NO: 9105665 - DNA, 22 bp, Homo sapiens
tttcagagcctttatctctcta

SEQ ID NO: 9105666 - DNA, 22 bp, Homo sapiens
tttcagagctctaggctctcag

SEQ ID NO: 9105667 - DNA, 22 bp, Homo sapiens
tttcagagctgagatgccacag

SEQ ID NO: 9105668 - DNA, 22 bp, Homo sapiens
tttacagcttctatactatgtg

SEQ ID NO: 9105669 - DNA, 19 bp, Homo sapiens
tttacagggaatggagacc

SEQ ID NO: 9105670 - DNA, 22 bp, Homo sapiens
tttacagtaaggtggatggtac

SEQ ID NO: 9105671 - DNA, 22 bp, Homo sapiens
tttacagtaaggtggatggtac

SEQ ID NO: 9105672 - DNA, 22 bp, Homo sapiens
tttacaggaagctgaaaaacat

SEQ ID NO: 9105673 - DNA, 22 bp, Homo sapiens
tttacagtcaccaaactttgct

SEQ ID NO: 9105674 - DNA, 22 bp, Homo sapiens
tttacagtctatgttgaattaa

SEQ ID NO: 9105675 - DNA, 22 bp, Homo sapiens
tttacagtctatgttgaattaa

SEQ ID NO: 9105676 - DNA, 22 bp, Homo sapiens
tttacagtctgtctagcaatgt

SEQ ID NO: 9105677 - DNA, 22 bp, Homo sapiens
tttaagtaataaagtagcagct

SEQ ID NO: 9105678 - DNA, 22 bp, Homo sapiens
tttaatgaataattcaaatctg

SEQ ID NO: 9105679 - DNA, 22 bp, Homo sapiens
tttaaggcttcactggagtggg

SEQ ID NO: 9105680 - DNA, 21 bp, Homo sapiens
tttaaggccagcaggaggtga

SEQ ID NO: 9105681 - DNA, 22 bp, Homo sapiens
tttaaactaacagtacacgttg

SEQ ID NO: 9105682 - DNA, 22 bp, Homo sapiens
tttaaagaaattcctcatcttt

SEQ ID NO: 9105683 - DNA, 17 bp, Homo sapiens
ttgtgtgtagttctgat

SEQ ID NO: 9105684 - DNA, 22 bp, Homo sapiens
ttgtgtgtagactcagccattg

SEQ ID NO: 9105685 - DNA, 22 bp, Homo sapiens
ttgtgtgtagactcagccattg

SEQ ID NO: 9105686 - DNA, 17 bp, Homo sapiens
ttgtgtgtagttctgat

SEQ ID NO: 9105687 - DNA, 22 bp, Homo sapiens
tttaaacatcttgttgccttaa

SEQ ID NO: 9105688 - DNA, 22 bp, Homo sapiens
tttaaacatcttgttgccttaa

SEQ ID NO: 9105689 - DNA, 22 bp, Homo sapiens
ttgtgtgtactggttatgggca

SEQ ID NO: 9105690 - DNA, 22 bp, Homo sapiens
ttgtgtgtactggttatgggca

SEQ ID NO: 9105691 - DNA, 22 bp, Homo sapiens
ttgtgtgtagactcagccattg

SEQ ID NO: 9105692 - DNA, 22 bp, Homo sapiens
tttaaataggactcctgggggt

SEQ ID NO: 9105693 - DNA, 22 bp, Homo sapiens
tttaaataggactcctgggggt

SEQ ID NO: 9105694 - DNA, 22 bp, Homo sapiens
tttaagatggtattttataaag

SEQ ID NO: 9105695 - DNA, 22 bp, Homo sapiens
tttaaatggcattttcccagat

SEQ ID NO: 9105696 - DNA, 22 bp, Homo sapiens
tttaccaagctttaattacata

SEQ ID NO: 9105697 - DNA, 22 bp, Homo sapiens
tttaccaaatgagactattgtt

SEQ ID NO: 9105698 - DNA, 22 bp, Homo sapiens
tttacagtgagagcttagtgag

SEQ ID NO: 9105699 - DNA, 22 bp, Homo sapiens
tttacagtgagagcttagtgag

SEQ ID NO: 9105700 - DNA, 22 bp, Homo sapiens
tttacagtgagagcttagtgag

SEQ ID NO: 9105701 - DNA, 20 bp, Homo sapiens
tttacattttgaaacagtga

SEQ ID NO: 9105702 - DNA, 20 bp, Homo sapiens
tttacattttgaaacagtga

SEQ ID NO: 9105703 - DNA, 22 bp, Homo sapiens
tttagagaccctctgctatttt

SEQ ID NO: 9105704 - DNA, 22 bp, Homo sapiens
tttagcaaaaaagctctgcgta

SEQ ID NO: 9105705 - DNA, 22 bp, Homo sapiens
tttagagttgagtattcattgg

SEQ ID NO: 9105706 - DNA, 22 bp, Homo sapiens
tttagcaacgaagcactcgaca

SEQ ID NO: 9105707 - DNA, 20 bp, Homo sapiens
tttagcaaaagggactgctc

SEQ ID NO: 9105708 - DNA, 22 bp, Homo sapiens
tttatatagagatttgtgcatg

SEQ ID NO: 9105709 - DNA, 22 bp, Homo sapiens
tttatatatggctggtctggat

SEQ ID NO: 9105710 - DNA, 22 bp, Homo sapiens
tttatattgggagtcgttttga

SEQ ID NO: 9105711 - DNA, 22 bp, Homo sapiens
tttatattgtaaaaatggttct

SEQ ID NO: 9105712 - DNA, 22 bp, Homo sapiens
tttatatttcccaggattggcc

SEQ ID NO: 9105713 - DNA, 22 bp, Homo sapiens
tttatatagagatttgtgcatg

SEQ ID NO: 9105714 - DNA, 22 bp, Homo sapiens
tttagcagagcatatgatatcc

SEQ ID NO: 9105715 - DNA, 22 bp, Homo sapiens
tttagcagagttatatggaagt

SEQ ID NO: 9105716 - DNA, 22 bp, Homo sapiens
tttagcaattagaatccagcat

SEQ ID NO: 9105717 - DNA, 22 bp, Homo sapiens
tttagcaattattaagggttga

SEQ ID NO: 9105718 - DNA, 22 bp, Homo sapiens
tttagcaagtatttactgacta

SEQ ID NO: 9105719 - DNA, 22 bp, Homo sapiens
tttagcaagttctctgagagaa

SEQ ID NO: 9105720 - DNA, 22 bp, Homo sapiens
tttagcaagtatttactgacta

SEQ ID NO: 9105721 - DNA, 22 bp, Homo sapiens
tttatcaaacaaattatccagc

SEQ ID NO: 9105722 - DNA, 22 bp, Homo sapiens
tttatcaaacaaattatccagc

SEQ ID NO: 9105723 - DNA, 20 bp, Homo sapiens
tttatcaggcacttactatt

SEQ ID NO: 9105724 - DNA, 22 bp, Homo sapiens
tttatcagtagcaaagttttaa

SEQ ID NO: 9105725 - DNA, 22 bp, Homo sapiens
tttatcagtagcaaagttttaa

SEQ ID NO: 9105726 - DNA, 22 bp, Homo sapiens
tttatcagaggctatgtttcat

SEQ ID NO: 9105727 - DNA, 22 bp, Homo sapiens
tttatcatcttgtttttaaagc

SEQ ID NO: 9105728 - DNA, 22 bp, Homo sapiens
tttatcatcttgtttttaaagc

SEQ ID NO: 9105729 - DNA, 21 bp, Homo sapiens
tttatcatcacgagcttgagc

SEQ ID NO: 9105730 - DNA, 22 bp, Homo sapiens
tttatccactcatccatgcctc

SEQ ID NO: 9105731 - DNA, 22 bp, Homo sapiens
tttatccaccttaccctgttcc

SEQ ID NO: 9105732 - DNA, 22 bp, Homo sapiens
tttatccaccagggactaggac

SEQ ID NO: 9105733 - DNA, 22 bp, Homo sapiens
tttatccacagtatccaaaatc

SEQ ID NO: 9105734 - DNA, 22 bp, Homo sapiens
tttatccagaatcaggattttt

SEQ ID NO: 9105735 - DNA, 22 bp, Homo sapiens
tttatccaagggttttaactgt

SEQ ID NO: 9105736 - DNA, 22 bp, Homo sapiens
tttatccaagcacaatttctaa

SEQ ID NO: 9105737 - DNA, 23 bp, Homo sapiens
tttatccaactctgtaatctctc

SEQ ID NO: 9105738 - DNA, 22 bp, Homo sapiens
tttatccatcatctgctgaagg

SEQ ID NO: 9105739 - DNA, 22 bp, Homo sapiens
tttatccatatcattaaaatct

SEQ ID NO: 9105740 - DNA, 22 bp, Homo sapiens
tttatccagtgttggaattttt

SEQ ID NO: 9105741 - DNA, 22 bp, Homo sapiens
tttatccagcagctattcaaaa

SEQ ID NO: 9105742 - DNA, 22 bp, Homo sapiens
tttatctcttttgaccaagatt

SEQ ID NO: 9105743 - DNA, 22 bp, Homo sapiens
tttatccattggttagaaaatc

SEQ ID NO: 9105744 - DNA, 22 bp, Homo sapiens
tttatccattcaccagttgaac

SEQ ID NO: 9105745 - DNA, 22 bp, Homo sapiens
tttatccatgctcccgttgatg

SEQ ID NO: 9105746 - DNA, 17 bp, Homo sapiens
acagcaggcccggaggg

SEQ ID NO: 9105747 - DNA, 19 bp, Homo sapiens
acagcagggatttttggag

SEQ ID NO: 9105748 - DNA, 22 bp, Homo sapiens
acagcagggaatatgggaattg

SEQ ID NO: 9105749 - DNA, 17 bp, Homo sapiens
acagcagggaagtgttg

SEQ ID NO: 9105750 - DNA, 22 bp, Homo sapiens
acagcaggttattgttatggca

SEQ ID NO: 9105751 - DNA, 22 bp, Homo sapiens
acagcaggttattgttatggca

SEQ ID NO: 9105752 - DNA, 21 bp, Homo sapiens
acagcagggctggcatgacag

SEQ ID NO: 9105753 - DNA, 22 bp, Homo sapiens
acagcaggttttaactttgaag

SEQ ID NO: 9105754 - DNA, 22 bp, Homo sapiens
acagcagtcagtgaatatttaa

SEQ ID NO: 9105755 - DNA, 22 bp, Homo sapiens
acagcagtcttaacacattgca

SEQ ID NO: 9105756 - DNA, 22 bp, Homo sapiens
acagcagtggattagaggatgg

SEQ ID NO: 9105757 - DNA, 22 bp, Homo sapiens
acagcagtgcacagagaaccct

SEQ ID NO: 9105758 - DNA, 22 bp, Homo sapiens
acagcagtgcacagagaaccct

SEQ ID NO: 9105759 - DNA, 22 bp, Homo sapiens
acagcagcgtgaagtgtgttat

SEQ ID NO: 9105760 - DNA, 22 bp, Homo sapiens
agctgagcacattcaaacaggt

SEQ ID NO: 9105761 - DNA, 22 bp, Homo sapiens
agctgagcacattcaaacaggt

SEQ ID NO: 9105762 - DNA, 22 bp, Homo sapiens
agctgagcacattcaaacaggt

SEQ ID NO: 9105763 - DNA, 22 bp, Homo sapiens
acagcagccttgttggtttcga

SEQ ID NO: 9105764 - DNA, 22 bp, Homo sapiens
acagcagcgtcaacttaaaatt

SEQ ID NO: 9105765 - DNA, 22 bp, Homo sapiens
acagcagcgtgaagtgtgttat

SEQ ID NO: 9105766 - DNA, 22 bp, Homo sapiens
acagcagcgtcaacttaaaatt

SEQ ID NO: 9105767 - DNA, 21 bp, Homo sapiens
agctgaggtaaggcaagagag

SEQ ID NO: 9105768 - DNA, 21 bp, Homo sapiens
agctgaggtaaggcaagagag

SEQ ID NO: 9105769 - DNA, 21 bp, Homo sapiens
agctgaggtaaggcaagagag

SEQ ID NO: 9105770 - DNA, 22 bp, Homo sapiens
agctgaggttagtataaatgtg

SEQ ID NO: 9105771 - DNA, 22 bp, Homo sapiens
agctgagttaattcatcactta

SEQ ID NO: 9105772 - DNA, 22 bp, Homo sapiens
agctgagttaattcatcactta

SEQ ID NO: 9105773 - DNA, 22 bp, Homo sapiens
agctgaggttgaagagtgaacg

SEQ ID NO: 9105774 - DNA, 20 bp, Homo sapiens
acagataccagggacatggg

SEQ ID NO: 9105775 - DNA, 22 bp, Homo sapiens
acagatacagggacttggtatt

SEQ ID NO: 9105776 - DNA, 22 bp, Homo sapiens
acagatactataatgtaaagtg

SEQ ID NO: 9105777 - DNA, 22 bp, Homo sapiens
acagatacaaatatacaaatac

SEQ ID NO: 9105778 - DNA, 22 bp, Homo sapiens
acagatataaactatagtagtg

SEQ ID NO: 9105779 - DNA, 22 bp, Homo sapiens
acagatatatgattgtgtaaat

SEQ ID NO: 9105780 - DNA, 22 bp, Homo sapiens
acagcagagtgtgagatagcca

SEQ ID NO: 9105781 - DNA, 22 bp, Homo sapiens
acagcagcactattgacatttt

SEQ ID NO: 9105782 - DNA, 21 bp, Homo sapiens
acagcagcaatctgtctttcc

SEQ ID NO: 9105783 - DNA, 21 bp, Homo sapiens
acagcagcaatctgtctttcc

SEQ ID NO: 9105784 - DNA, 22 bp, Homo sapiens
acagcagcaatagcagtgacat

SEQ ID NO: 9105785 - DNA, 22 bp, Homo sapiens
acagcagcaatagcagtgacat

SEQ ID NO: 9105786 - DNA, 22 bp, Homo sapiens
acagcagcaatagcagtgacat

SEQ ID NO: 9105787 - DNA, 22 bp, Homo sapiens
acagcagatctggctacaggtt

SEQ ID NO: 9105788 - DNA, 22 bp, Homo sapiens
acagcagatttccctgggctcc

SEQ ID NO: 9105789 - DNA, 22 bp, Homo sapiens
acagcagccagccactgtgagc

SEQ ID NO: 9105790 - DNA, 22 bp, Homo sapiens
acagcagccagccactgtgagc

SEQ ID NO: 9105791 - DNA, 22 bp, Homo sapiens
acagcagccagccactgtgagc

SEQ ID NO: 9105792 - DNA, 22 bp, Homo sapiens
acagcagcctgcagccctgtgt

SEQ ID NO: 9105793 - DNA, 22 bp, Homo sapiens
acagcagcctgcagccctgtgt

SEQ ID NO: 9105794 - DNA, 22 bp, Homo sapiens
acagcagccttgttggtttcga

SEQ ID NO: 9105795 - DNA, 20 bp, Homo sapiens
acagcagccttgctagaaac

SEQ ID NO: 9105796 - DNA, 22 bp, Homo sapiens
acagcagcactattgacatttt

SEQ ID NO: 9105797 - DNA, 22 bp, Homo sapiens
acagcagcactattgacatttt

SEQ ID NO: 9105798 - DNA, 22 bp, Homo sapiens
acagcagcataaactgactaag

SEQ ID NO: 9105799 - DNA, 22 bp, Homo sapiens
acagcagcataaactgactaag

SEQ ID NO: 9105800 - DNA, 22 bp, Homo sapiens
acagcagcataaactgactaag

SEQ ID NO: 9105801 - DNA, 22 bp, Homo sapiens
acagcagcataaactgactaag

SEQ ID NO: 9105802 - DNA, 22 bp, Homo sapiens
acagcagcataaactgactaag

SEQ ID NO: 9105803 - DNA, 22 bp, Homo sapiens
agcgtgaattagttggtacaca

SEQ ID NO: 9105804 - DNA, 21 bp, Homo sapiens
agcgtcaatatcgtcaacagg

SEQ ID NO: 9105805 - DNA, 22 bp, Homo sapiens
agcgtgaattagttggtacaca

SEQ ID NO: 9105806 - DNA, 22 bp, Homo sapiens
agctaaatgttgcttaaaattt

SEQ ID NO: 9105807 - DNA, 22 bp, Homo sapiens
agctaacacattccagctattt

SEQ ID NO: 9105808 - DNA, 22 bp, Homo sapiens
agctaaatcctacttttgtatt

SEQ ID NO: 9105809 - DNA, 22 bp, Homo sapiens
agcgggtctgcaagccttccct

SEQ ID NO: 9105810 - DNA, 22 bp, Homo sapiens
acagaggtcatggagagttctc

SEQ ID NO: 9105811 - DNA, 22 bp, Homo sapiens
acagaggtcatggagagttctc

SEQ ID NO: 9105812 - DNA, 22 bp, Homo sapiens
agccttagatttgggcaagaac

SEQ ID NO: 9105813 - DNA, 22 bp, Homo sapiens
agccttagggattgaggttgct

SEQ ID NO: 9105814 - DNA, 22 bp, Homo sapiens
acagaggtaggacatgagatat

SEQ ID NO: 9105815 - DNA, 22 bp, Homo sapiens
acagagggtttctaaggatttg

SEQ ID NO: 9105816 - DNA, 22 bp, Homo sapiens
acagaggtaggacatgagatat

SEQ ID NO: 9105817 - DNA, 22 bp, Homo sapiens
acagaggtcacctttgtatctt

SEQ ID NO: 9105818 - DNA, 22 bp, Homo sapiens
acagaggtaggacatgagatat

SEQ ID NO: 9105819 - DNA, 19 bp, Homo sapiens
acagagggcaactgagaaa

SEQ ID NO: 9105820 - DNA, 22 bp, Homo sapiens
acagaggccccgtgggagagcc

SEQ ID NO: 9105821 - DNA, 22 bp, Homo sapiens
acagaggcctcgtaggtacaac

SEQ ID NO: 9105822 - DNA, 22 bp, Homo sapiens
acagaggcctcggcctgcccag

SEQ ID NO: 9105823 - DNA, 23 bp, Homo sapiens
acagaggcttaaatgagtggcag

SEQ ID NO: 9105824 - DNA, 23 bp, Homo sapiens
acagaggcttaaatgagtggcag

SEQ ID NO: 9105825 - DNA, 23 bp, Homo sapiens
acagaggcttaaatgagtggcag

SEQ ID NO: 9105826 - DNA, 22 bp, Homo sapiens
acagaggcctcgtaggtacaac

SEQ ID NO: 9105827 - DNA, 22 bp, Homo sapiens
acagaggctgatcttcaagccc

SEQ ID NO: 9105828 - DNA, 22 bp, Homo sapiens
acagaggctgcgcttgggaacg

SEQ ID NO: 9105829 - DNA, 22 bp, Homo sapiens
acagagctgtacatgtgccatg

SEQ ID NO: 9105830 - DNA, 22 bp, Homo sapiens
acagaatgggatttgaatattt

SEQ ID NO: 9105831 - DNA, 22 bp, Homo sapiens
acagaattaacatttgatgaat

SEQ ID NO: 9105832 - DNA, 22 bp, Homo sapiens
acagaattaacatttgatgaat

SEQ ID NO: 9105833 - DNA, 17 bp, Homo sapiens
acagaggcaggagtgga

SEQ ID NO: 9105834 - DNA, 17 bp, Homo sapiens
acagaggcaggagtgga

SEQ ID NO: 9105835 - DNA, 22 bp, Homo sapiens
acagaggccatgagctgccacc

SEQ ID NO: 9105836 - DNA, 22 bp, Homo sapiens
acagaatagtagcttaaagtca

SEQ ID NO: 9105837 - DNA, 22 bp, Homo sapiens
acagaatgcgtagtgcatgttg

SEQ ID NO: 9105838 - DNA, 22 bp, Homo sapiens
acagaatgcagagatgcccaga

SEQ ID NO: 9105839 - DNA, 22 bp, Homo sapiens
acagaatattggttactgttgc

SEQ ID NO: 9105840 - DNA, 22 bp, Homo sapiens
acagaagctcaagagagcagtg

SEQ ID NO: 9105841 - DNA, 22 bp, Homo sapiens
acagaagtccccatgaagaagc

SEQ ID NO: 9105842 - DNA, 22 bp, Homo sapiens
acagaacttccagggaacatac

SEQ ID NO: 9105843 - DNA, 19 bp, Homo sapiens
acagaagcatagaaaagga

SEQ ID NO: 9105844 - DNA, 22 bp, Homo sapiens
acagaataactcttgcttgagt

SEQ ID NO: 9105845 - DNA, 22 bp, Homo sapiens
acagaagtttcaagtaagaagt

SEQ ID NO: 9105846 - DNA, 22 bp, Homo sapiens
acagaatactacagactggtta

SEQ ID NO: 9105847 - DNA, 22 bp, Homo sapiens
acagaatactcataagaagggg

SEQ ID NO: 9105848 - DNA, 22 bp, Homo sapiens
acagaataaggtttatctctcc

SEQ ID NO: 9105849 - DNA, 22 bp, Homo sapiens
acagaagtgtgtgtgtaggaat

SEQ ID NO: 9105850 - DNA, 22 bp, Homo sapiens
acagaagttggaattagatact

SEQ ID NO: 9105851 - DNA, 21 bp, Homo sapiens
acagaagtggcttggtctcag

SEQ ID NO: 9105852 - DNA, 22 bp, Homo sapiens
acagaagtggcttcaaagagca

SEQ ID NO: 9105853 - DNA, 22 bp, Homo sapiens
acagaagtggcttcaaagagca

SEQ ID NO: 9105854 - DNA, 22 bp, Homo sapiens
agccagctgttctggggcagca

SEQ ID NO: 9105855 - DNA, 22 bp, Homo sapiens
agccagctgtgggctcaggcgg

SEQ ID NO: 9105856 - DNA, 22 bp, Homo sapiens
agccagctgcctttcacatctg

SEQ ID NO: 9105857 - DNA, 19 bp, Homo sapiens
agccagagtggcccagggg

SEQ ID NO: 9105858 - DNA, 22 bp, Homo sapiens
agccagctggagaccactgttt

SEQ ID NO: 9105859 - DNA, 22 bp, Homo sapiens
agccagctggtgggtcagctgg

SEQ ID NO: 9105860 - DNA, 22 bp, Homo sapiens
agccagctggagaccactgttt

SEQ ID NO: 9105861 - DNA, 22 bp, Homo sapiens
agccagctgcctttcacatctg

SEQ ID NO: 9105862 - DNA, 22 bp, Homo sapiens
agccagaggtcatgagcacagg

SEQ ID NO: 9105863 - DNA, 22 bp, Homo sapiens
agccagaggtcatgagcacagg

SEQ ID NO: 9105864 - DNA, 22 bp, Homo sapiens
agccagagggaatctttgggga

SEQ ID NO: 9105865 - DNA, 22 bp, Homo sapiens
acacttcaaagggtgacttgat

SEQ ID NO: 9105866 - DNA, 22 bp, Homo sapiens
acactgttttagggaagaaaat

SEQ ID NO: 9105867 - DNA, 22 bp, Homo sapiens
acactgttccacactaagaagg

SEQ ID NO: 9105868 - DNA, 22 bp, Homo sapiens
agccagaggaacttgatgactg

SEQ ID NO: 9105869 - DNA, 22 bp, Homo sapiens
agccagagattgagatgcaggc

SEQ ID NO: 9105870 - DNA, 22 bp, Homo sapiens
acacttcaaatggttggaaaat

SEQ ID NO: 9105871 - DNA, 22 bp, Homo sapiens
agcaggtgagcacagccaggct

SEQ ID NO: 9105872 - DNA, 22 bp, Homo sapiens
acacccagagcgccagtgccga

SEQ ID NO: 9105873 - DNA, 22 bp, Homo sapiens
acacccagagcgccagtgccga

SEQ ID NO: 9105874 - DNA, 22 bp, Homo sapiens
acaccatggttcccaaactgtg

SEQ ID NO: 9105875 - DNA, 22 bp, Homo sapiens
acaccagggcctagccagggcg

SEQ ID NO: 9105876 - DNA, 22 bp, Homo sapiens
acaccatactcatgttggttcc

SEQ ID NO: 9105877 - DNA, 22 bp, Homo sapiens
acacccagcttttgaatgccct

SEQ ID NO: 9105878 - DNA, 22 bp, Homo sapiens
agccaaggagtgcaggtggctt

SEQ ID NO: 9105879 - DNA, 22 bp, Homo sapiens
agccaaggcagctagagctctg

SEQ ID NO: 9105880 - DNA, 22 bp, Homo sapiens
agccaaggtatcatgagaggca

SEQ ID NO: 9105881 - DNA, 22 bp, Homo sapiens
agccaaggtatcatgagaggca

SEQ ID NO: 9105882 - DNA, 22 bp, Homo sapiens
agccaatgagacttttggagtg

SEQ ID NO: 9105883 - DNA, 22 bp, Homo sapiens
agccaatgagacttttggagtg

SEQ ID NO: 9105884 - DNA, 22 bp, Homo sapiens
agccaagtgtctccgtttactc

SEQ ID NO: 9105885 - DNA, 22 bp, Homo sapiens
acacaatggcgtgtgccacaga

SEQ ID NO: 9105886 - DNA, 22 bp, Homo sapiens
acacaatgtcatcataatgtca

SEQ ID NO: 9105887 - DNA, 22 bp, Homo sapiens
acacaatgaggaggggcttttc

SEQ ID NO: 9105888 - DNA, 22 bp, Homo sapiens
acacaatgattcacaagcagca

SEQ ID NO: 9105889 - DNA, 22 bp, Homo sapiens
acacaatggcgtgtgccacaga

SEQ ID NO: 9105890 - DNA, 19 bp, Homo sapiens
acacaatgacacatatata

SEQ ID NO: 9105891 - DNA, 19 bp, Homo sapiens
acacaatgacacatatata

SEQ ID NO: 9105892 - DNA, 22 bp, Homo sapiens
acacacaaatctattagtgaat

SEQ ID NO: 9105893 - DNA, 22 bp, Homo sapiens
acacacaaatctattagtgaat

SEQ ID NO: 9105894 - DNA, 22 bp, Homo sapiens
acacacaattagttttatgctt

SEQ ID NO: 9105895 - DNA, 22 bp, Homo sapiens
acacacaactcattgtgtaata

SEQ ID NO: 9105896 - DNA, 22 bp, Homo sapiens
acacacaactcattgtgtaata

SEQ ID NO: 9105897 - DNA, 22 bp, Homo sapiens
acacaagttctaaagattgcgc

SEQ ID NO: 9105898 - DNA, 22 bp, Homo sapiens
acacaatacagggctcaaaata

SEQ ID NO: 9105899 - DNA, 22 bp, Homo sapiens
acacaatacagggctcaaaata

SEQ ID NO: 9105900 - DNA, 22 bp, Homo sapiens
acacaagattgtgtattgaatt

SEQ ID NO: 9105901 - DNA, 22 bp, Homo sapiens
acacaagaataatgatgaaggt

SEQ ID NO: 9105902 - DNA, 22 bp, Homo sapiens
acacaagaataatgatgaaggt

SEQ ID NO: 9105903 - DNA, 18 bp, Homo sapiens
acacacacacctgtgtat

SEQ ID NO: 9105904 - DNA, 22 bp, Homo sapiens
acacacacaagcaggttgtgga

SEQ ID NO: 9105905 - DNA, 22 bp, Homo sapiens
acacacacaagcaggttgtgga

SEQ ID NO: 9105906 - DNA, 18 bp, Homo sapiens
acacacacacctgtgtat

SEQ ID NO: 9105907 - DNA, 18 bp, Homo sapiens
acacacacacctgtgtat

SEQ ID NO: 9105908 - DNA, 19 bp, Homo sapiens
acacagggctagagttaca

SEQ ID NO: 9105909 - DNA, 19 bp, Homo sapiens
acacagggctagagttaca

SEQ ID NO: 9105910 - DNA, 22 bp, Homo sapiens
acacagtattacaataggtgct

SEQ ID NO: 9105911 - DNA, 22 bp, Homo sapiens
acacagtatgaaaagtctagtt

SEQ ID NO: 9105912 - DNA, 22 bp, Homo sapiens
acacagtgtgtgcagtcggacg

SEQ ID NO: 9105913 - DNA, 19 bp, Homo sapiens
agcaggccacagggccagc

SEQ ID NO: 9105914 - DNA, 22 bp, Homo sapiens
agcaggcttggtccccagcctc

SEQ ID NO: 9105915 - DNA, 22 bp, Homo sapiens
agcaggcttgttatgtctgaga

SEQ ID NO: 9105916 - DNA, 22 bp, Homo sapiens
agcaggcttgttatgtctgaga

SEQ ID NO: 9105917 - DNA, 21 bp, Homo sapiens
agcaggctttggagtggggct

SEQ ID NO: 9105918 - DNA, 21 bp, Homo sapiens
agcaggctttggagtggggct

SEQ ID NO: 9105919 - DNA, 22 bp, Homo sapiens
agcaggctttccacagaaggag

SEQ ID NO: 9105920 - DNA, 22 bp, Homo sapiens
agcaggctttcaagagtcttct

SEQ ID NO: 9105921 - DNA, 22 bp, Homo sapiens
agcaggctttcaagagtcttct

SEQ ID NO: 9105922 - DNA, 22 bp, Homo sapiens
acacagttctttcactgttggt

SEQ ID NO: 9105923 - DNA, 22 bp, Homo sapiens
acacagtttaaacgattagtac

SEQ ID NO: 9105924 - DNA, 22 bp, Homo sapiens
acacagttcaggatcaaatagc

SEQ ID NO: 9105925 - DNA, 22 bp, Homo sapiens
acacagttcttagcaggtgtct

SEQ ID NO: 9105926 - DNA, 22 bp, Homo sapiens
acacatcagaaatatgaatgag

SEQ ID NO: 9105927 - DNA, 22 bp, Homo sapiens
agcagggaagcctccagaacct

SEQ ID NO: 9105928 - DNA, 22 bp, Homo sapiens
agcagggaatagcggaaagaat

SEQ ID NO: 9105929 - DNA, 22 bp, Homo sapiens
agcagggaatagcggaaagaat

SEQ ID NO: 9105930 - DNA, 22 bp, Homo sapiens
agcagggacatggcatctctcc

SEQ ID NO: 9105931 - DNA, 19 bp, Homo sapiens
agcagggacatggaacttt

SEQ ID NO: 9105932 - DNA, 22 bp, Homo sapiens
agcagggactacgtgaaagtga

SEQ ID NO: 9105933 - DNA, 22 bp, Homo sapiens
agcagggactacgtgaaagtga

SEQ ID NO: 9105934 - DNA, 22 bp, Homo sapiens
agcagggactacgtgaaagtga

SEQ ID NO: 9105935 - DNA, 22 bp, Homo sapiens
agcagggactgagccagtggga

SEQ ID NO: 9105936 - DNA, 22 bp, Homo sapiens
aattccacagatgtctatctgt

SEQ ID NO: 9105937 - DNA, 22 bp, Homo sapiens
aattccacagctgcacagaggt

SEQ ID NO: 9105938 - DNA, 22 bp, Homo sapiens
aattccaagagcttcctaagtg

SEQ ID NO: 9105939 - DNA, 22 bp, Homo sapiens
aattccaacagacaaagttaga

SEQ ID NO: 9105940 - DNA, 22 bp, Homo sapiens
aattccagctgattgactttcc

SEQ ID NO: 9105941 - DNA, 22 bp, Homo sapiens
agagctgggtggtggtgactca

SEQ ID NO: 9105942 - DNA, 22 bp, Homo sapiens
agagctgggtggtggtgactca

SEQ ID NO: 9105943 - DNA, 22 bp, Homo sapiens
agagctgggtggtggtgactca

SEQ ID NO: 9105944 - DNA, 22 bp, Homo sapiens
agaggaaggatgcatatccaaa

SEQ ID NO: 9105945 - DNA, 22 bp, Homo sapiens
agaggaaggatgcatatccaaa

SEQ ID NO: 9105946 - DNA, 21 bp, Homo sapiens
agagctggtaggtaggtaggt

SEQ ID NO: 9105947 - DNA, 22 bp, Homo sapiens
agaggaatggagactaaacgct

SEQ ID NO: 9105948 - DNA, 22 bp, Homo sapiens
agaggaatgtatttccctgcaa

SEQ ID NO: 9105949 - DNA, 22 bp, Homo sapiens
agaggaatttctggaaggaggc

SEQ ID NO: 9105950 - DNA, 22 bp, Homo sapiens
agaggaatctgtctagacacaa

SEQ ID NO: 9105951 - DNA, 22 bp, Homo sapiens
agaggaatctgtctagacacaa

SEQ ID NO: 9105952 - DNA, 22 bp, Homo sapiens
agaggaatgtatttccctgcaa

SEQ ID NO: 9105953 - DNA, 22 bp, Homo sapiens
agaggaataaatttctgtagtg

SEQ ID NO: 9105954 - DNA, 21 bp, Homo sapiens
agaggaagtgattggtctggc

SEQ ID NO: 9105955 - DNA, 21 bp, Homo sapiens
agaggaagtgattggtctggc

SEQ ID NO: 9105956 - DNA, 22 bp, Homo sapiens
agaggaagtaatcaggacctgc

SEQ ID NO: 9105957 - DNA, 22 bp, Homo sapiens
agaggaagtaatcaggacctgc

SEQ ID NO: 9105958 - DNA, 22 bp, Homo sapiens
aatttcaattacttttgcacca

SEQ ID NO: 9105959 - DNA, 22 bp, Homo sapiens
aatttccagatcagatgactca

SEQ ID NO: 9105960 - DNA, 22 bp, Homo sapiens
aatttcggttcaaggcccagtt

SEQ ID NO: 9105961 - DNA, 22 bp, Homo sapiens
aatttcctgggataaaaagcca

SEQ ID NO: 9105962 - DNA, 22 bp, Homo sapiens
agaggattcactgcagaagaca

SEQ ID NO: 9105963 - DNA, 22 bp, Homo sapiens
aatttcaattacttttgcacca

SEQ ID NO: 9105964 - DNA, 22 bp, Homo sapiens
agaggatggttgaggaagacct

SEQ ID NO: 9105965 - DNA, 22 bp, Homo sapiens
agaggatgattttaaggacact

SEQ ID NO: 9105966 - DNA, 22 bp, Homo sapiens
agaggatgattttaaggacact

SEQ ID NO: 9105967 - DNA, 22 bp, Homo sapiens
agaggatgattttaaggacact

SEQ ID NO: 9105968 - DNA, 22 bp, Homo sapiens
agaggaatttctggaaggaggc

SEQ ID NO: 9105969 - DNA, 22 bp, Homo sapiens
agagctgcagggtggacccagg

SEQ ID NO: 9105970 - DNA, 22 bp, Homo sapiens
agagctgcaatttcatgtggtg

SEQ ID NO: 9105971 - DNA, 22 bp, Homo sapiens
agagctgcacctatgcagacct

SEQ ID NO: 9105972 - DNA, 22 bp, Homo sapiens
agagctgccctgccagttctaa

SEQ ID NO: 9105973 - DNA, 22 bp, Homo sapiens
agagctgcccacacagcagatt

SEQ ID NO: 9105974 - DNA, 22 bp, Homo sapiens
agagctgagaatgtggcttcct

SEQ ID NO: 9105975 - DNA, 22 bp, Homo sapiens
agagctgatttgattacagtgc

SEQ ID NO: 9105976 - DNA, 22 bp, Homo sapiens
agagctgaggatccagctgagc

SEQ ID NO: 9105977 - DNA, 22 bp, Homo sapiens
aattcatatggatatgctagta

SEQ ID NO: 9105978 - DNA, 22 bp, Homo sapiens
aattcatatggatatgctagta

SEQ ID NO: 9105979 - DNA, 22 bp, Homo sapiens
aattcatagcaacaaagaccca

SEQ ID NO: 9105980 - DNA, 22 bp, Homo sapiens
aattcatactctatattgcttt

SEQ ID NO: 9105981 - DNA, 22 bp, Homo sapiens
aattcatactctatattgcttt

SEQ ID NO: 9105982 - DNA, 22 bp, Homo sapiens
agagctggaaaagttgttttaa

SEQ ID NO: 9105983 - DNA, 22 bp, Homo sapiens
agagctggaagctgctcttaga

SEQ ID NO: 9105984 - DNA, 22 bp, Homo sapiens
agagctggaagctgctcttaga

SEQ ID NO: 9105985 - DNA, 22 bp, Homo sapiens
agagctggaagctgctcttaga

SEQ ID NO: 9105986 - DNA, 22 bp, Homo sapiens
aattacagtcggagcagcactg

SEQ ID NO: 9105987 - DNA, 22 bp, Homo sapiens
aattacagtcggagcagcactg

SEQ ID NO: 9105988 - DNA, 22 bp, Homo sapiens
agagcctggctcccagctaccg

SEQ ID NO: 9105989 - DNA, 22 bp, Homo sapiens
aattacaaatgtagactctcat

SEQ ID NO: 9105990 - DNA, 22 bp, Homo sapiens
aattacaaatgtagactctcat

SEQ ID NO: 9105991 - DNA, 22 bp, Homo sapiens
aattacacagggatcacttttt

SEQ ID NO: 9105992 - DNA, 23 bp, Homo sapiens
aattacaaccaagaactggaagg

SEQ ID NO: 9105993 - DNA, 22 bp, Homo sapiens
aattaattcagtttttaaggga

SEQ ID NO: 9105994 - DNA, 22 bp, Homo sapiens
aattaagagagagttgaagcaa

SEQ ID NO: 9105995 - DNA, 22 bp, Homo sapiens
aattaagaaaatgttttatgat

SEQ ID NO: 9105996 - DNA, 22 bp, Homo sapiens
agagcacagaagttatatgtta

SEQ ID NO: 9105997 - DNA, 22 bp, Homo sapiens
aattaacagagggcttattact

SEQ ID NO: 9105998 - DNA, 22 bp, Homo sapiens
agagcacactgacgtcagtctg

SEQ ID NO: 9105999 - DNA, 22 bp, Homo sapiens
agacatggagaaggagccagtg

SEQ ID NO: 9106000 - DNA, 22 bp, Homo sapiens
agacattatgctgagtgaaaga

SEQ ID NO: 9106001 - DNA, 22 bp, Homo sapiens
agacatgtccacaaagcattca

SEQ ID NO: 9106002 - DNA, 22 bp, Homo sapiens
aatgtataatatttaatgcttt

SEQ ID NO: 9106003 - DNA, 22 bp, Homo sapiens
agacattggctaaaagtagtgt

SEQ ID NO: 9106004 - DNA, 22 bp, Homo sapiens
agacatccttcaagtgatatgt

SEQ ID NO: 9106005 - DNA, 22 bp, Homo sapiens
agacatctcccatgcattttta

SEQ ID NO: 9106006 - DNA, 22 bp, Homo sapiens
agacatcttgcacacatatact

SEQ ID NO: 9106007 - DNA, 22 bp, Homo sapiens
agacatcctggggagggcaatg

SEQ ID NO: 9106008 - DNA, 22 bp, Homo sapiens
aatgctgcaagaggtgaaaaga

SEQ ID NO: 9106009 - DNA, 22 bp, Homo sapiens
aatgctgctctcataattatag

SEQ ID NO: 9106010 - DNA, 19 bp, Homo sapiens
aatgctgcttctttttgca

SEQ ID NO: 9106011 - DNA, 22 bp, Homo sapiens
aatgccttgcctgctacaactt

SEQ ID NO: 9106012 - DNA, 22 bp, Homo sapiens
aatgccttggagagcctagagg

SEQ ID NO: 9106013 - DNA, 22 bp, Homo sapiens
aatgccttggagagcctagagg

SEQ ID NO: 9106014 - DNA, 22 bp, Homo sapiens
aatgctatcggctctaagcatg

SEQ ID NO: 9106015 - DNA, 22 bp, Homo sapiens
aatgctattcattaagcctact

SEQ ID NO: 9106016 - DNA, 22 bp, Homo sapiens
agagaaggcatagaacttgagt

SEQ ID NO: 9106017 - DNA, 22 bp, Homo sapiens
agagaaggcatagaacttgagt

SEQ ID NO: 9106018 - DNA, 22 bp, Homo sapiens
agagaaggcatagaacttgagt

SEQ ID NO: 9106019 - DNA, 19 bp, Homo sapiens
agagaaggatcctatggtt

SEQ ID NO: 9106020 - DNA, 22 bp, Homo sapiens
agagaaatgattcctgggcaga

SEQ ID NO: 9106021 - DNA, 22 bp, Homo sapiens
agagaaatggggtaatctttca

SEQ ID NO: 9106022 - DNA, 21 bp, Homo sapiens
agagaagggactcttccagtc

SEQ ID NO: 9106023 - DNA, 21 bp, Homo sapiens
agagaagggactcttccagtc

SEQ ID NO: 9106024 - DNA, 21 bp, Homo sapiens
agagaagggattccaggccct

SEQ ID NO: 9106025 - DNA, 22 bp, Homo sapiens
agagaaggggtaaagagtcctg

SEQ ID NO: 9106026 - DNA, 22 bp, Homo sapiens
aatgtgtactttttcatgctca

SEQ ID NO: 9106027 - DNA, 22 bp, Homo sapiens
agagaagggcctgtatgtaatc

SEQ ID NO: 9106028 - DNA, 22 bp, Homo sapiens
agagaagggggaaagatctcac

SEQ ID NO: 9106029 - DNA, 21 bp, Homo sapiens
agagaagggattccaggccct

SEQ ID NO: 9106030 - DNA, 22 bp, Homo sapiens
agagaagggggaaagatctcac

SEQ ID NO: 9106031 - DNA, 22 bp, Homo sapiens
agagcaagtgacagaaacaggg

SEQ ID NO: 9106032 - DNA, 23 bp, Homo sapiens
agagcaaggaaatgaggtgtgat

SEQ ID NO: 9106033 - DNA, 22 bp, Homo sapiens
agagcaattagcttaggtaaaa

SEQ ID NO: 9106034 - DNA, 22 bp, Homo sapiens
aatgtgtataagggagagctaa

SEQ ID NO: 9106035 - DNA, 22 bp, Homo sapiens
aatgtgtatgaggaagagagaa

SEQ ID NO: 9106036 - DNA, 22 bp, Homo sapiens
agagatctgtggattcattgtc

SEQ ID NO: 9106037 - DNA, 22 bp, Homo sapiens
agagatctgtggattcattgtc

SEQ ID NO: 9106038 - DNA, 22 bp, Homo sapiens
agagatgaaaagggtactgagg

SEQ ID NO: 9106039 - DNA, 22 bp, Homo sapiens
agagatgaaaagtggagactgg

SEQ ID NO: 9106040 - DNA, 22 bp, Homo sapiens
agagatttacacatgccttttc

SEQ ID NO: 9106041 - DNA, 22 bp, Homo sapiens
agagatgaaaagtggagactgg

SEQ ID NO: 9106042 - DNA, 22 bp, Homo sapiens
agagatgaaaagggtactgagg

SEQ ID NO: 9106043 - DNA, 22 bp, Homo sapiens
acacaagaagttaatgggcaaa

SEQ ID NO: 9106044 - DNA, 22 bp, Homo sapiens
acacaagaagttaatgggcaaa

SEQ ID NO: 9106045 - DNA, 21 bp, Homo sapiens
acacaacaggcagtcattttc

SEQ ID NO: 9106046 - DNA, 21 bp, Homo sapiens
acacaacaggcagtcattttc

SEQ ID NO: 9106047 - DNA, 22 bp, Homo sapiens
acacaacagaagagcaattgca

SEQ ID NO: 9106048 - DNA, 21 bp, Homo sapiens
acacaacaggcagtcattttc

SEQ ID NO: 9106049 - DNA, 22 bp, Homo sapiens
acaattttccccataggttatc

SEQ ID NO: 9106050 - DNA, 22 bp, Homo sapiens
agcacagggcccagcctaggcc

SEQ ID NO: 9106051 - DNA, 22 bp, Homo sapiens
agcacaggtaatacagagtaac

SEQ ID NO: 9106052 - DNA, 22 bp, Homo sapiens
agcacaggtaatacagagtaac

SEQ ID NO: 9106053 - DNA, 22 bp, Homo sapiens
agcacaggtaatacagagtaac

SEQ ID NO: 9106054 - DNA, 22 bp, Homo sapiens
agcacagggacaatgccaggtg

SEQ ID NO: 9106055 - DNA, 22 bp, Homo sapiens
agcacagggcccagcctaggcc

SEQ ID NO: 9106056 - DNA, 22 bp, Homo sapiens
agcacaggaccaaggaagctgt

SEQ ID NO: 9106057 - DNA, 22 bp, Homo sapiens
agcacaggaccaaggaagctgt

SEQ ID NO: 9106058 - DNA, 22 bp, Homo sapiens
agcacaggctttggtgtgaggg

SEQ ID NO: 9106059 - DNA, 22 bp, Homo sapiens
agcacaaatataaaaatgtctg

SEQ ID NO: 9106060 - DNA, 22 bp, Homo sapiens
agcaaggccgagaggatgctat

SEQ ID NO: 9106061 - DNA, 23 bp, Homo sapiens
agcacaaagtgttttccttgtag

SEQ ID NO: 9106062 - DNA, 23 bp, Homo sapiens
agcacaaagtgttttccttgtag

SEQ ID NO: 9106063 - DNA, 22 bp, Homo sapiens
agcacacaggccacctccactt

SEQ ID NO: 9106064 - DNA, 22 bp, Homo sapiens
agcacacaggacttgattcatg

SEQ ID NO: 9106065 - DNA, 22 bp, Homo sapiens
agcacacaggacttgattcatg

SEQ ID NO: 9106066 - DNA, 22 bp, Homo sapiens
agcacaatataaagtgaacgca

SEQ ID NO: 9106067 - DNA, 22 bp, Homo sapiens
agcacaatatgggttttatagt

SEQ ID NO: 9106068 - DNA, 22 bp, Homo sapiens
agcacaatgtgaaaagagctct

SEQ ID NO: 9106069 - DNA, 22 bp, Homo sapiens
agcacagaaagtattgactgaa

SEQ ID NO: 9106070 - DNA, 22 bp, Homo sapiens
agcacagaaagcacatttgaaa

SEQ ID NO: 9106071 - DNA, 22 bp, Homo sapiens
agcacaggaacatggagatggg

SEQ ID NO: 9106072 - DNA, 21 bp, Homo sapiens
agcacagctttaagccatgtg

SEQ ID NO: 9106073 - DNA, 22 bp, Homo sapiens
agcacagaatgaggtggaagtg

SEQ ID NO: 9106074 - DNA, 22 bp, Homo sapiens
agcacagaatgaggtggaagtg

SEQ ID NO: 9106075 - DNA, 22 bp, Homo sapiens
agcacagaatggcttggaagcc

SEQ ID NO: 9106076 - DNA, 22 bp, Homo sapiens
agcaaatacatttttagcataa

SEQ ID NO: 9106077 - DNA, 22 bp, Homo sapiens
agcaaatacatttttagcataa

SEQ ID NO: 9106078 - DNA, 22 bp, Homo sapiens
agcaaagcttccataaagcagc

SEQ ID NO: 9106079 - DNA, 21 bp, Homo sapiens
agcaaaggcaggagaggtttc

SEQ ID NO: 9106080 - DNA, 21 bp, Homo sapiens
agcaaaggcaggagaggtttc

SEQ ID NO: 9106081 - DNA, 22 bp, Homo sapiens
agcaaagctgattaagagcaca

SEQ ID NO: 9106082 - DNA, 22 bp, Homo sapiens
agcaaagctgattaagagcaca

SEQ ID NO: 9106083 - DNA, 22 bp, Homo sapiens
agcaaagctgctcccttttgtc

SEQ ID NO: 9106084 - DNA, 22 bp, Homo sapiens
acaacattcttaaatacactga

SEQ ID NO: 9106085 - DNA, 22 bp, Homo sapiens
agattttggctggctggagaga

SEQ ID NO: 9106086 - DNA, 22 bp, Homo sapiens
acaacatttaaggaggcactga

SEQ ID NO: 9106087 - DNA, 22 bp, Homo sapiens
acaacatttccatttccttggt

SEQ ID NO: 9106088 - DNA, 22 bp, Homo sapiens
agcaaaagatagattaacaaga

SEQ ID NO: 9106089 - DNA, 22 bp, Homo sapiens
acaacattatacatagaaagct

SEQ ID NO: 9106090 - DNA, 22 bp, Homo sapiens
acaacattatacatagaaagct

SEQ ID NO: 9106091 - DNA, 22 bp, Homo sapiens
acaacagtttaggtatttgtag

SEQ ID NO: 9106092 - DNA, 22 bp, Homo sapiens
acaacatcagctgagaccttca

SEQ ID NO: 9106093 - DNA, 22 bp, Homo sapiens
acaacagtaggaaaacatgtct

SEQ ID NO: 9106094 - DNA, 22 bp, Homo sapiens
agcaaatacttgaataaaaaga

SEQ ID NO: 9106095 - DNA, 22 bp, Homo sapiens
agcaaatacttgaataaaaaga

SEQ ID NO: 9106096 - DNA, 22 bp, Homo sapiens
agcaaatacttgaataaaaaga

SEQ ID NO: 9106097 - DNA, 22 bp, Homo sapiens
acaagttttggaagtcttaagg

SEQ ID NO: 9106098 - DNA, 22 bp, Homo sapiens
acaagtttcattgtttagaacc

SEQ ID NO: 9106099 - DNA, 19 bp, Homo sapiens
agcaaatataatagtgttc

SEQ ID NO: 9106100 - DNA, 20 bp, Homo sapiens
acaatacaggttgtgtctga

SEQ ID NO: 9106101 - DNA, 22 bp, Homo sapiens
acaatactattttcagtatcct

SEQ ID NO: 9106102 - DNA, 22 bp, Homo sapiens
acaatactagccaaggttatta

SEQ ID NO: 9106103 - DNA, 22 bp, Homo sapiens
acaatacaggcttctggactta

SEQ ID NO: 9106104 - DNA, 22 bp, Homo sapiens
agcaaggcagtcagctggctgg

SEQ ID NO: 9106105 - DNA, 22 bp, Homo sapiens
agagtgggttataggcagactt

SEQ ID NO: 9106106 - DNA, 22 bp, Homo sapiens
agagtggtacttctttttcttc

SEQ ID NO: 9106107 - DNA, 22 bp, Homo sapiens
agagtgaagtttttgaaagtga

SEQ ID NO: 9106108 - DNA, 22 bp, Homo sapiens
agagtgaagttcatcgtgcagc

SEQ ID NO: 9106109 - DNA, 22 bp, Homo sapiens
aatttgtacaaaatgtttataa

SEQ ID NO: 9106110 - DNA, 22 bp, Homo sapiens
agagttcacactcagtgcaccc

SEQ ID NO: 9106111 - DNA, 22 bp, Homo sapiens
agagttatggacttaatgcagg

SEQ ID NO: 9106112 - DNA, 22 bp, Homo sapiens
agagttatcactccatgcagct

SEQ ID NO: 9106113 - DNA, 21 bp, Homo sapiens
agagttactgtcatcctaggt

SEQ ID NO: 9106114 - DNA, 21 bp, Homo sapiens
agagttactgtcatcctaggt

SEQ ID NO: 9106115 - DNA, 22 bp, Homo sapiens
agagttaggtccagaatgttgc

SEQ ID NO: 9106116 - DNA, 22 bp, Homo sapiens
agagttaaataagcattaactt

SEQ ID NO: 9106117 - DNA, 22 bp, Homo sapiens
agagttaaatgaaatggtatgt

SEQ ID NO: 9106118 - DNA, 22 bp, Homo sapiens
agagttaagacgtacatgagtg

SEQ ID NO: 9106119 - DNA, 22 bp, Homo sapiens
aatttgattcagcaaatgttca

SEQ ID NO: 9106120 - DNA, 22 bp, Homo sapiens
aatttgaaacatagtcaccact

SEQ ID NO: 9106121 - DNA, 18 bp, Homo sapiens
aatttctttgacaactta

SEQ ID NO: 9106122 - DNA, 22 bp, Homo sapiens
aatttggagctttgtttctaga

SEQ ID NO: 9106123 - DNA, 22 bp, Homo sapiens
aatttgattccctgcacctgtt

SEQ ID NO: 9106124 - DNA, 22 bp, Homo sapiens
aatttctaattgaatctctctt

SEQ ID NO: 9106125 - DNA, 22 bp, Homo sapiens
aatttctaattgaatctctctt

SEQ ID NO: 9106126 - DNA, 22 bp, Homo sapiens
aatttctaattgaatctctctt

SEQ ID NO: 9106127 - DNA, 22 bp, Homo sapiens
aatttctcatggattcagttat

SEQ ID NO: 9106128 - DNA, 22 bp, Homo sapiens
aatttctccaagaatgcttaga

SEQ ID NO: 9106129 - DNA, 22 bp, Homo sapiens
aatttctcggttttgatattgt

SEQ ID NO: 9106130 - DNA, 22 bp, Homo sapiens
aatttcttgggagctcagagaa

SEQ ID NO: 9106131 - DNA, 22 bp, Homo sapiens
aatttcttcagctctaaaatgg

SEQ ID NO: 9106132 - DNA, 21 bp, Homo sapiens
agatgcagtttgcaggtgggt

SEQ ID NO: 9106133 - DNA, 22 bp, Homo sapiens
agatgctatacattgtaagaca

SEQ ID NO: 9106134 - DNA, 22 bp, Homo sapiens
agatgcagagtttgctgtggac

SEQ ID NO: 9106135 - DNA, 22 bp, Homo sapiens
agatgcagatttggattcagga

SEQ ID NO: 9106136 - DNA, 21 bp, Homo sapiens
agatgcagttatgagatgcag

SEQ ID NO: 9106137 - DNA, 22 bp, Homo sapiens
agatgctgattgaatagatttc

SEQ ID NO: 9106138 - DNA, 22 bp, Homo sapiens
agatgcctaaatctgggcaagg

SEQ ID NO: 9106139 - DNA, 22 bp, Homo sapiens
agatgctgcctctcctcacaag

SEQ ID NO: 9106140 - DNA, 22 bp, Homo sapiens
agatgctgctccacaggccagg

SEQ ID NO: 9106141 - DNA, 22 bp, Homo sapiens
agatgctgctccacaggccagg

SEQ ID NO: 9106142 - DNA, 22 bp, Homo sapiens
agatgctgctccacaggccagg

SEQ ID NO: 9106143 - DNA, 23 bp, Homo sapiens
acaacaggaaatcagacctgaac

SEQ ID NO: 9106144 - DNA, 22 bp, Homo sapiens
acaacagagctggactgagagg

SEQ ID NO: 9106145 - DNA, 22 bp, Homo sapiens
acaaagttaacagttggatagt

SEQ ID NO: 9106146 - DNA, 22 bp, Homo sapiens
acaaagtttcttctaacatctg

SEQ ID NO: 9106147 - DNA, 22 bp, Homo sapiens
acaaagtttcttctaacatctg

SEQ ID NO: 9106148 - DNA, 22 bp, Homo sapiens
agagttcagttgtagccatatt

SEQ ID NO: 9106149 - DNA, 22 bp, Homo sapiens
agagttcagctactgcaaatgt

SEQ ID NO: 9106150 - DNA, 22 bp, Homo sapiens
agagttcacactcagtgcaccc

SEQ ID NO: 9106151 - DNA, 22 bp, Homo sapiens
acaaagtgctgacattacaggc

SEQ ID NO: 9106152 - DNA, 22 bp, Homo sapiens
aatagcagaagactagtagaca

SEQ ID NO: 9106153 - DNA, 22 bp, Homo sapiens
aatagcataagatgtcaaatag

SEQ ID NO: 9106154 - DNA, 22 bp, Homo sapiens
aatagcatagagttaaaatgca

SEQ ID NO: 9106155 - DNA, 22 bp, Homo sapiens
aatagcaaacagacatgcacaa

SEQ ID NO: 9106156 - DNA, 22 bp, Homo sapiens
aatagaatttaaatgcagtggc

SEQ ID NO: 9106157 - DNA, 22 bp, Homo sapiens
aatagcaaagttatcaaattaa

SEQ ID NO: 9106158 - DNA, 22 bp, Homo sapiens
aatagcaaatgctcatttgaaa

SEQ ID NO: 9106159 - DNA, 22 bp, Homo sapiens
aatagcacctgaggtagtttgt

SEQ ID NO: 9106160 - DNA, 22 bp, Homo sapiens
aatagcaattacccttcaactc

SEQ ID NO: 9106161 - DNA, 22 bp, Homo sapiens
actgtctctctagcagttcagg

SEQ ID NO: 9106162 - DNA, 22 bp, Homo sapiens
aatagaacaataattgtaaact

SEQ ID NO: 9106163 - DNA, 22 bp, Homo sapiens
aatagaatgtaatctaatacat

SEQ ID NO: 9106164 - DNA, 22 bp, Homo sapiens
aatagaatgtaatctaatacat

SEQ ID NO: 9106165 - DNA, 22 bp, Homo sapiens
actgtcctgaatactgcatgac

SEQ ID NO: 9106166 - DNA, 22 bp, Homo sapiens
actgtcctcgaagtacctgtgc

SEQ ID NO: 9106167 - DNA, 22 bp, Homo sapiens
actgtcctagaacctgcagctc

SEQ ID NO: 9106168 - DNA, 22 bp, Homo sapiens
actgtcctcagatattcttctg

SEQ ID NO: 9106169 - DNA, 22 bp, Homo sapiens
actgtctcctcatcatgcctgg

SEQ ID NO: 9106170 - DNA, 22 bp, Homo sapiens
actgtccttttaatgcagccgt

SEQ ID NO: 9106171 - DNA, 22 bp, Homo sapiens
actgtcctgcaaaaatactctt

SEQ ID NO: 9106172 - DNA, 22 bp, Homo sapiens
actgtcctggagctcacactct

SEQ ID NO: 9106173 - DNA, 22 bp, Homo sapiens
actgtacacgtgtcatttacag

SEQ ID NO: 9106174 - DNA, 22 bp, Homo sapiens
actgtccgggacaggcccatcc

SEQ ID NO: 9106175 - DNA, 22 bp, Homo sapiens
actgtacaactgctgagcagaa

SEQ ID NO: 9106176 - DNA, 22 bp, Homo sapiens
actggggagtggttttgggaag

SEQ ID NO: 9106177 - DNA, 22 bp, Homo sapiens
aagttttgaaatactgaagtgt

SEQ ID NO: 9106178 - DNA, 22 bp, Homo sapiens
aagttttgaaatactgaagtgt

SEQ ID NO: 9106179 - DNA, 22 bp, Homo sapiens
aagtttttcacattgctgttgt

SEQ ID NO: 9106180 - DNA, 22 bp, Homo sapiens
aagtttttcacattgctgttgt

SEQ ID NO: 9106181 - DNA, 22 bp, Homo sapiens
aagtttttgattctaagagaga

SEQ ID NO: 9106182 - DNA, 21 bp, Homo sapiens
aataaaacagttggtgtcaat

SEQ ID NO: 9106183 - DNA, 22 bp, Homo sapiens
aagtttttggtagagaaaagta

SEQ ID NO: 9106184 - DNA, 22 bp, Homo sapiens
aataaaatgaactggtagagtt

SEQ ID NO: 9106185 - DNA, 22 bp, Homo sapiens
aataaaatgaactggtagagtt

SEQ ID NO: 9106186 - DNA, 22 bp, Homo sapiens
aataaaatgaactggtagagtt

SEQ ID NO: 9106187 - DNA, 22 bp, Homo sapiens
aataaaatgaactggtagagtt

SEQ ID NO: 9106188 - DNA, 22 bp, Homo sapiens
actgggaggcatctggagctga

SEQ ID NO: 9106189 - DNA, 22 bp, Homo sapiens
actggctgatatggctaggaag

SEQ ID NO: 9106190 - DNA, 22 bp, Homo sapiens
actgggagtcatgaggaaggag

SEQ ID NO: 9106191 - DNA, 22 bp, Homo sapiens
actgggagggtcttgaagaggg

SEQ ID NO: 9106192 - DNA, 22 bp, Homo sapiens
aataatacatgagattaatgtt

SEQ ID NO: 9106193 - DNA, 22 bp, Homo sapiens
aataatacatgagattaatgtt

SEQ ID NO: 9106194 - DNA, 22 bp, Homo sapiens
aataatacatgagattaatgtt

SEQ ID NO: 9106195 - DNA, 22 bp, Homo sapiens
actggggagagtcatgccagca

SEQ ID NO: 9106196 - DNA, 22 bp, Homo sapiens
aataatagcagagtttacaatc

SEQ ID NO: 9106197 - DNA, 22 bp, Homo sapiens
aataatagcagagtttacaatc

SEQ ID NO: 9106198 - DNA, 22 bp, Homo sapiens
aataatagcagagtttacaatc

SEQ ID NO: 9106199 - DNA, 22 bp, Homo sapiens
aataatagcagagtttacaatc

SEQ ID NO: 9106200 - DNA, 22 bp, Homo sapiens
actgggcaccatcatgagatgg

SEQ ID NO: 9106201 - DNA, 22 bp, Homo sapiens
actgggcaccatcatgagatag

SEQ ID NO: 9106202 - DNA, 22 bp, Homo sapiens
actgggcaataaattcagagaa

SEQ ID NO: 9106203 - DNA, 22 bp, Homo sapiens
actgggcaaggatatgatgggt

SEQ ID NO: 9106204 - DNA, 22 bp, Homo sapiens
aataagtacttggggataactt

SEQ ID NO: 9106205 - DNA, 22 bp, Homo sapiens
aataagttgcctgttgaatcat

SEQ ID NO: 9106206 - DNA, 19 bp, Homo sapiens
aataagcttgggtaaaact

SEQ ID NO: 9106207 - DNA, 22 bp, Homo sapiens
aagtgtgggactagggctccag

SEQ ID NO: 9106208 - DNA, 22 bp, Homo sapiens
aagtgtgatttgtagaatgcct

SEQ ID NO: 9106209 - DNA, 22 bp, Homo sapiens
aagtgtgggaagtaggtggcga

SEQ ID NO: 9106210 - DNA, 22 bp, Homo sapiens
aagtgtgaattttagagtcagg

SEQ ID NO: 9106211 - DNA, 22 bp, Homo sapiens
aagtgtgagacacacaaaatta

SEQ ID NO: 9106212 - DNA, 22 bp, Homo sapiens
aagtgtgaattttagagtcagg

SEQ ID NO: 9106213 - DNA, 22 bp, Homo sapiens
aagtgtgttgactgaattgggg

SEQ ID NO: 9106214 - DNA, 22 bp, Homo sapiens
aagtgtgttgactgaattgggg

SEQ ID NO: 9106215 - DNA, 22 bp, Homo sapiens
acctgcctctaagcagcaggtg

SEQ ID NO: 9106216 - DNA, 22 bp, Homo sapiens
acctgcctcagtgcagctggat

SEQ ID NO: 9106217 - DNA, 22 bp, Homo sapiens
acctgcctcagtgcagctggat

SEQ ID NO: 9106218 - DNA, 22 bp, Homo sapiens
acctgcctcagtgcagctggat

SEQ ID NO: 9106219 - DNA, 22 bp, Homo sapiens
acctgcctatggagccacatgg

SEQ ID NO: 9106220 - DNA, 22 bp, Homo sapiens
aagtgtcttctgatggggtgtg

SEQ ID NO: 9106221 - DNA, 22 bp, Homo sapiens
aagtgtcttaactccttttggg

SEQ ID NO: 9106222 - DNA, 22 bp, Homo sapiens
aagtgtctttatatttgagaaa

SEQ ID NO: 9106223 - DNA, 22 bp, Homo sapiens
aagtgtctgcaaaatgacagag

SEQ ID NO: 9106224 - DNA, 22 bp, Homo sapiens
aagtgttaaagacttgaacact

SEQ ID NO: 9106225 - DNA, 22 bp, Homo sapiens
actcttgtctcaacttttgtat

SEQ ID NO: 9106226 - DNA, 22 bp, Homo sapiens
aagtgtttcttggaatgttgcg

SEQ ID NO: 9106227 - DNA, 22 bp, Homo sapiens
actctgggaatcctcaccttcc

SEQ ID NO: 9106228 - DNA, 22 bp, Homo sapiens
actctggcttgaggaccaggtc

SEQ ID NO: 9106229 - DNA, 22 bp, Homo sapiens
actgcagggcatcctggccaag

SEQ ID NO: 9106230 - DNA, 22 bp, Homo sapiens
actgcagggcatcctggccaag

SEQ ID NO: 9106231 - DNA, 22 bp, Homo sapiens
actgcatgataataatagcaga

SEQ ID NO: 9106232 - DNA, 22 bp, Homo sapiens
actgcatctgaaacatgggtca

SEQ ID NO: 9106233 - DNA, 22 bp, Homo sapiens
actgcattccagcctgggcaac

SEQ ID NO: 9106234 - DNA, 22 bp, Homo sapiens
actgcattatcaccaagatgta

SEQ ID NO: 9106235 - DNA, 22 bp, Homo sapiens
actgcattatcaccaagatgta

SEQ ID NO: 9106236 - DNA, 20 bp, Homo sapiens
aagttttctccaaatacagt

SEQ ID NO: 9106237 - DNA, 22 bp, Homo sapiens
actgcaggagacacagctgctg

SEQ ID NO: 9106238 - DNA, 22 bp, Homo sapiens
actgcagcctttgggctcataa

SEQ ID NO: 9106239 - DNA, 22 bp, Homo sapiens
actgcaggatgtgctcctattg

SEQ ID NO: 9106240 - DNA, 22 bp, Homo sapiens
actgcagccttgaactctgggc

SEQ ID NO: 9106241 - DNA, 22 bp, Homo sapiens
actgcagcctttgggctcataa

SEQ ID NO: 9106242 - DNA, 22 bp, Homo sapiens
actgcactccagcctgggtgac

SEQ ID NO: 9106243 - DNA, 22 bp, Homo sapiens
actgcactccagcctgggtgac

SEQ ID NO: 9106244 - DNA, 22 bp, Homo sapiens
aagttccttgaatgaagctagg

SEQ ID NO: 9106245 - DNA, 22 bp, Homo sapiens
aagttcctgggccaagtccagg

SEQ ID NO: 9106246 - DNA, 22 bp, Homo sapiens
actcttttataaagcatcttga

SEQ ID NO: 9106247 - DNA, 22 bp, Homo sapiens
actctttgtctgttgccgctta

SEQ ID NO: 9106248 - DNA, 22 bp, Homo sapiens
aagttcaaggctctagagttcc

SEQ ID NO: 9106249 - DNA, 22 bp, Homo sapiens
aagttcaaggtgatagtggcag

SEQ ID NO: 9106250 - DNA, 22 bp, Homo sapiens
aagttcaagtagtgttacatgg

SEQ ID NO: 9106251 - DNA, 22 bp, Homo sapiens
actgaaaaagtatgattcactg

SEQ ID NO: 9106252 - DNA, 22 bp, Homo sapiens
actgaaaaagacatcttggtaa

SEQ ID NO: 9106253 - DNA, 22 bp, Homo sapiens
aagttcctgagctcatatagca

SEQ ID NO: 9106254 - DNA, 22 bp, Homo sapiens
aagttcctcaaataaaacatga

SEQ ID NO: 9106255 - DNA, 22 bp, Homo sapiens
aagttcctcaaataaaacatga

SEQ ID NO: 9106256 - DNA, 22 bp, Homo sapiens
aagttcctaaagtcaggggtca

SEQ ID NO: 9106257 - DNA, 22 bp, Homo sapiens
aagttcctatatccaaatacag

SEQ ID NO: 9106258 - DNA, 22 bp, Homo sapiens
aagttcagcctggttttaatgc

SEQ ID NO: 9106259 - DNA, 22 bp, Homo sapiens
aagttcaatggaaaagctttag

SEQ ID NO: 9106260 - DNA, 22 bp, Homo sapiens
aagttcaagtgtaatctttatt

SEQ ID NO: 9106261 - DNA, 22 bp, Homo sapiens
aagttcaatcagatgaaaaagc

SEQ ID NO: 9106262 - DNA, 22 bp, Homo sapiens
aagttcaagtctcctgagtata

SEQ ID NO: 9106263 - DNA, 22 bp, Homo sapiens
aagttcaagtctgcatcttttt

SEQ ID NO: 9106264 - DNA, 23 bp, Homo sapiens
aagttcaagtcacagcctgtctt

SEQ ID NO: 9106265 - DNA, 22 bp, Homo sapiens
aagttcaagtagtgttacatgg

SEQ ID NO: 9106266 - DNA, 22 bp, Homo sapiens
aatgcattttattatatgtgac

SEQ ID NO: 9106267 - DNA, 22 bp, Homo sapiens
aatgccaacttggatatacatt

SEQ ID NO: 9106268 - DNA, 22 bp, Homo sapiens
aatgccagtgtgttgattccag

SEQ ID NO: 9106269 - DNA, 22 bp, Homo sapiens
aatgccttcccatttatacttt

SEQ ID NO: 9106270 - DNA, 22 bp, Homo sapiens
aatgccttataggctgaaaatt

SEQ ID NO: 9106271 - DNA, 22 bp, Homo sapiens
aatgcataccatgtcatctttg

SEQ ID NO: 9106272 - DNA, 22 bp, Homo sapiens
aatgcatacgtgtttgtggcaa

SEQ ID NO: 9106273 - DNA, 22 bp, Homo sapiens
aatgcacaaaggtgtctattgc

SEQ ID NO: 9106274 - DNA, 22 bp, Homo sapiens
aatgcacaaaggtgtctattgc

SEQ ID NO: 9106275 - DNA, 22 bp, Homo sapiens
aatgcattagctacatatgtct

SEQ ID NO: 9106276 - DNA, 21 bp, Homo sapiens
aatgcattaacataaagctga

SEQ ID NO: 9106277 - DNA, 22 bp, Homo sapiens
agaagccagcttcagctgcccg

SEQ ID NO: 9106278 - DNA, 22 bp, Homo sapiens
agaaggaaacagctgtgctttg

SEQ ID NO: 9106279 - DNA, 22 bp, Homo sapiens
agaaggaaaacctgtcttatgt

SEQ ID NO: 9106280 - DNA, 22 bp, Homo sapiens
agaaggaaggctgagtgctgat

SEQ ID NO: 9106281 - DNA, 22 bp, Homo sapiens
agaaggaaggctgagtgctgat

SEQ ID NO: 9106282 - DNA, 22 bp, Homo sapiens
agaaggaaggctgagtgctgat

SEQ ID NO: 9106283 - DNA, 22 bp, Homo sapiens
agaaggaaggctgagtgctgat

SEQ ID NO: 9106284 - DNA, 22 bp, Homo sapiens
agaaggaaggaagcattctgtt

SEQ ID NO: 9106285 - DNA, 22 bp, Homo sapiens
agaaggaaggaagcattctgtt

SEQ ID NO: 9106286 - DNA, 22 bp, Homo sapiens
agaaggaagccaggagggtgca

SEQ ID NO: 9106287 - DNA, 22 bp, Homo sapiens
agaaggaagccaggagggtgca

SEQ ID NO: 9106288 - DNA, 22 bp, Homo sapiens
agaactgtgaagtatgtgaaat

SEQ ID NO: 9106289 - DNA, 22 bp, Homo sapiens
agaagaaactgtcggggatatt

SEQ ID NO: 9106290 - DNA, 22 bp, Homo sapiens
aatgaagaaatggacatcttta

SEQ ID NO: 9106291 - DNA, 22 bp, Homo sapiens
aatgaagaaatggacatcttta

SEQ ID NO: 9106292 - DNA, 22 bp, Homo sapiens
agaagaaagattgaaggttcct

SEQ ID NO: 9106293 - DNA, 22 bp, Homo sapiens
agaacaattgccccaaagcttg

SEQ ID NO: 9106294 - DNA, 22 bp, Homo sapiens
aatgaatgaaccacatataaca

SEQ ID NO: 9106295 - DNA, 22 bp, Homo sapiens
agaagcagctttcaaggtgatt

SEQ ID NO: 9106296 - DNA, 22 bp, Homo sapiens
aatgaatgggtttaatatttta

SEQ ID NO: 9106297 - DNA, 22 bp, Homo sapiens
agaagccaccagctgaggaaga

SEQ ID NO: 9106298 - DNA, 22 bp, Homo sapiens
agaagcagctttcaaggtgatt

SEQ ID NO: 9106299 - DNA, 22 bp, Homo sapiens
agaagcagctttcaaggtgatt

SEQ ID NO: 9106300 - DNA, 22 bp, Homo sapiens
agaagccactggaggttgagat

SEQ ID NO: 9106301 - DNA, 22 bp, Homo sapiens
agaagccactgctcccagtgag

SEQ ID NO: 9106302 - DNA, 18 bp, Homo sapiens
agaagccacgaggagtcc

SEQ ID NO: 9106303 - DNA, 22 bp, Homo sapiens
aatgaagtgttatttagtttca

SEQ ID NO: 9106304 - DNA, 22 bp, Homo sapiens
aatgaagttctattcattttct

SEQ ID NO: 9106305 - DNA, 22 bp, Homo sapiens
aatgaagacacatctttctcat

SEQ ID NO: 9106306 - DNA, 22 bp, Homo sapiens
aatgaagataaaatgggatgga

SEQ ID NO: 9106307 - DNA, 22 bp, Homo sapiens
aatgaagattatggtgattaag

SEQ ID NO: 9106308 - DNA, 22 bp, Homo sapiens
aatcacaattacttttgcacca

SEQ ID NO: 9106309 - DNA, 22 bp, Homo sapiens
aatcacaaatgcaagttgtcac

SEQ ID NO: 9106310 - DNA, 22 bp, Homo sapiens
aatcacaaatgcaagttgtcac

SEQ ID NO: 9106311 - DNA, 22 bp, Homo sapiens
aatcacaaatttagacagagct

SEQ ID NO: 9106312 - DNA, 22 bp, Homo sapiens
agaaaggaagggaggagtttat

SEQ ID NO: 9106313 - DNA, 22 bp, Homo sapiens
agaaaggaggaagaatgacctc

SEQ ID NO: 9106314 - DNA, 22 bp, Homo sapiens
agaaaggaggaagaatgacctc

SEQ ID NO: 9106315 - DNA, 22 bp, Homo sapiens
agaaagggaactggcaaagcca

SEQ ID NO: 9106316 - DNA, 22 bp, Homo sapiens
agaaagggaactggcaaagcca

SEQ ID NO: 9106317 - DNA, 22 bp, Homo sapiens
agaaagggagcgtggatcaatt

SEQ ID NO: 9106318 - DNA, 22 bp, Homo sapiens
agaaagggagagccagcacacg

SEQ ID NO: 9106319 - DNA, 20 bp, Homo sapiens
aatcctgggacagaggcagg

SEQ ID NO: 9106320 - DNA, 22 bp, Homo sapiens
aatcctggcctagctgggctca

SEQ ID NO: 9106321 - DNA, 22 bp, Homo sapiens
aatctagattcggatcaaaggg

SEQ ID NO: 9106322 - DNA, 22 bp, Homo sapiens
aatctagagtgctaggtctgtg

SEQ ID NO: 9106323 - DNA, 22 bp, Homo sapiens
aatctacatagagatcaaatga

SEQ ID NO: 9106324 - DNA, 22 bp, Homo sapiens
aatctaaggacttagcattgct

SEQ ID NO: 9106325 - DNA, 22 bp, Homo sapiens
aatctaagccaccagtagtttc

SEQ ID NO: 9106326 - DNA, 22 bp, Homo sapiens
aatcaagagttgtgtaatattt

SEQ ID NO: 9106327 - DNA, 22 bp, Homo sapiens
aatcaatgttagtcatgaattt

SEQ ID NO: 9106328 - DNA, 21 bp, Homo sapiens
aatcaagagtactggtgtggc

SEQ ID NO: 9106329 - DNA, 22 bp, Homo sapiens
aatcaagagttgtgtaatattt

SEQ ID NO: 9106330 - DNA, 22 bp, Homo sapiens
acttttatgataatcaatgttc

SEQ ID NO: 9106331 - DNA, 22 bp, Homo sapiens
actttgttttcatgaaacagct

SEQ ID NO: 9106332 - DNA, 22 bp, Homo sapiens
acttttaaatgagtttcagttg

SEQ ID NO: 9106333 - DNA, 22 bp, Homo sapiens
actttgttgatgaaatagtttt

SEQ ID NO: 9106334 - DNA, 22 bp, Homo sapiens
actttgttgaagaatatgttag

SEQ ID NO: 9106335 - DNA, 22 bp, Homo sapiens
actttgcaaaaggaaatcacct

SEQ ID NO: 9106336 - DNA, 22 bp, Homo sapiens
actttgttcctttcacaaagaa

SEQ ID NO: 9106337 - DNA, 22 bp, Homo sapiens
actttgacagcattttaattat

SEQ ID NO: 9106338 - DNA, 22 bp, Homo sapiens
aataggaaaatatttaacaaga

SEQ ID NO: 9106339 - DNA, 22 bp, Homo sapiens
aataggaaaatatttaacaaga

SEQ ID NO: 9106340 - DNA, 22 bp, Homo sapiens
aataggaaaatatttaacaaga

SEQ ID NO: 9106341 - DNA, 22 bp, Homo sapiens
aataggaagcaccaaattctcc

SEQ ID NO: 9106342 - DNA, 23 bp, Homo sapiens
aatagctggtaatgatagcacaa

SEQ ID NO: 9106343 - DNA, 22 bp, Homo sapiens
aatagctgggaggcacattcat

SEQ ID NO: 9106344 - DNA, 17 bp, Homo sapiens
aatagctgctcagagag

SEQ ID NO: 9106345 - DNA, 22 bp, Homo sapiens
aatagcatgtaagtttaaaaga

SEQ ID NO: 9106346 - DNA, 22 bp, Homo sapiens
acatgacagtgcttagcaaact

SEQ ID NO: 9106347 - DNA, 22 bp, Homo sapiens
acatgcatgtcatcagcccttt

SEQ ID NO: 9106348 - DNA, 22 bp, Homo sapiens
acatgcatgaaatccataaaca

SEQ ID NO: 9106349 - DNA, 22 bp, Homo sapiens
acatgcatatacttaaatatgt

SEQ ID NO: 9106350 - DNA, 22 bp, Homo sapiens
acatgaaattctagctgaaccc

SEQ ID NO: 9106351 - DNA, 22 bp, Homo sapiens
acatgaagtggtcagatcaaac

SEQ ID NO: 9106352 - DNA, 22 bp, Homo sapiens
acatctagactcttgccctctt

SEQ ID NO: 9106353 - DNA, 22 bp, Homo sapiens
acatcctcccgatctactggct

SEQ ID NO: 9106354 - DNA, 20 bp, Homo sapiens
acatcctggtgactagaact

SEQ ID NO: 9106355 - DNA, 22 bp, Homo sapiens
acatcctcccgatctactggct

SEQ ID NO: 9106356 - DNA, 22 bp, Homo sapiens
acatcctcccgatctactggct

SEQ ID NO: 9106357 - DNA, 22 bp, Homo sapiens
acatcctcggggaaaggcactg

SEQ ID NO: 9106358 - DNA, 22 bp, Homo sapiens
acatcccacagaaacatacata

SEQ ID NO: 9106359 - DNA, 22 bp, Homo sapiens
aaggccagcctgagagctaaca

SEQ ID NO: 9106360 - DNA, 22 bp, Homo sapiens
aaggccagcagtttgagaccag

SEQ ID NO: 9106361 - DNA, 22 bp, Homo sapiens
aaggccagattcactttacaat

SEQ ID NO: 9106362 - DNA, 22 bp, Homo sapiens
aaggccagattctctctagggg

SEQ ID NO: 9106363 - DNA, 22 bp, Homo sapiens
aaggccagattctctctagggg

SEQ ID NO: 9106364 - DNA, 22 bp, Homo sapiens
aaggcatgtgtcctcagagaga

SEQ ID NO: 9106365 - DNA, 22 bp, Homo sapiens
aaggcattgctgatcctcaggt

SEQ ID NO: 9106366 - DNA, 22 bp, Homo sapiens
aaggcaccataggcaaatccag

SEQ ID NO: 9106367 - DNA, 22 bp, Homo sapiens
aaggcacattcctgaaaacaat

SEQ ID NO: 9106368 - DNA, 22 bp, Homo sapiens
aaggcacatattttagagtcac

SEQ ID NO: 9106369 - DNA, 22 bp, Homo sapiens
aaggcacatattttagagtcac

SEQ ID NO: 9106370 - DNA, 22 bp, Homo sapiens
aaggcacatgacctaggcctgg

SEQ ID NO: 9106371 - DNA, 22 bp, Homo sapiens
aaggcacatgacctaggcctgg

SEQ ID NO: 9106372 - DNA, 22 bp, Homo sapiens
aaggccagagcagactggagtt

SEQ ID NO: 9106373 - DNA, 22 bp, Homo sapiens
aaggccagagcgtgtcctgcct

SEQ ID NO: 9106374 - DNA, 22 bp, Homo sapiens
aaggcaatttcagggctctcta

SEQ ID NO: 9106375 - DNA, 22 bp, Homo sapiens
aaggcaatttgttgtgaggatt

SEQ ID NO: 9106376 - DNA, 22 bp, Homo sapiens
aaggcaatttggaagaggcaga

SEQ ID NO: 9106377 - DNA, 22 bp, Homo sapiens
aaggcaattggcttgtataaga

SEQ ID NO: 9106378 - DNA, 22 bp, Homo sapiens
aaggcaattgcagtttttgcca

SEQ ID NO: 9106379 - DNA, 22 bp, Homo sapiens
aaggcaattgattatttttcct

SEQ ID NO: 9106380 - DNA, 22 bp, Homo sapiens
aaggcacaacacaagagggtga

SEQ ID NO: 9106381 - DNA, 22 bp, Homo sapiens
aaggcacacagttagatagagc

SEQ ID NO: 9106382 - DNA, 22 bp, Homo sapiens
aaggcacagccacttgatcatc

SEQ ID NO: 9106383 - DNA, 22 bp, Homo sapiens
aaggcacagccacttgatcatc

SEQ ID NO: 9106384 - DNA, 18 bp, Homo sapiens
aaggcacaggagaacatt

SEQ ID NO: 9106385 - DNA, 18 bp, Homo sapiens
aaggcacaggagaacatt

SEQ ID NO: 9106386 - DNA, 22 bp, Homo sapiens
aaggcacatattgcagatcttg

SEQ ID NO: 9106387 - DNA, 22 bp, Homo sapiens
aaggcacatattttagagtcac

SEQ ID NO: 9106388 - DNA, 22 bp, Homo sapiens
aaggcacatattttagagtcac

SEQ ID NO: 9106389 - DNA, 22 bp, Homo sapiens
aaggcaaggcttccagctcccc

SEQ ID NO: 9106390 - DNA, 22 bp, Homo sapiens
aaggcaaggccaagccatcagt

SEQ ID NO: 9106391 - DNA, 22 bp, Homo sapiens
aaggcaaggcttccagctcccc

SEQ ID NO: 9106392 - DNA, 22 bp, Homo sapiens
aaggcaatagtattaaactgga

SEQ ID NO: 9106393 - DNA, 22 bp, Homo sapiens
aaggcaatatcaagagaattcg

SEQ ID NO: 9106394 - DNA, 22 bp, Homo sapiens
aaggcaagttttagttttctgg

SEQ ID NO: 9106395 - DNA, 22 bp, Homo sapiens
aaggcaagttttagttttctgg

SEQ ID NO: 9106396 - DNA, 22 bp, Homo sapiens
aaggcaaggttcaccgtgctat

SEQ ID NO: 9106397 - DNA, 22 bp, Homo sapiens
aaggcaatgaatactgtttttg

SEQ ID NO: 9106398 - DNA, 22 bp, Homo sapiens
aaggcaatattgagtttccctt

SEQ ID NO: 9106399 - DNA, 22 bp, Homo sapiens
aaggcaatattgagtttccctt

SEQ ID NO: 9106400 - DNA, 22 bp, Homo sapiens
aaggcaatgactgatttagaat

SEQ ID NO: 9106401 - DNA, 22 bp, Homo sapiens
aaggcaatgagggagatagagt

SEQ ID NO: 9106402 - DNA, 22 bp, Homo sapiens
aaggcaatgctaagaggtttgg

SEQ ID NO: 9106403 - DNA, 22 bp, Homo sapiens
aaggcaatgctaagaggtttgg

SEQ ID NO: 9106404 - DNA, 22 bp, Homo sapiens
aaggcaatgggatggatcatgt

SEQ ID NO: 9106405 - DNA, 22 bp, Homo sapiens
aaggcaatggcaagagaaagca

SEQ ID NO: 9106406 - DNA, 22 bp, Homo sapiens
aaggcaatggtttctgtgcctt

SEQ ID NO: 9106407 - DNA, 22 bp, Homo sapiens
aaggcaatgtaaattacagctt

SEQ ID NO: 9106408 - DNA, 22 bp, Homo sapiens
aaggcaatgtaaattacagctt

SEQ ID NO: 9106409 - DNA, 22 bp, Homo sapiens
aaggcaatgtcatggctcttgc

SEQ ID NO: 9106410 - DNA, 22 bp, Homo sapiens
aaggcaatgttagcaacataat

SEQ ID NO: 9106411 - DNA, 22 bp, Homo sapiens
aaggcaatgttagcaacataat

SEQ ID NO: 9106412 - DNA, 22 bp, Homo sapiens
aaggcaattgagaagaaacaga

SEQ ID NO: 9106413 - DNA, 22 bp, Homo sapiens
aagcttcttagaatgcatgtgc

SEQ ID NO: 9106414 - DNA, 23 bp, Homo sapiens
aagcttctatctctgcagaagga

SEQ ID NO: 9106415 - DNA, 23 bp, Homo sapiens
aagcttctagggtgggcaagatg

SEQ ID NO: 9106416 - DNA, 23 bp, Homo sapiens
aagcttccttgactggcccctag

SEQ ID NO: 9106417 - DNA, 23 bp, Homo sapiens
aagcttccttcacgtctcctggg

SEQ ID NO: 9106418 - DNA, 21 bp, Homo sapiens
aagcttccctgctctccaggg

SEQ ID NO: 9106419 - DNA, 22 bp, Homo sapiens
aagcttcctgaatgctcattta

SEQ ID NO: 9106420 - DNA, 23 bp, Homo sapiens
aagcttccttcacgtctcctggg

SEQ ID NO: 9106421 - DNA, 22 bp, Homo sapiens
aagcttcctgcatgggactgct

SEQ ID NO: 9106422 - DNA, 21 bp, Homo sapiens
aagcttccaaactgctggact

SEQ ID NO: 9106423 - DNA, 20 bp, Homo sapiens
aagcttccaggatctggtgt

SEQ ID NO: 9106424 - DNA, 21 bp, Homo sapiens
aagcttccaaactgctggact

SEQ ID NO: 9106425 - DNA, 22 bp, Homo sapiens
aagcttctttacaggagagatt

SEQ ID NO: 9106426 - DNA, 22 bp, Homo sapiens
aagcttctttacaggagagatt

SEQ ID NO: 9106427 - DNA, 21 bp, Homo sapiens
aagcttggctgatgttattgg

SEQ ID NO: 9106428 - DNA, 22 bp, Homo sapiens
aagcttggaagtcttcctttca

SEQ ID NO: 9106429 - DNA, 22 bp, Homo sapiens
aagcttgattgtagtctagaca

SEQ ID NO: 9106430 - DNA, 22 bp, Homo sapiens
aagcttgggaaccacggtaatc

SEQ ID NO: 9106431 - DNA, 22 bp, Homo sapiens
aagctgttgttcatcctgaatt

SEQ ID NO: 9106432 - DNA, 20 bp, Homo sapiens
aagcttcacttcatttgatc

SEQ ID NO: 9106433 - DNA, 22 bp, Homo sapiens
aagcttcagtgtgagcatgtaa

SEQ ID NO: 9106434 - DNA, 22 bp, Homo sapiens
aagctgtgaagagcaagtgagg

SEQ ID NO: 9106435 - DNA, 22 bp, Homo sapiens
aagctgtgagctggatgctcca

SEQ ID NO: 9106436 - DNA, 22 bp, Homo sapiens
aagctgtgagctggatgctcca

SEQ ID NO: 9106437 - DNA, 22 bp, Homo sapiens
aagctgtgcaggaactgcttgc

SEQ ID NO: 9106438 - DNA, 22 bp, Homo sapiens
aagctgtgcaggaactgcttgc

SEQ ID NO: 9106439 - DNA, 22 bp, Homo sapiens
aagctgtggcttggaggaaaca

SEQ ID NO: 9106440 - DNA, 22 bp, Homo sapiens
aagctgtgcctttgcctagaat

SEQ ID NO: 9106441 - DNA, 22 bp, Homo sapiens
aagctgtgtattacagaatatt

SEQ ID NO: 9106442 - DNA, 22 bp, Homo sapiens
aagctgtgtgactatttctgag

SEQ ID NO: 9106443 - DNA, 22 bp, Homo sapiens
aagctgtgtcctagaggtgtaa

SEQ ID NO: 9106444 - DNA, 22 bp, Homo sapiens
aagctgtgtcctagaggtgtaa

SEQ ID NO: 9106445 - DNA, 22 bp, Homo sapiens
aagctgtgtaagttgcttggtt

SEQ ID NO: 9106446 - DNA, 22 bp, Homo sapiens
aagctgtgtaagttgcttggtt

SEQ ID NO: 9106447 - DNA, 22 bp, Homo sapiens
aagctgtggtaaagggtagagg

SEQ ID NO: 9106448 - DNA, 22 bp, Homo sapiens
aagctgtgtgcagatgatctca

SEQ ID NO: 9106449 - DNA, 22 bp, Homo sapiens
aagctgtgtgactatttctgag

SEQ ID NO: 9106450 - DNA, 22 bp, Homo sapiens
aagctgtgtgcagatgatctca

SEQ ID NO: 9106451 - DNA, 21 bp, Homo sapiens
aagctgtgttccactgatagc

SEQ ID NO: 9106452 - DNA, 21 bp, Homo sapiens
aagctgtgttccactgatagc

SEQ ID NO: 9106453 - DNA, 22 bp, Homo sapiens
acagctggagtgaggatggagt

SEQ ID NO: 9106454 - DNA, 22 bp, Homo sapiens
acagctggagtgaggatggagt

SEQ ID NO: 9106455 - DNA, 22 bp, Homo sapiens
aagctgtgaaatctctagtgca

SEQ ID NO: 9106456 - DNA, 22 bp, Homo sapiens
aagctgtgaaatctctagtgca

SEQ ID NO: 9106457 - DNA, 22 bp, Homo sapiens
acagctggaggtctgtgagcac

SEQ ID NO: 9106458 - DNA, 22 bp, Homo sapiens
acagctggacaggggagagttt

SEQ ID NO: 9106459 - DNA, 22 bp, Homo sapiens
acagctggaggccccattgtcc

SEQ ID NO: 9106460 - DNA, 22 bp, Homo sapiens
acagctggacaggggagagttt

SEQ ID NO: 9106461 - DNA, 22 bp, Homo sapiens
aaggatgaacattaatacatca

SEQ ID NO: 9106462 - DNA, 22 bp, Homo sapiens
aaggatctgacagactatagaa

SEQ ID NO: 9106463 - DNA, 22 bp, Homo sapiens
aaggatctttctttttaccatt

SEQ ID NO: 9106464 - DNA, 22 bp, Homo sapiens
aaggatgattggtaatgacact

SEQ ID NO: 9106465 - DNA, 22 bp, Homo sapiens
aaggatgattggtaatgacact

SEQ ID NO: 9106466 - DNA, 22 bp, Homo sapiens
aaggaggcctggcagatgaaga

SEQ ID NO: 9106467 - DNA, 22 bp, Homo sapiens
aaggaggcctgcgagaaggggc

SEQ ID NO: 9106468 - DNA, 22 bp, Homo sapiens
aaggaggccctctccttctgga

SEQ ID NO: 9106469 - DNA, 22 bp, Homo sapiens
aaggatttttggaatgagatgg

SEQ ID NO: 9106470 - DNA, 22 bp, Homo sapiens
aaggcaaaagaggtgtcatcac

SEQ ID NO: 9106471 - DNA, 22 bp, Homo sapiens
aaggacaagtagtatttgcatc

SEQ ID NO: 9106472 - DNA, 22 bp, Homo sapiens
aaggacagaaacagattgctgg

SEQ ID NO: 9106473 - DNA, 22 bp, Homo sapiens
aaggacacctgcagagggacca

SEQ ID NO: 9106474 - DNA, 22 bp, Homo sapiens
aaggacaggcacagtggtggag

SEQ ID NO: 9106475 - DNA, 22 bp, Homo sapiens
aaggaagcagccagagaccctc

SEQ ID NO: 9106476 - DNA, 22 bp, Homo sapiens
aaggaagccttgcctgaataca

SEQ ID NO: 9106477 - DNA, 22 bp, Homo sapiens
aaggaagcagcaatgcatgatt

SEQ ID NO: 9106478 - DNA, 22 bp, Homo sapiens
aaggaagcagcaatgcatgatt

SEQ ID NO: 9106479 - DNA, 22 bp, Homo sapiens
aaggaagatgctggcctgggga

SEQ ID NO: 9106480 - DNA, 22 bp, Homo sapiens
aaggaagatgctggcctgggga

SEQ ID NO: 9106481 - DNA, 22 bp, Homo sapiens
aaggaagaatcatcacgttggg

SEQ ID NO: 9106482 - DNA, 22 bp, Homo sapiens
aaggaagctgttagacatgcat

SEQ ID NO: 9106483 - DNA, 22 bp, Homo sapiens
aaggaaggaattgatcatgcgc

SEQ ID NO: 9106484 - DNA, 22 bp, Homo sapiens
aaggaagggaaatagtgatgtc

SEQ ID NO: 9106485 - DNA, 22 bp, Homo sapiens
aaggaagggaaatagtgatgtc

SEQ ID NO: 9106486 - DNA, 22 bp, Homo sapiens
aaggaaggttcatagtcaaaga

SEQ ID NO: 9106487 - DNA, 22 bp, Homo sapiens
aaggaagttttcttggttccta

SEQ ID NO: 9106488 - DNA, 22 bp, Homo sapiens
aaggaaggttcatagtcaaaga

SEQ ID NO: 9106489 - DNA, 22 bp, Homo sapiens
aaggaaggtactcagtgattct

SEQ ID NO: 9106490 - DNA, 22 bp, Homo sapiens
aaggaaggtactcagtgattct

SEQ ID NO: 9106491 - DNA, 22 bp, Homo sapiens
aaggaaggttcatagtcaaaga

SEQ ID NO: 9106492 - DNA, 22 bp, Homo sapiens
aaggaaggttcatagtcaaaga

SEQ ID NO: 9106493 - DNA, 22 bp, Homo sapiens
aaggaaggttcatagtcaaaga

SEQ ID NO: 9106494 - DNA, 22 bp, Homo sapiens
aaggacaaagcagagctggatg

SEQ ID NO: 9106495 - DNA, 22 bp, Homo sapiens
aaggaattccctttctgacaga

SEQ ID NO: 9106496 - DNA, 17 bp, Homo sapiens
aaggaatgtcagaagtt

SEQ ID NO: 9106497 - DNA, 22 bp, Homo sapiens
aagggctggagactgggtcttc

SEQ ID NO: 9106498 - DNA, 22 bp, Homo sapiens
acatttcagtaagtgttaattt

SEQ ID NO: 9106499 - DNA, 22 bp, Homo sapiens
acatttcagattcatgaagtga

SEQ ID NO: 9106500 - DNA, 22 bp, Homo sapiens
acatttcagcgtgcatgacatg

SEQ ID NO: 9106501 - DNA, 22 bp, Homo sapiens
aagggctggccacattctgggt

SEQ ID NO: 9106502 - DNA, 22 bp, Homo sapiens
aagggctggatctctctgagca

SEQ ID NO: 9106503 - DNA, 22 bp, Homo sapiens
aagggatgcaggaaagaaggtt

SEQ ID NO: 9106504 - DNA, 22 bp, Homo sapiens
aagggcagaatagagaagatgg

SEQ ID NO: 9106505 - DNA, 20 bp, Homo sapiens
aagggagaataatgattgta

SEQ ID NO: 9106506 - DNA, 22 bp, Homo sapiens
aagggagacagttgtgtgagga

SEQ ID NO: 9106507 - DNA, 22 bp, Homo sapiens
aagggaggtaaagctatttaaa

SEQ ID NO: 9106508 - DNA, 22 bp, Homo sapiens
aagggaggtaaagctatttaaa

SEQ ID NO: 9106509 - DNA, 22 bp, Homo sapiens
aagggatgcaggaaagaaggtt

SEQ ID NO: 9106510 - DNA, 22 bp, Homo sapiens
aagggaggtaaagctatttaaa

SEQ ID NO: 9106511 - DNA, 22 bp, Homo sapiens
aagggaggggatgtaagcctgg

SEQ ID NO: 9106512 - DNA, 22 bp, Homo sapiens
acatttcagatgtaatgtgatg

SEQ ID NO: 9106513 - DNA, 22 bp, Homo sapiens
acatttcagattcatgaagtga

SEQ ID NO: 9106514 - DNA, 22 bp, Homo sapiens
aagggggccacacctggtgtga

SEQ ID NO: 9106515 - DNA, 22 bp, Homo sapiens
accagagggagacttcctcttc

SEQ ID NO: 9106516 - DNA, 22 bp, Homo sapiens
accagagcttacatgctagaaa

SEQ ID NO: 9106517 - DNA, 20 bp, Homo sapiens
accagaggaaagagcagtga

SEQ ID NO: 9106518 - DNA, 22 bp, Homo sapiens
aaggtaatccataatagttact

SEQ ID NO: 9106519 - DNA, 22 bp, Homo sapiens
aagggtccagcacctcggctcc

SEQ ID NO: 9106520 - DNA, 22 bp, Homo sapiens
aagggtccaaggctttgcgttt

SEQ ID NO: 9106521 - DNA, 19 bp, Homo sapiens
aagggtcacaagcagcaga

SEQ ID NO: 9106522 - DNA, 22 bp, Homo sapiens
aagggtgcaaagcactctagct

SEQ ID NO: 9106523 - DNA, 23 bp, Homo sapiens
aagggtccatagctatcattaca

SEQ ID NO: 9106524 - DNA, 22 bp, Homo sapiens
aagggtggatttctgagctcta

SEQ ID NO: 9106525 - DNA, 21 bp, Homo sapiens
aagtagatcactgttctcttg

SEQ ID NO: 9106526 - DNA, 22 bp, Homo sapiens
aagtagatgatctttctgcata

SEQ ID NO: 9106527 - DNA, 22 bp, Homo sapiens
aagtcatagtcgggaaagacat

SEQ ID NO: 9106528 - DNA, 22 bp, Homo sapiens
aagtatcaaatggtagcatatg

SEQ ID NO: 9106529 - DNA, 22 bp, Homo sapiens
aagtatatactaaatgttaatc

SEQ ID NO: 9106530 - DNA, 22 bp, Homo sapiens
aagtccagtgatactggcagga

SEQ ID NO: 9106531 - DNA, 22 bp, Homo sapiens
aagtccataggtttcatgaggg

SEQ ID NO: 9106532 - DNA, 22 bp, Homo sapiens
aagtccctggttcctagcaaaa

SEQ ID NO: 9106533 - DNA, 22 bp, Homo sapiens
aagtccctggtgctggctgcgc

SEQ ID NO: 9106534 - DNA, 20 bp, Homo sapiens
aagtcctgacctagtctaaa

SEQ ID NO: 9106535 - DNA, 22 bp, Homo sapiens
aagtcctgaagacacagaaaag

SEQ ID NO: 9106536 - DNA, 22 bp, Homo sapiens
aagtcctgaaacttctttctga

SEQ ID NO: 9106537 - DNA, 22 bp, Homo sapiens
aagtcctgccacctataagcct

SEQ ID NO: 9106538 - DNA, 22 bp, Homo sapiens
aagtcctgagaccagaaaatgg

SEQ ID NO: 9106539 - DNA, 22 bp, Homo sapiens
aagtcctgccagcaaatgtata

SEQ ID NO: 9106540 - DNA, 22 bp, Homo sapiens
aagtcctggatattaaattgat

SEQ ID NO: 9106541 - DNA, 22 bp, Homo sapiens
aagtcctgtgctagagacacct

SEQ ID NO: 9106542 - DNA, 22 bp, Homo sapiens
aagtcctgtgtgcttacacttg

SEQ ID NO: 9106543 - DNA, 22 bp, Homo sapiens
aagtcctgggcatttgaacagg

SEQ ID NO: 9106544 - DNA, 22 bp, Homo sapiens
aagtcctgggtgagaactgtcc

SEQ ID NO: 9106545 - DNA, 22 bp, Homo sapiens
acctgcctatggagccacatgg

SEQ ID NO: 9106546 - DNA, 22 bp, Homo sapiens
acctgcctatcagctgcctgct

SEQ ID NO: 9106547 - DNA, 22 bp, Homo sapiens
acctgcctagttggttctgccc

SEQ ID NO: 9106548 - DNA, 22 bp, Homo sapiens
acctgcctagttggttctgccc

SEQ ID NO: 9106549 - DNA, 22 bp, Homo sapiens
acctgcctatcagctgcctgct

SEQ ID NO: 9106550 - DNA, 22 bp, Homo sapiens
acctgcctatcagctgcctgct

SEQ ID NO: 9106551 - DNA, 22 bp, Homo sapiens
acctgcctagttggttctgccc

SEQ ID NO: 9106552 - DNA, 22 bp, Homo sapiens
aagtcctgttcctcatacttcc

SEQ ID NO: 9106553 - DNA, 22 bp, Homo sapiens
aagtccttcccaagcatgtacc

SEQ ID NO: 9106554 - DNA, 22 bp, Homo sapiens
aagtccttggagaatagaaagg

SEQ ID NO: 9106555 - DNA, 22 bp, Homo sapiens
acctctggacactgcatccttc

SEQ ID NO: 9106556 - DNA, 22 bp, Homo sapiens
acctctgcaaccctggaatggg

SEQ ID NO: 9106557 - DNA, 22 bp, Homo sapiens
acctctaaaaaattagaagcct

SEQ ID NO: 9106558 - DNA, 20 bp, Homo sapiens
acctagtacaatctgtttct

SEQ ID NO: 9106559 - DNA, 22 bp, Homo sapiens
acctatttatgcaattatgaaa

SEQ ID NO: 9106560 - DNA, 19 bp, Homo sapiens
acccaggggtttatgtgtg

SEQ ID NO: 9106561 - DNA, 22 bp, Homo sapiens
acccaggggcgaagctggccac

SEQ ID NO: 9106562 - DNA, 22 bp, Homo sapiens
acccaggggcagccttgctgtg

SEQ ID NO: 9106563 - DNA, 22 bp, Homo sapiens
acccagggcttaaggcggtgca

SEQ ID NO: 9106564 - DNA, 21 bp, Homo sapiens
acccaggggaagcagaaactg

SEQ ID NO: 9106565 - DNA, 22 bp, Homo sapiens
acccagggctcaagcgtaggca

SEQ ID NO: 9106566 - DNA, 22 bp, Homo sapiens
acccagggcttaaggcggtgca

SEQ ID NO: 9106567 - DNA, 22 bp, Homo sapiens
acccaggccattggcaagagtc

SEQ ID NO: 9106568 - DNA, 22 bp, Homo sapiens
acccagggagtgctcctgttct

SEQ ID NO: 9106569 - DNA, 22 bp, Homo sapiens
acccagggccacagcccgcagt

SEQ ID NO: 9106570 - DNA, 22 bp, Homo sapiens
acccagggctcaagcgtaggca

SEQ ID NO: 9106571 - DNA, 22 bp, Homo sapiens
acccagggcagccagcggggag

SEQ ID NO: 9106572 - DNA, 22 bp, Homo sapiens
acccagggcagccagcggggag

SEQ ID NO: 9106573 - DNA, 22 bp, Homo sapiens
acaatattgtacccagaagttt

SEQ ID NO: 9106574 - DNA, 20 bp, Homo sapiens
acaatatgtagatgaatagc

SEQ ID NO: 9106575 - DNA, 22 bp, Homo sapiens
acaatatgggatatacatttta

SEQ ID NO: 9106576 - DNA, 22 bp, Homo sapiens
acaatatacacatcctaatggg

SEQ ID NO: 9106577 - DNA, 22 bp, Homo sapiens
acaatatagtccatgagcatgc

SEQ ID NO: 9106578 - DNA, 22 bp, Homo sapiens
acaatgtcaaaataggaaacat

SEQ ID NO: 9106579 - DNA, 23 bp, Homo sapiens
acaatgtctgttcataaaatacc

SEQ ID NO: 9106580 - DNA, 22 bp, Homo sapiens
acaatgtctcatattcgtgttc

SEQ ID NO: 9106581 - DNA, 22 bp, Homo sapiens
acaatgtcacctctcatgtttt

SEQ ID NO: 9106582 - DNA, 22 bp, Homo sapiens
acaaatttcataggcaaatttt

SEQ ID NO: 9106583 - DNA, 22 bp, Homo sapiens
acaaatttcataggcaaatttt

SEQ ID NO: 9106584 - DNA, 22 bp, Homo sapiens
acaaattgttgggactcagccc

SEQ ID NO: 9106585 - DNA, 21 bp, Homo sapiens
acaaattgtttatataggaag

SEQ ID NO: 9106586 - DNA, 22 bp, Homo sapiens
acaaatttgtgtagttatggca

SEQ ID NO: 9106587 - DNA, 22 bp, Homo sapiens
acaaatttgtgtagttatggca

SEQ ID NO: 9106588 - DNA, 22 bp, Homo sapiens
acaaatttgtgtagttatggca

SEQ ID NO: 9106589 - DNA, 22 bp, Homo sapiens
acaacaaaatcactagtcttcc

SEQ ID NO: 9106590 - DNA, 22 bp, Homo sapiens
acaaatttgaatcctgacttct

SEQ ID NO: 9106591 - DNA, 22 bp, Homo sapiens
acaacaaaatcactagtcttcc

SEQ ID NO: 9106592 - DNA, 22 bp, Homo sapiens
acaacaaaatcactagtcttcc

SEQ ID NO: 9106593 - DNA, 22 bp, Homo sapiens
acaacaaaatcactagtcttcc

SEQ ID NO: 9106594 - DNA, 22 bp, Homo sapiens
acaaggcttatagttgcttttt

SEQ ID NO: 9106595 - DNA, 22 bp, Homo sapiens
acaaggcttcacacagtatgaa

SEQ ID NO: 9106596 - DNA, 22 bp, Homo sapiens
acaatagagttctcataggaca

SEQ ID NO: 9106597 - DNA, 22 bp, Homo sapiens
aagatacaaatgtcaatattgg

SEQ ID NO: 9106598 - DNA, 22 bp, Homo sapiens
aagataatattcattaactaga

SEQ ID NO: 9106599 - DNA, 22 bp, Homo sapiens
aagataatgtgtctgtctttgc

SEQ ID NO: 9106600 - DNA, 22 bp, Homo sapiens
aagagtttccagttgtggctca

SEQ ID NO: 9106601 - DNA, 17 bp, Homo sapiens
acacagccaggttctcc

SEQ ID NO: 9106602 - DNA, 17 bp, Homo sapiens
acacagccaggttctcc

SEQ ID NO: 9106603 - DNA, 17 bp, Homo sapiens
acacagccaggttctcc

SEQ ID NO: 9106604 - DNA, 22 bp, Homo sapiens
acacagccagggtagtaaggct

SEQ ID NO: 9106605 - DNA, 22 bp, Homo sapiens
acacagcaaggtctgactttgg

SEQ ID NO: 9106606 - DNA, 22 bp, Homo sapiens
acacagctagtgagtggcagag

SEQ ID NO: 9106607 - DNA, 22 bp, Homo sapiens
acacagagccaaaccatatcac

SEQ ID NO: 9106608 - DNA, 22 bp, Homo sapiens
acacagagccagggaatacagt

SEQ ID NO: 9106609 - DNA, 22 bp, Homo sapiens
acacagagcaaatcatgacaga

SEQ ID NO: 9106610 - DNA, 22 bp, Homo sapiens
acacagagcaaatcatgacaga

SEQ ID NO: 9106611 - DNA, 22 bp, Homo sapiens
acacagagctggaactgcttca

SEQ ID NO: 9106612 - DNA, 22 bp, Homo sapiens
acacagagctggaactgcttca

SEQ ID NO: 9106613 - DNA, 22 bp, Homo sapiens
acacagagctggaactgcttca

SEQ ID NO: 9106614 - DNA, 22 bp, Homo sapiens
acacagagctggaactgcttca

SEQ ID NO: 9106615 - DNA, 17 bp, Homo sapiens
acacagagattaacaca

SEQ ID NO: 9106616 - DNA, 17 bp, Homo sapiens
acacagacaggcagaca

SEQ ID NO: 9106617 - DNA, 22 bp, Homo sapiens
acacagaagctttttctattcc

SEQ ID NO: 9106618 - DNA, 17 bp, Homo sapiens
acacagacaggcagaca

SEQ ID NO: 9106619 - DNA, 22 bp, Homo sapiens
acaatgttctacatatacataa

SEQ ID NO: 9106620 - DNA, 22 bp, Homo sapiens
acaatgttctacatatacataa

SEQ ID NO: 9106621 - DNA, 22 bp, Homo sapiens
acacagaagctttttctattcc

SEQ ID NO: 9106622 - DNA, 22 bp, Homo sapiens
acacagaagctttttctattcc

SEQ ID NO: 9106623 - DNA, 22 bp, Homo sapiens
acacagaagatctcttaatgct

SEQ ID NO: 9106624 - DNA, 22 bp, Homo sapiens
aagaacattttgtagaatgaca

SEQ ID NO: 9106625 - DNA, 22 bp, Homo sapiens
aagaacattttgtagaatgaca

SEQ ID NO: 9106626 - DNA, 22 bp, Homo sapiens
aagaacatttatgatggcattt

SEQ ID NO: 9106627 - DNA, 22 bp, Homo sapiens
aagaacatttatgatggcattt

SEQ ID NO: 9106628 - DNA, 22 bp, Homo sapiens
aagaacattttgtagaatgaca

SEQ ID NO: 9106629 - DNA, 22 bp, Homo sapiens
aagaacattttgtagaatgaca

SEQ ID NO: 9106630 - DNA, 22 bp, Homo sapiens
aatgtacaagggttccagtttt

SEQ ID NO: 9106631 - DNA, 22 bp, Homo sapiens
aatgtacaataagacaaagagg

SEQ ID NO: 9106632 - DNA, 22 bp, Homo sapiens
aatgtacaataagacaaagagg

SEQ ID NO: 9106633 - DNA, 22 bp, Homo sapiens
aagaacattgactaagaggggc

SEQ ID NO: 9106634 - DNA, 22 bp, Homo sapiens
aagaacattgactaagaggggc

SEQ ID NO: 9106635 - DNA, 22 bp, Homo sapiens
aagaacaggttctagaaccatt

SEQ ID NO: 9106636 - DNA, 22 bp, Homo sapiens
aagaacaggttctagaaccatt

SEQ ID NO: 9106637 - DNA, 22 bp, Homo sapiens
aagaagagaaatgtgctgctgg

SEQ ID NO: 9106638 - DNA, 22 bp, Homo sapiens
aagaagaagtgttatttttaga

SEQ ID NO: 9106639 - DNA, 22 bp, Homo sapiens
aagaagaattattccctaatca

SEQ ID NO: 9106640 - DNA, 22 bp, Homo sapiens
aagaactgtatcaagatgtagt

SEQ ID NO: 9106641 - DNA, 22 bp, Homo sapiens
aagaactgtgctccaggctcca

SEQ ID NO: 9106642 - DNA, 22 bp, Homo sapiens
aagaacttcctaatatattttc

SEQ ID NO: 9106643 - DNA, 22 bp, Homo sapiens
acaaaaagggagatgaggtaga

SEQ ID NO: 9106644 - DNA, 22 bp, Homo sapiens
acaaaacagtgttcctgcccct

SEQ ID NO: 9106645 - DNA, 19 bp, Homo sapiens
aagaagcaataagctgtga

SEQ ID NO: 9106646 - DNA, 22 bp, Homo sapiens
aattttatctctaagcaggctt

SEQ ID NO: 9106647 - DNA, 22 bp, Homo sapiens
aagaagatggttaactttcagt

SEQ ID NO: 9106648 - DNA, 22 bp, Homo sapiens
aagaagagaactggcatcctaa

SEQ ID NO: 9106649 - DNA, 19 bp, Homo sapiens
aagaagcaataagctgtga

SEQ ID NO: 9106650 - DNA, 22 bp, Homo sapiens
acaaatccagtgaactccagtg

SEQ ID NO: 9106651 - DNA, 22 bp, Homo sapiens
acaaatgaacatataagcttga

SEQ ID NO: 9106652 - DNA, 22 bp, Homo sapiens
acaaatgaacatataagcttga

SEQ ID NO: 9106653 - DNA, 22 bp, Homo sapiens
acaaatgaacctgaaatctcag

SEQ ID NO: 9106654 - DNA, 22 bp, Homo sapiens
acaaatgactatttggtacagg

SEQ ID NO: 9106655 - DNA, 22 bp, Homo sapiens
acaaatgaatcatacataatgt

SEQ ID NO: 9106656 - DNA, 22 bp, Homo sapiens
acaaatgaatcatacataatgt

SEQ ID NO: 9106657 - DNA, 22 bp, Homo sapiens
acaaatgaatcatacataatgt

SEQ ID NO: 9106658 - DNA, 22 bp, Homo sapiens
aagaatctccatctgattcact

SEQ ID NO: 9106659 - DNA, 22 bp, Homo sapiens
acaaagctagagaagagaattg

SEQ ID NO: 9106660 - DNA, 22 bp, Homo sapiens
aagaatcattgtaaagttctgt

SEQ ID NO: 9106661 - DNA, 22 bp, Homo sapiens
acaaatatttactgaatccact

SEQ ID NO: 9106662 - DNA, 22 bp, Homo sapiens
acaaatatttactgaatccact

SEQ ID NO: 9106663 - DNA, 22 bp, Homo sapiens
acaaagctagagaagagaattg

SEQ ID NO: 9106664 - DNA, 21 bp, Homo sapiens
acaaaagaagctgccttttaa

SEQ ID NO: 9106665 - DNA, 22 bp, Homo sapiens
acaaaagaataagatgagtcat

SEQ ID NO: 9106666 - DNA, 22 bp, Homo sapiens
acaaaacagtgttcctgcccct

SEQ ID NO: 9106667 - DNA, 22 bp, Homo sapiens
acaaaagaataagatgagtcat

SEQ ID NO: 9106668 - DNA, 22 bp, Homo sapiens
acaaaagtgagtgtgtctcaga

SEQ ID NO: 9106669 - DNA, 22 bp, Homo sapiens
acaaaagtgagtgtgtctcaga

SEQ ID NO: 9106670 - DNA, 22 bp, Homo sapiens
acaaaagtgtaggaattcctta

SEQ ID NO: 9106671 - DNA, 22 bp, Homo sapiens
acaaaagtgtaggaattcctta

SEQ ID NO: 9106672 - DNA, 22 bp, Homo sapiens
acaaaagtgtaggaattcctta

SEQ ID NO: 9106673 - DNA, 22 bp, Homo sapiens
aagaatatctgttttatttagg

SEQ ID NO: 9106674 - DNA, 22 bp, Homo sapiens
aagaatcatctgaactttgagg

SEQ ID NO: 9106675 - DNA, 22 bp, Homo sapiens
aagaatcatcctgcaagagtct

SEQ ID NO: 9106676 - DNA, 17 bp, Homo sapiens
aagaatcattagagaag

SEQ ID NO: 9106677 - DNA, 17 bp, Homo sapiens
aagaatcattagagaag

SEQ ID NO: 9106678 - DNA, 23 bp, Homo sapiens
aagaatcagtaagtaaggagacc

SEQ ID NO: 9106679 - DNA, 23 bp, Homo sapiens
aagaatcagtaagtaaggagacc

SEQ ID NO: 9106680 - DNA, 22 bp, Homo sapiens
aagaatcatagagccactgata

SEQ ID NO: 9106681 - DNA, 22 bp, Homo sapiens
acagcagggggagctgttggac

SEQ ID NO: 9106682 - DNA, 22 bp, Homo sapiens
acagcagggggagctgttggac

SEQ ID NO: 9106683 - DNA, 22 bp, Homo sapiens
acagcagggggagctgttggac

SEQ ID NO: 9106684 - DNA, 22 bp, Homo sapiens
acagcaggaagctggagggaaa

SEQ ID NO: 9106685 - DNA, 22 bp, Homo sapiens
aagcataaaacgttacaacatg

SEQ ID NO: 9106686 - DNA, 22 bp, Homo sapiens
aagcagtgcgctcatctaaggg

SEQ ID NO: 9106687 - DNA, 20 bp, Homo sapiens
aagcagtgaggtgaggagtg

SEQ ID NO: 9106688 - DNA, 21 bp, Homo sapiens
aagcaggacatatgatgccct

SEQ ID NO: 9106689 - DNA, 22 bp, Homo sapiens
aagcaggctagattgaagggct

SEQ ID NO: 9106690 - DNA, 22 bp, Homo sapiens
acagagcaattcttgggtgttt

SEQ ID NO: 9106691 - DNA, 21 bp, Homo sapiens
aagcaggacatatgatgccct

SEQ ID NO: 9106692 - DNA, 21 bp, Homo sapiens
aagcagggactgcccaggtcc

SEQ ID NO: 9106693 - DNA, 22 bp, Homo sapiens
aagcagggagaaatttttcttc

SEQ ID NO: 9106694 - DNA, 21 bp, Homo sapiens
aagcaggctgtaatcatgtgg

SEQ ID NO: 9106695 - DNA, 21 bp, Homo sapiens
aagcaggctgtaatcatgtgg

SEQ ID NO: 9106696 - DNA, 22 bp, Homo sapiens
aagcaggcttggtgtggccgct

SEQ ID NO: 9106697 - DNA, 22 bp, Homo sapiens
aagcaggctcacgccaggcagt

SEQ ID NO: 9106698 - DNA, 22 bp, Homo sapiens
aagcaggttatgaaatatagaa

SEQ ID NO: 9106699 - DNA, 22 bp, Homo sapiens
aagcaggtgtgagccagtgggc

SEQ ID NO: 9106700 - DNA, 22 bp, Homo sapiens
aagcaggttacatacattatct

SEQ ID NO: 9106701 - DNA, 22 bp, Homo sapiens
aagcagggtgtcttgacccatg

SEQ ID NO: 9106702 - DNA, 23 bp, Homo sapiens
aagcagggagattcttagctgag

SEQ ID NO: 9106703 - DNA, 22 bp, Homo sapiens
acagcaggttacagtggcacag

SEQ ID NO: 9106704 - DNA, 19 bp, Homo sapiens
acagcaggtgtggggataa

SEQ ID NO: 9106705 - DNA, 22 bp, Homo sapiens
acagccaggaattctggagaag

SEQ ID NO: 9106706 - DNA, 22 bp, Homo sapiens
acagccaggacttggccctctt

SEQ ID NO: 9106707 - DNA, 22 bp, Homo sapiens
acagccagcagagctgtttcct

SEQ ID NO: 9106708 - DNA, 22 bp, Homo sapiens
acagccaggaattctggagaag

SEQ ID NO: 9106709 - DNA, 21 bp, Homo sapiens
acagccaggaacatgaggggc

SEQ ID NO: 9106710 - DNA, 21 bp, Homo sapiens
acagccaggaacatgaggggc

SEQ ID NO: 9106711 - DNA, 22 bp, Homo sapiens
acagccaggagccatgggcagg

SEQ ID NO: 9106712 - DNA, 22 bp, Homo sapiens
acagccaggagccatgggcagg

SEQ ID NO: 9106713 - DNA, 22 bp, Homo sapiens
acagccaggagccatgggcagg

SEQ ID NO: 9106714 - DNA, 22 bp, Homo sapiens
acagccaggcccagcacgcagg

SEQ ID NO: 9106715 - DNA, 22 bp, Homo sapiens
aagcccagatgtgagaactgag

SEQ ID NO: 9106716 - DNA, 22 bp, Homo sapiens
aagcccagatgtgagaactgag

SEQ ID NO: 9106717 - DNA, 22 bp, Homo sapiens
acagccaggcccagcacgcagg

SEQ ID NO: 9106718 - DNA, 22 bp, Homo sapiens
aagccaggttccatggaggagc

SEQ ID NO: 9106719 - DNA, 22 bp, Homo sapiens
aagccctcagagcctctttgac

SEQ ID NO: 9106720 - DNA, 22 bp, Homo sapiens
aagccctcatccccatgggcgt

SEQ ID NO: 9106721 - DNA, 22 bp, Homo sapiens
aagccctgacctgagagtccgt

SEQ ID NO: 9106722 - DNA, 22 bp, Homo sapiens
aagccctcattagccatagccc

SEQ ID NO: 9106723 - DNA, 22 bp, Homo sapiens
aagccctccgtacgtgctagct

SEQ ID NO: 9106724 - DNA, 23 bp, Homo sapiens
aagccctgaaggtttcaggccct

SEQ ID NO: 9106725 - DNA, 23 bp, Homo sapiens
aagccctgaaggtttcaggccct

SEQ ID NO: 9106726 - DNA, 22 bp, Homo sapiens
aagcccagcatccctgcaccag

SEQ ID NO: 9106727 - DNA, 22 bp, Homo sapiens
aagcccagctgaaagcattttt

SEQ ID NO: 9106728 - DNA, 22 bp, Homo sapiens
aagcccagctgaaagcattttt

SEQ ID NO: 9106729 - DNA, 22 bp, Homo sapiens
aagcccaggtaagtggctcatg

SEQ ID NO: 9106730 - DNA, 22 bp, Homo sapiens
aagcccataaaaagaggtccct

SEQ ID NO: 9106731 - DNA, 19 bp, Homo sapiens
aagcccagtgtatgctctt

SEQ ID NO: 9106732 - DNA, 22 bp, Homo sapiens
aagcccagtaccttcagtgagg

SEQ ID NO: 9106733 - DNA, 22 bp, Homo sapiens
acagaaatgatgtttggcaata

SEQ ID NO: 9106734 - DNA, 23 bp, Homo sapiens
acagacaacactgatgagagaaa

SEQ ID NO: 9106735 - DNA, 23 bp, Homo sapiens
acagaaatcatttgtaaggtacc

SEQ ID NO: 9106736 - DNA, 23 bp, Homo sapiens
acagaaatcatttgtaaggtacc

SEQ ID NO: 9106737 - DNA, 23 bp, Homo sapiens
acagacattgtacatcttgtttt

SEQ ID NO: 9106738 - DNA, 23 bp, Homo sapiens
acagacattccataatgtacacc

SEQ ID NO: 9106739 - DNA, 22 bp, Homo sapiens
acagacatttaataaatgctga

SEQ ID NO: 9106740 - DNA, 19 bp, Homo sapiens
acagacatttgcaattagc

SEQ ID NO: 9106741 - DNA, 22 bp, Homo sapiens
acagacattttaattattaaat

SEQ ID NO: 9106742 - DNA, 22 bp, Homo sapiens
acagacattttaattattaaat

SEQ ID NO: 9106743 - DNA, 22 bp, Homo sapiens
acagacattttaagacacttta

SEQ ID NO: 9106744 - DNA, 22 bp, Homo sapiens
acagaccaagtttccagcaggt

SEQ ID NO: 9106745 - DNA, 22 bp, Homo sapiens
acagaccaaaaaaggatattgg

SEQ ID NO: 9106746 - DNA, 22 bp, Homo sapiens
acagacattttctgtattgcct

SEQ ID NO: 9106747 - DNA, 22 bp, Homo sapiens
acagagatcagaggcataagca

SEQ ID NO: 9106748 - DNA, 23 bp, Homo sapiens
acagagatcttgacttgtatgga

SEQ ID NO: 9106749 - DNA, 20 bp, Homo sapiens
acagagatcagctgatgggc

SEQ ID NO: 9106750 - DNA, 20 bp, Homo sapiens
acagagatcagctgatgggc

SEQ ID NO: 9106751 - DNA, 20 bp, Homo sapiens
acagagatcctctctttatc

SEQ ID NO: 9106752 - DNA, 22 bp, Homo sapiens
acagagatgggaacattcaggt

SEQ ID NO: 9106753 - DNA, 22 bp, Homo sapiens
acagagatggcttttcagaggc

SEQ ID NO: 9106754 - DNA, 22 bp, Homo sapiens
acagagatggcacagagaaggt

SEQ ID NO: 9106755 - DNA, 22 bp, Homo sapiens
acagagatgagtcaacacagct

SEQ ID NO: 9106756 - DNA, 22 bp, Homo sapiens
acagagatgtggatgagggatt

SEQ ID NO: 9106757 - DNA, 22 bp, Homo sapiens
acagagatgtcagattggcagc

SEQ ID NO: 9106758 - DNA, 22 bp, Homo sapiens
acagagcaacttgagtatcctc

SEQ ID NO: 9106759 - DNA, 22 bp, Homo sapiens
acagagcaataacagggagagg

SEQ ID NO: 9106760 - DNA, 22 bp, Homo sapiens
acacttgccatgctgcacactg

SEQ ID NO: 9106761 - DNA, 20 bp, Homo sapiens
acagaaagctgccttgtccc

SEQ ID NO: 9106762 - DNA, 20 bp, Homo sapiens
acagaaagctgccttgtccc

SEQ ID NO: 9106763 - DNA, 23 bp, Homo sapiens
acagaaagttctgctggacagag

SEQ ID NO: 9106764 - DNA, 18 bp, Homo sapiens
acacttcctggtggtgtg

SEQ ID NO: 9106765 - DNA, 22 bp, Homo sapiens
acacttcatttacattataggc

SEQ ID NO: 9106766 - DNA, 21 bp, Homo sapiens
acacttcagtttttaaaggga

SEQ ID NO: 9106767 - DNA, 22 bp, Homo sapiens
acacttcagctccacaaacatt

SEQ ID NO: 9106768 - DNA, 22 bp, Homo sapiens
acacttcaggactctggggcaa

SEQ ID NO: 9106769 - DNA, 22 bp, Homo sapiens
acacataagcctaatcatctcc

SEQ ID NO: 9106770 - DNA, 22 bp, Homo sapiens
acacataagcctaatcatctcc

SEQ ID NO: 9106771 - DNA, 22 bp, Homo sapiens
acacataagcctaatcatctcc

SEQ ID NO: 9106772 - DNA, 22 bp, Homo sapiens
aagatacagtgaaagggcattg

SEQ ID NO: 9106773 - DNA, 23 bp, Homo sapiens
aagatacaggtgtggaatggttt

SEQ ID NO: 9106774 - DNA, 22 bp, Homo sapiens
aagatacagacagagccaaaat

SEQ ID NO: 9106775 - DNA, 22 bp, Homo sapiens
acacatataccactgtaaatga

SEQ ID NO: 9106776 - DNA, 20 bp, Homo sapiens
acacatagataagaagctga

SEQ ID NO: 9106777 - DNA, 22 bp, Homo sapiens
acacatagaaaataaatagtta

SEQ ID NO: 9106778 - DNA, 22 bp, Homo sapiens
acacatataccactgtaaatga

SEQ ID NO: 9106779 - DNA, 22 bp, Homo sapiens
acacatatatacatatttgtgc

SEQ ID NO: 9106780 - DNA, 23 bp, Homo sapiens
acactggttagctaaagttagag

SEQ ID NO: 9106781 - DNA, 22 bp, Homo sapiens
acactggttctcaagactaggt

SEQ ID NO: 9106782 - DNA, 20 bp, Homo sapiens
acacatatagcagcataaac

SEQ ID NO: 9106783 - DNA, 22 bp, Homo sapiens
aaggagaagggtaatcaacaca

SEQ ID NO: 9106784 - DNA, 22 bp, Homo sapiens
aaggagaagggtaatcaacaca

SEQ ID NO: 9106785 - DNA, 16 bp, Homo sapiens
aaggagggaagagaat

SEQ ID NO: 9106786 - DNA, 22 bp, Homo sapiens
aaatggcaacagaagggagttc

SEQ ID NO: 9106787 - DNA, 22 bp, Homo sapiens
aaatggcaatttagtttattta

SEQ ID NO: 9106788 - DNA, 22 bp, Homo sapiens
aaggagaagggtaatcaacaca

SEQ ID NO: 9106789 - DNA, 22 bp, Homo sapiens
aaatggagttctaagtatagta

SEQ ID NO: 9106790 - DNA, 21 bp, Homo sapiens
aaatggatagggcaatggaag

SEQ ID NO: 9106791 - DNA, 22 bp, Homo sapiens
aaatggatctttttataatgca

SEQ ID NO: 9106792 - DNA, 22 bp, Homo sapiens
aaatggaatgtgtttataattc

SEQ ID NO: 9106793 - DNA, 22 bp, Homo sapiens
aaatggacattgggtgagctct

SEQ ID NO: 9106794 - DNA, 22 bp, Homo sapiens
aaatggaagtgtatttagtgtt

SEQ ID NO: 9106795 - DNA, 22 bp, Homo sapiens
aaatggaagctatttatgattc

SEQ ID NO: 9106796 - DNA, 22 bp, Homo sapiens
aaatggaactgttgtgcatttg

SEQ ID NO: 9106797 - DNA, 22 bp, Homo sapiens
aaatggaagaagtgcaatactg

SEQ ID NO: 9106798 - DNA, 22 bp, Homo sapiens
aaatggaagaagtgcaatactg

SEQ ID NO: 9106799 - DNA, 22 bp, Homo sapiens
aaggagtctgggccattcagag

SEQ ID NO: 9106800 - DNA, 22 bp, Homo sapiens
aaggagtctgggccattcagag

SEQ ID NO: 9106801 - DNA, 22 bp, Homo sapiens
aaggatacttttagagcctgag

SEQ ID NO: 9106802 - DNA, 22 bp, Homo sapiens
aaggataaaaaccacttctaat

SEQ ID NO: 9106803 - DNA, 22 bp, Homo sapiens
aaggagtgctgaaaggaagcgg

SEQ ID NO: 9106804 - DNA, 22 bp, Homo sapiens
aaggagtggggcatatcacaga

SEQ ID NO: 9106805 - DNA, 22 bp, Homo sapiens
aaggcactgactgtgcagggga

SEQ ID NO: 9106806 - DNA, 22 bp, Homo sapiens
aaggcactgaaaaattgtgtgt

SEQ ID NO: 9106807 - DNA, 22 bp, Homo sapiens
aaggcactcattcaaggagata

SEQ ID NO: 9106808 - DNA, 20 bp, Homo sapiens
aaggcactatgtctgctagc

SEQ ID NO: 9106809 - DNA, 22 bp, Homo sapiens
aaggcccacagaactgtctcca

SEQ ID NO: 9106810 - DNA, 22 bp, Homo sapiens
aaggccatgcttgagttgaagg

SEQ ID NO: 9106811 - DNA, 22 bp, Homo sapiens
aaggccatgcacatcctaggca

SEQ ID NO: 9106812 - DNA, 22 bp, Homo sapiens
aaggccatacaatgaaaggggc

SEQ ID NO: 9106813 - DNA, 22 bp, Homo sapiens
aaggctgaattcaagggtaggc

SEQ ID NO: 9106814 - DNA, 22 bp, Homo sapiens
aaggcccttccaccagtcctcg

SEQ ID NO: 9106815 - DNA, 22 bp, Homo sapiens
aaggcccttccaccagtcctcg

SEQ ID NO: 9106816 - DNA, 22 bp, Homo sapiens
aaggccctggccccagcttctt

SEQ ID NO: 9106817 - DNA, 18 bp, Homo sapiens
aaggccctgagcatatgc

SEQ ID NO: 9106818 - DNA, 22 bp, Homo sapiens
aaggccctggcaggaagcagga

SEQ ID NO: 9106819 - DNA, 22 bp, Homo sapiens
aaggccctggccccagcttctt

SEQ ID NO: 9106820 - DNA, 22 bp, Homo sapiens
aaggccctaatagagcacatat

SEQ ID NO: 9106821 - DNA, 22 bp, Homo sapiens
aaggccctaatagagcacatat

SEQ ID NO: 9106822 - DNA, 22 bp, Homo sapiens
aaggcccagcgtgacctcagtg

SEQ ID NO: 9106823 - DNA, 22 bp, Homo sapiens
aagggaggccagaggttttgca

SEQ ID NO: 9106824 - DNA, 22 bp, Homo sapiens
aagggaggggatgtaagcctgg

SEQ ID NO: 9106825 - DNA, 22 bp, Homo sapiens
aaggctgagagtcacagtccta

SEQ ID NO: 9106826 - DNA, 22 bp, Homo sapiens
aaggctgagagtcacagtccta

SEQ ID NO: 9106827 - DNA, 22 bp, Homo sapiens
aaggctgagagtcacagtccta

SEQ ID NO: 9106828 - DNA, 22 bp, Homo sapiens
aaggctgagacagcacaggtcc

SEQ ID NO: 9106829 - DNA, 22 bp, Homo sapiens
aaggctgagacagcacaggtcc

SEQ ID NO: 9106830 - DNA, 22 bp, Homo sapiens
aaggctgacgtttgtgtttatt

SEQ ID NO: 9106831 - DNA, 21 bp, Homo sapiens
aaggctgagacaactcaggag

SEQ ID NO: 9106832 - DNA, 22 bp, Homo sapiens
aaggctgactcaacagggggcc

SEQ ID NO: 9106833 - DNA, 22 bp, Homo sapiens
aaggcccttccaccagtcctcg

SEQ ID NO: 9106834 - DNA, 22 bp, Homo sapiens
aaggctgaccagtttacacttt

SEQ ID NO: 9106835 - DNA, 22 bp, Homo sapiens
aagggcaggaaaagatggatgt

SEQ ID NO: 9106836 - DNA, 22 bp, Homo sapiens
aagggaggggatgtaagcctgg

SEQ ID NO: 9106837 - DNA, 22 bp, Homo sapiens
aagggcaggagaagacggatat

SEQ ID NO: 9106838 - DNA, 22 bp, Homo sapiens
aagggcaggcacccaccctcac

SEQ ID NO: 9106839 - DNA, 22 bp, Homo sapiens
aagggcaggcagagatcatata

SEQ ID NO: 9106840 - DNA, 22 bp, Homo sapiens
aagtacaacgcatacagagaaa

SEQ ID NO: 9106841 - DNA, 22 bp, Homo sapiens
aagtccaggtcctcattccatc

SEQ ID NO: 9106842 - DNA, 22 bp, Homo sapiens
aagtccagtgatactggcagga

SEQ ID NO: 9106843 - DNA, 22 bp, Homo sapiens
aaggttaaataggtattttcca

SEQ ID NO: 9106844 - DNA, 22 bp, Homo sapiens
aagtaacttatttgcaaacagg

SEQ ID NO: 9106845 - DNA, 22 bp, Homo sapiens
aagtaactaaagatatccattt

SEQ ID NO: 9106846 - DNA, 22 bp, Homo sapiens
aaggtgtgaactgattcattgg

SEQ ID NO: 9106847 - DNA, 21 bp, Homo sapiens
aaggtctgtaaagtgacagga

SEQ ID NO: 9106848 - DNA, 22 bp, Homo sapiens
aaggtctggatgatgggtgtgc

SEQ ID NO: 9106849 - DNA, 22 bp, Homo sapiens
aaggtctgtattagagtttcat

SEQ ID NO: 9106850 - DNA, 22 bp, Homo sapiens
aagggcaggtgggcatttctgg

SEQ ID NO: 9106851 - DNA, 22 bp, Homo sapiens
aagtcttttgctaagagtaatg

SEQ ID NO: 9106852 - DNA, 22 bp, Homo sapiens
aagtgaaacatgtatctcttta

SEQ ID NO: 9106853 - DNA, 22 bp, Homo sapiens
aagtctttttgaatctataact

SEQ ID NO: 9106854 - DNA, 22 bp, Homo sapiens
aagtgcattagatagaatgatg

SEQ ID NO: 9106855 - DNA, 22 bp, Homo sapiens
aagtgcctgggcaacatagcaa

SEQ ID NO: 9106856 - DNA, 22 bp, Homo sapiens
aagtgctcagggaacatttgtt

SEQ ID NO: 9106857 - DNA, 22 bp, Homo sapiens
aacagtaagagatgttttatct

SEQ ID NO: 9106858 - DNA, 22 bp, Homo sapiens
aacagtgctgattattttacct

SEQ ID NO: 9106859 - DNA, 22 bp, Homo sapiens
aacagtaaagacagaatttatc

SEQ ID NO: 9106860 - DNA, 22 bp, Homo sapiens
aacagttacccttaagatcttt

SEQ ID NO: 9106861 - DNA, 22 bp, Homo sapiens
aacagttatctcacatatggaa

SEQ ID NO: 9106862 - DNA, 22 bp, Homo sapiens
aacagtgcttcattcacacatt

SEQ ID NO: 9106863 - DNA, 22 bp, Homo sapiens
aacagtgtgtacacatcatagg

SEQ ID NO: 9106864 - DNA, 22 bp, Homo sapiens
aacagtgttctagggtgtggct

SEQ ID NO: 9106865 - DNA, 22 bp, Homo sapiens
aacagtgtgttttgttattaag

SEQ ID NO: 9106866 - DNA, 22 bp, Homo sapiens
aacagtgtcaggattacagata

SEQ ID NO: 9106867 - DNA, 22 bp, Homo sapiens
aacagtgtctgtggttaaaggt

SEQ ID NO: 9106868 - DNA, 22 bp, Homo sapiens
aatgcataatggtttgtgacaa

SEQ ID NO: 9106869 - DNA, 22 bp, Homo sapiens
aatgctttaattgcatgtagtg

SEQ ID NO: 9106870 - DNA, 22 bp, Homo sapiens
aatgtaacagcaacaacaatgg

SEQ ID NO: 9106871 - DNA, 22 bp, Homo sapiens
aatgtacaaaagtcagccaact

SEQ ID NO: 9106872 - DNA, 22 bp, Homo sapiens
aatgtacaaaagtcagccaact

SEQ ID NO: 9106873 - DNA, 22 bp, Homo sapiens
aatgtacaaaccttctttgtag

SEQ ID NO: 9106874 - DNA, 22 bp, Homo sapiens
aatgtacaaaccttctttgtag

SEQ ID NO: 9106875 - DNA, 22 bp, Homo sapiens
aatgtaaacagcaagagaaggg

SEQ ID NO: 9106876 - DNA, 22 bp, Homo sapiens
aactttacttgaaagaacatgt

SEQ ID NO: 9106877 - DNA, 22 bp, Homo sapiens
aactttacttgaaagaacatgt

SEQ ID NO: 9106878 - DNA, 22 bp, Homo sapiens
aatgtaaagttgggcacaaatg

SEQ ID NO: 9106879 - DNA, 22 bp, Homo sapiens
aatgtaaagttgggcacaaatg

SEQ ID NO: 9106880 - DNA, 22 bp, Homo sapiens
aactttacactgctttacatga

SEQ ID NO: 9106881 - DNA, 23 bp, Homo sapiens
aactttactattttgaataatgc

SEQ ID NO: 9106882 - DNA, 23 bp, Homo sapiens
aactttactattttgaataatgc

SEQ ID NO: 9106883 - DNA, 22 bp, Homo sapiens
aacttgtttcttccattcaaca

SEQ ID NO: 9106884 - DNA, 20 bp, Homo sapiens
aacttgttttgttttctaat

SEQ ID NO: 9106885 - DNA, 21 bp, Homo sapiens
aacttgtatttctccttattc

SEQ ID NO: 9106886 - DNA, 22 bp, Homo sapiens
aatgaaatgaagatatgatcag

SEQ ID NO: 9106887 - DNA, 18 bp, Homo sapiens
aatgaaatgtacaccttt

SEQ ID NO: 9106888 - DNA, 22 bp, Homo sapiens
aatgaaatgaagatatgatcag

SEQ ID NO: 9106889 - DNA, 21 bp, Homo sapiens
aatgatgaaagatgacagagt

SEQ ID NO: 9106890 - DNA, 22 bp, Homo sapiens
aatgatgaactcagagggaacc

SEQ ID NO: 9106891 - DNA, 22 bp, Homo sapiens
aatgcacatgccacatgtggta

SEQ ID NO: 9106892 - DNA, 19 bp, Homo sapiens
aatgcagagtgtggtcttt

SEQ ID NO: 9106893 - DNA, 22 bp, Homo sapiens
aatgcagagtaaatatttaatt

SEQ ID NO: 9106894 - DNA, 22 bp, Homo sapiens
aatgcagagtaaatatttaatt

SEQ ID NO: 9106895 - DNA, 22 bp, Homo sapiens
aatgcacttagtatgaatgcct

SEQ ID NO: 9106896 - DNA, 22 bp, Homo sapiens
aatgcacacatttggtactgaa

SEQ ID NO: 9106897 - DNA, 22 bp, Homo sapiens
aatctggtctaagtgaggatag

SEQ ID NO: 9106898 - DNA, 23 bp, Homo sapiens
aatctggctgatgttttttctct

SEQ ID NO: 9106899 - DNA, 22 bp, Homo sapiens
aatgaaatagttggctgtagag

SEQ ID NO: 9106900 - DNA, 22 bp, Homo sapiens
aatgaaatagttggctgtagag

SEQ ID NO: 9106901 - DNA, 22 bp, Homo sapiens
aatgaaatctgctgggtaaaga

SEQ ID NO: 9106902 - DNA, 17 bp, Homo sapiens
aatctcagtggcttaag

SEQ ID NO: 9106903 - DNA, 20 bp, Homo sapiens
aatctcagtatcctatgcaa

SEQ ID NO: 9106904 - DNA, 22 bp, Homo sapiens
aatctcactcaaagaattctct

SEQ ID NO: 9106905 - DNA, 22 bp, Homo sapiens
aatctcaagctgtaaatacctc

SEQ ID NO: 9106906 - DNA, 22 bp, Homo sapiens
aatccactaatgaagaatgggc

SEQ ID NO: 9106907 - DNA, 22 bp, Homo sapiens
aatatttcaaaaggaaacacag

SEQ ID NO: 9106908 - DNA, 22 bp, Homo sapiens
aatattgtttcaagatcacaga

SEQ ID NO: 9106909 - DNA, 22 bp, Homo sapiens
aatatcttctaaggatagaact

SEQ ID NO: 9106910 - DNA, 22 bp, Homo sapiens
aatattgagaaccagcatgttt

SEQ ID NO: 9106911 - DNA, 22 bp, Homo sapiens
aatatttatatttctcttccct

SEQ ID NO: 9106912 - DNA, 22 bp, Homo sapiens
aatatttatgacaggaagtagc

SEQ ID NO: 9106913 - DNA, 22 bp, Homo sapiens
aatatctgtggccatacaattt

SEQ ID NO: 9106914 - DNA, 22 bp, Homo sapiens
aatatctgtggccatacaattt

SEQ ID NO: 9106915 - DNA, 20 bp, Homo sapiens
aatataattctctgaattta

SEQ ID NO: 9106916 - DNA, 22 bp, Homo sapiens
aatataattttattcctagagt

SEQ ID NO: 9106917 - DNA, 22 bp, Homo sapiens
aatatcatctctcttttctgca

SEQ ID NO: 9106918 - DNA, 22 bp, Homo sapiens
aatatccaggtagatgtcttct

SEQ ID NO: 9106919 - DNA, 22 bp, Homo sapiens
aatatcctgaccagtaaactaa

SEQ ID NO: 9106920 - DNA, 22 bp, Homo sapiens
aatatcctttccagagtacagt

SEQ ID NO: 9106921 - DNA, 22 bp, Homo sapiens
aatacatatggaattccatgtt

SEQ ID NO: 9106922 - DNA, 22 bp, Homo sapiens
aatacataataagttttgtctg

SEQ ID NO: 9106923 - DNA, 22 bp, Homo sapiens
aatacataataagttttgtctg

SEQ ID NO: 9106924 - DNA, 22 bp, Homo sapiens
aatacagtgaaagtgagcaagg

SEQ ID NO: 9106925 - DNA, 22 bp, Homo sapiens
aatacagtaattttgatgagtt

SEQ ID NO: 9106926 - DNA, 22 bp, Homo sapiens
aatacagaggggtcacaattca

SEQ ID NO: 9106927 - DNA, 22 bp, Homo sapiens
aatacagaggggtcacaattca

SEQ ID NO: 9106928 - DNA, 22 bp, Homo sapiens
aatacagaggggtcacaattca

SEQ ID NO: 9106929 - DNA, 22 bp, Homo sapiens
aatacagatattcagtggtact

SEQ ID NO: 9106930 - DNA, 22 bp, Homo sapiens
aatacagatgagcttctgcctc

SEQ ID NO: 9106931 - DNA, 22 bp, Homo sapiens
aatacagatattcagtggtact

SEQ ID NO: 9106932 - DNA, 22 bp, Homo sapiens
aatacagatggcatgtgaagat

SEQ ID NO: 9106933 - DNA, 22 bp, Homo sapiens
aataatgtctgctattttaaaa

SEQ ID NO: 9106934 - DNA, 22 bp, Homo sapiens
aataatgtaggatgataaatga

SEQ ID NO: 9106935 - DNA, 22 bp, Homo sapiens
aataatgtaggatgataaatga

SEQ ID NO: 9106936 - DNA, 22 bp, Homo sapiens
aataatgtacatacatatttcg

SEQ ID NO: 9106937 - DNA, 22 bp, Homo sapiens
aataatcttgactactgaatca

SEQ ID NO: 9106938 - DNA, 22 bp, Homo sapiens
aataatgagacagcttatttaa

SEQ ID NO: 9106939 - DNA, 22 bp, Homo sapiens
aataatgagcttgtctaattgt

SEQ ID NO: 9106940 - DNA, 22 bp, Homo sapiens
aataatgagcttgtctaattgt

SEQ ID NO: 9106941 - DNA, 22 bp, Homo sapiens
aataatgtacatacatatttcg

SEQ ID NO: 9106942 - DNA, 22 bp, Homo sapiens
aataatgataatggttatagct

SEQ ID NO: 9106943 - DNA, 22 bp, Homo sapiens
aataatatttgaagcttcaaag

SEQ ID NO: 9106944 - DNA, 22 bp, Homo sapiens
aataatctccctttttgtatgt

SEQ ID NO: 9106945 - DNA, 22 bp, Homo sapiens
aagttacacattttcattgtaa

SEQ ID NO: 9106946 - DNA, 22 bp, Homo sapiens
aagttacaggagaaagagatca

SEQ ID NO: 9106947 - DNA, 22 bp, Homo sapiens
aagttaaggcacatgctttgga

SEQ ID NO: 9106948 - DNA, 22 bp, Homo sapiens
aagttaagtagtactctcttca

SEQ ID NO: 9106949 - DNA, 22 bp, Homo sapiens
aagttaagcatggccatgtgac

SEQ ID NO: 9106950 - DNA, 21 bp, Homo sapiens
aacagttctctttgaaggtgt

SEQ ID NO: 9106951 - DNA, 22 bp, Homo sapiens
aacagtttatgataaattctta

SEQ ID NO: 9106952 - DNA, 22 bp, Homo sapiens
aacagtttatgataaattctta

SEQ ID NO: 9106953 - DNA, 22 bp, Homo sapiens
aacagtttatgagatatgctat

SEQ ID NO: 9106954 - DNA, 22 bp, Homo sapiens
aagttacagttattatttaaaa

SEQ ID NO: 9106955 - DNA, 22 bp, Homo sapiens
aagttacagttacagaatggag

SEQ ID NO: 9106956 - DNA, 22 bp, Homo sapiens
aagttacagtctgcttgctgac

SEQ ID NO: 9106957 - DNA, 22 bp, Homo sapiens
aaaattttactggtgtttcctt

SEQ ID NO: 9106958 - DNA, 22 bp, Homo sapiens
aaaattttcagcttgacttgat

SEQ ID NO: 9106959 - DNA, 22 bp, Homo sapiens
aaaattgtcgaacagtagtaac

SEQ ID NO: 9106960 - DNA, 22 bp, Homo sapiens
aaaattgtcagaagttgatctt

SEQ ID NO: 9106961 - DNA, 22 bp, Homo sapiens
aaaattgtgaaggtttctgaaa

SEQ ID NO: 9106962 - DNA, 22 bp, Homo sapiens
aaagctattttattgcagctct

SEQ ID NO: 9106963 - DNA, 22 bp, Homo sapiens
aaaattttgccctatccttcat

SEQ ID NO: 9106964 - DNA, 22 bp, Homo sapiens
aaaggacatgtcaatatcaggc

SEQ ID NO: 9106965 - DNA, 22 bp, Homo sapiens
aaagctcacagtaatacaaggc

SEQ ID NO: 9106966 - DNA, 22 bp, Homo sapiens
aaaggagacttcagatctcctt

SEQ ID NO: 9106967 - DNA, 22 bp, Homo sapiens
aaaggagagtaggttactccat

SEQ ID NO: 9106968 - DNA, 22 bp, Homo sapiens
aaaggagagtgagtcagatgcc

SEQ ID NO: 9106969 - DNA, 22 bp, Homo sapiens
aaaggagagtgagtcagatgcc

SEQ ID NO: 9106970 - DNA, 22 bp, Homo sapiens
aaaggagataaagggcccttca

SEQ ID NO: 9106971 - DNA, 22 bp, Homo sapiens
aaaggagacagtcttacctgga

SEQ ID NO: 9106972 - DNA, 22 bp, Homo sapiens
aaaggagaaaacatacaggact

SEQ ID NO: 9106973 - DNA, 19 bp, Homo sapiens
aaagttttattctcatttg

SEQ ID NO: 9106974 - DNA, 22 bp, Homo sapiens
aaagttttctgccttcattaga

SEQ ID NO: 9106975 - DNA, 22 bp, Homo sapiens
aaagttttctgccttcattaga

SEQ ID NO: 9106976 - DNA, 19 bp, Homo sapiens
aaagttttattctcatttg

SEQ ID NO: 9106977 - DNA, 19 bp, Homo sapiens
aaagttttattctcatttg

SEQ ID NO: 9106978 - DNA, 22 bp, Homo sapiens
aaagttttattcaagcattagt

SEQ ID NO: 9106979 - DNA, 22 bp, Homo sapiens
aaagttctaaaactctttgtga

SEQ ID NO: 9106980 - DNA, 22 bp, Homo sapiens
aaagttctaaaactctttgtga

SEQ ID NO: 9106981 - DNA, 22 bp, Homo sapiens
aaagttttgttgattgtggaat

SEQ ID NO: 9106982 - DNA, 22 bp, Homo sapiens
aaagttttgttgattgtggaat

SEQ ID NO: 9106983 - DNA, 22 bp, Homo sapiens
aaagttttctgccttcattaga

SEQ ID NO: 9106984 - DNA, 22 bp, Homo sapiens
aaagtttttaagcaagaccctt

SEQ ID NO: 9106985 - DNA, 22 bp, Homo sapiens
aaagtttttaagcaagaccctt

SEQ ID NO: 9106986 - DNA, 22 bp, Homo sapiens
aaataaactgaagcacagagag

SEQ ID NO: 9106987 - DNA, 22 bp, Homo sapiens
aaagttccttttatagacatga

SEQ ID NO: 9106988 - DNA, 22 bp, Homo sapiens
aaagttcattgatgactgaggt

SEQ ID NO: 9106989 - DNA, 22 bp, Homo sapiens
aaagtcattgtaatatatgcta

SEQ ID NO: 9106990 - DNA, 22 bp, Homo sapiens
aaagtacagccacatccaagta

SEQ ID NO: 9106991 - DNA, 22 bp, Homo sapiens
aaagtacaggaaagcctagcca

SEQ ID NO: 9106992 - DNA, 22 bp, Homo sapiens
aaaggttagacagctctgcata

SEQ ID NO: 9106993 - DNA, 22 bp, Homo sapiens
aaagtacacacagagccaagaa

SEQ ID NO: 9106994 - DNA, 22 bp, Homo sapiens
aaagtcagttggccagatcact

SEQ ID NO: 9106995 - DNA, 22 bp, Homo sapiens
aaagtcagttggccagatcact

SEQ ID NO: 9106996 - DNA, 22 bp, Homo sapiens
aaagtcacttccttctgtcagc

SEQ ID NO: 9106997 - DNA, 22 bp, Homo sapiens
aaagtacatagcatattccaac

SEQ ID NO: 9106998 - DNA, 22 bp, Homo sapiens
aaagtacatgagattcaagggg

SEQ ID NO: 9106999 - DNA, 22 bp, Homo sapiens
aaagtacatgcaattcttctga

SEQ ID NO: 9107000 - DNA, 22 bp, Homo sapiens
aaagtacatgcaattcttctga

SEQ ID NO: 9107001 - DNA, 21 bp, Homo sapiens
aaatgaatgtggtagtgcaag

SEQ ID NO: 9107002 - DNA, 22 bp, Homo sapiens
aaatgacactaggctttttgca

SEQ ID NO: 9107003 - DNA, 22 bp, Homo sapiens
aaatgacaataaaagtccatgc

SEQ ID NO: 9107004 - DNA, 21 bp, Homo sapiens
aaatacagaaacttgttttca

SEQ ID NO: 9107005 - DNA, 22 bp, Homo sapiens
aaatacagagttatggacctca

SEQ ID NO: 9107006 - DNA, 22 bp, Homo sapiens
aaatacagagttgcttaaaagc

SEQ ID NO: 9107007 - DNA, 22 bp, Homo sapiens
aaatacagattccagggtctta

SEQ ID NO: 9107008 - DNA, 20 bp, Homo sapiens
aaatccagtgtgtattttac

SEQ ID NO: 9107009 - DNA, 21 bp, Homo sapiens
aaatacagatgcaaatctgtt

SEQ ID NO: 9107010 - DNA, 22 bp, Homo sapiens
aaataaaggaactgttttccca

SEQ ID NO: 9107011 - DNA, 22 bp, Homo sapiens
aaatacacgtacatgtgtaaaa

SEQ ID NO: 9107012 - DNA, 22 bp, Homo sapiens
aaatacacgtacatgtgtaaaa

SEQ ID NO: 9107013 - DNA, 22 bp, Homo sapiens
aaatacaatttcaggctgtaat

SEQ ID NO: 9107014 - DNA, 22 bp, Homo sapiens
aaatacaatttcaggctgtaat

SEQ ID NO: 9107015 - DNA, 22 bp, Homo sapiens
aaatacaatttcaggctgtaat

SEQ ID NO: 9107016 - DNA, 22 bp, Homo sapiens
aaatgtgagttatagcaataga

SEQ ID NO: 9107017 - DNA, 23 bp, Homo sapiens
aaatgtgagggaaaatctttctg

SEQ ID NO: 9107018 - DNA, 22 bp, Homo sapiens
aaagacacacagtgcttcagtt

SEQ ID NO: 9107019 - DNA, 22 bp, Homo sapiens
aaagacacacagccagcaagtg

SEQ ID NO: 9107020 - DNA, 22 bp, Homo sapiens
aaagacatatttctaagtttat

SEQ ID NO: 9107021 - DNA, 22 bp, Homo sapiens
aaagacatatttctaagtttat

SEQ ID NO: 9107022 - DNA, 22 bp, Homo sapiens
aaagacatatttctaagtttat

SEQ ID NO: 9107023 - DNA, 22 bp, Homo sapiens
aaagacatatttctaagtttat

SEQ ID NO: 9107024 - DNA, 22 bp, Homo sapiens
aaagacagatggcaaggatgat

SEQ ID NO: 9107025 - DNA, 22 bp, Homo sapiens
aaagacacatatgcttaaccca

SEQ ID NO: 9107026 - DNA, 22 bp, Homo sapiens
aaagacacatgtctcttagatt

SEQ ID NO: 9107027 - DNA, 22 bp, Homo sapiens
aaagacagacggaaacctgagg

SEQ ID NO: 9107028 - DNA, 23 bp, Homo sapiens
aaatgtcttctagctcttgagaa

SEQ ID NO: 9107029 - DNA, 22 bp, Homo sapiens
aaatgtctgtctcatgaggaaa

SEQ ID NO: 9107030 - DNA, 22 bp, Homo sapiens
aaacttcatggataatataaag

SEQ ID NO: 9107031 - DNA, 22 bp, Homo sapiens
aaacttcagtgaatgacttatg

SEQ ID NO: 9107032 - DNA, 22 bp, Homo sapiens
aaacttcagggaataaaagagt

SEQ ID NO: 9107033 - DNA, 22 bp, Homo sapiens
aaacttcagtaggagccaacct

SEQ ID NO: 9107034 - DNA, 22 bp, Homo sapiens
aaacttcaactggaatgggcta

SEQ ID NO: 9107035 - DNA, 22 bp, Homo sapiens
aaacttcaagattcaagcctgg

SEQ ID NO: 9107036 - DNA, 22 bp, Homo sapiens
aaacttcaaggatttgcaaatc

SEQ ID NO: 9107037 - DNA, 22 bp, Homo sapiens
aaacttcaaggatttgcaaatc

SEQ ID NO: 9107038 - DNA, 22 bp, Homo sapiens
aaaagaggttaaccaggtgtgt

SEQ ID NO: 9107039 - DNA, 22 bp, Homo sapiens
aaaaccaagttttccttagtct

SEQ ID NO: 9107040 - DNA, 22 bp, Homo sapiens
aaaacattttactgccatctca

SEQ ID NO: 9107041 - DNA, 22 bp, Homo sapiens
aaaacattttactgccatctca

SEQ ID NO: 9107042 - DNA, 22 bp, Homo sapiens
aaaacattttactgccatctca

SEQ ID NO: 9107043 - DNA, 22 bp, Homo sapiens
aaaacattgaattgcacactat

SEQ ID NO: 9107044 - DNA, 22 bp, Homo sapiens
aaaacattgaattgcacactat

SEQ ID NO: 9107045 - DNA, 22 bp, Homo sapiens
aaaacattgaattgcacactat

SEQ ID NO: 9107046 - DNA, 22 bp, Homo sapiens
aaaacattctgtgaactctcaa

SEQ ID NO: 9107047 - DNA, 22 bp, Homo sapiens
aaaacatgtccatacagaaact

SEQ ID NO: 9107048 - DNA, 22 bp, Homo sapiens
aaaaatgtgaccacagggtgtt

SEQ ID NO: 9107049 - DNA, 22 bp, Homo sapiens
aaaaatgttatctactgtccga

SEQ ID NO: 9107050 - DNA, 22 bp, Homo sapiens
aaaaatgttatctactgtccga

SEQ ID NO: 9107051 - DNA, 22 bp, Homo sapiens
aaaaatgttatctactgtccga

SEQ ID NO: 9107052 - DNA, 22 bp, Homo sapiens
aaaaattgctgagaacggaatt

SEQ ID NO: 9107053 - DNA, 22 bp, Homo sapiens
aaaacacaagaagcagggtaca

SEQ ID NO: 9107054 - DNA, 22 bp, Homo sapiens
aaaagatgaaatggtgtcttgg

SEQ ID NO: 9107055 - DNA, 22 bp, Homo sapiens
aaaagagtgtttcaactttggc

SEQ ID NO: 9107056 - DNA, 22 bp, Homo sapiens
aaaagagtgactgataagtata

SEQ ID NO: 9107057 - DNA, 22 bp, Homo sapiens
aaaagagtgtttcaactttggc

SEQ ID NO: 9107058 - DNA, 22 bp, Homo sapiens
aaaagatgaaatggtgtcttgg

SEQ ID NO: 9107059 - DNA, 22 bp, Homo sapiens
aaaagattgttagggagaatgt

SEQ ID NO: 9107060 - DNA, 22 bp, Homo sapiens
aaaagcaaggcagtctgtctga

SEQ ID NO: 9107061 - DNA, 22 bp, Homo sapiens
aaaagcaaggcagtctgtctga

SEQ ID NO: 9107062 - DNA, 22 bp, Homo sapiens
aaaagcaagaggctggattaaa

SEQ ID NO: 9107063 - DNA, 22 bp, Homo sapiens
aaaagcaagaggctggattaaa

SEQ ID NO: 9107064 - DNA, 22 bp, Homo sapiens
aaaagcaagaggctggattaaa

SEQ ID NO: 9107065 - DNA, 22 bp, Homo sapiens
aaaagcaaggcagtctgtctga

SEQ ID NO: 9107066 - DNA, 22 bp, Homo sapiens
aaaacaggagttttggtaggct

SEQ ID NO: 9107067 - DNA, 22 bp, Homo sapiens
aaaacaggtgtcagcaaactat

SEQ ID NO: 9107068 - DNA, 22 bp, Homo sapiens
aaaacagttataaacagagtca

SEQ ID NO: 9107069 - DNA, 22 bp, Homo sapiens
aaaacagtttaggcatcacagt

SEQ ID NO: 9107070 - DNA, 22 bp, Homo sapiens
aaaacagtttaggcatcacagt

SEQ ID NO: 9107071 - DNA, 22 bp, Homo sapiens
aaaacagtttaggcatcacagt

SEQ ID NO: 9107072 - DNA, 22 bp, Homo sapiens
aaaacagtttaggcatcacagt

SEQ ID NO: 9107073 - DNA, 22 bp, Homo sapiens
aaaacagtttttgctaactgct

SEQ ID NO: 9107074 - DNA, 22 bp, Homo sapiens
aaaagaggagtggtttatgaca

SEQ ID NO: 9107075 - DNA, 22 bp, Homo sapiens
aaaagaggagtggtttatgaca

SEQ ID NO: 9107076 - DNA, 22 bp, Homo sapiens
aaaacactgcctgcttgactga

SEQ ID NO: 9107077 - DNA, 22 bp, Homo sapiens
aaaacactgcctgcttgactga

SEQ ID NO: 9107078 - DNA, 22 bp, Homo sapiens
aaaacagacagccagtgtagag

SEQ ID NO: 9107079 - DNA, 23 bp, Homo sapiens
aaaacagcttcctccagtggctc

SEQ ID NO: 9107080 - DNA, 22 bp, Homo sapiens
aaaacagacagccagtgtagag

SEQ ID NO: 9107081 - DNA, 22 bp, Homo sapiens
aaaacacactggaccaatttaa

SEQ ID NO: 9107082 - DNA, 22 bp, Homo sapiens
aaaacactgcaaagctgattgg

SEQ ID NO: 9107083 - DNA, 22 bp, Homo sapiens
aaaacactgcaaagctgattgg

SEQ ID NO: 9107084 - DNA, 22 bp, Homo sapiens
aaaacacaagaagcagggtaca

SEQ ID NO: 9107085 - DNA, 22 bp, Homo sapiens
aaaacacaagaagcagggtaca

SEQ ID NO: 9107086 - DNA, 22 bp, Homo sapiens
aaaacacactggaccaatttaa

SEQ ID NO: 9107087 - DNA, 22 bp, Homo sapiens
aaaagcaagttgcctaggttga

SEQ ID NO: 9107088 - DNA, 22 bp, Homo sapiens
aaaagcaagttgcctaggttga

SEQ ID NO: 9107089 - DNA, 22 bp, Homo sapiens
aaaagcaagttgcctaggttga

SEQ ID NO: 9107090 - DNA, 22 bp, Homo sapiens
aaaagcaattgcgggttttgcc

SEQ ID NO: 9107091 - DNA, 22 bp, Homo sapiens
aaaagcaattgcgggttttgcc

SEQ ID NO: 9107092 - DNA, 22 bp, Homo sapiens
aaaagcaattgcgggttttgcc

SEQ ID NO: 9107093 - DNA, 22 bp, Homo sapiens
aaaagcaattgcagttcttgcc

SEQ ID NO: 9107094 - DNA, 22 bp, Homo sapiens
aaaagcaattgcagttcttgcc

SEQ ID NO: 9107095 - DNA, 22 bp, Homo sapiens
aaaagcaattgcagttcttgcc

SEQ ID NO: 9107096 - DNA, 22 bp, Homo sapiens
aaaagcaattgcagttcttgcc

SEQ ID NO: 9107097 - DNA, 22 bp, Homo sapiens
aaaagcagaccacgctttgtgg

SEQ ID NO: 9107098 - DNA, 22 bp, Homo sapiens
aaaagcactacaatttcgcttc

SEQ ID NO: 9107099 - DNA, 22 bp, Homo sapiens
aaaagcatctcaaaggagcttc

SEQ ID NO: 9107100 - DNA, 22 bp, Homo sapiens
aaaagcatctcaaaggagcttc

SEQ ID NO: 9107101 - DNA, 22 bp, Homo sapiens
aaaagcctggatactatcatta

SEQ ID NO: 9107102 - DNA, 20 bp, Homo sapiens
aaaagcagccagagatggta

SEQ ID NO: 9107103 - DNA, 22 bp, Homo sapiens
aaaagtatttatggctatgtaa

SEQ ID NO: 9107104 - DNA, 22 bp, Homo sapiens
aaaagtattttgagcactttat

SEQ ID NO: 9107105 - DNA, 21 bp, Homo sapiens
aaaaggaaggtctgtttgggg

SEQ ID NO: 9107106 - DNA, 21 bp, Homo sapiens
aaaaggaaggtctgtttgggg

SEQ ID NO: 9107107 - DNA, 19 bp, Homo sapiens
aaaaggaatattctttggg

SEQ ID NO: 9107108 - DNA, 21 bp, Homo sapiens
aaaaggaaggtctgtttgggg

SEQ ID NO: 9107109 - DNA, 22 bp, Homo sapiens
aaaagctttgttaataggtttg

SEQ ID NO: 9107110 - DNA, 22 bp, Homo sapiens
aaaagctctttctgctgtagat

SEQ ID NO: 9107111 - DNA, 22 bp, Homo sapiens
aaaagctctttctgctgtagat

SEQ ID NO: 9107112 - DNA, 22 bp, Homo sapiens
aaaagttagctattagtaggtg

SEQ ID NO: 9107113 - DNA, 22 bp, Homo sapiens
aaaagttcattagtgagcttct

SEQ ID NO: 9107114 - DNA, 22 bp, Homo sapiens
aaaagttacctctgtaatataa

SEQ ID NO: 9107115 - DNA, 22 bp, Homo sapiens
aaaagttaactgtgttcatgca

SEQ ID NO: 9107116 - DNA, 22 bp, Homo sapiens
aaaagtgttcaggaagaataat

SEQ ID NO: 9107117 - DNA, 22 bp, Homo sapiens
aaaagttacctctgtaatataa

SEQ ID NO: 9107118 - DNA, 22 bp, Homo sapiens
aaaagtttaagactcattctag

SEQ ID NO: 9107119 - DNA, 22 bp, Homo sapiens
aaaagttgcaaaattgctcttc

SEQ ID NO: 9107120 - DNA, 22 bp, Homo sapiens
aaaagttattgatgcaggacaa

SEQ ID NO: 9107121 - DNA, 22 bp, Homo sapiens
aaaagttcattagtgagcttct

SEQ ID NO: 9107122 - DNA, 22 bp, Homo sapiens
aaaagttccctggttagaaaag

SEQ ID NO: 9107123 - DNA, 22 bp, Homo sapiens
aaaagtttgtgcaaacactcag

SEQ ID NO: 9107124 - DNA, 21 bp, Homo sapiens
aaaagtttgacaggaaaggga

SEQ ID NO: 9107125 - DNA, 22 bp, Homo sapiens
aaaagtttgtgcaaacactcag

SEQ ID NO: 9107126 - DNA, 18 bp, Homo sapiens
aaaataacaaagttggct

SEQ ID NO: 9107127 - DNA, 22 bp, Homo sapiens
aaaatacacatactaggggaaa

SEQ ID NO: 9107128 - DNA, 22 bp, Homo sapiens
aaaatacacatactaggggaaa

SEQ ID NO: 9107129 - DNA, 22 bp, Homo sapiens
aaaatacacatactaggggaaa

SEQ ID NO: 9107130 - DNA, 22 bp, Homo sapiens
aaaataacttctactatttgca

SEQ ID NO: 9107131 - DNA, 22 bp, Homo sapiens
aaaataacttctactatttgca

SEQ ID NO: 9107132 - DNA, 22 bp, Homo sapiens
aaaatactactgtcttcttccc

SEQ ID NO: 9107133 - DNA, 22 bp, Homo sapiens
aaaatactgtggagtgttgaaa

SEQ ID NO: 9107134 - DNA, 22 bp, Homo sapiens
aaaatactactgtcttcttccc

SEQ ID NO: 9107135 - DNA, 22 bp, Homo sapiens
aaaatactactgtcttcttccc

SEQ ID NO: 9107136 - DNA, 22 bp, Homo sapiens
aaaatgagacacatgtgactcc

SEQ ID NO: 9107137 - DNA, 22 bp, Homo sapiens
aaaatgagacacatgtgactcc

SEQ ID NO: 9107138 - DNA, 22 bp, Homo sapiens
aaagcagccggttccctggtct

SEQ ID NO: 9107139 - DNA, 21 bp, Homo sapiens
aaagcagcccatggcacagtc

SEQ ID NO: 9107140 - DNA, 21 bp, Homo sapiens
aaaatgtagacttttccctga

SEQ ID NO: 9107141 - DNA, 21 bp, Homo sapiens
aaaatgtagacttttccctga

SEQ ID NO: 9107142 - DNA, 22 bp, Homo sapiens
aaaatgtatgatggaggtgcta

SEQ ID NO: 9107143 - DNA, 22 bp, Homo sapiens
aaagcagggtccaaggagatgt

SEQ ID NO: 9107144 - DNA, 22 bp, Homo sapiens
aaaatgcaaacctacctacata

SEQ ID NO: 9107145 - DNA, 20 bp, Homo sapiens
aaaatgatgggcagggcagg

SEQ ID NO: 9107146 - DNA, 22 bp, Homo sapiens
aaaatgatgctgtaatttggca

SEQ ID NO: 9107147 - DNA, 22 bp, Homo sapiens
aaaatgatatcctgacttttat

SEQ ID NO: 9107148 - DNA, 22 bp, Homo sapiens
aaaatgatatcctgacttttat

SEQ ID NO: 9107149 - DNA, 22 bp, Homo sapiens
aaaatgatgctgtaatttggca

SEQ ID NO: 9107150 - DNA, 22 bp, Homo sapiens
aaaatgagccatgaaccaacca

SEQ ID NO: 9107151 - DNA, 22 bp, Homo sapiens
aaaatgaggaacggatcatggc

SEQ ID NO: 9107152 - DNA, 22 bp, Homo sapiens
aaaatgagccatgaaccaacca

SEQ ID NO: 9107153 - DNA, 22 bp, Homo sapiens
aaaatgaggaacggatcatggc

SEQ ID NO: 9107154 - DNA, 22 bp, Homo sapiens
aaaatgaggaacggatcatggc

SEQ ID NO: 9107155 - DNA, 22 bp, Homo sapiens
aaaatgatatcctgacttttat

SEQ ID NO: 9107156 - DNA, 22 bp, Homo sapiens
aaaatgtaaagcttgagtgtag

SEQ ID NO: 9107157 - DNA, 22 bp, Homo sapiens
aaaatgtaaagcttgagtgtag

SEQ ID NO: 9107158 - DNA, 18 bp, Homo sapiens
aaaatgcaggcgacatgg

SEQ ID NO: 9107159 - DNA, 18 bp, Homo sapiens
aaaatgcaggcgacatgg

SEQ ID NO: 9107160 - DNA, 22 bp, Homo sapiens
aaaatgcatgagaatgtgctcg

SEQ ID NO: 9107161 - DNA, 22 bp, Homo sapiens
aaaatgcatgagaatgtgctcg

SEQ ID NO: 9107162 - DNA, 22 bp, Homo sapiens
aaaatgcatgagaatgtgctcg

SEQ ID NO: 9107163 - DNA, 22 bp, Homo sapiens
aaaatgcatgagaatgtgctcg

SEQ ID NO: 9107164 - DNA, 22 bp, Homo sapiens
aaattccattaggaaacttcca

SEQ ID NO: 9107165 - DNA, 22 bp, Homo sapiens
aaattccagaaactcagtatat

SEQ ID NO: 9107166 - DNA, 22 bp, Homo sapiens
aaattcagttttaataatcact

SEQ ID NO: 9107167 - DNA, 22 bp, Homo sapiens
aaagacatgacacattggagag

SEQ ID NO: 9107168 - DNA, 22 bp, Homo sapiens
aaattcagcatcctgcactgga

SEQ ID NO: 9107169 - DNA, 22 bp, Homo sapiens
aaattcagatggctttcttttc

SEQ ID NO: 9107170 - DNA, 22 bp, Homo sapiens
aaattcagcagtgaaatgcccc

SEQ ID NO: 9107171 - DNA, 22 bp, Homo sapiens
aaattcagttcctcagccacat

SEQ ID NO: 9107172 - DNA, 22 bp, Homo sapiens
aaattcagtttctgtcctggga

SEQ ID NO: 9107173 - DNA, 22 bp, Homo sapiens
aaattcagtgttcttcccgtaa

SEQ ID NO: 9107174 - DNA, 22 bp, Homo sapiens
aaattcagcatcctgcactgga

SEQ ID NO: 9107175 - DNA, 23 bp, Homo sapiens
aaattcagtccttcaactctgag

SEQ ID NO: 9107176 - DNA, 22 bp, Homo sapiens
aaagcagtctcagacttaagca

SEQ ID NO: 9107177 - DNA, 19 bp, Homo sapiens
aaagcagtgcatcctcttt

SEQ ID NO: 9107178 - DNA, 22 bp, Homo sapiens
aaagcagtgcaccttaattgat

SEQ ID NO: 9107179 - DNA, 20 bp, Homo sapiens
aaagcagtatgcaagtagag

SEQ ID NO: 9107180 - DNA, 22 bp, Homo sapiens
aaagcagtccttcccttaaggt

SEQ ID NO: 9107181 - DNA, 22 bp, Homo sapiens
aaagcagtccttcccttaaggt

SEQ ID NO: 9107182 - DNA, 22 bp, Homo sapiens
aaagcaggttgcaattacagtg

SEQ ID NO: 9107183 - DNA, 22 bp, Homo sapiens
aaagcagtagttttcaaatagt

SEQ ID NO: 9107184 - DNA, 22 bp, Homo sapiens
aaagcagtataagtaacggaag

SEQ ID NO: 9107185 - DNA, 22 bp, Homo sapiens
aaagcagtatagtggaagggct

SEQ ID NO: 9107186 - DNA, 22 bp, Homo sapiens
aaattgtaatgacttcacttga

SEQ ID NO: 9107187 - DNA, 22 bp, Homo sapiens
aaattgtccttttaagaaacag

SEQ ID NO: 9107188 - DNA, 22 bp, Homo sapiens
aaattgtcagaattcagaaagt

SEQ ID NO: 9107189 - DNA, 22 bp, Homo sapiens
aaattgtatattccatttgtat

SEQ ID NO: 9107190 - DNA, 20 bp, Homo sapiens
aaaggaatatatgaagtata

SEQ ID NO: 9107191 - DNA, 22 bp, Homo sapiens
aaaggaatattcaaaacagtca

SEQ ID NO: 9107192 - DNA, 22 bp, Homo sapiens
aaaggaggccacatggctagga

SEQ ID NO: 9107193 - DNA, 22 bp, Homo sapiens
aaaggattaaataaatgtgctg

SEQ ID NO: 9107194 - DNA, 22 bp, Homo sapiens
aaaggattagagataccatgcc

SEQ ID NO: 9107195 - DNA, 22 bp, Homo sapiens
aaaggcaagcatttatatagga

SEQ ID NO: 9107196 - DNA, 22 bp, Homo sapiens
aaaggcaaaggctggtatggct

SEQ ID NO: 9107197 - DNA, 22 bp, Homo sapiens
aaaggcaaaggctggtatggct

SEQ ID NO: 9107198 - DNA, 22 bp, Homo sapiens
aacatgaaagttgctaagtgca

SEQ ID NO: 9107199 - DNA, 22 bp, Homo sapiens
aacatgaagttttctatagtga

SEQ ID NO: 9107200 - DNA, 23 bp, Homo sapiens
aaaggcacagcattgtctagcag

SEQ ID NO: 9107201 - DNA, 22 bp, Homo sapiens
aaagcatgttgggtccctcttt

SEQ ID NO: 9107202 - DNA, 22 bp, Homo sapiens
aaagcatgctactttatatagg

SEQ ID NO: 9107203 - DNA, 22 bp, Homo sapiens
aaagcatgctactttatatagg

SEQ ID NO: 9107204 - DNA, 22 bp, Homo sapiens
aaagcatagttcatctgtccat

SEQ ID NO: 9107205 - DNA, 22 bp, Homo sapiens
aaagcatagaattagagttagg

SEQ ID NO: 9107206 - DNA, 22 bp, Homo sapiens
aaagcatagaattagagttagg

SEQ ID NO: 9107207 - DNA, 22 bp, Homo sapiens
aaagccaaatgaaagatggttc

SEQ ID NO: 9107208 - DNA, 20 bp, Homo sapiens
aaaggaatatatgaagtata

SEQ ID NO: 9107209 - DNA, 22 bp, Homo sapiens
aaaggaagtgccactcttcttc

SEQ ID NO: 9107210 - DNA, 22 bp, Homo sapiens
aaagccaaatgaaagatggttc

SEQ ID NO: 9107211 - DNA, 22 bp, Homo sapiens
aaagcatttcatgtctagaaag

SEQ ID NO: 9107212 - DNA, 20 bp, Homo sapiens
aaagcatttacttgtgattg

SEQ ID NO: 9107213 - DNA, 22 bp, Homo sapiens
aaagcattactagactggattt

SEQ ID NO: 9107214 - DNA, 22 bp, Homo sapiens
aaagcattattctgtggaaaaa

SEQ ID NO: 9107215 - DNA, 22 bp, Homo sapiens
aaagcattgtttcaagattaac

SEQ ID NO: 9107216 - DNA, 22 bp, Homo sapiens
aacatgatttagtataatgcag

SEQ ID NO: 9107217 - DNA, 22 bp, Homo sapiens
aacatgatgtgaagcatgaact

SEQ ID NO: 9107218 - DNA, 22 bp, Homo sapiens
aacatgattggaaaatgctgtc

SEQ ID NO: 9107219 - DNA, 22 bp, Homo sapiens
aacatgatttcatgcatttaga

SEQ ID NO: 9107220 - DNA, 22 bp, Homo sapiens
aacatgatttcatgcatttaga

SEQ ID NO: 9107221 - DNA, 22 bp, Homo sapiens
aaaggcatgcctccatttctat

SEQ ID NO: 9107222 - DNA, 22 bp, Homo sapiens
aaaggcatgcatggtctgctcc

SEQ ID NO: 9107223 - DNA, 22 bp, Homo sapiens
aacatgattggaaaatgctgtc

SEQ ID NO: 9107224 - DNA, 22 bp, Homo sapiens
aacatgatgtgaagcatgaact

SEQ ID NO: 9107225 - DNA, 22 bp, Homo sapiens
aacatgatgtgaagcatgaact

SEQ ID NO: 9107226 - DNA, 22 bp, Homo sapiens
aacatgatggggaagaacaaga

SEQ ID NO: 9107227 - DNA, 22 bp, Homo sapiens
aacatgagtgataaaattacct

SEQ ID NO: 9107228 - DNA, 22 bp, Homo sapiens
aacatgagcattcttgtgcttg

SEQ ID NO: 9107229 - DNA, 22 bp, Homo sapiens
aacatgaagttttctatagtga

SEQ ID NO: 9107230 - DNA, 22 bp, Homo sapiens
aaaggctcaacagctgtacttt

SEQ ID NO: 9107231 - DNA, 22 bp, Homo sapiens
aaaggctcacgcagttagtgat

SEQ ID NO: 9107232 - DNA, 22 bp, Homo sapiens
aaaggctcacgcagttagtgat

SEQ ID NO: 9107233 - DNA, 22 bp, Homo sapiens
aaaggctcatgaaccaggctcg

SEQ ID NO: 9107234 - DNA, 22 bp, Homo sapiens
aaaggctccttctcccatgacc

SEQ ID NO: 9107235 - DNA, 22 bp, Homo sapiens
aaaggctctaacaaggagagag

SEQ ID NO: 9107236 - DNA, 22 bp, Homo sapiens
aaagtcacatagcatcacttct

SEQ ID NO: 9107237 - DNA, 22 bp, Homo sapiens
aaagggaaaatatttagacata

SEQ ID NO: 9107238 - DNA, 22 bp, Homo sapiens
aaaggctttgagaagtcctgca

SEQ ID NO: 9107239 - DNA, 22 bp, Homo sapiens
aaagggaactctaattatcttc

SEQ ID NO: 9107240 - DNA, 22 bp, Homo sapiens
aaagggaagttgcacatgttcc

SEQ ID NO: 9107241 - DNA, 22 bp, Homo sapiens
aaagggaagttgcacatgttcc

SEQ ID NO: 9107242 - DNA, 22 bp, Homo sapiens
aaaggctggattcagagaggtg

SEQ ID NO: 9107243 - DNA, 22 bp, Homo sapiens
aaagtccaattttgttcaggct

SEQ ID NO: 9107244 - DNA, 20 bp, Homo sapiens
aaagtcccttagtgggagca

SEQ ID NO: 9107245 - DNA, 22 bp, Homo sapiens
aaagtccagggaaagagcgtct

SEQ ID NO: 9107246 - DNA, 22 bp, Homo sapiens
aaagtcctagcgatccacagaa

SEQ ID NO: 9107247 - DNA, 22 bp, Homo sapiens
aaagtcctagcgatccacagaa

SEQ ID NO: 9107248 - DNA, 22 bp, Homo sapiens
aaagtcctgtttgaaggacctg

SEQ ID NO: 9107249 - DNA, 22 bp, Homo sapiens
aaagtctatcagttactaatca

SEQ ID NO: 9107250 - DNA, 22 bp, Homo sapiens
aaagtcctttttgccatgcaag

SEQ ID NO: 9107251 - DNA, 22 bp, Homo sapiens
aaagtctaaattattcaataag

SEQ ID NO: 9107252 - DNA, 22 bp, Homo sapiens
aaagtctttattttgtatcttt

SEQ ID NO: 9107253 - DNA, 22 bp, Homo sapiens
aaagtctgaaagataagagtga

SEQ ID NO: 9107254 - DNA, 20 bp, Homo sapiens
aaagtcttatggttaatttt

SEQ ID NO: 9107255 - DNA, 22 bp, Homo sapiens
aaagttacacatctagtaagtg

SEQ ID NO: 9107256 - DNA, 22 bp, Homo sapiens
aacttgaaactgttccagaaaa

SEQ ID NO: 9107257 - DNA, 22 bp, Homo sapiens
aacttcttggtcctgagctgtt

SEQ ID NO: 9107258 - DNA, 22 bp, Homo sapiens
aacttctgccaaacagctgtta

SEQ ID NO: 9107259 - DNA, 19 bp, Homo sapiens
aaagttctgactgtagagc

SEQ ID NO: 9107260 - DNA, 22 bp, Homo sapiens
aaagttctgagaagcagtttac

SEQ ID NO: 9107261 - DNA, 19 bp, Homo sapiens
aaagttctgactgtagagc

SEQ ID NO: 9107262 - DNA, 22 bp, Homo sapiens
aaagttctattggatagtgctg

SEQ ID NO: 9107263 - DNA, 22 bp, Homo sapiens
aaagttctagagttgcaagaga

SEQ ID NO: 9107264 - DNA, 22 bp, Homo sapiens
aaagttctggcattttctgtct

SEQ ID NO: 9107265 - DNA, 22 bp, Homo sapiens
aaagttctgatgctgatcaaag

SEQ ID NO: 9107266 - DNA, 22 bp, Homo sapiens
aaagttctgggggagaagaacg

SEQ ID NO: 9107267 - DNA, 22 bp, Homo sapiens
aaagttctgggggagaagaacg

SEQ ID NO: 9107268 - DNA, 22 bp, Homo sapiens
aaagttctgtagtgcactgact

SEQ ID NO: 9107269 - DNA, 22 bp, Homo sapiens
aaatgcttgctcttgattattt

SEQ ID NO: 9107270 - DNA, 22 bp, Homo sapiens
aaatgcttgcaacatcccaggt

SEQ ID NO: 9107271 - DNA, 22 bp, Homo sapiens
aaatgcttcacctcattaaact

SEQ ID NO: 9107272 - DNA, 22 bp, Homo sapiens
aaatgcttcacctcattaaact

SEQ ID NO: 9107273 - DNA, 19 bp, Homo sapiens
aaatggaaaactttgggaa

SEQ ID NO: 9107274 - DNA, 22 bp, Homo sapiens
aaatggaaaatgctgttttggt

SEQ ID NO: 9107275 - DNA, 22 bp, Homo sapiens
aaatggaactgggctactaggt

SEQ ID NO: 9107276 - DNA, 22 bp, Homo sapiens
aaatgcttagaggtgttcaaat

SEQ ID NO: 9107277 - DNA, 22 bp, Homo sapiens
aaatgcttattagtgtcacaaa

SEQ ID NO: 9107278 - DNA, 22 bp, Homo sapiens
aaatgctgtgttttaacataga

SEQ ID NO: 9107279 - DNA, 22 bp, Homo sapiens
aaatgctgtgttttaacataga

SEQ ID NO: 9107280 - DNA, 22 bp, Homo sapiens
aaatgctgttcttttaggtaga

SEQ ID NO: 9107281 - DNA, 20 bp, Homo sapiens
aaatgctgtaatgtttggga

SEQ ID NO: 9107282 - DNA, 22 bp, Homo sapiens
aaatgatgttataagaccagga

SEQ ID NO: 9107283 - DNA, 22 bp, Homo sapiens
aaatgatgttataagaccagga

SEQ ID NO: 9107284 - DNA, 22 bp, Homo sapiens
aaatgatgtggagtgaaattgt

SEQ ID NO: 9107285 - DNA, 22 bp, Homo sapiens
aaatgatgtggagtgaaattgt

SEQ ID NO: 9107286 - DNA, 20 bp, Homo sapiens
aaatgatgggaataatctat

SEQ ID NO: 9107287 - DNA, 22 bp, Homo sapiens
aaatgatggtactcatgtttag

SEQ ID NO: 9107288 - DNA, 22 bp, Homo sapiens
aaatgatgctcacagattagtg

SEQ ID NO: 9107289 - DNA, 20 bp, Homo sapiens
aaatgatgggaataatctat

SEQ ID NO: 9107290 - DNA, 22 bp, Homo sapiens
aaatgattgtcaaagttctgtt

SEQ ID NO: 9107291 - DNA, 22 bp, Homo sapiens
aaatgcaaggccatgtgaagga

SEQ ID NO: 9107292 - DNA, 22 bp, Homo sapiens
aaatgcaaggattttgttaggc

SEQ ID NO: 9107293 - DNA, 22 bp, Homo sapiens
aaatgcacaaagattttgcact

SEQ ID NO: 9107294 - DNA, 22 bp, Homo sapiens
aaatgcacaaagattttgcact

SEQ ID NO: 9107295 - DNA, 22 bp, Homo sapiens
aaatgcacaataaagtaaaggc

SEQ ID NO: 9107296 - DNA, 22 bp, Homo sapiens
aaatgcacagaaaggatgtgga

SEQ ID NO: 9107297 - DNA, 22 bp, Homo sapiens
aaatgcacaggagaaccaattc

SEQ ID NO: 9107298 - DNA, 22 bp, Homo sapiens
aaatcaaggagggattatattt

SEQ ID NO: 9107299 - DNA, 22 bp, Homo sapiens
aaatcaaaagacatgtgtttta

SEQ ID NO: 9107300 - DNA, 22 bp, Homo sapiens
aaatcacagggtctctaagtat

SEQ ID NO: 9107301 - DNA, 22 bp, Homo sapiens
aaatcactaagttatagtgtgg

SEQ ID NO: 9107302 - DNA, 21 bp, Homo sapiens
aaatcactgtccaatcttggt

SEQ ID NO: 9107303 - DNA, 22 bp, Homo sapiens
aaatcacttaaatggcttattt

SEQ ID NO: 9107304 - DNA, 22 bp, Homo sapiens
aaatcagaaaatatggagagga

SEQ ID NO: 9107305 - DNA, 23 bp, Homo sapiens
aaatattcttttttagtaagtgc

SEQ ID NO: 9107306 - DNA, 23 bp, Homo sapiens
aaatattcttttttagtaagtgc

SEQ ID NO: 9107307 - DNA, 23 bp, Homo sapiens
aaatattcttttttagtaagtgc

SEQ ID NO: 9107308 - DNA, 23 bp, Homo sapiens
aaatattcttttttagtaagtgc

SEQ ID NO: 9107309 - DNA, 22 bp, Homo sapiens
aaatcaaaagacatgtgtttta

SEQ ID NO: 9107310 - DNA, 22 bp, Homo sapiens
aaatcaaaagacatgtgtttta

SEQ ID NO: 9107311 - DNA, 22 bp, Homo sapiens
aaatatttgtctgaggcggttg

SEQ ID NO: 9107312 - DNA, 22 bp, Homo sapiens
aaatatttgtctgaggcggttg

SEQ ID NO: 9107313 - DNA, 22 bp, Homo sapiens
aaatcagacttgaattttcatc

SEQ ID NO: 9107314 - DNA, 22 bp, Homo sapiens
aaatgaaatgagtgcctggagg

SEQ ID NO: 9107315 - DNA, 22 bp, Homo sapiens
aaatgaaatgagtgcctggagg

SEQ ID NO: 9107316 - DNA, 22 bp, Homo sapiens
aaatgatgattaaaatgaggta

SEQ ID NO: 9107317 - DNA, 22 bp, Homo sapiens
aaatgagtttgcctctagatag

SEQ ID NO: 9107318 - DNA, 22 bp, Homo sapiens
aaatgagtagcgatgcacatta

SEQ ID NO: 9107319 - DNA, 23 bp, Homo sapiens
aaatgactaaatgttcttataga

SEQ ID NO: 9107320 - DNA, 23 bp, Homo sapiens
aaatgactaaatgttcttataga

SEQ ID NO: 9107321 - DNA, 22 bp, Homo sapiens
aaatgaggttaatacagtgctt

SEQ ID NO: 9107322 - DNA, 23 bp, Homo sapiens
aaatgacatatggtttctgaagg

SEQ ID NO: 9107323 - DNA, 23 bp, Homo sapiens
aaatgacatatggtttctgaagg

SEQ ID NO: 9107324 - DNA, 19 bp, Homo sapiens
aaatacagcagctgtttcc

SEQ ID NO: 9107325 - DNA, 22 bp, Homo sapiens
aaatacaggagtttggacttct

SEQ ID NO: 9107326 - DNA, 22 bp, Homo sapiens
aaatacagattcttgtgtctat

SEQ ID NO: 9107327 - DNA, 22 bp, Homo sapiens
aaatacaaaaattagccaggca

SEQ ID NO: 9107328 - DNA, 22 bp, Homo sapiens
aagaagtggtccttttctttct

SEQ ID NO: 9107329 - DNA, 22 bp, Homo sapiens
aagaaggcttcagagcccagga

SEQ ID NO: 9107330 - DNA, 22 bp, Homo sapiens
aagaaggttgaatgactacttt

SEQ ID NO: 9107331 - DNA, 22 bp, Homo sapiens
aaatacagtgtgtgttctttga

SEQ ID NO: 9107332 - DNA, 22 bp, Homo sapiens
aaatacataaaggttgtaccag

SEQ ID NO: 9107333 - DNA, 22 bp, Homo sapiens
aaatacagtggcagcagataat

SEQ ID NO: 9107334 - DNA, 22 bp, Homo sapiens
aaatacagtggcagcagataat

SEQ ID NO: 9107335 - DNA, 22 bp, Homo sapiens
aagagagaactcccttcgccag

SEQ ID NO: 9107336 - DNA, 22 bp, Homo sapiens
aaatacataaaggttgtaccag

SEQ ID NO: 9107337 - DNA, 22 bp, Homo sapiens
aaatacatacactgtacgtggc

SEQ ID NO: 9107338 - DNA, 22 bp, Homo sapiens
aaatacatacactgtacgtggc

SEQ ID NO: 9107339 - DNA, 22 bp, Homo sapiens
aagaagcagagctgtgggtgtt

SEQ ID NO: 9107340 - DNA, 22 bp, Homo sapiens
aaagttgctggctttggttcat

SEQ ID NO: 9107341 - DNA, 22 bp, Homo sapiens
aaagttgctggctttggttcat

SEQ ID NO: 9107342 - DNA, 21 bp, Homo sapiens
aaagttgatttagattggtga

SEQ ID NO: 9107343 - DNA, 23 bp, Homo sapiens
aaagttgatttgcagtttaagag

SEQ ID NO: 9107344 - DNA, 22 bp, Homo sapiens
aaagttgcacaactttgtatac

SEQ ID NO: 9107345 - DNA, 22 bp, Homo sapiens
aaagttgcacaactttgtatac

SEQ ID NO: 9107346 - DNA, 22 bp, Homo sapiens
aaagttgatttggagggatatt

SEQ ID NO: 9107347 - DNA, 22 bp, Homo sapiens
aaagttgaccgaaagattttga

SEQ ID NO: 9107348 - DNA, 22 bp, Homo sapiens
aaagttgagttttatgtgttac

SEQ ID NO: 9107349 - DNA, 22 bp, Homo sapiens
aaagttgagtgctgatctgatt

SEQ ID NO: 9107350 - DNA, 15 bp, Homo sapiens
aaagttgatggctct

SEQ ID NO: 9107351 - DNA, 22 bp, Homo sapiens
aaagttgataaggtatcgtagt

SEQ ID NO: 9107352 - DNA, 22 bp, Homo sapiens
aaagttgactactaaggaatgt

SEQ ID NO: 9107353 - DNA, 22 bp, Homo sapiens
aaagttgagtagggtttgggcc

SEQ ID NO: 9107354 - DNA, 19 bp, Homo sapiens
aaagttgagaaacaatgga

SEQ ID NO: 9107355 - DNA, 22 bp, Homo sapiens
aagaagctgtagggattaactc

SEQ ID NO: 9107356 - DNA, 22 bp, Homo sapiens
aagaaggaagtgtggacatcac

SEQ ID NO: 9107357 - DNA, 22 bp, Homo sapiens
aagaaggcggaccagaagggag

SEQ ID NO: 9107358 - DNA, 22 bp, Homo sapiens
aagaaggcggaccagaagggag

SEQ ID NO: 9107359 - DNA, 22 bp, Homo sapiens
aagaaggcctggtagacgtctt

SEQ ID NO: 9107360 - DNA, 22 bp, Homo sapiens
aagaaggcctctgccctggctt

SEQ ID NO: 9107361 - DNA, 20 bp, Homo sapiens
aagaaggcctgcccagacac

SEQ ID NO: 9107362 - DNA, 22 bp, Homo sapiens
aagaagcatggctgtagattcc

SEQ ID NO: 9107363 - DNA, 22 bp, Homo sapiens
aagaagcatggctgtagattcc

SEQ ID NO: 9107364 - DNA, 22 bp, Homo sapiens
aagaagcatggctgtagattcc

SEQ ID NO: 9107365 - DNA, 22 bp, Homo sapiens
aagaagcatggctgtagattcc

SEQ ID NO: 9107366 - DNA, 22 bp, Homo sapiens
aagaagcattctttcattggtt

SEQ ID NO: 9107367 - DNA, 20 bp, Homo sapiens
aagaagccgggaaggcaggc

SEQ ID NO: 9107368 - DNA, 22 bp, Homo sapiens
aagaagcaggtcacagacaggg

SEQ ID NO: 9107369 - DNA, 22 bp, Homo sapiens
aagaagcatgagaagattttat

SEQ ID NO: 9107370 - DNA, 22 bp, Homo sapiens
aagaagcagctgccaggccagt

SEQ ID NO: 9107371 - DNA, 22 bp, Homo sapiens
aaatatagcaattatgcctact

SEQ ID NO: 9107372 - DNA, 22 bp, Homo sapiens
aagagagagttcctaggcaaaa

SEQ ID NO: 9107373 - DNA, 22 bp, Homo sapiens
aaataggggaccaggaaaggag

SEQ ID NO: 9107374 - DNA, 22 bp, Homo sapiens
aagagagagcattcttctgtta

SEQ ID NO: 9107375 - DNA, 22 bp, Homo sapiens
aagagagaccatgggggacagg

SEQ ID NO: 9107376 - DNA, 22 bp, Homo sapiens
aagagagaccatgggggacagg

SEQ ID NO: 9107377 - DNA, 22 bp, Homo sapiens
aagagagacaataggtagcatt

SEQ ID NO: 9107378 - DNA, 22 bp, Homo sapiens
aagagtttttggagtgtgagtt

SEQ ID NO: 9107379 - DNA, 22 bp, Homo sapiens
aagagtttgacctgtgccatcc

SEQ ID NO: 9107380 - DNA, 22 bp, Homo sapiens
aagagtttgtcagatctgcacg

SEQ ID NO: 9107381 - DNA, 22 bp, Homo sapiens
aagagtttgtcagatctgcacg

SEQ ID NO: 9107382 - DNA, 22 bp, Homo sapiens
aagagtttgggcaagtcataaa

SEQ ID NO: 9107383 - DNA, 22 bp, Homo sapiens
aagagtttgtcagatctgcacg

SEQ ID NO: 9107384 - DNA, 22 bp, Homo sapiens
aagagttttagacaaactgatt

SEQ ID NO: 9107385 - DNA, 22 bp, Homo sapiens
aagagttttctataatcttggc

SEQ ID NO: 9107386 - DNA, 22 bp, Homo sapiens
aagagttttctataatcttggc

SEQ ID NO: 9107387 - DNA, 22 bp, Homo sapiens
aaatatagtgacacttatagtc

SEQ ID NO: 9107388 - DNA, 22 bp, Homo sapiens
aaatatagtaaatgcatagttc

SEQ ID NO: 9107389 - DNA, 19 bp, Homo sapiens
aaatatcagagagatgata

SEQ ID NO: 9107390 - DNA, 22 bp, Homo sapiens
aagagtttctgggtcaaggatt

SEQ ID NO: 9107391 - DNA, 22 bp, Homo sapiens
aagagtttctgggtcaaggatt

SEQ ID NO: 9107392 - DNA, 22 bp, Homo sapiens
aagagtttctttattaaccttt

SEQ ID NO: 9107393 - DNA, 22 bp, Homo sapiens
aagagtttctgattcagtaggt

SEQ ID NO: 9107394 - DNA, 22 bp, Homo sapiens
aagagtttccatgctctgtgct

SEQ ID NO: 9107395 - DNA, 22 bp, Homo sapiens
cagcgctgtgggaacagggcta

SEQ ID NO: 9107396 - DNA, 22 bp, Homo sapiens
cagcctctgagccttggcagat

SEQ ID NO: 9107397 - DNA, 22 bp, Homo sapiens
cagcctctgagccttggcagat

SEQ ID NO: 9107398 - DNA, 22 bp, Homo sapiens
cagcctctgagccttggcagat

SEQ ID NO: 9107399 - DNA, 22 bp, Homo sapiens
cagcctctgtggctgccacacc

SEQ ID NO: 9107400 - DNA, 22 bp, Homo sapiens
cagcctctgacaccacagtcgt

SEQ ID NO: 9107401 - DNA, 22 bp, Homo sapiens
cagcctctgacaccacagtcgt

SEQ ID NO: 9107402 - DNA, 22 bp, Homo sapiens
cagccttgatggatgaggaagt

SEQ ID NO: 9107403 - DNA, 22 bp, Homo sapiens
cagccttcgacagttggagtag

SEQ ID NO: 9107404 - DNA, 22 bp, Homo sapiens
cagcctcttgcactttgaaggc

SEQ ID NO: 9107405 - DNA, 22 bp, Homo sapiens
agctctggagccggaggatttc

SEQ ID NO: 9107406 - DNA, 22 bp, Homo sapiens
agctctggaataatgatgtgat

SEQ ID NO: 9107407 - DNA, 22 bp, Homo sapiens
cagctgccccgctggctgacca

SEQ ID NO: 9107408 - DNA, 22 bp, Homo sapiens
cagctgccccgctggctgacca

SEQ ID NO: 9107409 - DNA, 22 bp, Homo sapiens
cagctgcccaggccacctggag

SEQ ID NO: 9107410 - DNA, 22 bp, Homo sapiens
cagctgcccatcctgggaaatg

SEQ ID NO: 9107411 - DNA, 22 bp, Homo sapiens
cagctgccccataaatcacagt

SEQ ID NO: 9107412 - DNA, 22 bp, Homo sapiens
cagctgccagcttctctccatc

SEQ ID NO: 9107413 - DNA, 18 bp, Homo sapiens
cagctgccagctcatgga

SEQ ID NO: 9107414 - DNA, 22 bp, Homo sapiens
cagctgagagtagaaatggagg

SEQ ID NO: 9107415 - DNA, 22 bp, Homo sapiens
cagctgagcatcactagtctgg

SEQ ID NO: 9107416 - DNA, 22 bp, Homo sapiens
cagctgcccaagccccagatgt

SEQ ID NO: 9107417 - DNA, 22 bp, Homo sapiens
cagctgccatgacatgtcctgc

SEQ ID NO: 9107418 - DNA, 22 bp, Homo sapiens
cagctgcccaggccacctggag

SEQ ID NO: 9107419 - DNA, 22 bp, Homo sapiens
cagctgccatgacatgtcctgc

SEQ ID NO: 9107420 - DNA, 18 bp, Homo sapiens
cagctgccagctcatgga

SEQ ID NO: 9107421 - DNA, 22 bp, Homo sapiens
agctgagctgcagatgactgta

SEQ ID NO: 9107422 - DNA, 22 bp, Homo sapiens
agctgagctgcagatgactgta

SEQ ID NO: 9107423 - DNA, 17 bp, Homo sapiens
agctgagctggccaggg

SEQ ID NO: 9107424 - DNA, 22 bp, Homo sapiens
agctgagctagtagttccagtg

SEQ ID NO: 9107425 - DNA, 22 bp, Homo sapiens
agctgagctcaggctgatgtaa

SEQ ID NO: 9107426 - DNA, 22 bp, Homo sapiens
agctgagctcaggctgatgtaa

SEQ ID NO: 9107427 - DNA, 21 bp, Homo sapiens
agctgagcccagaagactggt

SEQ ID NO: 9107428 - DNA, 21 bp, Homo sapiens
agctgagcccagaagactggt

SEQ ID NO: 9107429 - DNA, 22 bp, Homo sapiens
agctgagccagcagcaacagga

SEQ ID NO: 9107430 - DNA, 22 bp, Homo sapiens
agctgagcatttgatccacctc

SEQ ID NO: 9107431 - DNA, 22 bp, Homo sapiens
agctgagcatttgatccacctc

SEQ ID NO: 9107432 - DNA, 22 bp, Homo sapiens
agctgagccagcagcaacagga

SEQ ID NO: 9107433 - DNA, 22 bp, Homo sapiens
agctgagccagcagcaacagga

SEQ ID NO: 9107434 - DNA, 22 bp, Homo sapiens
agctgagccagcagcaacagga

SEQ ID NO: 9107435 - DNA, 22 bp, Homo sapiens
agctctggctaagctgataaat

SEQ ID NO: 9107436 - DNA, 22 bp, Homo sapiens
cagctgctttcagcaggaggga

SEQ ID NO: 9107437 - DNA, 22 bp, Homo sapiens
cagctgctttcagcaggaggga

SEQ ID NO: 9107438 - DNA, 19 bp, Homo sapiens
cagctggaatcatctgagg

SEQ ID NO: 9107439 - DNA, 22 bp, Homo sapiens
cagctggatccctgcagaactt

SEQ ID NO: 9107440 - DNA, 22 bp, Homo sapiens
cagctggcagaacctgcatcca

SEQ ID NO: 9107441 - DNA, 22 bp, Homo sapiens
cagctggcagaacctgcatcca

SEQ ID NO: 9107442 - DNA, 22 bp, Homo sapiens
cagctggcaagtggagcagggt

SEQ ID NO: 9107443 - DNA, 22 bp, Homo sapiens
cagctggcaagtggagcagggt

SEQ ID NO: 9107444 - DNA, 22 bp, Homo sapiens
cagctggcaagtggagcagggt

SEQ ID NO: 9107445 - DNA, 22 bp, Homo sapiens
cagctggcaagtggagcagggt

SEQ ID NO: 9107446 - DNA, 22 bp, Homo sapiens
cagctggcagccctggccctgc

SEQ ID NO: 9107447 - DNA, 22 bp, Homo sapiens
cagctggcagccctggccctgc

SEQ ID NO: 9107448 - DNA, 22 bp, Homo sapiens
cagctggcagccctggccctgc

SEQ ID NO: 9107449 - DNA, 22 bp, Homo sapiens
cagctggcagccctggccctgc

SEQ ID NO: 9107450 - DNA, 22 bp, Homo sapiens
cagctggcaagtggagcagggt

SEQ ID NO: 9107451 - DNA, 22 bp, Homo sapiens
cagctggcatacctgggcccgg

SEQ ID NO: 9107452 - DNA, 22 bp, Homo sapiens
cagctgggtggctcttctgctc

SEQ ID NO: 9107453 - DNA, 22 bp, Homo sapiens
cagctgggtggctcttctgctc

SEQ ID NO: 9107454 - DNA, 22 bp, Homo sapiens
cagcccagtaccaagcagttgg

SEQ ID NO: 9107455 - DNA, 22 bp, Homo sapiens
cagcccagtaccaagcagttgg

SEQ ID NO: 9107456 - DNA, 22 bp, Homo sapiens
cagcccagtaccaagcagttgg

SEQ ID NO: 9107457 - DNA, 22 bp, Homo sapiens
cagcccagtgcacgcccgtttc

SEQ ID NO: 9107458 - DNA, 22 bp, Homo sapiens
cagcctcctgggacactcaccg

SEQ ID NO: 9107459 - DNA, 22 bp, Homo sapiens
cagcctcctgggacactcaccg

SEQ ID NO: 9107460 - DNA, 22 bp, Homo sapiens
cagcctctaagcacagcctctc

SEQ ID NO: 9107461 - DNA, 22 bp, Homo sapiens
cagcctctaagcacagcctctc

SEQ ID NO: 9107462 - DNA, 22 bp, Homo sapiens
cagccctggtgaggttggctat

SEQ ID NO: 9107463 - DNA, 22 bp, Homo sapiens
cagccctggtgaggttggctat

SEQ ID NO: 9107464 - DNA, 22 bp, Homo sapiens
cagcccattcctgccatgccgc

SEQ ID NO: 9107465 - DNA, 22 bp, Homo sapiens
cagcccaaagccccaggctaga

SEQ ID NO: 9107466 - DNA, 22 bp, Homo sapiens
cagcccacgtcagggccactca

SEQ ID NO: 9107467 - DNA, 22 bp, Homo sapiens
cagcccacgtcagggccactca

SEQ ID NO: 9107468 - DNA, 22 bp, Homo sapiens
cagccatcagtaaagacagctt

SEQ ID NO: 9107469 - DNA, 22 bp, Homo sapiens
cagcccaaagccccaggctaga

SEQ ID NO: 9107470 - DNA, 22 bp, Homo sapiens
cagccagctggcactgtgagta

SEQ ID NO: 9107471 - DNA, 22 bp, Homo sapiens
cagccagctggcactgtgagta

SEQ ID NO: 9107472 - DNA, 22 bp, Homo sapiens
cagccagctggcactgtgagta

SEQ ID NO: 9107473 - DNA, 22 bp, Homo sapiens
cagcccacttcccagcacctac

SEQ ID NO: 9107474 - DNA, 22 bp, Homo sapiens
cagcccagacaccatcattcta

SEQ ID NO: 9107475 - DNA, 22 bp, Homo sapiens
cagcccagaactcacgtctcca

SEQ ID NO: 9107476 - DNA, 22 bp, Homo sapiens
cagcccagagaaggggcccgtg

SEQ ID NO: 9107477 - DNA, 22 bp, Homo sapiens
cagcactgcttcgcagccaggg

SEQ ID NO: 9107478 - DNA, 22 bp, Homo sapiens
cagcactgcttcgcagccaggg

SEQ ID NO: 9107479 - DNA, 22 bp, Homo sapiens
cagcactggggccactggagtt

SEQ ID NO: 9107480 - DNA, 22 bp, Homo sapiens
cagcactgtgataactgagcca

SEQ ID NO: 9107481 - DNA, 22 bp, Homo sapiens
cagcactggggggattcggagc

SEQ ID NO: 9107482 - DNA, 22 bp, Homo sapiens
cagcactttgagggctcttaat

SEQ ID NO: 9107483 - DNA, 22 bp, Homo sapiens
cagcactgttcccagaccactg

SEQ ID NO: 9107484 - DNA, 22 bp, Homo sapiens
cagcacttcaatgagcatttca

SEQ ID NO: 9107485 - DNA, 22 bp, Homo sapiens
cagcacttcagcattcagattt

SEQ ID NO: 9107486 - DNA, 22 bp, Homo sapiens
cagcactgttcccagaccactg

SEQ ID NO: 9107487 - DNA, 22 bp, Homo sapiens
cagcatcatactacctaaatga

SEQ ID NO: 9107488 - DNA, 22 bp, Homo sapiens
cagcatcaccaacttgagcaat

SEQ ID NO: 9107489 - DNA, 22 bp, Homo sapiens
cagcagaaaatacctgtaactc

SEQ ID NO: 9107490 - DNA, 22 bp, Homo sapiens
cagcagaaaatgtgggtgattt

SEQ ID NO: 9107491 - DNA, 22 bp, Homo sapiens
cagcatggagacaaagtgggca

SEQ ID NO: 9107492 - DNA, 22 bp, Homo sapiens
cagcatggagacaaagtgggca

SEQ ID NO: 9107493 - DNA, 22 bp, Homo sapiens
cagcatggacccatcgctgagt

SEQ ID NO: 9107494 - DNA, 22 bp, Homo sapiens
cagcatggggatcactgtaggc

SEQ ID NO: 9107495 - DNA, 22 bp, Homo sapiens
cagcatggcttgagtgtttcct

SEQ ID NO: 9107496 - DNA, 22 bp, Homo sapiens
agcgccactgcactccagcctg

SEQ ID NO: 9107497 - DNA, 22 bp, Homo sapiens
agcgccgcccctgctggtgttg

SEQ ID NO: 9107498 - DNA, 22 bp, Homo sapiens
agcgctggctggcgctccttcc

SEQ ID NO: 9107499 - DNA, 22 bp, Homo sapiens
agcgagggaggtctgaggacag

SEQ ID NO: 9107500 - DNA, 22 bp, Homo sapiens
agcgccactgcactccagcctg

SEQ ID NO: 9107501 - DNA, 22 bp, Homo sapiens
agcgcaggaacacgtctgcctt

SEQ ID NO: 9107502 - DNA, 22 bp, Homo sapiens
agcgcaggaacacgtctgcctt

SEQ ID NO: 9107503 - DNA, 22 bp, Homo sapiens
agcgccaagtgtgtggaggagg

SEQ ID NO: 9107504 - DNA, 22 bp, Homo sapiens
cagcatggtggagctgctcttt

SEQ ID NO: 9107505 - DNA, 22 bp, Homo sapiens
cagcatggggcttggagtcagc

SEQ ID NO: 9107506 - DNA, 22 bp, Homo sapiens
cagcatggtgccagtgagtcca

SEQ ID NO: 9107507 - DNA, 22 bp, Homo sapiens
cagcatggtgccagtgagtcca

SEQ ID NO: 9107508 - DNA, 22 bp, Homo sapiens
cagcatgggttccgggggcctg

SEQ ID NO: 9107509 - DNA, 21 bp, Homo sapiens
cagagctgtccaaaccctgac

SEQ ID NO: 9107510 - DNA, 22 bp, Homo sapiens
cagagctgtcatttgccagtga

SEQ ID NO: 9107511 - DNA, 23 bp, Homo sapiens
cagagctggctcagagctgcctg

SEQ ID NO: 9107512 - DNA, 22 bp, Homo sapiens
cagagccatcccagcctgtggt

SEQ ID NO: 9107513 - DNA, 23 bp, Homo sapiens
cagagctggctcagagctgcctg

SEQ ID NO: 9107514 - DNA, 22 bp, Homo sapiens
cagagccatcatgatatggagt

SEQ ID NO: 9107515 - DNA, 22 bp, Homo sapiens
cagagccatcccagcctgtggt

SEQ ID NO: 9107516 - DNA, 22 bp, Homo sapiens
cagagctgtgataaatagatat

SEQ ID NO: 9107517 - DNA, 22 bp, Homo sapiens
cagagctgttactattcatgaa

SEQ ID NO: 9107518 - DNA, 22 bp, Homo sapiens
cagagctgtccaaaccctgaca

SEQ ID NO: 9107519 - DNA, 22 bp, Homo sapiens
cagagctgttgcggggcttggc

SEQ ID NO: 9107520 - DNA, 20 bp, Homo sapiens
cagagctgttatggatgatg

SEQ ID NO: 9107521 - DNA, 22 bp, Homo sapiens
cagagccaggcctgccctcttt

SEQ ID NO: 9107522 - DNA, 22 bp, Homo sapiens
cagagccagtcagtcagaaact

SEQ ID NO: 9107523 - DNA, 22 bp, Homo sapiens
cagagccaggtctaggagtctc

SEQ ID NO: 9107524 - DNA, 22 bp, Homo sapiens
cagagcagtccttgtcaatcag

SEQ ID NO: 9107525 - DNA, 22 bp, Homo sapiens
cagagcagtctggagatccagc

SEQ ID NO: 9107526 - DNA, 22 bp, Homo sapiens
cagagcagtccttgtcaatcag

SEQ ID NO: 9107527 - DNA, 18 bp, Homo sapiens
cagagcagtatgaatgtt

SEQ ID NO: 9107528 - DNA, 18 bp, Homo sapiens
cagagcagtatgaatgtt

SEQ ID NO: 9107529 - DNA, 22 bp, Homo sapiens
cagagcagtaaatctggggcac

SEQ ID NO: 9107530 - DNA, 22 bp, Homo sapiens
cagagcagtagaaaacagcctt

SEQ ID NO: 9107531 - DNA, 22 bp, Homo sapiens
cagagcaggtatctttggtgaa

SEQ ID NO: 9107532 - DNA, 22 bp, Homo sapiens
cagagcagtaaatctggggcac

SEQ ID NO: 9107533 - DNA, 22 bp, Homo sapiens
cagagcaccagtgggagacaag

SEQ ID NO: 9107534 - DNA, 22 bp, Homo sapiens
cagagcagggtgcaccttgggc

SEQ ID NO: 9107535 - DNA, 22 bp, Homo sapiens
cagagcaggggtttcccaggtt

SEQ ID NO: 9107536 - DNA, 22 bp, Homo sapiens
cagagcaggggtttcccaggtt

SEQ ID NO: 9107537 - DNA, 22 bp, Homo sapiens
agccagggacgctgcaggctac

SEQ ID NO: 9107538 - DNA, 23 bp, Homo sapiens
agccagggcactggtggagattg

SEQ ID NO: 9107539 - DNA, 22 bp, Homo sapiens
agccagggatgcagcacagtga

SEQ ID NO: 9107540 - DNA, 22 bp, Homo sapiens
agccagggacgctgcaggctac

SEQ ID NO: 9107541 - DNA, 22 bp, Homo sapiens
agccagggacgctgcaggctac

SEQ ID NO: 9107542 - DNA, 22 bp, Homo sapiens
agccaggctgcagttggctggc

SEQ ID NO: 9107543 - DNA, 22 bp, Homo sapiens
agccaggccttttctcaaggtt

SEQ ID NO: 9107544 - DNA, 22 bp, Homo sapiens
agccaggctcaaggcctgctcc

SEQ ID NO: 9107545 - DNA, 22 bp, Homo sapiens
agccaagcaccactggcactcg

SEQ ID NO: 9107546 - DNA, 22 bp, Homo sapiens
agccaagaggagcctaaagcga

SEQ ID NO: 9107547 - DNA, 22 bp, Homo sapiens
agccaagcactcaactcctgga

SEQ ID NO: 9107548 - DNA, 22 bp, Homo sapiens
agccaagacatttagaaaagct

SEQ ID NO: 9107549 - DNA, 22 bp, Homo sapiens
agccaagagatgaggctgcagg

SEQ ID NO: 9107550 - DNA, 22 bp, Homo sapiens
agccaactaggagattaaggta

SEQ ID NO: 9107551 - DNA, 22 bp, Homo sapiens
agccaagaatcatgagctaata

SEQ ID NO: 9107552 - DNA, 22 bp, Homo sapiens
cagatatgtggattctattagc

SEQ ID NO: 9107553 - DNA, 22 bp, Homo sapiens
cagatatgtggattctattagc

SEQ ID NO: 9107554 - DNA, 22 bp, Homo sapiens
agcctaggtctgggtctagcag

SEQ ID NO: 9107555 - DNA, 22 bp, Homo sapiens
agcctattccaggatgagctca

SEQ ID NO: 9107556 - DNA, 22 bp, Homo sapiens
agcctattccaggatgagctca

SEQ ID NO: 9107557 - DNA, 22 bp, Homo sapiens
agcctaggtctgggtctagcag

SEQ ID NO: 9107558 - DNA, 18 bp, Homo sapiens
cagatccaggcagctatt

SEQ ID NO: 9107559 - DNA, 22 bp, Homo sapiens
cagatctagagcttttccatct

SEQ ID NO: 9107560 - DNA, 22 bp, Homo sapiens
cagatccttaggacaaccatcc

SEQ ID NO: 9107561 - DNA, 22 bp, Homo sapiens
cagatcatgaatgactgacaga

SEQ ID NO: 9107562 - DNA, 22 bp, Homo sapiens
agcctagggggtcctgggccac

SEQ ID NO: 9107563 - DNA, 22 bp, Homo sapiens
agcctagggggtcctgggccac

SEQ ID NO: 9107564 - DNA, 22 bp, Homo sapiens
agccggccatgtggtcttgtgc

SEQ ID NO: 9107565 - DNA, 22 bp, Homo sapiens
agccggccatgtggtcttgtgc

SEQ ID NO: 9107566 - DNA, 22 bp, Homo sapiens
agccctttccaatttgatttat

SEQ ID NO: 9107567 - DNA, 22 bp, Homo sapiens
agcccttgagtgtatctcaaat

SEQ ID NO: 9107568 - DNA, 22 bp, Homo sapiens
agcccttggtattttccgatcc

SEQ ID NO: 9107569 - DNA, 22 bp, Homo sapiens
agcccttagtacatttctcaag

SEQ ID NO: 9107570 - DNA, 22 bp, Homo sapiens
agcccttcaacctgcctactcc

SEQ ID NO: 9107571 - DNA, 22 bp, Homo sapiens
agcccttcaagagctctgtcct

SEQ ID NO: 9107572 - DNA, 22 bp, Homo sapiens
agcccttcaagagctctgtcct

SEQ ID NO: 9107573 - DNA, 19 bp, Homo sapiens
agcctggagggctggtcac

SEQ ID NO: 9107574 - DNA, 18 bp, Homo sapiens
agcctggagggttgaagt

SEQ ID NO: 9107575 - DNA, 22 bp, Homo sapiens
agcctggaggccaggagacagt

SEQ ID NO: 9107576 - DNA, 19 bp, Homo sapiens
agcctggagggctggtcac

SEQ ID NO: 9107577 - DNA, 22 bp, Homo sapiens
agcctggagaagatgtgtattg

SEQ ID NO: 9107578 - DNA, 22 bp, Homo sapiens
agcctggaattaaggaaatgca

SEQ ID NO: 9107579 - DNA, 22 bp, Homo sapiens
agcctggacagctacggagaac

SEQ ID NO: 9107580 - DNA, 22 bp, Homo sapiens
agcctggagcttgagttatgag

SEQ ID NO: 9107581 - DNA, 22 bp, Homo sapiens
agcctggaggaggagttgagca

SEQ ID NO: 9107582 - DNA, 22 bp, Homo sapiens
agcctggagaggcgccatacac

SEQ ID NO: 9107583 - DNA, 22 bp, Homo sapiens
cagatgaactgtgactgaaaat

SEQ ID NO: 9107584 - DNA, 22 bp, Homo sapiens
cagatgaactgtgactgaaaat

SEQ ID NO: 9107585 - DNA, 22 bp, Homo sapiens
cagatctgtagtaaaagatctc

SEQ ID NO: 9107586 - DNA, 22 bp, Homo sapiens
cagatctatctgttgatggtgc

SEQ ID NO: 9107587 - DNA, 22 bp, Homo sapiens
agcctgcttgagagtcctggct

SEQ ID NO: 9107588 - DNA, 22 bp, Homo sapiens
agcctggaagaacctgaagtct

SEQ ID NO: 9107589 - DNA, 22 bp, Homo sapiens
agcctgagtgcttaggactgtt

SEQ ID NO: 9107590 - DNA, 22 bp, Homo sapiens
agcctgagtgcttaggactgtt

SEQ ID NO: 9107591 - DNA, 22 bp, Homo sapiens
agcctgagtgcttaggactgtt

SEQ ID NO: 9107592 - DNA, 22 bp, Homo sapiens
agcctgagctgcctgccgcctc

SEQ ID NO: 9107593 - DNA, 22 bp, Homo sapiens
agccctgggctgtagataagca

SEQ ID NO: 9107594 - DNA, 22 bp, Homo sapiens
agccctgggctgtagataagca

SEQ ID NO: 9107595 - DNA, 22 bp, Homo sapiens
agccctctgagctagtcaccat

SEQ ID NO: 9107596 - DNA, 22 bp, Homo sapiens
agccctcttccagccagcacag

SEQ ID NO: 9107597 - DNA, 22 bp, Homo sapiens
agccctcttcccagatgcctca

SEQ ID NO: 9107598 - DNA, 22 bp, Homo sapiens
agccctgaagctggccatgtcc

SEQ ID NO: 9107599 - DNA, 20 bp, Homo sapiens
agccctcttgctttagggta

SEQ ID NO: 9107600 - DNA, 22 bp, Homo sapiens
agccctctgctgttctagtctc

SEQ ID NO: 9107601 - DNA, 20 bp, Homo sapiens
agccctcttccagatgaagg

SEQ ID NO: 9107602 - DNA, 22 bp, Homo sapiens
agccctctgctgttctagtctc

SEQ ID NO: 9107603 - DNA, 22 bp, Homo sapiens
agccctctgagctagtcaccat

SEQ ID NO: 9107604 - DNA, 22 bp, Homo sapiens
agccctctgcaaacacctgata

SEQ ID NO: 9107605 - DNA, 22 bp, Homo sapiens
agccctctgagctagtcaccat

SEQ ID NO: 9107606 - DNA, 22 bp, Homo sapiens
agccctctgagcctgggttgta

SEQ ID NO: 9107607 - DNA, 22 bp, Homo sapiens
agccctctccctttcttcttag

SEQ ID NO: 9107608 - DNA, 22 bp, Homo sapiens
agccctctctatggccctcttg

SEQ ID NO: 9107609 - DNA, 22 bp, Homo sapiens
agccctctctttagagatctga

SEQ ID NO: 9107610 - DNA, 21 bp, Homo sapiens
agccctctccaattccctttt

SEQ ID NO: 9107611 - DNA, 22 bp, Homo sapiens
agccctctaagcaagagaggaa

SEQ ID NO: 9107612 - DNA, 22 bp, Homo sapiens
agccctctccaccttcgaaaaa

SEQ ID NO: 9107613 - DNA, 22 bp, Homo sapiens
agccctcctttgttcatgctgc

SEQ ID NO: 9107614 - DNA, 22 bp, Homo sapiens
agccctctaaaaatgataacta

SEQ ID NO: 9107615 - DNA, 22 bp, Homo sapiens
agccctcgtttctgcatcctgt

SEQ ID NO: 9107616 - DNA, 22 bp, Homo sapiens
cagagtggcgaccccctcagct

SEQ ID NO: 9107617 - DNA, 22 bp, Homo sapiens
agccctcctcacatcagcgtcc

SEQ ID NO: 9107618 - DNA, 22 bp, Homo sapiens
cagagtggagatgtgtgtggaa

SEQ ID NO: 9107619 - DNA, 22 bp, Homo sapiens
cagaggaggcggtatacactgc

SEQ ID NO: 9107620 - DNA, 22 bp, Homo sapiens
cagaggaggccaccgcataggc

SEQ ID NO: 9107621 - DNA, 17 bp, Homo sapiens
cagaggagctttggggg

SEQ ID NO: 9107622 - DNA, 18 bp, Homo sapiens
cagaggagagacattcag

SEQ ID NO: 9107623 - DNA, 18 bp, Homo sapiens
cagaggagagacattcag

SEQ ID NO: 9107624 - DNA, 20 bp, Homo sapiens
cagaggagtacatatgttca

SEQ ID NO: 9107625 - DNA, 21 bp, Homo sapiens
cagaggtggcctgacctctga

SEQ ID NO: 9107626 - DNA, 22 bp, Homo sapiens
cagaggtgctggagtgagtcct

SEQ ID NO: 9107627 - DNA, 22 bp, Homo sapiens
cagaggagttcagtacacagcc

SEQ ID NO: 9107628 - DNA, 22 bp, Homo sapiens
cagagtgaaataggggatcaag

SEQ ID NO: 9107629 - DNA, 22 bp, Homo sapiens
cagagtgagggcctgcacctgc

SEQ ID NO: 9107630 - DNA, 22 bp, Homo sapiens
cagagtgatggcacctgctggg

SEQ ID NO: 9107631 - DNA, 22 bp, Homo sapiens
cagagtgatttgatgagttgca

SEQ ID NO: 9107632 - DNA, 22 bp, Homo sapiens
cactagaaaggtacagattatg

SEQ ID NO: 9107633 - DNA, 22 bp, Homo sapiens
cactaggctggagtgcagtggc

SEQ ID NO: 9107634 - DNA, 22 bp, Homo sapiens
agcaggtggacagaggaagaaa

SEQ ID NO: 9107635 - DNA, 22 bp, Homo sapiens
agcaggtggacagaggaagaaa

SEQ ID NO: 9107636 - DNA, 22 bp, Homo sapiens
cactaaatgcctaggaagaagc

SEQ ID NO: 9107637 - DNA, 22 bp, Homo sapiens
cactaaatgtttcaatgtggga

SEQ ID NO: 9107638 - DNA, 22 bp, Homo sapiens
cactaagttggtgttaattagt

SEQ ID NO: 9107639 - DNA, 22 bp, Homo sapiens
cactaattccatctccttttcc

SEQ ID NO: 9107640 - DNA, 22 bp, Homo sapiens
agcaggtgggatcaagctggca

SEQ ID NO: 9107641 - DNA, 22 bp, Homo sapiens
agcaggtggccacgaggaggag

SEQ ID NO: 9107642 - DNA, 22 bp, Homo sapiens
agcaggtggatttagacgggag

SEQ ID NO: 9107643 - DNA, 22 bp, Homo sapiens
cacattgggatgaagtctaaaa

SEQ ID NO: 9107644 - DNA, 22 bp, Homo sapiens
cacattgcagacgtatattatt

SEQ ID NO: 9107645 - DNA, 22 bp, Homo sapiens
cacattgcaggttgagaaggtg

SEQ ID NO: 9107646 - DNA, 22 bp, Homo sapiens
cacatttaagcagatgtggacc

SEQ ID NO: 9107647 - DNA, 22 bp, Homo sapiens
cacatttaaaaaatccacgatc

SEQ ID NO: 9107648 - DNA, 22 bp, Homo sapiens
cacatttaaaggttgaagctga

SEQ ID NO: 9107649 - DNA, 22 bp, Homo sapiens
cacctgagtgtcagtattctca

SEQ ID NO: 9107650 - DNA, 22 bp, Homo sapiens
cacatttaagtgcttgttcaga

SEQ ID NO: 9107651 - DNA, 22 bp, Homo sapiens
cacgtgagaccttgcagaggtg

SEQ ID NO: 9107652 - DNA, 22 bp, Homo sapiens
cacgtgagaccttgcagaggtg

SEQ ID NO: 9107653 - DNA, 22 bp, Homo sapiens
cacatgtacagaagcaggctgg

SEQ ID NO: 9107654 - DNA, 22 bp, Homo sapiens
cacatgtagtaagcaggcaatg

SEQ ID NO: 9107655 - DNA, 22 bp, Homo sapiens
cacatgaagagagtctagtaat

SEQ ID NO: 9107656 - DNA, 23 bp, Homo sapiens
cacatggaggaccgttcttataa

SEQ ID NO: 9107657 - DNA, 22 bp, Homo sapiens
cacaggctcttctcacttgatt

SEQ ID NO: 9107658 - DNA, 22 bp, Homo sapiens
cacatgaacatgctggaaaagc

SEQ ID NO: 9107659 - DNA, 22 bp, Homo sapiens
cacaggctgcccgcagctggga

SEQ ID NO: 9107660 - DNA, 22 bp, Homo sapiens
cacaggctctccagggcctgga

SEQ ID NO: 9107661 - DNA, 22 bp, Homo sapiens
cacaggctcttctcacttgatt

SEQ ID NO: 9107662 - DNA, 22 bp, Homo sapiens
cacaggctccggccttgcagcc

SEQ ID NO: 9107663 - DNA, 22 bp, Homo sapiens
cacaggctccggccttgcagcc

SEQ ID NO: 9107664 - DNA, 22 bp, Homo sapiens
cacaggctccggccttgcagcc

SEQ ID NO: 9107665 - DNA, 20 bp, Homo sapiens
cacaggctatatgagagcca

SEQ ID NO: 9107666 - DNA, 18 bp, Homo sapiens
cacaggctcccagtgagg

SEQ ID NO: 9107667 - DNA, 20 bp, Homo sapiens
cacaggctatatgagagcca

SEQ ID NO: 9107668 - DNA, 19 bp, Homo sapiens
agcaggctaggctgcctct

SEQ ID NO: 9107669 - DNA, 22 bp, Homo sapiens
agcaggctaggaacctcactgc

SEQ ID NO: 9107670 - DNA, 20 bp, Homo sapiens
agcaggccttggggagagga

SEQ ID NO: 9107671 - DNA, 18 bp, Homo sapiens
agcaggcgttgcctggga

SEQ ID NO: 9107672 - DNA, 22 bp, Homo sapiens
agcaggctaatcttgctgaaca

SEQ ID NO: 9107673 - DNA, 22 bp, Homo sapiens
agcaggctactcctgtgttcgt

SEQ ID NO: 9107674 - DNA, 22 bp, Homo sapiens
agcaggctactcctgtgttcgt

SEQ ID NO: 9107675 - DNA, 22 bp, Homo sapiens
agcaggctaagggacctgttta

SEQ ID NO: 9107676 - DNA, 22 bp, Homo sapiens
agcaggctaaataataatacat

SEQ ID NO: 9107677 - DNA, 22 bp, Homo sapiens
agcaggctaagggacctgttta

SEQ ID NO: 9107678 - DNA, 22 bp, Homo sapiens
agcaggccactgcagctggagc

SEQ ID NO: 9107679 - DNA, 21 bp, Homo sapiens
agcattcaaaagatgccataa

SEQ ID NO: 9107680 - DNA, 22 bp, Homo sapiens
agcattatgtccatgctaaatt

SEQ ID NO: 9107681 - DNA, 22 bp, Homo sapiens
cactgcacttcagcctgggtga

SEQ ID NO: 9107682 - DNA, 22 bp, Homo sapiens
cactgcacttcagcctgggtga

SEQ ID NO: 9107683 - DNA, 22 bp, Homo sapiens
cactgcactccatcctgggaaa

SEQ ID NO: 9107684 - DNA, 22 bp, Homo sapiens
cactgcacttcagcctgggtga

SEQ ID NO: 9107685 - DNA, 22 bp, Homo sapiens
cactgcacttcagcctgggtga

SEQ ID NO: 9107686 - DNA, 22 bp, Homo sapiens
cactgcacttcagcctgggtga

SEQ ID NO: 9107687 - DNA, 20 bp, Homo sapiens
agcatttgaaatatgactat

SEQ ID NO: 9107688 - DNA, 22 bp, Homo sapiens
agcatttagttagtaaatgttt

SEQ ID NO: 9107689 - DNA, 22 bp, Homo sapiens
agcatttagtctttattgcagc

SEQ ID NO: 9107690 - DNA, 22 bp, Homo sapiens
cactgcactccagcccgggcaa

SEQ ID NO: 9107691 - DNA, 22 bp, Homo sapiens
cactgcactccagcccgggcaa

SEQ ID NO: 9107692 - DNA, 22 bp, Homo sapiens
cactgcactccagcccgggcaa

SEQ ID NO: 9107693 - DNA, 22 bp, Homo sapiens
cactgcactccatcctgggaaa

SEQ ID NO: 9107694 - DNA, 22 bp, Homo sapiens
cactgcactccatcctgggaaa

SEQ ID NO: 9107695 - DNA, 22 bp, Homo sapiens
cactgcactccatcctgggaaa

SEQ ID NO: 9107696 - DNA, 22 bp, Homo sapiens
cactgcaacctccacctcctgg

SEQ ID NO: 9107697 - DNA, 22 bp, Homo sapiens
cactgcaacctctgccacctgg

SEQ ID NO: 9107698 - DNA, 22 bp, Homo sapiens
cactgcaacctccacctcctgg

SEQ ID NO: 9107699 - DNA, 22 bp, Homo sapiens
cactgaactccttgtttgtcct

SEQ ID NO: 9107700 - DNA, 22 bp, Homo sapiens
cactgcaccctcaaactcctgg

SEQ ID NO: 9107701 - DNA, 22 bp, Homo sapiens
cactgcaagctctgccacctgg

SEQ ID NO: 9107702 - DNA, 22 bp, Homo sapiens
cactgcacaatgtagcaaagaa

SEQ ID NO: 9107703 - DNA, 22 bp, Homo sapiens
cactgcactccagcccgggcaa

SEQ ID NO: 9107704 - DNA, 22 bp, Homo sapiens
cactgcactccagcactccagc

SEQ ID NO: 9107705 - DNA, 22 bp, Homo sapiens
cagaaacctccctgaatatttt

SEQ ID NO: 9107706 - DNA, 22 bp, Homo sapiens
cagaaactagatttagacacaa

SEQ ID NO: 9107707 - DNA, 22 bp, Homo sapiens
cagaaacctgtctggagtggga

SEQ ID NO: 9107708 - DNA, 22 bp, Homo sapiens
cagaaaccaaatgggatgggga

SEQ ID NO: 9107709 - DNA, 22 bp, Homo sapiens
cagaaacatgtataaagttgta

SEQ ID NO: 9107710 - DNA, 20 bp, Homo sapiens
cagaaagaaggtagattttt

SEQ ID NO: 9107711 - DNA, 22 bp, Homo sapiens
cagaaagacctgggctcaagag

SEQ ID NO: 9107712 - DNA, 22 bp, Homo sapiens
cagaaagacctgggctcaagag

SEQ ID NO: 9107713 - DNA, 22 bp, Homo sapiens
agccaaagatcagtgtgcaagt

SEQ ID NO: 9107714 - DNA, 22 bp, Homo sapiens
agccaaagtccaaatgcagtgt

SEQ ID NO: 9107715 - DNA, 22 bp, Homo sapiens
agccaaagtggtatatagggaa

SEQ ID NO: 9107716 - DNA, 22 bp, Homo sapiens
agccaacagccagcatcaacca

SEQ ID NO: 9107717 - DNA, 22 bp, Homo sapiens
agccaacaactctgagcccagt

SEQ ID NO: 9107718 - DNA, 22 bp, Homo sapiens
agccaacagccagcatcaacca

SEQ ID NO: 9107719 - DNA, 22 bp, Homo sapiens
agccaaagatcagtgtgcaagt

SEQ ID NO: 9107720 - DNA, 22 bp, Homo sapiens
agccaaagatcagtgtgcaagt

SEQ ID NO: 9107721 - DNA, 20 bp, Homo sapiens
agccaaaggagaacagtgct

SEQ ID NO: 9107722 - DNA, 22 bp, Homo sapiens
cactggtacgtaggttggggca

SEQ ID NO: 9107723 - DNA, 22 bp, Homo sapiens
cactggtacactgaatggcgtt

SEQ ID NO: 9107724 - DNA, 22 bp, Homo sapiens
cactttgcttagagaacaaggc

SEQ ID NO: 9107725 - DNA, 22 bp, Homo sapiens
cactttgcctcttacctgtggt

SEQ ID NO: 9107726 - DNA, 19 bp, Homo sapiens
cactttgctgaactcttct

SEQ ID NO: 9107727 - DNA, 19 bp, Homo sapiens
cactttgctgaactcttct

SEQ ID NO: 9107728 - DNA, 22 bp, Homo sapiens
cactttgcagggtggtgggagg

SEQ ID NO: 9107729 - DNA, 22 bp, Homo sapiens
cactggtatttgaaaatagatg

SEQ ID NO: 9107730 - DNA, 22 bp, Homo sapiens
cactggtagtttcagcaaccag

SEQ ID NO: 9107731 - DNA, 22 bp, Homo sapiens
cactggtagcagttaagttagg

SEQ ID NO: 9107732 - DNA, 21 bp, Homo sapiens
cactggtagatggcccgcagg

SEQ ID NO: 9107733 - DNA, 22 bp, Homo sapiens
cactggtagagagaagacaagg

SEQ ID NO: 9107734 - DNA, 20 bp, Homo sapiens
agcattttatggtaggaaac

SEQ ID NO: 9107735 - DNA, 20 bp, Homo sapiens
agcattttatggtaggaaac

SEQ ID NO: 9107736 - DNA, 17 bp, Homo sapiens
agcatttgtgttaacag

SEQ ID NO: 9107737 - DNA, 19 bp, Homo sapiens
agcatttggaattctacac

SEQ ID NO: 9107738 - DNA, 22 bp, Homo sapiens
agcattttctgagagtatagat

SEQ ID NO: 9107739 - DNA, 22 bp, Homo sapiens
agccaaaacatgtgagttttga

SEQ ID NO: 9107740 - DNA, 22 bp, Homo sapiens
cacagaaatattgtgtcccttg

SEQ ID NO: 9107741 - DNA, 22 bp, Homo sapiens
cacagaaatattgtgtcccttg

SEQ ID NO: 9107742 - DNA, 22 bp, Homo sapiens
cacagaaattattaggatgctt

SEQ ID NO: 9107743 - DNA, 20 bp, Homo sapiens
cacagaacaaattgcaggac

SEQ ID NO: 9107744 - DNA, 22 bp, Homo sapiens
cacagaacaccaaagaaccttc

SEQ ID NO: 9107745 - DNA, 22 bp, Homo sapiens
cacagaacaccaaagaaccttc

SEQ ID NO: 9107746 - DNA, 22 bp, Homo sapiens
cacagaacaccaaagaaccttc

SEQ ID NO: 9107747 - DNA, 22 bp, Homo sapiens
cacagaacaccaaagaaccttc

SEQ ID NO: 9107748 - DNA, 22 bp, Homo sapiens
cacagctgccatggctgcactt

SEQ ID NO: 9107749 - DNA, 22 bp, Homo sapiens
cacagctgccctactccatgtg

SEQ ID NO: 9107750 - DNA, 22 bp, Homo sapiens
cacagctgccctactccatgtg

SEQ ID NO: 9107751 - DNA, 22 bp, Homo sapiens
cacagctggggaagctgaggcc

SEQ ID NO: 9107752 - DNA, 22 bp, Homo sapiens
cacaggaaaaatgggtccttta

SEQ ID NO: 9107753 - DNA, 20 bp, Homo sapiens
cacaggaaagctactcagtt

SEQ ID NO: 9107754 - DNA, 20 bp, Homo sapiens
cacaggaaagctactcagtt

SEQ ID NO: 9107755 - DNA, 22 bp, Homo sapiens
cacaggaaaataaaagatctaa

SEQ ID NO: 9107756 - DNA, 22 bp, Homo sapiens
cacaggaaaataaaagatctaa

SEQ ID NO: 9107757 - DNA, 22 bp, Homo sapiens
cacaggaaagtcagccagaaga

SEQ ID NO: 9107758 - DNA, 20 bp, Homo sapiens
cacaggaaagctactcagtt

SEQ ID NO: 9107759 - DNA, 22 bp, Homo sapiens
cacaggaaatattaggagggat

SEQ ID NO: 9107760 - DNA, 22 bp, Homo sapiens
cacaggaaagtcagccagaaga

SEQ ID NO: 9107761 - DNA, 22 bp, Homo sapiens
agcaggcaggcccagcggctgg

SEQ ID NO: 9107762 - DNA, 22 bp, Homo sapiens
cacaggaagcaagcctggggcc

SEQ ID NO: 9107763 - DNA, 22 bp, Homo sapiens
agcaggcaggcccagcggctgg

SEQ ID NO: 9107764 - DNA, 22 bp, Homo sapiens
agcaggcaggcccagcggctgg

SEQ ID NO: 9107765 - DNA, 22 bp, Homo sapiens
agcaggcaggcccagcggctgg

SEQ ID NO: 9107766 - DNA, 22 bp, Homo sapiens
cacaggaagaggtatacaattc

SEQ ID NO: 9107767 - DNA, 22 bp, Homo sapiens
cacaggaagaggtatacaattc

SEQ ID NO: 9107768 - DNA, 22 bp, Homo sapiens
cacaggaagatctcccagaggt

SEQ ID NO: 9107769 - DNA, 22 bp, Homo sapiens
cacaggaaatgattctgcagca

SEQ ID NO: 9107770 - DNA, 22 bp, Homo sapiens
cacaggaaatgattctgcagca

SEQ ID NO: 9107771 - DNA, 22 bp, Homo sapiens
cacaggaacaaagaagacaatt

SEQ ID NO: 9107772 - DNA, 22 bp, Homo sapiens
cacaggaacaaagaagacaatt

SEQ ID NO: 9107773 - DNA, 22 bp, Homo sapiens
cacaggaacttactggccactt

SEQ ID NO: 9107774 - DNA, 22 bp, Homo sapiens
cacagaaaaaggcttgaaaatc

SEQ ID NO: 9107775 - DNA, 22 bp, Homo sapiens
cacactttgttgaagttttcat

SEQ ID NO: 9107776 - DNA, 22 bp, Homo sapiens
cacacatgtctctccatgctct

SEQ ID NO: 9107777 - DNA, 22 bp, Homo sapiens
cacacatgtctctccatgctct

SEQ ID NO: 9107778 - DNA, 22 bp, Homo sapiens
cacacatgtctctccatgctct

SEQ ID NO: 9107779 - DNA, 22 bp, Homo sapiens
cacacatggtagcaggtacaag

SEQ ID NO: 9107780 - DNA, 22 bp, Homo sapiens
cacacatggtcagtggctactc

SEQ ID NO: 9107781 - DNA, 22 bp, Homo sapiens
caatttttgtacttatagtact

SEQ ID NO: 9107782 - DNA, 22 bp, Homo sapiens
cacacatgaatccctagtacct

SEQ ID NO: 9107783 - DNA, 22 bp, Homo sapiens
cacacatgcatgtaagacctct

SEQ ID NO: 9107784 - DNA, 22 bp, Homo sapiens
caatttcttgttaattctcagg

SEQ ID NO: 9107785 - DNA, 22 bp, Homo sapiens
caatttgccctgttaaattttc

SEQ ID NO: 9107786 - DNA, 22 bp, Homo sapiens
caatttctgggcctcacacaag

SEQ ID NO: 9107787 - DNA, 22 bp, Homo sapiens
caatttctctttatatctcaca

SEQ ID NO: 9107788 - DNA, 22 bp, Homo sapiens
caatttctctttatatctcaca

SEQ ID NO: 9107789 - DNA, 22 bp, Homo sapiens
caattcaatggcaaagtattgt

SEQ ID NO: 9107790 - DNA, 22 bp, Homo sapiens
caattcaatggcaaagtattgt

SEQ ID NO: 9107791 - DNA, 22 bp, Homo sapiens
caattcaagttgagtacagctt

SEQ ID NO: 9107792 - DNA, 22 bp, Homo sapiens
caattcaaatgcatagttcaca

SEQ ID NO: 9107793 - DNA, 22 bp, Homo sapiens
caattcaacctaagtgcatcca

SEQ ID NO: 9107794 - DNA, 22 bp, Homo sapiens
caattcaacctaagtgcatcca

SEQ ID NO: 9107795 - DNA, 22 bp, Homo sapiens
cacacagacagctctctgaaga

SEQ ID NO: 9107796 - DNA, 22 bp, Homo sapiens
caatttttaaactatgaagttg

SEQ ID NO: 9107797 - DNA, 22 bp, Homo sapiens
caattttattggtccaaataca

SEQ ID NO: 9107798 - DNA, 22 bp, Homo sapiens
caattttactcttcctcttcca

SEQ ID NO: 9107799 - DNA, 18 bp, Homo sapiens
caattttacccagtccct

SEQ ID NO: 9107800 - DNA, 22 bp, Homo sapiens
caattttattggtccaaataca

SEQ ID NO: 9107801 - DNA, 22 bp, Homo sapiens
caaggaaggagagatgatgggt

SEQ ID NO: 9107802 - DNA, 22 bp, Homo sapiens
caaggaaggagagatgatgggt

SEQ ID NO: 9107803 - DNA, 22 bp, Homo sapiens
caaggaagttttaggagaggaa

SEQ ID NO: 9107804 - DNA, 21 bp, Homo sapiens
agcagacagatgcacgcacac

SEQ ID NO: 9107805 - DNA, 22 bp, Homo sapiens
caaggaagttttaggagaggaa

SEQ ID NO: 9107806 - DNA, 22 bp, Homo sapiens
agcagacaggctgccacagtgc

SEQ ID NO: 9107807 - DNA, 22 bp, Homo sapiens
agcagacaggtaggaggataaa

SEQ ID NO: 9107808 - DNA, 22 bp, Homo sapiens
agcagacatatctcatgtcaca

SEQ ID NO: 9107809 - DNA, 22 bp, Homo sapiens
agcagacatatctcatgtcaca

SEQ ID NO: 9107810 - DNA, 22 bp, Homo sapiens
agcagacatatctcatgtcaca

SEQ ID NO: 9107811 - DNA, 22 bp, Homo sapiens
agcagacaggctgccacagtgc

SEQ ID NO: 9107812 - DNA, 21 bp, Homo sapiens
agcagacagcccaagaaaatc

SEQ ID NO: 9107813 - DNA, 21 bp, Homo sapiens
agcagacagatgcacgcacac

SEQ ID NO: 9107814 - DNA, 21 bp, Homo sapiens
agcagacagatgcacgcacac

SEQ ID NO: 9107815 - DNA, 21 bp, Homo sapiens
agcagacagatgcacgcacac

SEQ ID NO: 9107816 - DNA, 22 bp, Homo sapiens
agcagacatggcttggatgtgg

SEQ ID NO: 9107817 - DNA, 22 bp, Homo sapiens
agcagagaagacacaggcttca

SEQ ID NO: 9107818 - DNA, 22 bp, Homo sapiens
caagggaagaggacagggacct

SEQ ID NO: 9107819 - DNA, 22 bp, Homo sapiens
caaggccaaagggccactgtca

SEQ ID NO: 9107820 - DNA, 22 bp, Homo sapiens
agcagagaccatatagcccaga

SEQ ID NO: 9107821 - DNA, 22 bp, Homo sapiens
caagcagaggtttatgtattag

SEQ ID NO: 9107822 - DNA, 22 bp, Homo sapiens
caagcagagaggttagaacaca

SEQ ID NO: 9107823 - DNA, 22 bp, Homo sapiens
caagctggaggttggagctact

SEQ ID NO: 9107824 - DNA, 22 bp, Homo sapiens
caagctggagttcctcagagtg

SEQ ID NO: 9107825 - DNA, 22 bp, Homo sapiens
caaggaaaacagatgatcaaca

SEQ ID NO: 9107826 - DNA, 22 bp, Homo sapiens
caaggaaaaagcgagctcgggg

SEQ ID NO: 9107827 - DNA, 22 bp, Homo sapiens
caagctttccattacacacatt

SEQ ID NO: 9107828 - DNA, 22 bp, Homo sapiens
caagcttaagacagaagaggca

SEQ ID NO: 9107829 - DNA, 22 bp, Homo sapiens
caaggaaacatgaaatgcattg

SEQ ID NO: 9107830 - DNA, 22 bp, Homo sapiens
caaggaaacatgaaatgcattg

SEQ ID NO: 9107831 - DNA, 22 bp, Homo sapiens
caaggaaaagaagtatttcaga

SEQ ID NO: 9107832 - DNA, 22 bp, Homo sapiens
caaggaaaacagatgatcaaca

SEQ ID NO: 9107833 - DNA, 22 bp, Homo sapiens
caattatatttagaatgataca

SEQ ID NO: 9107834 - DNA, 22 bp, Homo sapiens
caattatatttagaatgataca

SEQ ID NO: 9107835 - DNA, 22 bp, Homo sapiens
caattacatttattgagcattc

SEQ ID NO: 9107836 - DNA, 22 bp, Homo sapiens
caattaaagaagacctgcctca

SEQ ID NO: 9107837 - DNA, 22 bp, Homo sapiens
caagtctgacctctgggtgaag

SEQ ID NO: 9107838 - DNA, 22 bp, Homo sapiens
caagtctgacctctgggtgaag

SEQ ID NO: 9107839 - DNA, 22 bp, Homo sapiens
caagtctgacctctgggtgaag

SEQ ID NO: 9107840 - DNA, 22 bp, Homo sapiens
caagtccttttcttggctcagg

SEQ ID NO: 9107841 - DNA, 22 bp, Homo sapiens
caagtccttttcttggctcagg

SEQ ID NO: 9107842 - DNA, 22 bp, Homo sapiens
caagtcctcgcttctagctgtg

SEQ ID NO: 9107843 - DNA, 22 bp, Homo sapiens
caagtcctcaaagggctctgct

SEQ ID NO: 9107844 - DNA, 22 bp, Homo sapiens
caagtccttagatggttctttg

SEQ ID NO: 9107845 - DNA, 22 bp, Homo sapiens
caagtctgtctgctcctgtgtg

SEQ ID NO: 9107846 - DNA, 22 bp, Homo sapiens
caagtctgacctctgggtgaag

SEQ ID NO: 9107847 - DNA, 22 bp, Homo sapiens
caagggcttcaagtggccaaga

SEQ ID NO: 9107848 - DNA, 22 bp, Homo sapiens
caagggaaggctaagggcaaca

SEQ ID NO: 9107849 - DNA, 22 bp, Homo sapiens
caagggaattgtgtgtgagagg

SEQ ID NO: 9107850 - DNA, 22 bp, Homo sapiens
caagggcagatagctggtccaa

SEQ ID NO: 9107851 - DNA, 22 bp, Homo sapiens
caagggagttactgagggcggg

SEQ ID NO: 9107852 - DNA, 22 bp, Homo sapiens
caaacattgggggcttcaacac

SEQ ID NO: 9107853 - DNA, 22 bp, Homo sapiens
caaacattgctaccagaggttt

SEQ ID NO: 9107854 - DNA, 22 bp, Homo sapiens
caaacatttgacttctctcagg

SEQ ID NO: 9107855 - DNA, 22 bp, Homo sapiens
caaacatttaggaggagggagg

SEQ ID NO: 9107856 - DNA, 22 bp, Homo sapiens
caaacatttgacttctctcagg

SEQ ID NO: 9107857 - DNA, 22 bp, Homo sapiens
agcaatcagcttctttgtgttt

SEQ ID NO: 9107858 - DNA, 22 bp, Homo sapiens
caaacattttaaataagggata

SEQ ID NO: 9107859 - DNA, 22 bp, Homo sapiens
caaacattttctacttccagga

SEQ ID NO: 9107860 - DNA, 22 bp, Homo sapiens
caaacatttgttggaacccctg

SEQ ID NO: 9107861 - DNA, 22 bp, Homo sapiens
caaacattttaaataagggata

SEQ ID NO: 9107862 - DNA, 22 bp, Homo sapiens
caaacattttgagtggtttctg

SEQ ID NO: 9107863 - DNA, 22 bp, Homo sapiens
caaagggctctagactcagcag

SEQ ID NO: 9107864 - DNA, 22 bp, Homo sapiens
caaagggctctagactcagcag

SEQ ID NO: 9107865 - DNA, 22 bp, Homo sapiens
caaagtgctgggattacaggtg

SEQ ID NO: 9107866 - DNA, 22 bp, Homo sapiens
caaagtgctgggattagtgctg

SEQ ID NO: 9107867 - DNA, 22 bp, Homo sapiens
caaagtgctgggattataggca

SEQ ID NO: 9107868 - DNA, 22 bp, Homo sapiens
caaagtgctgggattacaggct

SEQ ID NO: 9107869 - DNA, 22 bp, Homo sapiens
caaagtgctgggattacaggtg

SEQ ID NO: 9107870 - DNA, 22 bp, Homo sapiens
agcaatgaaaacaataaggtga

SEQ ID NO: 9107871 - DNA, 23 bp, Homo sapiens
agcaatgctgggagactctgtaa

SEQ ID NO: 9107872 - DNA, 22 bp, Homo sapiens
agcaatgctaccgggtgattcg

SEQ ID NO: 9107873 - DNA, 23 bp, Homo sapiens
agcaatgctgggagactctgtaa

SEQ ID NO: 9107874 - DNA, 22 bp, Homo sapiens
caaagttgcagttatgtgatta

SEQ ID NO: 9107875 - DNA, 22 bp, Homo sapiens
caaagttttagtaaacatatat

SEQ ID NO: 9107876 - DNA, 22 bp, Homo sapiens
attttgtgaaccctcaagcaat

SEQ ID NO: 9107877 - DNA, 22 bp, Homo sapiens
attttgtggcagatgcagaacc

SEQ ID NO: 9107878 - DNA, 21 bp, Homo sapiens
attttgtacatagaatttgtc

SEQ ID NO: 9107879 - DNA, 22 bp, Homo sapiens
attttgtgaaccctcaagcaat

SEQ ID NO: 9107880 - DNA, 22 bp, Homo sapiens
attttgtggcagatgcagaacc

SEQ ID NO: 9107881 - DNA, 22 bp, Homo sapiens
attttgttatagaactctgtga

SEQ ID NO: 9107882 - DNA, 22 bp, Homo sapiens
attttgtggcagatgcagaacc

SEQ ID NO: 9107883 - DNA, 22 bp, Homo sapiens
attttgttgatggtggagtagc

SEQ ID NO: 9107884 - DNA, 22 bp, Homo sapiens
attttttcagattgagtgttaa

SEQ ID NO: 9107885 - DNA, 22 bp, Homo sapiens
attttttatataccaaggtggg

SEQ ID NO: 9107886 - DNA, 22 bp, Homo sapiens
agcaataacagaaaactttcct

SEQ ID NO: 9107887 - DNA, 23 bp, Homo sapiens
agcaataagaagggatacatgtg

SEQ ID NO: 9107888 - DNA, 22 bp, Homo sapiens
agcaaggggcagtgaaagtgtg

SEQ ID NO: 9107889 - DNA, 22 bp, Homo sapiens
agcaaggtggagaaggatgggt

SEQ ID NO: 9107890 - DNA, 20 bp, Homo sapiens
agcaaggctggagcttatgg

SEQ ID NO: 9107891 - DNA, 22 bp, Homo sapiens
attttttgttaactcaggatag

SEQ ID NO: 9107892 - DNA, 23 bp, Homo sapiens
attttttgtctttgtaactagat

SEQ ID NO: 9107893 - DNA, 22 bp, Homo sapiens
attttttcagattgagtgttaa

SEQ ID NO: 9107894 - DNA, 23 bp, Homo sapiens
attttttgtctttgtaactagat

SEQ ID NO: 9107895 - DNA, 22 bp, Homo sapiens
attttttcccagttagccagga

SEQ ID NO: 9107896 - DNA, 22 bp, Homo sapiens
attttttcccagttagccagga

SEQ ID NO: 9107897 - DNA, 22 bp, Homo sapiens
agcaaggctaaatttcagttat

SEQ ID NO: 9107898 - DNA, 22 bp, Homo sapiens
attttttctgtaaactggcctt

SEQ ID NO: 9107899 - DNA, 20 bp, Homo sapiens
agcaagagtgtacctggcca

SEQ ID NO: 9107900 - DNA, 22 bp, Homo sapiens
agcaagatgaaggattcaagac

SEQ ID NO: 9107901 - DNA, 22 bp, Homo sapiens
agatgacagccaaggagatgaa

SEQ ID NO: 9107902 - DNA, 22 bp, Homo sapiens
agatgacagctacgggatgaaa

SEQ ID NO: 9107903 - DNA, 22 bp, Homo sapiens
agatgagaatttttagagtgct

SEQ ID NO: 9107904 - DNA, 23 bp, Homo sapiens
agatgagccaacacctccatgcc

SEQ ID NO: 9107905 - DNA, 21 bp, Homo sapiens
agatgaggatactgaggccta

SEQ ID NO: 9107906 - DNA, 23 bp, Homo sapiens
agatgaggcttctccatgttggt

SEQ ID NO: 9107907 - DNA, 22 bp, Homo sapiens
agatgaggggtagaaaggactt

SEQ ID NO: 9107908 - DNA, 22 bp, Homo sapiens
atttgaatggcttaacacaacg

SEQ ID NO: 9107909 - DNA, 22 bp, Homo sapiens
atttgacaacttctggtggcat

SEQ ID NO: 9107910 - DNA, 22 bp, Homo sapiens
atttgaagaaagttttctagat

SEQ ID NO: 9107911 - DNA, 22 bp, Homo sapiens
atttgaatgcaggtagctgagt

SEQ ID NO: 9107912 - DNA, 22 bp, Homo sapiens
atttgaaatcccttctactgta

SEQ ID NO: 9107913 - DNA, 19 bp, Homo sapiens
atttgaaagctgtgcttgc

SEQ ID NO: 9107914 - DNA, 22 bp, Homo sapiens
atttgaaatctgggttactctg

SEQ ID NO: 9107915 - DNA, 22 bp, Homo sapiens
atttgaaatctgggttactctg

SEQ ID NO: 9107916 - DNA, 22 bp, Homo sapiens
atttctcttagcaagacattac

SEQ ID NO: 9107917 - DNA, 22 bp, Homo sapiens
atttacaggtagaattttaagt

SEQ ID NO: 9107918 - DNA, 22 bp, Homo sapiens
atttcttttcaagagggtgctt

SEQ ID NO: 9107919 - DNA, 23 bp, Homo sapiens
atttgaaactttcttgtttccag

SEQ ID NO: 9107920 - DNA, 22 bp, Homo sapiens
atttacagccttgaaaacagca

SEQ ID NO: 9107921 - DNA, 23 bp, Homo sapiens
atttacagctgtgtgagcaagtt

SEQ ID NO: 9107922 - DNA, 22 bp, Homo sapiens
atttacaggacagcttggcatt

SEQ ID NO: 9107923 - DNA, 22 bp, Homo sapiens
atttacaggacagcttggcatt

SEQ ID NO: 9107924 - DNA, 22 bp, Homo sapiens
agattctaccagagctagtttg

SEQ ID NO: 9107925 - DNA, 22 bp, Homo sapiens
agattctaaacttgattctgct

SEQ ID NO: 9107926 - DNA, 22 bp, Homo sapiens
agattcctagtgttatttctgt

SEQ ID NO: 9107927 - DNA, 22 bp, Homo sapiens
agattcctaaagtaagatatca

SEQ ID NO: 9107928 - DNA, 22 bp, Homo sapiens
agattgggtttgcttctgtgcc

SEQ ID NO: 9107929 - DNA, 22 bp, Homo sapiens
agattggagatggaagaaaagt

SEQ ID NO: 9107930 - DNA, 22 bp, Homo sapiens
agattgggattagagatctgta

SEQ ID NO: 9107931 - DNA, 22 bp, Homo sapiens
agattcattatcttctttgtac

SEQ ID NO: 9107932 - DNA, 22 bp, Homo sapiens
agattcagttaaggctggtaga

SEQ ID NO: 9107933 - DNA, 22 bp, Homo sapiens
agatgatatactacatggcttc

SEQ ID NO: 9107934 - DNA, 22 bp, Homo sapiens
agatgatgataattgaaaggca

SEQ ID NO: 9107935 - DNA, 22 bp, Homo sapiens
agatttagctgtgaacagcttg

SEQ ID NO: 9107936 - DNA, 19 bp, Homo sapiens
agatttacctcatatagtt

SEQ ID NO: 9107937 - DNA, 22 bp, Homo sapiens
agatttaaagcagtattcgcaa

SEQ ID NO: 9107938 - DNA, 22 bp, Homo sapiens
attttggcaacagccatgagcc

SEQ ID NO: 9107939 - DNA, 22 bp, Homo sapiens
agatttatgtggtcacactcag

SEQ ID NO: 9107940 - DNA, 22 bp, Homo sapiens
agatttatgtggtcacactcag

SEQ ID NO: 9107941 - DNA, 22 bp, Homo sapiens
agatttatgtggtcacactcag

SEQ ID NO: 9107942 - DNA, 22 bp, Homo sapiens
agatttatgtggtcacactcag

SEQ ID NO: 9107943 - DNA, 22 bp, Homo sapiens
agatttatgtggtcacactcag

SEQ ID NO: 9107944 - DNA, 22 bp, Homo sapiens
attctaagtgcttgtggtggtt

SEQ ID NO: 9107945 - DNA, 22 bp, Homo sapiens
attctaagcacgctgaagtctt

SEQ ID NO: 9107946 - DNA, 23 bp, Homo sapiens
attctaagatgtgatcttataac

SEQ ID NO: 9107947 - DNA, 22 bp, Homo sapiens
attctaagtcttgttcacattc

SEQ ID NO: 9107948 - DNA, 22 bp, Homo sapiens
attctaagtcttgttcacattc

SEQ ID NO: 9107949 - DNA, 22 bp, Homo sapiens
attctaagcacgctgaagtctt

SEQ ID NO: 9107950 - DNA, 20 bp, Homo sapiens
attctaaagctctgctcttt

SEQ ID NO: 9107951 - DNA, 20 bp, Homo sapiens
attctaaagctctgctcttt

SEQ ID NO: 9107952 - DNA, 22 bp, Homo sapiens
attctaaagcttgtggagctta

SEQ ID NO: 9107953 - DNA, 22 bp, Homo sapiens
attctaaatgtaatttagaatt

SEQ ID NO: 9107954 - DNA, 22 bp, Homo sapiens
attctaacacatgctctaagaa

SEQ ID NO: 9107955 - DNA, 22 bp, Homo sapiens
attctaaatgtaatttagaatt

SEQ ID NO: 9107956 - DNA, 22 bp, Homo sapiens
attctaaatgtaatttagaatt

SEQ ID NO: 9107957 - DNA, 22 bp, Homo sapiens
attctaaatgtaatttagaatt

SEQ ID NO: 9107958 - DNA, 22 bp, Homo sapiens
attcaaagaacctttagcattg

SEQ ID NO: 9107959 - DNA, 22 bp, Homo sapiens
attcaaactgtgttaggcagca

SEQ ID NO: 9107960 - DNA, 21 bp, Homo sapiens
attcaaagaagaggaaggccc

SEQ ID NO: 9107961 - DNA, 22 bp, Homo sapiens
attcaaacactttgagaagttc

SEQ ID NO: 9107962 - DNA, 22 bp, Homo sapiens
attcaaaagaccatgcagactc

SEQ ID NO: 9107963 - DNA, 22 bp, Homo sapiens
attcaaacaggaagaaatcatt

SEQ ID NO: 9107964 - DNA, 22 bp, Homo sapiens
attcaaacaggaagaaatcatt

SEQ ID NO: 9107965 - DNA, 22 bp, Homo sapiens
attcaaacaggaagaaatcatt

SEQ ID NO: 9107966 - DNA, 22 bp, Homo sapiens
attcaaacactttgagaagttc

SEQ ID NO: 9107967 - DNA, 22 bp, Homo sapiens
attcaaaccccatagacaactt

SEQ ID NO: 9107968 - DNA, 22 bp, Homo sapiens
attcaaacaggccaattgacct

SEQ ID NO: 9107969 - DNA, 22 bp, Homo sapiens
attcaaaccccatagacaactt

SEQ ID NO: 9107970 - DNA, 22 bp, Homo sapiens
attctctagtctcttccataaa

SEQ ID NO: 9107971 - DNA, 22 bp, Homo sapiens
attctctagtctcttccataaa

SEQ ID NO: 9107972 - DNA, 22 bp, Homo sapiens
attctctctctatgaaaactga

SEQ ID NO: 9107973 - DNA, 22 bp, Homo sapiens
attctacaatcatgtagatcct

SEQ ID NO: 9107974 - DNA, 22 bp, Homo sapiens
attctccagtagtcattctatc

SEQ ID NO: 9107975 - DNA, 22 bp, Homo sapiens
attctccagctcactgtccata

SEQ ID NO: 9107976 - DNA, 22 bp, Homo sapiens
attctacaacccaataataatt

SEQ ID NO: 9107977 - DNA, 22 bp, Homo sapiens
attctctggctaaaacctgaag

SEQ ID NO: 9107978 - DNA, 22 bp, Homo sapiens
attgaaaaatgactattgctta

SEQ ID NO: 9107979 - DNA, 22 bp, Homo sapiens
attcttctgcctactttcatcc

SEQ ID NO: 9107980 - DNA, 22 bp, Homo sapiens
attaataaaataccactttgtt

SEQ ID NO: 9107981 - DNA, 22 bp, Homo sapiens
agagcttgtaattgagtcaggt

SEQ ID NO: 9107982 - DNA, 22 bp, Homo sapiens
agagcttcactggagagcacat

SEQ ID NO: 9107983 - DNA, 22 bp, Homo sapiens
agagcttcactggagagcacat

SEQ ID NO: 9107984 - DNA, 23 bp, Homo sapiens
agagctttctaaaatgtaaatct

SEQ ID NO: 9107985 - DNA, 22 bp, Homo sapiens
agaggccctctctgctcagtct

SEQ ID NO: 9107986 - DNA, 22 bp, Homo sapiens
agaggccaggtccagagtttgt

SEQ ID NO: 9107987 - DNA, 22 bp, Homo sapiens
agaggccctctctgctcagtct

SEQ ID NO: 9107988 - DNA, 22 bp, Homo sapiens
agaggaagccattgcttactga

SEQ ID NO: 9107989 - DNA, 22 bp, Homo sapiens
agaggaagattttattaaccag

SEQ ID NO: 9107990 - DNA, 22 bp, Homo sapiens
agaggaaacataggtttttaaa

SEQ ID NO: 9107991 - DNA, 22 bp, Homo sapiens
agaggccggccgagcccatggg

SEQ ID NO: 9107992 - DNA, 22 bp, Homo sapiens
agaggccctgggctggtgtgct

SEQ ID NO: 9107993 - DNA, 22 bp, Homo sapiens
agaggccctggctagagcagct

SEQ ID NO: 9107994 - DNA, 19 bp, Homo sapiens
agaggcctcagcagctggc

SEQ ID NO: 9107995 - DNA, 19 bp, Homo sapiens
agaggcctcagcagctggc

SEQ ID NO: 9107996 - DNA, 22 bp, Homo sapiens
agaggcctcaaaccagacctga

SEQ ID NO: 9107997 - DNA, 22 bp, Homo sapiens
agaggcctaaccaagatgtcct

SEQ ID NO: 9107998 - DNA, 22 bp, Homo sapiens
agaggcctaaccaagatgtcct

SEQ ID NO: 9107999 - DNA, 22 bp, Homo sapiens
agaggcctccgaaaggtgggct

SEQ ID NO: 9108000 - DNA, 22 bp, Homo sapiens
agaggcctctagggcccctcag

SEQ ID NO: 9108001 - DNA, 22 bp, Homo sapiens
attattttatgtgcggcctgat

SEQ ID NO: 9108002 - DNA, 22 bp, Homo sapiens
attatttgtgtccacagaatac

SEQ ID NO: 9108003 - DNA, 22 bp, Homo sapiens
attattttatgtgcggcctgat

SEQ ID NO: 9108004 - DNA, 22 bp, Homo sapiens
attcaaaagaccatgcagactc

SEQ ID NO: 9108005 - DNA, 18 bp, Homo sapiens
attgagcatgacagacct

SEQ ID NO: 9108006 - DNA, 22 bp, Homo sapiens
attgagaatgcaatctactatg

SEQ ID NO: 9108007 - DNA, 22 bp, Homo sapiens
attgtataagtctatttacaat

SEQ ID NO: 9108008 - DNA, 22 bp, Homo sapiens
attgtataagtctatttacaat

SEQ ID NO: 9108009 - DNA, 22 bp, Homo sapiens
attgtataagtctatttacaat

SEQ ID NO: 9108010 - DNA, 22 bp, Homo sapiens
attgtatacaagcttaattgtt

SEQ ID NO: 9108011 - DNA, 22 bp, Homo sapiens
attgtattagcacaatacaatt

SEQ ID NO: 9108012 - DNA, 22 bp, Homo sapiens
attgaaaggcaaagtaggaagc

SEQ ID NO: 9108013 - DNA, 22 bp, Homo sapiens
attgagaagaaaatctaatata

SEQ ID NO: 9108014 - DNA, 22 bp, Homo sapiens
attgaaaaatgactattgctta

SEQ ID NO: 9108015 - DNA, 22 bp, Homo sapiens
attgaaaataaggccagaaaca

SEQ ID NO: 9108016 - DNA, 22 bp, Homo sapiens
attgaaaataaggccagaaaca

SEQ ID NO: 9108017 - DNA, 22 bp, Homo sapiens
attgaaaatgacatttgtgccc

SEQ ID NO: 9108018 - DNA, 22 bp, Homo sapiens
attgaaaatgacatttgtgccc

SEQ ID NO: 9108019 - DNA, 22 bp, Homo sapiens
attgaaaatataattctaggag

SEQ ID NO: 9108020 - DNA, 22 bp, Homo sapiens
attgaaagagaatgtagctctt

SEQ ID NO: 9108021 - DNA, 22 bp, Homo sapiens
attgtgctttagatcacagtct

SEQ ID NO: 9108022 - DNA, 22 bp, Homo sapiens
attgtatttaggagaaaagggt

SEQ ID NO: 9108023 - DNA, 22 bp, Homo sapiens
attgttaaactgaagcattact

SEQ ID NO: 9108024 - DNA, 22 bp, Homo sapiens
attgttaactatagcatctggt

SEQ ID NO: 9108025 - DNA, 22 bp, Homo sapiens
attgtggtgtcagttataggca

SEQ ID NO: 9108026 - DNA, 22 bp, Homo sapiens
attgtggtgtcagttataggca

SEQ ID NO: 9108027 - DNA, 22 bp, Homo sapiens
agatacaagttaagagaaagga

SEQ ID NO: 9108028 - DNA, 22 bp, Homo sapiens
agatacaagttaagagaaagga

SEQ ID NO: 9108029 - DNA, 22 bp, Homo sapiens
agatacaactgtttaaacatta

SEQ ID NO: 9108030 - DNA, 22 bp, Homo sapiens
agatacaactgtttaaacatta

SEQ ID NO: 9108031 - DNA, 22 bp, Homo sapiens
atttacagacgtggattagtgc

SEQ ID NO: 9108032 - DNA, 22 bp, Homo sapiens
agatacagacctcttattaagg

SEQ ID NO: 9108033 - DNA, 22 bp, Homo sapiens
agatacagaatggttgtttgtc

SEQ ID NO: 9108034 - DNA, 22 bp, Homo sapiens
agataattatgtcaatttcttg

SEQ ID NO: 9108035 - DNA, 22 bp, Homo sapiens
agatacaaaggcctacagagca

SEQ ID NO: 9108036 - DNA, 22 bp, Homo sapiens
atgcttcagatttggggtatta

SEQ ID NO: 9108037 - DNA, 22 bp, Homo sapiens
atgcttcatgatttggccatgt

SEQ ID NO: 9108038 - DNA, 22 bp, Homo sapiens
agagaaaagccatcccagccaa

SEQ ID NO: 9108039 - DNA, 22 bp, Homo sapiens
agagaaatttccctgccttctg

SEQ ID NO: 9108040 - DNA, 22 bp, Homo sapiens
agagaacacgtgcatctgcaat

SEQ ID NO: 9108041 - DNA, 22 bp, Homo sapiens
agagaacagacagatgcaatga

SEQ ID NO: 9108042 - DNA, 22 bp, Homo sapiens
agagaacagcattgcagctttg

SEQ ID NO: 9108043 - DNA, 22 bp, Homo sapiens
agagaacagacagatgcaatga

SEQ ID NO: 9108044 - DNA, 22 bp, Homo sapiens
agagaacagacagatgcaatga

SEQ ID NO: 9108045 - DNA, 22 bp, Homo sapiens
atgctgaaaattggatttgaat

SEQ ID NO: 9108046 - DNA, 22 bp, Homo sapiens
atgctgaactgagatgtaactt

SEQ ID NO: 9108047 - DNA, 22 bp, Homo sapiens
agacatagggaggcatataaat

SEQ ID NO: 9108048 - DNA, 22 bp, Homo sapiens
agacataggattccacatagca

SEQ ID NO: 9108049 - DNA, 22 bp, Homo sapiens
agacataggattccacatagca

SEQ ID NO: 9108050 - DNA, 22 bp, Homo sapiens
atgctgaatgaaagaaattagt

SEQ ID NO: 9108051 - DNA, 22 bp, Homo sapiens
atgctgaagtgtgtttgaagta

SEQ ID NO: 9108052 - DNA, 22 bp, Homo sapiens
atgctgaaggtgaattgacaat

SEQ ID NO: 9108053 - DNA, 18 bp, Homo sapiens
atgctgccctctgagggt

SEQ ID NO: 9108054 - DNA, 22 bp, Homo sapiens
atgctgcacaagccacatgtag

SEQ ID NO: 9108055 - DNA, 22 bp, Homo sapiens
atgctgagactggagcagctgg

SEQ ID NO: 9108056 - DNA, 22 bp, Homo sapiens
atgctgaggacaaagagatcaa

SEQ ID NO: 9108057 - DNA, 22 bp, Homo sapiens
agacatagaaaatcattaggaa

SEQ ID NO: 9108058 - DNA, 22 bp, Homo sapiens
agacatagaaaatcattaggaa

SEQ ID NO: 9108059 - DNA, 22 bp, Homo sapiens
agacatagataggcactgattg

SEQ ID NO: 9108060 - DNA, 22 bp, Homo sapiens
agacataggattccacatagca

SEQ ID NO: 9108061 - DNA, 22 bp, Homo sapiens
agacataggattccacatagca

SEQ ID NO: 9108062 - DNA, 22 bp, Homo sapiens
agacatagataggcactgattg

SEQ ID NO: 9108063 - DNA, 22 bp, Homo sapiens
agacataagcgagcatcacagg

SEQ ID NO: 9108064 - DNA, 22 bp, Homo sapiens
agacagtgtgagttcagggtgg

SEQ ID NO: 9108065 - DNA, 22 bp, Homo sapiens
atgccaggctgtttggcctcag

SEQ ID NO: 9108066 - DNA, 22 bp, Homo sapiens
atgccatctgaaatctgtcata

SEQ ID NO: 9108067 - DNA, 22 bp, Homo sapiens
agacagtgctatcccatctgtg

SEQ ID NO: 9108068 - DNA, 22 bp, Homo sapiens
atgcaacagctgggaatatgta

SEQ ID NO: 9108069 - DNA, 22 bp, Homo sapiens
atgcaacagagaaaatattgag

SEQ ID NO: 9108070 - DNA, 22 bp, Homo sapiens
atgcaacaggtcagccaggaag

SEQ ID NO: 9108071 - DNA, 22 bp, Homo sapiens
atgcaacacccctatggatgga

SEQ ID NO: 9108072 - DNA, 22 bp, Homo sapiens
atgcaacagagaaaatattgag

SEQ ID NO: 9108073 - DNA, 22 bp, Homo sapiens
atgcaaattctttgcttcttct

SEQ ID NO: 9108074 - DNA, 22 bp, Homo sapiens
atgcaacaaatgctacgaatcg

SEQ ID NO: 9108075 - DNA, 22 bp, Homo sapiens
atgcaacaaattgtgtgcaata

SEQ ID NO: 9108076 - DNA, 22 bp, Homo sapiens
atgcaacaatgtatttatgtat

SEQ ID NO: 9108077 - DNA, 22 bp, Homo sapiens
atgccactgcactccagcctag

SEQ ID NO: 9108078 - DNA, 22 bp, Homo sapiens
atgccaggccccacgctgggca

SEQ ID NO: 9108079 - DNA, 22 bp, Homo sapiens
atgccaggaacaaacagtggtg

SEQ ID NO: 9108080 - DNA, 22 bp, Homo sapiens
atctggctgagcgaggcccaca

SEQ ID NO: 9108081 - DNA, 22 bp, Homo sapiens
atctggcttacctagggtgcct

SEQ ID NO: 9108082 - DNA, 22 bp, Homo sapiens
atctgggagcggaggttgcagt

SEQ ID NO: 9108083 - DNA, 20 bp, Homo sapiens
atctgggcatcaattttgtg

SEQ ID NO: 9108084 - DNA, 22 bp, Homo sapiens
atctgggcagggcagcaaggcg

SEQ ID NO: 9108085 - DNA, 23 bp, Homo sapiens
atctgggcatctggagtggtcct

SEQ ID NO: 9108086 - DNA, 23 bp, Homo sapiens
atctgggcatctggagtggtcct

SEQ ID NO: 9108087 - DNA, 22 bp, Homo sapiens
atctgggcatggaggaaagaga

SEQ ID NO: 9108088 - DNA, 22 bp, Homo sapiens
atctgggccaatcctagtacca

SEQ ID NO: 9108089 - DNA, 22 bp, Homo sapiens
atctgggccagccccaagagac

SEQ ID NO: 9108090 - DNA, 22 bp, Homo sapiens
atctgggccagccccaagagac

SEQ ID NO: 9108091 - DNA, 22 bp, Homo sapiens
atctgggcctgttccctcacct

SEQ ID NO: 9108092 - DNA, 22 bp, Homo sapiens
atctgggtcacagtggcatcta

SEQ ID NO: 9108093 - DNA, 22 bp, Homo sapiens
atctgggcgtataggtgcaagt

SEQ ID NO: 9108094 - DNA, 22 bp, Homo sapiens
atctgggctcgaatcctagctc

SEQ ID NO: 9108095 - DNA, 22 bp, Homo sapiens
atctgggctcgaatcctagctc

SEQ ID NO: 9108096 - DNA, 22 bp, Homo sapiens
atctgttttgatacagttttat

SEQ ID NO: 9108097 - DNA, 22 bp, Homo sapiens
atctgttgtttgtttgctaaag

SEQ ID NO: 9108098 - DNA, 22 bp, Homo sapiens
atctgtttaattcattttcaca

SEQ ID NO: 9108099 - DNA, 22 bp, Homo sapiens
atgacaatatagctttgatttt

SEQ ID NO: 9108100 - DNA, 22 bp, Homo sapiens
atgaccaagagtccaggtcaag

SEQ ID NO: 9108101 - DNA, 22 bp, Homo sapiens
atgaccagactctcagtggggt

SEQ ID NO: 9108102 - DNA, 22 bp, Homo sapiens
atgaccagccgagataaacaga

SEQ ID NO: 9108103 - DNA, 22 bp, Homo sapiens
atgaccagccgagataaacaga

SEQ ID NO: 9108104 - DNA, 19 bp, Homo sapiens
atgaccagttccatgccct

SEQ ID NO: 9108105 - DNA, 22 bp, Homo sapiens
atgacccaagctcatggctccc

SEQ ID NO: 9108106 - DNA, 22 bp, Homo sapiens
atgacccaagctcatggctccc

SEQ ID NO: 9108107 - DNA, 22 bp, Homo sapiens
atgaccagtttccccactgtcc

SEQ ID NO: 9108108 - DNA, 22 bp, Homo sapiens
atgacccagtcaaagggaatgg

SEQ ID NO: 9108109 - DNA, 22 bp, Homo sapiens
atgacccagtcaaagggaatgg

SEQ ID NO: 9108110 - DNA, 22 bp, Homo sapiens
atcttacagcagcaaggaagta

SEQ ID NO: 9108111 - DNA, 22 bp, Homo sapiens
atcttacactgttgggtttctc

SEQ ID NO: 9108112 - DNA, 22 bp, Homo sapiens
atcttaagcttcatcaaccctg

SEQ ID NO: 9108113 - DNA, 22 bp, Homo sapiens
atcttacaattacaagacactc

SEQ ID NO: 9108114 - DNA, 22 bp, Homo sapiens
atgacaatacttcaataagctg

SEQ ID NO: 9108115 - DNA, 23 bp, Homo sapiens
atcttagcatagacttgagtccc

SEQ ID NO: 9108116 - DNA, 22 bp, Homo sapiens
atgattttctgataaagaactg

SEQ ID NO: 9108117 - DNA, 22 bp, Homo sapiens
atgatttaaagtcattgtgaac

SEQ ID NO: 9108118 - DNA, 22 bp, Homo sapiens
atgatttccagttgttgctaag

SEQ ID NO: 9108119 - DNA, 22 bp, Homo sapiens
atgatttaaagtcattgtgaac

SEQ ID NO: 9108120 - DNA, 22 bp, Homo sapiens
atgcaaattaacatatagtaga

SEQ ID NO: 9108121 - DNA, 22 bp, Homo sapiens
atgcaaatgtttaagttactat

SEQ ID NO: 9108122 - DNA, 22 bp, Homo sapiens
atgcaaatgtcaccacttctaa

SEQ ID NO: 9108123 - DNA, 22 bp, Homo sapiens
atgcaaatgtcaccacttctaa

SEQ ID NO: 9108124 - DNA, 22 bp, Homo sapiens
atgcaaatggcaatgagtgacc

SEQ ID NO: 9108125 - DNA, 22 bp, Homo sapiens
atgcaaatgctagagaatgttg

SEQ ID NO: 9108126 - DNA, 22 bp, Homo sapiens
atgcaaatgctagagaatgttg

SEQ ID NO: 9108127 - DNA, 22 bp, Homo sapiens
atgattttctgataaagaactg

SEQ ID NO: 9108128 - DNA, 22 bp, Homo sapiens
atgattctggcaaatttattat

SEQ ID NO: 9108129 - DNA, 22 bp, Homo sapiens
atgattctggtgagaatgagga

SEQ ID NO: 9108130 - DNA, 22 bp, Homo sapiens
atgattctggggcaaaagctgg

SEQ ID NO: 9108131 - DNA, 22 bp, Homo sapiens
atgattctcattttataaactt

SEQ ID NO: 9108132 - DNA, 22 bp, Homo sapiens
atgattctaaacttaaggggga

SEQ ID NO: 9108133 - DNA, 22 bp, Homo sapiens
atgaggcaaaggtggaggtggg

SEQ ID NO: 9108134 - DNA, 22 bp, Homo sapiens
atgaggcaaggctggccgtgtt

SEQ ID NO: 9108135 - DNA, 22 bp, Homo sapiens
atgaggatgttagtggactgga

SEQ ID NO: 9108136 - DNA, 22 bp, Homo sapiens
atgaggataccgcagggggcag

SEQ ID NO: 9108137 - DNA, 22 bp, Homo sapiens
atgaggagtcaaggagtcggag

SEQ ID NO: 9108138 - DNA, 22 bp, Homo sapiens
atgaggagtcaaggagtcggag

SEQ ID NO: 9108139 - DNA, 22 bp, Homo sapiens
atgaggatgggaagggagccaa

SEQ ID NO: 9108140 - DNA, 22 bp, Homo sapiens
atgaggatgttagtggactgga

SEQ ID NO: 9108141 - DNA, 22 bp, Homo sapiens
atgacttcgttttctctctgca

SEQ ID NO: 9108142 - DNA, 22 bp, Homo sapiens
atgacttttaaaagctggtact

SEQ ID NO: 9108143 - DNA, 22 bp, Homo sapiens
atgactttcctggcaaaagttg

SEQ ID NO: 9108144 - DNA, 22 bp, Homo sapiens
atgtgcatgcacttacatgtgt

SEQ ID NO: 9108145 - DNA, 22 bp, Homo sapiens
agagccagcaagtgaatagtga

SEQ ID NO: 9108146 - DNA, 22 bp, Homo sapiens
atgtgcattaaatgtcaatgtt

SEQ ID NO: 9108147 - DNA, 22 bp, Homo sapiens
agagccagcatttgacactggc

SEQ ID NO: 9108148 - DNA, 22 bp, Homo sapiens
agagccagcatttgacactggc

SEQ ID NO: 9108149 - DNA, 22 bp, Homo sapiens
agagccagccttctcagcttac

SEQ ID NO: 9108150 - DNA, 22 bp, Homo sapiens
agagccagcatttgggccctgc

SEQ ID NO: 9108151 - DNA, 22 bp, Homo sapiens
agagccagcatttgacactggc

SEQ ID NO: 9108152 - DNA, 22 bp, Homo sapiens
agagccaggatgtcttctgggg

SEQ ID NO: 9108153 - DNA, 22 bp, Homo sapiens
atgttacacataggcataaatg

SEQ ID NO: 9108154 - DNA, 22 bp, Homo sapiens
atgttacagaaactaagaggct

SEQ ID NO: 9108155 - DNA, 22 bp, Homo sapiens
atgttattttggaaaatacaaa

SEQ ID NO: 9108156 - DNA, 22 bp, Homo sapiens
atgttacacataggcataaatg

SEQ ID NO: 9108157 - DNA, 22 bp, Homo sapiens
agagccaggactgtgtctcact

SEQ ID NO: 9108158 - DNA, 22 bp, Homo sapiens
agagccaggatctgttttgggg

SEQ ID NO: 9108159 - DNA, 22 bp, Homo sapiens
agagccaggatctgttttgggg

SEQ ID NO: 9108160 - DNA, 22 bp, Homo sapiens
agagccaggaagtggcgtgggg

SEQ ID NO: 9108161 - DNA, 22 bp, Homo sapiens
agagccaggaagtggcgtgggg

SEQ ID NO: 9108162 - DNA, 22 bp, Homo sapiens
agagattacagcagggtccagc

SEQ ID NO: 9108163 - DNA, 22 bp, Homo sapiens
agagatgttcattcagcatgtt

SEQ ID NO: 9108164 - DNA, 22 bp, Homo sapiens
agagatgtagcaaagaaccaca

SEQ ID NO: 9108165 - DNA, 22 bp, Homo sapiens
agagatgtcgccttgcccaggg

SEQ ID NO: 9108166 - DNA, 22 bp, Homo sapiens
atgtcttgttaatctgaagcaa

SEQ ID NO: 9108167 - DNA, 22 bp, Homo sapiens
atgtcttctctgtaggtaaatt

SEQ ID NO: 9108168 - DNA, 22 bp, Homo sapiens
atgtcttctgtggagacaggta

SEQ ID NO: 9108169 - DNA, 22 bp, Homo sapiens
atgtgcaaatccaatgtgaatg

SEQ ID NO: 9108170 - DNA, 23 bp, Homo sapiens
atgtgcaaagtgctacagtatag

SEQ ID NO: 9108171 - DNA, 22 bp, Homo sapiens
atgtgcaacttttctgtctttt

SEQ ID NO: 9108172 - DNA, 22 bp, Homo sapiens
atgtgcaattattaagaagaga

SEQ ID NO: 9108173 - DNA, 21 bp, Homo sapiens
atgtgcagcaagcagcatgct

SEQ ID NO: 9108174 - DNA, 22 bp, Homo sapiens
atgtgcaggatccaggctccta

SEQ ID NO: 9108175 - DNA, 22 bp, Homo sapiens
atgtgcagcctttcttcatcat

SEQ ID NO: 9108176 - DNA, 22 bp, Homo sapiens
attaaatactgcaggctaagca

SEQ ID NO: 9108177 - DNA, 22 bp, Homo sapiens
attaaatactgcaggctaagca

SEQ ID NO: 9108178 - DNA, 22 bp, Homo sapiens
agagctctgcagctggcctcag

SEQ ID NO: 9108179 - DNA, 22 bp, Homo sapiens
agagctcaagacgctcacagta

SEQ ID NO: 9108180 - DNA, 22 bp, Homo sapiens
agagctcaagacgctcacagta

SEQ ID NO: 9108181 - DNA, 22 bp, Homo sapiens
agagctcctaaatgtagccaac

SEQ ID NO: 9108182 - DNA, 22 bp, Homo sapiens
attaaggaatgtaggcaagaag

SEQ ID NO: 9108183 - DNA, 22 bp, Homo sapiens
attaaggcacttgagcatgatg

SEQ ID NO: 9108184 - DNA, 22 bp, Homo sapiens
attaaggcgttggcgtgcttat

SEQ ID NO: 9108185 - DNA, 22 bp, Homo sapiens
attaagtgactaaagtaatgct

SEQ ID NO: 9108186 - DNA, 22 bp, Homo sapiens
attaaggtgtcaatgtatttgg

SEQ ID NO: 9108187 - DNA, 22 bp, Homo sapiens
attaaggctgcactggccttaa

SEQ ID NO: 9108188 - DNA, 22 bp, Homo sapiens
attaaggctcccatttccaatt

SEQ ID NO: 9108189 - DNA, 18 bp, Homo sapiens
attaaggctttgatagta

SEQ ID NO: 9108190 - DNA, 22 bp, Homo sapiens
attaagggccaatcctccagcc

SEQ ID NO: 9108191 - DNA, 22 bp, Homo sapiens
atgttctacagatggaaagggg

SEQ ID NO: 9108192 - DNA, 22 bp, Homo sapiens
atgttctacagatggaaagggg

SEQ ID NO: 9108193 - DNA, 22 bp, Homo sapiens
atgttctacagatggaaagggg

SEQ ID NO: 9108194 - DNA, 22 bp, Homo sapiens
atgttccttccagagagcagaa

SEQ ID NO: 9108195 - DNA, 22 bp, Homo sapiens
agagcctgttttgtgggagatg

SEQ ID NO: 9108196 - DNA, 22 bp, Homo sapiens
agagcctgttttgtgggagatg

SEQ ID NO: 9108197 - DNA, 22 bp, Homo sapiens
agagctagaaggaagcatttct

SEQ ID NO: 9108198 - DNA, 22 bp, Homo sapiens
agagcggggatagttaatattc

SEQ ID NO: 9108199 - DNA, 22 bp, Homo sapiens
agagccttgctctaaatttctc

SEQ ID NO: 9108200 - DNA, 21 bp, Homo sapiens
agagcggcggggcgcgtctgc

SEQ ID NO: 9108201 - DNA, 23 bp, Homo sapiens
agagccttttcacacttcaatgt

SEQ ID NO: 9108202 - DNA, 22 bp, Homo sapiens
agagccttgaagatctggaaaa

SEQ ID NO: 9108203 - DNA, 22 bp, Homo sapiens
agagccttgaagatctggaaaa

SEQ ID NO: 9108204 - DNA, 20 bp, Homo sapiens
agagccttgaggaagatgat

SEQ ID NO: 9108205 - DNA, 20 bp, Homo sapiens
agagccttgaggaagatgat

SEQ ID NO: 9108206 - DNA, 22 bp, Homo sapiens
atgttcctcactattttggccc

SEQ ID NO: 9108207 - DNA, 22 bp, Homo sapiens
atgttcctggtatatcatgacc

SEQ ID NO: 9108208 - DNA, 22 bp, Homo sapiens
atgttcaaactttttacacacc

SEQ ID NO: 9108209 - DNA, 22 bp, Homo sapiens
atgttcagcattctataaatat

SEQ ID NO: 9108210 - DNA, 22 bp, Homo sapiens
atgttcatatccccattctgat

SEQ ID NO: 9108211 - DNA, 17 bp, Homo sapiens
agagagaaaagggccat

SEQ ID NO: 9108212 - DNA, 17 bp, Homo sapiens
agagagaaaagggccat

SEQ ID NO: 9108213 - DNA, 22 bp, Homo sapiens
atgtaggattgagtgatagagg

SEQ ID NO: 9108214 - DNA, 21 bp, Homo sapiens
agagactgtcactgcagtacc

SEQ ID NO: 9108215 - DNA, 22 bp, Homo sapiens
agagactgtacgtggcaagtat

SEQ ID NO: 9108216 - DNA, 22 bp, Homo sapiens
agagactgtcacataacagagg

SEQ ID NO: 9108217 - DNA, 21 bp, Homo sapiens
agagactgtcactgcagtacc

SEQ ID NO: 9108218 - DNA, 21 bp, Homo sapiens
agagactgtcactgcagtacc

SEQ ID NO: 9108219 - DNA, 22 bp, Homo sapiens
agagacttctgccttagcaaga

SEQ ID NO: 9108220 - DNA, 22 bp, Homo sapiens
agagactgtgtccatcgtgcct

SEQ ID NO: 9108221 - DNA, 22 bp, Homo sapiens
agagactgcaaatcataagaat

SEQ ID NO: 9108222 - DNA, 22 bp, Homo sapiens
agagactgcaatgagtggtagg

SEQ ID NO: 9108223 - DNA, 22 bp, Homo sapiens
agagactggagttacgagttca

SEQ ID NO: 9108224 - DNA, 22 bp, Homo sapiens
agagactgtaatgagaggtaca

SEQ ID NO: 9108225 - DNA, 22 bp, Homo sapiens
agagactgctttatattgtact

SEQ ID NO: 9108226 - DNA, 22 bp, Homo sapiens
agagactggagatgggcagtgt

SEQ ID NO: 9108227 - DNA, 22 bp, Homo sapiens
agagactgctttatattgtact

SEQ ID NO: 9108228 - DNA, 19 bp, Homo sapiens
agagactgccaccagctgt

SEQ ID NO: 9108229 - DNA, 18 bp, Homo sapiens
agagatgggagttggaaa

SEQ ID NO: 9108230 - DNA, 20 bp, Homo sapiens
agagatggggtatcaccgta

SEQ ID NO: 9108231 - DNA, 20 bp, Homo sapiens
agagatggggtatcaccgta

SEQ ID NO: 9108232 - DNA, 22 bp, Homo sapiens
agagatggcgtctcagagcctg

SEQ ID NO: 9108233 - DNA, 22 bp, Homo sapiens
atgtagttagaagattcaaaca

SEQ ID NO: 9108234 - DNA, 22 bp, Homo sapiens
atgtagtttggggctagattta

SEQ ID NO: 9108235 - DNA, 22 bp, Homo sapiens
atgtagtttggggctagattta

SEQ ID NO: 9108236 - DNA, 22 bp, Homo sapiens
atggacaatgccaatacagttt

SEQ ID NO: 9108237 - DNA, 22 bp, Homo sapiens
atggaatgtttatacacagttg

SEQ ID NO: 9108238 - DNA, 22 bp, Homo sapiens
atggaattaaaagtcaagtaat

SEQ ID NO: 9108239 - DNA, 22 bp, Homo sapiens
atggacagctggcctcaaggga

SEQ ID NO: 9108240 - DNA, 22 bp, Homo sapiens
agagaacatattttgtatgatt

SEQ ID NO: 9108241 - DNA, 22 bp, Homo sapiens
agagaacatattttgtatgatt

SEQ ID NO: 9108242 - DNA, 22 bp, Homo sapiens
agagaacagtgttttgaaggag

SEQ ID NO: 9108243 - DNA, 22 bp, Homo sapiens
agagaacagcctcctagagaaa

SEQ ID NO: 9108244 - DNA, 22 bp, Homo sapiens
agagaacagcctcctagagaaa

SEQ ID NO: 9108245 - DNA, 22 bp, Homo sapiens
agagaacagcctcctagagaaa

SEQ ID NO: 9108246 - DNA, 22 bp, Homo sapiens
agagaagacttacagccacagt

SEQ ID NO: 9108247 - DNA, 22 bp, Homo sapiens
agagaagacttacagccacagt

SEQ ID NO: 9108248 - DNA, 22 bp, Homo sapiens
agagaagacttacagccacagt

SEQ ID NO: 9108249 - DNA, 22 bp, Homo sapiens
agagaacatgacgtaatagtgg

SEQ ID NO: 9108250 - DNA, 22 bp, Homo sapiens
atgggccaagtaaacattctca

SEQ ID NO: 9108251 - DNA, 22 bp, Homo sapiens
atgggccacacacgattgggtg

SEQ ID NO: 9108252 - DNA, 22 bp, Homo sapiens
atgggccaggcttgggatgaca

SEQ ID NO: 9108253 - DNA, 23 bp, Homo sapiens
atgggccaagcaagacccatgac

SEQ ID NO: 9108254 - DNA, 22 bp, Homo sapiens
atgggcatgatattagtaccta

SEQ ID NO: 9108255 - DNA, 18 bp, Homo sapiens
atgggaggggccaagaga

SEQ ID NO: 9108256 - DNA, 22 bp, Homo sapiens
atgggcagtaacagtggcagtc

SEQ ID NO: 9108257 - DNA, 22 bp, Homo sapiens
atgggaggcaggctcagaaccg

SEQ ID NO: 9108258 - DNA, 18 bp, Homo sapiens
atgggaggggccaagaga

SEQ ID NO: 9108259 - DNA, 22 bp, Homo sapiens
agggctcaatggtgggcatgta

SEQ ID NO: 9108260 - DNA, 22 bp, Homo sapiens
agggctcaagaaagtgtacctc

SEQ ID NO: 9108261 - DNA, 22 bp, Homo sapiens
agggcctggttctgtgtaggga

SEQ ID NO: 9108262 - DNA, 22 bp, Homo sapiens
agggcctggttctgtgtaggga

SEQ ID NO: 9108263 - DNA, 22 bp, Homo sapiens
agggccagttctacctctgaat

SEQ ID NO: 9108264 - DNA, 22 bp, Homo sapiens
agggccagtaccaggtgggtgg

SEQ ID NO: 9108265 - DNA, 22 bp, Homo sapiens
agggccagcactcctggcagga

SEQ ID NO: 9108266 - DNA, 22 bp, Homo sapiens
agggccagcactcctggcagga

SEQ ID NO: 9108267 - DNA, 22 bp, Homo sapiens
agggccagccaggccctacaaa

SEQ ID NO: 9108268 - DNA, 22 bp, Homo sapiens
agggccagcccataatgccaaa

SEQ ID NO: 9108269 - DNA, 22 bp, Homo sapiens
agggcactggcttgcaaactca

SEQ ID NO: 9108270 - DNA, 22 bp, Homo sapiens
agggcactctgcagggaccacc

SEQ ID NO: 9108271 - DNA, 22 bp, Homo sapiens
agggcactccttggcagctctg

SEQ ID NO: 9108272 - DNA, 22 bp, Homo sapiens
agggcactccttggcagctctg

SEQ ID NO: 9108273 - DNA, 20 bp, Homo sapiens
accagagactggggacaagt

SEQ ID NO: 9108274 - DNA, 20 bp, Homo sapiens
accagagactggggacaagt

SEQ ID NO: 9108275 - DNA, 22 bp, Homo sapiens
accagagaatttagccaagaaa

SEQ ID NO: 9108276 - DNA, 20 bp, Homo sapiens
accagagacctgaatcagtt

SEQ ID NO: 9108277 - DNA, 20 bp, Homo sapiens
accagagacctgaatcagtt

SEQ ID NO: 9108278 - DNA, 22 bp, Homo sapiens
accagagaaaacacagcaggct

SEQ ID NO: 9108279 - DNA, 22 bp, Homo sapiens
accagagaaaacacagcaggct

SEQ ID NO: 9108280 - DNA, 22 bp, Homo sapiens
accagagaaaacacagcaggct

SEQ ID NO: 9108281 - DNA, 22 bp, Homo sapiens
accagagagcctaggctgggca

SEQ ID NO: 9108282 - DNA, 22 bp, Homo sapiens
accagagagagacagggttgtg

SEQ ID NO: 9108283 - DNA, 22 bp, Homo sapiens
accagagatgtctaataggggc

SEQ ID NO: 9108284 - DNA, 20 bp, Homo sapiens
accagagatagcaatagtgc

SEQ ID NO: 9108285 - DNA, 22 bp, Homo sapiens
accagagaggctgcagtgtgtg

SEQ ID NO: 9108286 - DNA, 20 bp, Homo sapiens
accagagatagcaatagtgc

SEQ ID NO: 9108287 - DNA, 22 bp, Homo sapiens
agggagctgactggctgccatt

SEQ ID NO: 9108288 - DNA, 22 bp, Homo sapiens
agggagctgactggctgccatt

SEQ ID NO: 9108289 - DNA, 20 bp, Homo sapiens
accagagctctcagtatgtg

SEQ ID NO: 9108290 - DNA, 22 bp, Homo sapiens
agggaggagtcctcaaagtcat

SEQ ID NO: 9108291 - DNA, 22 bp, Homo sapiens
agggaggagtcctcaaagtcat

SEQ ID NO: 9108292 - DNA, 22 bp, Homo sapiens
agggagctgactggctgccatt

SEQ ID NO: 9108293 - DNA, 22 bp, Homo sapiens
agggaggatctgctccttgtct

SEQ ID NO: 9108294 - DNA, 22 bp, Homo sapiens
agggaggcattagctactgcga

SEQ ID NO: 9108295 - DNA, 22 bp, Homo sapiens
agggaggtctggctgccctgag

SEQ ID NO: 9108296 - DNA, 22 bp, Homo sapiens
agggcacatctgctgggaatgg

SEQ ID NO: 9108297 - DNA, 22 bp, Homo sapiens
agggcacagcctaaagcctatg

SEQ ID NO: 9108298 - DNA, 22 bp, Homo sapiens
agggcacaagactctgagcccc

SEQ ID NO: 9108299 - DNA, 22 bp, Homo sapiens
agggcacaggctccgggtccag

SEQ ID NO: 9108300 - DNA, 22 bp, Homo sapiens
agggatgtgcagcatccagaca

SEQ ID NO: 9108301 - DNA, 22 bp, Homo sapiens
acctcagttcaattcagttaga

SEQ ID NO: 9108302 - DNA, 22 bp, Homo sapiens
acctccagctttttagagacat

SEQ ID NO: 9108303 - DNA, 22 bp, Homo sapiens
acctcagctatttcaaaacaga

SEQ ID NO: 9108304 - DNA, 21 bp, Homo sapiens
acctcaagcaacaaccaaggt

SEQ ID NO: 9108305 - DNA, 22 bp, Homo sapiens
accctttgtccaatagaaatga

SEQ ID NO: 9108306 - DNA, 22 bp, Homo sapiens
accctttgtccaatagaaatga

SEQ ID NO: 9108307 - DNA, 22 bp, Homo sapiens
aggggcctcgcaggaccgctcc

SEQ ID NO: 9108308 - DNA, 22 bp, Homo sapiens
aggggccattgttctgcccgct

SEQ ID NO: 9108309 - DNA, 22 bp, Homo sapiens
aggggccattgttctgcccgct

SEQ ID NO: 9108310 - DNA, 22 bp, Homo sapiens
aggggccacctgtggcaccctg

SEQ ID NO: 9108311 - DNA, 22 bp, Homo sapiens
aggggtgtgcatcctggaggat

SEQ ID NO: 9108312 - DNA, 20 bp, Homo sapiens
agggtcagtagcacagagct

SEQ ID NO: 9108313 - DNA, 22 bp, Homo sapiens
aggggttggatttggcctagag

SEQ ID NO: 9108314 - DNA, 19 bp, Homo sapiens
agggtacacgagagaagag

SEQ ID NO: 9108315 - DNA, 22 bp, Homo sapiens
aggggtggagagtgttgccagt

SEQ ID NO: 9108316 - DNA, 22 bp, Homo sapiens
aggggtggagagtgttgccagt

SEQ ID NO: 9108317 - DNA, 22 bp, Homo sapiens
acctcccagaaagttttgcagg

SEQ ID NO: 9108318 - DNA, 22 bp, Homo sapiens
aggggtgatttgggacaggaca

SEQ ID NO: 9108319 - DNA, 16 bp, Homo sapiens
acctccagtcaagggt

SEQ ID NO: 9108320 - DNA, 22 bp, Homo sapiens
aggggtgacacatatcagtgca

SEQ ID NO: 9108321 - DNA, 22 bp, Homo sapiens
acctcccagctctgagcttggg

SEQ ID NO: 9108322 - DNA, 22 bp, Homo sapiens
acctcccagaaagttttgcagg

SEQ ID NO: 9108323 - DNA, 22 bp, Homo sapiens
agggctcagcctcctcctcagc

SEQ ID NO: 9108324 - DNA, 22 bp, Homo sapiens
agggctcagggcacgtcatcca

SEQ ID NO: 9108325 - DNA, 22 bp, Homo sapiens
agggctcagaacaatgagtgta

SEQ ID NO: 9108326 - DNA, 22 bp, Homo sapiens
agggctcagggtcaccatctgt

SEQ ID NO: 9108327 - DNA, 22 bp, Homo sapiens
agggctcagggtcaccatctgt

SEQ ID NO: 9108328 - DNA, 22 bp, Homo sapiens
aggggcagttccaagttttgtg

SEQ ID NO: 9108329 - DNA, 22 bp, Homo sapiens
aggggagctaacaccagagccc

SEQ ID NO: 9108330 - DNA, 22 bp, Homo sapiens
aggggagcttgcctggtcaccc

SEQ ID NO: 9108331 - DNA, 22 bp, Homo sapiens
aggggagccgaggggcatctgt

SEQ ID NO: 9108332 - DNA, 22 bp, Homo sapiens
aggggagcgacattccgtgccg

SEQ ID NO: 9108333 - DNA, 22 bp, Homo sapiens
aggggagccgaggggcatctgt

SEQ ID NO: 9108334 - DNA, 22 bp, Homo sapiens
agggctttgagaatagtggaac

SEQ ID NO: 9108335 - DNA, 22 bp, Homo sapiens
agggctttctttgtaaaagaag

SEQ ID NO: 9108336 - DNA, 22 bp, Homo sapiens
agggctttgatggcattctcat

SEQ ID NO: 9108337 - DNA, 22 bp, Homo sapiens
agggctttgatggcattctcat

SEQ ID NO: 9108338 - DNA, 22 bp, Homo sapiens
aggggagcatctgtgatggtta

SEQ ID NO: 9108339 - DNA, 22 bp, Homo sapiens
aggggagcaaggccgtggtgta

SEQ ID NO: 9108340 - DNA, 22 bp, Homo sapiens
aggctccagtctcctctggcag

SEQ ID NO: 9108341 - DNA, 22 bp, Homo sapiens
aggctccttgttcatcatccat

SEQ ID NO: 9108342 - DNA, 22 bp, Homo sapiens
aggctccagtctcctctggcag

SEQ ID NO: 9108343 - DNA, 22 bp, Homo sapiens
acattaaatttcatagtgatta

SEQ ID NO: 9108344 - DNA, 22 bp, Homo sapiens
acattaaatttcatagtgatta

SEQ ID NO: 9108345 - DNA, 22 bp, Homo sapiens
acattaaaaaatgttgcatgaa

SEQ ID NO: 9108346 - DNA, 22 bp, Homo sapiens
acatgttttgtgccttgactag

SEQ ID NO: 9108347 - DNA, 22 bp, Homo sapiens
acattaaaatggagaattttga

SEQ ID NO: 9108348 - DNA, 22 bp, Homo sapiens
aggctcaggtctcaggtctggc

SEQ ID NO: 9108349 - DNA, 22 bp, Homo sapiens
aggctctgacccatgggaccca

SEQ ID NO: 9108350 - DNA, 22 bp, Homo sapiens
aggctctcagatcagccacatt

SEQ ID NO: 9108351 - DNA, 22 bp, Homo sapiens
aggctctcctccccaggaccat

SEQ ID NO: 9108352 - DNA, 21 bp, Homo sapiens
aggctctcatccagggaccca

SEQ ID NO: 9108353 - DNA, 22 bp, Homo sapiens
aggctctcactatcctcctagc

SEQ ID NO: 9108354 - DNA, 22 bp, Homo sapiens
aggctctcagatcagccacatt

SEQ ID NO: 9108355 - DNA, 22 bp, Homo sapiens
aggctctctagaaactgtgcct

SEQ ID NO: 9108356 - DNA, 22 bp, Homo sapiens
acatgtatgctttatgaagtag

SEQ ID NO: 9108357 - DNA, 22 bp, Homo sapiens
acatgtctaagtactcaacaaa

SEQ ID NO: 9108358 - DNA, 21 bp, Homo sapiens
acatgtacacatgtatgcaca

SEQ ID NO: 9108359 - DNA, 20 bp, Homo sapiens
acatgtacagacaggtttct

SEQ ID NO: 9108360 - DNA, 21 bp, Homo sapiens
acatgtacacatgtatgcaca

SEQ ID NO: 9108361 - DNA, 22 bp, Homo sapiens
acatgtacatacacatatgtaa

SEQ ID NO: 9108362 - DNA, 22 bp, Homo sapiens
acatgtacatacacatatgtaa

SEQ ID NO: 9108363 - DNA, 22 bp, Homo sapiens
acatgtactgttggtgaagagg

SEQ ID NO: 9108364 - DNA, 20 bp, Homo sapiens
acatgtactaatgaatacag

SEQ ID NO: 9108365 - DNA, 20 bp, Homo sapiens
acatggcattcccacgtggt

SEQ ID NO: 9108366 - DNA, 22 bp, Homo sapiens
acatggctcagtctcatgacag

SEQ ID NO: 9108367 - DNA, 22 bp, Homo sapiens
acatggctaaattagctttact

SEQ ID NO: 9108368 - DNA, 22 bp, Homo sapiens
aggcagtgtgtagctggaagag

SEQ ID NO: 9108369 - DNA, 22 bp, Homo sapiens
acatgtaacatatatgtagcat

SEQ ID NO: 9108370 - DNA, 22 bp, Homo sapiens
acatgtaaaaggaacatgcatg

SEQ ID NO: 9108371 - DNA, 22 bp, Homo sapiens
acatgtgctcttgctgtacagc

SEQ ID NO: 9108372 - DNA, 22 bp, Homo sapiens
aggctcaagcactgatattttt

SEQ ID NO: 9108373 - DNA, 22 bp, Homo sapiens
acatgtgtaaaagtggataaaa

SEQ ID NO: 9108374 - DNA, 22 bp, Homo sapiens
aggctcagggacggggcccctt

SEQ ID NO: 9108375 - DNA, 22 bp, Homo sapiens
aggctcagggactccctccctc

SEQ ID NO: 9108376 - DNA, 22 bp, Homo sapiens
accactgcccatggtgaaaact

SEQ ID NO: 9108377 - DNA, 22 bp, Homo sapiens
accactgcccatggtgaaaact

SEQ ID NO: 9108378 - DNA, 22 bp, Homo sapiens
accactgcccatggtgaaaact

SEQ ID NO: 9108379 - DNA, 22 bp, Homo sapiens
accacaggacccatgagtcagt

SEQ ID NO: 9108380 - DNA, 22 bp, Homo sapiens
accacaggaattgctctgtggt

SEQ ID NO: 9108381 - DNA, 22 bp, Homo sapiens
aggctgtgatgagcctcatgga

SEQ ID NO: 9108382 - DNA, 22 bp, Homo sapiens
accagaaggaccagaggcaagg

SEQ ID NO: 9108383 - DNA, 22 bp, Homo sapiens
accactgggcgggcagcctgct

SEQ ID NO: 9108384 - DNA, 22 bp, Homo sapiens
accacttatcatcactatctca

SEQ ID NO: 9108385 - DNA, 22 bp, Homo sapiens
accactgtatctccagcacatt

SEQ ID NO: 9108386 - DNA, 22 bp, Homo sapiens
aggctgggaaacctgaagttgt

SEQ ID NO: 9108387 - DNA, 22 bp, Homo sapiens
aggctgggaaacctgaagttgt

SEQ ID NO: 9108388 - DNA, 22 bp, Homo sapiens
aggctggctttggtagcatggt

SEQ ID NO: 9108389 - DNA, 19 bp, Homo sapiens
aggctgtgagggaggactc

SEQ ID NO: 9108390 - DNA, 22 bp, Homo sapiens
aggctgtgagaggtggctccca

SEQ ID NO: 9108391 - DNA, 22 bp, Homo sapiens
aggctgtgagaagtccttcagt

SEQ ID NO: 9108392 - DNA, 23 bp, Homo sapiens
aggctggcttcaggagcctctcc

SEQ ID NO: 9108393 - DNA, 22 bp, Homo sapiens
aggctggcttggctctcctgtg

SEQ ID NO: 9108394 - DNA, 22 bp, Homo sapiens
aggctggcttcccaagcgtcct

SEQ ID NO: 9108395 - DNA, 22 bp, Homo sapiens
acatttctccctgcatgcctgc

SEQ ID NO: 9108396 - DNA, 22 bp, Homo sapiens
acatttctcatctagtagagta

SEQ ID NO: 9108397 - DNA, 22 bp, Homo sapiens
acatttctcaggtaagtcattt

SEQ ID NO: 9108398 - DNA, 22 bp, Homo sapiens
acatttctcaggtaagtcattt

SEQ ID NO: 9108399 - DNA, 22 bp, Homo sapiens
aggctgctggcaggcgtggacg

SEQ ID NO: 9108400 - DNA, 22 bp, Homo sapiens
acatttctcagggagttttgct

SEQ ID NO: 9108401 - DNA, 22 bp, Homo sapiens
aggctgcagaacagtcaggtgc

SEQ ID NO: 9108402 - DNA, 22 bp, Homo sapiens
aggctctggagttagccaggca

SEQ ID NO: 9108403 - DNA, 22 bp, Homo sapiens
aggctctggcaacagctggtgt

SEQ ID NO: 9108404 - DNA, 22 bp, Homo sapiens
aggctgctgccttggagagtgt

SEQ ID NO: 9108405 - DNA, 22 bp, Homo sapiens
acagcagtgtctggtactgagt

SEQ ID NO: 9108406 - DNA, 22 bp, Homo sapiens
acagcagttaacgatcagactc

SEQ ID NO: 9108407 - DNA, 22 bp, Homo sapiens
acagcagtgggttgccagtggg

SEQ ID NO: 9108408 - DNA, 22 bp, Homo sapiens
acagcagtggtgcactgagcca

SEQ ID NO: 9108409 - DNA, 22 bp, Homo sapiens
acagcagtgggttgccagtggg

SEQ ID NO: 9108410 - DNA, 22 bp, Homo sapiens
acagcagtgggttgccagtggg

SEQ ID NO: 9108411 - DNA, 22 bp, Homo sapiens
acagcagttactgaaataaagt

SEQ ID NO: 9108412 - DNA, 22 bp, Homo sapiens
acagcagttactgaaataaagt

SEQ ID NO: 9108413 - DNA, 22 bp, Homo sapiens
acagcagtttagaggacagcca

SEQ ID NO: 9108414 - DNA, 22 bp, Homo sapiens
acagccagaggagccaggctgg

SEQ ID NO: 9108415 - DNA, 22 bp, Homo sapiens
acagccaaggaattaggaaggg

SEQ ID NO: 9108416 - DNA, 22 bp, Homo sapiens
acagccagaagtcagggtggga

SEQ ID NO: 9108417 - DNA, 22 bp, Homo sapiens
acagcattgctccatctcaaga

SEQ ID NO: 9108418 - DNA, 22 bp, Homo sapiens
acagcatttaaagaaaatgaac

SEQ ID NO: 9108419 - DNA, 22 bp, Homo sapiens
acagcatttaaagaaaatgaac

SEQ ID NO: 9108420 - DNA, 22 bp, Homo sapiens
acagcattcaataaataataac

SEQ ID NO: 9108421 - DNA, 22 bp, Homo sapiens
acagcattccctttggctgctt

SEQ ID NO: 9108422 - DNA, 22 bp, Homo sapiens
acagcattcaataaataataac

SEQ ID NO: 9108423 - DNA, 22 bp, Homo sapiens
acaggaagaaagtgcagtagat

SEQ ID NO: 9108424 - DNA, 22 bp, Homo sapiens
acaggaagaaagtgcagtagat

SEQ ID NO: 9108425 - DNA, 22 bp, Homo sapiens
acagcttcgaggatctcatccc

SEQ ID NO: 9108426 - DNA, 22 bp, Homo sapiens
acagcttctatttctctgtact

SEQ ID NO: 9108427 - DNA, 22 bp, Homo sapiens
acagcttctctgaaattcatgt

SEQ ID NO: 9108428 - DNA, 22 bp, Homo sapiens
acagcttctcctcgatgtcatg

SEQ ID NO: 9108429 - DNA, 22 bp, Homo sapiens
acaggaagtgctggcacttaca

SEQ ID NO: 9108430 - DNA, 22 bp, Homo sapiens
acaggaagtgggaagaaacagg

SEQ ID NO: 9108431 - DNA, 22 bp, Homo sapiens
acaggaagtttggaaagcctca

SEQ ID NO: 9108432 - DNA, 22 bp, Homo sapiens
acaggaagtgggaagaaacagg

SEQ ID NO: 9108433 - DNA, 22 bp, Homo sapiens
acaggaatttcctaatattcga

SEQ ID NO: 9108434 - DNA, 22 bp, Homo sapiens
acaggaagtttggaaagcctca

SEQ ID NO: 9108435 - DNA, 22 bp, Homo sapiens
acaggacaaaaatctggatggc

SEQ ID NO: 9108436 - DNA, 22 bp, Homo sapiens
agcttcttctgatttgtcagtc

SEQ ID NO: 9108437 - DNA, 22 bp, Homo sapiens
agcttcttcttggtctttccca

SEQ ID NO: 9108438 - DNA, 22 bp, Homo sapiens
agcttcttgaccaagcctgtaa

SEQ ID NO: 9108439 - DNA, 22 bp, Homo sapiens
agcttcttgaccaagcctgtaa

SEQ ID NO: 9108440 - DNA, 21 bp, Homo sapiens
agcttccagagcacattccat

SEQ ID NO: 9108441 - DNA, 22 bp, Homo sapiens
agcttccacatctgtcttcagt

SEQ ID NO: 9108442 - DNA, 22 bp, Homo sapiens
agcttccaatttctccaagaga

SEQ ID NO: 9108443 - DNA, 22 bp, Homo sapiens
acaggacagtctagtaacagta

SEQ ID NO: 9108444 - DNA, 22 bp, Homo sapiens
acaggacatggcttctgtgacg

SEQ ID NO: 9108445 - DNA, 22 bp, Homo sapiens
acaggacatgtaccaggtggtc

SEQ ID NO: 9108446 - DNA, 22 bp, Homo sapiens
acaggactgtgatccagtaacc

SEQ ID NO: 9108447 - DNA, 22 bp, Homo sapiens
acaggactgtggaaggatctct

SEQ ID NO: 9108448 - DNA, 22 bp, Homo sapiens
acaggactgtggaaggatctct

SEQ ID NO: 9108449 - DNA, 22 bp, Homo sapiens
acaggacttaagtcatttataa

SEQ ID NO: 9108450 - DNA, 19 bp, Homo sapiens
agcttctttggaaacattt

SEQ ID NO: 9108451 - DNA, 22 bp, Homo sapiens
agcttctttaattcagcatgat

SEQ ID NO: 9108452 - DNA, 22 bp, Homo sapiens
agcttctttaattcagcatgat

SEQ ID NO: 9108453 - DNA, 22 bp, Homo sapiens
agcttctttgtgggctccagaa

SEQ ID NO: 9108454 - DNA, 22 bp, Homo sapiens
acaggatggagataatagaaaa

SEQ ID NO: 9108455 - DNA, 22 bp, Homo sapiens
acaggcaagtcacacaacttgt

SEQ ID NO: 9108456 - DNA, 18 bp, Homo sapiens
aggaaagaaaggcaggtg

SEQ ID NO: 9108457 - DNA, 22 bp, Homo sapiens
acaggcacaccttcctgcaggc

SEQ ID NO: 9108458 - DNA, 21 bp, Homo sapiens
acaggcaaattttagacaatg

SEQ ID NO: 9108459 - DNA, 22 bp, Homo sapiens
acaggcaaacacagaaagtagg

SEQ ID NO: 9108460 - DNA, 22 bp, Homo sapiens
acaggcaagaggaaagcaagta

SEQ ID NO: 9108461 - DNA, 22 bp, Homo sapiens
acaggcaaggccagtgagaaat

SEQ ID NO: 9108462 - DNA, 22 bp, Homo sapiens
acaggcctgtgtgcacacgagg

SEQ ID NO: 9108463 - DNA, 22 bp, Homo sapiens
acaggcctggtgctgctgacag

SEQ ID NO: 9108464 - DNA, 22 bp, Homo sapiens
acaggcctggtgctgctgacag

SEQ ID NO: 9108465 - DNA, 22 bp, Homo sapiens
acaggccttggtcctgacctaa

SEQ ID NO: 9108466 - DNA, 22 bp, Homo sapiens
acaggccttggtcctgacctaa

SEQ ID NO: 9108467 - DNA, 18 bp, Homo sapiens
acaggctattgcaggaga

SEQ ID NO: 9108468 - DNA, 22 bp, Homo sapiens
acaggccttaggagagatgggg

SEQ ID NO: 9108469 - DNA, 22 bp, Homo sapiens
acaggccttggcaggcatgtga

SEQ ID NO: 9108470 - DNA, 21 bp, Homo sapiens
acaggccttaggggccattca

SEQ ID NO: 9108471 - DNA, 22 bp, Homo sapiens
aggaaaggttcagtgattgaaa

SEQ ID NO: 9108472 - DNA, 22 bp, Homo sapiens
aggaaaggttcagtgattgaaa

SEQ ID NO: 9108473 - DNA, 19 bp, Homo sapiens
aggaaaggtggccttagca

SEQ ID NO: 9108474 - DNA, 19 bp, Homo sapiens
aggaaaggtggccttagca

SEQ ID NO: 9108475 - DNA, 22 bp, Homo sapiens
aggaaaggtgagagcggccgcg

SEQ ID NO: 9108476 - DNA, 22 bp, Homo sapiens
aggaaaggggtaggtgtggacg

SEQ ID NO: 9108477 - DNA, 22 bp, Homo sapiens
aggaaaggggtaggtgtggacg

SEQ ID NO: 9108478 - DNA, 22 bp, Homo sapiens
aggaaaggtagcgtgccagcag

SEQ ID NO: 9108479 - DNA, 22 bp, Homo sapiens
aggaaaggtagcgtgccagcag

SEQ ID NO: 9108480 - DNA, 21 bp, Homo sapiens
acagggcatgcagctggctgt

SEQ ID NO: 9108481 - DNA, 21 bp, Homo sapiens
acagggcatgcagctggctgt

SEQ ID NO: 9108482 - DNA, 23 bp, Homo sapiens
acagggcattgctggcctcgagg

SEQ ID NO: 9108483 - DNA, 21 bp, Homo sapiens
acaggctctggggatgctggg

SEQ ID NO: 9108484 - DNA, 22 bp, Homo sapiens
acaggctctcagccagttggca

SEQ ID NO: 9108485 - DNA, 22 bp, Homo sapiens
acaggctcacagtcatttcatt

SEQ ID NO: 9108486 - DNA, 22 bp, Homo sapiens
aggacaggtgtagtgggctctg

SEQ ID NO: 9108487 - DNA, 22 bp, Homo sapiens
aggacaggtgtagtgggctctg

SEQ ID NO: 9108488 - DNA, 22 bp, Homo sapiens
aggacaggtgtagtgggctctg

SEQ ID NO: 9108489 - DNA, 23 bp, Homo sapiens
aggactgctcacttgaggcttcc

SEQ ID NO: 9108490 - DNA, 22 bp, Homo sapiens
aggactggccctgaggggaggc

SEQ ID NO: 9108491 - DNA, 22 bp, Homo sapiens
aggactggcagtgtgaggggtc

SEQ ID NO: 9108492 - DNA, 22 bp, Homo sapiens
aggactgggtgcagagggcatc

SEQ ID NO: 9108493 - DNA, 22 bp, Homo sapiens
aggactggcggtcggtggggat

SEQ ID NO: 9108494 - DNA, 22 bp, Homo sapiens
aggacacaggtaagccagtgga

SEQ ID NO: 9108495 - DNA, 22 bp, Homo sapiens
aggacacaggtaagccagtgga

SEQ ID NO: 9108496 - DNA, 22 bp, Homo sapiens
aggacacaggtaagccagtgga

SEQ ID NO: 9108497 - DNA, 22 bp, Homo sapiens
acagggccttatatccagaagg

SEQ ID NO: 9108498 - DNA, 22 bp, Homo sapiens
acagggccttatatccagaagg

SEQ ID NO: 9108499 - DNA, 22 bp, Homo sapiens
acagggcctcagccagggcaga

SEQ ID NO: 9108500 - DNA, 22 bp, Homo sapiens
acagggccattggaggattata

SEQ ID NO: 9108501 - DNA, 22 bp, Homo sapiens
aggcagatttaggagaaaagaa

SEQ ID NO: 9108502 - DNA, 22 bp, Homo sapiens
aggcagcaaagaaatgatgctg

SEQ ID NO: 9108503 - DNA, 22 bp, Homo sapiens
aggcagcaagattatttaatcc

SEQ ID NO: 9108504 - DNA, 22 bp, Homo sapiens
aggcagcaaatgtctggaacag

SEQ ID NO: 9108505 - DNA, 22 bp, Homo sapiens
aggcagcaaagaaatgatgctg

SEQ ID NO: 9108506 - DNA, 22 bp, Homo sapiens
aggcagcaaatgtctggaacag

SEQ ID NO: 9108507 - DNA, 22 bp, Homo sapiens
aggcagcaaagaaatgatgctg

SEQ ID NO: 9108508 - DNA, 22 bp, Homo sapiens
aggcagcaatgaatgaaatgga

SEQ ID NO: 9108509 - DNA, 22 bp, Homo sapiens
aggcagcaatgaatgaaatgga

SEQ ID NO: 9108510 - DNA, 22 bp, Homo sapiens
aggcaggtgggtcacttgagtc

SEQ ID NO: 9108511 - DNA, 22 bp, Homo sapiens
aggcaggttacaaaaactttat

SEQ ID NO: 9108512 - DNA, 22 bp, Homo sapiens
acatagttcagagcagcagacc

SEQ ID NO: 9108513 - DNA, 22 bp, Homo sapiens
aggcaggttggggaaaagcact

SEQ ID NO: 9108514 - DNA, 22 bp, Homo sapiens
aggcagatcacaggagggcctg

SEQ ID NO: 9108515 - DNA, 22 bp, Homo sapiens
aggcagacttcctgcttggatc

SEQ ID NO: 9108516 - DNA, 22 bp, Homo sapiens
aggcagagaaaaaccagatatg

SEQ ID NO: 9108517 - DNA, 22 bp, Homo sapiens
aggcagatgggagctggaagtt

SEQ ID NO: 9108518 - DNA, 22 bp, Homo sapiens
aggcagatgggagctggaagtt

SEQ ID NO: 9108519 - DNA, 22 bp, Homo sapiens
aggcagatcacttgaggccagg

SEQ ID NO: 9108520 - DNA, 22 bp, Homo sapiens
aggcagatgaacctgggttgag

SEQ ID NO: 9108521 - DNA, 22 bp, Homo sapiens
aggcagatggatgggcatttgt

SEQ ID NO: 9108522 - DNA, 22 bp, Homo sapiens
aggcagattacttgaggccagg

SEQ ID NO: 9108523 - DNA, 22 bp, Homo sapiens
aggcagatgtttggcattgctt

SEQ ID NO: 9108524 - DNA, 22 bp, Homo sapiens
aggcagaagccagccagggtcc

SEQ ID NO: 9108525 - DNA, 22 bp, Homo sapiens
aggcagaaccagctgggacttt

SEQ ID NO: 9108526 - DNA, 22 bp, Homo sapiens
aggcagaatgttggaaaggaag

SEQ ID NO: 9108527 - DNA, 21 bp, Homo sapiens
aggcagaaagagcccaggctg

SEQ ID NO: 9108528 - DNA, 21 bp, Homo sapiens
aggcagaaagagcccaggctg

SEQ ID NO: 9108529 - DNA, 22 bp, Homo sapiens
aggcagaaccagctgggacttt

SEQ ID NO: 9108530 - DNA, 22 bp, Homo sapiens
aggcagactgtgcgggaagagt

SEQ ID NO: 9108531 - DNA, 22 bp, Homo sapiens
aggcagactgtgcgggaagagt

SEQ ID NO: 9108532 - DNA, 22 bp, Homo sapiens
aggcagacttaccttctgggga

SEQ ID NO: 9108533 - DNA, 22 bp, Homo sapiens
aggcagacttcctgcttggatc

SEQ ID NO: 9108534 - DNA, 22 bp, Homo sapiens
aggcagactggcagggcctgga

SEQ ID NO: 9108535 - DNA, 22 bp, Homo sapiens
aggcagactcaatggctagata

SEQ ID NO: 9108536 - DNA, 22 bp, Homo sapiens
aggcagaccatgaatcatgacc

SEQ ID NO: 9108537 - DNA, 22 bp, Homo sapiens
aggcagacaagtccagaactgg

SEQ ID NO: 9108538 - DNA, 22 bp, Homo sapiens
aggcagaccacctgtagccatc

SEQ ID NO: 9108539 - DNA, 18 bp, Homo sapiens
aggcagacactagaggtc

SEQ ID NO: 9108540 - DNA, 20 bp, Homo sapiens
aggcagacaaggagtctgtt

SEQ ID NO: 9108541 - DNA, 22 bp, Homo sapiens
aggcagacaaggacacagtggg

SEQ ID NO: 9108542 - DNA, 20 bp, Homo sapiens
aggcagtgtagagatgagta

SEQ ID NO: 9108543 - DNA, 20 bp, Homo sapiens
aggcagtgtagagatgagta

SEQ ID NO: 9108544 - DNA, 20 bp, Homo sapiens
aggcagtgtagagatgagta

SEQ ID NO: 9108545 - DNA, 22 bp, Homo sapiens
aggcagtgtattgctagcggct

SEQ ID NO: 9108546 - DNA, 23 bp, Homo sapiens
aggcagtgtctcttatcctgtcc

SEQ ID NO: 9108547 - DNA, 22 bp, Homo sapiens
aggcagtgtattgctagcggct

SEQ ID NO: 9108548 - DNA, 22 bp, Homo sapiens
aggcagtgtattgctagcggct

SEQ ID NO: 9108549 - DNA, 22 bp, Homo sapiens
aggcagtgtggagggctgttgc

SEQ ID NO: 9108550 - DNA, 22 bp, Homo sapiens
aggcagtgtgggccaagcttcc

SEQ ID NO: 9108551 - DNA, 22 bp, Homo sapiens
aggcagtgtattgctagcggct

SEQ ID NO: 9108552 - DNA, 22 bp, Homo sapiens
aggcagtgtggagggctgttgc

SEQ ID NO: 9108553 - DNA, 22 bp, Homo sapiens
aggcagtgtgtagctggaagag

SEQ ID NO: 9108554 - DNA, 22 bp, Homo sapiens
aggcagtgtgtagctggaagag

SEQ ID NO: 9108555 - DNA, 22 bp, Homo sapiens
acatctgtttgagaaaaagaag

SEQ ID NO: 9108556 - DNA, 22 bp, Homo sapiens
acatctttatactagtccttga

SEQ ID NO: 9108557 - DNA, 22 bp, Homo sapiens
aggcagtggtgtttgctggtgg

SEQ ID NO: 9108558 - DNA, 22 bp, Homo sapiens
acatctggaaagttacttgaga

SEQ ID NO: 9108559 - DNA, 22 bp, Homo sapiens
acatctgaccattacaagacat

SEQ ID NO: 9108560 - DNA, 22 bp, Homo sapiens
acatccatttgctttatttgct

SEQ ID NO: 9108561 - DNA, 22 bp, Homo sapiens
acatctctgggtcctccatgca

SEQ ID NO: 9108562 - DNA, 22 bp, Homo sapiens
acatctcttataaactctctga

SEQ ID NO: 9108563 - DNA, 22 bp, Homo sapiens
acatatattactagtaaagaca

SEQ ID NO: 9108564 - DNA, 22 bp, Homo sapiens
acatatatgtaaagtactttgt

SEQ ID NO: 9108565 - DNA, 22 bp, Homo sapiens
acatatatgtaaagtactttgt

SEQ ID NO: 9108566 - DNA, 22 bp, Homo sapiens
acatatatgcgtgggctcatgg

SEQ ID NO: 9108567 - DNA, 22 bp, Homo sapiens
acatatatgtaaagtactttgt

SEQ ID NO: 9108568 - DNA, 22 bp, Homo sapiens
aggaggccctagagctctagag

SEQ ID NO: 9108569 - DNA, 22 bp, Homo sapiens
aggaggcccctcctgggttgct

SEQ ID NO: 9108570 - DNA, 22 bp, Homo sapiens
aggaggccgatttcagaggtcg

SEQ ID NO: 9108571 - DNA, 17 bp, Homo sapiens
aggaggccctggcgttt

SEQ ID NO: 9108572 - DNA, 22 bp, Homo sapiens
acagtgcagggcgggaagaagg

SEQ ID NO: 9108573 - DNA, 22 bp, Homo sapiens
acagtgcagggcgggaagaagg

SEQ ID NO: 9108574 - DNA, 22 bp, Homo sapiens
acagtgcagggtgggaagaagg

SEQ ID NO: 9108575 - DNA, 22 bp, Homo sapiens
acagtgcagggtgggaagaagg

SEQ ID NO: 9108576 - DNA, 22 bp, Homo sapiens
acagtgctgtctatctcactaa

SEQ ID NO: 9108577 - DNA, 22 bp, Homo sapiens
aggaggccgatttcagaggtcg

SEQ ID NO: 9108578 - DNA, 22 bp, Homo sapiens
acagtgaatgcccaagaaaagt

SEQ ID NO: 9108579 - DNA, 22 bp, Homo sapiens
acagtgaatgcccaagaaaagt

SEQ ID NO: 9108580 - DNA, 22 bp, Homo sapiens
acagtgacactcaggtgggatg

SEQ ID NO: 9108581 - DNA, 23 bp, Homo sapiens
acagtgaaacacgcagtaagagt

SEQ ID NO: 9108582 - DNA, 22 bp, Homo sapiens
acagtgaaaagtagctaacaca

SEQ ID NO: 9108583 - DNA, 22 bp, Homo sapiens
acagtctgtcccccaggtgcta

SEQ ID NO: 9108584 - DNA, 22 bp, Homo sapiens
acagtctggaggctgcttcatt

SEQ ID NO: 9108585 - DNA, 22 bp, Homo sapiens
acagtctggaggctgcttcatt

SEQ ID NO: 9108586 - DNA, 22 bp, Homo sapiens
aggacttcaaatggaaacaaaa

SEQ ID NO: 9108587 - DNA, 22 bp, Homo sapiens
aggacttccaaacctcccaaat

SEQ ID NO: 9108588 - DNA, 22 bp, Homo sapiens
aggacttcatcacctgtataaa

SEQ ID NO: 9108589 - DNA, 22 bp, Homo sapiens
aggacttagaacattatgtact

SEQ ID NO: 9108590 - DNA, 22 bp, Homo sapiens
aggcacctcagctgagcctggg

SEQ ID NO: 9108591 - DNA, 22 bp, Homo sapiens
aggcaccagtaagagtagaact

SEQ ID NO: 9108592 - DNA, 21 bp, Homo sapiens
aggcaccacatctccctcccc

SEQ ID NO: 9108593 - DNA, 22 bp, Homo sapiens
aggcacagcacacctggccccc

SEQ ID NO: 9108594 - DNA, 22 bp, Homo sapiens
acagtggctcatgcctgtcatc

SEQ ID NO: 9108595 - DNA, 22 bp, Homo sapiens
acagtggcctcaaagaaagaga

SEQ ID NO: 9108596 - DNA, 22 bp, Homo sapiens
acagtggcagtattagggcaga

SEQ ID NO: 9108597 - DNA, 22 bp, Homo sapiens
aggcaccttgcggtccagtgaa

SEQ ID NO: 9108598 - DNA, 23 bp, Homo sapiens
aggcactcgacagaaatattgga

SEQ ID NO: 9108599 - DNA, 22 bp, Homo sapiens
aggcacgtggcgccaggagtga

SEQ ID NO: 9108600 - DNA, 22 bp, Homo sapiens
aggcaccttgagagcaggagct

SEQ ID NO: 9108601 - DNA, 22 bp, Homo sapiens
aggcaccttgagagcaggagct

SEQ ID NO: 9108602 - DNA, 17 bp, Homo sapiens
aggcacctcttcctgct

SEQ ID NO: 9108603 - DNA, 22 bp, Homo sapiens
aggcacctggatcttggaattc

SEQ ID NO: 9108604 - DNA, 20 bp, Homo sapiens
aggcacctgtcacaggtgag

SEQ ID NO: 9108605 - DNA, 22 bp, Homo sapiens
aggcactggtccattttctgca

SEQ ID NO: 9108606 - DNA, 22 bp, Homo sapiens
aggcagaaaatagtcatccaaa

SEQ ID NO: 9108607 - DNA, 22 bp, Homo sapiens
aggcagaaaatagtcatccaaa

SEQ ID NO: 9108608 - DNA, 22 bp, Homo sapiens
aggcagaaaatagtcatccaaa

SEQ ID NO: 9108609 - DNA, 22 bp, Homo sapiens
agtcctgggttctggtgttttg

SEQ ID NO: 9108610 - DNA, 22 bp, Homo sapiens
agtcctggtgacactcctcttc

SEQ ID NO: 9108611 - DNA, 22 bp, Homo sapiens
agtcctgtatctgagctgagtc

SEQ ID NO: 9108612 - DNA, 22 bp, Homo sapiens
agtcctgtatctgagctgagtc

SEQ ID NO: 9108613 - DNA, 22 bp, Homo sapiens
agtcctgtgaggggtgcagctt

SEQ ID NO: 9108614 - DNA, 22 bp, Homo sapiens
agtcctgtgcaaatgcatctga

SEQ ID NO: 9108615 - DNA, 22 bp, Homo sapiens
agtcctgtgagtttttctagtt

SEQ ID NO: 9108616 - DNA, 22 bp, Homo sapiens
agtcctgtgggtgggctggcca

SEQ ID NO: 9108617 - DNA, 22 bp, Homo sapiens
actctgggccccaggtggagct

SEQ ID NO: 9108618 - DNA, 22 bp, Homo sapiens
actctgggccccaggtggagct

SEQ ID NO: 9108619 - DNA, 22 bp, Homo sapiens
actctggggcgctactccaact

SEQ ID NO: 9108620 - DNA, 22 bp, Homo sapiens
actctgggctgttaggagctgt

SEQ ID NO: 9108621 - DNA, 22 bp, Homo sapiens
actctgggctttgatttgttac

SEQ ID NO: 9108622 - DNA, 22 bp, Homo sapiens
actctggggtgatgtctctgag

SEQ ID NO: 9108623 - DNA, 22 bp, Homo sapiens
actctgggtcctgccattcact

SEQ ID NO: 9108624 - DNA, 22 bp, Homo sapiens
actctggggtgatgtctctgag

SEQ ID NO: 9108625 - DNA, 20 bp, Homo sapiens
actctggggctcattagggg

SEQ ID NO: 9108626 - DNA, 22 bp, Homo sapiens
actctgggttctttcacttgac

SEQ ID NO: 9108627 - DNA, 22 bp, Homo sapiens
agtccagaccccggcagctggt

SEQ ID NO: 9108628 - DNA, 22 bp, Homo sapiens
agtccaggactgtttcagctga

SEQ ID NO: 9108629 - DNA, 21 bp, Homo sapiens
agtccaggaggaggccaggtt

SEQ ID NO: 9108630 - DNA, 22 bp, Homo sapiens
agtccaggagttgggtgacatt

SEQ ID NO: 9108631 - DNA, 22 bp, Homo sapiens
agtccaggcattccagccattc

SEQ ID NO: 9108632 - DNA, 18 bp, Homo sapiens
actctgggacctgttatt

SEQ ID NO: 9108633 - DNA, 22 bp, Homo sapiens
actctgggagaggacaaacaaa

SEQ ID NO: 9108634 - DNA, 22 bp, Homo sapiens
actctgggatcttgaaaagagt

SEQ ID NO: 9108635 - DNA, 22 bp, Homo sapiens
actctgggcccaccctcagagt

SEQ ID NO: 9108636 - DNA, 22 bp, Homo sapiens
actctgggcccaccctcagagt

SEQ ID NO: 9108637 - DNA, 22 bp, Homo sapiens
actctgggatgagaaaagggtt

SEQ ID NO: 9108638 - DNA, 22 bp, Homo sapiens
actctgggattgtttctggtat

SEQ ID NO: 9108639 - DNA, 22 bp, Homo sapiens
actcagagttttacccagagac

SEQ ID NO: 9108640 - DNA, 22 bp, Homo sapiens
actcagagtgcatctcctattt

SEQ ID NO: 9108641 - DNA, 22 bp, Homo sapiens
actcagagcttggctccttgct

SEQ ID NO: 9108642 - DNA, 22 bp, Homo sapiens
actcagaggaaagttgagattg

SEQ ID NO: 9108643 - DNA, 22 bp, Homo sapiens
actcagagtagaaaataggttc

SEQ ID NO: 9108644 - DNA, 22 bp, Homo sapiens
agtaacatgagtttttctaatg

SEQ ID NO: 9108645 - DNA, 22 bp, Homo sapiens
agtaacatctttgacatttgtt

SEQ ID NO: 9108646 - DNA, 22 bp, Homo sapiens
agtaacagtaacatcttcctag

SEQ ID NO: 9108647 - DNA, 22 bp, Homo sapiens
agtaacttaggagatacatggg

SEQ ID NO: 9108648 - DNA, 21 bp, Homo sapiens
agtaacattttgttgtttaca

SEQ ID NO: 9108649 - DNA, 22 bp, Homo sapiens
agtcagtgaaaactagaatgtt

SEQ ID NO: 9108650 - DNA, 22 bp, Homo sapiens
agtcagtgaaggcattgctcaa

SEQ ID NO: 9108651 - DNA, 23 bp, Homo sapiens
agtcagtgcgggatggtcagggg

SEQ ID NO: 9108652 - DNA, 23 bp, Homo sapiens
agtcagtgcgggatggtcagggg

SEQ ID NO: 9108653 - DNA, 22 bp, Homo sapiens
agtcagtgacttttgctgagag

SEQ ID NO: 9108654 - DNA, 22 bp, Homo sapiens
agtcagtggtatttaggggaat

SEQ ID NO: 9108655 - DNA, 22 bp, Homo sapiens
agtcagtgtagaaagcccaggc

SEQ ID NO: 9108656 - DNA, 23 bp, Homo sapiens
agtcagtgtaagtttggaatgca

SEQ ID NO: 9108657 - DNA, 22 bp, Homo sapiens
agtcagtgggcttggcacagaa

SEQ ID NO: 9108658 - DNA, 22 bp, Homo sapiens
agtcagtgggagaagtgtgaag

SEQ ID NO: 9108659 - DNA, 22 bp, Homo sapiens
agtcagtggctccgagcctggt

SEQ ID NO: 9108660 - DNA, 22 bp, Homo sapiens
agtcagtggatttaccatgcgt

SEQ ID NO: 9108661 - DNA, 22 bp, Homo sapiens
agtcagtggatttaccatgcgt

SEQ ID NO: 9108662 - DNA, 22 bp, Homo sapiens
agtaataatagctgtaaagtgc

SEQ ID NO: 9108663 - DNA, 22 bp, Homo sapiens
agtaagtgagtcactgtgctgg

SEQ ID NO: 9108664 - DNA, 22 bp, Homo sapiens
aggtggagacccagagaaggcg

SEQ ID NO: 9108665 - DNA, 22 bp, Homo sapiens
aggtggagacccagagaaggcg

SEQ ID NO: 9108666 - DNA, 22 bp, Homo sapiens
aggtggtgatgacagaagacag

SEQ ID NO: 9108667 - DNA, 22 bp, Homo sapiens
aggtgtcatttctctgcaggtg

SEQ ID NO: 9108668 - DNA, 22 bp, Homo sapiens
aggttccatcacctgcagtgga

SEQ ID NO: 9108669 - DNA, 22 bp, Homo sapiens
aggttccaggttcgaatcccat

SEQ ID NO: 9108670 - DNA, 22 bp, Homo sapiens
aggttcctcttcatgttcaaca

SEQ ID NO: 9108671 - DNA, 22 bp, Homo sapiens
aggttcctcttcctctggcctg

SEQ ID NO: 9108672 - DNA, 22 bp, Homo sapiens
aggttcctcttcctctggcctg

SEQ ID NO: 9108673 - DNA, 22 bp, Homo sapiens
aggttccaggtctgggttatgt

SEQ ID NO: 9108674 - DNA, 22 bp, Homo sapiens
aggttccagggattaggatgtg

SEQ ID NO: 9108675 - DNA, 20 bp, Homo sapiens
aggttccagccacaaccagc

SEQ ID NO: 9108676 - DNA, 21 bp, Homo sapiens
aggttccagcagccagagaat

SEQ ID NO: 9108677 - DNA, 22 bp, Homo sapiens
aggttctggagaacttggaggt

SEQ ID NO: 9108678 - DNA, 22 bp, Homo sapiens
aggttctgatttgttggggagg

SEQ ID NO: 9108679 - DNA, 22 bp, Homo sapiens
aggttctccttatcaatgaaga

SEQ ID NO: 9108680 - DNA, 22 bp, Homo sapiens
aggttctcacacgtctacaccc

SEQ ID NO: 9108681 - DNA, 22 bp, Homo sapiens
aggttctcacacgtctacaccc

SEQ ID NO: 9108682 - DNA, 22 bp, Homo sapiens
aggttcgggcacttacaaatgg

SEQ ID NO: 9108683 - DNA, 21 bp, Homo sapiens
aggttcctgagtcatgcctta

SEQ ID NO: 9108684 - DNA, 22 bp, Homo sapiens
aggttccttatggggatggcta

SEQ ID NO: 9108685 - DNA, 20 bp, Homo sapiens
aggttcctttgtggagaatt

SEQ ID NO: 9108686 - DNA, 20 bp, Homo sapiens
aggttcctttgtggagaatt

SEQ ID NO: 9108687 - DNA, 22 bp, Homo sapiens
actcagagcctcgagggactgc

SEQ ID NO: 9108688 - DNA, 22 bp, Homo sapiens
actcacagtccctgtaggagtg

SEQ ID NO: 9108689 - DNA, 22 bp, Homo sapiens
aggttcttggtgagcatttggt

SEQ ID NO: 9108690 - DNA, 22 bp, Homo sapiens
aggttcttgactctaccttcca

SEQ ID NO: 9108691 - DNA, 18 bp, Homo sapiens
agggtcagtgtcactggc

SEQ ID NO: 9108692 - DNA, 19 bp, Homo sapiens
agggtccagggagcggctc

SEQ ID NO: 9108693 - DNA, 22 bp, Homo sapiens
agggtccatcaaggactgcaca

SEQ ID NO: 9108694 - DNA, 22 bp, Homo sapiens
agggtccagtaacagatgccag

SEQ ID NO: 9108695 - DNA, 22 bp, Homo sapiens
agggtccatcaaggactgcaca

SEQ ID NO: 9108696 - DNA, 22 bp, Homo sapiens
agggtcctaagcctcagataag

SEQ ID NO: 9108697 - DNA, 22 bp, Homo sapiens
agggtgagggtctggccttgag

SEQ ID NO: 9108698 - DNA, 22 bp, Homo sapiens
agggtgagggtctggccttgag

SEQ ID NO: 9108699 - DNA, 22 bp, Homo sapiens
agggtgcagaaggagcctagga

SEQ ID NO: 9108700 - DNA, 22 bp, Homo sapiens
agggtgcaggtgtggagtctag

SEQ ID NO: 9108701 - DNA, 22 bp, Homo sapiens
agggtgcagaaggagcctagga

SEQ ID NO: 9108702 - DNA, 22 bp, Homo sapiens
agggtgcagaaggagcctagga

SEQ ID NO: 9108703 - DNA, 22 bp, Homo sapiens
aggtgcaggagctgtgcaggga

SEQ ID NO: 9108704 - DNA, 19 bp, Homo sapiens
aggtgcaggtcacagggga

SEQ ID NO: 9108705 - DNA, 22 bp, Homo sapiens
agggtgcatgtttgcaagagtg

SEQ ID NO: 9108706 - DNA, 22 bp, Homo sapiens
aggtgaggataggtggccaagg

SEQ ID NO: 9108707 - DNA, 21 bp, Homo sapiens
aggtgccaaggagaagcaggc

SEQ ID NO: 9108708 - DNA, 22 bp, Homo sapiens
aggtgccagatgcacagctgaa

SEQ ID NO: 9108709 - DNA, 22 bp, Homo sapiens
aggtgccaattttcagtgaaca

SEQ ID NO: 9108710 - DNA, 21 bp, Homo sapiens
aggtgccaaggagaagcaggc

SEQ ID NO: 9108711 - DNA, 21 bp, Homo sapiens
aggtgccaaggagaagcaggc

SEQ ID NO: 9108712 - DNA, 22 bp, Homo sapiens
aggtgccactctcatgggctac

SEQ ID NO: 9108713 - DNA, 23 bp, Homo sapiens
aggtgccaactgagagctgagag

SEQ ID NO: 9108714 - DNA, 22 bp, Homo sapiens
agtggctggaattgcaggtgcg

SEQ ID NO: 9108715 - DNA, 22 bp, Homo sapiens
agtggctggaattgcaggtgcg

SEQ ID NO: 9108716 - DNA, 22 bp, Homo sapiens
agtgggagccagcagcttgggg

SEQ ID NO: 9108717 - DNA, 20 bp, Homo sapiens
agtgggagagggcagactgc

SEQ ID NO: 9108718 - DNA, 20 bp, Homo sapiens
agtgggagagggcagactgc

SEQ ID NO: 9108719 - DNA, 20 bp, Homo sapiens
agtgggagagggcagactgc

SEQ ID NO: 9108720 - DNA, 22 bp, Homo sapiens
agtggcagagccaagatatgat

SEQ ID NO: 9108721 - DNA, 22 bp, Homo sapiens
agtggcagagcaggtgctggaa

SEQ ID NO: 9108722 - DNA, 22 bp, Homo sapiens
agtggcagagccaagtagagcc

SEQ ID NO: 9108723 - DNA, 22 bp, Homo sapiens
agtgggaggcggctgacgggcg

SEQ ID NO: 9108724 - DNA, 22 bp, Homo sapiens
agtgggagcggcagtcggggac

SEQ ID NO: 9108725 - DNA, 22 bp, Homo sapiens
agtgggagccagcagcttgggg

SEQ ID NO: 9108726 - DNA, 22 bp, Homo sapiens
agtgggagcggcagtcggggac

SEQ ID NO: 9108727 - DNA, 22 bp, Homo sapiens
agtgggagcggcagtcggggac

SEQ ID NO: 9108728 - DNA, 22 bp, Homo sapiens
agtggcagacacaatgtgggca

SEQ ID NO: 9108729 - DNA, 22 bp, Homo sapiens
agtggcagagaccccagccagc

SEQ ID NO: 9108730 - DNA, 22 bp, Homo sapiens
agtggcagagaccccagccagc

SEQ ID NO: 9108731 - DNA, 22 bp, Homo sapiens
agtggcagaagtcactgggtag

SEQ ID NO: 9108732 - DNA, 22 bp, Homo sapiens
agtgaatgtccccgcgggtcag

SEQ ID NO: 9108733 - DNA, 22 bp, Homo sapiens
agtgagagtattaatgtgaact

SEQ ID NO: 9108734 - DNA, 22 bp, Homo sapiens
agtgagatatgtctcactgtcc

SEQ ID NO: 9108735 - DNA, 17 bp, Homo sapiens
agtgaggagattggaag

SEQ ID NO: 9108736 - DNA, 22 bp, Homo sapiens
agtgaggcaaagtgagaggcag

SEQ ID NO: 9108737 - DNA, 22 bp, Homo sapiens
agtgcaaagaaatcagctttgt

SEQ ID NO: 9108738 - DNA, 22 bp, Homo sapiens
agtgcaaagctgctgctgtggt

SEQ ID NO: 9108739 - DNA, 22 bp, Homo sapiens
agtgcaaagcagcctgtacacc

SEQ ID NO: 9108740 - DNA, 22 bp, Homo sapiens
agtgcaaagccgaggtttcttg

SEQ ID NO: 9108741 - DNA, 22 bp, Homo sapiens
agtgcaaattatttacctgatt

SEQ ID NO: 9108742 - DNA, 22 bp, Homo sapiens
agtgcaaagggctgttgagaag

SEQ ID NO: 9108743 - DNA, 22 bp, Homo sapiens
agtgcaaatatctacgcggtga

SEQ ID NO: 9108744 - DNA, 22 bp, Homo sapiens
agtgcaaagggatcagattggg

SEQ ID NO: 9108745 - DNA, 22 bp, Homo sapiens
agtgcaacttcacgtagagtac

SEQ ID NO: 9108746 - DNA, 20 bp, Homo sapiens
agtgcaagaaagcacagctg

SEQ ID NO: 9108747 - DNA, 22 bp, Homo sapiens
agtgctgtcccgacaactgagg

SEQ ID NO: 9108748 - DNA, 22 bp, Homo sapiens
agtgctgtccagtttcacaggt

SEQ ID NO: 9108749 - DNA, 22 bp, Homo sapiens
agtgctgaagactggctaggga

SEQ ID NO: 9108750 - DNA, 20 bp, Homo sapiens
agtgcaagaaagcacagctg

SEQ ID NO: 9108751 - DNA, 22 bp, Homo sapiens
agtgcaaaagtaattggagttt

SEQ ID NO: 9108752 - DNA, 22 bp, Homo sapiens
agtgcaaaagtaattggagttt

SEQ ID NO: 9108753 - DNA, 22 bp, Homo sapiens
agtgcaaaaaagtgttgtgaca

SEQ ID NO: 9108754 - DNA, 22 bp, Homo sapiens
agtgcaaactttattgtgacct

SEQ ID NO: 9108755 - DNA, 22 bp, Homo sapiens
agtgcaaaattcagaagcaatt

SEQ ID NO: 9108756 - DNA, 22 bp, Homo sapiens
agtgattttgctttgaagtgac

SEQ ID NO: 9108757 - DNA, 20 bp, Homo sapiens
agtgatttgttagtacattg

SEQ ID NO: 9108758 - DNA, 22 bp, Homo sapiens
agtgtggggtcaccggcccagg

SEQ ID NO: 9108759 - DNA, 22 bp, Homo sapiens
agtgtgtaagggatcaaagagt

SEQ ID NO: 9108760 - DNA, 22 bp, Homo sapiens
agtgtctgttgttcagaactct

SEQ ID NO: 9108761 - DNA, 22 bp, Homo sapiens
agtgtctgttgcttttgcagtg

SEQ ID NO: 9108762 - DNA, 22 bp, Homo sapiens
agtgtctttcatatcctccatc

SEQ ID NO: 9108763 - DNA, 19 bp, Homo sapiens
agtgtgtactgaaagcact

SEQ ID NO: 9108764 - DNA, 23 bp, Homo sapiens
actgggctgaaattaaaggtgtc

SEQ ID NO: 9108765 - DNA, 23 bp, Homo sapiens
actgggctgaaatttttcatggc

SEQ ID NO: 9108766 - DNA, 17 bp, Homo sapiens
agtgtgtgaaatggtgg

SEQ ID NO: 9108767 - DNA, 17 bp, Homo sapiens
agtgtgtgaaatggtgg

SEQ ID NO: 9108768 - DNA, 17 bp, Homo sapiens
agtgtgtgaaatggtgg

SEQ ID NO: 9108769 - DNA, 22 bp, Homo sapiens
agtgggggccaacgagggcagc

SEQ ID NO: 9108770 - DNA, 22 bp, Homo sapiens
agtgggggccaacgagggcagc

SEQ ID NO: 9108771 - DNA, 21 bp, Homo sapiens
agtggggtctctgtggaggcc

SEQ ID NO: 9108772 - DNA, 22 bp, Homo sapiens
agtgtctgttacgcttgcagaa

SEQ ID NO: 9108773 - DNA, 22 bp, Homo sapiens
agtgtctgttgagtttcaaaag

SEQ ID NO: 9108774 - DNA, 22 bp, Homo sapiens
agtgtctgtgttttctattgct

SEQ ID NO: 9108775 - DNA, 22 bp, Homo sapiens
agtgtctgtgatgaggtcagga

SEQ ID NO: 9108776 - DNA, 22 bp, Homo sapiens
agtgtctgtgatgaggtcagga

SEQ ID NO: 9108777 - DNA, 22 bp, Homo sapiens
agtgtctgtgaggggaattcct

SEQ ID NO: 9108778 - DNA, 22 bp, Homo sapiens
agtgtctgtgctttgcagcaaa

SEQ ID NO: 9108779 - DNA, 22 bp, Homo sapiens
agtgtctgtgctttgcagcaaa

SEQ ID NO: 9108780 - DNA, 20 bp, Homo sapiens
agtgtctggtgcagggcctc

SEQ ID NO: 9108781 - DNA, 20 bp, Homo sapiens
agtgtctggtgcagggcctc

SEQ ID NO: 9108782 - DNA, 22 bp, Homo sapiens
agtgtctggtgagggctctctc

SEQ ID NO: 9108783 - DNA, 22 bp, Homo sapiens
agtgtctggtgagggctctctc

SEQ ID NO: 9108784 - DNA, 22 bp, Homo sapiens
agtgtctgaaccaccggggcat

SEQ ID NO: 9108785 - DNA, 22 bp, Homo sapiens
agtgtctgaaccaccggggcat

SEQ ID NO: 9108786 - DNA, 22 bp, Homo sapiens
agtgtctggtctctgaactaaa

SEQ ID NO: 9108787 - DNA, 22 bp, Homo sapiens
actggggcagtgggcagtggtt

SEQ ID NO: 9108788 - DNA, 22 bp, Homo sapiens
actggggcaggaaagtatgctg

SEQ ID NO: 9108789 - DNA, 22 bp, Homo sapiens
actggggtgaaattggagtgtc

SEQ ID NO: 9108790 - DNA, 23 bp, Homo sapiens
actgggtctatctccagagaaga

SEQ ID NO: 9108791 - DNA, 22 bp, Homo sapiens
actggggtttaggcctgggcaa

SEQ ID NO: 9108792 - DNA, 22 bp, Homo sapiens
actggggcctcctccatgctct

SEQ ID NO: 9108793 - DNA, 22 bp, Homo sapiens
actggtactgttctgcggatca

SEQ ID NO: 9108794 - DNA, 22 bp, Homo sapiens
actggtacctgtcttgaatttt

SEQ ID NO: 9108795 - DNA, 23 bp, Homo sapiens
actggtacaggtttactggtgtc

SEQ ID NO: 9108796 - DNA, 22 bp, Homo sapiens
actggtactcagctggcactca

SEQ ID NO: 9108797 - DNA, 22 bp, Homo sapiens
actggtttcctagaataagact

SEQ ID NO: 9108798 - DNA, 22 bp, Homo sapiens
actggtttcccggaactacagt

SEQ ID NO: 9108799 - DNA, 22 bp, Homo sapiens
agttaagtaaacatttcccaga

SEQ ID NO: 9108800 - DNA, 22 bp, Homo sapiens
agttaataatggaaagacacat

SEQ ID NO: 9108801 - DNA, 21 bp, Homo sapiens
agttacaagtttattcagagg

SEQ ID NO: 9108802 - DNA, 22 bp, Homo sapiens
agttacaactgtttgaatgtca

SEQ ID NO: 9108803 - DNA, 22 bp, Homo sapiens
agttacagcactcaaagttttc

SEQ ID NO: 9108804 - DNA, 21 bp, Homo sapiens
agttacatgtatagataaagt

SEQ ID NO: 9108805 - DNA, 22 bp, Homo sapiens
agttacataatctgtgaatttt

SEQ ID NO: 9108806 - DNA, 22 bp, Homo sapiens
agttacatctgttatgtgtgtt

SEQ ID NO: 9108807 - DNA, 22 bp, Homo sapiens
agttcaaaaaggtaaagtttat

SEQ ID NO: 9108808 - DNA, 22 bp, Homo sapiens
agttcaaaaaggtaaagtttat

SEQ ID NO: 9108809 - DNA, 22 bp, Homo sapiens
agttcaaagctgcagtaatgga

SEQ ID NO: 9108810 - DNA, 22 bp, Homo sapiens
agttcaaagctgcagtaatgga

SEQ ID NO: 9108811 - DNA, 22 bp, Homo sapiens
agttcaaactctataagaactt

SEQ ID NO: 9108812 - DNA, 22 bp, Homo sapiens
agttcaaactctataagaactt

SEQ ID NO: 9108813 - DNA, 22 bp, Homo sapiens
agttcaaagtcaaggaaactgt

SEQ ID NO: 9108814 - DNA, 22 bp, Homo sapiens
agttcaagcaatgctggaagaa

SEQ ID NO: 9108815 - DNA, 22 bp, Homo sapiens
agttcaatagaaaaatatatta

SEQ ID NO: 9108816 - DNA, 22 bp, Homo sapiens
agttacattctgagctgagtag

SEQ ID NO: 9108817 - DNA, 22 bp, Homo sapiens
agttacatgtgaatagaaagta

SEQ ID NO: 9108818 - DNA, 22 bp, Homo sapiens
agaaatgtcaagtgttcttgtt

SEQ ID NO: 9108819 - DNA, 22 bp, Homo sapiens
agaaatgtaattgcaactgtct

SEQ ID NO: 9108820 - DNA, 22 bp, Homo sapiens
agaaatggaaatccaagcaact

SEQ ID NO: 9108821 - DNA, 22 bp, Homo sapiens
agaaatgtatagtgaatttttc

SEQ ID NO: 9108822 - DNA, 22 bp, Homo sapiens
agaaatgtgagccccttatcaa

SEQ ID NO: 9108823 - DNA, 22 bp, Homo sapiens
agaaatgttgaatacacaaaat

SEQ ID NO: 9108824 - DNA, 22 bp, Homo sapiens
agaagcaggcagatttcagctc

SEQ ID NO: 9108825 - DNA, 22 bp, Homo sapiens
agaagcaggcctcacagatctg

SEQ ID NO: 9108826 - DNA, 22 bp, Homo sapiens
agaagcaggcctcacagatctg

SEQ ID NO: 9108827 - DNA, 22 bp, Homo sapiens
agaagcagggcagggaaaagca

SEQ ID NO: 9108828 - DNA, 22 bp, Homo sapiens
agaagcagggcagggaaaagca

SEQ ID NO: 9108829 - DNA, 22 bp, Homo sapiens
agaagcagggcagggaaaagca

SEQ ID NO: 9108830 - DNA, 22 bp, Homo sapiens
agaaatgttgaatacatcagga

SEQ ID NO: 9108831 - DNA, 20 bp, Homo sapiens
agaagcattcaaagaaaact

SEQ ID NO: 9108832 - DNA, 22 bp, Homo sapiens
agaagccaaaggggccagatat

SEQ ID NO: 9108833 - DNA, 18 bp, Homo sapiens
agaagcaggttctcccag

SEQ ID NO: 9108834 - DNA, 18 bp, Homo sapiens
agaagcaggtaaaattct

SEQ ID NO: 9108835 - DNA, 22 bp, Homo sapiens
agaagcagttattttttgcaca

SEQ ID NO: 9108836 - DNA, 22 bp, Homo sapiens
agaagcagttattttttgcaca

SEQ ID NO: 9108837 - DNA, 22 bp, Homo sapiens
agaagcagttattttttgcaca

SEQ ID NO: 9108838 - DNA, 20 bp, Homo sapiens
agaagcatcattctgatgtc

SEQ ID NO: 9108839 - DNA, 22 bp, Homo sapiens
agaagccatgtttagtaggatg

SEQ ID NO: 9108840 - DNA, 22 bp, Homo sapiens
agaagccattccctgtaggctc

SEQ ID NO: 9108841 - DNA, 22 bp, Homo sapiens
agaagccattccctgtaggctc

SEQ ID NO: 9108842 - DNA, 22 bp, Homo sapiens
agaagccattgaagcagacctc

SEQ ID NO: 9108843 - DNA, 22 bp, Homo sapiens
agaagccattgaagcagacctc

SEQ ID NO: 9108844 - DNA, 21 bp, Homo sapiens
agaagcctgggtggaggtggg

SEQ ID NO: 9108845 - DNA, 22 bp, Homo sapiens
agaagcctcatcctctctagtg

SEQ ID NO: 9108846 - DNA, 18 bp, Homo sapiens
agaagcctgcctcaatgc

SEQ ID NO: 9108847 - DNA, 21 bp, Homo sapiens
agaagctagtcactaaatcca

SEQ ID NO: 9108848 - DNA, 22 bp, Homo sapiens
agaagctgacagatgcagcagg

SEQ ID NO: 9108849 - DNA, 22 bp, Homo sapiens
agaagctgacagatgcagcagg

SEQ ID NO: 9108850 - DNA, 22 bp, Homo sapiens
agaagctgacagatgcagcagg

SEQ ID NO: 9108851 - DNA, 22 bp, Homo sapiens
agaagctgacagatgcagcagg

SEQ ID NO: 9108852 - DNA, 20 bp, Homo sapiens
agaagctgatactgatggaa

SEQ ID NO: 9108853 - DNA, 22 bp, Homo sapiens
agaagctgcgtttatttaaatc

SEQ ID NO: 9108854 - DNA, 22 bp, Homo sapiens
agaagctgcctacatgaccagc

SEQ ID NO: 9108855 - DNA, 22 bp, Homo sapiens
agaagctgcctacatgaccagc

SEQ ID NO: 9108856 - DNA, 22 bp, Homo sapiens
atcctgagctacacctgctcct

SEQ ID NO: 9108857 - DNA, 22 bp, Homo sapiens
atcctgaggaaggtgcagagat

SEQ ID NO: 9108858 - DNA, 22 bp, Homo sapiens
atcctgagttcctgcctctaaa

SEQ ID NO: 9108859 - DNA, 22 bp, Homo sapiens
atcctgcttgttacttatagag

SEQ ID NO: 9108860 - DNA, 22 bp, Homo sapiens
atcctgggaagctgacattgaa

SEQ ID NO: 9108861 - DNA, 22 bp, Homo sapiens
atcctggcgccacacggctcta

SEQ ID NO: 9108862 - DNA, 22 bp, Homo sapiens
agaagccatagtatctcagggt

SEQ ID NO: 9108863 - DNA, 22 bp, Homo sapiens
agaaagaacgttggttatctta

SEQ ID NO: 9108864 - DNA, 17 bp, Homo sapiens
agaaagaggatccacag

SEQ ID NO: 9108865 - DNA, 17 bp, Homo sapiens
agaaagaggatccacag

SEQ ID NO: 9108866 - DNA, 22 bp, Homo sapiens
agaaagaggatgcagatctcat

SEQ ID NO: 9108867 - DNA, 22 bp, Homo sapiens
atattaatgagcaagtaagtga

SEQ ID NO: 9108868 - DNA, 22 bp, Homo sapiens
atattaatgggatttagtcagg

SEQ ID NO: 9108869 - DNA, 22 bp, Homo sapiens
atattaatgagcaagtaagtga

SEQ ID NO: 9108870 - DNA, 22 bp, Homo sapiens
atattaattatttacacatgag

SEQ ID NO: 9108871 - DNA, 22 bp, Homo sapiens
atattaatgggatttagtcagg

SEQ ID NO: 9108872 - DNA, 22 bp, Homo sapiens
atattaatgggatttagtcagg

SEQ ID NO: 9108873 - DNA, 22 bp, Homo sapiens
atattaagatgctattggtttt

SEQ ID NO: 9108874 - DNA, 22 bp, Homo sapiens
atattaatgagcaagtaagtga

SEQ ID NO: 9108875 - DNA, 22 bp, Homo sapiens
atattaaatggattttgggagc

SEQ ID NO: 9108876 - DNA, 22 bp, Homo sapiens
atatagtttaggttcgaatggg

SEQ ID NO: 9108877 - DNA, 20 bp, Homo sapiens
agaaacatttcttgagaact

SEQ ID NO: 9108878 - DNA, 22 bp, Homo sapiens
atatagttgggtttcattctac

SEQ ID NO: 9108879 - DNA, 22 bp, Homo sapiens
agaaagaacgcacttgtgctgc

SEQ ID NO: 9108880 - DNA, 22 bp, Homo sapiens
agaaaagggcaggagggataca

SEQ ID NO: 9108881 - DNA, 22 bp, Homo sapiens
agaaaagggcaggagggataca

SEQ ID NO: 9108882 - DNA, 22 bp, Homo sapiens
atatagaaggtgctatttacat

SEQ ID NO: 9108883 - DNA, 22 bp, Homo sapiens
atatagaaggtgctatttacat

SEQ ID NO: 9108884 - DNA, 22 bp, Homo sapiens
atatagaaggtgctatttacat

SEQ ID NO: 9108885 - DNA, 19 bp, Homo sapiens
atatagcattattcaattt

SEQ ID NO: 9108886 - DNA, 22 bp, Homo sapiens
atatagcacttgttttgcatgt

SEQ ID NO: 9108887 - DNA, 22 bp, Homo sapiens
atatagtaagcagtctgtaaat

SEQ ID NO: 9108888 - DNA, 20 bp, Homo sapiens
agaaatattgagttcagagg

SEQ ID NO: 9108889 - DNA, 23 bp, Homo sapiens
agaaagtttgtgccttgtgacac

SEQ ID NO: 9108890 - DNA, 22 bp, Homo sapiens
agaaagtttgtttttatccata

SEQ ID NO: 9108891 - DNA, 22 bp, Homo sapiens
atattaattatttacacatgag

SEQ ID NO: 9108892 - DNA, 22 bp, Homo sapiens
agaaatatgctgattagatgaa

SEQ ID NO: 9108893 - DNA, 22 bp, Homo sapiens
agaaatatgctgattagatgaa

SEQ ID NO: 9108894 - DNA, 22 bp, Homo sapiens
agaaatatgctgattagatgaa

SEQ ID NO: 9108895 - DNA, 22 bp, Homo sapiens
atcaatgcttgccaaatggaag

SEQ ID NO: 9108896 - DNA, 22 bp, Homo sapiens
agaaatctttcctgaagtgttt

SEQ ID NO: 9108897 - DNA, 22 bp, Homo sapiens
agaaatgacacacatgagacat

SEQ ID NO: 9108898 - DNA, 22 bp, Homo sapiens
agaaatcttggagtctgtggta

SEQ ID NO: 9108899 - DNA, 22 bp, Homo sapiens
atcaattttgaggatacaagaa

SEQ ID NO: 9108900 - DNA, 22 bp, Homo sapiens
agaaatgcctacgagataggga

SEQ ID NO: 9108901 - DNA, 22 bp, Homo sapiens
agaaatgcattagcacatatag

SEQ ID NO: 9108902 - DNA, 22 bp, Homo sapiens
agaaatgctcaggtcaacttaa

SEQ ID NO: 9108903 - DNA, 22 bp, Homo sapiens
agaaatgcagtctcgtcaaaag

SEQ ID NO: 9108904 - DNA, 22 bp, Homo sapiens
agaaatgcagtttcaagacaaa

SEQ ID NO: 9108905 - DNA, 22 bp, Homo sapiens
atcaagagtattgacaagacca

SEQ ID NO: 9108906 - DNA, 22 bp, Homo sapiens
atcaatgctctgtacccagaat

SEQ ID NO: 9108907 - DNA, 22 bp, Homo sapiens
atcaatatcagatcagacagga

SEQ ID NO: 9108908 - DNA, 22 bp, Homo sapiens
atcaaggctttggacatagcaa

SEQ ID NO: 9108909 - DNA, 23 bp, Homo sapiens
atcaagtcatcagcaaaatacat

SEQ ID NO: 9108910 - DNA, 22 bp, Homo sapiens
atcaagtctgcctgtctggagg

SEQ ID NO: 9108911 - DNA, 22 bp, Homo sapiens
atagctgtttttaggccaaata

SEQ ID NO: 9108912 - DNA, 22 bp, Homo sapiens
atagctttcttaaatatataaa

SEQ ID NO: 9108913 - DNA, 22 bp, Homo sapiens
atagctttcttaaatatataaa

SEQ ID NO: 9108914 - DNA, 22 bp, Homo sapiens
ataggaaagaaaattatgtagg

SEQ ID NO: 9108915 - DNA, 22 bp, Homo sapiens
atagctttttgtcatagagtct

SEQ ID NO: 9108916 - DNA, 20 bp, Homo sapiens
ataggaaagggaggggcttt

SEQ ID NO: 9108917 - DNA, 22 bp, Homo sapiens
ataggagatcaatatgcaattt

SEQ ID NO: 9108918 - DNA, 22 bp, Homo sapiens
ataggatgataaaattagaaac

SEQ ID NO: 9108919 - DNA, 22 bp, Homo sapiens
atagtgtcagaaaatcataaga

SEQ ID NO: 9108920 - DNA, 22 bp, Homo sapiens
ataggagatcaatatgcaattt

SEQ ID NO: 9108921 - DNA, 22 bp, Homo sapiens
ataggacagcagacaattagta

SEQ ID NO: 9108922 - DNA, 22 bp, Homo sapiens
ataggagactgttcttggcttc

SEQ ID NO: 9108923 - DNA, 22 bp, Homo sapiens
atagtgttttacttagacttct

SEQ ID NO: 9108924 - DNA, 22 bp, Homo sapiens
atagttatgctctagacaagaa

SEQ ID NO: 9108925 - DNA, 22 bp, Homo sapiens
atagtgttgtatgtacagtctg

SEQ ID NO: 9108926 - DNA, 22 bp, Homo sapiens
agaaaaggattgatggatcaga

SEQ ID NO: 9108927 - DNA, 22 bp, Homo sapiens
agaaaaggattgatggatcaga

SEQ ID NO: 9108928 - DNA, 22 bp, Homo sapiens
agaaaaggattgatggatcaga

SEQ ID NO: 9108929 - DNA, 22 bp, Homo sapiens
agaaaagggcaggagggataca

SEQ ID NO: 9108930 - DNA, 17 bp, Homo sapiens
agaaaagagaccagcag

SEQ ID NO: 9108931 - DNA, 22 bp, Homo sapiens
atagttccagcatctttggtaa

SEQ ID NO: 9108932 - DNA, 22 bp, Homo sapiens
atagttccagcatctttggtaa

SEQ ID NO: 9108933 - DNA, 22 bp, Homo sapiens
agaaaacttgtcacagctctca

SEQ ID NO: 9108934 - DNA, 22 bp, Homo sapiens
agaaaacttgtcacagctctca

SEQ ID NO: 9108935 - DNA, 22 bp, Homo sapiens
agaaaacttgctcgagcctgtt

SEQ ID NO: 9108936 - DNA, 22 bp, Homo sapiens
agaaaacttgctcgagcctgtt

SEQ ID NO: 9108937 - DNA, 20 bp, Homo sapiens
agaaaaagtgtggaaatttc

SEQ ID NO: 9108938 - DNA, 22 bp, Homo sapiens
atagaagatagcttttgtttct

SEQ ID NO: 9108939 - DNA, 22 bp, Homo sapiens
atagaacaaggtagacagcttt

SEQ ID NO: 9108940 - DNA, 22 bp, Homo sapiens
atagaacagaaacagatgcaca

SEQ ID NO: 9108941 - DNA, 22 bp, Homo sapiens
atagaacagaaacagatgcaca

SEQ ID NO: 9108942 - DNA, 22 bp, Homo sapiens
atagaacaggggcaggagcatt

SEQ ID NO: 9108943 - DNA, 22 bp, Homo sapiens
atagaaatgtattttggactag

SEQ ID NO: 9108944 - DNA, 22 bp, Homo sapiens
atagaaatgtattttggactag

SEQ ID NO: 9108945 - DNA, 22 bp, Homo sapiens
atactgttggcagcagaccaga

SEQ ID NO: 9108946 - DNA, 22 bp, Homo sapiens
atactgtttctcttctacatga

SEQ ID NO: 9108947 - DNA, 22 bp, Homo sapiens
atacactggcctttgcagagcc

SEQ ID NO: 9108948 - DNA, 22 bp, Homo sapiens
atacactgttcactagatcttc

SEQ ID NO: 9108949 - DNA, 22 bp, Homo sapiens
actttactccccaacataaatg

SEQ ID NO: 9108950 - DNA, 22 bp, Homo sapiens
actttagatattcctctgtaca

SEQ ID NO: 9108951 - DNA, 22 bp, Homo sapiens
atagcatataagttataaaact

SEQ ID NO: 9108952 - DNA, 22 bp, Homo sapiens
atagaatagcatagaaaattga

SEQ ID NO: 9108953 - DNA, 22 bp, Homo sapiens
actttacaggcacttcaagtat

SEQ ID NO: 9108954 - DNA, 22 bp, Homo sapiens
actttacagatggtttcctgac

SEQ ID NO: 9108955 - DNA, 22 bp, Homo sapiens
ataacagacttagagttacaag

SEQ ID NO: 9108956 - DNA, 22 bp, Homo sapiens
ataacagagagctactgaactg

SEQ ID NO: 9108957 - DNA, 22 bp, Homo sapiens
ataacactaaatgtatgtaaca

SEQ ID NO: 9108958 - DNA, 22 bp, Homo sapiens
ataaattttcttgctgtactta

SEQ ID NO: 9108959 - DNA, 22 bp, Homo sapiens
ataaatttataattgtttcctg

SEQ ID NO: 9108960 - DNA, 22 bp, Homo sapiens
ataaattttcttgctgtactta

SEQ ID NO: 9108961 - DNA, 22 bp, Homo sapiens
ataaattttcttgctgtactta

SEQ ID NO: 9108962 - DNA, 22 bp, Homo sapiens
agttgatttttctggctcagcc

SEQ ID NO: 9108963 - DNA, 22 bp, Homo sapiens
agttgcagacgcagagatgttg

SEQ ID NO: 9108964 - DNA, 22 bp, Homo sapiens
agttgcagacgcagagatgttg

SEQ ID NO: 9108965 - DNA, 22 bp, Homo sapiens
agttgcagccttcaggagaccc

SEQ ID NO: 9108966 - DNA, 19 bp, Homo sapiens
ataaataaaaagtgggaga

SEQ ID NO: 9108967 - DNA, 22 bp, Homo sapiens
ataaattgtgcttttgacatct

SEQ ID NO: 9108968 - DNA, 22 bp, Homo sapiens
ataaatttataattgtttcctg

SEQ ID NO: 9108969 - DNA, 22 bp, Homo sapiens
ataaattctctgatgtatagta

SEQ ID NO: 9108970 - DNA, 22 bp, Homo sapiens
ataaattctctgatgtatagta

SEQ ID NO: 9108971 - DNA, 22 bp, Homo sapiens
ataaattatgaatggccctttt

SEQ ID NO: 9108972 - DNA, 22 bp, Homo sapiens
agttcacaatagaagaggtggc

SEQ ID NO: 9108973 - DNA, 22 bp, Homo sapiens
agttcacattccgaggtactgg

SEQ ID NO: 9108974 - DNA, 22 bp, Homo sapiens
agttcacatatctgttttattt

SEQ ID NO: 9108975 - DNA, 22 bp, Homo sapiens
agttcacagggaaggttattgt

SEQ ID NO: 9108976 - DNA, 22 bp, Homo sapiens
agttcagcttcccaggtcactg

SEQ ID NO: 9108977 - DNA, 22 bp, Homo sapiens
agttcagagtaaatgttgaagg

SEQ ID NO: 9108978 - DNA, 22 bp, Homo sapiens
agttcactctttatgagaaagt

SEQ ID NO: 9108979 - DNA, 22 bp, Homo sapiens
agttcactatagaagacagtgt

SEQ ID NO: 9108980 - DNA, 22 bp, Homo sapiens
agttcactttctgtagtggaag

SEQ ID NO: 9108981 - DNA, 22 bp, Homo sapiens
agttcagaaatgtctttgcaaa

SEQ ID NO: 9108982 - DNA, 22 bp, Homo sapiens
agttcagaggcaggagaaggct

SEQ ID NO: 9108983 - DNA, 22 bp, Homo sapiens
agttcagaggcaggagaaggct

SEQ ID NO: 9108984 - DNA, 22 bp, Homo sapiens
agttgaataattagacatatct

SEQ ID NO: 9108985 - DNA, 22 bp, Homo sapiens
agttctttgtgagtaatacaga

SEQ ID NO: 9108986 - DNA, 22 bp, Homo sapiens
agttcttttaccaaggcaaatg

SEQ ID NO: 9108987 - DNA, 22 bp, Homo sapiens
agttctttgtgatggaaattta

SEQ ID NO: 9108988 - DNA, 22 bp, Homo sapiens
agttctttgtgatggaaattta

SEQ ID NO: 9108989 - DNA, 22 bp, Homo sapiens
agttgaaaattaagtgaatttc

SEQ ID NO: 9108990 - DNA, 22 bp, Homo sapiens
agttcttttctagattctggat

SEQ ID NO: 9108991 - DNA, 22 bp, Homo sapiens
ataagctgaatagtcaacacaa

SEQ ID NO: 9108992 - DNA, 19 bp, Homo sapiens
ataaggcaattggatttgg

SEQ ID NO: 9108993 - DNA, 22 bp, Homo sapiens
ataaggcaagctgtcagtttgt

SEQ ID NO: 9108994 - DNA, 22 bp, Homo sapiens
ataaggcagaaatgattctagt

SEQ ID NO: 9108995 - DNA, 22 bp, Homo sapiens
ataaggcagaaatgattctagt

SEQ ID NO: 9108996 - DNA, 22 bp, Homo sapiens
ataaggcacacatagatagggt

SEQ ID NO: 9108997 - DNA, 22 bp, Homo sapiens
atacaaagacaaatctcaatct

SEQ ID NO: 9108998 - DNA, 22 bp, Homo sapiens
atacaagttgtgataatgtaaa

SEQ ID NO: 9108999 - DNA, 22 bp, Homo sapiens
ataaggcatatagtcacttttt

SEQ ID NO: 9109000 - DNA, 22 bp, Homo sapiens
ataaggcatctctcagttagca

SEQ ID NO: 9109001 - DNA, 22 bp, Homo sapiens
ataaggcagtcccttaacaagg

SEQ ID NO: 9109002 - DNA, 19 bp, Homo sapiens
ataaggcagtgactttttt

SEQ ID NO: 9109003 - DNA, 22 bp, Homo sapiens
ataaggcagtgacttcatctat

SEQ ID NO: 9109004 - DNA, 22 bp, Homo sapiens
atacaatcatcattatattccc

SEQ ID NO: 9109005 - DNA, 22 bp, Homo sapiens
atacaatccagccattgccaca

SEQ ID NO: 9109006 - DNA, 22 bp, Homo sapiens
atacaattattctgcagatatt

SEQ ID NO: 9109007 - DNA, 22 bp, Homo sapiens
atacaatgggtgcaaagatgtg

SEQ ID NO: 9109008 - DNA, 22 bp, Homo sapiens
atacacagctacattgaacaat

SEQ ID NO: 9109009 - DNA, 22 bp, Homo sapiens
atacacagccattatgaattag

SEQ ID NO: 9109010 - DNA, 19 bp, Homo sapiens
atacactaatataaaccac

SEQ ID NO: 9109011 - DNA, 22 bp, Homo sapiens
atacacgtgtgtgtacatgcac

SEQ ID NO: 9109012 - DNA, 22 bp, Homo sapiens
atacacatttgctagagatggg

SEQ ID NO: 9109013 - DNA, 22 bp, Homo sapiens
atacactgagtccttttctcat

SEQ ID NO: 9109014 - DNA, 22 bp, Homo sapiens
atttccatgtccaaaaattagt

SEQ ID NO: 9109015 - DNA, 22 bp, Homo sapiens
atttccattatcatgacaaatt

SEQ ID NO: 9109016 - DNA, 22 bp, Homo sapiens
gcccacagtgtagcaggtactc

SEQ ID NO: 9109017 - DNA, 21 bp, Homo sapiens
gcccacagtgaggaggatccc

SEQ ID NO: 9109018 - DNA, 22 bp, Homo sapiens
gcccacagtctatcagtttgcg

SEQ ID NO: 9109019 - DNA, 22 bp, Homo sapiens
gcccacagttagtttgcatggc

SEQ ID NO: 9109020 - DNA, 22 bp, Homo sapiens
gcccacagttagtttgcatggc

SEQ ID NO: 9109021 - DNA, 22 bp, Homo sapiens
gcccacagttaatgggggctct

SEQ ID NO: 9109022 - DNA, 22 bp, Homo sapiens
gcccccacaggcgggctcgggt

SEQ ID NO: 9109023 - DNA, 17 bp, Homo sapiens
gcccccagaaatctcag

SEQ ID NO: 9109024 - DNA, 22 bp, Homo sapiens
atttctgtatcctgctgtcaga

SEQ ID NO: 9109025 - DNA, 22 bp, Homo sapiens
atttctgtggcttcattctcct

SEQ ID NO: 9109026 - DNA, 22 bp, Homo sapiens
atttctgtggcttcattctcct

SEQ ID NO: 9109027 - DNA, 22 bp, Homo sapiens
atttctgttatacctttctcag

SEQ ID NO: 9109028 - DNA, 22 bp, Homo sapiens
atttctgtagtccacattcttt

SEQ ID NO: 9109029 - DNA, 17 bp, Homo sapiens
gcccacccttaggagct

SEQ ID NO: 9109030 - DNA, 17 bp, Homo sapiens
gcccacccttaggagct

SEQ ID NO: 9109031 - DNA, 22 bp, Homo sapiens
gcccacctaacctgctcacctt

SEQ ID NO: 9109032 - DNA, 22 bp, Homo sapiens
atttctcagtgtacattatgtt

SEQ ID NO: 9109033 - DNA, 22 bp, Homo sapiens
atttctgatacccggtcaccct

SEQ ID NO: 9109034 - DNA, 22 bp, Homo sapiens
atttctgataaacgtaagctgc

SEQ ID NO: 9109035 - DNA, 22 bp, Homo sapiens
gccaggtggaggttgcagtgag

SEQ ID NO: 9109036 - DNA, 22 bp, Homo sapiens
atttcatgttaactgaacagaa

SEQ ID NO: 9109037 - DNA, 22 bp, Homo sapiens
atttcatgttgatctttcgagg

SEQ ID NO: 9109038 - DNA, 22 bp, Homo sapiens
atttcatgtttcatctacctaa

SEQ ID NO: 9109039 - DNA, 22 bp, Homo sapiens
atttccaggctgttttgtgaat

SEQ ID NO: 9109040 - DNA, 22 bp, Homo sapiens
gccaggtgcatggctgagtctc

SEQ ID NO: 9109041 - DNA, 22 bp, Homo sapiens
gccaggtgagaggactgaggct

SEQ ID NO: 9109042 - DNA, 22 bp, Homo sapiens
gccaggctggtgcaaggatatt

SEQ ID NO: 9109043 - DNA, 19 bp, Homo sapiens
gccaggtcttgggtccagg

SEQ ID NO: 9109044 - DNA, 22 bp, Homo sapiens
gccaggctggtgcaaggatatt

SEQ ID NO: 9109045 - DNA, 22 bp, Homo sapiens
gccaggctggtcttgaactcct

SEQ ID NO: 9109046 - DNA, 22 bp, Homo sapiens
gccaggctggggggagatgtct

SEQ ID NO: 9109047 - DNA, 22 bp, Homo sapiens
gccaggctggccagcaccttct

SEQ ID NO: 9109048 - DNA, 22 bp, Homo sapiens
gccaggctggccagcaccttct

SEQ ID NO: 9109049 - DNA, 22 bp, Homo sapiens
gccaggctggcaaaaggaaacc

SEQ ID NO: 9109050 - DNA, 22 bp, Homo sapiens
gccaggctggaaagaacagaca

SEQ ID NO: 9109051 - DNA, 22 bp, Homo sapiens
gccaggctgctggctgctgtcc

SEQ ID NO: 9109052 - DNA, 19 bp, Homo sapiens
gccaggcctggacctgcag

SEQ ID NO: 9109053 - DNA, 22 bp, Homo sapiens
gccacaggtcggctagagggtc

SEQ ID NO: 9109054 - DNA, 22 bp, Homo sapiens
gccacagggcgagcggaggcca

SEQ ID NO: 9109055 - DNA, 22 bp, Homo sapiens
gccacagggcgagcggaggcca

SEQ ID NO: 9109056 - DNA, 22 bp, Homo sapiens
gcctcaaaagtgttgtagaggg

SEQ ID NO: 9109057 - DNA, 19 bp, Homo sapiens
gcctatgtcttcaaatcat

SEQ ID NO: 9109058 - DNA, 22 bp, Homo sapiens
gcctaggtaccagcagagagcc

SEQ ID NO: 9109059 - DNA, 22 bp, Homo sapiens
gcctagtgcactggcagggctc

SEQ ID NO: 9109060 - DNA, 20 bp, Homo sapiens
gcctagggtcacttcagtga

SEQ ID NO: 9109061 - DNA, 18 bp, Homo sapiens
gcctctgttgcttgcctg

SEQ ID NO: 9109062 - DNA, 22 bp, Homo sapiens
gcctctgagtttggagaagagc

SEQ ID NO: 9109063 - DNA, 22 bp, Homo sapiens
gcctgaagaacagctgtgagga

SEQ ID NO: 9109064 - DNA, 22 bp, Homo sapiens
gcctgaagaacagctgtgagga

SEQ ID NO: 9109065 - DNA, 22 bp, Homo sapiens
gcctatggattggagaaggagc

SEQ ID NO: 9109066 - DNA, 22 bp, Homo sapiens
gcctcacagactgactgaaagc

SEQ ID NO: 9109067 - DNA, 20 bp, Homo sapiens
gcctagggtcacttcagtga

SEQ ID NO: 9109068 - DNA, 22 bp, Homo sapiens
gcctaggagacaagcgtgaaag

SEQ ID NO: 9109069 - DNA, 22 bp, Homo sapiens
gcctaggagtggggatggcggt

SEQ ID NO: 9109070 - DNA, 22 bp, Homo sapiens
gcctaggagtacagaatggttt

SEQ ID NO: 9109071 - DNA, 22 bp, Homo sapiens
atttggaaaagcggtaacttgc

SEQ ID NO: 9109072 - DNA, 22 bp, Homo sapiens
gccccctctttggagccagcca

SEQ ID NO: 9109073 - DNA, 22 bp, Homo sapiens
gccccctctttggagccagcca

SEQ ID NO: 9109074 - DNA, 22 bp, Homo sapiens
atttgccttttaaactcacaat

SEQ ID NO: 9109075 - DNA, 22 bp, Homo sapiens
atttgctagtggaattttcctg

SEQ ID NO: 9109076 - DNA, 22 bp, Homo sapiens
gcccccagaagggccacagatt

SEQ ID NO: 9109077 - DNA, 22 bp, Homo sapiens
gcccccagagaatgaggtacga

SEQ ID NO: 9109078 - DNA, 22 bp, Homo sapiens
gcccccagagaatgaggtacga

SEQ ID NO: 9109079 - DNA, 18 bp, Homo sapiens
gcccccagatgctactga

SEQ ID NO: 9109080 - DNA, 22 bp, Homo sapiens
gcccccagacctcagtgggctg

SEQ ID NO: 9109081 - DNA, 22 bp, Homo sapiens
gcccccagagaatgaggtacga

SEQ ID NO: 9109082 - DNA, 22 bp, Homo sapiens
gcccccaggcactacatgtgaa

SEQ ID NO: 9109083 - DNA, 22 bp, Homo sapiens
gcccccaggctctggagaacct

SEQ ID NO: 9109084 - DNA, 22 bp, Homo sapiens
gcccccagctctcaagctcaaa

SEQ ID NO: 9109085 - DNA, 22 bp, Homo sapiens
gccccctcaaagaggaagctct

SEQ ID NO: 9109086 - DNA, 22 bp, Homo sapiens
gcccccaggtgacttatccaca

SEQ ID NO: 9109087 - DNA, 22 bp, Homo sapiens
gcctggagttgtggtgaagcca

SEQ ID NO: 9109088 - DNA, 22 bp, Homo sapiens
gcctggagttgtggtgaagcca

SEQ ID NO: 9109089 - DNA, 22 bp, Homo sapiens
gcctggattccttgtttctcag

SEQ ID NO: 9109090 - DNA, 22 bp, Homo sapiens
gcctggaggaatgtagctgagg

SEQ ID NO: 9109091 - DNA, 22 bp, Homo sapiens
gcctggaggaatgtagctgagg

SEQ ID NO: 9109092 - DNA, 22 bp, Homo sapiens
attttacttagtgtaatgtcca

SEQ ID NO: 9109093 - DNA, 22 bp, Homo sapiens
attttactactccaattaatga

SEQ ID NO: 9109094 - DNA, 22 bp, Homo sapiens
gcctggcacattgcagtggatt

SEQ ID NO: 9109095 - DNA, 22 bp, Homo sapiens
attttactactccaattaatga

SEQ ID NO: 9109096 - DNA, 22 bp, Homo sapiens
gcctggcaaggccctgttgact

SEQ ID NO: 9109097 - DNA, 22 bp, Homo sapiens
gcctgagatcagccaagcccct

SEQ ID NO: 9109098 - DNA, 22 bp, Homo sapiens
gcctgagattcccggagccgtg

SEQ ID NO: 9109099 - DNA, 22 bp, Homo sapiens
gcctgagattcccggagccgtg

SEQ ID NO: 9109100 - DNA, 22 bp, Homo sapiens
gcctgagagtctccagaccttg

SEQ ID NO: 9109101 - DNA, 22 bp, Homo sapiens
gcctgagagtctccagaccttg

SEQ ID NO: 9109102 - DNA, 22 bp, Homo sapiens
gcctgagagttgaagttcagtg

SEQ ID NO: 9109103 - DNA, 22 bp, Homo sapiens
gcctgagatcagccaagcccct

SEQ ID NO: 9109104 - DNA, 22 bp, Homo sapiens
gcctgagatcaggagaaagcca

SEQ ID NO: 9109105 - DNA, 22 bp, Homo sapiens
gcctgagatcaggagaaagcca

SEQ ID NO: 9109106 - DNA, 22 bp, Homo sapiens
gcctgagacagtgtggtccaat

SEQ ID NO: 9109107 - DNA, 22 bp, Homo sapiens
gcctgagagaactgaccaagag

SEQ ID NO: 9109108 - DNA, 22 bp, Homo sapiens
gcctgagaaggacacagcaggt

SEQ ID NO: 9109109 - DNA, 22 bp, Homo sapiens
gcctgagaaggataggaagcga

SEQ ID NO: 9109110 - DNA, 22 bp, Homo sapiens
gcctgagaaggataggaagcga

SEQ ID NO: 9109111 - DNA, 22 bp, Homo sapiens
gcctgacttgtgtattttacat

SEQ ID NO: 9109112 - DNA, 22 bp, Homo sapiens
gcctgaagtttcatgcctctat

SEQ ID NO: 9109113 - DNA, 22 bp, Homo sapiens
caaatagaactcacagacaaga

SEQ ID NO: 9109114 - DNA, 22 bp, Homo sapiens
caaatactttatatacttcaaa

SEQ ID NO: 9109115 - DNA, 22 bp, Homo sapiens
caaatactttatatacttcaaa

SEQ ID NO: 9109116 - DNA, 22 bp, Homo sapiens
caaatactgagcacgcaatcaa

SEQ ID NO: 9109117 - DNA, 22 bp, Homo sapiens
caaatactgagtttattttcaa

SEQ ID NO: 9109118 - DNA, 22 bp, Homo sapiens
caaatactgtactgaacactgt

SEQ ID NO: 9109119 - DNA, 22 bp, Homo sapiens
caaaggaagctccttgatggcg

SEQ ID NO: 9109120 - DNA, 22 bp, Homo sapiens
caaaggaggtaatgggtgtgag

SEQ ID NO: 9109121 - DNA, 21 bp, Homo sapiens
caaaggactgtagctcactga

SEQ ID NO: 9109122 - DNA, 22 bp, Homo sapiens
caaaggaggtgataggccctct

SEQ ID NO: 9109123 - DNA, 22 bp, Homo sapiens
caaagtgctggaattacaggtg

SEQ ID NO: 9109124 - DNA, 22 bp, Homo sapiens
caaagtgctggaattacaggtg

SEQ ID NO: 9109125 - DNA, 22 bp, Homo sapiens
caaagtgctgggattacaggct

SEQ ID NO: 9109126 - DNA, 22 bp, Homo sapiens
caaatacaaatacgggcagctt

SEQ ID NO: 9109127 - DNA, 22 bp, Homo sapiens
caaatacaaatacgggcagctt

SEQ ID NO: 9109128 - DNA, 22 bp, Homo sapiens
caaatactacgattcttgcagt

SEQ ID NO: 9109129 - DNA, 18 bp, Homo sapiens
caaagctcacgttccatc

SEQ ID NO: 9109130 - DNA, 22 bp, Homo sapiens
caaagctataaattcagacaga

SEQ ID NO: 9109131 - DNA, 22 bp, Homo sapiens
caaagccctggaaagatgaaga

SEQ ID NO: 9109132 - DNA, 22 bp, Homo sapiens
caaagcctctgatttcacttgt

SEQ ID NO: 9109133 - DNA, 22 bp, Homo sapiens
caaagctcatgctcttagccat

SEQ ID NO: 9109134 - DNA, 22 bp, Homo sapiens
caaagctgatactcagcaagta

SEQ ID NO: 9109135 - DNA, 22 bp, Homo sapiens
caaagctgatactcagcaagta

SEQ ID NO: 9109136 - DNA, 22 bp, Homo sapiens
caaagctgatactcagcaagta

SEQ ID NO: 9109137 - DNA, 22 bp, Homo sapiens
caaagctgacgaggtcagcatc

SEQ ID NO: 9109138 - DNA, 22 bp, Homo sapiens
caaaggaaatactaatctggaa

SEQ ID NO: 9109139 - DNA, 22 bp, Homo sapiens
caaagctgtgaattcctacaaa

SEQ ID NO: 9109140 - DNA, 22 bp, Homo sapiens
caaaggaaatactaatctggaa

SEQ ID NO: 9109141 - DNA, 22 bp, Homo sapiens
caaatgctaacttctttccaaa

SEQ ID NO: 9109142 - DNA, 22 bp, Homo sapiens
caaatgctaacttctttccaaa

SEQ ID NO: 9109143 - DNA, 22 bp, Homo sapiens
caaatgcatgagaaataagagg

SEQ ID NO: 9109144 - DNA, 22 bp, Homo sapiens
caaatgcatgagaaataagagg

SEQ ID NO: 9109145 - DNA, 22 bp, Homo sapiens
caaatgcatgagaaataagagg

SEQ ID NO: 9109146 - DNA, 22 bp, Homo sapiens
caaatgctggccctgctactta

SEQ ID NO: 9109147 - DNA, 21 bp, Homo sapiens
caaatgctggctggatgagga

SEQ ID NO: 9109148 - DNA, 22 bp, Homo sapiens
caaatgctatgattttgagttt

SEQ ID NO: 9109149 - DNA, 22 bp, Homo sapiens
caaatgctggccctgctactta

SEQ ID NO: 9109150 - DNA, 22 bp, Homo sapiens
caaatgctatgattttgagttt

SEQ ID NO: 9109151 - DNA, 20 bp, Homo sapiens
gctgacccctgctgtcatgc

SEQ ID NO: 9109152 - DNA, 20 bp, Homo sapiens
gctgacccctgctgtcatgc

SEQ ID NO: 9109153 - DNA, 22 bp, Homo sapiens
gctgactcagatgcagctggat

SEQ ID NO: 9109154 - DNA, 22 bp, Homo sapiens
gctgactggttgcacagagggt

SEQ ID NO: 9109155 - DNA, 22 bp, Homo sapiens
gctgactgctcagggccagctg

SEQ ID NO: 9109156 - DNA, 22 bp, Homo sapiens
gctgactgatggacacagcacc

SEQ ID NO: 9109157 - DNA, 23 bp, Homo sapiens
gctgactgtgaaattctggagct

SEQ ID NO: 9109158 - DNA, 20 bp, Homo sapiens
gctgactgtttgggtggcgg

SEQ ID NO: 9109159 - DNA, 22 bp, Homo sapiens
caaatgcatagtttataagaag

SEQ ID NO: 9109160 - DNA, 22 bp, Homo sapiens
caaatgcatagtttataagaag

SEQ ID NO: 9109161 - DNA, 18 bp, Homo sapiens
gctctggttccttcaacc

SEQ ID NO: 9109162 - DNA, 22 bp, Homo sapiens
gctctttgcacagctctgccct

SEQ ID NO: 9109163 - DNA, 22 bp, Homo sapiens
gctgacccctacaggttgtgtt

SEQ ID NO: 9109164 - DNA, 22 bp, Homo sapiens
gctgaaaggggtgacattcttt

SEQ ID NO: 9109165 - DNA, 20 bp, Homo sapiens
gctctttgtaagggaatttg

SEQ ID NO: 9109166 - DNA, 22 bp, Homo sapiens
gctctttggattcctttacaaa

SEQ ID NO: 9109167 - DNA, 23 bp, Homo sapiens
gctctttgttcatgtggatgcct

SEQ ID NO: 9109168 - DNA, 22 bp, Homo sapiens
gctctttgtattttggaatcaa

SEQ ID NO: 9109169 - DNA, 22 bp, Homo sapiens
attttgtttcctttggagtaga

SEQ ID NO: 9109170 - DNA, 23 bp, Homo sapiens
atttttagcctctctgagctgag

SEQ ID NO: 9109171 - DNA, 22 bp, Homo sapiens
attttgctttatgtaaatatgt

SEQ ID NO: 9109172 - DNA, 22 bp, Homo sapiens
atttttatgacaaaccatcctc

SEQ ID NO: 9109173 - DNA, 22 bp, Homo sapiens
atttttatgacaaaccatcctc

SEQ ID NO: 9109174 - DNA, 22 bp, Homo sapiens
atttttccatgatacttatctg

SEQ ID NO: 9109175 - DNA, 22 bp, Homo sapiens
atttttccaattaggataaaga

SEQ ID NO: 9109176 - DNA, 22 bp, Homo sapiens
atttttcaactttggaaatggc

SEQ ID NO: 9109177 - DNA, 22 bp, Homo sapiens
attttactttgtgaatattgac

SEQ ID NO: 9109178 - DNA, 22 bp, Homo sapiens
attttagagaaacaaacgtagg

SEQ ID NO: 9109179 - DNA, 22 bp, Homo sapiens
attttacttagtgtaatgtcca

SEQ ID NO: 9109180 - DNA, 22 bp, Homo sapiens
attttacttagtgtaatgtcca

SEQ ID NO: 9109181 - DNA, 22 bp, Homo sapiens
attttactttgtgaatattgac

SEQ ID NO: 9109182 - DNA, 22 bp, Homo sapiens
caaaagcagttctatctgagtt

SEQ ID NO: 9109183 - DNA, 22 bp, Homo sapiens
caaaagcagttctatctgagtt

SEQ ID NO: 9109184 - DNA, 22 bp, Homo sapiens
caaaagcagttctatctgagtt

SEQ ID NO: 9109185 - DNA, 22 bp, Homo sapiens
atttttgccctgcagtacataa

SEQ ID NO: 9109186 - DNA, 22 bp, Homo sapiens
atttttctctttccactgagat

SEQ ID NO: 9109187 - DNA, 22 bp, Homo sapiens
atttttctctttccactgagat

SEQ ID NO: 9109188 - DNA, 22 bp, Homo sapiens
atttttgagctgtgaacatagc

SEQ ID NO: 9109189 - DNA, 22 bp, Homo sapiens
atttttctctcacacttaccag

SEQ ID NO: 9109190 - DNA, 22 bp, Homo sapiens
atttttctctccactccattaa

SEQ ID NO: 9109191 - DNA, 22 bp, Homo sapiens
atttttctctccactccattaa

SEQ ID NO: 9109192 - DNA, 22 bp, Homo sapiens
atttttctctccactccattaa

SEQ ID NO: 9109193 - DNA, 22 bp, Homo sapiens
caaacatctgcaccttgaccgg

SEQ ID NO: 9109194 - DNA, 22 bp, Homo sapiens
caaacattcaagtacaagtctt

SEQ ID NO: 9109195 - DNA, 22 bp, Homo sapiens
caaacatagtgaagcaatgaca

SEQ ID NO: 9109196 - DNA, 22 bp, Homo sapiens
caaaattctgcatttctaataa

SEQ ID NO: 9109197 - DNA, 22 bp, Homo sapiens
caaacaatttgcatttccttag

SEQ ID NO: 9109198 - DNA, 22 bp, Homo sapiens
caaaattagggagtgagctgga

SEQ ID NO: 9109199 - DNA, 22 bp, Homo sapiens
caaaattagaaatgcagctgtt

SEQ ID NO: 9109200 - DNA, 22 bp, Homo sapiens
caaaattagggagtgagctgga

SEQ ID NO: 9109201 - DNA, 22 bp, Homo sapiens
caaaattctgcatttctaataa

SEQ ID NO: 9109202 - DNA, 22 bp, Homo sapiens
caaaattctgcatttctaataa

SEQ ID NO: 9109203 - DNA, 22 bp, Homo sapiens
caaaattctgcatttctaataa

SEQ ID NO: 9109204 - DNA, 22 bp, Homo sapiens
caaaattagggagtgagctgga

SEQ ID NO: 9109205 - DNA, 22 bp, Homo sapiens
caaaatgatgtgattttattgt

SEQ ID NO: 9109206 - DNA, 22 bp, Homo sapiens
caaaatgatgtgattttattgt

SEQ ID NO: 9109207 - DNA, 22 bp, Homo sapiens
caaaatgcatctgagaccaggc

SEQ ID NO: 9109208 - DNA, 22 bp, Homo sapiens
caaaatagatgttaacctggaa

SEQ ID NO: 9109209 - DNA, 22 bp, Homo sapiens
caaaataccacgacttgtttta

SEQ ID NO: 9109210 - DNA, 22 bp, Homo sapiens
caaaattagaaatgcagctgtt

SEQ ID NO: 9109211 - DNA, 22 bp, Homo sapiens
caaaattagaaatgcagctgtt

SEQ ID NO: 9109212 - DNA, 22 bp, Homo sapiens
caaaatgtgagtcccacctcaa

SEQ ID NO: 9109213 - DNA, 22 bp, Homo sapiens
caaaatgttctggcacctttaa

SEQ ID NO: 9109214 - DNA, 18 bp, Homo sapiens
caaagcaggtgacagtgt

SEQ ID NO: 9109215 - DNA, 18 bp, Homo sapiens
caaagcaggtgacagtgt

SEQ ID NO: 9109216 - DNA, 22 bp, Homo sapiens
caaagcaggcttgtcaaattgc

SEQ ID NO: 9109217 - DNA, 22 bp, Homo sapiens
caaagcagtgatccttaaagga

SEQ ID NO: 9109218 - DNA, 22 bp, Homo sapiens
caaagccaggctttctaatgta

SEQ ID NO: 9109219 - DNA, 22 bp, Homo sapiens
caaacattcagatgcaatggta

SEQ ID NO: 9109220 - DNA, 22 bp, Homo sapiens
caaacattcaagtacaagtctt

SEQ ID NO: 9109221 - DNA, 22 bp, Homo sapiens
caaacattcaagtacaagtctt

SEQ ID NO: 9109222 - DNA, 22 bp, Homo sapiens
caaagaggttttgagggcagct

SEQ ID NO: 9109223 - DNA, 22 bp, Homo sapiens
caaacattccgcttctcccagg

SEQ ID NO: 9109224 - DNA, 22 bp, Homo sapiens
caaagaggttttgagggcagct

SEQ ID NO: 9109225 - DNA, 22 bp, Homo sapiens
caaagcaggaagaatattgaaa

SEQ ID NO: 9109226 - DNA, 22 bp, Homo sapiens
caaagcaggaagaatattgaaa

SEQ ID NO: 9109227 - DNA, 22 bp, Homo sapiens
caaagcagagccagagcttgtc

SEQ ID NO: 9109228 - DNA, 22 bp, Homo sapiens
attgataaattgcaatggggct

SEQ ID NO: 9109229 - DNA, 22 bp, Homo sapiens
attgactttcccttctcctcat

SEQ ID NO: 9109230 - DNA, 22 bp, Homo sapiens
gcaggcctttatccctgcctca

SEQ ID NO: 9109231 - DNA, 22 bp, Homo sapiens
gcaggcctttatccctgcctca

SEQ ID NO: 9109232 - DNA, 22 bp, Homo sapiens
attgatgtgccgaaatagaggc

SEQ ID NO: 9109233 - DNA, 22 bp, Homo sapiens
attgatgtgtcacaagagattt

SEQ ID NO: 9109234 - DNA, 22 bp, Homo sapiens
gcaggcctgtcttgctcgccct

SEQ ID NO: 9109235 - DNA, 22 bp, Homo sapiens
gcaggcctgtaatgaagggaca

SEQ ID NO: 9109236 - DNA, 22 bp, Homo sapiens
gcaggcctggtttacatggtag

SEQ ID NO: 9109237 - DNA, 22 bp, Homo sapiens
gcaggccttggcaatgagcctg

SEQ ID NO: 9109238 - DNA, 22 bp, Homo sapiens
gcaggcctgtcttgctcgccct

SEQ ID NO: 9109239 - DNA, 22 bp, Homo sapiens
gcaggccttggcaatgagcctg

SEQ ID NO: 9109240 - DNA, 22 bp, Homo sapiens
gcaggcctgcaggtatggccgg

SEQ ID NO: 9109241 - DNA, 22 bp, Homo sapiens
gcaggcctgcaggtatggccgg

SEQ ID NO: 9109242 - DNA, 19 bp, Homo sapiens
gcaggcctcttgggaatta

SEQ ID NO: 9109243 - DNA, 22 bp, Homo sapiens
gcaggcctgactgtagggggca

SEQ ID NO: 9109244 - DNA, 22 bp, Homo sapiens
gcaggcctgactgtagggggca

SEQ ID NO: 9109245 - DNA, 22 bp, Homo sapiens
gcaggcctgcccagcaggatgg

SEQ ID NO: 9109246 - DNA, 19 bp, Homo sapiens
gcaggcctcttgggaatta

SEQ ID NO: 9109247 - DNA, 22 bp, Homo sapiens
gcaggcctgggagtcatcttgt

SEQ ID NO: 9109248 - DNA, 22 bp, Homo sapiens
gcagggctgctgaaacttgttt

SEQ ID NO: 9109249 - DNA, 22 bp, Homo sapiens
gcagggctgcagagggcactgt

SEQ ID NO: 9109250 - DNA, 22 bp, Homo sapiens
attgcaaaattgtcctgtggaa

SEQ ID NO: 9109251 - DNA, 22 bp, Homo sapiens
attgcaaaattgtcctgtggaa

SEQ ID NO: 9109252 - DNA, 22 bp, Homo sapiens
attgcaaagaaatacatgctta

SEQ ID NO: 9109253 - DNA, 22 bp, Homo sapiens
gcagcgctactcacagctctga

SEQ ID NO: 9109254 - DNA, 22 bp, Homo sapiens
gcagctgccttcagctggatgg

SEQ ID NO: 9109255 - DNA, 22 bp, Homo sapiens
gcagctgcctattcagggcttg

SEQ ID NO: 9109256 - DNA, 22 bp, Homo sapiens
gcagctgctcccttttacagtg

SEQ ID NO: 9109257 - DNA, 22 bp, Homo sapiens
gcagctgctggaagttcctgcc

SEQ ID NO: 9109258 - DNA, 22 bp, Homo sapiens
gcagctgctggagggaggcagg

SEQ ID NO: 9109259 - DNA, 22 bp, Homo sapiens
gcagctgctgtggcatcaagct

SEQ ID NO: 9109260 - DNA, 22 bp, Homo sapiens
gcagctgctgtggcatcaagct

SEQ ID NO: 9109261 - DNA, 22 bp, Homo sapiens
gcagctggaagtgacactctgt

SEQ ID NO: 9109262 - DNA, 22 bp, Homo sapiens
gcagctggaagtgacactctgt

SEQ ID NO: 9109263 - DNA, 22 bp, Homo sapiens
attccttggaacagatgcgaag

SEQ ID NO: 9109264 - DNA, 22 bp, Homo sapiens
attccttgctctcatcaacctt

SEQ ID NO: 9109265 - DNA, 22 bp, Homo sapiens
attccttgcacatcagatagtt

SEQ ID NO: 9109266 - DNA, 22 bp, Homo sapiens
gcagctggacccacacggctta

SEQ ID NO: 9109267 - DNA, 22 bp, Homo sapiens
gcagctggacccacacggctta

SEQ ID NO: 9109268 - DNA, 19 bp, Homo sapiens
attcttgttaagtgtcatc

SEQ ID NO: 9109269 - DNA, 22 bp, Homo sapiens
attcttgtttaatttgcatccc

SEQ ID NO: 9109270 - DNA, 22 bp, Homo sapiens
attctttaattcaattgaagga

SEQ ID NO: 9109271 - DNA, 22 bp, Homo sapiens
attctttaattcaattgaagga

SEQ ID NO: 9109272 - DNA, 22 bp, Homo sapiens
attctttacattggcttcttcc

SEQ ID NO: 9109273 - DNA, 22 bp, Homo sapiens
attctttattgctgatggttat

SEQ ID NO: 9109274 - DNA, 22 bp, Homo sapiens
attctttcaaggaatagttatt

SEQ ID NO: 9109275 - DNA, 22 bp, Homo sapiens
attctttagttggcttcttgcc

SEQ ID NO: 9109276 - DNA, 22 bp, Homo sapiens
attctttattgctgatggttat

SEQ ID NO: 9109277 - DNA, 22 bp, Homo sapiens
attctttagccagcaggtatat

SEQ ID NO: 9109278 - DNA, 19 bp, Homo sapiens
attcttcagcagtgagacc

SEQ ID NO: 9109279 - DNA, 22 bp, Homo sapiens
attccttgtatatctacatgca

SEQ ID NO: 9109280 - DNA, 22 bp, Homo sapiens
attccttgggaattattgaatg

SEQ ID NO: 9109281 - DNA, 22 bp, Homo sapiens
attccttgggctgccttattat

SEQ ID NO: 9109282 - DNA, 22 bp, Homo sapiens
attccttggcattctggacttg

SEQ ID NO: 9109283 - DNA, 22 bp, Homo sapiens
attccttgggaattattgaatg

SEQ ID NO: 9109284 - DNA, 22 bp, Homo sapiens
attcttcagtatgtgtggattg

SEQ ID NO: 9109285 - DNA, 22 bp, Homo sapiens
gccaagagaatgtgagagaaat

SEQ ID NO: 9109286 - DNA, 21 bp, Homo sapiens
gccaagaacaagacagacatg

SEQ ID NO: 9109287 - DNA, 22 bp, Homo sapiens
gccaagagaatgtgagagaaat

SEQ ID NO: 9109288 - DNA, 22 bp, Homo sapiens
gccacagggcagatgcgcagag

SEQ ID NO: 9109289 - DNA, 22 bp, Homo sapiens
gccaacaggccttgctctgctc

SEQ ID NO: 9109290 - DNA, 22 bp, Homo sapiens
gccaacaggccttgctctgctc

SEQ ID NO: 9109291 - DNA, 22 bp, Homo sapiens
gccaacagctgggtgcatgtcc

SEQ ID NO: 9109292 - DNA, 22 bp, Homo sapiens
gccaaaggacctgtgggtgaca

SEQ ID NO: 9109293 - DNA, 17 bp, Homo sapiens
gccaaagggttccaatc

SEQ ID NO: 9109294 - DNA, 22 bp, Homo sapiens
gccaaaggcccttctgaaggca

SEQ ID NO: 9109295 - DNA, 22 bp, Homo sapiens
gccaaaggattctatggagata

SEQ ID NO: 9109296 - DNA, 22 bp, Homo sapiens
attgtgaattgagagtacttct

SEQ ID NO: 9109297 - DNA, 22 bp, Homo sapiens
attgtgaatagtgccgcagtaa

SEQ ID NO: 9109298 - DNA, 22 bp, Homo sapiens
attgtgaatagtgccgcagtaa

SEQ ID NO: 9109299 - DNA, 22 bp, Homo sapiens
attgtgaatagtgccgcagtaa

SEQ ID NO: 9109300 - DNA, 22 bp, Homo sapiens
attgtgattagagaatatagag

SEQ ID NO: 9109301 - DNA, 22 bp, Homo sapiens
gccaaagcagtcttgcctctgc

SEQ ID NO: 9109302 - DNA, 22 bp, Homo sapiens
gccaaagcccaggagacagcca

SEQ ID NO: 9109303 - DNA, 22 bp, Homo sapiens
attgtcttctgtcttatagttc

SEQ ID NO: 9109304 - DNA, 22 bp, Homo sapiens
attgtctgtactttaaaaatgt

SEQ ID NO: 9109305 - DNA, 22 bp, Homo sapiens
attgtcttctggtcttatcttt

SEQ ID NO: 9109306 - DNA, 22 bp, Homo sapiens
attgtcttaaacaaatgtgttt

SEQ ID NO: 9109307 - DNA, 22 bp, Homo sapiens
attgtctttaaaaatatacaac

SEQ ID NO: 9109308 - DNA, 22 bp, Homo sapiens
attgtctttggtgcttccagga

SEQ ID NO: 9109309 - DNA, 22 bp, Homo sapiens
gcatacagagaggatgtggcat

SEQ ID NO: 9109310 - DNA, 22 bp, Homo sapiens
gcatacagtccttgtattcttc

SEQ ID NO: 9109311 - DNA, 18 bp, Homo sapiens
gcatacagaggggaagta

SEQ ID NO: 9109312 - DNA, 22 bp, Homo sapiens
gcagtgtgtggtgagggctgcc

SEQ ID NO: 9109313 - DNA, 22 bp, Homo sapiens
gcagtgtgtttctgagatatgg

SEQ ID NO: 9109314 - DNA, 22 bp, Homo sapiens
gcagtgtgtagagtttaggaaa

SEQ ID NO: 9109315 - DNA, 22 bp, Homo sapiens
gcagtgtgcatggcttttggcc

SEQ ID NO: 9109316 - DNA, 22 bp, Homo sapiens
gcagtgtgtctcttggcttcct

SEQ ID NO: 9109317 - DNA, 22 bp, Homo sapiens
gcagtgtgaccgagcttgcttc

SEQ ID NO: 9109318 - DNA, 22 bp, Homo sapiens
gcagtgtgatgcttccagccac

SEQ ID NO: 9109319 - DNA, 23 bp, Homo sapiens
gcagtgtgaatccagtgtttcag

SEQ ID NO: 9109320 - DNA, 22 bp, Homo sapiens
gcagtgtgaccgagcttgcttc

SEQ ID NO: 9109321 - DNA, 22 bp, Homo sapiens
gcagtgctttagtctgtccttt

SEQ ID NO: 9109322 - DNA, 22 bp, Homo sapiens
gcagtgcttgctcaggcttcat

SEQ ID NO: 9109323 - DNA, 20 bp, Homo sapiens
gcagtgctggtgcctctgct

SEQ ID NO: 9109324 - DNA, 18 bp, Homo sapiens
attgtcagaagtcatgtg

SEQ ID NO: 9109325 - DNA, 22 bp, Homo sapiens
attgtatttgtacaagacatgt

SEQ ID NO: 9109326 - DNA, 22 bp, Homo sapiens
attgtcagctcgaaatgcatca

SEQ ID NO: 9109327 - DNA, 22 bp, Homo sapiens
attgtcagtttaatatagtcaa

SEQ ID NO: 9109328 - DNA, 22 bp, Homo sapiens
attgtcattccagtcattgtta

SEQ ID NO: 9109329 - DNA, 22 bp, Homo sapiens
attgtcattggcttctatgtct

SEQ ID NO: 9109330 - DNA, 22 bp, Homo sapiens
gcatcaagacgatgtgaaatcg

SEQ ID NO: 9109331 - DNA, 22 bp, Homo sapiens
gcatattttcacaagctcttgg

SEQ ID NO: 9109332 - DNA, 22 bp, Homo sapiens
gcatcagaatcatccggggaat

SEQ ID NO: 9109333 - DNA, 22 bp, Homo sapiens
gcatatgatcacgtgtgtcggt

SEQ ID NO: 9109334 - DNA, 22 bp, Homo sapiens
gcatatcatgacttctatctta

SEQ ID NO: 9109335 - DNA, 22 bp, Homo sapiens
gcatattttcacaagctcttgg

SEQ ID NO: 9109336 - DNA, 22 bp, Homo sapiens
gcatatgatcacgtgtgtcggt

SEQ ID NO: 9109337 - DNA, 22 bp, Homo sapiens
attcagaagctattcttagttc

SEQ ID NO: 9109338 - DNA, 22 bp, Homo sapiens
attcagaagcaatcacagtgag

SEQ ID NO: 9109339 - DNA, 20 bp, Homo sapiens
attcagaataggcatgtaaa

SEQ ID NO: 9109340 - DNA, 22 bp, Homo sapiens
attcagaagcaatcacagtgag

SEQ ID NO: 9109341 - DNA, 22 bp, Homo sapiens
attcagaatggcaaacttctag

SEQ ID NO: 9109342 - DNA, 20 bp, Homo sapiens
attcagaataggcatgtaaa

SEQ ID NO: 9109343 - DNA, 22 bp, Homo sapiens
attcagaattgtgggcagtaca

SEQ ID NO: 9109344 - DNA, 22 bp, Homo sapiens
attcagaatggcaaacttctag

SEQ ID NO: 9109345 - DNA, 22 bp, Homo sapiens
gcagatgctgtggtgatagaag

SEQ ID NO: 9109346 - DNA, 22 bp, Homo sapiens
gcagatgcttggcactgacagt

SEQ ID NO: 9109347 - DNA, 22 bp, Homo sapiens
attcagactcttgagcagtccc

SEQ ID NO: 9109348 - DNA, 22 bp, Homo sapiens
attcagactatgaacacgtcag

SEQ ID NO: 9109349 - DNA, 23 bp, Homo sapiens
attcagaattgtgtgtttgtata

SEQ ID NO: 9109350 - DNA, 22 bp, Homo sapiens
attcagaattttggggagctaa

SEQ ID NO: 9109351 - DNA, 22 bp, Homo sapiens
attcagaattgtgggcagtaca

SEQ ID NO: 9109352 - DNA, 22 bp, Homo sapiens
gcagcagagaccccaggaagga

SEQ ID NO: 9109353 - DNA, 22 bp, Homo sapiens
gcagcagaggccctactctttg

SEQ ID NO: 9109354 - DNA, 22 bp, Homo sapiens
gcagcagagtttgggagatggt

SEQ ID NO: 9109355 - DNA, 22 bp, Homo sapiens
attcataagtaaatgattacct

SEQ ID NO: 9109356 - DNA, 22 bp, Homo sapiens
attcatacaggctttgctctta

SEQ ID NO: 9109357 - DNA, 22 bp, Homo sapiens
attcataacggcaaatgtcacc

SEQ ID NO: 9109358 - DNA, 22 bp, Homo sapiens
attcataacggcaaatgtcacc

SEQ ID NO: 9109359 - DNA, 22 bp, Homo sapiens
attcacaatagcagcttgcatg

SEQ ID NO: 9109360 - DNA, 22 bp, Homo sapiens
attcacaatagcagcttgcatg

SEQ ID NO: 9109361 - DNA, 22 bp, Homo sapiens
attcacaatgatacataagcga

SEQ ID NO: 9109362 - DNA, 22 bp, Homo sapiens
attcacaatgatacataagcga

SEQ ID NO: 9109363 - DNA, 22 bp, Homo sapiens
gcacggctaatttttgtatttt

SEQ ID NO: 9109364 - DNA, 22 bp, Homo sapiens
gcacggctaatttttgtatttt

SEQ ID NO: 9109365 - DNA, 22 bp, Homo sapiens
gcacggcaagacggggcctcct

SEQ ID NO: 9109366 - DNA, 22 bp, Homo sapiens
attcaaggtttattcagtttag

SEQ ID NO: 9109367 - DNA, 22 bp, Homo sapiens
attcaaggtttattcagtttag

SEQ ID NO: 9109368 - DNA, 22 bp, Homo sapiens
attcaaggttggctcaggaatt

SEQ ID NO: 9109369 - DNA, 22 bp, Homo sapiens
attcaaggtatttaaaacataa

SEQ ID NO: 9109370 - DNA, 22 bp, Homo sapiens
attcaagattaattctatgtca

SEQ ID NO: 9109371 - DNA, 22 bp, Homo sapiens
attcaagagctggctttgaaat

SEQ ID NO: 9109372 - DNA, 22 bp, Homo sapiens
attcaagagctggctttgaaat

SEQ ID NO: 9109373 - DNA, 22 bp, Homo sapiens
attcaagagctggctttgaaat

SEQ ID NO: 9109374 - DNA, 22 bp, Homo sapiens
attcaagaggaacaatgaagat

SEQ ID NO: 9109375 - DNA, 22 bp, Homo sapiens
attcaagaggaacaatgaagat

SEQ ID NO: 9109376 - DNA, 22 bp, Homo sapiens
attcacatgcccaagcagcacc

SEQ ID NO: 9109377 - DNA, 22 bp, Homo sapiens
attcactggcagacagaactca

SEQ ID NO: 9109378 - DNA, 22 bp, Homo sapiens
attcacctgttagtaaaaatct

SEQ ID NO: 9109379 - DNA, 22 bp, Homo sapiens
attcagaaactctgggcagaac

SEQ ID NO: 9109380 - DNA, 22 bp, Homo sapiens
attcactgtgggtcctttggat

SEQ ID NO: 9109381 - DNA, 22 bp, Homo sapiens
attcagaaatagaaaatttgat

SEQ ID NO: 9109382 - DNA, 22 bp, Homo sapiens
attcagaaagttgtcatatttg

SEQ ID NO: 9109383 - DNA, 22 bp, Homo sapiens
attcagaaagggttgcctggtt

SEQ ID NO: 9109384 - DNA, 22 bp, Homo sapiens
attcagaaagatatgcctggtt

SEQ ID NO: 9109385 - DNA, 22 bp, Homo sapiens
attcagaaagcaagtgctgggt

SEQ ID NO: 9109386 - DNA, 21 bp, Homo sapiens
attcagaaagggaataaactc

SEQ ID NO: 9109387 - DNA, 21 bp, Homo sapiens
attcagaaagggaataaactc

SEQ ID NO: 9109388 - DNA, 22 bp, Homo sapiens
gatttctctgcacccactcagg

SEQ ID NO: 9109389 - DNA, 22 bp, Homo sapiens
gatttctagttcattatctatt

SEQ ID NO: 9109390 - DNA, 22 bp, Homo sapiens
gatttctagtaagtcatgaagg

SEQ ID NO: 9109391 - DNA, 22 bp, Homo sapiens
gatttctacttgaacttgctaa

SEQ ID NO: 9109392 - DNA, 22 bp, Homo sapiens
gatttctaaggaggctgaactt

SEQ ID NO: 9109393 - DNA, 22 bp, Homo sapiens
gatttctaagttttaccacaaa

SEQ ID NO: 9109394 - DNA, 22 bp, Homo sapiens
gatttctaagttttaccacaaa

SEQ ID NO: 9109395 - DNA, 22 bp, Homo sapiens
gatttctacttgaacttgctaa

SEQ ID NO: 9109396 - DNA, 19 bp, Homo sapiens
gatttctacaaatgtcaga

SEQ ID NO: 9109397 - DNA, 17 bp, Homo sapiens
gatttcctgaagttctt

SEQ ID NO: 9109398 - DNA, 22 bp, Homo sapiens
gatttcagggtgtcttccagct

SEQ ID NO: 9109399 - DNA, 22 bp, Homo sapiens
gatttcagagtttattaggtta

SEQ ID NO: 9109400 - DNA, 22 bp, Homo sapiens
attagaaaatacatgggctgtc

SEQ ID NO: 9109401 - DNA, 23 bp, Homo sapiens
attagaaaggctttctggtgaaa

SEQ ID NO: 9109402 - DNA, 22 bp, Homo sapiens
attactatgatttgatcattac

SEQ ID NO: 9109403 - DNA, 22 bp, Homo sapiens
attactatgatttgatcattac

SEQ ID NO: 9109404 - DNA, 22 bp, Homo sapiens
attacatgagagaatgtaaata

SEQ ID NO: 9109405 - DNA, 22 bp, Homo sapiens
attacatatgttggcaacattt

SEQ ID NO: 9109406 - DNA, 22 bp, Homo sapiens
attacatatgttggcaacattt

SEQ ID NO: 9109407 - DNA, 22 bp, Homo sapiens
attacagttctacacatccttt

SEQ ID NO: 9109408 - DNA, 22 bp, Homo sapiens
gatatgtttaatgcctcagtat

SEQ ID NO: 9109409 - DNA, 22 bp, Homo sapiens
gatattcctgaaggacagggtt

SEQ ID NO: 9109410 - DNA, 22 bp, Homo sapiens
gatattctatgtagaatgagct

SEQ ID NO: 9109411 - DNA, 22 bp, Homo sapiens
gatattcctgaaggacagggtt

SEQ ID NO: 9109412 - DNA, 22 bp, Homo sapiens
attacagtggacagctatgcac

SEQ ID NO: 9109413 - DNA, 22 bp, Homo sapiens
attacaatcgagagaaacaaat

SEQ ID NO: 9109414 - DNA, 22 bp, Homo sapiens
attaggaaattatatgtcctcc

SEQ ID NO: 9109415 - DNA, 20 bp, Homo sapiens
attaggattttaggtcatca

SEQ ID NO: 9109416 - DNA, 22 bp, Homo sapiens
attaggatttggtatggtcata

SEQ ID NO: 9109417 - DNA, 22 bp, Homo sapiens
attaggatgttcctatgcacat

SEQ ID NO: 9109418 - DNA, 22 bp, Homo sapiens
attaggatgtgtatattgtgtt

SEQ ID NO: 9109419 - DNA, 22 bp, Homo sapiens
attaggaagtaagtatcacaag

SEQ ID NO: 9109420 - DNA, 22 bp, Homo sapiens
attagctttggtggaaaggagt

SEQ ID NO: 9109421 - DNA, 22 bp, Homo sapiens
attagtctactgtctaataaat

SEQ ID NO: 9109422 - DNA, 22 bp, Homo sapiens
attaggcactagaatgtcaatt

SEQ ID NO: 9109423 - DNA, 22 bp, Homo sapiens
attaggcaattctgggcatctc

SEQ ID NO: 9109424 - DNA, 22 bp, Homo sapiens
attaggattttgtccaagtagc

SEQ ID NO: 9109425 - DNA, 22 bp, Homo sapiens
attaggcattatggggataagg

SEQ ID NO: 9109426 - DNA, 22 bp, Homo sapiens
attaggcattctgaatgaggtc

SEQ ID NO: 9109427 - DNA, 22 bp, Homo sapiens
attcaacatattctgagtaaaa

SEQ ID NO: 9109428 - DNA, 22 bp, Homo sapiens
attcaacatattctgagtaaaa

SEQ ID NO: 9109429 - DNA, 22 bp, Homo sapiens
attcaaattaagttaattcagc

SEQ ID NO: 9109430 - DNA, 22 bp, Homo sapiens
attcaaatgtcaaatccaccag

SEQ ID NO: 9109431 - DNA, 22 bp, Homo sapiens
attcaaagtagatgaagtttca

SEQ ID NO: 9109432 - DNA, 22 bp, Homo sapiens
attcaaagtactagctattttt

SEQ ID NO: 9109433 - DNA, 22 bp, Homo sapiens
attcaaagtctagatgtagtgt

SEQ ID NO: 9109434 - DNA, 22 bp, Homo sapiens
attcaaagtaataaccagaact

SEQ ID NO: 9109435 - DNA, 22 bp, Homo sapiens
attagttgaacaagttaagtaa

SEQ ID NO: 9109436 - DNA, 22 bp, Homo sapiens
gaggagaatgcgcaccacatat

SEQ ID NO: 9109437 - DNA, 18 bp, Homo sapiens
atggtctcatactgggag

SEQ ID NO: 9109438 - DNA, 22 bp, Homo sapiens
gaggagaagggcacggagaaaa

SEQ ID NO: 9109439 - DNA, 22 bp, Homo sapiens
gaggagaagctattggaaggac

SEQ ID NO: 9109440 - DNA, 21 bp, Homo sapiens
atggtgagatactgggtgtgg

SEQ ID NO: 9109441 - DNA, 22 bp, Homo sapiens
gaggagaaatttggggacctga

SEQ ID NO: 9109442 - DNA, 22 bp, Homo sapiens
gaggaaggctaaggggcttaga

SEQ ID NO: 9109443 - DNA, 22 bp, Homo sapiens
gaggagaagctaagaaacacag

SEQ ID NO: 9109444 - DNA, 22 bp, Homo sapiens
gaggagaagctattggaaggac

SEQ ID NO: 9109445 - DNA, 22 bp, Homo sapiens
gaggagaagctattggaaggac

SEQ ID NO: 9109446 - DNA, 22 bp, Homo sapiens
gaggcagcctcagtggacctcg

SEQ ID NO: 9109447 - DNA, 22 bp, Homo sapiens
gaggcagcctcagtggacctcg

SEQ ID NO: 9109448 - DNA, 22 bp, Homo sapiens
gaggcagcctcagtggacctcg

SEQ ID NO: 9109449 - DNA, 22 bp, Homo sapiens
gaggcagccagaggttctcatt

SEQ ID NO: 9109450 - DNA, 22 bp, Homo sapiens
gaggcagccagaggttctcatt

SEQ ID NO: 9109451 - DNA, 22 bp, Homo sapiens
gaggcagcatggtaccttggag

SEQ ID NO: 9109452 - DNA, 22 bp, Homo sapiens
gaggcagcatggtaccttggag

SEQ ID NO: 9109453 - DNA, 22 bp, Homo sapiens
gaggcagcatggtaccttggag

SEQ ID NO: 9109454 - DNA, 22 bp, Homo sapiens
gaggcagcatctatggtgggaa

SEQ ID NO: 9109455 - DNA, 22 bp, Homo sapiens
gaggcagcatctatggtgggaa

SEQ ID NO: 9109456 - DNA, 22 bp, Homo sapiens
gaggcagcatggtaccttggag

SEQ ID NO: 9109457 - DNA, 22 bp, Homo sapiens
gaggcagcattcgcatagacag

SEQ ID NO: 9109458 - DNA, 22 bp, Homo sapiens
gaggcagcattcgcatagacag

SEQ ID NO: 9109459 - DNA, 22 bp, Homo sapiens
gaggcagcattcgcatagacag

SEQ ID NO: 9109460 - DNA, 22 bp, Homo sapiens
gaggcagcagggctggttcctt

SEQ ID NO: 9109461 - DNA, 22 bp, Homo sapiens
gaggcagcatctatggtgggaa

SEQ ID NO: 9109462 - DNA, 22 bp, Homo sapiens
gaggcagcagggctggttcctt

SEQ ID NO: 9109463 - DNA, 22 bp, Homo sapiens
gaggcagcagggctggttcctt

SEQ ID NO: 9109464 - DNA, 22 bp, Homo sapiens
gaggcacatatatacagagccc

SEQ ID NO: 9109465 - DNA, 22 bp, Homo sapiens
atggtggatttgtgattcagct

SEQ ID NO: 9109466 - DNA, 22 bp, Homo sapiens
atggtggactcttgattcaggc

SEQ ID NO: 9109467 - DNA, 22 bp, Homo sapiens
atggtggacgggagacaggact

SEQ ID NO: 9109468 - DNA, 22 bp, Homo sapiens
atggtgtatgatgttttcaatt

SEQ ID NO: 9109469 - DNA, 22 bp, Homo sapiens
atgggctgtcctagtccagccc

SEQ ID NO: 9109470 - DNA, 22 bp, Homo sapiens
atgggctgggatctgagtgtca

SEQ ID NO: 9109471 - DNA, 22 bp, Homo sapiens
atgggctgggaatacacagggg

SEQ ID NO: 9109472 - DNA, 22 bp, Homo sapiens
atgggctggcagcctgaacagc

SEQ ID NO: 9109473 - DNA, 22 bp, Homo sapiens
atgggctgcttctccagcacct

SEQ ID NO: 9109474 - DNA, 22 bp, Homo sapiens
atggggagagaagggctgagct

SEQ ID NO: 9109475 - DNA, 22 bp, Homo sapiens
atggggagctcaccacctgttt

SEQ ID NO: 9109476 - DNA, 22 bp, Homo sapiens
atggggagagcctctgtcccca

SEQ ID NO: 9109477 - DNA, 22 bp, Homo sapiens
atgggcagggcagtgtataaga

SEQ ID NO: 9109478 - DNA, 18 bp, Homo sapiens
atgggcaggtaagatcca

SEQ ID NO: 9109479 - DNA, 22 bp, Homo sapiens
atgggctgacaagacatgcata

SEQ ID NO: 9109480 - DNA, 22 bp, Homo sapiens
atgggaaggttttgagagcggg

SEQ ID NO: 9109481 - DNA, 22 bp, Homo sapiens
atgggaaggttttgagagcggg

SEQ ID NO: 9109482 - DNA, 22 bp, Homo sapiens
atgggaagtgttagaagatttt

SEQ ID NO: 9109483 - DNA, 22 bp, Homo sapiens
atgggaagtgttagaagatttt

SEQ ID NO: 9109484 - DNA, 19 bp, Homo sapiens
atgggaagcggccagcgga

SEQ ID NO: 9109485 - DNA, 22 bp, Homo sapiens
atgggacacgttttaaggaaaa

SEQ ID NO: 9109486 - DNA, 22 bp, Homo sapiens
atggctttcctgggacatgggc

SEQ ID NO: 9109487 - DNA, 22 bp, Homo sapiens
atggcttgtctatgagtgctct

SEQ ID NO: 9109488 - DNA, 22 bp, Homo sapiens
atggcttgttcattggtacctg

SEQ ID NO: 9109489 - DNA, 22 bp, Homo sapiens
atggcttgtctatgagtgctct

SEQ ID NO: 9109490 - DNA, 22 bp, Homo sapiens
atggcttggcaccatctccttg

SEQ ID NO: 9109491 - DNA, 22 bp, Homo sapiens
atggcttggcaccatctccttg

SEQ ID NO: 9109492 - DNA, 22 bp, Homo sapiens
atggcttctagcattgtcacaa

SEQ ID NO: 9109493 - DNA, 17 bp, Homo sapiens
atggcttccattgacca

SEQ ID NO: 9109494 - DNA, 22 bp, Homo sapiens
atggctggcatccaggtgggct

SEQ ID NO: 9109495 - DNA, 22 bp, Homo sapiens
atggcattatagcaatggtttg

SEQ ID NO: 9109496 - DNA, 17 bp, Homo sapiens
gagatgggtggatcacc

SEQ ID NO: 9109497 - DNA, 17 bp, Homo sapiens
gagatgggtggatcacc

SEQ ID NO: 9109498 - DNA, 17 bp, Homo sapiens
gagatgggtggatcacc

SEQ ID NO: 9109499 - DNA, 22 bp, Homo sapiens
gagatggggaataggagcaagc

SEQ ID NO: 9109500 - DNA, 22 bp, Homo sapiens
atggccaactgaaatgaaagat

SEQ ID NO: 9109501 - DNA, 22 bp, Homo sapiens
atggccaccatctctaaaacac

SEQ ID NO: 9109502 - DNA, 22 bp, Homo sapiens
atggccaccatctctaaaacac

SEQ ID NO: 9109503 - DNA, 22 bp, Homo sapiens
atggccaccatttaatgaagct

SEQ ID NO: 9109504 - DNA, 21 bp, Homo sapiens
atggccactatggtgcagcag

SEQ ID NO: 9109505 - DNA, 22 bp, Homo sapiens
atggccaagaagtattcctgac

SEQ ID NO: 9109506 - DNA, 22 bp, Homo sapiens
atggccacatttagtaactggt

SEQ ID NO: 9109507 - DNA, 21 bp, Homo sapiens
atggccactatggtgcagcag

SEQ ID NO: 9109508 - DNA, 22 bp, Homo sapiens
atggagggaaaagtggagagcc

SEQ ID NO: 9109509 - DNA, 21 bp, Homo sapiens
atggagggaccagggaagcag

SEQ ID NO: 9109510 - DNA, 18 bp, Homo sapiens
atggaggcagagagctga

SEQ ID NO: 9109511 - DNA, 18 bp, Homo sapiens
atggaggcagagagctga

SEQ ID NO: 9109512 - DNA, 22 bp, Homo sapiens
gagagcagactctcaaagctgg

SEQ ID NO: 9109513 - DNA, 22 bp, Homo sapiens
atggaggatgtgcagcatgggc

SEQ ID NO: 9109514 - DNA, 17 bp, Homo sapiens
atggaggcagacaggtc

SEQ ID NO: 9109515 - DNA, 22 bp, Homo sapiens
atggagggtggtaagacagaga

SEQ ID NO: 9109516 - DNA, 22 bp, Homo sapiens
gagatggagtctttttctgtca

SEQ ID NO: 9109517 - DNA, 22 bp, Homo sapiens
gagatggcaggtgtgtgggaca

SEQ ID NO: 9109518 - DNA, 17 bp, Homo sapiens
gagatggcattggcagc

SEQ ID NO: 9109519 - DNA, 22 bp, Homo sapiens
gagatggccagtgccaggacaa

SEQ ID NO: 9109520 - DNA, 22 bp, Homo sapiens
gagatggctctcagatctttga

SEQ ID NO: 9109521 - DNA, 21 bp, Homo sapiens
gagatggcccagtagcgggcc

SEQ ID NO: 9109522 - DNA, 22 bp, Homo sapiens
gactggggctctagccaggcct

SEQ ID NO: 9109523 - DNA, 22 bp, Homo sapiens
gactgggccaaggtcagcagct

SEQ ID NO: 9109524 - DNA, 22 bp, Homo sapiens
gagagagaggtgctgccaggca

SEQ ID NO: 9109525 - DNA, 22 bp, Homo sapiens
gagagagagctaatattaagct

SEQ ID NO: 9109526 - DNA, 22 bp, Homo sapiens
gagagagaaggcctgtgggtgt

SEQ ID NO: 9109527 - DNA, 22 bp, Homo sapiens
gagagataggttgcaggaagct

SEQ ID NO: 9109528 - DNA, 22 bp, Homo sapiens
gagagatccagactgtgggtga

SEQ ID NO: 9109529 - DNA, 22 bp, Homo sapiens
gagagcaatggggacgggcagg

SEQ ID NO: 9109530 - DNA, 22 bp, Homo sapiens
atggaggatgtgcagcatgggc

SEQ ID NO: 9109531 - DNA, 22 bp, Homo sapiens
gagagcacggtcttgggcatgg

SEQ ID NO: 9109532 - DNA, 22 bp, Homo sapiens
gagagaggcctccatgtactga

SEQ ID NO: 9109533 - DNA, 22 bp, Homo sapiens
gagagagctctgtgcctgggat

SEQ ID NO: 9109534 - DNA, 22 bp, Homo sapiens
gagagaggcctccatgtactga

SEQ ID NO: 9109535 - DNA, 22 bp, Homo sapiens
atgttctttgaaatattttaga

SEQ ID NO: 9109536 - DNA, 22 bp, Homo sapiens
atgttctttgaaatattttaga

SEQ ID NO: 9109537 - DNA, 22 bp, Homo sapiens
atgttctttcagccagtgcatc

SEQ ID NO: 9109538 - DNA, 22 bp, Homo sapiens
atgttctttcagccagtgcatc

SEQ ID NO: 9109539 - DNA, 22 bp, Homo sapiens
atgttcttgttcaaatgtcagt

SEQ ID NO: 9109540 - DNA, 22 bp, Homo sapiens
atgttctttgtgattctgagct

SEQ ID NO: 9109541 - DNA, 22 bp, Homo sapiens
atgttctttggaatttatgaaa

SEQ ID NO: 9109542 - DNA, 22 bp, Homo sapiens
atgttctttggaatttatgaaa

SEQ ID NO: 9109543 - DNA, 22 bp, Homo sapiens
atgttctttggaatttatgaaa

SEQ ID NO: 9109544 - DNA, 22 bp, Homo sapiens
atgttctttgtgattctgagct

SEQ ID NO: 9109545 - DNA, 22 bp, Homo sapiens
atgttctttgtgattctgagct

SEQ ID NO: 9109546 - DNA, 22 bp, Homo sapiens
atgttcttggatgttgtgtata

SEQ ID NO: 9109547 - DNA, 22 bp, Homo sapiens
atgttcttgactttcctgcctg

SEQ ID NO: 9109548 - DNA, 22 bp, Homo sapiens
atgttcttctatctttattaaa

SEQ ID NO: 9109549 - DNA, 22 bp, Homo sapiens
atgttcttctatctttattaaa

SEQ ID NO: 9109550 - DNA, 22 bp, Homo sapiens
atgttcttccttcaatttggaa

SEQ ID NO: 9109551 - DNA, 22 bp, Homo sapiens
atgttcttccaaatctgtaaca

SEQ ID NO: 9109552 - DNA, 20 bp, Homo sapiens
atgttcttcatttaatgttc

SEQ ID NO: 9109553 - DNA, 22 bp, Homo sapiens
atgttcttatcattctttcgga

SEQ ID NO: 9109554 - DNA, 22 bp, Homo sapiens
atgtgtctggttattgacatgc

SEQ ID NO: 9109555 - DNA, 22 bp, Homo sapiens
atgttattttggaaaatacaaa

SEQ ID NO: 9109556 - DNA, 22 bp, Homo sapiens
atgttattttggaaaatacaaa

SEQ ID NO: 9109557 - DNA, 22 bp, Homo sapiens
atgttctgaatcaagcaactct

SEQ ID NO: 9109558 - DNA, 22 bp, Homo sapiens
gaggtggcccttgctcagcctt

SEQ ID NO: 9109559 - DNA, 22 bp, Homo sapiens
gaggtggcactgtgaggagcac

SEQ ID NO: 9109560 - DNA, 22 bp, Homo sapiens
gaggtggcactgtgaggagcac

SEQ ID NO: 9109561 - DNA, 22 bp, Homo sapiens
gaggtggcaatttaatgcagtc

SEQ ID NO: 9109562 - DNA, 22 bp, Homo sapiens
gaggtggcctcaagcagtcttc

SEQ ID NO: 9109563 - DNA, 22 bp, Homo sapiens
atgtgtctctaaaatttagtaa

SEQ ID NO: 9109564 - DNA, 22 bp, Homo sapiens
atgtgtctctaccaatgcaatt

SEQ ID NO: 9109565 - DNA, 18 bp, Homo sapiens
gatatggaaggccatgcc

SEQ ID NO: 9109566 - DNA, 22 bp, Homo sapiens
gatatatttggaccagagcatt

SEQ ID NO: 9109567 - DNA, 22 bp, Homo sapiens
gatatattttccatggtctgca

SEQ ID NO: 9109568 - DNA, 22 bp, Homo sapiens
gatacaaattcatgtctgaatt

SEQ ID NO: 9109569 - DNA, 22 bp, Homo sapiens
gataatgtgccgataatttcta

SEQ ID NO: 9109570 - DNA, 22 bp, Homo sapiens
gatacaaaatataaatggagag

SEQ ID NO: 9109571 - DNA, 22 bp, Homo sapiens
gatacaaaatataaatggagag

SEQ ID NO: 9109572 - DNA, 22 bp, Homo sapiens
atgttggctggattttagattt

SEQ ID NO: 9109573 - DNA, 22 bp, Homo sapiens
atgttggccaggctggtcttga

SEQ ID NO: 9109574 - DNA, 22 bp, Homo sapiens
atgttggagtcgtaaggcatgg

SEQ ID NO: 9109575 - DNA, 22 bp, Homo sapiens
atgttgcccattccaggagata

SEQ ID NO: 9109576 - DNA, 22 bp, Homo sapiens
atgtttaaaggagtcagagact

SEQ ID NO: 9109577 - DNA, 22 bp, Homo sapiens
atgttgttttttcataaagtat

SEQ ID NO: 9109578 - DNA, 22 bp, Homo sapiens
atgttgtttttgtcccagaagg

SEQ ID NO: 9109579 - DNA, 22 bp, Homo sapiens
atgttgtgtttgactgttaccc

SEQ ID NO: 9109580 - DNA, 22 bp, Homo sapiens
atgttgtgtttgactgttaccc

SEQ ID NO: 9109581 - DNA, 22 bp, Homo sapiens
atgttgttaaatgggtgtattt

SEQ ID NO: 9109582 - DNA, 22 bp, Homo sapiens
atgttgttgaactctttgcatg

SEQ ID NO: 9109583 - DNA, 22 bp, Homo sapiens
gagttcagtgtttctagtagtg

SEQ ID NO: 9109584 - DNA, 20 bp, Homo sapiens
gaggtagggcttaaggcaag

SEQ ID NO: 9109585 - DNA, 20 bp, Homo sapiens
gaggtagggcttaaggcaag

SEQ ID NO: 9109586 - DNA, 22 bp, Homo sapiens
gaggtagggcagaggctgaatg

SEQ ID NO: 9109587 - DNA, 22 bp, Homo sapiens
atgtgactttgtgtcttccatc

SEQ ID NO: 9109588 - DNA, 22 bp, Homo sapiens
atgtgacttcagtcttcttaca

SEQ ID NO: 9109589 - DNA, 22 bp, Homo sapiens
atgtgaatgcagttatctataa

SEQ ID NO: 9109590 - DNA, 22 bp, Homo sapiens
atgtgaatgcagttatctataa

SEQ ID NO: 9109591 - DNA, 22 bp, Homo sapiens
atgtgaagcttgtgctaacata

SEQ ID NO: 9109592 - DNA, 21 bp, Homo sapiens
atgtgaaatatcatcagagca

SEQ ID NO: 9109593 - DNA, 22 bp, Homo sapiens
atgtgaaatattaagccgagga

SEQ ID NO: 9109594 - DNA, 22 bp, Homo sapiens
atgtgaaacgcaatgggatcat

SEQ ID NO: 9109595 - DNA, 22 bp, Homo sapiens
atgtgaaatagctggatatgaa

SEQ ID NO: 9109596 - DNA, 20 bp, Homo sapiens
atgtgaaagatcagttgtct

SEQ ID NO: 9109597 - DNA, 22 bp, Homo sapiens
gagggctctactcaccaccctg

SEQ ID NO: 9109598 - DNA, 22 bp, Homo sapiens
gagggctctaccaagtaactct

SEQ ID NO: 9109599 - DNA, 20 bp, Homo sapiens
gagggctcgtggatggataa

SEQ ID NO: 9109600 - DNA, 19 bp, Homo sapiens
gagggctcatttgaacaat

SEQ ID NO: 9109601 - DNA, 22 bp, Homo sapiens
gagggctcactgagaaagcagt

SEQ ID NO: 9109602 - DNA, 22 bp, Homo sapiens
gagggctcaactactactaggc

SEQ ID NO: 9109603 - DNA, 22 bp, Homo sapiens
atgtctgcgttatatcaatatc

SEQ ID NO: 9109604 - DNA, 22 bp, Homo sapiens
atgtctgctattcatagggaaa

SEQ ID NO: 9109605 - DNA, 22 bp, Homo sapiens
atgtctgataaataatgcataa

SEQ ID NO: 9109606 - DNA, 22 bp, Homo sapiens
atgtctgcaaatatctgccagt

SEQ ID NO: 9109607 - DNA, 22 bp, Homo sapiens
atgtctgataaataatgcataa

SEQ ID NO: 9109608 - DNA, 22 bp, Homo sapiens
atgtctgcggcccaggccaggg

SEQ ID NO: 9109609 - DNA, 22 bp, Homo sapiens
atgtctgcggcccaggccaggg

SEQ ID NO: 9109610 - DNA, 22 bp, Homo sapiens
atgtctgcggcccaggccaggg

SEQ ID NO: 9109611 - DNA, 20 bp, Homo sapiens
atgtctgaagtaatccattt

SEQ ID NO: 9109612 - DNA, 20 bp, Homo sapiens
atgtctgaagtaatccattt

SEQ ID NO: 9109613 - DNA, 22 bp, Homo sapiens
atgtcattaaaattgtgctgca

SEQ ID NO: 9109614 - DNA, 22 bp, Homo sapiens
atgtcccttctttggtgctcag

SEQ ID NO: 9109615 - DNA, 22 bp, Homo sapiens
atgtcatttaaatgtttgtata

SEQ ID NO: 9109616 - DNA, 22 bp, Homo sapiens
atgtcccagctgagagacaact

SEQ ID NO: 9109617 - DNA, 22 bp, Homo sapiens
atgtcccttgtctgtgatgtct

SEQ ID NO: 9109618 - DNA, 22 bp, Homo sapiens
atgtagcagatatttgtgcaca

SEQ ID NO: 9109619 - DNA, 20 bp, Homo sapiens
atgtagatgaaagcaaaggc

SEQ ID NO: 9109620 - DNA, 22 bp, Homo sapiens
atgtagaagctgacagtgctgt

SEQ ID NO: 9109621 - DNA, 22 bp, Homo sapiens
atgtagaacaggttaatgacag

SEQ ID NO: 9109622 - DNA, 22 bp, Homo sapiens
atgtagaagtgggcattataga

SEQ ID NO: 9109623 - DNA, 22 bp, Homo sapiens
atgtagaagtgggcattataga

SEQ ID NO: 9109624 - DNA, 22 bp, Homo sapiens
atgtagaattccttctactttg

SEQ ID NO: 9109625 - DNA, 22 bp, Homo sapiens
atgtagaggagtttctggtctg

SEQ ID NO: 9109626 - DNA, 22 bp, Homo sapiens
atgtagaaagttattttactct

SEQ ID NO: 9109627 - DNA, 22 bp, Homo sapiens
atgtagaacaggttaatgacag

SEQ ID NO: 9109628 - DNA, 22 bp, Homo sapiens
gaggcagcgggtcaggaccgtg

SEQ ID NO: 9109629 - DNA, 22 bp, Homo sapiens
gaggcagcgggtcaggaccgtg

SEQ ID NO: 9109630 - DNA, 22 bp, Homo sapiens
gaggcagcggctcacagagaaa

SEQ ID NO: 9109631 - DNA, 22 bp, Homo sapiens
gaggcagcggctcacagagaaa

SEQ ID NO: 9109632 - DNA, 22 bp, Homo sapiens
gaggcagcggctcacagagaaa

SEQ ID NO: 9109633 - DNA, 22 bp, Homo sapiens
atgtcgcctgaagcggaggctc

SEQ ID NO: 9109634 - DNA, 22 bp, Homo sapiens
atgtcctgttttggcttgctct

SEQ ID NO: 9109635 - DNA, 22 bp, Homo sapiens
ctttcaactacatacaggcgat

SEQ ID NO: 9109636 - DNA, 22 bp, Homo sapiens
ctttccccagtatatcattgcc

SEQ ID NO: 9109637 - DNA, 22 bp, Homo sapiens
ctttccctgcttagaaggattt

SEQ ID NO: 9109638 - DNA, 22 bp, Homo sapiens
ctttccccaagcaccacagtgc

SEQ ID NO: 9109639 - DNA, 22 bp, Homo sapiens
ctttcccagagtagttgatgct

SEQ ID NO: 9109640 - DNA, 22 bp, Homo sapiens
ctttcccacgcagtggatgaga

SEQ ID NO: 9109641 - DNA, 22 bp, Homo sapiens
ctttcccttagccccattctat

SEQ ID NO: 9109642 - DNA, 22 bp, Homo sapiens
atgaaaagttcgatctagaagg

SEQ ID NO: 9109643 - DNA, 22 bp, Homo sapiens
atgaaaagttcgatctagaagg

SEQ ID NO: 9109644 - DNA, 22 bp, Homo sapiens
cttcttgtgcactctctatgta

SEQ ID NO: 9109645 - DNA, 22 bp, Homo sapiens
cttctttaatgtatacaaaaga

SEQ ID NO: 9109646 - DNA, 22 bp, Homo sapiens
cttctttaatgtatacaaaaga

SEQ ID NO: 9109647 - DNA, 22 bp, Homo sapiens
cttctttactttctagaaataa

SEQ ID NO: 9109648 - DNA, 22 bp, Homo sapiens
cttctttaccaagagatagagt

SEQ ID NO: 9109649 - DNA, 22 bp, Homo sapiens
atctggataggttgttttgcat

SEQ ID NO: 9109650 - DNA, 22 bp, Homo sapiens
atgaacatgtgactcagacctg

SEQ ID NO: 9109651 - DNA, 22 bp, Homo sapiens
atgaacatgtgactcagacctg

SEQ ID NO: 9109652 - DNA, 22 bp, Homo sapiens
atgaacatctctgatccaagca

SEQ ID NO: 9109653 - DNA, 22 bp, Homo sapiens
ctttctgattttaagctctaat

SEQ ID NO: 9109654 - DNA, 22 bp, Homo sapiens
ctttcttatacctgtcagggcc

SEQ ID NO: 9109655 - DNA, 22 bp, Homo sapiens
ctttcttaatttttaaggacac

SEQ ID NO: 9109656 - DNA, 22 bp, Homo sapiens
ctttctcttgagcaagagctgt

SEQ ID NO: 9109657 - DNA, 22 bp, Homo sapiens
atgaaacaagggtattttctct

SEQ ID NO: 9109658 - DNA, 22 bp, Homo sapiens
atgaaacaagggtattttctct

SEQ ID NO: 9109659 - DNA, 22 bp, Homo sapiens
atgaaaattgacagcggaagta

SEQ ID NO: 9109660 - DNA, 22 bp, Homo sapiens
atgaaaatgtacatgtgtataa

SEQ ID NO: 9109661 - DNA, 22 bp, Homo sapiens
atgaaaatgtacatgtgtataa

SEQ ID NO: 9109662 - DNA, 22 bp, Homo sapiens
atgaaaagttcgatctagaagg

SEQ ID NO: 9109663 - DNA, 22 bp, Homo sapiens
atgaaacagtgtgtatagcaaa

SEQ ID NO: 9109664 - DNA, 22 bp, Homo sapiens
atgaaacagagtacttaatata

SEQ ID NO: 9109665 - DNA, 22 bp, Homo sapiens
atgaaattcatctgagaatgct

SEQ ID NO: 9109666 - DNA, 22 bp, Homo sapiens
gaaacatttgttgagtacttgc

SEQ ID NO: 9109667 - DNA, 21 bp, Homo sapiens
atgacagatgctgcagatcgt

SEQ ID NO: 9109668 - DNA, 21 bp, Homo sapiens
atgacagatgctgcagatcgt

SEQ ID NO: 9109669 - DNA, 22 bp, Homo sapiens
atgacaggaggcagctgggcag

SEQ ID NO: 9109670 - DNA, 22 bp, Homo sapiens
atgacaggaataactatgatgg

SEQ ID NO: 9109671 - DNA, 20 bp, Homo sapiens
gaaacattggcagcaactga

SEQ ID NO: 9109672 - DNA, 22 bp, Homo sapiens
gaaacattggtctgccccttat

SEQ ID NO: 9109673 - DNA, 22 bp, Homo sapiens
gaaacattgtgttctacagatt

SEQ ID NO: 9109674 - DNA, 22 bp, Homo sapiens
gaaacattgtgttctacagatt

SEQ ID NO: 9109675 - DNA, 20 bp, Homo sapiens
gaaacattggcagcaactga

SEQ ID NO: 9109676 - DNA, 20 bp, Homo sapiens
gaaacattggcagcaactga

SEQ ID NO: 9109677 - DNA, 22 bp, Homo sapiens
gaaacattgagcagaaggagaa

SEQ ID NO: 9109678 - DNA, 22 bp, Homo sapiens
gaaacattcagtcaacagtgtt

SEQ ID NO: 9109679 - DNA, 22 bp, Homo sapiens
gaaacattcatatgagaaacct

SEQ ID NO: 9109680 - DNA, 22 bp, Homo sapiens
gaaacatagttgagacactgct

SEQ ID NO: 9109681 - DNA, 22 bp, Homo sapiens
gaaacagtcaactttctttccc

SEQ ID NO: 9109682 - DNA, 22 bp, Homo sapiens
gaaacagtgagaacttttcctg

SEQ ID NO: 9109683 - DNA, 22 bp, Homo sapiens
ctttctttcgaagacgtgatta

SEQ ID NO: 9109684 - DNA, 22 bp, Homo sapiens
gaaaatgttagcttcatagtca

SEQ ID NO: 9109685 - DNA, 22 bp, Homo sapiens
atgatgaagagtaacaggctga

SEQ ID NO: 9109686 - DNA, 22 bp, Homo sapiens
atgatgcaccattataagagtt

SEQ ID NO: 9109687 - DNA, 22 bp, Homo sapiens
atgatcagggcagaagcagaag

SEQ ID NO: 9109688 - DNA, 22 bp, Homo sapiens
atgatccaaagccacaggggca

SEQ ID NO: 9109689 - DNA, 22 bp, Homo sapiens
gaaatagatctctgggatgcaa

SEQ ID NO: 9109690 - DNA, 22 bp, Homo sapiens
gaaatagatctctgggatgcaa

SEQ ID NO: 9109691 - DNA, 22 bp, Homo sapiens
gaaatatacatgaagtcggctg

SEQ ID NO: 9109692 - DNA, 19 bp, Homo sapiens
atgatacaggtgaaaattg

SEQ ID NO: 9109693 - DNA, 22 bp, Homo sapiens
atgatattttagtaaagtgata

SEQ ID NO: 9109694 - DNA, 19 bp, Homo sapiens
atgatacaggtgaaaattg

SEQ ID NO: 9109695 - DNA, 22 bp, Homo sapiens
atgatatttgcaatgtgcttgc

SEQ ID NO: 9109696 - DNA, 22 bp, Homo sapiens
gaaatactgtaaagttattatt

SEQ ID NO: 9109697 - DNA, 22 bp, Homo sapiens
gaaatacagttgggaggaggta

SEQ ID NO: 9109698 - DNA, 22 bp, Homo sapiens
gaaagtgcagtcagacaaggca

SEQ ID NO: 9109699 - DNA, 22 bp, Homo sapiens
gaaagtcatggatgaacactac

SEQ ID NO: 9109700 - DNA, 22 bp, Homo sapiens
gaaatagaagctgccaatttct

SEQ ID NO: 9109701 - DNA, 22 bp, Homo sapiens
gaaatagacactttctatgaat

SEQ ID NO: 9109702 - DNA, 22 bp, Homo sapiens
gaaatagacactttctatgaat

SEQ ID NO: 9109703 - DNA, 22 bp, Homo sapiens
gaaatagacactttctatgaat

SEQ ID NO: 9109704 - DNA, 22 bp, Homo sapiens
gaaatagacactttctatgaat

SEQ ID NO: 9109705 - DNA, 22 bp, Homo sapiens
gaaagtatttacattaacatct

SEQ ID NO: 9109706 - DNA, 22 bp, Homo sapiens
gaaagtatttacattaacatct

SEQ ID NO: 9109707 - DNA, 22 bp, Homo sapiens
gaaagtatttaagtccatattt

SEQ ID NO: 9109708 - DNA, 22 bp, Homo sapiens
gaaagtattctccctgaatttt

SEQ ID NO: 9109709 - DNA, 22 bp, Homo sapiens
gaaagtattctccctgaatttt

SEQ ID NO: 9109710 - DNA, 22 bp, Homo sapiens
gaaagtatttaagtccatattt

SEQ ID NO: 9109711 - DNA, 22 bp, Homo sapiens
gaaagtattagcctagaagtca

SEQ ID NO: 9109712 - DNA, 22 bp, Homo sapiens
gaaagtattagcctagaagtca

SEQ ID NO: 9109713 - DNA, 22 bp, Homo sapiens
gaaagtattcacaaagttcttg

SEQ ID NO: 9109714 - DNA, 22 bp, Homo sapiens
gaaagtatgccatctacctctt

SEQ ID NO: 9109715 - DNA, 22 bp, Homo sapiens
gaaaggttgtaacaagactctt

SEQ ID NO: 9109716 - DNA, 22 bp, Homo sapiens
gactggatgtttaatcaacaga

SEQ ID NO: 9109717 - DNA, 22 bp, Homo sapiens
gactggatattgagtactgcaa

SEQ ID NO: 9109718 - DNA, 22 bp, Homo sapiens
gactggcctggggctgggcaca

SEQ ID NO: 9109719 - DNA, 22 bp, Homo sapiens
gactggcctggggctgggcaca

SEQ ID NO: 9109720 - DNA, 22 bp, Homo sapiens
gactggcctggagatgcagctg

SEQ ID NO: 9109721 - DNA, 22 bp, Homo sapiens
gactggcctggagatgcagctg

SEQ ID NO: 9109722 - DNA, 22 bp, Homo sapiens
gactggagataaaaccatgagt

SEQ ID NO: 9109723 - DNA, 22 bp, Homo sapiens
gactaaataaaagccaaacttc

SEQ ID NO: 9109724 - DNA, 19 bp, Homo sapiens
gactaaataataatagcag

SEQ ID NO: 9109725 - DNA, 19 bp, Homo sapiens
gactaaataaactctcccc

SEQ ID NO: 9109726 - DNA, 22 bp, Homo sapiens
gactaaattcctgttcgcgatg

SEQ ID NO: 9109727 - DNA, 22 bp, Homo sapiens
gactaaatgctttgtgcatgca

SEQ ID NO: 9109728 - DNA, 22 bp, Homo sapiens
gactaaatcagacttttccaaa

SEQ ID NO: 9109729 - DNA, 22 bp, Homo sapiens
gactacaacaataagaacagct

SEQ ID NO: 9109730 - DNA, 22 bp, Homo sapiens
gacgagagactccatccaccac

SEQ ID NO: 9109731 - DNA, 22 bp, Homo sapiens
gacgagagactccatccaccac

SEQ ID NO: 9109732 - DNA, 22 bp, Homo sapiens
atgctccttggcttcaaagcca

SEQ ID NO: 9109733 - DNA, 22 bp, Homo sapiens
atgctcctcgagtgtctcacag

SEQ ID NO: 9109734 - DNA, 22 bp, Homo sapiens
atgctccttggcttcaaagcca

SEQ ID NO: 9109735 - DNA, 22 bp, Homo sapiens
atgctctagagctcttttcact

SEQ ID NO: 9109736 - DNA, 18 bp, Homo sapiens
atgctcctatctctgagc

SEQ ID NO: 9109737 - DNA, 22 bp, Homo sapiens
atgctatttaccacacatcatt

SEQ ID NO: 9109738 - DNA, 22 bp, Homo sapiens
atgctcagggcacactctggac

SEQ ID NO: 9109739 - DNA, 22 bp, Homo sapiens
atgctcagcctgaggtggggag

SEQ ID NO: 9109740 - DNA, 22 bp, Homo sapiens
atgctcagacaccgggcggggg

SEQ ID NO: 9109741 - DNA, 22 bp, Homo sapiens
atgctctggccctttgaacgct

SEQ ID NO: 9109742 - DNA, 22 bp, Homo sapiens
atgctctctgtcctgctcagag

SEQ ID NO: 9109743 - DNA, 22 bp, Homo sapiens
atgctctgatgctgttaaatgt

SEQ ID NO: 9109744 - DNA, 22 bp, Homo sapiens
gaccttgtgatccacccgcttt

SEQ ID NO: 9109745 - DNA, 22 bp, Homo sapiens
gaccttgtgatctgcctgcctt

SEQ ID NO: 9109746 - DNA, 22 bp, Homo sapiens
gaccttgtgctccgaggcgggc

SEQ ID NO: 9109747 - DNA, 22 bp, Homo sapiens
gaccttgtgatctgcccacctt

SEQ ID NO: 9109748 - DNA, 22 bp, Homo sapiens
gaccttgtgatccgcccgcctt

SEQ ID NO: 9109749 - DNA, 22 bp, Homo sapiens
gacaccagcaaggctgtgagga

SEQ ID NO: 9109750 - DNA, 22 bp, Homo sapiens
gacacatagatctatctcactc

SEQ ID NO: 9109751 - DNA, 22 bp, Homo sapiens
gacacatacagcagtaagtcta

SEQ ID NO: 9109752 - DNA, 22 bp, Homo sapiens
gacacattgatgtgagtacata

SEQ ID NO: 9109753 - DNA, 22 bp, Homo sapiens
gacacaaagtttgtcagaaatt

SEQ ID NO: 9109754 - DNA, 22 bp, Homo sapiens
gacacaaagtttgtcagaaatt

SEQ ID NO: 9109755 - DNA, 22 bp, Homo sapiens
gacacaaagtttgtcagaaatt

SEQ ID NO: 9109756 - DNA, 21 bp, Homo sapiens
gacacaaagggtagtaatggt

SEQ ID NO: 9109757 - DNA, 21 bp, Homo sapiens
gacacaaagggtagtaatggt

SEQ ID NO: 9109758 - DNA, 21 bp, Homo sapiens
gacacaaagggtagtaatggt

SEQ ID NO: 9109759 - DNA, 22 bp, Homo sapiens
gacaatttctcaatatagaaac

SEQ ID NO: 9109760 - DNA, 22 bp, Homo sapiens
gacaattgcttttgccgaataa

SEQ ID NO: 9109761 - DNA, 22 bp, Homo sapiens
gacaatgtgaggcgagtttgtt

SEQ ID NO: 9109762 - DNA, 22 bp, Homo sapiens
gacaatgtgttgaaagggaaaa

SEQ ID NO: 9109763 - DNA, 22 bp, Homo sapiens
gacaatgtgcaattgcagctag

SEQ ID NO: 9109764 - DNA, 22 bp, Homo sapiens
gacaatgtgaggcgagtttgtt

SEQ ID NO: 9109765 - DNA, 22 bp, Homo sapiens
gacatttattggattttacgag

SEQ ID NO: 9109766 - DNA, 22 bp, Homo sapiens
gacatttattagaaaactatca

SEQ ID NO: 9109767 - DNA, 22 bp, Homo sapiens
gacataaatgaagtttgactat

SEQ ID NO: 9109768 - DNA, 22 bp, Homo sapiens
gacatttatgaaggagatatgc

SEQ ID NO: 9109769 - DNA, 22 bp, Homo sapiens
gaccaagatacagcatcataga

SEQ ID NO: 9109770 - DNA, 22 bp, Homo sapiens
gaccacagattcctaagtggca

SEQ ID NO: 9109771 - DNA, 22 bp, Homo sapiens
atgctatgtaactggcagatag

SEQ ID NO: 9109772 - DNA, 22 bp, Homo sapiens
gaccacagaggtgtgggagaga

SEQ ID NO: 9109773 - DNA, 22 bp, Homo sapiens
atgcacaattaggatatagctt

SEQ ID NO: 9109774 - DNA, 22 bp, Homo sapiens
gaaggctgtggctggtctcagt

SEQ ID NO: 9109775 - DNA, 22 bp, Homo sapiens
gaaggctgtcagagaggagggc

SEQ ID NO: 9109776 - DNA, 22 bp, Homo sapiens
gaaggctggggcatcagtgaaa

SEQ ID NO: 9109777 - DNA, 22 bp, Homo sapiens
gaaggctggggccttctcatct

SEQ ID NO: 9109778 - DNA, 22 bp, Homo sapiens
atgcacagacccaaaggccatc

SEQ ID NO: 9109779 - DNA, 22 bp, Homo sapiens
atgcacagacccaaaggccatc

SEQ ID NO: 9109780 - DNA, 22 bp, Homo sapiens
atgcacagatcctggcacttag

SEQ ID NO: 9109781 - DNA, 22 bp, Homo sapiens
atgcacagcagtgagttcagtg

SEQ ID NO: 9109782 - DNA, 22 bp, Homo sapiens
atgcacaggaagtgtccccatt

SEQ ID NO: 9109783 - DNA, 22 bp, Homo sapiens
atgcacagaacaattttaagag

SEQ ID NO: 9109784 - DNA, 22 bp, Homo sapiens
atgcacaattaggatatagctt

SEQ ID NO: 9109785 - DNA, 22 bp, Homo sapiens
atgcacaatgttttgatttgag

SEQ ID NO: 9109786 - DNA, 22 bp, Homo sapiens
atgcacacgtaccctacaaggc

SEQ ID NO: 9109787 - DNA, 22 bp, Homo sapiens
gaaggctgctgggaagtgtggt

SEQ ID NO: 9109788 - DNA, 22 bp, Homo sapiens
gaaggctggctcagctttccag

SEQ ID NO: 9109789 - DNA, 22 bp, Homo sapiens
gaacaagtttccaaattataac

SEQ ID NO: 9109790 - DNA, 22 bp, Homo sapiens
gaaggcaacaccaggatgcact

SEQ ID NO: 9109791 - DNA, 22 bp, Homo sapiens
gaaggcaacaccaggatgcact

SEQ ID NO: 9109792 - DNA, 22 bp, Homo sapiens
gaaggcaacaccaggatgcact

SEQ ID NO: 9109793 - DNA, 22 bp, Homo sapiens
gaaggcaagatctcagtggagg

SEQ ID NO: 9109794 - DNA, 22 bp, Homo sapiens
gaaggcaagatctcagtggagg

SEQ ID NO: 9109795 - DNA, 22 bp, Homo sapiens
gaaggcaagatctcagtggagg

SEQ ID NO: 9109796 - DNA, 22 bp, Homo sapiens
gaaggcaagatctcagtggagg

SEQ ID NO: 9109797 - DNA, 22 bp, Homo sapiens
gaaggcaagcagcataaatgtc

SEQ ID NO: 9109798 - DNA, 22 bp, Homo sapiens
gaaggcaagcagcataaatgtc

SEQ ID NO: 9109799 - DNA, 22 bp, Homo sapiens
gaacaaacagtcaggacagtct

SEQ ID NO: 9109800 - DNA, 22 bp, Homo sapiens
gaacaaacatttttggcagtat

SEQ ID NO: 9109801 - DNA, 22 bp, Homo sapiens
gaacaaactgggtcccaatgat

SEQ ID NO: 9109802 - DNA, 19 bp, Homo sapiens
gaacaaacttaaacttttc

SEQ ID NO: 9109803 - DNA, 22 bp, Homo sapiens
gaacaaagacatggaggaggat

SEQ ID NO: 9109804 - DNA, 22 bp, Homo sapiens
gaacaaacacatcccagcagtg

SEQ ID NO: 9109805 - DNA, 22 bp, Homo sapiens
gaacaaacagaagaggcggaac

SEQ ID NO: 9109806 - DNA, 22 bp, Homo sapiens
gaacaaacacatcccagcagtg

SEQ ID NO: 9109807 - DNA, 22 bp, Homo sapiens
gaataatattgactttgcaggc

SEQ ID NO: 9109808 - DNA, 22 bp, Homo sapiens
gaataatattgactttgcaggc

SEQ ID NO: 9109809 - DNA, 22 bp, Homo sapiens
gaatacaaacttaaggctttac

SEQ ID NO: 9109810 - DNA, 22 bp, Homo sapiens
gaatacaaacttaaggctttac

SEQ ID NO: 9109811 - DNA, 22 bp, Homo sapiens
gaatacaaagcagaactcatac

SEQ ID NO: 9109812 - DNA, 23 bp, Homo sapiens
gaatacaaagcagatggtccagc

SEQ ID NO: 9109813 - DNA, 22 bp, Homo sapiens
gaatacaaagcagaactcatac

SEQ ID NO: 9109814 - DNA, 22 bp, Homo sapiens
atgcacaggctgtgggctggtt

SEQ ID NO: 9109815 - DNA, 22 bp, Homo sapiens
atgcacaggtgctgatgcacgc

SEQ ID NO: 9109816 - DNA, 22 bp, Homo sapiens
gaagtcttttagcaaaacgaac

SEQ ID NO: 9109817 - DNA, 22 bp, Homo sapiens
gaataacattttttcctttaca

SEQ ID NO: 9109818 - DNA, 22 bp, Homo sapiens
gaataatagcagaaattagcag

SEQ ID NO: 9109819 - DNA, 22 bp, Homo sapiens
gaataatagcagaaattagcag

SEQ ID NO: 9109820 - DNA, 22 bp, Homo sapiens
gaataatagcagaaattagcag

SEQ ID NO: 9109821 - DNA, 22 bp, Homo sapiens
gacaatacagaaagggacatgc

SEQ ID NO: 9109822 - DNA, 22 bp, Homo sapiens
gaattttatcttattacttgca

SEQ ID NO: 9109823 - DNA, 22 bp, Homo sapiens
gacaataaagtgatacatggga

SEQ ID NO: 9109824 - DNA, 22 bp, Homo sapiens
gacaatcagccatatccagggt

SEQ ID NO: 9109825 - DNA, 22 bp, Homo sapiens
gacaatgtgacagaccaatgat

SEQ ID NO: 9109826 - DNA, 22 bp, Homo sapiens
gacaatgtaaatcaggatagca

SEQ ID NO: 9109827 - DNA, 19 bp, Homo sapiens
gaattttaggacttcagca

SEQ ID NO: 9109828 - DNA, 22 bp, Homo sapiens
gaatcagaatctgcatgttaag

SEQ ID NO: 9109829 - DNA, 22 bp, Homo sapiens
gaatcagaatctctggggttgg

SEQ ID NO: 9109830 - DNA, 22 bp, Homo sapiens
gaatcagaatctctggggttgg

SEQ ID NO: 9109831 - DNA, 22 bp, Homo sapiens
gaatcagaatctctaaggtggg

SEQ ID NO: 9109832 - DNA, 22 bp, Homo sapiens
gaatcagaatctgcatttttaa

SEQ ID NO: 9109833 - DNA, 22 bp, Homo sapiens
gaatcagactgacctgagttca

SEQ ID NO: 9109834 - DNA, 22 bp, Homo sapiens
gaatcagataataagcaagcat

SEQ ID NO: 9109835 - DNA, 22 bp, Homo sapiens
gaatcagactacaaatgacccc

SEQ ID NO: 9109836 - DNA, 22 bp, Homo sapiens
gaatcagatgcggtttagctta

SEQ ID NO: 9109837 - DNA, 22 bp, Homo sapiens
gaatcagatactgatttcagtc

SEQ ID NO: 9109838 - DNA, 22 bp, Homo sapiens
gaatcagaaccactggagggtt

SEQ ID NO: 9109839 - DNA, 22 bp, Homo sapiens
gaatcacagaggcaaattctga

SEQ ID NO: 9109840 - DNA, 22 bp, Homo sapiens
gaatcacactcgtaagtgagtt

SEQ ID NO: 9109841 - DNA, 22 bp, Homo sapiens
gaatcaattatccaggctgttg

SEQ ID NO: 9109842 - DNA, 22 bp, Homo sapiens
gaatcaattgtgaagactatga

SEQ ID NO: 9109843 - DNA, 22 bp, Homo sapiens
gaatcaaatcaagttcttttga

SEQ ID NO: 9109844 - DNA, 22 bp, Homo sapiens
gaatcaaatcaagttcttttga

SEQ ID NO: 9109845 - DNA, 22 bp, Homo sapiens
gaatcaatggtagattaagtaa

SEQ ID NO: 9109846 - DNA, 22 bp, Homo sapiens
gaatacaaataataccaaggtg

SEQ ID NO: 9109847 - DNA, 22 bp, Homo sapiens
gtcccaggcttatgtggagctt

SEQ ID NO: 9109848 - DNA, 22 bp, Homo sapiens
gtcccaggctccatggcagcca

SEQ ID NO: 9109849 - DNA, 22 bp, Homo sapiens
gtcccaggctccatggcagcca

SEQ ID NO: 9109850 - DNA, 19 bp, Homo sapiens
gtccctgggcagaggcacc

SEQ ID NO: 9109851 - DNA, 19 bp, Homo sapiens
gtccctgggcagaggcacc

SEQ ID NO: 9109852 - DNA, 22 bp, Homo sapiens
gtccctgggaaaggagagggca

SEQ ID NO: 9109853 - DNA, 22 bp, Homo sapiens
gtccctgggaaaggagagggca

SEQ ID NO: 9109854 - DNA, 22 bp, Homo sapiens
gtccctggggaatcagctggag

SEQ ID NO: 9109855 - DNA, 22 bp, Homo sapiens
gtccctggggaatcagctggag

SEQ ID NO: 9109856 - DNA, 22 bp, Homo sapiens
gtccctggggaatcagctggag

SEQ ID NO: 9109857 - DNA, 22 bp, Homo sapiens
gtctgcttttgttttactggta

SEQ ID NO: 9109858 - DNA, 22 bp, Homo sapiens
gtccctggtttgcccaggacca

SEQ ID NO: 9109859 - DNA, 22 bp, Homo sapiens
gtccctgggtctaaggcagtaa

SEQ ID NO: 9109860 - DNA, 22 bp, Homo sapiens
gtccctggtttgcccaggacca

SEQ ID NO: 9109861 - DNA, 22 bp, Homo sapiens
gtccctgggggtttaggactca

SEQ ID NO: 9109862 - DNA, 22 bp, Homo sapiens
gtccctgggggtttaggactca

SEQ ID NO: 9109863 - DNA, 22 bp, Homo sapiens
gtccctgggtagctcagtggct

SEQ ID NO: 9109864 - DNA, 22 bp, Homo sapiens
gtctggagccaccctaagcatt

SEQ ID NO: 9109865 - DNA, 22 bp, Homo sapiens
gtctggagagctgagcagagtt

SEQ ID NO: 9109866 - DNA, 22 bp, Homo sapiens
gtctggagacttgggtcatcaa

SEQ ID NO: 9109867 - DNA, 22 bp, Homo sapiens
cagccagggagcaaagagttga

SEQ ID NO: 9109868 - DNA, 22 bp, Homo sapiens
gtctggaaggaggagatggagc

SEQ ID NO: 9109869 - DNA, 22 bp, Homo sapiens
gtctggaagaactagggatgtt

SEQ ID NO: 9109870 - DNA, 22 bp, Homo sapiens
gtctggaagctctaggggagaa

SEQ ID NO: 9109871 - DNA, 22 bp, Homo sapiens
gtctggaaattaagaggaggtt

SEQ ID NO: 9109872 - DNA, 22 bp, Homo sapiens
gtctggaaagagctgaggttca

SEQ ID NO: 9109873 - DNA, 22 bp, Homo sapiens
gtctggaaccaagacgtgtagc

SEQ ID NO: 9109874 - DNA, 22 bp, Homo sapiens
gtctggaagaacctgtgccagt

SEQ ID NO: 9109875 - DNA, 22 bp, Homo sapiens
gtctggaaatttaaggtatgag

SEQ ID NO: 9109876 - DNA, 22 bp, Homo sapiens
cagcccaggctcagatgttggg

SEQ ID NO: 9109877 - DNA, 22 bp, Homo sapiens
cagccaggtatgggcgtgcggg

SEQ ID NO: 9109878 - DNA, 22 bp, Homo sapiens
cagcccctccctcaggcaggtg

SEQ ID NO: 9109879 - DNA, 22 bp, Homo sapiens
cagcccctcacagagctgtcct

SEQ ID NO: 9109880 - DNA, 22 bp, Homo sapiens
cagcccccatggggaggtcaag

SEQ ID NO: 9109881 - DNA, 22 bp, Homo sapiens
cagccccatggtgtgctccagc

SEQ ID NO: 9109882 - DNA, 22 bp, Homo sapiens
cagccccatggtgtgctccagc

SEQ ID NO: 9109883 - DNA, 22 bp, Homo sapiens
cagccccttcctggcatctgga

SEQ ID NO: 9109884 - DNA, 22 bp, Homo sapiens
cagccccttcctggcatctgga

SEQ ID NO: 9109885 - DNA, 22 bp, Homo sapiens
cagccctcaggtcctcagcagc

SEQ ID NO: 9109886 - DNA, 22 bp, Homo sapiens
gtctgtagaataaatatgagta

SEQ ID NO: 9109887 - DNA, 22 bp, Homo sapiens
gtctgtaattattaaagaaagg

SEQ ID NO: 9109888 - DNA, 22 bp, Homo sapiens
cagccctcaggtcctcagcagc

SEQ ID NO: 9109889 - DNA, 22 bp, Homo sapiens
cagccctcaggtcctcagcagc

SEQ ID NO: 9109890 - DNA, 22 bp, Homo sapiens
cagccctcaaaccacttccagg

SEQ ID NO: 9109891 - DNA, 22 bp, Homo sapiens
gtctgtagatgagtcttaagaa

SEQ ID NO: 9109892 - DNA, 22 bp, Homo sapiens
gtctgtcatctgagatggagtg

SEQ ID NO: 9109893 - DNA, 22 bp, Homo sapiens
gtctgtctccctgtgactgaga

SEQ ID NO: 9109894 - DNA, 22 bp, Homo sapiens
gtctgtggtccctgctggggac

SEQ ID NO: 9109895 - DNA, 22 bp, Homo sapiens
gtctgtctctctccagagtgca

SEQ ID NO: 9109896 - DNA, 22 bp, Homo sapiens
gtctgtctccctgtgactgaga

SEQ ID NO: 9109897 - DNA, 22 bp, Homo sapiens
gtctgtctctctccagagtgca

SEQ ID NO: 9109898 - DNA, 22 bp, Homo sapiens
gtctgtctgttgttgagaagca

SEQ ID NO: 9109899 - DNA, 22 bp, Homo sapiens
gtctgtctgttgttgagaagca

SEQ ID NO: 9109900 - DNA, 22 bp, Homo sapiens
gtctgtgcagttactagctggt

SEQ ID NO: 9109901 - DNA, 22 bp, Homo sapiens
gtctgtggcaggggagaagttt

SEQ ID NO: 9109902 - DNA, 22 bp, Homo sapiens
gtcccaggcagagtcaggaggg

SEQ ID NO: 9109903 - DNA, 22 bp, Homo sapiens
gtcccaggcagagtcaggaggg

SEQ ID NO: 9109904 - DNA, 22 bp, Homo sapiens
gtcccagcttcccactagcagc

SEQ ID NO: 9109905 - DNA, 22 bp, Homo sapiens
gtcccaggaacattctggctag

SEQ ID NO: 9109906 - DNA, 22 bp, Homo sapiens
gtccagccaccctggaggcacg

SEQ ID NO: 9109907 - DNA, 22 bp, Homo sapiens
gtccagccaccctggaggcacg

SEQ ID NO: 9109908 - DNA, 22 bp, Homo sapiens
gtccagccactcaccttccagc

SEQ ID NO: 9109909 - DNA, 22 bp, Homo sapiens
gtccagccagctggtccttgcc

SEQ ID NO: 9109910 - DNA, 22 bp, Homo sapiens
cagcaggctgtggaaatcctgg

SEQ ID NO: 9109911 - DNA, 22 bp, Homo sapiens
cagcaggctggacttcagtccc

SEQ ID NO: 9109912 - DNA, 22 bp, Homo sapiens
cagcaggctctgagtggctgcc

SEQ ID NO: 9109913 - DNA, 22 bp, Homo sapiens
cagcaggctctgagtggctgcc

SEQ ID NO: 9109914 - DNA, 22 bp, Homo sapiens
cagcaggctgcgattgctcatt

SEQ ID NO: 9109915 - DNA, 22 bp, Homo sapiens
cagcaggctgcgattgctcatt

SEQ ID NO: 9109916 - DNA, 22 bp, Homo sapiens
cagcaggctgcgattgctcatt

SEQ ID NO: 9109917 - DNA, 22 bp, Homo sapiens
gtcatgcctggcttcttagaca

SEQ ID NO: 9109918 - DNA, 22 bp, Homo sapiens
gtcatgccagcggagctcggga

SEQ ID NO: 9109919 - DNA, 22 bp, Homo sapiens
cagcaggcgttgggagaaagac

SEQ ID NO: 9109920 - DNA, 20 bp, Homo sapiens
cagcaggctatggggcaccc

SEQ ID NO: 9109921 - DNA, 22 bp, Homo sapiens
gtcattatctacagaagtgtgt

SEQ ID NO: 9109922 - DNA, 22 bp, Homo sapiens
gtcattataccattataattgt

SEQ ID NO: 9109923 - DNA, 22 bp, Homo sapiens
gtcatctgtttacttttctgct

SEQ ID NO: 9109924 - DNA, 22 bp, Homo sapiens
gtcatctgtgcttttggtagga

SEQ ID NO: 9109925 - DNA, 22 bp, Homo sapiens
cagcaggacatggaggagtaaa

SEQ ID NO: 9109926 - DNA, 22 bp, Homo sapiens
gtcagcatgagcaagggctgac

SEQ ID NO: 9109927 - DNA, 22 bp, Homo sapiens
gtcagcctgcactcagggagcg

SEQ ID NO: 9109928 - DNA, 22 bp, Homo sapiens
gtcagcgtgctcagcctattat

SEQ ID NO: 9109929 - DNA, 22 bp, Homo sapiens
gtcagcgtgctcagcctattat

SEQ ID NO: 9109930 - DNA, 22 bp, Homo sapiens
cagcaggaaggtttcccctgca

SEQ ID NO: 9109931 - DNA, 22 bp, Homo sapiens
cagcagctgtttacggaacacc

SEQ ID NO: 9109932 - DNA, 22 bp, Homo sapiens
cagcagctggttgaatccttct

SEQ ID NO: 9109933 - DNA, 22 bp, Homo sapiens
cagcagctggttgaatccttct

SEQ ID NO: 9109934 - DNA, 22 bp, Homo sapiens
cagcagctggttatacctgtgg

SEQ ID NO: 9109935 - DNA, 22 bp, Homo sapiens
cagcagctggtgagacacagcc

SEQ ID NO: 9109936 - DNA, 22 bp, Homo sapiens
cagcagctggtgagacacagcc

SEQ ID NO: 9109937 - DNA, 22 bp, Homo sapiens
cagcagcttctgttgatcagaa

SEQ ID NO: 9109938 - DNA, 22 bp, Homo sapiens
cagcagctttgccaagtcagcc

SEQ ID NO: 9109939 - DNA, 22 bp, Homo sapiens
cagcagctttgccaagtcagcc

SEQ ID NO: 9109940 - DNA, 22 bp, Homo sapiens
cagcagcttctgttgatcagaa

SEQ ID NO: 9109941 - DNA, 20 bp, Homo sapiens
cagcaggaaaagtgcctcag

SEQ ID NO: 9109942 - DNA, 22 bp, Homo sapiens
cagcagctttgccaagtcagcc

SEQ ID NO: 9109943 - DNA, 22 bp, Homo sapiens
cagcagcttttgcattctcatt

SEQ ID NO: 9109944 - DNA, 22 bp, Homo sapiens
cagcagctgcgtgcccaggccg

SEQ ID NO: 9109945 - DNA, 22 bp, Homo sapiens
cagcagctgcgtgcccaggccg

SEQ ID NO: 9109946 - DNA, 22 bp, Homo sapiens
cagcagctgggaaggaggctga

SEQ ID NO: 9109947 - DNA, 22 bp, Homo sapiens
cagcagctgggaaggaggctga

SEQ ID NO: 9109948 - DNA, 22 bp, Homo sapiens
cagcagctgggaaggaggctga

SEQ ID NO: 9109949 - DNA, 22 bp, Homo sapiens
cagcagctgggaaggaggctga

SEQ ID NO: 9109950 - DNA, 22 bp, Homo sapiens
cagcagctgatggggaagtgat

SEQ ID NO: 9109951 - DNA, 22 bp, Homo sapiens
cagcagctgatggggaagtgat

SEQ ID NO: 9109952 - DNA, 22 bp, Homo sapiens
cagcagctgatggggaagtgat

SEQ ID NO: 9109953 - DNA, 22 bp, Homo sapiens
cagcagctgcaaatggaaacag

SEQ ID NO: 9109954 - DNA, 23 bp, Homo sapiens
cagcagctgcctggttttttggt

SEQ ID NO: 9109955 - DNA, 22 bp, Homo sapiens
cagcagctgcctcagctgggga

SEQ ID NO: 9109956 - DNA, 22 bp, Homo sapiens
cagcagctagaggaagggcaga

SEQ ID NO: 9109957 - DNA, 22 bp, Homo sapiens
cagcagctagaggaagggcaga

SEQ ID NO: 9109958 - DNA, 22 bp, Homo sapiens
cagcactaatcctgcaatttct

SEQ ID NO: 9109959 - DNA, 22 bp, Homo sapiens
cagcactaggatatacatttcc

SEQ ID NO: 9109960 - DNA, 22 bp, Homo sapiens
cagcagctacttggagcagcag

SEQ ID NO: 9109961 - DNA, 22 bp, Homo sapiens
cagcaccttcctatccaggaga

SEQ ID NO: 9109962 - DNA, 22 bp, Homo sapiens
cagcaccttccttaactccagg

SEQ ID NO: 9109963 - DNA, 22 bp, Homo sapiens
cagcacctgttagcattaaata

SEQ ID NO: 9109964 - DNA, 22 bp, Homo sapiens
cagcacctgctcttagacacgg

SEQ ID NO: 9109965 - DNA, 22 bp, Homo sapiens
cagcaccattttcctggtcagc

SEQ ID NO: 9109966 - DNA, 22 bp, Homo sapiens
cagcacctccgcagttcacctg

SEQ ID NO: 9109967 - DNA, 22 bp, Homo sapiens
cagcacctccgcagttcacctg

SEQ ID NO: 9109968 - DNA, 18 bp, Homo sapiens
gtgctgtgggcagtggcc

SEQ ID NO: 9109969 - DNA, 18 bp, Homo sapiens
gtgctgtgggcagtggcc

SEQ ID NO: 9109970 - DNA, 22 bp, Homo sapiens
gtgctgtgtgatccatgctggc

SEQ ID NO: 9109971 - DNA, 22 bp, Homo sapiens
gtgctgtgtgatccatgctggc

SEQ ID NO: 9109972 - DNA, 22 bp, Homo sapiens
gtgctgtgtgatccatgctggc

SEQ ID NO: 9109973 - DNA, 22 bp, Homo sapiens
gtgccctcacaaagtggaaaga

SEQ ID NO: 9109974 - DNA, 22 bp, Homo sapiens
gtgccctcatgaaacgaaggat

SEQ ID NO: 9109975 - DNA, 22 bp, Homo sapiens
gtgccctcctgaagccatcaca

SEQ ID NO: 9109976 - DNA, 22 bp, Homo sapiens
gtgctgtgcgctttttctgtat

SEQ ID NO: 9109977 - DNA, 22 bp, Homo sapiens
cagccctgctgacactgtctga

SEQ ID NO: 9109978 - DNA, 22 bp, Homo sapiens
cagccctgctgacactgtctga

SEQ ID NO: 9109979 - DNA, 22 bp, Homo sapiens
cagccctgctgccttagtgcct

SEQ ID NO: 9109980 - DNA, 22 bp, Homo sapiens
cagccctgctgacactgtctga

SEQ ID NO: 9109981 - DNA, 22 bp, Homo sapiens
cagccctgctgacactgtctga

SEQ ID NO: 9109982 - DNA, 22 bp, Homo sapiens
cagccctgctcttagtgtctcc

SEQ ID NO: 9109983 - DNA, 22 bp, Homo sapiens
cagccctgctgacactgtctga

SEQ ID NO: 9109984 - DNA, 22 bp, Homo sapiens
cagccctgctcttagtgtctcc

SEQ ID NO: 9109985 - DNA, 22 bp, Homo sapiens
cagccctgctcttagtgtctcc

SEQ ID NO: 9109986 - DNA, 22 bp, Homo sapiens
cagccctgctcttagtgtctcc

SEQ ID NO: 9109987 - DNA, 22 bp, Homo sapiens
cagccctgctggcaatgatgag

SEQ ID NO: 9109988 - DNA, 22 bp, Homo sapiens
cagccctgctggcaatgatgag

SEQ ID NO: 9109989 - DNA, 22 bp, Homo sapiens
cagccctgctggttttgggcaa

SEQ ID NO: 9109990 - DNA, 22 bp, Homo sapiens
cagccctgctggttttgggcaa

SEQ ID NO: 9109991 - DNA, 22 bp, Homo sapiens
cagccctgctggttttgggcaa

SEQ ID NO: 9109992 - DNA, 22 bp, Homo sapiens
cagccctgcttccccgctagtt

SEQ ID NO: 9109993 - DNA, 22 bp, Homo sapiens
cagccctgcttccccgctagtt

SEQ ID NO: 9109994 - DNA, 22 bp, Homo sapiens
cagccctgcttccccgctagtt

SEQ ID NO: 9109995 - DNA, 22 bp, Homo sapiens
cagccctgcagccatggcctgt

SEQ ID NO: 9109996 - DNA, 22 bp, Homo sapiens
cagccctgcagctggatctcac

SEQ ID NO: 9109997 - DNA, 22 bp, Homo sapiens
cagccctgcagctggatctcac

SEQ ID NO: 9109998 - DNA, 22 bp, Homo sapiens
cagccctgcagccatggcctgt

SEQ ID NO: 9109999 - DNA, 22 bp, Homo sapiens
cagccctgcagccatggcctgt

SEQ ID NO: 9110000 - DNA, 22 bp, Homo sapiens
cagccctgaaacaacctcctct

SEQ ID NO: 9110001 - DNA, 22 bp, Homo sapiens
cagccctgcggaggtgtatact

SEQ ID NO: 9110002 - DNA, 17 bp, Homo sapiens
cagccctgccgttccca

SEQ ID NO: 9110003 - DNA, 17 bp, Homo sapiens
cagccctgccgttccca

SEQ ID NO: 9110004 - DNA, 22 bp, Homo sapiens
cagccctgccatggagcctcct

SEQ ID NO: 9110005 - DNA, 22 bp, Homo sapiens
cagccctgccatggagcctcct

SEQ ID NO: 9110006 - DNA, 22 bp, Homo sapiens
cagccctgccatggagcctcct

SEQ ID NO: 9110007 - DNA, 20 bp, Homo sapiens
cagcctccactcactcagct

SEQ ID NO: 9110008 - DNA, 22 bp, Homo sapiens
cagcctctttccacatcaggca

SEQ ID NO: 9110009 - DNA, 23 bp, Homo sapiens
cagccctggagatgtgggaggca

SEQ ID NO: 9110010 - DNA, 22 bp, Homo sapiens
cagccctggcagctttcagggt

SEQ ID NO: 9110011 - DNA, 22 bp, Homo sapiens
cagccctggcccaggtgcctta

SEQ ID NO: 9110012 - DNA, 22 bp, Homo sapiens
cagccctgcttccccgctagtt

SEQ ID NO: 9110013 - DNA, 22 bp, Homo sapiens
cagccctggaacagctgactca

SEQ ID NO: 9110014 - DNA, 22 bp, Homo sapiens
cagccctggaacagctgactca

SEQ ID NO: 9110015 - DNA, 23 bp, Homo sapiens
cagccctggagatgtgggaggca

SEQ ID NO: 9110016 - DNA, 22 bp, Homo sapiens
cagccctggaacagctgactca

SEQ ID NO: 9110017 - DNA, 22 bp, Homo sapiens
cagccctggaacagctgactca

SEQ ID NO: 9110018 - DNA, 23 bp, Homo sapiens
cagccctggagatgtgggaggca

SEQ ID NO: 9110019 - DNA, 23 bp, Homo sapiens
cagccctggagatgtgggaggca

SEQ ID NO: 9110020 - DNA, 22 bp, Homo sapiens
cagcctgccctggaagcccagc

SEQ ID NO: 9110021 - DNA, 22 bp, Homo sapiens
cagcctgccctggaagcccagc

SEQ ID NO: 9110022 - DNA, 22 bp, Homo sapiens
cagcctgcagggctgcctgttg

SEQ ID NO: 9110023 - DNA, 20 bp, Homo sapiens
cagcctgcatcatctgcagc

SEQ ID NO: 9110024 - DNA, 22 bp, Homo sapiens
cagcctgagccttctgtagcaa

SEQ ID NO: 9110025 - DNA, 22 bp, Homo sapiens
cagcctgactatggctgcaggt

SEQ ID NO: 9110026 - DNA, 22 bp, Homo sapiens
cagcctgagccttctgtagcaa

SEQ ID NO: 9110027 - DNA, 22 bp, Homo sapiens
cagcctgactatggctgcaggt

SEQ ID NO: 9110028 - DNA, 22 bp, Homo sapiens
cagcctgcagggctgcctgttg

SEQ ID NO: 9110029 - DNA, 22 bp, Homo sapiens
cagcctgagccttctgtagcaa

SEQ ID NO: 9110030 - DNA, 22 bp, Homo sapiens
cagcctctttccacatcaggca

SEQ ID NO: 9110031 - DNA, 22 bp, Homo sapiens
cagcctgacaccagctttgggc

SEQ ID NO: 9110032 - DNA, 22 bp, Homo sapiens
cagcctgactatggctgcaggt

SEQ ID NO: 9110033 - DNA, 22 bp, Homo sapiens
cagcctgacaccagctttgggc

SEQ ID NO: 9110034 - DNA, 22 bp, Homo sapiens
cagcctggattgcagaatgcta

SEQ ID NO: 9110035 - DNA, 22 bp, Homo sapiens
cagcctgggctccagagtccct

SEQ ID NO: 9110036 - DNA, 22 bp, Homo sapiens
cagcctggtccccggctcaccc

SEQ ID NO: 9110037 - DNA, 22 bp, Homo sapiens
cagcctggtccccggctcaccc

SEQ ID NO: 9110038 - DNA, 22 bp, Homo sapiens
cagcctgtagaatacagtaaat

SEQ ID NO: 9110039 - DNA, 22 bp, Homo sapiens
cagcctgtctgggcagagtgga

SEQ ID NO: 9110040 - DNA, 22 bp, Homo sapiens
cagcctggacagcgaccagagt

SEQ ID NO: 9110041 - DNA, 21 bp, Homo sapiens
cagcctgctgctccagggcca

SEQ ID NO: 9110042 - DNA, 22 bp, Homo sapiens
cagcctgctagggcaatgcctt

SEQ ID NO: 9110043 - DNA, 22 bp, Homo sapiens
cagcctgctagggcaatgcctt

SEQ ID NO: 9110044 - DNA, 21 bp, Homo sapiens
cagcctgctgctccagggcca

SEQ ID NO: 9110045 - DNA, 22 bp, Homo sapiens
cagcctggagccacagcccagg

SEQ ID NO: 9110046 - DNA, 22 bp, Homo sapiens
cagcctggagccacagcccagg

SEQ ID NO: 9110047 - DNA, 22 bp, Homo sapiens
cagcctggagccacagcccagg

SEQ ID NO: 9110048 - DNA, 22 bp, Homo sapiens
cagcctggagccacagcccagg

SEQ ID NO: 9110049 - DNA, 22 bp, Homo sapiens
cagctagtacaatgggagagca

SEQ ID NO: 9110050 - DNA, 20 bp, Homo sapiens
cagctagtggtaggagtcgg

SEQ ID NO: 9110051 - DNA, 22 bp, Homo sapiens
cagctagtcagaggcagggcca

SEQ ID NO: 9110052 - DNA, 22 bp, Homo sapiens
cagctagtcagaggcagggcca

SEQ ID NO: 9110053 - DNA, 22 bp, Homo sapiens
cagctagggagtggcagagctt

SEQ ID NO: 9110054 - DNA, 22 bp, Homo sapiens
cagctagtaaatggcaagacta

SEQ ID NO: 9110055 - DNA, 22 bp, Homo sapiens
gtgcccaggtgtccctgagaag

SEQ ID NO: 9110056 - DNA, 22 bp, Homo sapiens
gtgcccagtcctgccttgacag

SEQ ID NO: 9110057 - DNA, 22 bp, Homo sapiens
cagctacaggacctgatgcacc

SEQ ID NO: 9110058 - DNA, 22 bp, Homo sapiens
cagctacagtctgattggttca

SEQ ID NO: 9110059 - DNA, 22 bp, Homo sapiens
cagctacaaatacttttgtatg

SEQ ID NO: 9110060 - DNA, 22 bp, Homo sapiens
cagctaccatggtttgttccag

SEQ ID NO: 9110061 - DNA, 22 bp, Homo sapiens
cagctaccatggtttgttccag

SEQ ID NO: 9110062 - DNA, 22 bp, Homo sapiens
cagcacagtgaccagacccact

SEQ ID NO: 9110063 - DNA, 22 bp, Homo sapiens
cagcacagtgcagatgctgact

SEQ ID NO: 9110064 - DNA, 22 bp, Homo sapiens
cagcacagtgaccagacccact

SEQ ID NO: 9110065 - DNA, 22 bp, Homo sapiens
cagcacagtttcccccatgagc

SEQ ID NO: 9110066 - DNA, 22 bp, Homo sapiens
cagcacatgctcatcagggaag

SEQ ID NO: 9110067 - DNA, 19 bp, Homo sapiens
cagcacatgcttctctgag

SEQ ID NO: 9110068 - DNA, 22 bp, Homo sapiens
cagcaccatttgcagcctcttt

SEQ ID NO: 9110069 - DNA, 22 bp, Homo sapiens
cagcaccagcatattccagggc

SEQ ID NO: 9110070 - DNA, 22 bp, Homo sapiens
cagcacatagtaggtattcact

SEQ ID NO: 9110071 - DNA, 22 bp, Homo sapiens
cagcacataagccgaagactgt

SEQ ID NO: 9110072 - DNA, 22 bp, Homo sapiens
cagcacagtttgcttggcagag

SEQ ID NO: 9110073 - DNA, 22 bp, Homo sapiens
cagcacaattttcaggagtcca

SEQ ID NO: 9110074 - DNA, 22 bp, Homo sapiens
ggtgctgggaacgaggaattca

SEQ ID NO: 9110075 - DNA, 22 bp, Homo sapiens
ggtgctggacacgtggcactcc

SEQ ID NO: 9110076 - DNA, 22 bp, Homo sapiens
cagcaaggactgggcatgtgaa

SEQ ID NO: 9110077 - DNA, 22 bp, Homo sapiens
cagcaagagaggcagggcaaat

SEQ ID NO: 9110078 - DNA, 22 bp, Homo sapiens
cagcaagagactgttctctaag

SEQ ID NO: 9110079 - DNA, 22 bp, Homo sapiens
cagcaagattaagggcagaaaa

SEQ ID NO: 9110080 - DNA, 22 bp, Homo sapiens
cagcaagatttttaaagcaagg

SEQ ID NO: 9110081 - DNA, 21 bp, Homo sapiens
cagcaaggaagtcgagtaggt

SEQ ID NO: 9110082 - DNA, 22 bp, Homo sapiens
cagcaagatttttaaagcaagg

SEQ ID NO: 9110083 - DNA, 22 bp, Homo sapiens
ggtgagaaagggattcctgttc

SEQ ID NO: 9110084 - DNA, 17 bp, Homo sapiens
ggtgagacctcccactc

SEQ ID NO: 9110085 - DNA, 22 bp, Homo sapiens
ggtgagaaagggattcctgttc

SEQ ID NO: 9110086 - DNA, 22 bp, Homo sapiens
ggtgagaaaaatgagtatgatt

SEQ ID NO: 9110087 - DNA, 21 bp, Homo sapiens
cagcaagacatgtttatcaag

SEQ ID NO: 9110088 - DNA, 22 bp, Homo sapiens
cagcaagacagtttcctaagtg

SEQ ID NO: 9110089 - DNA, 22 bp, Homo sapiens
cagcaaagtaagctgacatgta

SEQ ID NO: 9110090 - DNA, 22 bp, Homo sapiens
cagcaaagtaagctgacatgta

SEQ ID NO: 9110091 - DNA, 22 bp, Homo sapiens
cagcaaagtaagctgacatgta

SEQ ID NO: 9110092 - DNA, 22 bp, Homo sapiens
cagcaaagtaagctgacatgta

SEQ ID NO: 9110093 - DNA, 22 bp, Homo sapiens
ggtctgagtgccagggagagaa

SEQ ID NO: 9110094 - DNA, 22 bp, Homo sapiens
ggtctgcccactactctccatt

SEQ ID NO: 9110095 - DNA, 22 bp, Homo sapiens
ggtctgccacaagatttttgag

SEQ ID NO: 9110096 - DNA, 22 bp, Homo sapiens
ggtctgccctgggtggaggcgc

SEQ ID NO: 9110097 - DNA, 22 bp, Homo sapiens
ggtctgagatatttgttcagct

SEQ ID NO: 9110098 - DNA, 18 bp, Homo sapiens
ggtctgagatcgtttttc

SEQ ID NO: 9110099 - DNA, 22 bp, Homo sapiens
ggtctgagcttgagcccatgct

SEQ ID NO: 9110100 - DNA, 22 bp, Homo sapiens
ggtctgagtagagggctggcga

SEQ ID NO: 9110101 - DNA, 22 bp, Homo sapiens
ggtctgaggctccaaggaggtg

SEQ ID NO: 9110102 - DNA, 22 bp, Homo sapiens
ggtgacagttccggaggtacag

SEQ ID NO: 9110103 - DNA, 22 bp, Homo sapiens
ggtgacagtggttaaaatttgt

SEQ ID NO: 9110104 - DNA, 22 bp, Homo sapiens
ggtgacagtggttaaaatttgt

SEQ ID NO: 9110105 - DNA, 22 bp, Homo sapiens
ggtgacagtggttaaaatttgt

SEQ ID NO: 9110106 - DNA, 22 bp, Homo sapiens
ggtgacagtggttaaaatttgt

SEQ ID NO: 9110107 - DNA, 22 bp, Homo sapiens
ggggagcaatagttgaggtgtg

SEQ ID NO: 9110108 - DNA, 22 bp, Homo sapiens
ggggagcagaagcagcaacaac

SEQ ID NO: 9110109 - DNA, 19 bp, Homo sapiens
cagaggcaccaggtataga

SEQ ID NO: 9110110 - DNA, 22 bp, Homo sapiens
cagaggcacaagaaagcaaggc

SEQ ID NO: 9110111 - DNA, 22 bp, Homo sapiens
cagaggcacagtgcgggccact

SEQ ID NO: 9110112 - DNA, 21 bp, Homo sapiens
cagaggggctagcctggctgc

SEQ ID NO: 9110113 - DNA, 21 bp, Homo sapiens
cagaggggctagcctggctgc

SEQ ID NO: 9110114 - DNA, 22 bp, Homo sapiens
cagaggggctgacacccttggc

SEQ ID NO: 9110115 - DNA, 22 bp, Homo sapiens
cagaggggataacaggtgtaga

SEQ ID NO: 9110116 - DNA, 21 bp, Homo sapiens
cagagggcttttctctgttct

SEQ ID NO: 9110117 - DNA, 22 bp, Homo sapiens
cagaggggtgtagagatcactg

SEQ ID NO: 9110118 - DNA, 22 bp, Homo sapiens
cagagggaaaaggggagtaata

SEQ ID NO: 9110119 - DNA, 22 bp, Homo sapiens
cagagggctcagtcctgctgga

SEQ ID NO: 9110120 - DNA, 22 bp, Homo sapiens
cagagggctcggcggccgctcc

SEQ ID NO: 9110121 - DNA, 22 bp, Homo sapiens
cagagggctgtgtaaggatgtt

SEQ ID NO: 9110122 - DNA, 22 bp, Homo sapiens
cagagggctgccctgagttcgt

SEQ ID NO: 9110123 - DNA, 22 bp, Homo sapiens
ggtcctgggaagatgctcatga

SEQ ID NO: 9110124 - DNA, 22 bp, Homo sapiens
cagagtctggactgcaggctcc

SEQ ID NO: 9110125 - DNA, 22 bp, Homo sapiens
cagagtcttgtgtgttcagccc

SEQ ID NO: 9110126 - DNA, 17 bp, Homo sapiens
cagagtctgtctgcatc

SEQ ID NO: 9110127 - DNA, 22 bp, Homo sapiens
cagagtctctgggaggctgggt

SEQ ID NO: 9110128 - DNA, 22 bp, Homo sapiens
cagagtcctgcaccagctccag

SEQ ID NO: 9110129 - DNA, 22 bp, Homo sapiens
cagagtcctggacacagagaca

SEQ ID NO: 9110130 - DNA, 22 bp, Homo sapiens
cagagtcccagatgcccctcct

SEQ ID NO: 9110131 - DNA, 22 bp, Homo sapiens
cagagtcatgggccgtcaggca

SEQ ID NO: 9110132 - DNA, 22 bp, Homo sapiens
cagagtcatgggccgtcaggca

SEQ ID NO: 9110133 - DNA, 22 bp, Homo sapiens
cagagtcagtattgaattgaaa

SEQ ID NO: 9110134 - DNA, 22 bp, Homo sapiens
ggtccaaggctcggtggcgggg

SEQ ID NO: 9110135 - DNA, 22 bp, Homo sapiens
ggtcattgaaatcagaagggtt

SEQ ID NO: 9110136 - DNA, 22 bp, Homo sapiens
cagaggtacagccattgaagat

SEQ ID NO: 9110137 - DNA, 22 bp, Homo sapiens
cagaggtaccagcagcctctgg

SEQ ID NO: 9110138 - DNA, 22 bp, Homo sapiens
cagaggtacaagctaagttggg

SEQ ID NO: 9110139 - DNA, 22 bp, Homo sapiens
cagaggtagaaggcatgcagtg

SEQ ID NO: 9110140 - DNA, 22 bp, Homo sapiens
cagaggtagaactggccctcac

SEQ ID NO: 9110141 - DNA, 22 bp, Homo sapiens
cagaggtagaaggcatgcagtg

SEQ ID NO: 9110142 - DNA, 22 bp, Homo sapiens
cagaggtagcatgctgtggctt

SEQ ID NO: 9110143 - DNA, 22 bp, Homo sapiens
ggtcacagggaagggctctcaa

SEQ ID NO: 9110144 - DNA, 22 bp, Homo sapiens
cagaggtagaaggcatgcagtg

SEQ ID NO: 9110145 - DNA, 22 bp, Homo sapiens
ggtcagtgacttttttctgtgg

SEQ ID NO: 9110146 - DNA, 22 bp, Homo sapiens
ggtcagtgacttttttctgtgg

SEQ ID NO: 9110147 - DNA, 23 bp, Homo sapiens
ggtcagtgagttcgtttctctgg

SEQ ID NO: 9110148 - DNA, 23 bp, Homo sapiens
ggtcagtgagttcgtttctctgg

SEQ ID NO: 9110149 - DNA, 22 bp, Homo sapiens
ggtcagtgcgatttcccactcc

SEQ ID NO: 9110150 - DNA, 22 bp, Homo sapiens
ggtcatctgcctccaaagcact

SEQ ID NO: 9110151 - DNA, 22 bp, Homo sapiens
ggtcagtgtacacatgtgcagg

SEQ ID NO: 9110152 - DNA, 22 bp, Homo sapiens
ggtcagtgtttcatctgtgaaa

SEQ ID NO: 9110153 - DNA, 22 bp, Homo sapiens
ggtcagtgctgccagagtgacc

SEQ ID NO: 9110154 - DNA, 22 bp, Homo sapiens
ggtcagtggcagggggtacttc

SEQ ID NO: 9110155 - DNA, 21 bp, Homo sapiens
ggtcagtggctttcttgcacc

SEQ ID NO: 9110156 - DNA, 22 bp, Homo sapiens
cagacagggtcctgtccgtcac

SEQ ID NO: 9110157 - DNA, 22 bp, Homo sapiens
ggcttaggtgtctctctgcacc

SEQ ID NO: 9110158 - DNA, 22 bp, Homo sapiens
ggcttatgtttgtcaagcaatc

SEQ ID NO: 9110159 - DNA, 22 bp, Homo sapiens
ggcttagcaactcctgaggctc

SEQ ID NO: 9110160 - DNA, 22 bp, Homo sapiens
cagaccagccatttgcctcttc

SEQ ID NO: 9110161 - DNA, 22 bp, Homo sapiens
cagacatggcgccaagtgctag

SEQ ID NO: 9110162 - DNA, 22 bp, Homo sapiens
cagacatggcgccaagtgctag

SEQ ID NO: 9110163 - DNA, 22 bp, Homo sapiens
cagacccaggatccaaatgttg

SEQ ID NO: 9110164 - DNA, 21 bp, Homo sapiens
cagaccattgcatgagcaggt

SEQ ID NO: 9110165 - DNA, 22 bp, Homo sapiens
cagaccatcttgaagcaaactg

SEQ ID NO: 9110166 - DNA, 22 bp, Homo sapiens
cagaccatcttgaagcaaactg

SEQ ID NO: 9110167 - DNA, 22 bp, Homo sapiens
cagaccctcgggtgagttggcc

SEQ ID NO: 9110168 - DNA, 22 bp, Homo sapiens
cagaccccgagtttgcagagtt

SEQ ID NO: 9110169 - DNA, 22 bp, Homo sapiens
cagacccaggatccaaatgttg

SEQ ID NO: 9110170 - DNA, 22 bp, Homo sapiens
cagacccttttctgagaggacc

SEQ ID NO: 9110171 - DNA, 22 bp, Homo sapiens
cagaccctcgggtgagttggcc

SEQ ID NO: 9110172 - DNA, 22 bp, Homo sapiens
cagaccctgggccacagaggag

SEQ ID NO: 9110173 - DNA, 22 bp, Homo sapiens
cagacctggaaaacaggcttgc

SEQ ID NO: 9110174 - DNA, 23 bp, Homo sapiens
cagacctggcagtcatcctcaac

SEQ ID NO: 9110175 - DNA, 22 bp, Homo sapiens
cagacctggaaaacaggcttgc

SEQ ID NO: 9110176 - DNA, 20 bp, Homo sapiens
cagacctgcacccacttcga

SEQ ID NO: 9110177 - DNA, 22 bp, Homo sapiens
cagacctggaaaacaggcttgc

SEQ ID NO: 9110178 - DNA, 20 bp, Homo sapiens
cagacctgcacccacttcga

SEQ ID NO: 9110179 - DNA, 22 bp, Homo sapiens
cagacctgaggttgagtaccag

SEQ ID NO: 9110180 - DNA, 20 bp, Homo sapiens
cagacctgcacccacttcga

SEQ ID NO: 9110181 - DNA, 22 bp, Homo sapiens
cagacctgggtccctggcctgt

SEQ ID NO: 9110182 - DNA, 22 bp, Homo sapiens
cagacctgggtccctggcctgt

SEQ ID NO: 9110183 - DNA, 19 bp, Homo sapiens
cagacctgtccagcctgtg

SEQ ID NO: 9110184 - DNA, 22 bp, Homo sapiens
cagactctgatgcagccttgtg

SEQ ID NO: 9110185 - DNA, 22 bp, Homo sapiens
cagactggccacatctgcactg

SEQ ID NO: 9110186 - DNA, 22 bp, Homo sapiens
cagactggccacatctgcactg

SEQ ID NO: 9110187 - DNA, 22 bp, Homo sapiens
cagagacaggatctcgaagact

SEQ ID NO: 9110188 - DNA, 22 bp, Homo sapiens
cagagacaggatctcgaagact

SEQ ID NO: 9110189 - DNA, 22 bp, Homo sapiens
cagagacaggaatcagctgcag

SEQ ID NO: 9110190 - DNA, 22 bp, Homo sapiens
cagagacaggaatcagctgcag

SEQ ID NO: 9110191 - DNA, 22 bp, Homo sapiens
cagagacaggaatcagctgcag

SEQ ID NO: 9110192 - DNA, 22 bp, Homo sapiens
gggcagtgggtggctgcagcct

SEQ ID NO: 9110193 - DNA, 22 bp, Homo sapiens
gggcagtgggaccaggcaccag

SEQ ID NO: 9110194 - DNA, 22 bp, Homo sapiens
gggcagtgggaccaggcaccag

SEQ ID NO: 9110195 - DNA, 22 bp, Homo sapiens
gggcagtggctcacgcctgtaa

SEQ ID NO: 9110196 - DNA, 20 bp, Homo sapiens
gggcagtggcgctatctcag

SEQ ID NO: 9110197 - DNA, 20 bp, Homo sapiens
gggcagtggcgctatctcag

SEQ ID NO: 9110198 - DNA, 22 bp, Homo sapiens
gggcagtggtccaggctacagc

SEQ ID NO: 9110199 - DNA, 22 bp, Homo sapiens
gggcagtgggtggctgcagcct

SEQ ID NO: 9110200 - DNA, 22 bp, Homo sapiens
gggcagtggttacacagctgag

SEQ ID NO: 9110201 - DNA, 22 bp, Homo sapiens
gggcagcattctgtgggcaggt

SEQ ID NO: 9110202 - DNA, 22 bp, Homo sapiens
gggcagcatgtcactagcatgg

SEQ ID NO: 9110203 - DNA, 22 bp, Homo sapiens
gggcagcatgaggaccctcatc

SEQ ID NO: 9110204 - DNA, 22 bp, Homo sapiens
gggcagcagttgccctaatcaa

SEQ ID NO: 9110205 - DNA, 22 bp, Homo sapiens
gggcagcatgaggaccctcatc

SEQ ID NO: 9110206 - DNA, 22 bp, Homo sapiens
gggcagcatcaggaggggcttt

SEQ ID NO: 9110207 - DNA, 22 bp, Homo sapiens
gggcagcagcaggaggtctctg

SEQ ID NO: 9110208 - DNA, 22 bp, Homo sapiens
gggcagcagcaggaggtctctg

SEQ ID NO: 9110209 - DNA, 22 bp, Homo sapiens
gggcagcagagccctgccgagt

SEQ ID NO: 9110210 - DNA, 21 bp, Homo sapiens
gggcagcagcagcaacaaggg

SEQ ID NO: 9110211 - DNA, 22 bp, Homo sapiens
cagagctggctctgcatgtaca

SEQ ID NO: 9110212 - DNA, 22 bp, Homo sapiens
cagagctgcttcccagtttgtg

SEQ ID NO: 9110213 - DNA, 22 bp, Homo sapiens
cagagcctgcctctggctgtgg

SEQ ID NO: 9110214 - DNA, 22 bp, Homo sapiens
cagagcctccctcctctgccat

SEQ ID NO: 9110215 - DNA, 22 bp, Homo sapiens
cagagcctccctcctctgccat

SEQ ID NO: 9110216 - DNA, 22 bp, Homo sapiens
cagagcctctcagaggtcagac

SEQ ID NO: 9110217 - DNA, 22 bp, Homo sapiens
cagagcctctcagaggtcagac

SEQ ID NO: 9110218 - DNA, 22 bp, Homo sapiens
cagagcctctgccctgggcact

SEQ ID NO: 9110219 - DNA, 22 bp, Homo sapiens
cagagcctctgccctgggcact

SEQ ID NO: 9110220 - DNA, 23 bp, Homo sapiens
cagagctggcttcatgggtgtgc

SEQ ID NO: 9110221 - DNA, 23 bp, Homo sapiens
cagagctggcttcatgggtgtgc

SEQ ID NO: 9110222 - DNA, 22 bp, Homo sapiens
cagagctgggatcccatgggcg

SEQ ID NO: 9110223 - DNA, 23 bp, Homo sapiens
cagagctggcttcatgggtgtgc

SEQ ID NO: 9110224 - DNA, 22 bp, Homo sapiens
cagagctgggcatggtgaaagg

SEQ ID NO: 9110225 - DNA, 22 bp, Homo sapiens
cagagctgggtttgggaaacct

SEQ ID NO: 9110226 - DNA, 22 bp, Homo sapiens
cagagctgggcatggtgaaagg

SEQ ID NO: 9110227 - DNA, 22 bp, Homo sapiens
gggctgaggggtatctcatggg

SEQ ID NO: 9110228 - DNA, 22 bp, Homo sapiens
cagagctgggtttgggaaacct

SEQ ID NO: 9110229 - DNA, 22 bp, Homo sapiens
gggctgaggggtatctcatggg

SEQ ID NO: 9110230 - DNA, 22 bp, Homo sapiens
gggctgagtctgctgcctgtca

SEQ ID NO: 9110231 - DNA, 22 bp, Homo sapiens
cagaggcaaaagaggtggaggt

SEQ ID NO: 9110232 - DNA, 22 bp, Homo sapiens
cagaggcaaaagaggtggaggt

SEQ ID NO: 9110233 - DNA, 20 bp, Homo sapiens
cagaggcaaggagacttgga

SEQ ID NO: 9110234 - DNA, 22 bp, Homo sapiens
cagaggacttcccactcatctg

SEQ ID NO: 9110235 - DNA, 22 bp, Homo sapiens
cagaggatatatggtttgtatg

SEQ ID NO: 9110236 - DNA, 22 bp, Homo sapiens
cagaggattatggagatggtct

SEQ ID NO: 9110237 - DNA, 22 bp, Homo sapiens
cagagcctaaaacgactccact

SEQ ID NO: 9110238 - DNA, 22 bp, Homo sapiens
cagagcctaaaacgactccact

SEQ ID NO: 9110239 - DNA, 22 bp, Homo sapiens
cagagcctaaaacgactccact

SEQ ID NO: 9110240 - DNA, 22 bp, Homo sapiens
cagagcctcatcatccactcca

SEQ ID NO: 9110241 - DNA, 22 bp, Homo sapiens
cagagcctccctcctctgccat

SEQ ID NO: 9110242 - DNA, 19 bp, Homo sapiens
cagagcctcagagctagaa

SEQ ID NO: 9110243 - DNA, 19 bp, Homo sapiens
cagagcctcagagctagaa

SEQ ID NO: 9110244 - DNA, 22 bp, Homo sapiens
gggctctgtttagatcagagat

SEQ ID NO: 9110245 - DNA, 22 bp, Homo sapiens
gggctcttttctgagcttcact

SEQ ID NO: 9110246 - DNA, 22 bp, Homo sapiens
gggctgaactcaagtcagctcc

SEQ ID NO: 9110247 - DNA, 22 bp, Homo sapiens
gggccagcagtatcggaggcat

SEQ ID NO: 9110248 - DNA, 22 bp, Homo sapiens
gggccagacctcttctcaggga

SEQ ID NO: 9110249 - DNA, 22 bp, Homo sapiens
gggccagacctcttctcaggga

SEQ ID NO: 9110250 - DNA, 22 bp, Homo sapiens
gggccagagcacagaggatgtt

SEQ ID NO: 9110251 - DNA, 22 bp, Homo sapiens
gggccagagcttggcagctggg

SEQ ID NO: 9110252 - DNA, 22 bp, Homo sapiens
gggccacctggattccatgtgt

SEQ ID NO: 9110253 - DNA, 22 bp, Homo sapiens
gggcagtgtcggggcccaggga

SEQ ID NO: 9110254 - DNA, 22 bp, Homo sapiens
gggcagtgtcgaggtctggtcc

SEQ ID NO: 9110255 - DNA, 22 bp, Homo sapiens
gggcagtgtctggcccccaggc

SEQ ID NO: 9110256 - DNA, 22 bp, Homo sapiens
gggcagtgtggtcgtgcctttg

SEQ ID NO: 9110257 - DNA, 22 bp, Homo sapiens
gggcagtgtctgcaaatgaaca

SEQ ID NO: 9110258 - DNA, 22 bp, Homo sapiens
caagtttaaggcactgataagt

SEQ ID NO: 9110259 - DNA, 22 bp, Homo sapiens
caagtttacaatgtgtatgtgt

SEQ ID NO: 9110260 - DNA, 22 bp, Homo sapiens
gctgttctgcgtcccaggctgg

SEQ ID NO: 9110261 - DNA, 22 bp, Homo sapiens
caagtcaagcatgcccttattt

SEQ ID NO: 9110262 - DNA, 22 bp, Homo sapiens
caagtcaactcaaattgttatc

SEQ ID NO: 9110263 - DNA, 22 bp, Homo sapiens
caagtatttgcggagttccacg

SEQ ID NO: 9110264 - DNA, 22 bp, Homo sapiens
caagtattttaaggactagtgg

SEQ ID NO: 9110265 - DNA, 22 bp, Homo sapiens
gctgttcctgcttagaggtcgg

SEQ ID NO: 9110266 - DNA, 22 bp, Homo sapiens
gctgttcccatgtggggctcag

SEQ ID NO: 9110267 - DNA, 22 bp, Homo sapiens
gctgttcatagaaatggtctca

SEQ ID NO: 9110268 - DNA, 22 bp, Homo sapiens
gctgttcaagactaggaaattt

SEQ ID NO: 9110269 - DNA, 22 bp, Homo sapiens
caagtatttcctgatggcctgt

SEQ ID NO: 9110270 - DNA, 22 bp, Homo sapiens
caagtatttcctgatggcctgt

SEQ ID NO: 9110271 - DNA, 22 bp, Homo sapiens
caagtatgagaaagctattacc

SEQ ID NO: 9110272 - DNA, 22 bp, Homo sapiens
caagtattctgtaaaaagtcaa

SEQ ID NO: 9110273 - DNA, 22 bp, Homo sapiens
caagtatgagaaagctattacc

SEQ ID NO: 9110274 - DNA, 22 bp, Homo sapiens
caagtactgtgatagctgaagt

SEQ ID NO: 9110275 - DNA, 22 bp, Homo sapiens
caagtactttgaaaagttgaat

SEQ ID NO: 9110276 - DNA, 22 bp, Homo sapiens
caaggtgaacttgctgtacagc

SEQ ID NO: 9110277 - DNA, 22 bp, Homo sapiens
caaggtgattgggatagctggt

SEQ ID NO: 9110278 - DNA, 22 bp, Homo sapiens
caaggtgatacttacattagtg

SEQ ID NO: 9110279 - DNA, 22 bp, Homo sapiens
caaggtgccatgctgggcgggg

SEQ ID NO: 9110280 - DNA, 22 bp, Homo sapiens
caaggttccagaattatgctct

SEQ ID NO: 9110281 - DNA, 22 bp, Homo sapiens
gctttcttagtgtgttaattgg

SEQ ID NO: 9110282 - DNA, 17 bp, Homo sapiens
gcttgggctgcctgttg

SEQ ID NO: 9110283 - DNA, 22 bp, Homo sapiens
caataaagaagatttttgcaat

SEQ ID NO: 9110284 - DNA, 22 bp, Homo sapiens
caataactgctaaattccctgt

SEQ ID NO: 9110285 - DNA, 22 bp, Homo sapiens
caagttttgattttgcagtaaa

SEQ ID NO: 9110286 - DNA, 22 bp, Homo sapiens
caagtttgtgttctatcattct

SEQ ID NO: 9110287 - DNA, 22 bp, Homo sapiens
caagtttgctgatccttgtttt

SEQ ID NO: 9110288 - DNA, 22 bp, Homo sapiens
caagttttagaaatatctggat

SEQ ID NO: 9110289 - DNA, 22 bp, Homo sapiens
caagttttctgggttcagagca

SEQ ID NO: 9110290 - DNA, 22 bp, Homo sapiens
gctttgcacaacctttaagaca

SEQ ID NO: 9110291 - DNA, 22 bp, Homo sapiens
gctttgcacagattaggttatt

SEQ ID NO: 9110292 - DNA, 22 bp, Homo sapiens
gctttgcacagtgctgtgttaa

SEQ ID NO: 9110293 - DNA, 22 bp, Homo sapiens
gctttgcacagtgctgtgttaa

SEQ ID NO: 9110294 - DNA, 22 bp, Homo sapiens
gctttcttttcaagaatgtatt

SEQ ID NO: 9110295 - DNA, 22 bp, Homo sapiens
gctttcttggttctgcaggggc

SEQ ID NO: 9110296 - DNA, 22 bp, Homo sapiens
gctttcttgctgcatggtggct

SEQ ID NO: 9110297 - DNA, 18 bp, Homo sapiens
gctttgcactcatgttgt

SEQ ID NO: 9110298 - DNA, 18 bp, Homo sapiens
gctttgcactcatgttgt

SEQ ID NO: 9110299 - DNA, 22 bp, Homo sapiens
gctttgcactccagctgtggcc

SEQ ID NO: 9110300 - DNA, 22 bp, Homo sapiens
gctttgcactctgatccttccc

SEQ ID NO: 9110301 - DNA, 18 bp, Homo sapiens
gctttgcagaaatacaga

SEQ ID NO: 9110302 - DNA, 22 bp, Homo sapiens
gctttgcagacaaaattccagc

SEQ ID NO: 9110303 - DNA, 22 bp, Homo sapiens
gctttgcagacaaaattccagc

SEQ ID NO: 9110304 - DNA, 22 bp, Homo sapiens
gctttgcaggaaaccagtgcat

SEQ ID NO: 9110305 - DNA, 22 bp, Homo sapiens
gctttgcattcttgtgtgatca

SEQ ID NO: 9110306 - DNA, 22 bp, Homo sapiens
gctttgcattgtgatgggatgc

SEQ ID NO: 9110307 - DNA, 22 bp, Homo sapiens
gctttgcattgtgatgggatgc

SEQ ID NO: 9110308 - DNA, 22 bp, Homo sapiens
gctttgcattgtttaatcagga

SEQ ID NO: 9110309 - DNA, 22 bp, Homo sapiens
gctttgcctgtagcattggcct

SEQ ID NO: 9110310 - DNA, 22 bp, Homo sapiens
gctttgctagcactgcgcttcc

SEQ ID NO: 9110311 - DNA, 22 bp, Homo sapiens
caatgtgtgtgtttttctcaac

SEQ ID NO: 9110312 - DNA, 22 bp, Homo sapiens
caatgtgtttgcatattaaaat

SEQ ID NO: 9110313 - DNA, 22 bp, Homo sapiens
caatgtatcaagaagcatcagt

SEQ ID NO: 9110314 - DNA, 22 bp, Homo sapiens
gctttgctagcactgcgcttcc

SEQ ID NO: 9110315 - DNA, 22 bp, Homo sapiens
caatgtcaaggagaccaaaacg

SEQ ID NO: 9110316 - DNA, 22 bp, Homo sapiens
caatgtcatgattttccattag

SEQ ID NO: 9110317 - DNA, 22 bp, Homo sapiens
gctggaggcagttcagacacca

SEQ ID NO: 9110318 - DNA, 22 bp, Homo sapiens
gctggaggcagttcagacacca

SEQ ID NO: 9110319 - DNA, 22 bp, Homo sapiens
gctggaggcagttcagacacca

SEQ ID NO: 9110320 - DNA, 22 bp, Homo sapiens
gctggaggctggagtgcagtgg

SEQ ID NO: 9110321 - DNA, 22 bp, Homo sapiens
gctggaggctggagtgcagtgg

SEQ ID NO: 9110322 - DNA, 22 bp, Homo sapiens
caaggcaggaagcctgtcttat

SEQ ID NO: 9110323 - DNA, 22 bp, Homo sapiens
caaggccaagtctctgtgaaga

SEQ ID NO: 9110324 - DNA, 22 bp, Homo sapiens
caaggccaaggttttgtgaact

SEQ ID NO: 9110325 - DNA, 22 bp, Homo sapiens
caaggccacgttctgcatgcgg

SEQ ID NO: 9110326 - DNA, 19 bp, Homo sapiens
caaggccaccatttctccg

SEQ ID NO: 9110327 - DNA, 22 bp, Homo sapiens
caaggccactccagagactggt

SEQ ID NO: 9110328 - DNA, 22 bp, Homo sapiens
caaggccagtccattttggaag

SEQ ID NO: 9110329 - DNA, 22 bp, Homo sapiens
caaggccagttcaccaagggca

SEQ ID NO: 9110330 - DNA, 22 bp, Homo sapiens
caaggccagtttctcctagtca

SEQ ID NO: 9110331 - DNA, 22 bp, Homo sapiens
caaggccactgctcaggtttcc

SEQ ID NO: 9110332 - DNA, 22 bp, Homo sapiens
caaggccagagccagcgataag

SEQ ID NO: 9110333 - DNA, 17 bp, Homo sapiens
caaggccagcatcttca

SEQ ID NO: 9110334 - DNA, 22 bp, Homo sapiens
caaggccagggaatttttctgg

SEQ ID NO: 9110335 - DNA, 22 bp, Homo sapiens
caaggcctcctgggcccagaga

SEQ ID NO: 9110336 - DNA, 22 bp, Homo sapiens
caaggcctgcctctggcagaaa

SEQ ID NO: 9110337 - DNA, 22 bp, Homo sapiens
caaggcctgactgcttgtctaa

SEQ ID NO: 9110338 - DNA, 22 bp, Homo sapiens
caaggccataagagatacaaaa

SEQ ID NO: 9110339 - DNA, 22 bp, Homo sapiens
caaggccatgagcagcgagtgt

SEQ ID NO: 9110340 - DNA, 22 bp, Homo sapiens
caaggccatattgcctgtatgt

SEQ ID NO: 9110341 - DNA, 22 bp, Homo sapiens
caaggccctgcaacctgacttg

SEQ ID NO: 9110342 - DNA, 21 bp, Homo sapiens
gctggctgtcccagggaagca

SEQ ID NO: 9110343 - DNA, 21 bp, Homo sapiens
gctggctgtcccagggaagca

SEQ ID NO: 9110344 - DNA, 22 bp, Homo sapiens
caagggtgaaggcagaggacat

SEQ ID NO: 9110345 - DNA, 22 bp, Homo sapiens
caagggggcaggatcacacttg

SEQ ID NO: 9110346 - DNA, 22 bp, Homo sapiens
gctggctgtatcacctggccag

SEQ ID NO: 9110347 - DNA, 22 bp, Homo sapiens
gctggctgggtccctgagaggc

SEQ ID NO: 9110348 - DNA, 22 bp, Homo sapiens
gctggctgggtccctgagaggc

SEQ ID NO: 9110349 - DNA, 22 bp, Homo sapiens
gctggctgggacagattccatt

SEQ ID NO: 9110350 - DNA, 22 bp, Homo sapiens
caaggccttcgtctcctagctt

SEQ ID NO: 9110351 - DNA, 20 bp, Homo sapiens
caaggcctggatctagttgc

SEQ ID NO: 9110352 - DNA, 22 bp, Homo sapiens
gctggctggctgtgcaaaggca

SEQ ID NO: 9110353 - DNA, 22 bp, Homo sapiens
caagcagccccaacatgaggat

SEQ ID NO: 9110354 - DNA, 22 bp, Homo sapiens
caagcagatattttagtcaaga

SEQ ID NO: 9110355 - DNA, 22 bp, Homo sapiens
caagattcattttgtccttgtc

SEQ ID NO: 9110356 - DNA, 22 bp, Homo sapiens
caagattcagagtcttctaacc

SEQ ID NO: 9110357 - DNA, 22 bp, Homo sapiens
caaatgtggtttctcagcattc

SEQ ID NO: 9110358 - DNA, 22 bp, Homo sapiens
gctggaggatggactggaagaa

SEQ ID NO: 9110359 - DNA, 22 bp, Homo sapiens
gctggaggatggactggaagaa

SEQ ID NO: 9110360 - DNA, 22 bp, Homo sapiens
gctggaggatggactggaagaa

SEQ ID NO: 9110361 - DNA, 22 bp, Homo sapiens
gctggaggatcacttgagccca

SEQ ID NO: 9110362 - DNA, 22 bp, Homo sapiens
gctggaggatggactggaagaa

SEQ ID NO: 9110363 - DNA, 22 bp, Homo sapiens
gctggaggaggaagtgtgaggg

SEQ ID NO: 9110364 - DNA, 21 bp, Homo sapiens
caagccagaccaatagcagcc

SEQ ID NO: 9110365 - DNA, 22 bp, Homo sapiens
caagcatgtcttcttaagcaat

SEQ ID NO: 9110366 - DNA, 22 bp, Homo sapiens
caagcaggtttgctattttctt

SEQ ID NO: 9110367 - DNA, 22 bp, Homo sapiens
caagcagggtttatgcatggag

SEQ ID NO: 9110368 - DNA, 22 bp, Homo sapiens
caagccagctcctgccacagag

SEQ ID NO: 9110369 - DNA, 22 bp, Homo sapiens
ggagcctgcgggagctcccatt

SEQ ID NO: 9110370 - DNA, 22 bp, Homo sapiens
ggagcctgcgggagctcccatt

SEQ ID NO: 9110371 - DNA, 22 bp, Homo sapiens
ggagctgctccttcagccaagt

SEQ ID NO: 9110372 - DNA, 22 bp, Homo sapiens
ggagctgctcagagccagtccc

SEQ ID NO: 9110373 - DNA, 22 bp, Homo sapiens
ggagcctgcgggagctcccatt

SEQ ID NO: 9110374 - DNA, 23 bp, Homo sapiens
ggagctgctgttgggggagctgc

SEQ ID NO: 9110375 - DNA, 22 bp, Homo sapiens
ggagcctgagggccctcttgga

SEQ ID NO: 9110376 - DNA, 22 bp, Homo sapiens
ggagcctgagcggcccagggcc

SEQ ID NO: 9110377 - DNA, 22 bp, Homo sapiens
ggagcctgagcggcccagggcc

SEQ ID NO: 9110378 - DNA, 22 bp, Homo sapiens
ggagcctgacagtgcccagcat

SEQ ID NO: 9110379 - DNA, 22 bp, Homo sapiens
ggagcctgaaaagtctgcattt

SEQ ID NO: 9110380 - DNA, 23 bp, Homo sapiens
ggagcctccggtgtgtgagaggc

SEQ ID NO: 9110381 - DNA, 22 bp, Homo sapiens
ggagcctgacagtgcccagcat

SEQ ID NO: 9110382 - DNA, 22 bp, Homo sapiens
ggagctggcagcgcaacccaga

SEQ ID NO: 9110383 - DNA, 22 bp, Homo sapiens
ggagctggcagcgcaacccaga

SEQ ID NO: 9110384 - DNA, 20 bp, Homo sapiens
ggagctggcatccagcctct

SEQ ID NO: 9110385 - DNA, 22 bp, Homo sapiens
ggagctggagagtacagagttt

SEQ ID NO: 9110386 - DNA, 22 bp, Homo sapiens
ggagctggcagcgcaacccaga

SEQ ID NO: 9110387 - DNA, 22 bp, Homo sapiens
ggagctggagagtacagagttt

SEQ ID NO: 9110388 - DNA, 22 bp, Homo sapiens
ggagctggagagctagcctagg

SEQ ID NO: 9110389 - DNA, 23 bp, Homo sapiens
ggagctggacccttacacctttc

SEQ ID NO: 9110390 - DNA, 22 bp, Homo sapiens
ggagctgctttgatctgaagaa

SEQ ID NO: 9110391 - DNA, 22 bp, Homo sapiens
ggagctggaatatattgaaacc

SEQ ID NO: 9110392 - DNA, 22 bp, Homo sapiens
ggagcccttggcacctagtagg

SEQ ID NO: 9110393 - DNA, 19 bp, Homo sapiens
ggagccgccgcccttcatt

SEQ ID NO: 9110394 - DNA, 22 bp, Homo sapiens
ggagccctgccctaggcagctc

SEQ ID NO: 9110395 - DNA, 22 bp, Homo sapiens
ggagcccttctattccatggag

SEQ ID NO: 9110396 - DNA, 22 bp, Homo sapiens
ggagcccttgctgaccttccaa

SEQ ID NO: 9110397 - DNA, 22 bp, Homo sapiens
ggagccctcaccggcgagtgcc

SEQ ID NO: 9110398 - DNA, 22 bp, Homo sapiens
ggagccctccatcccttgcggc

SEQ ID NO: 9110399 - DNA, 22 bp, Homo sapiens
cacagatgagctgaatagcttt

SEQ ID NO: 9110400 - DNA, 22 bp, Homo sapiens
cacagatgaagtaaacaactct

SEQ ID NO: 9110401 - DNA, 22 bp, Homo sapiens
cacagatagaccttatgagatt

SEQ ID NO: 9110402 - DNA, 22 bp, Homo sapiens
cacagatagaccttatgagatt

SEQ ID NO: 9110403 - DNA, 22 bp, Homo sapiens
cacagatgaagtaaacaactct

SEQ ID NO: 9110404 - DNA, 22 bp, Homo sapiens
cacagagtggaggcttggcctg

SEQ ID NO: 9110405 - DNA, 22 bp, Homo sapiens
cacagaggtgatagtggtcaag

SEQ ID NO: 9110406 - DNA, 22 bp, Homo sapiens
cacagaggtgatagtggtcaag

SEQ ID NO: 9110407 - DNA, 22 bp, Homo sapiens
cacagaggtctgggcccagcag

SEQ ID NO: 9110408 - DNA, 22 bp, Homo sapiens
cacagaggtctgggcccagcag

SEQ ID NO: 9110409 - DNA, 22 bp, Homo sapiens
cacagaggtctgggcccagcag

SEQ ID NO: 9110410 - DNA, 22 bp, Homo sapiens
cacaggcttgtcagcatgaggc

SEQ ID NO: 9110411 - DNA, 22 bp, Homo sapiens
cacaggcttgtcagcatgaggc

SEQ ID NO: 9110412 - DNA, 22 bp, Homo sapiens
cacaggcttgtcagcatgaggc

SEQ ID NO: 9110413 - DNA, 22 bp, Homo sapiens
cacaggcttttctgacataggc

SEQ ID NO: 9110414 - DNA, 22 bp, Homo sapiens
cacaggcttccagtccccagct

SEQ ID NO: 9110415 - DNA, 22 bp, Homo sapiens
ggaggccaaagtgtgggcggct

SEQ ID NO: 9110416 - DNA, 22 bp, Homo sapiens
ggaggcaggaaagacaggttca

SEQ ID NO: 9110417 - DNA, 22 bp, Homo sapiens
ggaggcaggaaagacaggttca

SEQ ID NO: 9110418 - DNA, 22 bp, Homo sapiens
ggaggccaaggaggagcttgcc

SEQ ID NO: 9110419 - DNA, 22 bp, Homo sapiens
ggaggcagaatagagtgtgggt

SEQ ID NO: 9110420 - DNA, 22 bp, Homo sapiens
ggaggcaggaaagacaggttca

SEQ ID NO: 9110421 - DNA, 22 bp, Homo sapiens
ggaggcaggaaagacaggttca

SEQ ID NO: 9110422 - DNA, 22 bp, Homo sapiens
cacaggagaaaggggaagctcg

SEQ ID NO: 9110423 - DNA, 22 bp, Homo sapiens
cacaggagaaaggggaagctcg

SEQ ID NO: 9110424 - DNA, 22 bp, Homo sapiens
cacaggaatgaacagggaaaga

SEQ ID NO: 9110425 - DNA, 22 bp, Homo sapiens
cacaggaatctgcattttgacc

SEQ ID NO: 9110426 - DNA, 22 bp, Homo sapiens
cacaggaattagcagcctaaaa

SEQ ID NO: 9110427 - DNA, 22 bp, Homo sapiens
cacaggactcgactgcagacag

SEQ ID NO: 9110428 - DNA, 22 bp, Homo sapiens
cacaggaccaattcacattcca

SEQ ID NO: 9110429 - DNA, 22 bp, Homo sapiens
cacagctttgctttccttaata

SEQ ID NO: 9110430 - DNA, 22 bp, Homo sapiens
cacaggaaggccttctcacaat

SEQ ID NO: 9110431 - DNA, 22 bp, Homo sapiens
cacagcttgtttagtgactcac

SEQ ID NO: 9110432 - DNA, 20 bp, Homo sapiens
ggagctggcatccagcctct

SEQ ID NO: 9110433 - DNA, 22 bp, Homo sapiens
cacaggaagtggtcagtgccag

SEQ ID NO: 9110434 - DNA, 18 bp, Homo sapiens
cacaggaaggggaatatc

SEQ ID NO: 9110435 - DNA, 22 bp, Homo sapiens
cacaggaatcagcattaatggc

SEQ ID NO: 9110436 - DNA, 22 bp, Homo sapiens
cacaggaatcagcattaatggc

SEQ ID NO: 9110437 - DNA, 22 bp, Homo sapiens
cacaggaatcagcattaatggc

SEQ ID NO: 9110438 - DNA, 22 bp, Homo sapiens
cacaggaatcgtcacttagcgc

SEQ ID NO: 9110439 - DNA, 22 bp, Homo sapiens
cacaggaatataagtttgagtt

SEQ ID NO: 9110440 - DNA, 22 bp, Homo sapiens
cacaggaatataagtttgagtt

SEQ ID NO: 9110441 - DNA, 22 bp, Homo sapiens
cacaggaatataagtttgagtt

SEQ ID NO: 9110442 - DNA, 22 bp, Homo sapiens
cacaggaataagtcaaacttca

SEQ ID NO: 9110443 - DNA, 22 bp, Homo sapiens
cacacagatggtaagggaggga

SEQ ID NO: 9110444 - DNA, 22 bp, Homo sapiens
cacacagctcaggggcactgcc

SEQ ID NO: 9110445 - DNA, 22 bp, Homo sapiens
cacacagctagtgacaggagaa

SEQ ID NO: 9110446 - DNA, 21 bp, Homo sapiens
cacacagctgcccttaggtag

SEQ ID NO: 9110447 - DNA, 21 bp, Homo sapiens
cacacagctgcccttaggtag

SEQ ID NO: 9110448 - DNA, 22 bp, Homo sapiens
cacacaggaaaattggaattaa

SEQ ID NO: 9110449 - DNA, 22 bp, Homo sapiens
cacacaggaaaattggaattaa

SEQ ID NO: 9110450 - DNA, 22 bp, Homo sapiens
ggaagggcctcgggcgtgggac

SEQ ID NO: 9110451 - DNA, 22 bp, Homo sapiens
ggaagggcctcgggcgtgggac

SEQ ID NO: 9110452 - DNA, 22 bp, Homo sapiens
cacagaactggttaatagcaga

SEQ ID NO: 9110453 - DNA, 22 bp, Homo sapiens
ggaaggggccttgagcaaactg

SEQ ID NO: 9110454 - DNA, 22 bp, Homo sapiens
cacagaactggttaatagcaga

SEQ ID NO: 9110455 - DNA, 22 bp, Homo sapiens
cacagaactggttaatagcaga

SEQ ID NO: 9110456 - DNA, 22 bp, Homo sapiens
cacagaagaatcatgctgtgtt

SEQ ID NO: 9110457 - DNA, 22 bp, Homo sapiens
cacagaagtgtgtataactctt

SEQ ID NO: 9110458 - DNA, 22 bp, Homo sapiens
cacagaagtttcatagtctcga

SEQ ID NO: 9110459 - DNA, 22 bp, Homo sapiens
cacagaagtttcatagtctcga

SEQ ID NO: 9110460 - DNA, 22 bp, Homo sapiens
cacagaataattcacatggctc

SEQ ID NO: 9110461 - DNA, 22 bp, Homo sapiens
ggaaggggagctaaatctactg

SEQ ID NO: 9110462 - DNA, 22 bp, Homo sapiens
ggaaggggagctaaatctactg

SEQ ID NO: 9110463 - DNA, 22 bp, Homo sapiens
ggaaggggagctggaaagggta

SEQ ID NO: 9110464 - DNA, 22 bp, Homo sapiens
ggaagggcggatagtataagtt

SEQ ID NO: 9110465 - DNA, 21 bp, Homo sapiens
ggaagggctctgaggacggct

SEQ ID NO: 9110466 - DNA, 22 bp, Homo sapiens
ggaaggggagctggaaagggta

SEQ ID NO: 9110467 - DNA, 22 bp, Homo sapiens
ggaaggggagctggaaagggta

SEQ ID NO: 9110468 - DNA, 22 bp, Homo sapiens
ggaaggggagctggaaagggta

SEQ ID NO: 9110469 - DNA, 22 bp, Homo sapiens
cacagacagtgtccctttgttg

SEQ ID NO: 9110470 - DNA, 22 bp, Homo sapiens
cacagacagtgtccctttgttg

SEQ ID NO: 9110471 - DNA, 22 bp, Homo sapiens
ggactgggagaatggaggcaag

SEQ ID NO: 9110472 - DNA, 22 bp, Homo sapiens
ggactgggccaggggttggact

SEQ ID NO: 9110473 - DNA, 22 bp, Homo sapiens
ggactgggattctggatctgct

SEQ ID NO: 9110474 - DNA, 22 bp, Homo sapiens
ggactgggcatgggtgctctgc

SEQ ID NO: 9110475 - DNA, 22 bp, Homo sapiens
cacagaggctcaaagccaggtg

SEQ ID NO: 9110476 - DNA, 22 bp, Homo sapiens
cacagaggctcaaagccaggtg

SEQ ID NO: 9110477 - DNA, 22 bp, Homo sapiens
cacagaggctcaaagccaggtg

SEQ ID NO: 9110478 - DNA, 22 bp, Homo sapiens
cacagaggctcaaagccaggtg

SEQ ID NO: 9110479 - DNA, 22 bp, Homo sapiens
cacagaggcggaaaattctgaa

SEQ ID NO: 9110480 - DNA, 21 bp, Homo sapiens
cacagaggcgctgtatggctg

SEQ ID NO: 9110481 - DNA, 21 bp, Homo sapiens
cacagaggcgctgtatggctg

SEQ ID NO: 9110482 - DNA, 22 bp, Homo sapiens
cacagaggcatgaccctgccct

SEQ ID NO: 9110483 - DNA, 22 bp, Homo sapiens
cacagaggcaaccttctggggt

SEQ ID NO: 9110484 - DNA, 22 bp, Homo sapiens
cacagaggcatgaccctgccct

SEQ ID NO: 9110485 - DNA, 22 bp, Homo sapiens
cacagaggatgcccaagcgatc

SEQ ID NO: 9110486 - DNA, 22 bp, Homo sapiens
cacagaggagtgcacactctct

SEQ ID NO: 9110487 - DNA, 22 bp, Homo sapiens
cacagaggagtgcacactctct

SEQ ID NO: 9110488 - DNA, 22 bp, Homo sapiens
cacagaggcaaccttctggggt

SEQ ID NO: 9110489 - DNA, 22 bp, Homo sapiens
cacagaggatgcccaagcgatc

SEQ ID NO: 9110490 - DNA, 22 bp, Homo sapiens
cacagaggatttttagggcagt

SEQ ID NO: 9110491 - DNA, 22 bp, Homo sapiens
cacagaggatttttagggcagt

SEQ ID NO: 9110492 - DNA, 22 bp, Homo sapiens
cacagaggaaaggcagttggta

SEQ ID NO: 9110493 - DNA, 22 bp, Homo sapiens
cacagaggaaatgactttctta

SEQ ID NO: 9110494 - DNA, 22 bp, Homo sapiens
cacagaggactgtagcggggag

SEQ ID NO: 9110495 - DNA, 22 bp, Homo sapiens
cacagaggaatgcatcagcaga

SEQ ID NO: 9110496 - DNA, 22 bp, Homo sapiens
cacagaggaatgcatcagcaga

SEQ ID NO: 9110497 - DNA, 22 bp, Homo sapiens
cacagaggactgtagcggggag

SEQ ID NO: 9110498 - DNA, 22 bp, Homo sapiens
cacagagctgaacctgggtcat

SEQ ID NO: 9110499 - DNA, 22 bp, Homo sapiens
cacagagagctacgtgcagcgt

SEQ ID NO: 9110500 - DNA, 22 bp, Homo sapiens
cacagagctggaaaggctgggc

SEQ ID NO: 9110501 - DNA, 22 bp, Homo sapiens
cacagagctgaacctgggtcat

SEQ ID NO: 9110502 - DNA, 22 bp, Homo sapiens
cacagaggaaaggcagttggta

SEQ ID NO: 9110503 - DNA, 22 bp, Homo sapiens
cacagaggaaaggcagttggta

SEQ ID NO: 9110504 - DNA, 22 bp, Homo sapiens
cacagagctggaaaggctgggc

SEQ ID NO: 9110505 - DNA, 20 bp, Homo sapiens
ggctgtcccgcggctgccgg

SEQ ID NO: 9110506 - DNA, 22 bp, Homo sapiens
ggctgtccttggccaaggcact

SEQ ID NO: 9110507 - DNA, 19 bp, Homo sapiens
ggctgtctcggcccagcca

SEQ ID NO: 9110508 - DNA, 22 bp, Homo sapiens
ggctgtcaattcataggtcaga

SEQ ID NO: 9110509 - DNA, 22 bp, Homo sapiens
ggctgtcagggtgagctggctt

SEQ ID NO: 9110510 - DNA, 22 bp, Homo sapiens
ggctgtcagggtgagctggctt

SEQ ID NO: 9110511 - DNA, 22 bp, Homo sapiens
ggctggttagttgaggaggact

SEQ ID NO: 9110512 - DNA, 21 bp, Homo sapiens
ggctggtgtttagctgtgata

SEQ ID NO: 9110513 - DNA, 22 bp, Homo sapiens
ggctggttttcagttactgagt

SEQ ID NO: 9110514 - DNA, 22 bp, Homo sapiens
ggctggttttcagttactgagt

SEQ ID NO: 9110515 - DNA, 22 bp, Homo sapiens
ggctggtttgacaaactgacaa

SEQ ID NO: 9110516 - DNA, 22 bp, Homo sapiens
ggctggtttgacaaactgacaa

SEQ ID NO: 9110517 - DNA, 22 bp, Homo sapiens
cagaaagcttggtacaatatgc

SEQ ID NO: 9110518 - DNA, 22 bp, Homo sapiens
cagaaagcttggtacaatatgc

SEQ ID NO: 9110519 - DNA, 22 bp, Homo sapiens
cagaaagctctttcaatcttgc

SEQ ID NO: 9110520 - DNA, 22 bp, Homo sapiens
cagaaagctctttcaatcttgc

SEQ ID NO: 9110521 - DNA, 18 bp, Homo sapiens
cagaaagttatttactct

SEQ ID NO: 9110522 - DNA, 23 bp, Homo sapiens
cagaaataaactggtttgtagat

SEQ ID NO: 9110523 - DNA, 23 bp, Homo sapiens
cagaaataaactggtttgtagat

SEQ ID NO: 9110524 - DNA, 22 bp, Homo sapiens
cagaaatacccagcatttggag

SEQ ID NO: 9110525 - DNA, 22 bp, Homo sapiens
cagaaagcgggatgcagcatgt

SEQ ID NO: 9110526 - DNA, 22 bp, Homo sapiens
cagaaagccgacttacaatgga

SEQ ID NO: 9110527 - DNA, 23 bp, Homo sapiens
cagaaagccctttccccacagta

SEQ ID NO: 9110528 - DNA, 23 bp, Homo sapiens
cagaaagccctttccccacagta

SEQ ID NO: 9110529 - DNA, 23 bp, Homo sapiens
cagaaagccctttccccacagta

SEQ ID NO: 9110530 - DNA, 22 bp, Homo sapiens
cagaaagccctatgtacagtgg

SEQ ID NO: 9110531 - DNA, 22 bp, Homo sapiens
cagaaagccctatgtacagtgg

SEQ ID NO: 9110532 - DNA, 20 bp, Homo sapiens
cagaaagcatgttccagggc

SEQ ID NO: 9110533 - DNA, 20 bp, Homo sapiens
cagaaagcatgttccagggc

SEQ ID NO: 9110534 - DNA, 22 bp, Homo sapiens
cagaaagcaagccattcactgt

SEQ ID NO: 9110535 - DNA, 22 bp, Homo sapiens
cagaaagcagagctgagccttt

SEQ ID NO: 9110536 - DNA, 22 bp, Homo sapiens
ggctgcctcaaagctcaagctc

SEQ ID NO: 9110537 - DNA, 22 bp, Homo sapiens
ggctgccctcggggtcgcaggc

SEQ ID NO: 9110538 - DNA, 22 bp, Homo sapiens
ggctgccctcgtctactgccca

SEQ ID NO: 9110539 - DNA, 22 bp, Homo sapiens
ggctgccataacagagtaccac

SEQ ID NO: 9110540 - DNA, 22 bp, Homo sapiens
ggctgccataactgataccata

SEQ ID NO: 9110541 - DNA, 22 bp, Homo sapiens
ggctgccataacagagtaccac

SEQ ID NO: 9110542 - DNA, 22 bp, Homo sapiens
ggctgccataactgataccata

SEQ ID NO: 9110543 - DNA, 22 bp, Homo sapiens
cagaaaataaagtttctacgca

SEQ ID NO: 9110544 - DNA, 22 bp, Homo sapiens
cagaaaataaacatttgtggaa

SEQ ID NO: 9110545 - DNA, 22 bp, Homo sapiens
cactttggtagctgttttggga

SEQ ID NO: 9110546 - DNA, 22 bp, Homo sapiens
cacttttaacaggagaattccc

SEQ ID NO: 9110547 - DNA, 22 bp, Homo sapiens
cacttttaacaggagaattccc

SEQ ID NO: 9110548 - DNA, 22 bp, Homo sapiens
cagaaaacctgactctagaact

SEQ ID NO: 9110549 - DNA, 22 bp, Homo sapiens
cagaaaacctgactctagaact

SEQ ID NO: 9110550 - DNA, 22 bp, Homo sapiens
ggctccagggtctctccttgtg

SEQ ID NO: 9110551 - DNA, 22 bp, Homo sapiens
ggctctgggttctgcaatgcgt

SEQ ID NO: 9110552 - DNA, 22 bp, Homo sapiens
ggctctggtcagtgaggggcct

SEQ ID NO: 9110553 - DNA, 22 bp, Homo sapiens
ggctgagcttatatatgtgctg

SEQ ID NO: 9110554 - DNA, 22 bp, Homo sapiens
ggctgagcctggagcatctggt

SEQ ID NO: 9110555 - DNA, 22 bp, Homo sapiens
ggctgagctcaggggcagcagg

SEQ ID NO: 9110556 - DNA, 22 bp, Homo sapiens
ggctctggtgagggtaggagat

SEQ ID NO: 9110557 - DNA, 22 bp, Homo sapiens
ggctctggtgagggtaggagat

SEQ ID NO: 9110558 - DNA, 22 bp, Homo sapiens
ggctctggtgccctggctccca

SEQ ID NO: 9110559 - DNA, 22 bp, Homo sapiens
ggctctggtgccctggctccca

SEQ ID NO: 9110560 - DNA, 22 bp, Homo sapiens
ggctctggtgccctggctccca

SEQ ID NO: 9110561 - DNA, 22 bp, Homo sapiens
ggctctggtggcaattgactgg

SEQ ID NO: 9110562 - DNA, 22 bp, Homo sapiens
ggctcacacatgactgggctct

SEQ ID NO: 9110563 - DNA, 22 bp, Homo sapiens
ggctcaggctggagtgcagtgg

SEQ ID NO: 9110564 - DNA, 22 bp, Homo sapiens
ggctcaggctggagtgcagtgg

SEQ ID NO: 9110565 - DNA, 22 bp, Homo sapiens
ggctcagggaatgaggaagaat

SEQ ID NO: 9110566 - DNA, 22 bp, Homo sapiens
ggcctgtgtctgtgcctgtcct

SEQ ID NO: 9110567 - DNA, 22 bp, Homo sapiens
ggcctgtgtctgtgcctgtcct

SEQ ID NO: 9110568 - DNA, 22 bp, Homo sapiens
ggctcaatgcaacttctgcctc

SEQ ID NO: 9110569 - DNA, 22 bp, Homo sapiens
ggctcaatgcaacttctgcctc

SEQ ID NO: 9110570 - DNA, 22 bp, Homo sapiens
ggcctgaggccaccagcagccc

SEQ ID NO: 9110571 - DNA, 19 bp, Homo sapiens
ggcctgaggccacagatcc

SEQ ID NO: 9110572 - DNA, 19 bp, Homo sapiens
ggcctgaggccacagatcc

SEQ ID NO: 9110573 - DNA, 22 bp, Homo sapiens
ggcctgaggccaccagcagccc

SEQ ID NO: 9110574 - DNA, 22 bp, Homo sapiens
ggcctgaggccaccagcagccc

SEQ ID NO: 9110575 - DNA, 22 bp, Homo sapiens
ggcctgaggccaccagcagccc

SEQ ID NO: 9110576 - DNA, 22 bp, Homo sapiens
ggcctgtctcacccccgggtgc

SEQ ID NO: 9110577 - DNA, 22 bp, Homo sapiens
ggcctgtaatcccagctactca

SEQ ID NO: 9110578 - DNA, 22 bp, Homo sapiens
ggcctgtccagcctgcctggct

SEQ ID NO: 9110579 - DNA, 22 bp, Homo sapiens
ggcctgtccagcctgcctggct

SEQ ID NO: 9110580 - DNA, 22 bp, Homo sapiens
ggcctgtgcaagacagcacccc

SEQ ID NO: 9110581 - DNA, 22 bp, Homo sapiens
ggcctgaggcaatagtcagaca

SEQ ID NO: 9110582 - DNA, 22 bp, Homo sapiens
ggcctgagcttgggcagcgtat

SEQ ID NO: 9110583 - DNA, 22 bp, Homo sapiens
ggcctgagcttgggcagcgtat

SEQ ID NO: 9110584 - DNA, 18 bp, Homo sapiens
ggcctgaggatttcagca

SEQ ID NO: 9110585 - DNA, 22 bp, Homo sapiens
ggcctgagcttgggcagcgtat

SEQ ID NO: 9110586 - DNA, 22 bp, Homo sapiens
ggcctgagctctggggaggcaa

SEQ ID NO: 9110587 - DNA, 20 bp, Homo sapiens
ggcctgagcatggctggcag

SEQ ID NO: 9110588 - DNA, 22 bp, Homo sapiens
ggcctctctccagtcagtgcag

SEQ ID NO: 9110589 - DNA, 20 bp, Homo sapiens
ggcctgagcatggctggcag

SEQ ID NO: 9110590 - DNA, 22 bp, Homo sapiens
ggcctgagcagacagcatgatg

SEQ ID NO: 9110591 - DNA, 22 bp, Homo sapiens
ggcctgagcagacagcatgatg

SEQ ID NO: 9110592 - DNA, 21 bp, Homo sapiens
ggcctgagcacctgtccacct

SEQ ID NO: 9110593 - DNA, 22 bp, Homo sapiens
cacatagaaaacttagcaggga

SEQ ID NO: 9110594 - DNA, 22 bp, Homo sapiens
cacatagataggcagaagaaca

SEQ ID NO: 9110595 - DNA, 22 bp, Homo sapiens
cacatatacctcttcttgagtt

SEQ ID NO: 9110596 - DNA, 22 bp, Homo sapiens
cacatatacctcttcttgagtt

SEQ ID NO: 9110597 - DNA, 22 bp, Homo sapiens
cacatttacatataaaactttc

SEQ ID NO: 9110598 - DNA, 22 bp, Homo sapiens
cacatttaattggtttagggtg

SEQ ID NO: 9110599 - DNA, 22 bp, Homo sapiens
cacatttagaggttagcatggt

SEQ ID NO: 9110600 - DNA, 22 bp, Homo sapiens
cacatttacttttatcccttgg

SEQ ID NO: 9110601 - DNA, 22 bp, Homo sapiens
cacatttacttttatcccttgg

SEQ ID NO: 9110602 - DNA, 18 bp, Homo sapiens
cacatttacctggctccc

SEQ ID NO: 9110603 - DNA, 22 bp, Homo sapiens
cacatttatctctctccggtga

SEQ ID NO: 9110604 - DNA, 22 bp, Homo sapiens
cacatttatctgttctttctag

SEQ ID NO: 9110605 - DNA, 22 bp, Homo sapiens
cacatttatgggctgggaggca

SEQ ID NO: 9110606 - DNA, 22 bp, Homo sapiens
cacatttaggaggtggggaagc

SEQ ID NO: 9110607 - DNA, 22 bp, Homo sapiens
cacatttaggttcctatagcca

SEQ ID NO: 9110608 - DNA, 22 bp, Homo sapiens
ggcaggcaggagcgtgcttggg

SEQ ID NO: 9110609 - DNA, 22 bp, Homo sapiens
ggcaggcaggagcgtgcttggg

SEQ ID NO: 9110610 - DNA, 22 bp, Homo sapiens
cacatttatttgaggctaattg

SEQ ID NO: 9110611 - DNA, 22 bp, Homo sapiens
ggcaggcaggagctctgtctcc

SEQ ID NO: 9110612 - DNA, 22 bp, Homo sapiens
ggcaggcaggagctctgtctcc

SEQ ID NO: 9110613 - DNA, 22 bp, Homo sapiens
ggcaggcaggagcgtgcttggg

SEQ ID NO: 9110614 - DNA, 22 bp, Homo sapiens
ggcaggcaggagcgtgcttggg

SEQ ID NO: 9110615 - DNA, 22 bp, Homo sapiens
ggcaggcaggtcttcatggccc

SEQ ID NO: 9110616 - DNA, 22 bp, Homo sapiens
ggcaggcaggtcttcatggccc

SEQ ID NO: 9110617 - DNA, 22 bp, Homo sapiens
ggcaggcaggtcttcatggccc

SEQ ID NO: 9110618 - DNA, 20 bp, Homo sapiens
ggcaggcaggaggtttccag

SEQ ID NO: 9110619 - DNA, 22 bp, Homo sapiens
ggcaggcatcatcagttgatca

SEQ ID NO: 9110620 - DNA, 22 bp, Homo sapiens
ggcaggcatcatcagttgatca

SEQ ID NO: 9110621 - DNA, 22 bp, Homo sapiens
ggcaggcagtgtggtgtgaaac

SEQ ID NO: 9110622 - DNA, 22 bp, Homo sapiens
ggcaggcagtgtggtgtgaaac

SEQ ID NO: 9110623 - DNA, 22 bp, Homo sapiens
ggcaggcagtgtggtgtgaaac

SEQ ID NO: 9110624 - DNA, 22 bp, Homo sapiens
ggcaggcatggccactccctag

SEQ ID NO: 9110625 - DNA, 22 bp, Homo sapiens
ggcaggcatcatgtggtcatta

SEQ ID NO: 9110626 - DNA, 22 bp, Homo sapiens
ggcaggcatcatgtggtcatta

SEQ ID NO: 9110627 - DNA, 22 bp, Homo sapiens
ggcaggcatggggtctgccatt

SEQ ID NO: 9110628 - DNA, 22 bp, Homo sapiens
ggcaggcatggggtctgccatt

SEQ ID NO: 9110629 - DNA, 22 bp, Homo sapiens
ggcaggcatggggtctgccatt

SEQ ID NO: 9110630 - DNA, 22 bp, Homo sapiens
ggcagggagagcatgctgataa

SEQ ID NO: 9110631 - DNA, 22 bp, Homo sapiens
ggcagggagagcatgctgataa

SEQ ID NO: 9110632 - DNA, 22 bp, Homo sapiens
ggcagggagagcatgctgataa

SEQ ID NO: 9110633 - DNA, 22 bp, Homo sapiens
ggcagggaggaggtgaaagtga

SEQ ID NO: 9110634 - DNA, 19 bp, Homo sapiens
cacatacagaaaagagtaa

SEQ ID NO: 9110635 - DNA, 22 bp, Homo sapiens
cacatacaatggtgttatttgg

SEQ ID NO: 9110636 - DNA, 22 bp, Homo sapiens
cacatacatacgtatgtataca

SEQ ID NO: 9110637 - DNA, 22 bp, Homo sapiens
cacatacatgcacacctaaata

SEQ ID NO: 9110638 - DNA, 22 bp, Homo sapiens
cacatacatacgtatgtataca

SEQ ID NO: 9110639 - DNA, 22 bp, Homo sapiens
cacatacccggctattgctgct

SEQ ID NO: 9110640 - DNA, 22 bp, Homo sapiens
cacatacattcatgttactcta

SEQ ID NO: 9110641 - DNA, 22 bp, Homo sapiens
cacataagaaatgaatatgaga

SEQ ID NO: 9110642 - DNA, 22 bp, Homo sapiens
cacataagtcccctgtgccaag

SEQ ID NO: 9110643 - DNA, 22 bp, Homo sapiens
cacataataaatgttcctgatg

SEQ ID NO: 9110644 - DNA, 22 bp, Homo sapiens
cacataaatggtgccatgtttt

SEQ ID NO: 9110645 - DNA, 22 bp, Homo sapiens
cacagttttgtcttggtttcca

SEQ ID NO: 9110646 - DNA, 22 bp, Homo sapiens
cacagttttatcttatactgat

SEQ ID NO: 9110647 - DNA, 22 bp, Homo sapiens
cacatacaaggcacactggagg

SEQ ID NO: 9110648 - DNA, 22 bp, Homo sapiens
cacatacaaggcacactggagg

SEQ ID NO: 9110649 - DNA, 22 bp, Homo sapiens
cacataatcaccaagtcctttc

SEQ ID NO: 9110650 - DNA, 22 bp, Homo sapiens
cacagtttggttttgctgtaat

SEQ ID NO: 9110651 - DNA, 22 bp, Homo sapiens
ggaggtgctggcggccagctct

SEQ ID NO: 9110652 - DNA, 22 bp, Homo sapiens
ggaggtgctgatcccagtcaac

SEQ ID NO: 9110653 - DNA, 22 bp, Homo sapiens
ggaggtggagctggaagttcca

SEQ ID NO: 9110654 - DNA, 22 bp, Homo sapiens
ggaggtgacgaaaagaaattgt

SEQ ID NO: 9110655 - DNA, 22 bp, Homo sapiens
cacaggcttttttggctgatgt

SEQ ID NO: 9110656 - DNA, 22 bp, Homo sapiens
cacagggaaccaaggctgggcc

SEQ ID NO: 9110657 - DNA, 22 bp, Homo sapiens
ggaggtgaggccgtagggtgtg

SEQ ID NO: 9110658 - DNA, 22 bp, Homo sapiens
ggaggtgaggccgtagggtgtg

SEQ ID NO: 9110659 - DNA, 22 bp, Homo sapiens
ggaggtgactggatcatgggca

SEQ ID NO: 9110660 - DNA, 22 bp, Homo sapiens
ggcattgtctatttgcattcat

SEQ ID NO: 9110661 - DNA, 22 bp, Homo sapiens
ggcatcaggatctgtcttgctt

SEQ ID NO: 9110662 - DNA, 22 bp, Homo sapiens
ggcatttagttttcatattctg

SEQ ID NO: 9110663 - DNA, 22 bp, Homo sapiens
ggccaaggatggtggctctggt

SEQ ID NO: 9110664 - DNA, 22 bp, Homo sapiens
ggccaaggatggtggctctggt

SEQ ID NO: 9110665 - DNA, 22 bp, Homo sapiens
ggccaccttcctgtggtctctg

SEQ ID NO: 9110666 - DNA, 22 bp, Homo sapiens
ggccactcggccacccctgccg

SEQ ID NO: 9110667 - DNA, 22 bp, Homo sapiens
ggcatttttgacaaagagcaat

SEQ ID NO: 9110668 - DNA, 22 bp, Homo sapiens
ggccaagatcccattatacaaa

SEQ ID NO: 9110669 - DNA, 22 bp, Homo sapiens
ggccaagaatgataggctcagt

SEQ ID NO: 9110670 - DNA, 22 bp, Homo sapiens
ggccaagatggaaggagagatg

SEQ ID NO: 9110671 - DNA, 22 bp, Homo sapiens
ggccaagaatgataggctcagt

SEQ ID NO: 9110672 - DNA, 22 bp, Homo sapiens
ggcaggtgcccagagagcacga

SEQ ID NO: 9110673 - DNA, 22 bp, Homo sapiens
ggcaggtgcccagagagcacga

SEQ ID NO: 9110674 - DNA, 22 bp, Homo sapiens
ggcaggtgccagttggcttggg

SEQ ID NO: 9110675 - DNA, 22 bp, Homo sapiens
ggcaggtgcacctgagccatct

SEQ ID NO: 9110676 - DNA, 22 bp, Homo sapiens
ggcaggtgcacctgagccatct

SEQ ID NO: 9110677 - DNA, 22 bp, Homo sapiens
ggcagggcaggaaagtcaggaa

SEQ ID NO: 9110678 - DNA, 22 bp, Homo sapiens
ggcagggcaggaaagtcaggaa

SEQ ID NO: 9110679 - DNA, 22 bp, Homo sapiens
ggcagggcaggaaagtcaggaa

SEQ ID NO: 9110680 - DNA, 22 bp, Homo sapiens
ggcagggcaggaaagtcaggaa

SEQ ID NO: 9110681 - DNA, 22 bp, Homo sapiens
ggcagggagtggagactcccta

SEQ ID NO: 9110682 - DNA, 22 bp, Homo sapiens
ggcccttgcagcaggcgctggc

SEQ ID NO: 9110683 - DNA, 22 bp, Homo sapiens
ggccctgttagagctcccacaa

SEQ ID NO: 9110684 - DNA, 22 bp, Homo sapiens
ggccctgttagagctcccacaa

SEQ ID NO: 9110685 - DNA, 22 bp, Homo sapiens
ggcccttcctcttgtgctggca

SEQ ID NO: 9110686 - DNA, 22 bp, Homo sapiens
ggccctgtggttttgcaaagtc

SEQ ID NO: 9110687 - DNA, 22 bp, Homo sapiens
ggccccagggattaggccaacc

SEQ ID NO: 9110688 - DNA, 22 bp, Homo sapiens
ggccctgtcctggctgtctccg

SEQ ID NO: 9110689 - DNA, 22 bp, Homo sapiens
ggccctgtccctggccgtctgt

SEQ ID NO: 9110690 - DNA, 22 bp, Homo sapiens
ggccactgccctggctacaccg

SEQ ID NO: 9110691 - DNA, 22 bp, Homo sapiens
ggccactgctctccagcctggg

SEQ ID NO: 9110692 - DNA, 22 bp, Homo sapiens
ggccactgctctccagcctggg

SEQ ID NO: 9110693 - DNA, 22 bp, Homo sapiens
cacgcacgctgggtggaggcgc

SEQ ID NO: 9110694 - DNA, 22 bp, Homo sapiens
caccttgtggcccagtcaggtt

SEQ ID NO: 9110695 - DNA, 22 bp, Homo sapiens
caccttccatctccttggctag

SEQ ID NO: 9110696 - DNA, 22 bp, Homo sapiens
caccttcagaatgctccaggca

SEQ ID NO: 9110697 - DNA, 20 bp, Homo sapiens
caccttcaaatttcctggca

SEQ ID NO: 9110698 - DNA, 21 bp, Homo sapiens
caccttatagataaaattaga

SEQ ID NO: 9110699 - DNA, 22 bp, Homo sapiens
cacctgttgtttattcatctct

SEQ ID NO: 9110700 - DNA, 22 bp, Homo sapiens
cacctgtacagggccgggctgg

SEQ ID NO: 9110701 - DNA, 22 bp, Homo sapiens
ggccggggcctgctcgcctgtg

SEQ ID NO: 9110702 - DNA, 22 bp, Homo sapiens
ggccggggcctgctcgcctgtg

SEQ ID NO: 9110703 - DNA, 22 bp, Homo sapiens
ggccgggcaggtctcagccagc

SEQ ID NO: 9110704 - DNA, 22 bp, Homo sapiens
ggccggggcctccccgcgtcgc

SEQ ID NO: 9110705 - DNA, 20 bp, Homo sapiens
ggccggggagctctccaggg

SEQ ID NO: 9110706 - DNA, 20 bp, Homo sapiens
ggccggggagctctccaggg

SEQ ID NO: 9110707 - DNA, 22 bp, Homo sapiens
atccagggtgtggagagagctc

SEQ ID NO: 9110708 - DNA, 22 bp, Homo sapiens
atccagttaagatgaggtcata

SEQ ID NO: 9110709 - DNA, 22 bp, Homo sapiens
atccatataggcagatggcaca

SEQ ID NO: 9110710 - DNA, 22 bp, Homo sapiens
atccagttcttggaagcacagg

SEQ ID NO: 9110711 - DNA, 22 bp, Homo sapiens
atccagttccaaagatcattta

SEQ ID NO: 9110712 - DNA, 22 bp, Homo sapiens
ctgtgggagaggtgcctggatt

SEQ ID NO: 9110713 - DNA, 22 bp, Homo sapiens
atccaccctgtggtggctttct

SEQ ID NO: 9110714 - DNA, 22 bp, Homo sapiens
atcctgtctatgagtagataat

SEQ ID NO: 9110715 - DNA, 19 bp, Homo sapiens
atcctgggtcctccagctg

SEQ ID NO: 9110716 - DNA, 22 bp, Homo sapiens
atcctgggctgcaccctcagcc

SEQ ID NO: 9110717 - DNA, 22 bp, Homo sapiens
atcctgggcagtgtgtcactct

SEQ ID NO: 9110718 - DNA, 22 bp, Homo sapiens
ctgtgtgctgaaatgcagtgag

SEQ ID NO: 9110719 - DNA, 22 bp, Homo sapiens
ctgtgtgctgaaatgcagtgag

SEQ ID NO: 9110720 - DNA, 22 bp, Homo sapiens
ctgtgtgcctagagggtggccg

SEQ ID NO: 9110721 - DNA, 22 bp, Homo sapiens
ctgtgtggactggttgaggccc

SEQ ID NO: 9110722 - DNA, 22 bp, Homo sapiens
ctgtgtgctgaaatgcagtgag

SEQ ID NO: 9110723 - DNA, 22 bp, Homo sapiens
ctgtgtggcctcaagccagcct

SEQ ID NO: 9110724 - DNA, 22 bp, Homo sapiens
ctgtgtgtcctcggacgagttt

SEQ ID NO: 9110725 - DNA, 22 bp, Homo sapiens
ctgtgtgtcctcggacgagttt

SEQ ID NO: 9110726 - DNA, 22 bp, Homo sapiens
ctgtgtgtcatttgtcaatcct

SEQ ID NO: 9110727 - DNA, 22 bp, Homo sapiens
ctgtgtgtcatttgtcaatcct

SEQ ID NO: 9110728 - DNA, 22 bp, Homo sapiens
atcagagaccggtcaagtcatg

SEQ ID NO: 9110729 - DNA, 22 bp, Homo sapiens
atcagagattgtagtatgtgca

SEQ ID NO: 9110730 - DNA, 22 bp, Homo sapiens
ctgtggagtgtagatgctgggt

SEQ ID NO: 9110731 - DNA, 22 bp, Homo sapiens
ctgtggagtgtagatgctgggt

SEQ ID NO: 9110732 - DNA, 22 bp, Homo sapiens
atcagaatgattagtaaccaat

SEQ ID NO: 9110733 - DNA, 22 bp, Homo sapiens
atcagaatcttctgaacagtgg

SEQ ID NO: 9110734 - DNA, 22 bp, Homo sapiens
atcagaattagccagtgaggct

SEQ ID NO: 9110735 - DNA, 22 bp, Homo sapiens
ctgtggagttccatcaggggag

SEQ ID NO: 9110736 - DNA, 22 bp, Homo sapiens
ctgtggagttccatcaggggag

SEQ ID NO: 9110737 - DNA, 23 bp, Homo sapiens
ctgtggccctgcttcatgcagcc

SEQ ID NO: 9110738 - DNA, 21 bp, Homo sapiens
ctgtggcctggctagcaccgt

SEQ ID NO: 9110739 - DNA, 22 bp, Homo sapiens
ctgtggccttggaccagcatct

SEQ ID NO: 9110740 - DNA, 22 bp, Homo sapiens
ctgtgggagaagttgctggagt

SEQ ID NO: 9110741 - DNA, 23 bp, Homo sapiens
ctgtgggaagtcggggagcgcgc

SEQ ID NO: 9110742 - DNA, 22 bp, Homo sapiens
ctgtggctaggaagctgtggga

SEQ ID NO: 9110743 - DNA, 22 bp, Homo sapiens
ctgtggctaggaagctgtggga

SEQ ID NO: 9110744 - DNA, 22 bp, Homo sapiens
ctgtggctatggtgtacatact

SEQ ID NO: 9110745 - DNA, 22 bp, Homo sapiens
ctgtggctcaaaatcccatgat

SEQ ID NO: 9110746 - DNA, 22 bp, Homo sapiens
ctgtggctcaaaatcccatgat

SEQ ID NO: 9110747 - DNA, 22 bp, Homo sapiens
ctgtggctcaaaatcccatgat

SEQ ID NO: 9110748 - DNA, 22 bp, Homo sapiens
ctgtggctcaattgcctactga

SEQ ID NO: 9110749 - DNA, 22 bp, Homo sapiens
ctgtggcttttccggggagcct

SEQ ID NO: 9110750 - DNA, 22 bp, Homo sapiens
ctgtggctttggggcggaggac

SEQ ID NO: 9110751 - DNA, 22 bp, Homo sapiens
ctgtggctttggggcggaggac

SEQ ID NO: 9110752 - DNA, 22 bp, Homo sapiens
ctgtggctttgcagggcttgtt

SEQ ID NO: 9110753 - DNA, 22 bp, Homo sapiens
atcctgtgttgctactggagga

SEQ ID NO: 9110754 - DNA, 22 bp, Homo sapiens
atccttaagaaagttttctata

SEQ ID NO: 9110755 - DNA, 22 bp, Homo sapiens
atccttaaaggaattctgattt

SEQ ID NO: 9110756 - DNA, 22 bp, Homo sapiens
atcctgtggggcggctgcaggg

SEQ ID NO: 9110757 - DNA, 22 bp, Homo sapiens
cttagagatgggttttacttag

SEQ ID NO: 9110758 - DNA, 22 bp, Homo sapiens
cttagagatgggttttacttag

SEQ ID NO: 9110759 - DNA, 22 bp, Homo sapiens
cttagacatggcagctccaagt

SEQ ID NO: 9110760 - DNA, 22 bp, Homo sapiens
cttccaggtgctggcctggcct

SEQ ID NO: 9110761 - DNA, 22 bp, Homo sapiens
cttagatgaagtcacagaaccc

SEQ ID NO: 9110762 - DNA, 22 bp, Homo sapiens
cttcccaagactgtattgcaag

SEQ ID NO: 9110763 - DNA, 22 bp, Homo sapiens
cttccatacagacaatgcaatg

SEQ ID NO: 9110764 - DNA, 22 bp, Homo sapiens
cttccagtcttttcagtggagt

SEQ ID NO: 9110765 - DNA, 22 bp, Homo sapiens
cttccaggtgctggcctggcct

SEQ ID NO: 9110766 - DNA, 22 bp, Homo sapiens
cttccaggttctggttgggaag

SEQ ID NO: 9110767 - DNA, 22 bp, Homo sapiens
cttcctcaggcattagctggac

SEQ ID NO: 9110768 - DNA, 22 bp, Homo sapiens
cttcctcaggcattagctggac

SEQ ID NO: 9110769 - DNA, 22 bp, Homo sapiens
cttcctcacggtgcaacaggaa

SEQ ID NO: 9110770 - DNA, 22 bp, Homo sapiens
cttcctagcttcagagtctgtt

SEQ ID NO: 9110771 - DNA, 22 bp, Homo sapiens
cttcctagtgtctactttggag

SEQ ID NO: 9110772 - DNA, 22 bp, Homo sapiens
cttcctaaaagcttcaagagaa

SEQ ID NO: 9110773 - DNA, 18 bp, Homo sapiens
cttcctcatcgctctccc

SEQ ID NO: 9110774 - DNA, 22 bp, Homo sapiens
cttcctcccccacacactcact

SEQ ID NO: 9110775 - DNA, 22 bp, Homo sapiens
cttcctcatgtgcaatgcaagc

SEQ ID NO: 9110776 - DNA, 22 bp, Homo sapiens
cttcctcccggcccatgctctg

SEQ ID NO: 9110777 - DNA, 22 bp, Homo sapiens
atctgaagaatgaatggaatta

SEQ ID NO: 9110778 - DNA, 22 bp, Homo sapiens
atctgaataaatttcttttagt

SEQ ID NO: 9110779 - DNA, 22 bp, Homo sapiens
atctgaataaatttcttttagt

SEQ ID NO: 9110780 - DNA, 22 bp, Homo sapiens
atctgaataaatttcttttagt

SEQ ID NO: 9110781 - DNA, 21 bp, Homo sapiens
atctgaagtttgagaggaaag

SEQ ID NO: 9110782 - DNA, 22 bp, Homo sapiens
atctgaagggaagtggaaggca

SEQ ID NO: 9110783 - DNA, 22 bp, Homo sapiens
atctgaagggaagtggaaggca

SEQ ID NO: 9110784 - DNA, 22 bp, Homo sapiens
atctgaagggaagtggaaggca

SEQ ID NO: 9110785 - DNA, 23 bp, Homo sapiens
atctgaaaaggcattttcttccc

SEQ ID NO: 9110786 - DNA, 22 bp, Homo sapiens
atctgaaactctgacattgtct

SEQ ID NO: 9110787 - DNA, 22 bp, Homo sapiens
cttcctctagcctagtaatgcc

SEQ ID NO: 9110788 - DNA, 22 bp, Homo sapiens
cttcctctagcctagtaatgcc

SEQ ID NO: 9110789 - DNA, 22 bp, Homo sapiens
cttcctcccggcccatgctctg

SEQ ID NO: 9110790 - DNA, 22 bp, Homo sapiens
atctgcatcagactttgcatga

SEQ ID NO: 9110791 - DNA, 22 bp, Homo sapiens
atctgcatcagactttgcatga

SEQ ID NO: 9110792 - DNA, 22 bp, Homo sapiens
cttcttaatgacagattaaaat

SEQ ID NO: 9110793 - DNA, 22 bp, Homo sapiens
cttcttgctgggggcctcagtg

SEQ ID NO: 9110794 - DNA, 22 bp, Homo sapiens
cttcttgcaattttcatcttat

SEQ ID NO: 9110795 - DNA, 22 bp, Homo sapiens
cttcttattaatccttctctgt

SEQ ID NO: 9110796 - DNA, 22 bp, Homo sapiens
cttcttggtgatggcttacctg

SEQ ID NO: 9110797 - DNA, 22 bp, Homo sapiens
cttcttggtgatggcttacctg

SEQ ID NO: 9110798 - DNA, 21 bp, Homo sapiens
cttcttggggagcagctagac

SEQ ID NO: 9110799 - DNA, 22 bp, Homo sapiens
cttcttgggtcagagaatcatt

SEQ ID NO: 9110800 - DNA, 22 bp, Homo sapiens
cttcttgggttctgagattaca

SEQ ID NO: 9110801 - DNA, 22 bp, Homo sapiens
cttcttggctgcaagtctctgt

SEQ ID NO: 9110802 - DNA, 21 bp, Homo sapiens
cttcttggggagcagctagac

SEQ ID NO: 9110803 - DNA, 20 bp, Homo sapiens
cttcttggagatggtgtttt

SEQ ID NO: 9110804 - DNA, 22 bp, Homo sapiens
cttcttggactactcactagag

SEQ ID NO: 9110805 - DNA, 22 bp, Homo sapiens
atctgagactgagtttggattt

SEQ ID NO: 9110806 - DNA, 22 bp, Homo sapiens
atctgagatgcaggtgggtgga

SEQ ID NO: 9110807 - DNA, 22 bp, Homo sapiens
atctgagaagattttggcataa

SEQ ID NO: 9110808 - DNA, 22 bp, Homo sapiens
atctgagtcaaatatttcattt

SEQ ID NO: 9110809 - DNA, 22 bp, Homo sapiens
atctgagtctctgacagcatgt

SEQ ID NO: 9110810 - DNA, 22 bp, Homo sapiens
atctgagtgttggatttattgt

SEQ ID NO: 9110811 - DNA, 22 bp, Homo sapiens
ctgggctcacctgtggctggca

SEQ ID NO: 9110812 - DNA, 20 bp, Homo sapiens
ctgggctcaagtgatcctcc

SEQ ID NO: 9110813 - DNA, 22 bp, Homo sapiens
ctgggctcagatgagaggaagg

SEQ ID NO: 9110814 - DNA, 21 bp, Homo sapiens
ctgggctcaagcaatcctttc

SEQ ID NO: 9110815 - DNA, 20 bp, Homo sapiens
ctgggctcaagtgagcctcc

SEQ ID NO: 9110816 - DNA, 22 bp, Homo sapiens
ctgggctcaagtgatccaccca

SEQ ID NO: 9110817 - DNA, 20 bp, Homo sapiens
ctgggctcaagtgatcctcc

SEQ ID NO: 9110818 - DNA, 22 bp, Homo sapiens
ctgggctcaagaagtcttccct

SEQ ID NO: 9110819 - DNA, 22 bp, Homo sapiens
ctgggcctggtagggcttgaaa

SEQ ID NO: 9110820 - DNA, 22 bp, Homo sapiens
ctgggctcaagaagtcttccct

SEQ ID NO: 9110821 - DNA, 22 bp, Homo sapiens
ctgggcctggtagggcttgaaa

SEQ ID NO: 9110822 - DNA, 22 bp, Homo sapiens
ctgggcctggtagggcttgaaa

SEQ ID NO: 9110823 - DNA, 22 bp, Homo sapiens
ctgggcctggggctgttgagag

SEQ ID NO: 9110824 - DNA, 22 bp, Homo sapiens
ctggcttccaccatggcccctg

SEQ ID NO: 9110825 - DNA, 22 bp, Homo sapiens
ctggcttccctgtcttatggaa

SEQ ID NO: 9110826 - DNA, 22 bp, Homo sapiens
ctggctgtttcaaatgtataga

SEQ ID NO: 9110827 - DNA, 22 bp, Homo sapiens
ctggctgttttcaatgttgatg

SEQ ID NO: 9110828 - DNA, 22 bp, Homo sapiens
ctggctggccggagcgaggcgg

SEQ ID NO: 9110829 - DNA, 22 bp, Homo sapiens
ctggctggccggaggcatccct

SEQ ID NO: 9110830 - DNA, 22 bp, Homo sapiens
ctggctggccggaggcatccct

SEQ ID NO: 9110831 - DNA, 22 bp, Homo sapiens
ctggctggctcatttttcattg

SEQ ID NO: 9110832 - DNA, 22 bp, Homo sapiens
ctggctgtgtccacagagtaag

SEQ ID NO: 9110833 - DNA, 22 bp, Homo sapiens
ctggctgggagcgagctgctca

SEQ ID NO: 9110834 - DNA, 22 bp, Homo sapiens
ctggctgggagcgagctgctca

SEQ ID NO: 9110835 - DNA, 22 bp, Homo sapiens
ctggctgggagcgagctgctca

SEQ ID NO: 9110836 - DNA, 22 bp, Homo sapiens
ctgggctgagcctgggctgtgt

SEQ ID NO: 9110837 - DNA, 22 bp, Homo sapiens
atattcactgggtactaaaaag

SEQ ID NO: 9110838 - DNA, 22 bp, Homo sapiens
atattcttcttgttcagactat

SEQ ID NO: 9110839 - DNA, 22 bp, Homo sapiens
atattcactgagcataaagcca

SEQ ID NO: 9110840 - DNA, 22 bp, Homo sapiens
atattcactgggtactaaaaag

SEQ ID NO: 9110841 - DNA, 22 bp, Homo sapiens
ctgggctctgcggtgtcgctct

SEQ ID NO: 9110842 - DNA, 22 bp, Homo sapiens
atattatggccccatctaagct

SEQ ID NO: 9110843 - DNA, 22 bp, Homo sapiens
atattatgctaagggaaataag

SEQ ID NO: 9110844 - DNA, 22 bp, Homo sapiens
ctgggctctggggtcccggtgc

SEQ ID NO: 9110845 - DNA, 22 bp, Homo sapiens
ctgggctctgtgtttcagtttc

SEQ ID NO: 9110846 - DNA, 22 bp, Homo sapiens
ctgggctcttcccagatccaga

SEQ ID NO: 9110847 - DNA, 22 bp, Homo sapiens
ctgggctcttcccagatccaga

SEQ ID NO: 9110848 - DNA, 22 bp, Homo sapiens
ctgggctcttctcaccctgttt

SEQ ID NO: 9110849 - DNA, 22 bp, Homo sapiens
atatgccagctccaagtaagag

SEQ ID NO: 9110850 - DNA, 20 bp, Homo sapiens
atatgctaatttttagtggg

SEQ ID NO: 9110851 - DNA, 22 bp, Homo sapiens
atatgctattgctgtaatttaa

SEQ ID NO: 9110852 - DNA, 22 bp, Homo sapiens
atatgtttttggaaagaacaca

SEQ ID NO: 9110853 - DNA, 22 bp, Homo sapiens
atatgtttttggaaagaacaca

SEQ ID NO: 9110854 - DNA, 22 bp, Homo sapiens
atattaggtgctcaatacatgc

SEQ ID NO: 9110855 - DNA, 22 bp, Homo sapiens
atattataagttatttcaagtt

SEQ ID NO: 9110856 - DNA, 22 bp, Homo sapiens
atattacataaacatgagtgaa

SEQ ID NO: 9110857 - DNA, 22 bp, Homo sapiens
atattacataaacatgagtgaa

SEQ ID NO: 9110858 - DNA, 22 bp, Homo sapiens
atattacataaacatgagtgaa

SEQ ID NO: 9110859 - DNA, 22 bp, Homo sapiens
atattacttcctggtataaaat

SEQ ID NO: 9110860 - DNA, 22 bp, Homo sapiens
atcagaagcttgtagtctctct

SEQ ID NO: 9110861 - DNA, 22 bp, Homo sapiens
atcagaacaaaagaacagttta

SEQ ID NO: 9110862 - DNA, 21 bp, Homo sapiens
atcagaatctctagatttgga

SEQ ID NO: 9110863 - DNA, 22 bp, Homo sapiens
atcagaatactatcaacagtga

SEQ ID NO: 9110864 - DNA, 21 bp, Homo sapiens
atcagaaaatgtaatggagca

SEQ ID NO: 9110865 - DNA, 22 bp, Homo sapiens
atcagaaatagtcatgttactt

SEQ ID NO: 9110866 - DNA, 22 bp, Homo sapiens
atcagaaaggtgggcaagcaga

SEQ ID NO: 9110867 - DNA, 22 bp, Homo sapiens
atcagaaaaacataatgttatt

SEQ ID NO: 9110868 - DNA, 22 bp, Homo sapiens
atcacattgccagtgattaccc

SEQ ID NO: 9110869 - DNA, 22 bp, Homo sapiens
atcaacatgacaggagaagaga

SEQ ID NO: 9110870 - DNA, 22 bp, Homo sapiens
atcaacatgaatttctctgaag

SEQ ID NO: 9110871 - DNA, 22 bp, Homo sapiens
atcaaatcattgcattaatgtt

SEQ ID NO: 9110872 - DNA, 23 bp, Homo sapiens
atcaaatgattggccattcagtg

SEQ ID NO: 9110873 - DNA, 22 bp, Homo sapiens
atcaaatataataattttcgct

SEQ ID NO: 9110874 - DNA, 22 bp, Homo sapiens
atcaacaggtatggatgagatt

SEQ ID NO: 9110875 - DNA, 22 bp, Homo sapiens
atcaaataaaggtacctagctt

SEQ ID NO: 9110876 - DNA, 22 bp, Homo sapiens
atcaaatacaaagggcataagg

SEQ ID NO: 9110877 - DNA, 22 bp, Homo sapiens
atcaaatacaaagggcataagg

SEQ ID NO: 9110878 - DNA, 22 bp, Homo sapiens
atcaaatacaaagggcataagg

SEQ ID NO: 9110879 - DNA, 22 bp, Homo sapiens
atattcttgtgattataaagta

SEQ ID NO: 9110880 - DNA, 22 bp, Homo sapiens
atattcttgaagggagattata

SEQ ID NO: 9110881 - DNA, 22 bp, Homo sapiens
atattcttgtgattataaagta

SEQ ID NO: 9110882 - DNA, 22 bp, Homo sapiens
atattcttgtgattataaagta

SEQ ID NO: 9110883 - DNA, 18 bp, Homo sapiens
atattgggagcaggggca

SEQ ID NO: 9110884 - DNA, 22 bp, Homo sapiens
atattgtgtgtacaagtagtta

SEQ ID NO: 9110885 - DNA, 22 bp, Homo sapiens
atattgttgactataagagtaa

SEQ ID NO: 9110886 - DNA, 22 bp, Homo sapiens
atattgtactagggttacatgt

SEQ ID NO: 9110887 - DNA, 22 bp, Homo sapiens
atattggtaaagtggattaaca

SEQ ID NO: 9110888 - DNA, 22 bp, Homo sapiens
atattgtactagggttacatgt

SEQ ID NO: 9110889 - DNA, 22 bp, Homo sapiens
atcaaagtgatttgtaaacagg

SEQ ID NO: 9110890 - DNA, 23 bp, Homo sapiens
atcaaagtggaaatcaattatct

SEQ ID NO: 9110891 - DNA, 20 bp, Homo sapiens
atcaaaggctgattcagtcc

SEQ ID NO: 9110892 - DNA, 22 bp, Homo sapiens
atattttggggtgatgtgcatc

SEQ ID NO: 9110893 - DNA, 22 bp, Homo sapiens
atatttaaacagggtaccaata

SEQ ID NO: 9110894 - DNA, 22 bp, Homo sapiens
ataagatgagatcagctttctg

SEQ ID NO: 9110895 - DNA, 21 bp, Homo sapiens
ataagcatgctgattacattt

SEQ ID NO: 9110896 - DNA, 22 bp, Homo sapiens
ataactttcttcacccttgctg

SEQ ID NO: 9110897 - DNA, 22 bp, Homo sapiens
ataacttcagggctgtgacaga

SEQ ID NO: 9110898 - DNA, 22 bp, Homo sapiens
ataacttcagtttctgtgtcct

SEQ ID NO: 9110899 - DNA, 22 bp, Homo sapiens
ataacttattagattggagctg

SEQ ID NO: 9110900 - DNA, 22 bp, Homo sapiens
ataacttagagtaggcaaaagt

SEQ ID NO: 9110901 - DNA, 22 bp, Homo sapiens
ataacttaatgggtcatgctct

SEQ ID NO: 9110902 - DNA, 22 bp, Homo sapiens
ataagaaacattattctttcca

SEQ ID NO: 9110903 - DNA, 22 bp, Homo sapiens
atacaacagaaaatgattattc

SEQ ID NO: 9110904 - DNA, 22 bp, Homo sapiens
atacaaatttatagatgcattt

SEQ ID NO: 9110905 - DNA, 22 bp, Homo sapiens
atacaaatttatagatgcattt

SEQ ID NO: 9110906 - DNA, 22 bp, Homo sapiens
ctgctgcaatctggcttccatg

SEQ ID NO: 9110907 - DNA, 22 bp, Homo sapiens
ctgctgcaactctttagagggt

SEQ ID NO: 9110908 - DNA, 22 bp, Homo sapiens
ctgctgatcagggcaaagcaaa

SEQ ID NO: 9110909 - DNA, 22 bp, Homo sapiens
ctgctgaggtccttgctcagac

SEQ ID NO: 9110910 - DNA, 22 bp, Homo sapiens
ctgctgaggtggagattgcagt

SEQ ID NO: 9110911 - DNA, 22 bp, Homo sapiens
ctgctgaggtatactatgtgac

SEQ ID NO: 9110912 - DNA, 22 bp, Homo sapiens
atacaactttacatgcaattcc

SEQ ID NO: 9110913 - DNA, 22 bp, Homo sapiens
atacaactgctctcagataagt

SEQ ID NO: 9110914 - DNA, 22 bp, Homo sapiens
ataacagtgacctctcagcacc

SEQ ID NO: 9110915 - DNA, 22 bp, Homo sapiens
ataacagatgcttcagcataaa

SEQ ID NO: 9110916 - DNA, 22 bp, Homo sapiens
ataacatggagtttgtcattta

SEQ ID NO: 9110917 - DNA, 22 bp, Homo sapiens
ataaatgtgaattagagctttg

SEQ ID NO: 9110918 - DNA, 22 bp, Homo sapiens
ataaatgtgaattagagctttg

SEQ ID NO: 9110919 - DNA, 22 bp, Homo sapiens
ataaatgtttgttgaatgaata

SEQ ID NO: 9110920 - DNA, 22 bp, Homo sapiens
ataacagagttgggaagtgaaa

SEQ ID NO: 9110921 - DNA, 22 bp, Homo sapiens
ataaattaggatctggggttcc

SEQ ID NO: 9110922 - DNA, 23 bp, Homo sapiens
ataaattactatctccctagagc

SEQ ID NO: 9110923 - DNA, 22 bp, Homo sapiens
ctgcctctgcgtcccacagagt

SEQ ID NO: 9110924 - DNA, 22 bp, Homo sapiens
ctgcctctgcgtcccacagagt

SEQ ID NO: 9110925 - DNA, 22 bp, Homo sapiens
ataaatggctttcattcctagg

SEQ ID NO: 9110926 - DNA, 22 bp, Homo sapiens
ataaatgcctcagaatcatccc

SEQ ID NO: 9110927 - DNA, 22 bp, Homo sapiens
ataaatgattcagcaggaaata

SEQ ID NO: 9110928 - DNA, 22 bp, Homo sapiens
ataaatgattcagcaggaaata

SEQ ID NO: 9110929 - DNA, 22 bp, Homo sapiens
ataaatgattcagcaggaaata

SEQ ID NO: 9110930 - DNA, 22 bp, Homo sapiens
ctgcctctccccagagtggccc

SEQ ID NO: 9110931 - DNA, 22 bp, Homo sapiens
ctgcctctccccagagtggccc

SEQ ID NO: 9110932 - DNA, 22 bp, Homo sapiens
ctgcctctcaggtccctgagat

SEQ ID NO: 9110933 - DNA, 22 bp, Homo sapiens
ctgcctctcaggtccctgagat

SEQ ID NO: 9110934 - DNA, 20 bp, Homo sapiens
ctgccgaccacagccatgga

SEQ ID NO: 9110935 - DNA, 22 bp, Homo sapiens
ctgcctctcagcctgaccgcca

SEQ ID NO: 9110936 - DNA, 22 bp, Homo sapiens
ctgcctctcagcctgaccgcca

SEQ ID NO: 9110937 - DNA, 22 bp, Homo sapiens
ctgccctttatttcacaaagta

SEQ ID NO: 9110938 - DNA, 22 bp, Homo sapiens
ctgccctttatttcacaaagta

SEQ ID NO: 9110939 - DNA, 23 bp, Homo sapiens
ctgcattgtctcctgggagcatg

SEQ ID NO: 9110940 - DNA, 20 bp, Homo sapiens
ctgccgaccacagccatgga

SEQ ID NO: 9110941 - DNA, 22 bp, Homo sapiens
ctgcatgtcactctgctgtccc

SEQ ID NO: 9110942 - DNA, 23 bp, Homo sapiens
ctgcatgtccactggtgtaaatg

SEQ ID NO: 9110943 - DNA, 22 bp, Homo sapiens
ctgcattacagcctccttagga

SEQ ID NO: 9110944 - DNA, 22 bp, Homo sapiens
ctgcattacaattctgctctat

SEQ ID NO: 9110945 - DNA, 22 bp, Homo sapiens
ctgcattaagttgcctgtaaga

SEQ ID NO: 9110946 - DNA, 22 bp, Homo sapiens
ctgcattattggggcctgtttc

SEQ ID NO: 9110947 - DNA, 22 bp, Homo sapiens
ctgcattattggaacggctgaa

SEQ ID NO: 9110948 - DNA, 22 bp, Homo sapiens
ctgcattagtcatgctttgcag

SEQ ID NO: 9110949 - DNA, 22 bp, Homo sapiens
ctgcattattctagtccaagcc

SEQ ID NO: 9110950 - DNA, 22 bp, Homo sapiens
ctgcattactaacaaactccca

SEQ ID NO: 9110951 - DNA, 22 bp, Homo sapiens
ctgcatctgttagattatcacc

SEQ ID NO: 9110952 - DNA, 21 bp, Homo sapiens
ctgcatctgagtcattatgcc

SEQ ID NO: 9110953 - DNA, 22 bp, Homo sapiens
ctgcatctgcataatcaacttc

SEQ ID NO: 9110954 - DNA, 22 bp, Homo sapiens
ctgcatctctgctagtcagtca

SEQ ID NO: 9110955 - DNA, 22 bp, Homo sapiens
ctgcatcttagtcaaaatctgt

SEQ ID NO: 9110956 - DNA, 22 bp, Homo sapiens
ctgcatcttagtcaaaatctgt

SEQ ID NO: 9110957 - DNA, 22 bp, Homo sapiens
ctgcatggttcaaatgagctaa

SEQ ID NO: 9110958 - DNA, 21 bp, Homo sapiens
ctgcatctcatagaacatgtc

SEQ ID NO: 9110959 - DNA, 22 bp, Homo sapiens
ctgcatctcaggagacgggtct

SEQ ID NO: 9110960 - DNA, 22 bp, Homo sapiens
ctgcatccatgttgctgcaaag

SEQ ID NO: 9110961 - DNA, 20 bp, Homo sapiens
ctgcagggttagaggctcca

SEQ ID NO: 9110962 - DNA, 22 bp, Homo sapiens
ctgcagggttcggagagttccc

SEQ ID NO: 9110963 - DNA, 20 bp, Homo sapiens
ctgcagggtgagtgggcgat

SEQ ID NO: 9110964 - DNA, 22 bp, Homo sapiens
ctgcagagatgaagaaggtggc

SEQ ID NO: 9110965 - DNA, 22 bp, Homo sapiens
ctgcagagaattgtggggcttc

SEQ ID NO: 9110966 - DNA, 23 bp, Homo sapiens
ctgcaattgcctgatctcattgg

SEQ ID NO: 9110967 - DNA, 22 bp, Homo sapiens
ctgcaatatgatgtctgagaaa

SEQ ID NO: 9110968 - DNA, 22 bp, Homo sapiens
ctgcaatagtttagaataattg

SEQ ID NO: 9110969 - DNA, 22 bp, Homo sapiens
ctgcaaataggggtgtgaataa

SEQ ID NO: 9110970 - DNA, 22 bp, Homo sapiens
ctgcaaataggggtgtgaataa

SEQ ID NO: 9110971 - DNA, 22 bp, Homo sapiens
ctgcaaatcaagttcttataat

SEQ ID NO: 9110972 - DNA, 22 bp, Homo sapiens
ctgcaaatcaagttcttataat

SEQ ID NO: 9110973 - DNA, 22 bp, Homo sapiens
ctgaggagctgaaggccctcca

SEQ ID NO: 9110974 - DNA, 22 bp, Homo sapiens
ctgaggagcgttggtcacgtgt

SEQ ID NO: 9110975 - DNA, 22 bp, Homo sapiens
ctgaggagccccctctcagcat

SEQ ID NO: 9110976 - DNA, 22 bp, Homo sapiens
ctgaggagccccctctcagcat

SEQ ID NO: 9110977 - DNA, 22 bp, Homo sapiens
ctgaggagatgggctttttagg

SEQ ID NO: 9110978 - DNA, 22 bp, Homo sapiens
ctgaggagatgataatgtcatt

SEQ ID NO: 9110979 - DNA, 22 bp, Homo sapiens
ctgaggagatccccccagaagt

SEQ ID NO: 9110980 - DNA, 22 bp, Homo sapiens
ctgaggagcagctggcccgcta

SEQ ID NO: 9110981 - DNA, 22 bp, Homo sapiens
ctgaggagcaaccccgtgccct

SEQ ID NO: 9110982 - DNA, 22 bp, Homo sapiens
ctgaggagcaaccccgtgccct

SEQ ID NO: 9110983 - DNA, 22 bp, Homo sapiens
ctgaggagcaaccccgtgccct

SEQ ID NO: 9110984 - DNA, 22 bp, Homo sapiens
agttatcatcccttacactttg

SEQ ID NO: 9110985 - DNA, 22 bp, Homo sapiens
agttatgtcctcagcaaatcaa

SEQ ID NO: 9110986 - DNA, 22 bp, Homo sapiens
atacatatatggtacttcctgg

SEQ ID NO: 9110987 - DNA, 22 bp, Homo sapiens
atacatagctgaaaacttgtag

SEQ ID NO: 9110988 - DNA, 22 bp, Homo sapiens
atacataggagaataacttcag

SEQ ID NO: 9110989 - DNA, 22 bp, Homo sapiens
atacataggagaataacttcag

SEQ ID NO: 9110990 - DNA, 22 bp, Homo sapiens
atacataggatatgtacgtgca

SEQ ID NO: 9110991 - DNA, 22 bp, Homo sapiens
atacatagtaccacatttgaca

SEQ ID NO: 9110992 - DNA, 22 bp, Homo sapiens
atacataggatatgtacgtgca

SEQ ID NO: 9110993 - DNA, 22 bp, Homo sapiens
atacatagtaccacatttgaca

SEQ ID NO: 9110994 - DNA, 22 bp, Homo sapiens
atacatagttctgtgaaaagta

SEQ ID NO: 9110995 - DNA, 22 bp, Homo sapiens
atacatagttctgtgaaaagta

SEQ ID NO: 9110996 - DNA, 22 bp, Homo sapiens
atacattcagcagtgctcatga

SEQ ID NO: 9110997 - DNA, 22 bp, Homo sapiens
atacattcatcacttttggtcc

SEQ ID NO: 9110998 - DNA, 21 bp, Homo sapiens
atacattctattaagcattta

SEQ ID NO: 9110999 - DNA, 22 bp, Homo sapiens
atacctgatcaaggcaaaaatg

SEQ ID NO: 9111000 - DNA, 22 bp, Homo sapiens
atacctgtgtatccacaagcgt

SEQ ID NO: 9111001 - DNA, 22 bp, Homo sapiens
atacccattccttgtgttcagt

SEQ ID NO: 9111002 - DNA, 22 bp, Homo sapiens
ataccataggaaaggatcagcc

SEQ ID NO: 9111003 - DNA, 22 bp, Homo sapiens
ataccatggcagtttattcacg

SEQ ID NO: 9111004 - DNA, 22 bp, Homo sapiens
atacatacatgtacacataaat

SEQ ID NO: 9111005 - DNA, 22 bp, Homo sapiens
atacataattacttccgatgtt

SEQ ID NO: 9111006 - DNA, 17 bp, Homo sapiens
atacagtttattttaca

SEQ ID NO: 9111007 - DNA, 17 bp, Homo sapiens
atacagtttattttaca

SEQ ID NO: 9111008 - DNA, 22 bp, Homo sapiens
atacatacatgtatgcacatac

SEQ ID NO: 9111009 - DNA, 22 bp, Homo sapiens
atacatagatagataatctggc

SEQ ID NO: 9111010 - DNA, 22 bp, Homo sapiens
atacatagatagataatctggc

SEQ ID NO: 9111011 - DNA, 22 bp, Homo sapiens
atacatagcagagtcaattaat

SEQ ID NO: 9111012 - DNA, 22 bp, Homo sapiens
atacatagcagagtcaattaat

SEQ ID NO: 9111013 - DNA, 22 bp, Homo sapiens
atacatagcagggtagtagatc

SEQ ID NO: 9111014 - DNA, 22 bp, Homo sapiens
atacagtatgtaggcttttcag

SEQ ID NO: 9111015 - DNA, 20 bp, Homo sapiens
atacagtaggtgctcaatat

SEQ ID NO: 9111016 - DNA, 22 bp, Homo sapiens
atacagtataactaataaaccc

SEQ ID NO: 9111017 - DNA, 22 bp, Homo sapiens
atacagtaaccacattctatag

SEQ ID NO: 9111018 - DNA, 19 bp, Homo sapiens
atacagatgtatccatgat

SEQ ID NO: 9111019 - DNA, 22 bp, Homo sapiens
atacagtagacaatctcatgaa

SEQ ID NO: 9111020 - DNA, 22 bp, Homo sapiens
atacagtagacaatctcatgaa

SEQ ID NO: 9111021 - DNA, 22 bp, Homo sapiens
atacagtaatttgtaactcatc

SEQ ID NO: 9111022 - DNA, 18 bp, Homo sapiens
ctgctgcaggcactcagg

SEQ ID NO: 9111023 - DNA, 22 bp, Homo sapiens
ctgctgcaggatgggcactctg

SEQ ID NO: 9111024 - DNA, 22 bp, Homo sapiens
ctgctgcagatgacagacccaa

SEQ ID NO: 9111025 - DNA, 22 bp, Homo sapiens
ctggaatgaagctatgtacatt

SEQ ID NO: 9111026 - DNA, 19 bp, Homo sapiens
ctggaatgagaacatgccc

SEQ ID NO: 9111027 - DNA, 19 bp, Homo sapiens
ctggaatgatagagacctc

SEQ ID NO: 9111028 - DNA, 22 bp, Homo sapiens
ctggaatgggagtcagacagag

SEQ ID NO: 9111029 - DNA, 22 bp, Homo sapiens
ctggctggccggagcgaggcgg

SEQ ID NO: 9111030 - DNA, 22 bp, Homo sapiens
ctggctggccatgtagagatga

SEQ ID NO: 9111031 - DNA, 22 bp, Homo sapiens
ctggctggccatgcagcgccag

SEQ ID NO: 9111032 - DNA, 22 bp, Homo sapiens
ctggctggcaagtagaacacaa

SEQ ID NO: 9111033 - DNA, 19 bp, Homo sapiens
atagcagctatacccagat

SEQ ID NO: 9111034 - DNA, 22 bp, Homo sapiens
atagcagtaacactgacatttt

SEQ ID NO: 9111035 - DNA, 19 bp, Homo sapiens
ctggctgcaatgccagggt

SEQ ID NO: 9111036 - DNA, 22 bp, Homo sapiens
atagcagcatttcttccaagga

SEQ ID NO: 9111037 - DNA, 22 bp, Homo sapiens
atagcacttatagatttggtct

SEQ ID NO: 9111038 - DNA, 22 bp, Homo sapiens
atagcacttattgtatgctgag

SEQ ID NO: 9111039 - DNA, 22 bp, Homo sapiens
atagcactggtttttcttggtt

SEQ ID NO: 9111040 - DNA, 22 bp, Homo sapiens
atagcagcatcagtttatctcc

SEQ ID NO: 9111041 - DNA, 22 bp, Homo sapiens
atagcaattaagctccagaatt

SEQ ID NO: 9111042 - DNA, 22 bp, Homo sapiens
atagcaaatattttaatgagca

SEQ ID NO: 9111043 - DNA, 22 bp, Homo sapiens
atagcaaattctttaggtgctt

SEQ ID NO: 9111044 - DNA, 22 bp, Homo sapiens
atagcaaatattttaatgagca

SEQ ID NO: 9111045 - DNA, 22 bp, Homo sapiens
atagcaacaccccaattttcta

SEQ ID NO: 9111046 - DNA, 22 bp, Homo sapiens
atagcaaggtatgactggagcc

SEQ ID NO: 9111047 - DNA, 22 bp, Homo sapiens
ctggctccatcactgggtgatg

SEQ ID NO: 9111048 - DNA, 22 bp, Homo sapiens
ctggctccagtgacaagtcgat

SEQ ID NO: 9111049 - DNA, 22 bp, Homo sapiens
ctggctccatcactgggtgatg

SEQ ID NO: 9111050 - DNA, 22 bp, Homo sapiens
ctggctccatcctaggcaaatg

SEQ ID NO: 9111051 - DNA, 22 bp, Homo sapiens
ctggctccatcactgggtgatg

SEQ ID NO: 9111052 - DNA, 22 bp, Homo sapiens
ctggctccatctttgcttcctg

SEQ ID NO: 9111053 - DNA, 22 bp, Homo sapiens
ctggctccattactcagcatct

SEQ ID NO: 9111054 - DNA, 22 bp, Homo sapiens
ctggctccattactcagcatct

SEQ ID NO: 9111055 - DNA, 22 bp, Homo sapiens
ctggctccatctttgcttcctg

SEQ ID NO: 9111056 - DNA, 22 bp, Homo sapiens
ctggctccatccttgagctctg

SEQ ID NO: 9111057 - DNA, 22 bp, Homo sapiens
ctggctcccgttgtccttgaag

SEQ ID NO: 9111058 - DNA, 22 bp, Homo sapiens
ctggctccctcgctgaggtgct

SEQ ID NO: 9111059 - DNA, 22 bp, Homo sapiens
ctggctcccggggatcgagcac

SEQ ID NO: 9111060 - DNA, 22 bp, Homo sapiens
ctggctcccgtctggtggccat

SEQ ID NO: 9111061 - DNA, 22 bp, Homo sapiens
ctggctcccatgagctctcacg

SEQ ID NO: 9111062 - DNA, 22 bp, Homo sapiens
ctggctcccgaagccctcagtg

SEQ ID NO: 9111063 - DNA, 22 bp, Homo sapiens
ctggctcccgaagccctcagtg

SEQ ID NO: 9111064 - DNA, 22 bp, Homo sapiens
ctggctcccatgagctctcacg

SEQ ID NO: 9111065 - DNA, 22 bp, Homo sapiens
ctggctcccatgagctctcacg

SEQ ID NO: 9111066 - DNA, 22 bp, Homo sapiens
ctggctcccagctttcagggag

SEQ ID NO: 9111067 - DNA, 22 bp, Homo sapiens
atactatattaccttctcaact

SEQ ID NO: 9111068 - DNA, 23 bp, Homo sapiens
atagactgatttggatgtgaaag

SEQ ID NO: 9111069 - DNA, 19 bp, Homo sapiens
atagagacagagtttaatc

SEQ ID NO: 9111070 - DNA, 22 bp, Homo sapiens
atagagattctggagtttgcac

SEQ ID NO: 9111071 - DNA, 22 bp, Homo sapiens
atagcaaaagcatgtgcaatac

SEQ ID NO: 9111072 - DNA, 22 bp, Homo sapiens
atagcaaagcctggcacaatga

SEQ ID NO: 9111073 - DNA, 22 bp, Homo sapiens
atagcaaagatgtcaattcccc

SEQ ID NO: 9111074 - DNA, 22 bp, Homo sapiens
atagcaaaggacaatagtcagt

SEQ ID NO: 9111075 - DNA, 22 bp, Homo sapiens
ctggccccaggcagcctgctgg

SEQ ID NO: 9111076 - DNA, 22 bp, Homo sapiens
ctggcccatggtgagctctggg

SEQ ID NO: 9111077 - DNA, 22 bp, Homo sapiens
ctggcccatggtgagctctggg

SEQ ID NO: 9111078 - DNA, 22 bp, Homo sapiens
ctggcccatggtgagctctggg

SEQ ID NO: 9111079 - DNA, 22 bp, Homo sapiens
ctctcagaagtttatgtcagaa

SEQ ID NO: 9111080 - DNA, 22 bp, Homo sapiens
ctctcagaagtagcacgtgggc

SEQ ID NO: 9111081 - DNA, 22 bp, Homo sapiens
agtggcagagtgcactcaggca

SEQ ID NO: 9111082 - DNA, 22 bp, Homo sapiens
agtggcagagtcagggtttgga

SEQ ID NO: 9111083 - DNA, 22 bp, Homo sapiens
agtggcagagtcagggtttgga

SEQ ID NO: 9111084 - DNA, 22 bp, Homo sapiens
agtggcagagtgcactcaggca

SEQ ID NO: 9111085 - DNA, 22 bp, Homo sapiens
ctcctgggaatttagttgtgag

SEQ ID NO: 9111086 - DNA, 22 bp, Homo sapiens
ctcctgggaatttagttgtgag

SEQ ID NO: 9111087 - DNA, 20 bp, Homo sapiens
ctcctgggactgctggttat

SEQ ID NO: 9111088 - DNA, 22 bp, Homo sapiens
ctcctgggaaatgaaggggcag

SEQ ID NO: 9111089 - DNA, 22 bp, Homo sapiens
ctcctgggaaatgaaggggcag

SEQ ID NO: 9111090 - DNA, 22 bp, Homo sapiens
ctcctgggaaaggctggacaca

SEQ ID NO: 9111091 - DNA, 22 bp, Homo sapiens
ctcctggggccatggaaggaac

SEQ ID NO: 9111092 - DNA, 22 bp, Homo sapiens
ctcctggggccatggaaggaac

SEQ ID NO: 9111093 - DNA, 22 bp, Homo sapiens
ctcctgggggacagcggcaggg

SEQ ID NO: 9111094 - DNA, 22 bp, Homo sapiens
ctcctgggtcattgccagcaaa

SEQ ID NO: 9111095 - DNA, 18 bp, Homo sapiens
ctccagggaactcagtca

SEQ ID NO: 9111096 - DNA, 22 bp, Homo sapiens
ctcccaggttgattctttccct

SEQ ID NO: 9111097 - DNA, 22 bp, Homo sapiens
ctcccaggttccgacgcctctt

SEQ ID NO: 9111098 - DNA, 22 bp, Homo sapiens
ctccctccctacgtgagctcac

SEQ ID NO: 9111099 - DNA, 22 bp, Homo sapiens
ctccctctcaccggagccctgg

SEQ ID NO: 9111100 - DNA, 22 bp, Homo sapiens
ctccctctcaccggagccctgg

SEQ ID NO: 9111101 - DNA, 22 bp, Homo sapiens
ctccctctcaccggagccctgg

SEQ ID NO: 9111102 - DNA, 22 bp, Homo sapiens
ctccctcaggccttagccctgc

SEQ ID NO: 9111103 - DNA, 22 bp, Homo sapiens
ctcctcagaagagggtaacaca

SEQ ID NO: 9111104 - DNA, 22 bp, Homo sapiens
ctcctcactttccagactgggc

SEQ ID NO: 9111105 - DNA, 22 bp, Homo sapiens
ctcctacagtgtttgagtccag

SEQ ID NO: 9111106 - DNA, 22 bp, Homo sapiens
ctccctctgtccgaggccggct

SEQ ID NO: 9111107 - DNA, 22 bp, Homo sapiens
agtcctggacttggagtcaggg

SEQ ID NO: 9111108 - DNA, 18 bp, Homo sapiens
agtcctggagatcaccaa

SEQ ID NO: 9111109 - DNA, 22 bp, Homo sapiens
agtcctagacttttctgccact

SEQ ID NO: 9111110 - DNA, 22 bp, Homo sapiens
agtcctaggccctgctccagat

SEQ ID NO: 9111111 - DNA, 22 bp, Homo sapiens
agtcctaggccctgctccagat

SEQ ID NO: 9111112 - DNA, 22 bp, Homo sapiens
agtcctgcatccagttacatct

SEQ ID NO: 9111113 - DNA, 22 bp, Homo sapiens
agtcctgatgctctggcaggag

SEQ ID NO: 9111114 - DNA, 22 bp, Homo sapiens
agtcctggacttggagtcaggg

SEQ ID NO: 9111115 - DNA, 22 bp, Homo sapiens
agtccgtggccagactcaagag

SEQ ID NO: 9111116 - DNA, 21 bp, Homo sapiens
agtcccctgtccttacttcta

SEQ ID NO: 9111117 - DNA, 22 bp, Homo sapiens
ctcattaaaggaaatcacctgc

SEQ ID NO: 9111118 - DNA, 22 bp, Homo sapiens
ctcatggcagagtcacctgtcc

SEQ ID NO: 9111119 - DNA, 22 bp, Homo sapiens
ctcattgcccagatccccacag

SEQ ID NO: 9111120 - DNA, 22 bp, Homo sapiens
ctcattgcaacctccgcctccc

SEQ ID NO: 9111121 - DNA, 22 bp, Homo sapiens
ctcattgcaacctccgcctccc

SEQ ID NO: 9111122 - DNA, 18 bp, Homo sapiens
ctcagtgtttgctgaaaa

SEQ ID NO: 9111123 - DNA, 22 bp, Homo sapiens
agtcctgggtccagcaggtcct

SEQ ID NO: 9111124 - DNA, 19 bp, Homo sapiens
agtcctggcctgggggacc

SEQ ID NO: 9111125 - DNA, 22 bp, Homo sapiens
agtcctggccccaaggaaggat

SEQ ID NO: 9111126 - DNA, 19 bp, Homo sapiens
agtcctggcctgggggacc

SEQ ID NO: 9111127 - DNA, 22 bp, Homo sapiens
agtcctggctctacgggcttca

SEQ ID NO: 9111128 - DNA, 22 bp, Homo sapiens
agtcttcccagaggaggtgcca

SEQ ID NO: 9111129 - DNA, 22 bp, Homo sapiens
agtcttccctgtgccagagtgt

SEQ ID NO: 9111130 - DNA, 20 bp, Homo sapiens
agtcttcccccagaagaggg

SEQ ID NO: 9111131 - DNA, 21 bp, Homo sapiens
agtcttctccagaggctgggg

SEQ ID NO: 9111132 - DNA, 22 bp, Homo sapiens
agtcttctgaataagaatcact

SEQ ID NO: 9111133 - DNA, 18 bp, Homo sapiens
agtcttctgatccatttt

SEQ ID NO: 9111134 - DNA, 22 bp, Homo sapiens
ctccagctgagtaagaacacta

SEQ ID NO: 9111135 - DNA, 22 bp, Homo sapiens
agtcttagataagtgaccaatg

SEQ ID NO: 9111136 - DNA, 22 bp, Homo sapiens
agtcttcactcttcactactat

SEQ ID NO: 9111137 - DNA, 22 bp, Homo sapiens
agtcttcagcatagcatatggc

SEQ ID NO: 9111138 - DNA, 23 bp, Homo sapiens
agtcttcattgtatttccagacc

SEQ ID NO: 9111139 - DNA, 22 bp, Homo sapiens
agtcttcagcagccttctcagg

SEQ ID NO: 9111140 - DNA, 22 bp, Homo sapiens
ctccaggctggatccaagtcaa

SEQ ID NO: 9111141 - DNA, 22 bp, Homo sapiens
ctccagcttctgcccagagact

SEQ ID NO: 9111142 - DNA, 22 bp, Homo sapiens
ctctgggaaagattgtgcaggc

SEQ ID NO: 9111143 - DNA, 22 bp, Homo sapiens
ctctgggaagggctgagcactg

SEQ ID NO: 9111144 - DNA, 22 bp, Homo sapiens
ctctgggaattctgagcaagca

SEQ ID NO: 9111145 - DNA, 22 bp, Homo sapiens
ctctgggaattctgagcaagca

SEQ ID NO: 9111146 - DNA, 22 bp, Homo sapiens
ctctggctttgctcatgcatcc

SEQ ID NO: 9111147 - DNA, 22 bp, Homo sapiens
ctctggctttgctcatgcatcc

SEQ ID NO: 9111148 - DNA, 22 bp, Homo sapiens
ctctggcttgttaatgcatatt

SEQ ID NO: 9111149 - DNA, 22 bp, Homo sapiens
ctctgggaccatggcaagtgcg

SEQ ID NO: 9111150 - DNA, 18 bp, Homo sapiens
ctctgggagaggcataca

SEQ ID NO: 9111151 - DNA, 22 bp, Homo sapiens
ctctgggcttgttgacctgcac

SEQ ID NO: 9111152 - DNA, 22 bp, Homo sapiens
ctctgggcttcaagtcagattt

SEQ ID NO: 9111153 - DNA, 22 bp, Homo sapiens
ctctgggcttcctttgtgggtt

SEQ ID NO: 9111154 - DNA, 20 bp, Homo sapiens
ctctgggctgcgttgcaaac

SEQ ID NO: 9111155 - DNA, 22 bp, Homo sapiens
ctctgggcttacctgcttcctg

SEQ ID NO: 9111156 - DNA, 19 bp, Homo sapiens
ctctgggctgcatcttggt

SEQ ID NO: 9111157 - DNA, 22 bp, Homo sapiens
ctctgggctgccttttagctct

SEQ ID NO: 9111158 - DNA, 22 bp, Homo sapiens
ctctttggtgcaccttgcagtc

SEQ ID NO: 9111159 - DNA, 22 bp, Homo sapiens
ctctggggtggaggaggctgac

SEQ ID NO: 9111160 - DNA, 22 bp, Homo sapiens
ctctgggcttgttgacctgcac

SEQ ID NO: 9111161 - DNA, 22 bp, Homo sapiens
ctctggggaagcagccagctgg

SEQ ID NO: 9111162 - DNA, 22 bp, Homo sapiens
ctctgcaggcacccagggtggg

SEQ ID NO: 9111163 - DNA, 23 bp, Homo sapiens
ctctgcaggagagtgggcagggc

SEQ ID NO: 9111164 - DNA, 23 bp, Homo sapiens
ctctgcaggagagtgggcagggc

SEQ ID NO: 9111165 - DNA, 21 bp, Homo sapiens
ctctgcagccctgcttccagg

SEQ ID NO: 9111166 - DNA, 22 bp, Homo sapiens
ctctgcaggccttgagtgtggt

SEQ ID NO: 9111167 - DNA, 22 bp, Homo sapiens
ctctgcaggccttgagtgtggt

SEQ ID NO: 9111168 - DNA, 17 bp, Homo sapiens
ctctgcagtgcatggct

SEQ ID NO: 9111169 - DNA, 22 bp, Homo sapiens
ctctcagtaaatttctgcccca

SEQ ID NO: 9111170 - DNA, 22 bp, Homo sapiens
ctctcagtcctgcgcgcctctg

SEQ ID NO: 9111171 - DNA, 19 bp, Homo sapiens
ctctcagcctgtctccttg

SEQ ID NO: 9111172 - DNA, 22 bp, Homo sapiens
ctctcagtgccacacagccatt

SEQ ID NO: 9111173 - DNA, 22 bp, Homo sapiens
ctctcagtgcctgccctaggct

SEQ ID NO: 9111174 - DNA, 22 bp, Homo sapiens
ctctgcatcagcttcattctgt

SEQ ID NO: 9111175 - DNA, 22 bp, Homo sapiens
ctctgcagtgtaacagcgcttg

SEQ ID NO: 9111176 - DNA, 21 bp, Homo sapiens
ctctgcagtgcccaccttgcc

SEQ ID NO: 9111177 - DNA, 22 bp, Homo sapiens
ctctgcctgccactgttcaggc

SEQ ID NO: 9111178 - DNA, 22 bp, Homo sapiens
ctctgcctgtctcatcctgcaa

SEQ ID NO: 9111179 - DNA, 22 bp, Homo sapiens
ctctgcctgtgtcgccaccaca

SEQ ID NO: 9111180 - DNA, 22 bp, Homo sapiens
ctctgcctgtgtcgccaccaca

SEQ ID NO: 9111181 - DNA, 22 bp, Homo sapiens
ctctgcctgcccaccgacccat

SEQ ID NO: 9111182 - DNA, 22 bp, Homo sapiens
ctctgcctgtctcatcctgcaa

SEQ ID NO: 9111183 - DNA, 22 bp, Homo sapiens
ctctgctgagccagagtcccca

SEQ ID NO: 9111184 - DNA, 22 bp, Homo sapiens
ctctgctcaccagccatgtgat

SEQ ID NO: 9111185 - DNA, 22 bp, Homo sapiens
ctctgctgatatagcttttcaa

SEQ ID NO: 9111186 - DNA, 22 bp, Homo sapiens
ctctgctgatctcagctgggct

SEQ ID NO: 9111187 - DNA, 23 bp, Homo sapiens
ctctggatcctgtagctcctggc

SEQ ID NO: 9111188 - DNA, 22 bp, Homo sapiens
ctgaggagaggtggcctgtgtt

SEQ ID NO: 9111189 - DNA, 22 bp, Homo sapiens
ctgaggagaggtggcctgtgtt

SEQ ID NO: 9111190 - DNA, 22 bp, Homo sapiens
ctgaggagaccatcaactaatt

SEQ ID NO: 9111191 - DNA, 22 bp, Homo sapiens
ctgaggagacagaagccaaata

SEQ ID NO: 9111192 - DNA, 22 bp, Homo sapiens
ctgaggagagatcacgtggtgt

SEQ ID NO: 9111193 - DNA, 22 bp, Homo sapiens
ctgaggagagatcacgtggtgt

SEQ ID NO: 9111194 - DNA, 22 bp, Homo sapiens
ctgaggagaccatcaactaatt

SEQ ID NO: 9111195 - DNA, 17 bp, Homo sapiens
ctgaggagaacagaaag

SEQ ID NO: 9111196 - DNA, 22 bp, Homo sapiens
ctgaggagaacaatgagatcaa

SEQ ID NO: 9111197 - DNA, 22 bp, Homo sapiens
ctgagcagcagggagactggtg

SEQ ID NO: 9111198 - DNA, 22 bp, Homo sapiens
ctgagctgggactcagtagcaa

SEQ ID NO: 9111199 - DNA, 22 bp, Homo sapiens
ctgagctgggactcagtagcaa

SEQ ID NO: 9111200 - DNA, 22 bp, Homo sapiens
ctgagctgggactcagtagcaa

SEQ ID NO: 9111201 - DNA, 22 bp, Homo sapiens
agttataatctgctactgatat

SEQ ID NO: 9111202 - DNA, 22 bp, Homo sapiens
agttatataactatctagatgc

SEQ ID NO: 9111203 - DNA, 22 bp, Homo sapiens
ctgagcagaggtcaagatactt

SEQ ID NO: 9111204 - DNA, 22 bp, Homo sapiens
ctgagcagcaacccagagcctc

SEQ ID NO: 9111205 - DNA, 22 bp, Homo sapiens
ctgagcagcaccttcaagaaac

SEQ ID NO: 9111206 - DNA, 22 bp, Homo sapiens
ctgagcagcacagggcgccagg

SEQ ID NO: 9111207 - DNA, 22 bp, Homo sapiens
ctgagcagcacagggcgccagg

SEQ ID NO: 9111208 - DNA, 22 bp, Homo sapiens
ctgagcagcacagggcgccagg

SEQ ID NO: 9111209 - DNA, 22 bp, Homo sapiens
ctgagcagcaattgctggccca

SEQ ID NO: 9111210 - DNA, 22 bp, Homo sapiens
ctgagcagcaacccagagcctc

SEQ ID NO: 9111211 - DNA, 22 bp, Homo sapiens
ctgagcagcaacccagagcctc

SEQ ID NO: 9111212 - DNA, 22 bp, Homo sapiens
agttagaatataattatgttaa

SEQ ID NO: 9111213 - DNA, 22 bp, Homo sapiens
agttactttctgatcagtgtgt

SEQ ID NO: 9111214 - DNA, 22 bp, Homo sapiens
ctgaagctttacttcaaataca

SEQ ID NO: 9111215 - DNA, 20 bp, Homo sapiens
agtgtctgggcctcaggccc

SEQ ID NO: 9111216 - DNA, 20 bp, Homo sapiens
agtgtctggattttgtaacc

SEQ ID NO: 9111217 - DNA, 22 bp, Homo sapiens
agtgtctggaggcattcttggt

SEQ ID NO: 9111218 - DNA, 18 bp, Homo sapiens
agtgtctggatatttggg

SEQ ID NO: 9111219 - DNA, 22 bp, Homo sapiens
agtgtctgcttatcagttcttg

SEQ ID NO: 9111220 - DNA, 22 bp, Homo sapiens
agtgtctgctttgagtcaggtg

SEQ ID NO: 9111221 - DNA, 22 bp, Homo sapiens
agtgtctgctttgagtcaggtg

SEQ ID NO: 9111222 - DNA, 22 bp, Homo sapiens
ctgaaatggttgcctggagaat

SEQ ID NO: 9111223 - DNA, 22 bp, Homo sapiens
ctgaaatgttaaatacttggct

SEQ ID NO: 9111224 - DNA, 22 bp, Homo sapiens
agtgtctgcctgggaggagcat

SEQ ID NO: 9111225 - DNA, 22 bp, Homo sapiens
agtgtctgcctgggaggagcat

SEQ ID NO: 9111226 - DNA, 22 bp, Homo sapiens
agtgtctgctcagacagctaca

SEQ ID NO: 9111227 - DNA, 22 bp, Homo sapiens
agtgtctgctcagacagctaca

SEQ ID NO: 9111228 - DNA, 22 bp, Homo sapiens
agtgtctgctaggttcatcaac

SEQ ID NO: 9111229 - DNA, 22 bp, Homo sapiens
agtgtctgcggcggggaggcgg

SEQ ID NO: 9111230 - DNA, 22 bp, Homo sapiens
agtgtctgcgggcagaggagcg

SEQ ID NO: 9111231 - DNA, 22 bp, Homo sapiens
agtgtctgcgggcagaggagcg

SEQ ID NO: 9111232 - DNA, 22 bp, Homo sapiens
ctgaatgtcgatcagcttgggt

SEQ ID NO: 9111233 - DNA, 22 bp, Homo sapiens
ctgacaaaccactgctccagct

SEQ ID NO: 9111234 - DNA, 22 bp, Homo sapiens
ctgacagatacttatgacataa

SEQ ID NO: 9111235 - DNA, 22 bp, Homo sapiens
ctgagaaaagacatttctagat

SEQ ID NO: 9111236 - DNA, 22 bp, Homo sapiens
aggtggggaggagtgtctcttt

SEQ ID NO: 9111237 - DNA, 22 bp, Homo sapiens
cctgtgcattgagtttgcaccc

SEQ ID NO: 9111238 - DNA, 18 bp, Homo sapiens
cctgtgtgtgttgcaggc

SEQ ID NO: 9111239 - DNA, 22 bp, Homo sapiens
cctgtcctccaagagcacatct

SEQ ID NO: 9111240 - DNA, 22 bp, Homo sapiens
cctgtctccctggcatggctca

SEQ ID NO: 9111241 - DNA, 20 bp, Homo sapiens
cctgtctcctcttacctggc

SEQ ID NO: 9111242 - DNA, 20 bp, Homo sapiens
cctgtccaagctccacccca

SEQ ID NO: 9111243 - DNA, 22 bp, Homo sapiens
cctgtcatactaacgtagtggg

SEQ ID NO: 9111244 - DNA, 22 bp, Homo sapiens
cctgtcccaagcagggctggcc

SEQ ID NO: 9111245 - DNA, 22 bp, Homo sapiens
cctgtgaggtcatctgtggtaa

SEQ ID NO: 9111246 - DNA, 19 bp, Homo sapiens
cctgtgagaggacaggtgt

SEQ ID NO: 9111247 - DNA, 20 bp, Homo sapiens
cctgtctcctcttacctggc

SEQ ID NO: 9111248 - DNA, 22 bp, Homo sapiens
cctgtgcaggctccataataga

SEQ ID NO: 9111249 - DNA, 22 bp, Homo sapiens
cctgtgcactatctgcattttt

SEQ ID NO: 9111250 - DNA, 22 bp, Homo sapiens
cctgtgcagcccttgccagttt

SEQ ID NO: 9111251 - DNA, 19 bp, Homo sapiens
cctgtgcacatgtgtcctt

SEQ ID NO: 9111252 - DNA, 22 bp, Homo sapiens
cctgtgaggtcttgcatgtgaa

SEQ ID NO: 9111253 - DNA, 22 bp, Homo sapiens
cctgggctcacagccaaggctc

SEQ ID NO: 9111254 - DNA, 22 bp, Homo sapiens
cctgggctcaccatgccttgga

SEQ ID NO: 9111255 - DNA, 22 bp, Homo sapiens
cctgggctcaccatgccttgga

SEQ ID NO: 9111256 - DNA, 22 bp, Homo sapiens
cctgggctcaagtgatggtccc

SEQ ID NO: 9111257 - DNA, 22 bp, Homo sapiens
cctgggctcaagtgatggtccc

SEQ ID NO: 9111258 - DNA, 22 bp, Homo sapiens
cctgggctcaggcttgggcagc

SEQ ID NO: 9111259 - DNA, 22 bp, Homo sapiens
cctgggctcaccatgccttgga

SEQ ID NO: 9111260 - DNA, 22 bp, Homo sapiens
cctgggctcaccatgccttgga

SEQ ID NO: 9111261 - DNA, 22 bp, Homo sapiens
cctgggctccactccaagagca

SEQ ID NO: 9111262 - DNA, 22 bp, Homo sapiens
cctgggctccactccaagagca

SEQ ID NO: 9111263 - DNA, 22 bp, Homo sapiens
cctgggcataaatcactccaag

SEQ ID NO: 9111264 - DNA, 22 bp, Homo sapiens
cctgggcataaatcactccaag

SEQ ID NO: 9111265 - DNA, 22 bp, Homo sapiens
cctggctctgtcctcgcgcaaa

SEQ ID NO: 9111266 - DNA, 22 bp, Homo sapiens
cctggctctgtcctcgcgcaaa

SEQ ID NO: 9111267 - DNA, 22 bp, Homo sapiens
cctggctctggttccctcagct

SEQ ID NO: 9111268 - DNA, 22 bp, Homo sapiens
cctggctctggttccctcagct

SEQ ID NO: 9111269 - DNA, 22 bp, Homo sapiens
cctggctctgggatcttcgctt

SEQ ID NO: 9111270 - DNA, 22 bp, Homo sapiens
cctggctctgcgtgcagctccg

SEQ ID NO: 9111271 - DNA, 22 bp, Homo sapiens
cctggctctgcgtgcagctccg

SEQ ID NO: 9111272 - DNA, 22 bp, Homo sapiens
cctgggctttcaaaaccagcct

SEQ ID NO: 9111273 - DNA, 22 bp, Homo sapiens
cctgggctttcaaaaccagcct

SEQ ID NO: 9111274 - DNA, 22 bp, Homo sapiens
cctgggctttcaaaaccagcct

SEQ ID NO: 9111275 - DNA, 22 bp, Homo sapiens
cctgggctttcggcggcttcct

SEQ ID NO: 9111276 - DNA, 22 bp, Homo sapiens
cctgggctttcggcggcttcct

SEQ ID NO: 9111277 - DNA, 22 bp, Homo sapiens
cctgggctttcggcggcttcct

SEQ ID NO: 9111278 - DNA, 22 bp, Homo sapiens
cctgtcagttgctgtcagggat

SEQ ID NO: 9111279 - DNA, 22 bp, Homo sapiens
cctgtcagttgctgtcagggat

SEQ ID NO: 9111280 - DNA, 22 bp, Homo sapiens
cctgtcagttgctgtcagggat

SEQ ID NO: 9111281 - DNA, 22 bp, Homo sapiens
cctgtcagctgatggctatgta

SEQ ID NO: 9111282 - DNA, 22 bp, Homo sapiens
cctgtcagggtttgcctcagaa

SEQ ID NO: 9111283 - DNA, 22 bp, Homo sapiens
cctggtgctgctatcaggggta

SEQ ID NO: 9111284 - DNA, 20 bp, Homo sapiens
cctgggctccaggagccccg

SEQ ID NO: 9111285 - DNA, 20 bp, Homo sapiens
cctgggctccaggagccccg

SEQ ID NO: 9111286 - DNA, 22 bp, Homo sapiens
cctgggcttctgtctagatgtt

SEQ ID NO: 9111287 - DNA, 22 bp, Homo sapiens
cctgggcttctgtctagatgtt

SEQ ID NO: 9111288 - DNA, 22 bp, Homo sapiens
cctgggctcgcgcacttcaccc

SEQ ID NO: 9111289 - DNA, 22 bp, Homo sapiens
cctgggctcgcgcacttcaccc

SEQ ID NO: 9111290 - DNA, 22 bp, Homo sapiens
cctgggcttgcatctgtgctgg

SEQ ID NO: 9111291 - DNA, 22 bp, Homo sapiens
cctgggcttgcatctgtgctgg

SEQ ID NO: 9111292 - DNA, 22 bp, Homo sapiens
cctgggcttggttgttgagaac

SEQ ID NO: 9111293 - DNA, 22 bp, Homo sapiens
cctgggcttctgtctagatgtt

SEQ ID NO: 9111294 - DNA, 22 bp, Homo sapiens
cctgggcttgcatctgtgctgg

SEQ ID NO: 9111295 - DNA, 22 bp, Homo sapiens
cctgcagagccacgtgccagcg

SEQ ID NO: 9111296 - DNA, 22 bp, Homo sapiens
cctgcagagcaggagaggcatc

SEQ ID NO: 9111297 - DNA, 22 bp, Homo sapiens
cctgcagagcaggagaggcatc

SEQ ID NO: 9111298 - DNA, 22 bp, Homo sapiens
cctgcagagggactggcaggaa

SEQ ID NO: 9111299 - DNA, 22 bp, Homo sapiens
cctgcagaggtcaggccagaaa

SEQ ID NO: 9111300 - DNA, 22 bp, Homo sapiens
cctgcagatgtgggacagctgt

SEQ ID NO: 9111301 - DNA, 21 bp, Homo sapiens
cctgcagcaccagaaggagat

SEQ ID NO: 9111302 - DNA, 22 bp, Homo sapiens
cctgcagatgtgggacagctgt

SEQ ID NO: 9111303 - DNA, 18 bp, Homo sapiens
cctgcagcccaggaggcc

SEQ ID NO: 9111304 - DNA, 18 bp, Homo sapiens
cctgcagcccaggaggcc

SEQ ID NO: 9111305 - DNA, 23 bp, Homo sapiens
cctgcagctgccacgccctgctc

SEQ ID NO: 9111306 - DNA, 23 bp, Homo sapiens
cctgcagctgctggggctccacc

SEQ ID NO: 9111307 - DNA, 22 bp, Homo sapiens
cctgccagatcccctgagctga

SEQ ID NO: 9111308 - DNA, 22 bp, Homo sapiens
cctgccagcatggcttatctcc

SEQ ID NO: 9111309 - DNA, 22 bp, Homo sapiens
cctgccagcccgcgttcatgcc

SEQ ID NO: 9111310 - DNA, 22 bp, Homo sapiens
aggtaggatgggtggagatgat

SEQ ID NO: 9111311 - DNA, 21 bp, Homo sapiens
cctgccaggaaactgagtgtc

SEQ ID NO: 9111312 - DNA, 22 bp, Homo sapiens
cctgccagcgcttatctctcgg

SEQ ID NO: 9111313 - DNA, 23 bp, Homo sapiens
aggtaggttattgctgctacctg

SEQ ID NO: 9111314 - DNA, 22 bp, Homo sapiens
aggtccctgcagcagactgcca

SEQ ID NO: 9111315 - DNA, 22 bp, Homo sapiens
aggtcccaggcatagctggtct

SEQ ID NO: 9111316 - DNA, 21 bp, Homo sapiens
aggtcccaggtttgggcagca

SEQ ID NO: 9111317 - DNA, 22 bp, Homo sapiens
aggtccagttttctgacaaggg

SEQ ID NO: 9111318 - DNA, 22 bp, Homo sapiens
aggtccatagaggcactgatct

SEQ ID NO: 9111319 - DNA, 22 bp, Homo sapiens
aggtccatcgtggatgaactgc

SEQ ID NO: 9111320 - DNA, 22 bp, Homo sapiens
aggtccatcttaaatgcactca

SEQ ID NO: 9111321 - DNA, 22 bp, Homo sapiens
cctggctctgccgtaaccacca

SEQ ID NO: 9111322 - DNA, 22 bp, Homo sapiens
cctggctctgcagccactccag

SEQ ID NO: 9111323 - DNA, 22 bp, Homo sapiens
cctggctctgcagccactccag

SEQ ID NO: 9111324 - DNA, 22 bp, Homo sapiens
aggtcctgaagattttactaga

SEQ ID NO: 9111325 - DNA, 19 bp, Homo sapiens
cctggctctgagcccagcc

SEQ ID NO: 9111326 - DNA, 22 bp, Homo sapiens
aggtcctgagggttcgtctgca

SEQ ID NO: 9111327 - DNA, 22 bp, Homo sapiens
aggtcctgagggttcgtctgca

SEQ ID NO: 9111328 - DNA, 22 bp, Homo sapiens
aggtcctgactccacgttctag

SEQ ID NO: 9111329 - DNA, 22 bp, Homo sapiens
aggtcctgacgccctttgaaat

SEQ ID NO: 9111330 - DNA, 22 bp, Homo sapiens
aggtcctgacgccctttgaaat

SEQ ID NO: 9111331 - DNA, 22 bp, Homo sapiens
aggtcctgaagattttactaga

SEQ ID NO: 9111332 - DNA, 22 bp, Homo sapiens
cctggatgatccatgtcatgga

SEQ ID NO: 9111333 - DNA, 22 bp, Homo sapiens
cctggagttgaaggaaggtggg

SEQ ID NO: 9111334 - DNA, 22 bp, Homo sapiens
cctggagtgacaggtgtagcct

SEQ ID NO: 9111335 - DNA, 19 bp, Homo sapiens
cctggagtcgcgctgcctc

SEQ ID NO: 9111336 - DNA, 22 bp, Homo sapiens
ctacattttgtgattatgaaat

SEQ ID NO: 9111337 - DNA, 22 bp, Homo sapiens
ctacattttgtgattatgaaat

SEQ ID NO: 9111338 - DNA, 22 bp, Homo sapiens
ctacatttgttctatagctttt

SEQ ID NO: 9111339 - DNA, 22 bp, Homo sapiens
ctacatttgttcaaataagctg

SEQ ID NO: 9111340 - DNA, 22 bp, Homo sapiens
ctacatttggagagtataggaa

SEQ ID NO: 9111341 - DNA, 22 bp, Homo sapiens
ctacatttcccagctgccttcc

SEQ ID NO: 9111342 - DNA, 22 bp, Homo sapiens
ctagaaatattttacagtcaag

SEQ ID NO: 9111343 - DNA, 22 bp, Homo sapiens
ctacccagagtgaatctcttaa

SEQ ID NO: 9111344 - DNA, 22 bp, Homo sapiens
ctagaaatctctgtttacatca

SEQ ID NO: 9111345 - DNA, 22 bp, Homo sapiens
ctaaggaaaggaaatacagtaa

SEQ ID NO: 9111346 - DNA, 22 bp, Homo sapiens
ctaagcataatggtgctttaag

SEQ ID NO: 9111347 - DNA, 22 bp, Homo sapiens
agtatttagagacacaagatgg

SEQ ID NO: 9111348 - DNA, 22 bp, Homo sapiens
agtattctggtttttcaggtgg

SEQ ID NO: 9111349 - DNA, 22 bp, Homo sapiens
agtattctggaattctatgtga

SEQ ID NO: 9111350 - DNA, 22 bp, Homo sapiens
agtcccagctactcaagaggct

SEQ ID NO: 9111351 - DNA, 22 bp, Homo sapiens
agtcccagctactcaagaggct

SEQ ID NO: 9111352 - DNA, 23 bp, Homo sapiens
ctagtaaatcctgaatagcaggc

SEQ ID NO: 9111353 - DNA, 22 bp, Homo sapiens
ctagtaaagctatgattctgcc

SEQ ID NO: 9111354 - DNA, 22 bp, Homo sapiens
ctagtaaagtactcaaatagcc

SEQ ID NO: 9111355 - DNA, 22 bp, Homo sapiens
ctagtaaagtactcaaatagcc

SEQ ID NO: 9111356 - DNA, 22 bp, Homo sapiens
ctaggttgatgcaaaaggaact

SEQ ID NO: 9111357 - DNA, 22 bp, Homo sapiens
ctaggtgatccactgctctctt

SEQ ID NO: 9111358 - DNA, 19 bp, Homo sapiens
agtccatgaatggaggatg

SEQ ID NO: 9111359 - DNA, 22 bp, Homo sapiens
agtccatagtttacattacagc

SEQ ID NO: 9111360 - DNA, 22 bp, Homo sapiens
agtccatcttctcttgctggtc

SEQ ID NO: 9111361 - DNA, 22 bp, Homo sapiens
ctagggtcaggggcctgcgtcg

SEQ ID NO: 9111362 - DNA, 22 bp, Homo sapiens
agtccaataacctctttccttc

SEQ ID NO: 9111363 - DNA, 22 bp, Homo sapiens
ctagaatatcatatgaagagac

SEQ ID NO: 9111364 - DNA, 22 bp, Homo sapiens
ctagaacagaaagtacaggaaa

SEQ ID NO: 9111365 - DNA, 22 bp, Homo sapiens
ctagaacagtcaaagtgagctc

SEQ ID NO: 9111366 - DNA, 22 bp, Homo sapiens
ctagaaggaagcccagcacttc

SEQ ID NO: 9111367 - DNA, 22 bp, Homo sapiens
agtccatacattgagaataaca

SEQ ID NO: 9111368 - DNA, 22 bp, Homo sapiens
agtccagggcttagtcagcggg

SEQ ID NO: 9111369 - DNA, 22 bp, Homo sapiens
agtccagggcttagtcagcggg

SEQ ID NO: 9111370 - DNA, 22 bp, Homo sapiens
agtccagggctctctgtgggat

SEQ ID NO: 9111371 - DNA, 22 bp, Homo sapiens
agtccagggagcccaggctttg

SEQ ID NO: 9111372 - DNA, 22 bp, Homo sapiens
agtacacaagacacatttaaaa

SEQ ID NO: 9111373 - DNA, 22 bp, Homo sapiens
agtacaatgtctgacacagtag

SEQ ID NO: 9111374 - DNA, 22 bp, Homo sapiens
agtacaatgtctgacacagtag

SEQ ID NO: 9111375 - DNA, 22 bp, Homo sapiens
agtacacagaattctacttgtt

SEQ ID NO: 9111376 - DNA, 22 bp, Homo sapiens
agtacacagtagactttctcat

SEQ ID NO: 9111377 - DNA, 19 bp, Homo sapiens
agtacagaaaagagccctg

SEQ ID NO: 9111378 - DNA, 22 bp, Homo sapiens
agtacagacctgtctcttcctg

SEQ ID NO: 9111379 - DNA, 22 bp, Homo sapiens
agtacagacctgtctcttcctg

SEQ ID NO: 9111380 - DNA, 22 bp, Homo sapiens
agtacagatttagacacgatag

SEQ ID NO: 9111381 - DNA, 22 bp, Homo sapiens
agtacagatttctgggccctac

SEQ ID NO: 9111382 - DNA, 22 bp, Homo sapiens
ctaaacttcttggcaattttat

SEQ ID NO: 9111383 - DNA, 22 bp, Homo sapiens
ctaaactttgtttatactctga

SEQ ID NO: 9111384 - DNA, 22 bp, Homo sapiens
ctaaacttcatatgttgcttta

SEQ ID NO: 9111385 - DNA, 22 bp, Homo sapiens
ctaagacatgccctgcatgata

SEQ ID NO: 9111386 - DNA, 19 bp, Homo sapiens
ctaaacttatgtgaccaca

SEQ ID NO: 9111387 - DNA, 22 bp, Homo sapiens
ctaagaaatgttgtgaatgcca

SEQ ID NO: 9111388 - DNA, 22 bp, Homo sapiens
ctaagcaagaatgagtgcaaca

SEQ ID NO: 9111389 - DNA, 21 bp, Homo sapiens
ctaagcaaggagcaggggtag

SEQ ID NO: 9111390 - DNA, 17 bp, Homo sapiens
cgggcatggagggcagg

SEQ ID NO: 9111391 - DNA, 22 bp, Homo sapiens
cgggcaaggcgagactaggccc

SEQ ID NO: 9111392 - DNA, 22 bp, Homo sapiens
cgggcacacacttgacaggttc

SEQ ID NO: 9111393 - DNA, 22 bp, Homo sapiens
cgggcagattgggaaggttcat

SEQ ID NO: 9111394 - DNA, 22 bp, Homo sapiens
cgggcagatcacacagggcttg

SEQ ID NO: 9111395 - DNA, 22 bp, Homo sapiens
cgggctcagcccggcccctcgc

SEQ ID NO: 9111396 - DNA, 20 bp, Homo sapiens
agtacaatgtatgattcaga

SEQ ID NO: 9111397 - DNA, 20 bp, Homo sapiens
agtacaatgtatgattcaga

SEQ ID NO: 9111398 - DNA, 22 bp, Homo sapiens
cgggcgcactccgggcagctgt

SEQ ID NO: 9111399 - DNA, 18 bp, Homo sapiens
cgggcgggcgcctggccc

SEQ ID NO: 9111400 - DNA, 22 bp, Homo sapiens
cgggctcagccagcccattctt

SEQ ID NO: 9111401 - DNA, 22 bp, Homo sapiens
cctgttcaccatggtcacgtgc

SEQ ID NO: 9111402 - DNA, 18 bp, Homo sapiens
cctgtgtgtgttgcaggc

SEQ ID NO: 9111403 - DNA, 20 bp, Homo sapiens
cctgttccattccctcaacc

SEQ ID NO: 9111404 - DNA, 19 bp, Homo sapiens
cctgttcttggctgaggct

SEQ ID NO: 9111405 - DNA, 22 bp, Homo sapiens
cctgttcagagctaagcatcat

SEQ ID NO: 9111406 - DNA, 22 bp, Homo sapiens
cctgttcaccctccatgcacag

SEQ ID NO: 9111407 - DNA, 19 bp, Homo sapiens
cctgttcttggctgaggct

SEQ ID NO: 9111408 - DNA, 22 bp, Homo sapiens
cctgttgtctcttcctgttgac

SEQ ID NO: 9111409 - DNA, 22 bp, Homo sapiens
cgaggccatgcatgctgaggac

SEQ ID NO: 9111410 - DNA, 17 bp, Homo sapiens
cctgttgttgcctttgc

SEQ ID NO: 9111411 - DNA, 22 bp, Homo sapiens
cgaggcggcggaagtgcccgta

SEQ ID NO: 9111412 - DNA, 22 bp, Homo sapiens
cgcaggctccggggtgccctgg

SEQ ID NO: 9111413 - DNA, 22 bp, Homo sapiens
cgcaggcaatgctccgcggggg

SEQ ID NO: 9111414 - DNA, 19 bp, Homo sapiens
cgcaggagccgaggtgacc

SEQ ID NO: 9111415 - DNA, 19 bp, Homo sapiens
cgcaggagccgaggtgacc

SEQ ID NO: 9111416 - DNA, 22 bp, Homo sapiens
cgcagctgtccatgtgtggggg

SEQ ID NO: 9111417 - DNA, 22 bp, Homo sapiens
cgcaggctgcagccaagaagag

SEQ ID NO: 9111418 - DNA, 22 bp, Homo sapiens
cgcaggctcggttcacagagca

SEQ ID NO: 9111419 - DNA, 22 bp, Homo sapiens
cgcaggctcggttcacagagca

SEQ ID NO: 9111420 - DNA, 22 bp, Homo sapiens
aggtttctgcaatgtgtgtaca

SEQ ID NO: 9111421 - DNA, 22 bp, Homo sapiens
aggtttctgctgtcctccttct

SEQ ID NO: 9111422 - DNA, 22 bp, Homo sapiens
aggtttctgcactgtcactggt

SEQ ID NO: 9111423 - DNA, 22 bp, Homo sapiens
agtaaaaagttcagaatggttg

SEQ ID NO: 9111424 - DNA, 22 bp, Homo sapiens
cggctcagctagcttggcccca

SEQ ID NO: 9111425 - DNA, 22 bp, Homo sapiens
aggtttctggaaaggttttgct

SEQ ID NO: 9111426 - DNA, 22 bp, Homo sapiens
aggtttctggatttattatggc

SEQ ID NO: 9111427 - DNA, 21 bp, Homo sapiens
aggtttctgtgagcagagcag

SEQ ID NO: 9111428 - DNA, 22 bp, Homo sapiens
aggtttcttcttaggaatatgt

SEQ ID NO: 9111429 - DNA, 22 bp, Homo sapiens
aggtttctttatgctgctagaa

SEQ ID NO: 9111430 - DNA, 18 bp, Homo sapiens
aggtttggtggaaacata

SEQ ID NO: 9111431 - DNA, 22 bp, Homo sapiens
aggtttggtttgacaagactga

SEQ ID NO: 9111432 - DNA, 22 bp, Homo sapiens
aggcttttgctctggctcctct

SEQ ID NO: 9111433 - DNA, 22 bp, Homo sapiens
aggctttggggcattctgtgtt

SEQ ID NO: 9111434 - DNA, 22 bp, Homo sapiens
agggaaaggctgatgctgtggg

SEQ ID NO: 9111435 - DNA, 21 bp, Homo sapiens
agggaaagaaaatgagctaat

SEQ ID NO: 9111436 - DNA, 22 bp, Homo sapiens
aggctttggaatcagagttctg

SEQ ID NO: 9111437 - DNA, 22 bp, Homo sapiens
aggctttgcaaaaaagctcata

SEQ ID NO: 9111438 - DNA, 22 bp, Homo sapiens
cccagatgcaggttcaagagta

SEQ ID NO: 9111439 - DNA, 22 bp, Homo sapiens
aggcttggctctcctatgagaa

SEQ ID NO: 9111440 - DNA, 22 bp, Homo sapiens
cccagagttggtcaggggaccc

SEQ ID NO: 9111441 - DNA, 22 bp, Homo sapiens
aggcttggctggcagccctggg

SEQ ID NO: 9111442 - DNA, 22 bp, Homo sapiens
agggaaataatctattctgagg

SEQ ID NO: 9111443 - DNA, 22 bp, Homo sapiens
cccaggaagttgagactgcagt

SEQ ID NO: 9111444 - DNA, 22 bp, Homo sapiens
agggagcttctggcctcagcct

SEQ ID NO: 9111445 - DNA, 22 bp, Homo sapiens
agggagctgtggtcagctcagt

SEQ ID NO: 9111446 - DNA, 17 bp, Homo sapiens
cccaggccgccgggagc

SEQ ID NO: 9111447 - DNA, 22 bp, Homo sapiens
cccaggccctggcagagcttgt

SEQ ID NO: 9111448 - DNA, 22 bp, Homo sapiens
cccaggccctggcagagcttgt

SEQ ID NO: 9111449 - DNA, 22 bp, Homo sapiens
cccaggcctggtctgggccagt

SEQ ID NO: 9111450 - DNA, 22 bp, Homo sapiens
cccaggcctggtctgggccagt

SEQ ID NO: 9111451 - DNA, 22 bp, Homo sapiens
cccaggcctggtctgggccagt

SEQ ID NO: 9111452 - DNA, 22 bp, Homo sapiens
agggagctgactggctgccatt

SEQ ID NO: 9111453 - DNA, 22 bp, Homo sapiens
agggagccctgaaccagagggt

SEQ ID NO: 9111454 - DNA, 22 bp, Homo sapiens
agggagccctgaaccagagggt

SEQ ID NO: 9111455 - DNA, 22 bp, Homo sapiens
agggaccctgatgactgaggag

SEQ ID NO: 9111456 - DNA, 22 bp, Homo sapiens
cccaggccccagggcttgtcag

SEQ ID NO: 9111457 - DNA, 22 bp, Homo sapiens
cccaggccccagggcttgtcag

SEQ ID NO: 9111458 - DNA, 22 bp, Homo sapiens
cccaggccagaacttggttgct

SEQ ID NO: 9111459 - DNA, 22 bp, Homo sapiens
cccaggccagaacttggttgct

SEQ ID NO: 9111460 - DNA, 22 bp, Homo sapiens
cccaggccagaacttggttgct

SEQ ID NO: 9111461 - DNA, 22 bp, Homo sapiens
agggaatggatgatggcaggtt

SEQ ID NO: 9111462 - DNA, 22 bp, Homo sapiens
agggacagttacatcatcagac

SEQ ID NO: 9111463 - DNA, 22 bp, Homo sapiens
agggacagtctactgttcactg

SEQ ID NO: 9111464 - DNA, 22 bp, Homo sapiens
agggacagtctactgttcactg

SEQ ID NO: 9111465 - DNA, 22 bp, Homo sapiens
agggacagttacatcatcagac

SEQ ID NO: 9111466 - DNA, 22 bp, Homo sapiens
agggcagaagtacagacactta

SEQ ID NO: 9111467 - DNA, 22 bp, Homo sapiens
agggcagaccacgtgcaaggat

SEQ ID NO: 9111468 - DNA, 22 bp, Homo sapiens
agggcagaagtacagacactta

SEQ ID NO: 9111469 - DNA, 22 bp, Homo sapiens
agggcagaaatattgatactgt

SEQ ID NO: 9111470 - DNA, 22 bp, Homo sapiens
agggcagaaatcgattacacct

SEQ ID NO: 9111471 - DNA, 22 bp, Homo sapiens
agggcagactaggatggaagtg

SEQ ID NO: 9111472 - DNA, 22 bp, Homo sapiens
agggcagactaggatggaagtg

SEQ ID NO: 9111473 - DNA, 22 bp, Homo sapiens
agggcagactaggatggaagtg

SEQ ID NO: 9111474 - DNA, 22 bp, Homo sapiens
agggcagagaaatgtagttgag

SEQ ID NO: 9111475 - DNA, 22 bp, Homo sapiens
cccctgccagctatccctgaac

SEQ ID NO: 9111476 - DNA, 21 bp, Homo sapiens
cccctgggagccctgtcagta

SEQ ID NO: 9111477 - DNA, 22 bp, Homo sapiens
cccctgctggcctgctggtttc

SEQ ID NO: 9111478 - DNA, 22 bp, Homo sapiens
cccctgctggcctgctggtttc

SEQ ID NO: 9111479 - DNA, 22 bp, Homo sapiens
cccctgccatagtcaaatctaa

SEQ ID NO: 9111480 - DNA, 22 bp, Homo sapiens
cccaggtgctgaaggaggccgc

SEQ ID NO: 9111481 - DNA, 22 bp, Homo sapiens
cccaggtctgtgccagctctga

SEQ ID NO: 9111482 - DNA, 22 bp, Homo sapiens
agggagctttaccccagatcac

SEQ ID NO: 9111483 - DNA, 22 bp, Homo sapiens
cccaggtggcagaagctgcagt

SEQ ID NO: 9111484 - DNA, 22 bp, Homo sapiens
cccaggtggcagaagctgcagt

SEQ ID NO: 9111485 - DNA, 21 bp, Homo sapiens
cccaggtgggatggttgcctc

SEQ ID NO: 9111486 - DNA, 22 bp, Homo sapiens
cccaggtgggcacctcgaggaa

SEQ ID NO: 9111487 - DNA, 22 bp, Homo sapiens
cccaggtgggttggcctctgtc

SEQ ID NO: 9111488 - DNA, 22 bp, Homo sapiens
cccaggtgggttggcctctgtc

SEQ ID NO: 9111489 - DNA, 22 bp, Homo sapiens
agggatgggtctaacccagaac

SEQ ID NO: 9111490 - DNA, 22 bp, Homo sapiens
agggatggtggaggttgcaagt

SEQ ID NO: 9111491 - DNA, 22 bp, Homo sapiens
agggcagaaaccaccttgatgg

SEQ ID NO: 9111492 - DNA, 22 bp, Homo sapiens
cccaggtgtttgtggcagaggt

SEQ ID NO: 9111493 - DNA, 22 bp, Homo sapiens
cccaggtgtttgtggcagaggt

SEQ ID NO: 9111494 - DNA, 19 bp, Homo sapiens
cccaggtgtttgaggctgc

SEQ ID NO: 9111495 - DNA, 23 bp, Homo sapiens
cccaggtgtggaggcggtggcag

SEQ ID NO: 9111496 - DNA, 22 bp, Homo sapiens
agggccactggctgacggctgc

SEQ ID NO: 9111497 - DNA, 22 bp, Homo sapiens
agggccaccagggagtctcagg

SEQ ID NO: 9111498 - DNA, 22 bp, Homo sapiens
ccctgaggagagcgcttcccga

SEQ ID NO: 9111499 - DNA, 22 bp, Homo sapiens
agggccaagtccaggacctcgg

SEQ ID NO: 9111500 - DNA, 22 bp, Homo sapiens
agggccacagtaatgctgagta

SEQ ID NO: 9111501 - DNA, 22 bp, Homo sapiens
agggccacagtggggcctgaga

SEQ ID NO: 9111502 - DNA, 22 bp, Homo sapiens
agggccacagtggggcctgaga

SEQ ID NO: 9111503 - DNA, 22 bp, Homo sapiens
agggccaccagagcagggcagt

SEQ ID NO: 9111504 - DNA, 20 bp, Homo sapiens
ccccttcatctacagcctga

SEQ ID NO: 9111505 - DNA, 20 bp, Homo sapiens
ccccttcatctacagcctga

SEQ ID NO: 9111506 - DNA, 22 bp, Homo sapiens
cccctgggtccaggcttctctg

SEQ ID NO: 9111507 - DNA, 22 bp, Homo sapiens
cccctgggtccaggcttctctg

SEQ ID NO: 9111508 - DNA, 23 bp, Homo sapiens
agggcccaagcctggacagcagg

SEQ ID NO: 9111509 - DNA, 22 bp, Homo sapiens
ccctgaggggcttactttgccc

SEQ ID NO: 9111510 - DNA, 22 bp, Homo sapiens
ccctgaggggcttactttgccc

SEQ ID NO: 9111511 - DNA, 22 bp, Homo sapiens
ccctgaggcacaggccacgtat

SEQ ID NO: 9111512 - DNA, 22 bp, Homo sapiens
ccctgaggatagggcaggaccc

SEQ ID NO: 9111513 - DNA, 22 bp, Homo sapiens
ccctgaggatgtctccttcctg

SEQ ID NO: 9111514 - DNA, 22 bp, Homo sapiens
aggggctcctttgtgctgcgtc

SEQ ID NO: 9111515 - DNA, 22 bp, Homo sapiens
aggggctgcctggcttggcact

SEQ ID NO: 9111516 - DNA, 22 bp, Homo sapiens
aggggctgcctggcttggcact

SEQ ID NO: 9111517 - DNA, 22 bp, Homo sapiens
aggggcgtgctcttccccgacg

SEQ ID NO: 9111518 - DNA, 22 bp, Homo sapiens
aggggcggcctgcctgaagcag

SEQ ID NO: 9111519 - DNA, 18 bp, Homo sapiens
aggggcagcttgtgtgga

SEQ ID NO: 9111520 - DNA, 22 bp, Homo sapiens
cctcgacctccccaggctcagg

SEQ ID NO: 9111521 - DNA, 22 bp, Homo sapiens
cctccttctggggccttctgct

SEQ ID NO: 9111522 - DNA, 22 bp, Homo sapiens
cctcctggtgggcgcttctggc

SEQ ID NO: 9111523 - DNA, 22 bp, Homo sapiens
cctcctggtgggcgcttctggc

SEQ ID NO: 9111524 - DNA, 22 bp, Homo sapiens
cctcctgtctccttcctatatt

SEQ ID NO: 9111525 - DNA, 22 bp, Homo sapiens
aggggaatgggtagactgttga

SEQ ID NO: 9111526 - DNA, 22 bp, Homo sapiens
cctcctggtgacaaggcaaagc

SEQ ID NO: 9111527 - DNA, 22 bp, Homo sapiens
aggggaatgggtagactgttga

SEQ ID NO: 9111528 - DNA, 22 bp, Homo sapiens
aggggaatgggtagactgttga

SEQ ID NO: 9111529 - DNA, 22 bp, Homo sapiens
agggggtgatcaaggtgcggcg

SEQ ID NO: 9111530 - DNA, 22 bp, Homo sapiens
agggggtgatcaaggtgcggcg

SEQ ID NO: 9111531 - DNA, 22 bp, Homo sapiens
agggggtgcatttgtgaatgaa

SEQ ID NO: 9111532 - DNA, 22 bp, Homo sapiens
agggggtgcccagatgaaggat

SEQ ID NO: 9111533 - DNA, 22 bp, Homo sapiens
agggggtgctacttccagagtt

SEQ ID NO: 9111534 - DNA, 22 bp, Homo sapiens
agggggtgggaagtctagaatc

SEQ ID NO: 9111535 - DNA, 22 bp, Homo sapiens
agggggtgggaagtctagaatc

SEQ ID NO: 9111536 - DNA, 22 bp, Homo sapiens
agggggtgtctctgattgggtt

SEQ ID NO: 9111537 - DNA, 22 bp, Homo sapiens
cctgagtcccctcattcactct

SEQ ID NO: 9111538 - DNA, 22 bp, Homo sapiens
aggggtgaaggcccgataggag

SEQ ID NO: 9111539 - DNA, 22 bp, Homo sapiens
aggggtgaaagagggccctcaa

SEQ ID NO: 9111540 - DNA, 22 bp, Homo sapiens
cctgagtcccataatgttgcca

SEQ ID NO: 9111541 - DNA, 22 bp, Homo sapiens
cctgagtctgtgttttcctaag

SEQ ID NO: 9111542 - DNA, 22 bp, Homo sapiens
cctctgtgtcagggaagagact

SEQ ID NO: 9111543 - DNA, 22 bp, Homo sapiens
cctctgtgtcagggaagagact

SEQ ID NO: 9111544 - DNA, 22 bp, Homo sapiens
cctctgtggtctgtctaatgca

SEQ ID NO: 9111545 - DNA, 22 bp, Homo sapiens
cctctgtggtctgtctaatgca

SEQ ID NO: 9111546 - DNA, 22 bp, Homo sapiens
cctctgtgtcctggtcattgaa

SEQ ID NO: 9111547 - DNA, 22 bp, Homo sapiens
cctctgtgtcctggtcattgaa

SEQ ID NO: 9111548 - DNA, 20 bp, Homo sapiens
cctctgtgtcctgtgtcata

SEQ ID NO: 9111549 - DNA, 22 bp, Homo sapiens
cctctgtgtcttggtttcaaga

SEQ ID NO: 9111550 - DNA, 22 bp, Homo sapiens
agggggctcctccggtgcttcc

SEQ ID NO: 9111551 - DNA, 22 bp, Homo sapiens
agggggctgccaaggaatgtaa

SEQ ID NO: 9111552 - DNA, 22 bp, Homo sapiens
agggggtgaatgtctgtctaca

SEQ ID NO: 9111553 - DNA, 22 bp, Homo sapiens
agggggtgaatgtctgtctaca

SEQ ID NO: 9111554 - DNA, 22 bp, Homo sapiens
agggggctggagacacctcctc

SEQ ID NO: 9111555 - DNA, 22 bp, Homo sapiens
agggcccatgtgggagcacttg

SEQ ID NO: 9111556 - DNA, 22 bp, Homo sapiens
agggcccagtggagagctgagc

SEQ ID NO: 9111557 - DNA, 22 bp, Homo sapiens
agggcccatgtgggagcacttg

SEQ ID NO: 9111558 - DNA, 22 bp, Homo sapiens
ccctggcaaaatccctggtaca

SEQ ID NO: 9111559 - DNA, 17 bp, Homo sapiens
ccctggcaaagaatggc

SEQ ID NO: 9111560 - DNA, 17 bp, Homo sapiens
ccctggcaaagaatggc

SEQ ID NO: 9111561 - DNA, 22 bp, Homo sapiens
ccctggcaagtgctgtgtagct

SEQ ID NO: 9111562 - DNA, 22 bp, Homo sapiens
ccctggcactagcgacggccat

SEQ ID NO: 9111563 - DNA, 22 bp, Homo sapiens
ccctggcagaaggtgtagaagc

SEQ ID NO: 9111564 - DNA, 22 bp, Homo sapiens
ccctggcataaaacttctccag

SEQ ID NO: 9111565 - DNA, 22 bp, Homo sapiens
ccctggccagctcatgtctgag

SEQ ID NO: 9111566 - DNA, 22 bp, Homo sapiens
ccctggcatgcatgtccctggc

SEQ ID NO: 9111567 - DNA, 22 bp, Homo sapiens
agggcctggcttcactttctca

SEQ ID NO: 9111568 - DNA, 22 bp, Homo sapiens
ccctggccagggcacagggagg

SEQ ID NO: 9111569 - DNA, 22 bp, Homo sapiens
ccctggccagctcatgtctgag

SEQ ID NO: 9111570 - DNA, 22 bp, Homo sapiens
ccctggcagaatgtctctgggc

SEQ ID NO: 9111571 - DNA, 19 bp, Homo sapiens
ccctggcaggcaagcctgg

SEQ ID NO: 9111572 - DNA, 19 bp, Homo sapiens
ccctggcaggcaagcctgg

SEQ ID NO: 9111573 - DNA, 22 bp, Homo sapiens
ccctggcataaaacttctccag

SEQ ID NO: 9111574 - DNA, 22 bp, Homo sapiens
agggcctgtgctgagtagacga

SEQ ID NO: 9111575 - DNA, 22 bp, Homo sapiens
agggcctgtgcttcctgagata

SEQ ID NO: 9111576 - DNA, 22 bp, Homo sapiens
cctaagtaagttgactttcaga

SEQ ID NO: 9111577 - DNA, 20 bp, Homo sapiens
agggcctgttgcaagcgttt

SEQ ID NO: 9111578 - DNA, 22 bp, Homo sapiens
cctacaggaaattgtatcaaaa

SEQ ID NO: 9111579 - DNA, 22 bp, Homo sapiens
cctacagttatattcttgattg

SEQ ID NO: 9111580 - DNA, 22 bp, Homo sapiens
cctaatttgattttaaatagcc

SEQ ID NO: 9111581 - DNA, 22 bp, Homo sapiens
cctacacatctcacctcacagg

SEQ ID NO: 9111582 - DNA, 22 bp, Homo sapiens
cctacacatctcacctcacagg

SEQ ID NO: 9111583 - DNA, 22 bp, Homo sapiens
cctaagtattttcagtgttaac

SEQ ID NO: 9111584 - DNA, 22 bp, Homo sapiens
agggcctgtgcttcctgagata

SEQ ID NO: 9111585 - DNA, 22 bp, Homo sapiens
agggcctgtccgctcccgcccg

SEQ ID NO: 9111586 - DNA, 22 bp, Homo sapiens
agggcctgtctgtagaactgaa

SEQ ID NO: 9111587 - DNA, 22 bp, Homo sapiens
agggcctgtctgtagaactgaa

SEQ ID NO: 9111588 - DNA, 22 bp, Homo sapiens
agggcctgtctgtagaactgaa

SEQ ID NO: 9111589 - DNA, 22 bp, Homo sapiens
agggcctgggaagaggaaccct

SEQ ID NO: 9111590 - DNA, 22 bp, Homo sapiens
agggcctggcttcactttctca

SEQ ID NO: 9111591 - DNA, 22 bp, Homo sapiens
agggcctggcttcactttctca

SEQ ID NO: 9111592 - DNA, 22 bp, Homo sapiens
agggcctgtccgctcccgcccg

SEQ ID NO: 9111593 - DNA, 22 bp, Homo sapiens
agggcctgtcagcggtgtcctg

SEQ ID NO: 9111594 - DNA, 22 bp, Homo sapiens
agggcctgtgaattctccctgc

SEQ ID NO: 9111595 - DNA, 22 bp, Homo sapiens
agggcctgtgaattctccctgc

SEQ ID NO: 9111596 - DNA, 22 bp, Homo sapiens
agggcctgtctgtagaactgaa

SEQ ID NO: 9111597 - DNA, 22 bp, Homo sapiens
agggcctgtgaattctccctgc

SEQ ID NO: 9111598 - DNA, 21 bp, Homo sapiens
agggcctgtgctctccaggtc

SEQ ID NO: 9111599 - DNA, 21 bp, Homo sapiens
agggcctgtgctctccaggtc

SEQ ID NO: 9111600 - DNA, 22 bp, Homo sapiens
cctcaggtgtgggccagctgtc

SEQ ID NO: 9111601 - DNA, 22 bp, Homo sapiens
agggctttgatgtccatgagga

SEQ ID NO: 9111602 - DNA, 22 bp, Homo sapiens
agggctttgcaatgcacagtgg

SEQ ID NO: 9111603 - DNA, 22 bp, Homo sapiens
agggctttggccccctgctgca

SEQ ID NO: 9111604 - DNA, 22 bp, Homo sapiens
agggctttggccccctgctgca

SEQ ID NO: 9111605 - DNA, 22 bp, Homo sapiens
agggctttgtggcagtcactat

SEQ ID NO: 9111606 - DNA, 19 bp, Homo sapiens
agggctttgtgtgctgctc

SEQ ID NO: 9111607 - DNA, 22 bp, Homo sapiens
agggcttttgcaatccaagtct

SEQ ID NO: 9111608 - DNA, 22 bp, Homo sapiens
agggcttttgagcgcacgtctg

SEQ ID NO: 9111609 - DNA, 22 bp, Homo sapiens
agggctttgtttaggtgaccac

SEQ ID NO: 9111610 - DNA, 22 bp, Homo sapiens
cctcagggtggcatcagatctt

SEQ ID NO: 9111611 - DNA, 22 bp, Homo sapiens
cctcagggtctgaggagaccgt

SEQ ID NO: 9111612 - DNA, 18 bp, Homo sapiens
cctcaggggacctggcag

SEQ ID NO: 9111613 - DNA, 22 bp, Homo sapiens
cctacttagcatattttctctt

SEQ ID NO: 9111614 - DNA, 22 bp, Homo sapiens
cctaccagtaggaggccagaga

SEQ ID NO: 9111615 - DNA, 22 bp, Homo sapiens
cctacataacactgccaaactg

SEQ ID NO: 9111616 - DNA, 22 bp, Homo sapiens
cctacatacttgggctttacct

SEQ ID NO: 9111617 - DNA, 22 bp, Homo sapiens
cctacatatagggctttgctgt

SEQ ID NO: 9111618 - DNA, 22 bp, Homo sapiens
cctacatatctaagacaagcca

SEQ ID NO: 9111619 - DNA, 22 bp, Homo sapiens
cctacagttatattcttgattg

SEQ ID NO: 9111620 - DNA, 18 bp, Homo sapiens
cctcagggagatccagtg

SEQ ID NO: 9111621 - DNA, 22 bp, Homo sapiens
cctcagggaggcctctgtggct

SEQ ID NO: 9111622 - DNA, 22 bp, Homo sapiens
agggctgagactaaggccagat

SEQ ID NO: 9111623 - DNA, 22 bp, Homo sapiens
cccaattttgggcacaacgaaa

SEQ ID NO: 9111624 - DNA, 22 bp, Homo sapiens
cccacacatttttcacttaccg

SEQ ID NO: 9111625 - DNA, 18 bp, Homo sapiens
cccacacagcagtagctc

SEQ ID NO: 9111626 - DNA, 22 bp, Homo sapiens
cccacacatttttcacttaccg

SEQ ID NO: 9111627 - DNA, 20 bp, Homo sapiens
cccacacccttcccacttgg

SEQ ID NO: 9111628 - DNA, 18 bp, Homo sapiens
cccacacagcagtagctc

SEQ ID NO: 9111629 - DNA, 18 bp, Homo sapiens
cccacacagcagtagctc

SEQ ID NO: 9111630 - DNA, 22 bp, Homo sapiens
ccattttgtctcctgaaatcta

SEQ ID NO: 9111631 - DNA, 22 bp, Homo sapiens
cccaagttaatttgtagctgaa

SEQ ID NO: 9111632 - DNA, 22 bp, Homo sapiens
cccaagttaaaattcagtgctc

SEQ ID NO: 9111633 - DNA, 22 bp, Homo sapiens
ccattttattagtgacatttag

SEQ ID NO: 9111634 - DNA, 22 bp, Homo sapiens
ccagtgtgaccatctgttagct

SEQ ID NO: 9111635 - DNA, 22 bp, Homo sapiens
ccagtgtgaacctcaccaccct

SEQ ID NO: 9111636 - DNA, 20 bp, Homo sapiens
aggctgccaggtctcacatc

SEQ ID NO: 9111637 - DNA, 22 bp, Homo sapiens
ccagtgggagggagctaggcca

SEQ ID NO: 9111638 - DNA, 22 bp, Homo sapiens
ccagtgggtaggccatggtgag

SEQ ID NO: 9111639 - DNA, 22 bp, Homo sapiens
ccagtgggagggagctaggcca

SEQ ID NO: 9111640 - DNA, 22 bp, Homo sapiens
ccagtgggtaggccatggtgag

SEQ ID NO: 9111641 - DNA, 22 bp, Homo sapiens
aggctgccaaagcttctgtctc

SEQ ID NO: 9111642 - DNA, 22 bp, Homo sapiens
aggctgcagtgcaggtaggatt

SEQ ID NO: 9111643 - DNA, 21 bp, Homo sapiens
aggctgcatgcatgagtgtgg

SEQ ID NO: 9111644 - DNA, 23 bp, Homo sapiens
aggctgcagaagaatagggtcat

SEQ ID NO: 9111645 - DNA, 22 bp, Homo sapiens
aggctgcagaggtgctgccaga

SEQ ID NO: 9111646 - DNA, 22 bp, Homo sapiens
aggctgcagtgcaggtaggatt

SEQ ID NO: 9111647 - DNA, 22 bp, Homo sapiens
aggctgcaggtctgggtcatgt

SEQ ID NO: 9111648 - DNA, 22 bp, Homo sapiens
aggctgcaggtctgggtcatgt

SEQ ID NO: 9111649 - DNA, 22 bp, Homo sapiens
cccacctctcagagagccttgc

SEQ ID NO: 9111650 - DNA, 22 bp, Homo sapiens
cccacgtcgaacttgctccaga

SEQ ID NO: 9111651 - DNA, 22 bp, Homo sapiens
cccacgtcgaacttgctccaga

SEQ ID NO: 9111652 - DNA, 22 bp, Homo sapiens
aggctgtgcacagggcacctgc

SEQ ID NO: 9111653 - DNA, 22 bp, Homo sapiens
aggctgtgcattttggagggcc

SEQ ID NO: 9111654 - DNA, 22 bp, Homo sapiens
aggctgtggccctggtctagca

SEQ ID NO: 9111655 - DNA, 22 bp, Homo sapiens
aggctgtgcgaggtctcagagt

SEQ ID NO: 9111656 - DNA, 22 bp, Homo sapiens
aggctgtgggacagttaggaga

SEQ ID NO: 9111657 - DNA, 22 bp, Homo sapiens
cccagaggtgacatcccattct

SEQ ID NO: 9111658 - DNA, 22 bp, Homo sapiens
cccagaggtgacatcccattct

SEQ ID NO: 9111659 - DNA, 22 bp, Homo sapiens
aggctgtggtgctgaaggaggg

SEQ ID NO: 9111660 - DNA, 22 bp, Homo sapiens
cccagaggtgcttcagaggtgc

SEQ ID NO: 9111661 - DNA, 20 bp, Homo sapiens
cccagaggttgcggcaggag

SEQ ID NO: 9111662 - DNA, 20 bp, Homo sapiens
cccagaggttgcggcaggag

SEQ ID NO: 9111663 - DNA, 22 bp, Homo sapiens
ccaggtgggcgtgtcttcacct

SEQ ID NO: 9111664 - DNA, 22 bp, Homo sapiens
ccaggtgggcgtgtcttcacct

SEQ ID NO: 9111665 - DNA, 22 bp, Homo sapiens
ccaggtgcctccagtcacagtg

SEQ ID NO: 9111666 - DNA, 22 bp, Homo sapiens
ccaggtggtgaaagtgggccct

SEQ ID NO: 9111667 - DNA, 22 bp, Homo sapiens
ccagggcagcagaattggggca

SEQ ID NO: 9111668 - DNA, 22 bp, Homo sapiens
aggctctgtatgaaggtttggg

SEQ ID NO: 9111669 - DNA, 22 bp, Homo sapiens
aggctctgtatgaaggtttggg

SEQ ID NO: 9111670 - DNA, 20 bp, Homo sapiens
ccaggtggtgcctggagagg

SEQ ID NO: 9111671 - DNA, 20 bp, Homo sapiens
ccaggtggtgcctggagagg

SEQ ID NO: 9111672 - DNA, 22 bp, Homo sapiens
ccaggtggtgcctctgttcgca

SEQ ID NO: 9111673 - DNA, 19 bp, Homo sapiens
ccagtagagacagctgcag

SEQ ID NO: 9111674 - DNA, 22 bp, Homo sapiens
ccagtacatcgcatggtgacca

SEQ ID NO: 9111675 - DNA, 22 bp, Homo sapiens
ccagtacttgctacctcaattg

SEQ ID NO: 9111676 - DNA, 22 bp, Homo sapiens
ccagtactttgtgcaacaaatg

SEQ ID NO: 9111677 - DNA, 22 bp, Homo sapiens
ccagtactgtctccaatattcc

SEQ ID NO: 9111678 - DNA, 22 bp, Homo sapiens
ccaggttcaaatagctgtgtga

SEQ ID NO: 9111679 - DNA, 22 bp, Homo sapiens
ccaggttggagttcagtggcgc

SEQ ID NO: 9111680 - DNA, 22 bp, Homo sapiens
aggctctgggaagcagtgagtt

SEQ ID NO: 9111681 - DNA, 22 bp, Homo sapiens
aggctcagcccaaggtggagag

SEQ ID NO: 9111682 - DNA, 20 bp, Homo sapiens
aggctctgcctgcaggccca

SEQ ID NO: 9111683 - DNA, 22 bp, Homo sapiens
ccaggcctgtgcaaggagggag

SEQ ID NO: 9111684 - DNA, 22 bp, Homo sapiens
ccaggcctgtgcaaggagggag

SEQ ID NO: 9111685 - DNA, 20 bp, Homo sapiens
ccaggcctgggcctgctcta

SEQ ID NO: 9111686 - DNA, 22 bp, Homo sapiens
ccaggcctgtgcaaggagggag

SEQ ID NO: 9111687 - DNA, 22 bp, Homo sapiens
ccaggcctgtgttgtgtggagg

SEQ ID NO: 9111688 - DNA, 22 bp, Homo sapiens
ccaggccttccagtacgcagaa

SEQ ID NO: 9111689 - DNA, 22 bp, Homo sapiens
ccaggccttccagtacgcagaa

SEQ ID NO: 9111690 - DNA, 22 bp, Homo sapiens
ccaggcctgtgttgtgtggagg

SEQ ID NO: 9111691 - DNA, 22 bp, Homo sapiens
ccaggcctgtgttgtgtggagg

SEQ ID NO: 9111692 - DNA, 22 bp, Homo sapiens
ccaggcctgtgttgtgtggagg

SEQ ID NO: 9111693 - DNA, 22 bp, Homo sapiens
ccaggcctcccttttccagcca

SEQ ID NO: 9111694 - DNA, 22 bp, Homo sapiens
ccaggcctcccttttccagcca

SEQ ID NO: 9111695 - DNA, 22 bp, Homo sapiens
ccaggcctcacctgcccaccta

SEQ ID NO: 9111696 - DNA, 22 bp, Homo sapiens
ccaggcctcacctgcccaccta

SEQ ID NO: 9111697 - DNA, 22 bp, Homo sapiens
ccaggcctcacctgcccaccta

SEQ ID NO: 9111698 - DNA, 20 bp, Homo sapiens
ccaggcctgggcctgctcta

SEQ ID NO: 9111699 - DNA, 20 bp, Homo sapiens
ccaggcctgggcctgctcta

SEQ ID NO: 9111700 - DNA, 20 bp, Homo sapiens
ccaggcctgggcctgctcta

SEQ ID NO: 9111701 - DNA, 22 bp, Homo sapiens
ccaggccttctgaggacactct

SEQ ID NO: 9111702 - DNA, 22 bp, Homo sapiens
ccaggccttctgaggacactct

SEQ ID NO: 9111703 - DNA, 22 bp, Homo sapiens
ccaggccttctgaggacactct

SEQ ID NO: 9111704 - DNA, 22 bp, Homo sapiens
ccaggcctttcttcttggtctg

SEQ ID NO: 9111705 - DNA, 22 bp, Homo sapiens
ccaggccttccagtacgcagaa

SEQ ID NO: 9111706 - DNA, 22 bp, Homo sapiens
ccaggccttccagtacgcagaa

SEQ ID NO: 9111707 - DNA, 22 bp, Homo sapiens
ccaggccttctgaggacactct

SEQ ID NO: 9111708 - DNA, 22 bp, Homo sapiens
ccaggccttctgaggacactct

SEQ ID NO: 9111709 - DNA, 22 bp, Homo sapiens
aggctcagatccttgtgtcctg

SEQ ID NO: 9111710 - DNA, 22 bp, Homo sapiens
ccaggcctttcttcttggtctg

SEQ ID NO: 9111711 - DNA, 22 bp, Homo sapiens
ccaggcctttcttcttggtctg

SEQ ID NO: 9111712 - DNA, 22 bp, Homo sapiens
ccaggcctttcttcttggtctg

SEQ ID NO: 9111713 - DNA, 22 bp, Homo sapiens
ccagagtcattttgagtcataa

SEQ ID NO: 9111714 - DNA, 22 bp, Homo sapiens
ccagagtctatgagtcctcatt

SEQ ID NO: 9111715 - DNA, 22 bp, Homo sapiens
ccagccactgggccactgccag

SEQ ID NO: 9111716 - DNA, 22 bp, Homo sapiens
ccagccactgggccactgccag

SEQ ID NO: 9111717 - DNA, 22 bp, Homo sapiens
ccagccagcaagctcccagttc

SEQ ID NO: 9111718 - DNA, 22 bp, Homo sapiens
ccagccagatgataagctctat

SEQ ID NO: 9111719 - DNA, 22 bp, Homo sapiens
ccagccagatgataagctctat

SEQ ID NO: 9111720 - DNA, 22 bp, Homo sapiens
ccagccagctgcccttggggcc

SEQ ID NO: 9111721 - DNA, 22 bp, Homo sapiens
ccagccagctggttggacgcct

SEQ ID NO: 9111722 - DNA, 22 bp, Homo sapiens
ccagccagccttgatctgagta

SEQ ID NO: 9111723 - DNA, 22 bp, Homo sapiens
ccagccagcaagctcccagttc

SEQ ID NO: 9111724 - DNA, 22 bp, Homo sapiens
ccagccagccttgatctgagta

SEQ ID NO: 9111725 - DNA, 22 bp, Homo sapiens
ccagccaggctggctgtggagg

SEQ ID NO: 9111726 - DNA, 22 bp, Homo sapiens
ccagccaggcattgcaaactga

SEQ ID NO: 9111727 - DNA, 22 bp, Homo sapiens
ccagccaggcattgcaaactga

SEQ ID NO: 9111728 - DNA, 22 bp, Homo sapiens
ccagccagtatattccaaagcc

SEQ ID NO: 9111729 - DNA, 22 bp, Homo sapiens
ccagccctcctccatcagagga

SEQ ID NO: 9111730 - DNA, 22 bp, Homo sapiens
ccagccctcctccatcagagga

SEQ ID NO: 9111731 - DNA, 17 bp, Homo sapiens
ccagccctcgcgctttt

SEQ ID NO: 9111732 - DNA, 22 bp, Homo sapiens
ccagccctcctccatcagagga

SEQ ID NO: 9111733 - DNA, 22 bp, Homo sapiens
ccagccctcctccatcagagga

SEQ ID NO: 9111734 - DNA, 23 bp, Homo sapiens
ccagccctccaccagctctaggc

SEQ ID NO: 9111735 - DNA, 23 bp, Homo sapiens
ccagccctccaccagctctaggc

SEQ ID NO: 9111736 - DNA, 23 bp, Homo sapiens
ccagccctccaccagctctaggc

SEQ ID NO: 9111737 - DNA, 23 bp, Homo sapiens
ccagccctccaccagctctaggc

SEQ ID NO: 9111738 - DNA, 22 bp, Homo sapiens
ccagccctgaaccctgctgcat

SEQ ID NO: 9111739 - DNA, 22 bp, Homo sapiens
ccagccctgattagagaatgtc

SEQ ID NO: 9111740 - DNA, 22 bp, Homo sapiens
ccagccctgaaccctgctgcat

SEQ ID NO: 9111741 - DNA, 22 bp, Homo sapiens
ccagccctgaaccctgctgcat

SEQ ID NO: 9111742 - DNA, 22 bp, Homo sapiens
ccagccctgaaccctgctgcat

SEQ ID NO: 9111743 - DNA, 22 bp, Homo sapiens
ccagccctgaaccctgctgcat

SEQ ID NO: 9111744 - DNA, 22 bp, Homo sapiens
ccagccctgaaccctgctgcat

SEQ ID NO: 9111745 - DNA, 22 bp, Homo sapiens
ccagccctgaaccctgctgcat

SEQ ID NO: 9111746 - DNA, 22 bp, Homo sapiens
ccagccctgaaccctgctgcat

SEQ ID NO: 9111747 - DNA, 22 bp, Homo sapiens
ccagccctgattagagaatgtc

SEQ ID NO: 9111748 - DNA, 18 bp, Homo sapiens
ccagccctgcagcacctg

SEQ ID NO: 9111749 - DNA, 18 bp, Homo sapiens
ccagccctgcagcacctg

SEQ ID NO: 9111750 - DNA, 18 bp, Homo sapiens
ccagccctgcagcacctg

SEQ ID NO: 9111751 - DNA, 18 bp, Homo sapiens
ccagccctgcagcacctg

SEQ ID NO: 9111752 - DNA, 22 bp, Homo sapiens
aggccctgcccagagctcctcg

SEQ ID NO: 9111753 - DNA, 22 bp, Homo sapiens
aggccctgcccagtgccacaag

SEQ ID NO: 9111754 - DNA, 23 bp, Homo sapiens
aggccctgcctgtccctcttttt

SEQ ID NO: 9111755 - DNA, 22 bp, Homo sapiens
aggcaggtcacatgcttggcga

SEQ ID NO: 9111756 - DNA, 22 bp, Homo sapiens
ccagaggatcagtactggctgg

SEQ ID NO: 9111757 - DNA, 20 bp, Homo sapiens
ccagagctgatggctgcccg

SEQ ID NO: 9111758 - DNA, 20 bp, Homo sapiens
ccagagctgatggctgcccg

SEQ ID NO: 9111759 - DNA, 19 bp, Homo sapiens
aggcaggtgcagaggtccc

SEQ ID NO: 9111760 - DNA, 22 bp, Homo sapiens
aggcaggtgagtcaaaacagac

SEQ ID NO: 9111761 - DNA, 22 bp, Homo sapiens
ccagaggatgctggtcagcctc

SEQ ID NO: 9111762 - DNA, 22 bp, Homo sapiens
ccagaggcagacttacactcca

SEQ ID NO: 9111763 - DNA, 22 bp, Homo sapiens
ccagaggatgctggtcagcctc

SEQ ID NO: 9111764 - DNA, 19 bp, Homo sapiens
ccagagtcatgtctccccc

SEQ ID NO: 9111765 - DNA, 22 bp, Homo sapiens
ccagaggttccaggctagggag

SEQ ID NO: 9111766 - DNA, 19 bp, Homo sapiens
ccagaggtttgctgggcct

SEQ ID NO: 9111767 - DNA, 19 bp, Homo sapiens
ccagaggtttgctgggcct

SEQ ID NO: 9111768 - DNA, 22 bp, Homo sapiens
ccagaggtggtggtgtctagaa

SEQ ID NO: 9111769 - DNA, 22 bp, Homo sapiens
ccagaggtggtgggtgctacag

SEQ ID NO: 9111770 - DNA, 22 bp, Homo sapiens
ccagaggttactttgccttgga

SEQ ID NO: 9111771 - DNA, 22 bp, Homo sapiens
ccagaggttccaggctagggag

SEQ ID NO: 9111772 - DNA, 20 bp, Homo sapiens
ccagaggctgacagactttg

SEQ ID NO: 9111773 - DNA, 22 bp, Homo sapiens
ccagaggctggcaagggctcct

SEQ ID NO: 9111774 - DNA, 22 bp, Homo sapiens
ccagaggtgctgggagaggtct

SEQ ID NO: 9111775 - DNA, 22 bp, Homo sapiens
ccagaggctggcaagggctcct

SEQ ID NO: 9111776 - DNA, 22 bp, Homo sapiens
ccagaggtgggagtgatctggt

SEQ ID NO: 9111777 - DNA, 21 bp, Homo sapiens
ccagaggcctctcttggccac

SEQ ID NO: 9111778 - DNA, 23 bp, Homo sapiens
ccagctcccaggtctgaggactg

SEQ ID NO: 9111779 - DNA, 23 bp, Homo sapiens
ccagctcccaggtctgaggactg

SEQ ID NO: 9111780 - DNA, 23 bp, Homo sapiens
ccagctcccaggtctgaggactg

SEQ ID NO: 9111781 - DNA, 22 bp, Homo sapiens
ccagctcccctcagcaggtaat

SEQ ID NO: 9111782 - DNA, 22 bp, Homo sapiens
ccagctcccctcagcaggtaat

SEQ ID NO: 9111783 - DNA, 22 bp, Homo sapiens
ccagctcccattcttcacctgt

SEQ ID NO: 9111784 - DNA, 22 bp, Homo sapiens
ccagctccgggagttgctgctg

SEQ ID NO: 9111785 - DNA, 22 bp, Homo sapiens
ccagctccgggagttgctgctg

SEQ ID NO: 9111786 - DNA, 22 bp, Homo sapiens
ccagctccctgaagcctggtct

SEQ ID NO: 9111787 - DNA, 22 bp, Homo sapiens
ccagctccctgaagcctggtct

SEQ ID NO: 9111788 - DNA, 22 bp, Homo sapiens
ccagctccctgaagcctggtct

SEQ ID NO: 9111789 - DNA, 22 bp, Homo sapiens
ccagctcccgcaggctgcacag

SEQ ID NO: 9111790 - DNA, 22 bp, Homo sapiens
ccagctccaggtagatgggcag

SEQ ID NO: 9111791 - DNA, 22 bp, Homo sapiens
ccagctccattgcttagtgtaa

SEQ ID NO: 9111792 - DNA, 22 bp, Homo sapiens
ccagctccaggtagatgggcag

SEQ ID NO: 9111793 - DNA, 22 bp, Homo sapiens
ccagctccaggtagatgggcag

SEQ ID NO: 9111794 - DNA, 22 bp, Homo sapiens
ccagctccaggtagatgggcag

SEQ ID NO: 9111795 - DNA, 22 bp, Homo sapiens
ccagctccaggactgggagctg

SEQ ID NO: 9111796 - DNA, 21 bp, Homo sapiens
aggccctggaggtcagagaaa

SEQ ID NO: 9111797 - DNA, 22 bp, Homo sapiens
ccaggaggtgctggaagaaagc

SEQ ID NO: 9111798 - DNA, 22 bp, Homo sapiens
ccaggaggtggagattgcagtg

SEQ ID NO: 9111799 - DNA, 22 bp, Homo sapiens
ccaggaggtgctggaagaaagc

SEQ ID NO: 9111800 - DNA, 22 bp, Homo sapiens
aggcctgggacgggagccgtga

SEQ ID NO: 9111801 - DNA, 22 bp, Homo sapiens
aggcctgggacgggagccgtga

SEQ ID NO: 9111802 - DNA, 22 bp, Homo sapiens
ccaggaggggtctctgtctccc

SEQ ID NO: 9111803 - DNA, 22 bp, Homo sapiens
ccaggcacaggtgggcctcaga

SEQ ID NO: 9111804 - DNA, 22 bp, Homo sapiens
aggctcagaggtgagcatctgc

SEQ ID NO: 9111805 - DNA, 20 bp, Homo sapiens
aggctcagagcagtagtaca

SEQ ID NO: 9111806 - DNA, 22 bp, Homo sapiens
ccaggcactcacggggcactgg

SEQ ID NO: 9111807 - DNA, 22 bp, Homo sapiens
ccaggcaccatgttcttaggac

SEQ ID NO: 9111808 - DNA, 22 bp, Homo sapiens
ccaggcactgctcgaggtgcta

SEQ ID NO: 9111809 - DNA, 20 bp, Homo sapiens
ccaggcactgtcccatgcag

SEQ ID NO: 9111810 - DNA, 22 bp, Homo sapiens
aggctagatagagggtcatctt

SEQ ID NO: 9111811 - DNA, 22 bp, Homo sapiens
aggcctggtgtgccggatgcag

SEQ ID NO: 9111812 - DNA, 22 bp, Homo sapiens
aggcctggtgtgccggatgcag

SEQ ID NO: 9111813 - DNA, 22 bp, Homo sapiens
aggctagaggcttctggcttca

SEQ ID NO: 9111814 - DNA, 22 bp, Homo sapiens
aggctagaggcttctggcttca

SEQ ID NO: 9111815 - DNA, 22 bp, Homo sapiens
aggctcagagagctgtgtccat

SEQ ID NO: 9111816 - DNA, 22 bp, Homo sapiens
aggcctgggtgttcaccagaag

SEQ ID NO: 9111817 - DNA, 22 bp, Homo sapiens
aggcctggtgaatgaagtatct

SEQ ID NO: 9111818 - DNA, 22 bp, Homo sapiens
aggcctggtgaatgaagtatct

SEQ ID NO: 9111819 - DNA, 22 bp, Homo sapiens
aggcctggtgaatgaagtatct

SEQ ID NO: 9111820 - DNA, 22 bp, Homo sapiens
aggcctgggcaagaaggggcgt

SEQ ID NO: 9111821 - DNA, 19 bp, Homo sapiens
aggcctggggttttgcact

SEQ ID NO: 9111822 - DNA, 19 bp, Homo sapiens
aggcctggggttttgcact

SEQ ID NO: 9111823 - DNA, 22 bp, Homo sapiens
aggcctgggtctcgtgcctacc

SEQ ID NO: 9111824 - DNA, 22 bp, Homo sapiens
aggcctgggtctcgtgcctacc

SEQ ID NO: 9111825 - DNA, 22 bp, Homo sapiens
aggcctgggtctcgtgcctacc

SEQ ID NO: 9111826 - DNA, 22 bp, Homo sapiens
aggcctgggtctcgtgcctacc

SEQ ID NO: 9111827 - DNA, 22 bp, Homo sapiens
caggagccagaggcggatggag

SEQ ID NO: 9111828 - DNA, 22 bp, Homo sapiens
caggagccagaggcggatggag

SEQ ID NO: 9111829 - DNA, 22 bp, Homo sapiens
caggagccacattccaccttga

SEQ ID NO: 9111830 - DNA, 22 bp, Homo sapiens
caggagcagagggtggtcagca

SEQ ID NO: 9111831 - DNA, 18 bp, Homo sapiens
caggagcaggagttgaac

SEQ ID NO: 9111832 - DNA, 18 bp, Homo sapiens
caggagcaggagttgaac

SEQ ID NO: 9111833 - DNA, 22 bp, Homo sapiens
caggatggagagtgaggggtca

SEQ ID NO: 9111834 - DNA, 22 bp, Homo sapiens
caggagcccagagtcctcagct

SEQ ID NO: 9111835 - DNA, 22 bp, Homo sapiens
caggagcccagagtcctcagct

SEQ ID NO: 9111836 - DNA, 20 bp, Homo sapiens
caggcacactcattcctgct

SEQ ID NO: 9111837 - DNA, 22 bp, Homo sapiens
caggcacacccactggtgcaga

SEQ ID NO: 9111838 - DNA, 22 bp, Homo sapiens
caggcacacatccgtgagagat

SEQ ID NO: 9111839 - DNA, 22 bp, Homo sapiens
caggcacacccactggtgcaga

SEQ ID NO: 9111840 - DNA, 22 bp, Homo sapiens
caggcacacaggctccctgggc

SEQ ID NO: 9111841 - DNA, 22 bp, Homo sapiens
caggcacacaggctccctgggc

SEQ ID NO: 9111842 - DNA, 22 bp, Homo sapiens
caggcacacatccgtgagagat

SEQ ID NO: 9111843 - DNA, 22 bp, Homo sapiens
caggcacacatccgtgagagat

SEQ ID NO: 9111844 - DNA, 22 bp, Homo sapiens
caggatggtcagatgcattgtc

SEQ ID NO: 9111845 - DNA, 22 bp, Homo sapiens
caggatggtcagatgcattgtc

SEQ ID NO: 9111846 - DNA, 22 bp, Homo sapiens
caggcacaatgagcgccatctt

SEQ ID NO: 9111847 - DNA, 22 bp, Homo sapiens
caggatgggatgtagtgggccc

SEQ ID NO: 9111848 - DNA, 22 bp, Homo sapiens
cagctgttcctggttggtggga

SEQ ID NO: 9111849 - DNA, 22 bp, Homo sapiens
cagctgttcggggctggcatgt

SEQ ID NO: 9111850 - DNA, 22 bp, Homo sapiens
cagctgttcttgggacagacag

SEQ ID NO: 9111851 - DNA, 22 bp, Homo sapiens
cagctgttgactggtacatgaa

SEQ ID NO: 9111852 - DNA, 22 bp, Homo sapiens
cagctgttgatctcttaagcct

SEQ ID NO: 9111853 - DNA, 22 bp, Homo sapiens
cagctgttgcagcactgagaga

SEQ ID NO: 9111854 - DNA, 22 bp, Homo sapiens
caggactatgttcaacagatag

SEQ ID NO: 9111855 - DNA, 22 bp, Homo sapiens
caggacctggaatgcttgtgaa

SEQ ID NO: 9111856 - DNA, 22 bp, Homo sapiens
caggacctggaatgcttgtgaa

SEQ ID NO: 9111857 - DNA, 22 bp, Homo sapiens
caggactgaagggcacagggaa

SEQ ID NO: 9111858 - DNA, 22 bp, Homo sapiens
caggagcaaggagcagtgggat

SEQ ID NO: 9111859 - DNA, 22 bp, Homo sapiens
cagctgttatgaggtgtacatg

SEQ ID NO: 9111860 - DNA, 22 bp, Homo sapiens
cagctgttactgaagtaaaatg

SEQ ID NO: 9111861 - DNA, 22 bp, Homo sapiens
cagctgttactctgagtaaatg

SEQ ID NO: 9111862 - DNA, 22 bp, Homo sapiens
cagctgttcctggaaggagacc

SEQ ID NO: 9111863 - DNA, 22 bp, Homo sapiens
cagctgttcattgttgccaccc

SEQ ID NO: 9111864 - DNA, 22 bp, Homo sapiens
cagctgttcacatttccaaaac

SEQ ID NO: 9111865 - DNA, 22 bp, Homo sapiens
cagctgttcagcaactcgcaga

SEQ ID NO: 9111866 - DNA, 22 bp, Homo sapiens
cagctgttaccaatcttagggc

SEQ ID NO: 9111867 - DNA, 22 bp, Homo sapiens
cagctgtgtatgagagcatgct

SEQ ID NO: 9111868 - DNA, 22 bp, Homo sapiens
cagctgtgtatgagagcatgct

SEQ ID NO: 9111869 - DNA, 22 bp, Homo sapiens
cagctgtccaaacacattaact

SEQ ID NO: 9111870 - DNA, 22 bp, Homo sapiens
cagctgtcagccggtgcaggct

SEQ ID NO: 9111871 - DNA, 22 bp, Homo sapiens
cagctgtccaaacacattaact

SEQ ID NO: 9111872 - DNA, 22 bp, Homo sapiens
cagctggtaggtagcagatttg

SEQ ID NO: 9111873 - DNA, 22 bp, Homo sapiens
cagctggtactcagttcttgtc

SEQ ID NO: 9111874 - DNA, 22 bp, Homo sapiens
cagctggtactcagttcttgtc

SEQ ID NO: 9111875 - DNA, 22 bp, Homo sapiens
cagctggtcaactgaatgaaca

SEQ ID NO: 9111876 - DNA, 22 bp, Homo sapiens
cagctggtgaactagtttttca

SEQ ID NO: 9111877 - DNA, 22 bp, Homo sapiens
cagctggtgagcttagtagggt

SEQ ID NO: 9111878 - DNA, 22 bp, Homo sapiens
cagctggtggctgatgaccgtc

SEQ ID NO: 9111879 - DNA, 22 bp, Homo sapiens
cagctggtgagcttagtagggt

SEQ ID NO: 9111880 - DNA, 22 bp, Homo sapiens
cagctggtgaactagtttttca

SEQ ID NO: 9111881 - DNA, 22 bp, Homo sapiens
cagctggtggctgatgaccgtc

SEQ ID NO: 9111882 - DNA, 22 bp, Homo sapiens
cagctggttatcagagaggcct

SEQ ID NO: 9111883 - DNA, 22 bp, Homo sapiens
cagctggttatcagagaggcct

SEQ ID NO: 9111884 - DNA, 22 bp, Homo sapiens
cagctggtgtccagggaagtgg

SEQ ID NO: 9111885 - DNA, 22 bp, Homo sapiens
cagctggtgtcaggcactgcag

SEQ ID NO: 9111886 - DNA, 22 bp, Homo sapiens
cagctggtgtcaggcactgcag

SEQ ID NO: 9111887 - DNA, 22 bp, Homo sapiens
cagctggtgtcaggcactgcag

SEQ ID NO: 9111888 - DNA, 22 bp, Homo sapiens
cagctggttcagtgtctggtga

SEQ ID NO: 9111889 - DNA, 22 bp, Homo sapiens
cagctggttgaagaggagctgg

SEQ ID NO: 9111890 - DNA, 22 bp, Homo sapiens
cagctggttttagcacagttag

SEQ ID NO: 9111891 - DNA, 23 bp, Homo sapiens
cagctggttgtgggagtggctgc

SEQ ID NO: 9111892 - DNA, 23 bp, Homo sapiens
cagctggttgtgggagtggctgc

SEQ ID NO: 9111893 - DNA, 22 bp, Homo sapiens
cagctggttggaagggagctga

SEQ ID NO: 9111894 - DNA, 23 bp, Homo sapiens
agcttcgccttcctttctctgca

SEQ ID NO: 9111895 - DNA, 22 bp, Homo sapiens
agcttctcagaagagtcctgta

SEQ ID NO: 9111896 - DNA, 22 bp, Homo sapiens
agcttctcagcttcagaactgt

SEQ ID NO: 9111897 - DNA, 22 bp, Homo sapiens
agcttctcagcttcagaactgt

SEQ ID NO: 9111898 - DNA, 21 bp, Homo sapiens
caggctctgctagaggagcct

SEQ ID NO: 9111899 - DNA, 22 bp, Homo sapiens
caggctctgctgctacagctgt

SEQ ID NO: 9111900 - DNA, 22 bp, Homo sapiens
caggctctgctgctacagctgt

SEQ ID NO: 9111901 - DNA, 22 bp, Homo sapiens
agcttctcagaagagtcctgta

SEQ ID NO: 9111902 - DNA, 22 bp, Homo sapiens
caggctcttccatcctgctgag

SEQ ID NO: 9111903 - DNA, 21 bp, Homo sapiens
caggctctgctgggtgctggg

SEQ ID NO: 9111904 - DNA, 22 bp, Homo sapiens
agcttcctgatgcaagagggct

SEQ ID NO: 9111905 - DNA, 21 bp, Homo sapiens
agcttcctgcagtgggaggtc

SEQ ID NO: 9111906 - DNA, 22 bp, Homo sapiens
agcttcctgtcttctgcacaaa

SEQ ID NO: 9111907 - DNA, 22 bp, Homo sapiens
agcttcctgtcttctgcacaaa

SEQ ID NO: 9111908 - DNA, 22 bp, Homo sapiens
agcttcctgtcttctgcacaaa

SEQ ID NO: 9111909 - DNA, 22 bp, Homo sapiens
agcttccttgaattctgtagaa

SEQ ID NO: 9111910 - DNA, 22 bp, Homo sapiens
agcttcctgttgagagagggag

SEQ ID NO: 9111911 - DNA, 22 bp, Homo sapiens
agcttccttggcgctgaggcct

SEQ ID NO: 9111912 - DNA, 22 bp, Homo sapiens
agcttccttgaattctgtagaa

SEQ ID NO: 9111913 - DNA, 22 bp, Homo sapiens
agcttccttggcgctgaggcct

SEQ ID NO: 9111914 - DNA, 23 bp, Homo sapiens
agcttcctagtgacctggagtct

SEQ ID NO: 9111915 - DNA, 22 bp, Homo sapiens
agcttcctcacctcagaggtct

SEQ ID NO: 9111916 - DNA, 22 bp, Homo sapiens
agcttcctgactggtgctctta

SEQ ID NO: 9111917 - DNA, 22 bp, Homo sapiens
agcttcccaaggttggaaggtt

SEQ ID NO: 9111918 - DNA, 22 bp, Homo sapiens
agcttcctacaaccatctcaga

SEQ ID NO: 9111919 - DNA, 18 bp, Homo sapiens
agcttccctctgagaggg

SEQ ID NO: 9111920 - DNA, 22 bp, Homo sapiens
agctgtctgtctcctgaggaga

SEQ ID NO: 9111921 - DNA, 22 bp, Homo sapiens
agctgtctgtctcctgaggaga

SEQ ID NO: 9111922 - DNA, 22 bp, Homo sapiens
agctgtctgtctcctgaggaga

SEQ ID NO: 9111923 - DNA, 22 bp, Homo sapiens
agctgtctttctgcctcctgat

SEQ ID NO: 9111924 - DNA, 22 bp, Homo sapiens
caggcccaggtgtcgatgttcc

SEQ ID NO: 9111925 - DNA, 22 bp, Homo sapiens
caggcccatgagggcagccaca

SEQ ID NO: 9111926 - DNA, 22 bp, Homo sapiens
caggcccattctaggcttgcta

SEQ ID NO: 9111927 - DNA, 22 bp, Homo sapiens
caggcccatttgtagccacttt

SEQ ID NO: 9111928 - DNA, 22 bp, Homo sapiens
caggcccattctaggcttgcta

SEQ ID NO: 9111929 - DNA, 22 bp, Homo sapiens
caggcagcgtcctgcttcctgt

SEQ ID NO: 9111930 - DNA, 22 bp, Homo sapiens
caggcagcgtcctgcttcctgt

SEQ ID NO: 9111931 - DNA, 22 bp, Homo sapiens
caggcagcgtcctgcttcctgt

SEQ ID NO: 9111932 - DNA, 22 bp, Homo sapiens
caggcagcgctcgtggcctggc

SEQ ID NO: 9111933 - DNA, 22 bp, Homo sapiens
caggcagcgctcgtggcctggc

SEQ ID NO: 9111934 - DNA, 22 bp, Homo sapiens
caggcagcgctcgtggcctggc

SEQ ID NO: 9111935 - DNA, 22 bp, Homo sapiens
caggcagcctgcggtctgcaca

SEQ ID NO: 9111936 - DNA, 22 bp, Homo sapiens
caggcagccttctcgtctcaca

SEQ ID NO: 9111937 - DNA, 22 bp, Homo sapiens
caggcagcctgcggtctgcaca

SEQ ID NO: 9111938 - DNA, 22 bp, Homo sapiens
caggcagggagctggaaaggat

SEQ ID NO: 9111939 - DNA, 22 bp, Homo sapiens
caggcagggagctggaaaggat

SEQ ID NO: 9111940 - DNA, 22 bp, Homo sapiens
caggcagggagctggaaaggat

SEQ ID NO: 9111941 - DNA, 22 bp, Homo sapiens
caggcagctcgatgccttgttg

SEQ ID NO: 9111942 - DNA, 22 bp, Homo sapiens
caggcagctagatttataacaa

SEQ ID NO: 9111943 - DNA, 22 bp, Homo sapiens
caggcagctcaaccttgggagc

SEQ ID NO: 9111944 - DNA, 22 bp, Homo sapiens
caggcagctcaaccttgggagc

SEQ ID NO: 9111945 - DNA, 22 bp, Homo sapiens
caggcagggagctggaaaggat

SEQ ID NO: 9111946 - DNA, 22 bp, Homo sapiens
agctggttcatggactgcctgg

SEQ ID NO: 9111947 - DNA, 22 bp, Homo sapiens
agctggtggaagggagcccaaa

SEQ ID NO: 9111948 - DNA, 22 bp, Homo sapiens
agctggtgctgaagctcttgag

SEQ ID NO: 9111949 - DNA, 22 bp, Homo sapiens
agctggtggaagggagcccaaa

SEQ ID NO: 9111950 - DNA, 22 bp, Homo sapiens
caggcagtgtgacgctagggtt

SEQ ID NO: 9111951 - DNA, 22 bp, Homo sapiens
caggcaggtgcagattcctctt

SEQ ID NO: 9111952 - DNA, 22 bp, Homo sapiens
caggcaggtgcagattcctctt

SEQ ID NO: 9111953 - DNA, 23 bp, Homo sapiens
agctggtttcaatgtgttatttc

SEQ ID NO: 9111954 - DNA, 22 bp, Homo sapiens
agctggtttaggaaaaggtagg

SEQ ID NO: 9111955 - DNA, 22 bp, Homo sapiens
agctgtcctggctcaggctgtg

SEQ ID NO: 9111956 - DNA, 22 bp, Homo sapiens
agctgtcctggctcaggctgtg

SEQ ID NO: 9111957 - DNA, 22 bp, Homo sapiens
agctgtcagtgctgtgcctgta

SEQ ID NO: 9111958 - DNA, 22 bp, Homo sapiens
agctgtcaggcagaactgagct

SEQ ID NO: 9111959 - DNA, 22 bp, Homo sapiens
agctgtctacctgcagagtcct

SEQ ID NO: 9111960 - DNA, 22 bp, Homo sapiens
cagtatgattgccagttctatc

SEQ ID NO: 9111961 - DNA, 22 bp, Homo sapiens
cagtatgagagttgaatcaagg

SEQ ID NO: 9111962 - DNA, 22 bp, Homo sapiens
cagtatgactacaaacagcttt

SEQ ID NO: 9111963 - DNA, 22 bp, Homo sapiens
cagtatcttgcttatagacaca

SEQ ID NO: 9111964 - DNA, 22 bp, Homo sapiens
cagtatgtactcttatcatgta

SEQ ID NO: 9111965 - DNA, 22 bp, Homo sapiens
cagtatgttcttccaggacaga

SEQ ID NO: 9111966 - DNA, 22 bp, Homo sapiens
cagtatgtgatgcaacggaata

SEQ ID NO: 9111967 - DNA, 22 bp, Homo sapiens
cagtatgtctactggacaaagt

SEQ ID NO: 9111968 - DNA, 22 bp, Homo sapiens
cagtatgtctactggacaaagt

SEQ ID NO: 9111969 - DNA, 22 bp, Homo sapiens
cagtaagtattcgagtctccat

SEQ ID NO: 9111970 - DNA, 22 bp, Homo sapiens
cagtatgtttattagaactgca

SEQ ID NO: 9111971 - DNA, 22 bp, Homo sapiens
cagtatgtttgggagacatgac

SEQ ID NO: 9111972 - DNA, 22 bp, Homo sapiens
cagtattcatctaaggagcttg

SEQ ID NO: 9111973 - DNA, 22 bp, Homo sapiens
cagtatttcattcagaattgtt

SEQ ID NO: 9111974 - DNA, 22 bp, Homo sapiens
cagtatttaggattaggagaga

SEQ ID NO: 9111975 - DNA, 22 bp, Homo sapiens
cagtatttgttacagcattagc

SEQ ID NO: 9111976 - DNA, 22 bp, Homo sapiens
cagtatttcctcttcttaactt

SEQ ID NO: 9111977 - DNA, 22 bp, Homo sapiens
cagtatttggaatatagctaag

SEQ ID NO: 9111978 - DNA, 22 bp, Homo sapiens
cagtaaacaatgcctttttggg

SEQ ID NO: 9111979 - DNA, 22 bp, Homo sapiens
cagtaaacactagcattcttgg

SEQ ID NO: 9111980 - DNA, 22 bp, Homo sapiens
aggacagagggaccagagccca

SEQ ID NO: 9111981 - DNA, 22 bp, Homo sapiens
aggacagagggaccagagccca

SEQ ID NO: 9111982 - DNA, 22 bp, Homo sapiens
aggacagagggaccagagccca

SEQ ID NO: 9111983 - DNA, 22 bp, Homo sapiens
aggacagagggaccagagccca

SEQ ID NO: 9111984 - DNA, 22 bp, Homo sapiens
cagtaaatgagaagctagtaat

SEQ ID NO: 9111985 - DNA, 22 bp, Homo sapiens
cagtaacatttcaaggtagagg

SEQ ID NO: 9111986 - DNA, 22 bp, Homo sapiens
cagtaacatgtctgttaagaaa

SEQ ID NO: 9111987 - DNA, 22 bp, Homo sapiens
cagtaacatgaagagacatgga

SEQ ID NO: 9111988 - DNA, 22 bp, Homo sapiens
cagtaacatgaagagacatgga

SEQ ID NO: 9111989 - DNA, 23 bp, Homo sapiens
aggaagttatgaagggagaatag

SEQ ID NO: 9111990 - DNA, 22 bp, Homo sapiens
aggaagtgtcagggataacgat

SEQ ID NO: 9111991 - DNA, 23 bp, Homo sapiens
aggaagttaaggcagacagacag

SEQ ID NO: 9111992 - DNA, 22 bp, Homo sapiens
aggaagttagtaaattatgtgc

SEQ ID NO: 9111993 - DNA, 22 bp, Homo sapiens
aggacaagacaaggaccagaga

SEQ ID NO: 9111994 - DNA, 22 bp, Homo sapiens
aggaatgaactcgagtgatctg

SEQ ID NO: 9111995 - DNA, 22 bp, Homo sapiens
aggaatcaggagatgagcacgg

SEQ ID NO: 9111996 - DNA, 22 bp, Homo sapiens
aggaatcaggagatgagcacgg

SEQ ID NO: 9111997 - DNA, 22 bp, Homo sapiens
aggacagagcctgtgcagaccg

SEQ ID NO: 9111998 - DNA, 22 bp, Homo sapiens
aggacagacctaggactggagc

SEQ ID NO: 9111999 - DNA, 22 bp, Homo sapiens
aggacagagccctagtttcata

SEQ ID NO: 9112000 - DNA, 22 bp, Homo sapiens
aggacaagacaaggaccagaga

SEQ ID NO: 9112001 - DNA, 22 bp, Homo sapiens
aggacagacctaggactggagc

SEQ ID NO: 9112002 - DNA, 22 bp, Homo sapiens
cagggcttgaatcaaggaagtc

SEQ ID NO: 9112003 - DNA, 22 bp, Homo sapiens
caggtggtgcctccaggctggt

SEQ ID NO: 9112004 - DNA, 22 bp, Homo sapiens
cagggcttcgctcctggtgcac

SEQ ID NO: 9112005 - DNA, 22 bp, Homo sapiens
cagggcttcgctcctggtgcac

SEQ ID NO: 9112006 - DNA, 22 bp, Homo sapiens
cagggcttcttggcatttgctg

SEQ ID NO: 9112007 - DNA, 22 bp, Homo sapiens
cagggcttctataccaattcat

SEQ ID NO: 9112008 - DNA, 22 bp, Homo sapiens
cagggcttcgtgtctcagtgct

SEQ ID NO: 9112009 - DNA, 22 bp, Homo sapiens
cagggcttcgatggatggatgg

SEQ ID NO: 9112010 - DNA, 22 bp, Homo sapiens
aggaagtggataaaatagcttt

SEQ ID NO: 9112011 - DNA, 22 bp, Homo sapiens
aggaagtgcagggggaagtact

SEQ ID NO: 9112012 - DNA, 22 bp, Homo sapiens
aggaagtgaaagggaaggagtt

SEQ ID NO: 9112013 - DNA, 22 bp, Homo sapiens
aggaagtgactaggtaacccaa

SEQ ID NO: 9112014 - DNA, 22 bp, Homo sapiens
cagggctggctgtggcaatctc

SEQ ID NO: 9112015 - DNA, 22 bp, Homo sapiens
aggaaaggattggcttctctgt

SEQ ID NO: 9112016 - DNA, 22 bp, Homo sapiens
aggaaaggattggcttctctgt

SEQ ID NO: 9112017 - DNA, 19 bp, Homo sapiens
aggaaaggatcaaaatagc

SEQ ID NO: 9112018 - DNA, 22 bp, Homo sapiens
aggaagaaaactaattagatgg

SEQ ID NO: 9112019 - DNA, 22 bp, Homo sapiens
aggaaaggcctcagcagaaacc

SEQ ID NO: 9112020 - DNA, 22 bp, Homo sapiens
aggaaaggcctttgcatttggt

SEQ ID NO: 9112021 - DNA, 22 bp, Homo sapiens
aggaaaggcctttgcatttggt

SEQ ID NO: 9112022 - DNA, 22 bp, Homo sapiens
aggaaaggcctttgcatttggt

SEQ ID NO: 9112023 - DNA, 21 bp, Homo sapiens
aggaaaggccagcacgtaggg

SEQ ID NO: 9112024 - DNA, 22 bp, Homo sapiens
aggaaaggcctcagcagaaacc

SEQ ID NO: 9112025 - DNA, 22 bp, Homo sapiens
aggaaaggcctcagcagaaacc

SEQ ID NO: 9112026 - DNA, 22 bp, Homo sapiens
aggaaaggcctcagcagaaacc

SEQ ID NO: 9112027 - DNA, 23 bp, Homo sapiens
aggaagaggcaatttctcttaga

SEQ ID NO: 9112028 - DNA, 22 bp, Homo sapiens
aggaagagggtggcagataatc

SEQ ID NO: 9112029 - DNA, 22 bp, Homo sapiens
aggaagagggtggcagataatc

SEQ ID NO: 9112030 - DNA, 18 bp, Homo sapiens
cagggctgtggggtcact

SEQ ID NO: 9112031 - DNA, 22 bp, Homo sapiens
aggaagagctggaccagaggac

SEQ ID NO: 9112032 - DNA, 22 bp, Homo sapiens
aggaagagcccgggtgacataa

SEQ ID NO: 9112033 - DNA, 22 bp, Homo sapiens
aggaagagcccgggtgacataa

SEQ ID NO: 9112034 - DNA, 22 bp, Homo sapiens
aggaagagcccgggtgacataa

SEQ ID NO: 9112035 - DNA, 22 bp, Homo sapiens
aggaagagcccgggtgacataa

SEQ ID NO: 9112036 - DNA, 22 bp, Homo sapiens
agctttggagctgggtgaaaga

SEQ ID NO: 9112037 - DNA, 22 bp, Homo sapiens
agctttgctgctggagaagggt

SEQ ID NO: 9112038 - DNA, 22 bp, Homo sapiens
cagggctggatttcatttctag

SEQ ID NO: 9112039 - DNA, 22 bp, Homo sapiens
cagggctggctgtggcaatctc

SEQ ID NO: 9112040 - DNA, 22 bp, Homo sapiens
cagggctctgccttgagggatg

SEQ ID NO: 9112041 - DNA, 22 bp, Homo sapiens
agctttgggcagaagaggattc

SEQ ID NO: 9112042 - DNA, 22 bp, Homo sapiens
agctttgggattcaggcaggaa

SEQ ID NO: 9112043 - DNA, 22 bp, Homo sapiens
cagggcaggatgctgtgattat

SEQ ID NO: 9112044 - DNA, 22 bp, Homo sapiens
caggctgaagtgcagtggtgtg

SEQ ID NO: 9112045 - DNA, 22 bp, Homo sapiens
caggctcttttggtggcaagga

SEQ ID NO: 9112046 - DNA, 22 bp, Homo sapiens
caggctgacaactgagcatttt

SEQ ID NO: 9112047 - DNA, 22 bp, Homo sapiens
caggctcttccatcctgctgag

SEQ ID NO: 9112048 - DNA, 22 bp, Homo sapiens
caggctgaagtgcagtggtgtg

SEQ ID NO: 9112049 - DNA, 22 bp, Homo sapiens
caggctcttttggtggcaagga

SEQ ID NO: 9112050 - DNA, 22 bp, Homo sapiens
catcttattttcttctagtgct

SEQ ID NO: 9112051 - DNA, 19 bp, Homo sapiens
catctctgcaaggagctgc

SEQ ID NO: 9112052 - DNA, 22 bp, Homo sapiens
catctctggttcagtctctgtg

SEQ ID NO: 9112053 - DNA, 22 bp, Homo sapiens
catctctggttcagtctctgtg

SEQ ID NO: 9112054 - DNA, 22 bp, Homo sapiens
catctctggcttggattatggt

SEQ ID NO: 9112055 - DNA, 22 bp, Homo sapiens
catctcatcagtgagagtcagc

SEQ ID NO: 9112056 - DNA, 22 bp, Homo sapiens
catccaaactctcattatctgt

SEQ ID NO: 9112057 - DNA, 22 bp, Homo sapiens
catccaaagcaaatatcttaaa

SEQ ID NO: 9112058 - DNA, 22 bp, Homo sapiens
catccaaagcaaatatcttaaa

SEQ ID NO: 9112059 - DNA, 22 bp, Homo sapiens
catctcatttattccaactcag

SEQ ID NO: 9112060 - DNA, 22 bp, Homo sapiens
catctcatcctgccctaaaaca

SEQ ID NO: 9112061 - DNA, 19 bp, Homo sapiens
catctcccacagccacaca

SEQ ID NO: 9112062 - DNA, 22 bp, Homo sapiens
aggaggctgaactagggtctgg

SEQ ID NO: 9112063 - DNA, 20 bp, Homo sapiens
aggaggcctgcagatagttc

SEQ ID NO: 9112064 - DNA, 20 bp, Homo sapiens
aggaggcctgcagatagttc

SEQ ID NO: 9112065 - DNA, 22 bp, Homo sapiens
aggaggcctggctggggagatc

SEQ ID NO: 9112066 - DNA, 22 bp, Homo sapiens
aggaggcctggctggggagatc

SEQ ID NO: 9112067 - DNA, 22 bp, Homo sapiens
catacaaatgtgtccaggctct

SEQ ID NO: 9112068 - DNA, 22 bp, Homo sapiens
catacaatcaagttctttatta

SEQ ID NO: 9112069 - DNA, 22 bp, Homo sapiens
catacaatcaagttctttatta

SEQ ID NO: 9112070 - DNA, 19 bp, Homo sapiens
catacaattaccataggat

SEQ ID NO: 9112071 - DNA, 19 bp, Homo sapiens
catacaattaccataggat

SEQ ID NO: 9112072 - DNA, 22 bp, Homo sapiens
catacagagaaggataataaag

SEQ ID NO: 9112073 - DNA, 22 bp, Homo sapiens
aggatttgtatagctttctttt

SEQ ID NO: 9112074 - DNA, 22 bp, Homo sapiens
aggatttggggaagaaaacact

SEQ ID NO: 9112075 - DNA, 22 bp, Homo sapiens
aggatttggccatggcttcggg

SEQ ID NO: 9112076 - DNA, 22 bp, Homo sapiens
aggatttgcactggtgtttgag

SEQ ID NO: 9112077 - DNA, 22 bp, Homo sapiens
catgagcataaatcagtcacga

SEQ ID NO: 9112078 - DNA, 22 bp, Homo sapiens
catgagatttgggaggggccag

SEQ ID NO: 9112079 - DNA, 22 bp, Homo sapiens
catgagatttgggaggggccag

SEQ ID NO: 9112080 - DNA, 22 bp, Homo sapiens
catgagatttgggaggggccag

SEQ ID NO: 9112081 - DNA, 22 bp, Homo sapiens
catgagctgctgggagcctgtc

SEQ ID NO: 9112082 - DNA, 22 bp, Homo sapiens
catgagcattttggtctagttt

SEQ ID NO: 9112083 - DNA, 22 bp, Homo sapiens
catgaggatccaggtgacaggc

SEQ ID NO: 9112084 - DNA, 22 bp, Homo sapiens
catgagaatgaagaagacttaa

SEQ ID NO: 9112085 - DNA, 22 bp, Homo sapiens
catgagaatgaagaagacttaa

SEQ ID NO: 9112086 - DNA, 22 bp, Homo sapiens
catgagaatgaagaagacttaa

SEQ ID NO: 9112087 - DNA, 22 bp, Homo sapiens
catgagataatttttctccagt

SEQ ID NO: 9112088 - DNA, 22 bp, Homo sapiens
catgagatctgcagggatgggc

SEQ ID NO: 9112089 - DNA, 22 bp, Homo sapiens
catgagagatccttcatgagag

SEQ ID NO: 9112090 - DNA, 23 bp, Homo sapiens
aggatgtaggatgtatggcagag

SEQ ID NO: 9112091 - DNA, 22 bp, Homo sapiens
aggatgtgagtggacacagtcc

SEQ ID NO: 9112092 - DNA, 22 bp, Homo sapiens
catcttctgggacttctcagtt

SEQ ID NO: 9112093 - DNA, 22 bp, Homo sapiens
catcttgtgaggaccttcttgc

SEQ ID NO: 9112094 - DNA, 22 bp, Homo sapiens
aggatgagaagattggaatctt

SEQ ID NO: 9112095 - DNA, 22 bp, Homo sapiens
aggatgggcctgggatatgctt

SEQ ID NO: 9112096 - DNA, 22 bp, Homo sapiens
aggatgggcctgggatatgctt

SEQ ID NO: 9112097 - DNA, 22 bp, Homo sapiens
aggatggggtctgcagcctggt

SEQ ID NO: 9112098 - DNA, 23 bp, Homo sapiens
aggatgggtggcaatagaaagac

SEQ ID NO: 9112099 - DNA, 22 bp, Homo sapiens
cataacattattttctgaagat

SEQ ID NO: 9112100 - DNA, 22 bp, Homo sapiens
cagttttatgtcgaatgtatac

SEQ ID NO: 9112101 - DNA, 17 bp, Homo sapiens
aggagctgggggtggtg

SEQ ID NO: 9112102 - DNA, 22 bp, Homo sapiens
cataagaaggtaacatccttaa

SEQ ID NO: 9112103 - DNA, 22 bp, Homo sapiens
cataagaatatttagtggcagc

SEQ ID NO: 9112104 - DNA, 22 bp, Homo sapiens
cataagaatattccatcctttg

SEQ ID NO: 9112105 - DNA, 22 bp, Homo sapiens
cataacttgctttggagcccgg

SEQ ID NO: 9112106 - DNA, 22 bp, Homo sapiens
cataactagagtgaaatgttga

SEQ ID NO: 9112107 - DNA, 22 bp, Homo sapiens
cataacattgagcagcattcct

SEQ ID NO: 9112108 - DNA, 22 bp, Homo sapiens
cataagaaatttaacagaactt

SEQ ID NO: 9112109 - DNA, 22 bp, Homo sapiens
cataactttaaagacagtgtgg

SEQ ID NO: 9112110 - DNA, 22 bp, Homo sapiens
cataacttggtgttggaaactg

SEQ ID NO: 9112111 - DNA, 22 bp, Homo sapiens
cataagaaataatgatgatgac

SEQ ID NO: 9112112 - DNA, 22 bp, Homo sapiens
aggagctggtagtctcattggg

SEQ ID NO: 9112113 - DNA, 22 bp, Homo sapiens
aggagctgggttcctttggtgg

SEQ ID NO: 9112114 - DNA, 22 bp, Homo sapiens
aggagctgggttcctttggtgg

SEQ ID NO: 9112115 - DNA, 22 bp, Homo sapiens
aggagctgtcagagtgccagag

SEQ ID NO: 9112116 - DNA, 22 bp, Homo sapiens
aggagctgtcagagtgccagag

SEQ ID NO: 9112117 - DNA, 22 bp, Homo sapiens
aggagctgtcagagtgccagag

SEQ ID NO: 9112118 - DNA, 22 bp, Homo sapiens
aggagctgtcatttgattcaca

SEQ ID NO: 9112119 - DNA, 22 bp, Homo sapiens
aggagctgtcatttgattcaca

SEQ ID NO: 9112120 - DNA, 22 bp, Homo sapiens
aggagctgtgaatgggaggggt

SEQ ID NO: 9112121 - DNA, 22 bp, Homo sapiens
aggaggcagatgcttggctgta

SEQ ID NO: 9112122 - DNA, 22 bp, Homo sapiens
aggaggccgctgatgggctccc

SEQ ID NO: 9112123 - DNA, 22 bp, Homo sapiens
aggaggccgctgatgggctccc

SEQ ID NO: 9112124 - DNA, 22 bp, Homo sapiens
aggaggccgctgatgggctccc

SEQ ID NO: 9112125 - DNA, 23 bp, Homo sapiens
aggaggcctgaaactgaggctga

SEQ ID NO: 9112126 - DNA, 23 bp, Homo sapiens
aggaggcctgaaactgaggctga

SEQ ID NO: 9112127 - DNA, 22 bp, Homo sapiens
aggaggcctctatccagagaga

SEQ ID NO: 9112128 - DNA, 22 bp, Homo sapiens
aggaggccgggattctggagat

SEQ ID NO: 9112129 - DNA, 22 bp, Homo sapiens
aggaggccgggattctggagat

SEQ ID NO: 9112130 - DNA, 22 bp, Homo sapiens
aggaggcctacgcacatgtcta

SEQ ID NO: 9112131 - DNA, 22 bp, Homo sapiens
aggaggcctacgcacatgtcta

SEQ ID NO: 9112132 - DNA, 20 bp, Homo sapiens
cagtccaggctagaaaacaa

SEQ ID NO: 9112133 - DNA, 22 bp, Homo sapiens
cagtgtggagggagagagcctg

SEQ ID NO: 9112134 - DNA, 22 bp, Homo sapiens
cagtgtggctgagacagaggct

SEQ ID NO: 9112135 - DNA, 22 bp, Homo sapiens
cagtccaggcctggaggagcca

SEQ ID NO: 9112136 - DNA, 22 bp, Homo sapiens
cagtccagctcatcagtggcac

SEQ ID NO: 9112137 - DNA, 22 bp, Homo sapiens
cagtccagccagtagggtgtgg

SEQ ID NO: 9112138 - DNA, 22 bp, Homo sapiens
cagtatttgttccctatcaatg

SEQ ID NO: 9112139 - DNA, 22 bp, Homo sapiens
cagtccagagcccaccagagga

SEQ ID NO: 9112140 - DNA, 22 bp, Homo sapiens
aggagccaggaaacctgctctg

SEQ ID NO: 9112141 - DNA, 23 bp, Homo sapiens
aggagccaggtgcagcccttgtg

SEQ ID NO: 9112142 - DNA, 22 bp, Homo sapiens
aggagccaggaaacctgctctg

SEQ ID NO: 9112143 - DNA, 22 bp, Homo sapiens
aggagccagaatccagactcgg

SEQ ID NO: 9112144 - DNA, 22 bp, Homo sapiens
aggagccaggaaacctgctctg

SEQ ID NO: 9112145 - DNA, 22 bp, Homo sapiens
cagtgtgtggatcctcccagga

SEQ ID NO: 9112146 - DNA, 22 bp, Homo sapiens
cagtgtggtgtgcacagcttag

SEQ ID NO: 9112147 - DNA, 22 bp, Homo sapiens
cagtgtttaatcattgtgaatt

SEQ ID NO: 9112148 - DNA, 23 bp, Homo sapiens
ccactagcacctgttcaacttct

SEQ ID NO: 9112149 - DNA, 22 bp, Homo sapiens
ccacgtccagctaattttcgta

SEQ ID NO: 9112150 - DNA, 22 bp, Homo sapiens
ccacgctcatcctctctgagag

SEQ ID NO: 9112151 - DNA, 22 bp, Homo sapiens
ccacccagccagatgcaggaag

SEQ ID NO: 9112152 - DNA, 22 bp, Homo sapiens
ccacccagaccagggatctggg

SEQ ID NO: 9112153 - DNA, 22 bp, Homo sapiens
ccacccagccagatgcaggaag

SEQ ID NO: 9112154 - DNA, 22 bp, Homo sapiens
ccacccagccagatgcaggaag

SEQ ID NO: 9112155 - DNA, 22 bp, Homo sapiens
ccaccaggcactcacagggaag

SEQ ID NO: 9112156 - DNA, 19 bp, Homo sapiens
ccaccagtgtgatctaaga

SEQ ID NO: 9112157 - DNA, 22 bp, Homo sapiens
ccacagtggttctcaaccaggg

SEQ ID NO: 9112158 - DNA, 22 bp, Homo sapiens
ccaatgaaaggtcaattctata

SEQ ID NO: 9112159 - DNA, 22 bp, Homo sapiens
catttgaaacctggaatctacc

SEQ ID NO: 9112160 - DNA, 22 bp, Homo sapiens
catttctgggagacatgctaga

SEQ ID NO: 9112161 - DNA, 22 bp, Homo sapiens
ccacagaattctgtctccagga

SEQ ID NO: 9112162 - DNA, 22 bp, Homo sapiens
ccacagaatgatgacacttcag

SEQ ID NO: 9112163 - DNA, 22 bp, Homo sapiens
ccacagaattctgtctccagga

SEQ ID NO: 9112164 - DNA, 22 bp, Homo sapiens
ccacagagacagagcccagggt

SEQ ID NO: 9112165 - DNA, 22 bp, Homo sapiens
ccacagagacagagcccagggt

SEQ ID NO: 9112166 - DNA, 22 bp, Homo sapiens
ccacagagacagggtccttgct

SEQ ID NO: 9112167 - DNA, 22 bp, Homo sapiens
ccacagagacagggtccttgct

SEQ ID NO: 9112168 - DNA, 22 bp, Homo sapiens
ccacagagagtgtcagcctttg

SEQ ID NO: 9112169 - DNA, 22 bp, Homo sapiens
ccacagagactctgcaggactg

SEQ ID NO: 9112170 - DNA, 22 bp, Homo sapiens
ccacagagactctgcaggactg

SEQ ID NO: 9112171 - DNA, 22 bp, Homo sapiens
ccacagagagtgtcagcctttg

SEQ ID NO: 9112172 - DNA, 19 bp, Homo sapiens
ccacagagactagaagaca

SEQ ID NO: 9112173 - DNA, 22 bp, Homo sapiens
ccacagagactctgcaggactg

SEQ ID NO: 9112174 - DNA, 18 bp, Homo sapiens
aggcaggatcctggcctc

SEQ ID NO: 9112175 - DNA, 23 bp, Homo sapiens
ccacaggcacagaggcttgcatc

SEQ ID NO: 9112176 - DNA, 23 bp, Homo sapiens
ccacaggcacagaggcttgcatc

SEQ ID NO: 9112177 - DNA, 22 bp, Homo sapiens
aggcaggaggatcatggatgca

SEQ ID NO: 9112178 - DNA, 22 bp, Homo sapiens
aggcaggaggatcatggatgca

SEQ ID NO: 9112179 - DNA, 22 bp, Homo sapiens
aggcaggaggatcatggatgca

SEQ ID NO: 9112180 - DNA, 22 bp, Homo sapiens
aggcaggaggatcatggatgca

SEQ ID NO: 9112181 - DNA, 22 bp, Homo sapiens
aggcaggagtgaccctgacagg

SEQ ID NO: 9112182 - DNA, 19 bp, Homo sapiens
ccacagagcatgctgaggc

SEQ ID NO: 9112183 - DNA, 22 bp, Homo sapiens
ccacagagcattagatttcaga

SEQ ID NO: 9112184 - DNA, 22 bp, Homo sapiens
aggcaggaaaatcgcttgaacc

SEQ ID NO: 9112185 - DNA, 22 bp, Homo sapiens
aggcaggaaccctgtgtgcgcc

SEQ ID NO: 9112186 - DNA, 22 bp, Homo sapiens
aggcaggaaccctgtgtgcgcc

SEQ ID NO: 9112187 - DNA, 17 bp, Homo sapiens
aggcaggagattggaga

SEQ ID NO: 9112188 - DNA, 17 bp, Homo sapiens
aggcaggagattggaga

SEQ ID NO: 9112189 - DNA, 22 bp, Homo sapiens
catttcaaaagaattgccagaa

SEQ ID NO: 9112190 - DNA, 22 bp, Homo sapiens
catttcaagcattgacttctat

SEQ ID NO: 9112191 - DNA, 22 bp, Homo sapiens
catttcaagcattgacttctat

SEQ ID NO: 9112192 - DNA, 23 bp, Homo sapiens
catttcaacgaattttccttctg

SEQ ID NO: 9112193 - DNA, 21 bp, Homo sapiens
catttcaaagagctggaaatc

SEQ ID NO: 9112194 - DNA, 22 bp, Homo sapiens
catttcaatacagtttgtaaat

SEQ ID NO: 9112195 - DNA, 22 bp, Homo sapiens
catttcaatacagtttgtaaat

SEQ ID NO: 9112196 - DNA, 22 bp, Homo sapiens
catttcaatactatctgagaat

SEQ ID NO: 9112197 - DNA, 22 bp, Homo sapiens
catttcaattatttgctcttct

SEQ ID NO: 9112198 - DNA, 22 bp, Homo sapiens
catttcacacataaacttgggt

SEQ ID NO: 9112199 - DNA, 22 bp, Homo sapiens
catttctccgccgagatcactg

SEQ ID NO: 9112200 - DNA, 22 bp, Homo sapiens
cattggaatgatcgttttgctg

SEQ ID NO: 9112201 - DNA, 22 bp, Homo sapiens
cattggtttgatattgccatgg

SEQ ID NO: 9112202 - DNA, 22 bp, Homo sapiens
cattggttgtcatggcaggagg

SEQ ID NO: 9112203 - DNA, 22 bp, Homo sapiens
cattggtcttctaacagagaga

SEQ ID NO: 9112204 - DNA, 21 bp, Homo sapiens
aggcactgtttgtggtttggg

SEQ ID NO: 9112205 - DNA, 21 bp, Homo sapiens
aggcacttaaccaatgttagc

SEQ ID NO: 9112206 - DNA, 22 bp, Homo sapiens
aggcactgttcccagttatcct

SEQ ID NO: 9112207 - DNA, 20 bp, Homo sapiens
aggcactgttgtctgtatcc

SEQ ID NO: 9112208 - DNA, 22 bp, Homo sapiens
aggcactgtgggtgtggccgga

SEQ ID NO: 9112209 - DNA, 22 bp, Homo sapiens
aggcacttctcaaattcatgcc

SEQ ID NO: 9112210 - DNA, 22 bp, Homo sapiens
aggcacttaataaggattcaat

SEQ ID NO: 9112211 - DNA, 22 bp, Homo sapiens
aggcacttaacctactaactga

SEQ ID NO: 9112212 - DNA, 22 bp, Homo sapiens
aggcacttgcattgatgaggtc

SEQ ID NO: 9112213 - DNA, 22 bp, Homo sapiens
aggcacttgattaatgtgaatt

SEQ ID NO: 9112214 - DNA, 22 bp, Homo sapiens
aggcacttgaattgatgatgtt

SEQ ID NO: 9112215 - DNA, 22 bp, Homo sapiens
aggcaatacacagcatttcaca

SEQ ID NO: 9112216 - DNA, 22 bp, Homo sapiens
aggcaatagaatatgcctgagg

SEQ ID NO: 9112217 - DNA, 21 bp, Homo sapiens
aggcaataaagttttgtctac

SEQ ID NO: 9112218 - DNA, 22 bp, Homo sapiens
aggcaataagcctcaactgtct

SEQ ID NO: 9112219 - DNA, 23 bp, Homo sapiens
aggcaatacaaggcatctctgga

SEQ ID NO: 9112220 - DNA, 22 bp, Homo sapiens
aggcaatcccctgaggatactt

SEQ ID NO: 9112221 - DNA, 22 bp, Homo sapiens
aggcaataggttcctcatcttt

SEQ ID NO: 9112222 - DNA, 22 bp, Homo sapiens
aggcaatattccatgtggaact

SEQ ID NO: 9112223 - DNA, 22 bp, Homo sapiens
cattccttaacgtggggagtct

SEQ ID NO: 9112224 - DNA, 22 bp, Homo sapiens
aggcaatcctcttacagatggg

SEQ ID NO: 9112225 - DNA, 22 bp, Homo sapiens
aggcaatcccctgaggatactt

SEQ ID NO: 9112226 - DNA, 22 bp, Homo sapiens
aggcaagttattggctcagagc

SEQ ID NO: 9112227 - DNA, 22 bp, Homo sapiens
aggcaagtgcattagaagagca

SEQ ID NO: 9112228 - DNA, 22 bp, Homo sapiens
aggcaaggtgctacagacagtg

SEQ ID NO: 9112229 - DNA, 22 bp, Homo sapiens
cattgctttgtgcatatttaaa

SEQ ID NO: 9112230 - DNA, 22 bp, Homo sapiens
aggcaagcagtcagtctatgag

SEQ ID NO: 9112231 - DNA, 22 bp, Homo sapiens
aggcaagcattgggaacagggc

SEQ ID NO: 9112232 - DNA, 22 bp, Homo sapiens
aggcaagcccaggcacttggag

SEQ ID NO: 9112233 - DNA, 22 bp, Homo sapiens
aggcaagcccccagtgaggctc

SEQ ID NO: 9112234 - DNA, 22 bp, Homo sapiens
aggcaagcccccagtgaggctc

SEQ ID NO: 9112235 - DNA, 20 bp, Homo sapiens
aggcaaggtagatgtctgct

SEQ ID NO: 9112236 - DNA, 23 bp, Homo sapiens
aggcaagggtgtaaaggaaatga

SEQ ID NO: 9112237 - DNA, 22 bp, Homo sapiens
aggcaagctgcagagagtcctt

SEQ ID NO: 9112238 - DNA, 22 bp, Homo sapiens
aggcaagcttgaaattggctct

SEQ ID NO: 9112239 - DNA, 23 bp, Homo sapiens
aggcaagggtgtaaaggaaatga

SEQ ID NO: 9112240 - DNA, 23 bp, Homo sapiens
aggcaagggtgtaaaggaaatga

SEQ ID NO: 9112241 - DNA, 22 bp, Homo sapiens
aggcaaggaagaattctcccct

SEQ ID NO: 9112242 - DNA, 22 bp, Homo sapiens
aggcaagggggcgccaccttcc

SEQ ID NO: 9112243 - DNA, 23 bp, Homo sapiens
aggcaagaacgggttgttcaccc

SEQ ID NO: 9112244 - DNA, 22 bp, Homo sapiens
aggcaagaacagacatgggagt

SEQ ID NO: 9112245 - DNA, 22 bp, Homo sapiens
aggcaagaaactttctgggaga

SEQ ID NO: 9112246 - DNA, 20 bp, Homo sapiens
aggcaactcaagtttttgcc

SEQ ID NO: 9112247 - DNA, 22 bp, Homo sapiens
cattcttacacaatattttaat

SEQ ID NO: 9112248 - DNA, 22 bp, Homo sapiens
cattcttctcccttaccttcca

SEQ ID NO: 9112249 - DNA, 22 bp, Homo sapiens
cattctgtgattctaaatccct

SEQ ID NO: 9112250 - DNA, 22 bp, Homo sapiens
cattctgtgattctaaatccct

SEQ ID NO: 9112251 - DNA, 22 bp, Homo sapiens
tcccacattaccctgactgaca

SEQ ID NO: 9112252 - DNA, 22 bp, Homo sapiens
cattcttgcaccgtgatggctt

SEQ ID NO: 9112253 - DNA, 22 bp, Homo sapiens
tcccacccatcctgcatctctt

SEQ ID NO: 9112254 - DNA, 22 bp, Homo sapiens
tcccaccccttgactctttaag

SEQ ID NO: 9112255 - DNA, 22 bp, Homo sapiens
cattacgagctctaaaatacta

SEQ ID NO: 9112256 - DNA, 22 bp, Homo sapiens
cattagagcagataatatgtgt

SEQ ID NO: 9112257 - DNA, 22 bp, Homo sapiens
cattagattggtgcaaaaataa

SEQ ID NO: 9112258 - DNA, 22 bp, Homo sapiens
cattagaactaagatgtccagg

SEQ ID NO: 9112259 - DNA, 22 bp, Homo sapiens
cattagaacctataaaaagcat

SEQ ID NO: 9112260 - DNA, 22 bp, Homo sapiens
cattagcactctaaggaagaga

SEQ ID NO: 9112261 - DNA, 22 bp, Homo sapiens
cattctaaagtgttttatacct

SEQ ID NO: 9112262 - DNA, 22 bp, Homo sapiens
cattctatcttggactggatct

SEQ ID NO: 9112263 - DNA, 22 bp, Homo sapiens
cattctatgaaaactaggcaat

SEQ ID NO: 9112264 - DNA, 22 bp, Homo sapiens
cattctcaatagtagatgagta

SEQ ID NO: 9112265 - DNA, 22 bp, Homo sapiens
tccaggagcatccaggtgaagc

SEQ ID NO: 9112266 - DNA, 22 bp, Homo sapiens
catgggaggttggcttggcatg

SEQ ID NO: 9112267 - DNA, 22 bp, Homo sapiens
catgggaggtctgcaaggtgct

SEQ ID NO: 9112268 - DNA, 22 bp, Homo sapiens
tccaggagaggcctgaccaggt

SEQ ID NO: 9112269 - DNA, 22 bp, Homo sapiens
tccaggagatacactgcaccag

SEQ ID NO: 9112270 - DNA, 22 bp, Homo sapiens
tccaggagattcattaggtcat

SEQ ID NO: 9112271 - DNA, 17 bp, Homo sapiens
tccaggagaggcaatgg

SEQ ID NO: 9112272 - DNA, 17 bp, Homo sapiens
tccaggagaggcaatgg

SEQ ID NO: 9112273 - DNA, 22 bp, Homo sapiens
catgggctacagaagcatgctg

SEQ ID NO: 9112274 - DNA, 22 bp, Homo sapiens
catgggcccgtgagaggcaggg

SEQ ID NO: 9112275 - DNA, 22 bp, Homo sapiens
tccattttagagatgaagaaac

SEQ ID NO: 9112276 - DNA, 22 bp, Homo sapiens
tcccaaaaaaggtatgttgaag

SEQ ID NO: 9112277 - DNA, 22 bp, Homo sapiens
tccattttgtaggtatgctaca

SEQ ID NO: 9112278 - DNA, 22 bp, Homo sapiens
tccattttctaagtatcactta

SEQ ID NO: 9112279 - DNA, 22 bp, Homo sapiens
tccattttcatctcatgtataa

SEQ ID NO: 9112280 - DNA, 22 bp, Homo sapiens
cattgttatagcattacacacc

SEQ ID NO: 9112281 - DNA, 22 bp, Homo sapiens
cattgttgaacacctgctggat

SEQ ID NO: 9112282 - DNA, 22 bp, Homo sapiens
cattgttaccatcttttaccta

SEQ ID NO: 9112283 - DNA, 22 bp, Homo sapiens
catttaaaggttgtgggtaaaa

SEQ ID NO: 9112284 - DNA, 22 bp, Homo sapiens
cattgtacagttattttaaaat

SEQ ID NO: 9112285 - DNA, 22 bp, Homo sapiens
cattgtcctctgatgccttccc

SEQ ID NO: 9112286 - DNA, 22 bp, Homo sapiens
tcccactcccaggcaggcctct

SEQ ID NO: 9112287 - DNA, 22 bp, Homo sapiens
tcccactcccaggcaggcctct

SEQ ID NO: 9112288 - DNA, 22 bp, Homo sapiens
tcccactcactgtctctgacac

SEQ ID NO: 9112289 - DNA, 22 bp, Homo sapiens
tcccactcccaggcaggcctct

SEQ ID NO: 9112290 - DNA, 22 bp, Homo sapiens
catttaatcctcacaagcctat

SEQ ID NO: 9112291 - DNA, 22 bp, Homo sapiens
catttaatgcacggatgtagcc

SEQ ID NO: 9112292 - DNA, 22 bp, Homo sapiens
catttaatccatagaggaatgt

SEQ ID NO: 9112293 - DNA, 22 bp, Homo sapiens
catttacaatgtacaggttgtg

SEQ ID NO: 9112294 - DNA, 22 bp, Homo sapiens
catttacaatgtacaggttgtg

SEQ ID NO: 9112295 - DNA, 22 bp, Homo sapiens
catttacaatgtacaggttgtg

SEQ ID NO: 9112296 - DNA, 22 bp, Homo sapiens
catttacacacagaggtgtgct

SEQ ID NO: 9112297 - DNA, 22 bp, Homo sapiens
catttacacacagaggtgtgct

SEQ ID NO: 9112298 - DNA, 22 bp, Homo sapiens
catttacacacagaggtgtgct

SEQ ID NO: 9112299 - DNA, 22 bp, Homo sapiens
tccctcctggtgagcaggggct

SEQ ID NO: 9112300 - DNA, 22 bp, Homo sapiens
tccctcctggtgatgatgcaaa

SEQ ID NO: 9112301 - DNA, 22 bp, Homo sapiens
tccctccttaataagaggtctg

SEQ ID NO: 9112302 - DNA, 22 bp, Homo sapiens
catttacacttctaaccacaag

SEQ ID NO: 9112303 - DNA, 22 bp, Homo sapiens
catttacacttctaaccacaag

SEQ ID NO: 9112304 - DNA, 20 bp, Homo sapiens
tccctcctgcagatagagaa

SEQ ID NO: 9112305 - DNA, 22 bp, Homo sapiens
tccctcctgcatgaggctcggc

SEQ ID NO: 9112306 - DNA, 22 bp, Homo sapiens
tccctgctttcttgtgagggga

SEQ ID NO: 9112307 - DNA, 18 bp, Homo sapiens
tccctggggctgccaccc

SEQ ID NO: 9112308 - DNA, 22 bp, Homo sapiens
tccctggggtaacattagaggg

SEQ ID NO: 9112309 - DNA, 22 bp, Homo sapiens
tccctggggtatcgctgaggca

SEQ ID NO: 9112310 - DNA, 22 bp, Homo sapiens
tccctggggtatcgctgaggca

SEQ ID NO: 9112311 - DNA, 22 bp, Homo sapiens
tccctggggtatcgctgaggca

SEQ ID NO: 9112312 - DNA, 22 bp, Homo sapiens
tccctggggttcctccagccac

SEQ ID NO: 9112313 - DNA, 22 bp, Homo sapiens
tccctggggttcctccagccac

SEQ ID NO: 9112314 - DNA, 22 bp, Homo sapiens
tccctgggttcccgtggaagtg

SEQ ID NO: 9112315 - DNA, 22 bp, Homo sapiens
tccctgggttcccgtggaagtg

SEQ ID NO: 9112316 - DNA, 22 bp, Homo sapiens
tccctgggtcattctctggcac

SEQ ID NO: 9112317 - DNA, 22 bp, Homo sapiens
tccctgggtcattctctggcac

SEQ ID NO: 9112318 - DNA, 22 bp, Homo sapiens
tccctgggttacctttcaaggt

SEQ ID NO: 9112319 - DNA, 22 bp, Homo sapiens
tccctgggttacctttcaaggt

SEQ ID NO: 9112320 - DNA, 22 bp, Homo sapiens
tccctgggtcctgcttgctctc

SEQ ID NO: 9112321 - DNA, 22 bp, Homo sapiens
tccctgggtcctgcttgctctc

SEQ ID NO: 9112322 - DNA, 22 bp, Homo sapiens
tccctctacagggaagcgcttt

SEQ ID NO: 9112323 - DNA, 22 bp, Homo sapiens
tccctcctttatcaaaaagaga

SEQ ID NO: 9112324 - DNA, 22 bp, Homo sapiens
tccctctccctattgcctggag

SEQ ID NO: 9112325 - DNA, 22 bp, Homo sapiens
catttattctcagatccttgtc

SEQ ID NO: 9112326 - DNA, 22 bp, Homo sapiens
catttattcatgatctgtagct

SEQ ID NO: 9112327 - DNA, 22 bp, Homo sapiens
tcctggctccagcagctcttcc

SEQ ID NO: 9112328 - DNA, 22 bp, Homo sapiens
ccacagaaagttgtctagagta

SEQ ID NO: 9112329 - DNA, 22 bp, Homo sapiens
ccacagaaagttgtctagagta

SEQ ID NO: 9112330 - DNA, 22 bp, Homo sapiens
ccacagaacctcagctttgagc

SEQ ID NO: 9112331 - DNA, 22 bp, Homo sapiens
tcctgggagacccagctgtgga

SEQ ID NO: 9112332 - DNA, 22 bp, Homo sapiens
tcctgggactttcaaggctagg

SEQ ID NO: 9112333 - DNA, 22 bp, Homo sapiens
tcctgggagcacatggtcctgc

SEQ ID NO: 9112334 - DNA, 22 bp, Homo sapiens
tcctgggagcccttgctccacc

SEQ ID NO: 9112335 - DNA, 22 bp, Homo sapiens
tcctgggcttaagtgatcctcc

SEQ ID NO: 9112336 - DNA, 17 bp, Homo sapiens
ccacaccctttccttcc

SEQ ID NO: 9112337 - DNA, 22 bp, Homo sapiens
ccacacagtcagtttccaagaa

SEQ ID NO: 9112338 - DNA, 22 bp, Homo sapiens
ccacactgaacctcagtgtctt

SEQ ID NO: 9112339 - DNA, 22 bp, Homo sapiens
ccacactgaccagctgtgagac

SEQ ID NO: 9112340 - DNA, 22 bp, Homo sapiens
ccacagaaagcctgggaagtgg

SEQ ID NO: 9112341 - DNA, 22 bp, Homo sapiens
ccacagaaaataaagcacgatt

SEQ ID NO: 9112342 - DNA, 22 bp, Homo sapiens
ccacagaaaataaagcacgatt

SEQ ID NO: 9112343 - DNA, 22 bp, Homo sapiens
ccaaggaggccccaggtcagct

SEQ ID NO: 9112344 - DNA, 22 bp, Homo sapiens
ccaaggcaacgttggtgtcagg

SEQ ID NO: 9112345 - DNA, 22 bp, Homo sapiens
ccaaggcaatgtgcagctggtg

SEQ ID NO: 9112346 - DNA, 22 bp, Homo sapiens
ccaaggcagaagatggctcttg

SEQ ID NO: 9112347 - DNA, 22 bp, Homo sapiens
ccaaggagcaaggctcaacaag

SEQ ID NO: 9112348 - DNA, 22 bp, Homo sapiens
ccaaggagaatgacaccatgga

SEQ ID NO: 9112349 - DNA, 22 bp, Homo sapiens
ccaagaggttgaggctgcagtg

SEQ ID NO: 9112350 - DNA, 22 bp, Homo sapiens
tcctaattgcttcatgtgttgt

SEQ ID NO: 9112351 - DNA, 20 bp, Homo sapiens
tcctaataacctgaagaaat

SEQ ID NO: 9112352 - DNA, 22 bp, Homo sapiens
tcctacaatgcacagaatagcc

SEQ ID NO: 9112353 - DNA, 22 bp, Homo sapiens
ccaaggcttcccagagatgctc

SEQ ID NO: 9112354 - DNA, 22 bp, Homo sapiens
ccaagggaaaccgagaggctgg

SEQ ID NO: 9112355 - DNA, 22 bp, Homo sapiens
ccaagggaaggatgtatatgat

SEQ ID NO: 9112356 - DNA, 22 bp, Homo sapiens
ccaaggcttcccagagatgctc

SEQ ID NO: 9112357 - DNA, 22 bp, Homo sapiens
ccaaggcttcccagagatgctc

SEQ ID NO: 9112358 - DNA, 22 bp, Homo sapiens
ccaaggcttcccagagatgctc

SEQ ID NO: 9112359 - DNA, 22 bp, Homo sapiens
tcctggaggagatccaatctga

SEQ ID NO: 9112360 - DNA, 22 bp, Homo sapiens
ccaaggctggagtgcagtggcg

SEQ ID NO: 9112361 - DNA, 22 bp, Homo sapiens
ccaaggctcctcagctggtctt

SEQ ID NO: 9112362 - DNA, 22 bp, Homo sapiens
ccaaggctcctcagctggtctt

SEQ ID NO: 9112363 - DNA, 22 bp, Homo sapiens
ccaaggctcctcagctggtctt

SEQ ID NO: 9112364 - DNA, 22 bp, Homo sapiens
ccagagacaaggagctggagtc

SEQ ID NO: 9112365 - DNA, 22 bp, Homo sapiens
ccagagaagtcttgcctggatt

SEQ ID NO: 9112366 - DNA, 22 bp, Homo sapiens
ccagagaatccggagagtccat

SEQ ID NO: 9112367 - DNA, 22 bp, Homo sapiens
ccagagaattttagacaaaaat

SEQ ID NO: 9112368 - DNA, 22 bp, Homo sapiens
ccagagaaataaggggaaaatg

SEQ ID NO: 9112369 - DNA, 22 bp, Homo sapiens
ccagagaaccatctgcttgagg

SEQ ID NO: 9112370 - DNA, 22 bp, Homo sapiens
ccagagaaccttgagctgtgag

SEQ ID NO: 9112371 - DNA, 22 bp, Homo sapiens
ccagagaagaaaagcacctttt

SEQ ID NO: 9112372 - DNA, 22 bp, Homo sapiens
ccagagaaggtggagcttgtgt

SEQ ID NO: 9112373 - DNA, 22 bp, Homo sapiens
tctaaggtcaggggaaagtttg

SEQ ID NO: 9112374 - DNA, 22 bp, Homo sapiens
tctaataaataaatgctctagg

SEQ ID NO: 9112375 - DNA, 23 bp, Homo sapiens
tctaatacatgaaacctagatgt

SEQ ID NO: 9112376 - DNA, 22 bp, Homo sapiens
tctaatcctatggtggggaggg

SEQ ID NO: 9112377 - DNA, 22 bp, Homo sapiens
tctaatcctatggtggggaggg

SEQ ID NO: 9112378 - DNA, 22 bp, Homo sapiens
tctaatcctatggtggggaggg

SEQ ID NO: 9112379 - DNA, 22 bp, Homo sapiens
ccagacaggggctgttcctgct

SEQ ID NO: 9112380 - DNA, 22 bp, Homo sapiens
ccagacaggggctgttcctgct

SEQ ID NO: 9112381 - DNA, 22 bp, Homo sapiens
tctaatccttgctacctgggtg

SEQ ID NO: 9112382 - DNA, 22 bp, Homo sapiens
ccactgtcagaggggctgtgcc

SEQ ID NO: 9112383 - DNA, 22 bp, Homo sapiens
ccactgtctgcaggcctcagca

SEQ ID NO: 9112384 - DNA, 22 bp, Homo sapiens
ccactgtcagaggggctgtgcc

SEQ ID NO: 9112385 - DNA, 22 bp, Homo sapiens
ccactgtctgcaggcctcagca

SEQ ID NO: 9112386 - DNA, 22 bp, Homo sapiens
ccactgtcttttccaggctgaa

SEQ ID NO: 9112387 - DNA, 22 bp, Homo sapiens
ccactgtcttttccaggctgaa

SEQ ID NO: 9112388 - DNA, 22 bp, Homo sapiens
ccactgtctgtgacatcagaaa

SEQ ID NO: 9112389 - DNA, 22 bp, Homo sapiens
ccactgtcttttccaggctgaa

SEQ ID NO: 9112390 - DNA, 22 bp, Homo sapiens
tctaagacactgtactttcagt

SEQ ID NO: 9112391 - DNA, 22 bp, Homo sapiens
tctaagaggcatcaagacaagc

SEQ ID NO: 9112392 - DNA, 22 bp, Homo sapiens
tctaagaggcatcaagacaagc

SEQ ID NO: 9112393 - DNA, 22 bp, Homo sapiens
tctaagaatactcatatcttct

SEQ ID NO: 9112394 - DNA, 22 bp, Homo sapiens
tctaagaatactcatatcttct

SEQ ID NO: 9112395 - DNA, 22 bp, Homo sapiens
tctaagaaatcagatgatgagg

SEQ ID NO: 9112396 - DNA, 22 bp, Homo sapiens
ccacttcatcagtgctccattt

SEQ ID NO: 9112397 - DNA, 22 bp, Homo sapiens
tcctgggcttgctcctccagct

SEQ ID NO: 9112398 - DNA, 22 bp, Homo sapiens
tcctgggcttgctcctccagct

SEQ ID NO: 9112399 - DNA, 19 bp, Homo sapiens
tcctggggaggggcatggc

SEQ ID NO: 9112400 - DNA, 22 bp, Homo sapiens
tccttcagtcttctgagccata

SEQ ID NO: 9112401 - DNA, 21 bp, Homo sapiens
tccttcagtctagatgattgt

SEQ ID NO: 9112402 - DNA, 17 bp, Homo sapiens
tccttcagtgcctctgc

SEQ ID NO: 9112403 - DNA, 22 bp, Homo sapiens
tccttcagttaaagatctcaca

SEQ ID NO: 9112404 - DNA, 22 bp, Homo sapiens
tccttcagtgtcccgctcaggt

SEQ ID NO: 9112405 - DNA, 22 bp, Homo sapiens
tccttcccaggtgtcgccgcct

SEQ ID NO: 9112406 - DNA, 22 bp, Homo sapiens
tccttccatggtggggctgctt

SEQ ID NO: 9112407 - DNA, 22 bp, Homo sapiens
tccttccaggtccagggatgtg

SEQ ID NO: 9112408 - DNA, 22 bp, Homo sapiens
tccttccaggtccagggatgtg

SEQ ID NO: 9112409 - DNA, 21 bp, Homo sapiens
tccttcagttctgcactttct

SEQ ID NO: 9112410 - DNA, 22 bp, Homo sapiens
tccttcagttcaattagtccgt

SEQ ID NO: 9112411 - DNA, 22 bp, Homo sapiens
tccttcagttatcacagtactg

SEQ ID NO: 9112412 - DNA, 22 bp, Homo sapiens
tccttgtaaaggagctctaaca

SEQ ID NO: 9112413 - DNA, 22 bp, Homo sapiens
tcctttatcaaggagccttaga

SEQ ID NO: 9112414 - DNA, 22 bp, Homo sapiens
ccactgctaacttgctgcagct

SEQ ID NO: 9112415 - DNA, 22 bp, Homo sapiens
tcctttatctgctcagaaagta

SEQ ID NO: 9112416 - DNA, 22 bp, Homo sapiens
tcctttatctgctcagaaagta

SEQ ID NO: 9112417 - DNA, 22 bp, Homo sapiens
tcctttatgtgagttgtttccc

SEQ ID NO: 9112418 - DNA, 22 bp, Homo sapiens
tccttggggacgctgacatcgt

SEQ ID NO: 9112419 - DNA, 22 bp, Homo sapiens
tccttccccctcaagagaactt

SEQ ID NO: 9112420 - DNA, 22 bp, Homo sapiens
catgcagtgactcagacacagg

SEQ ID NO: 9112421 - DNA, 22 bp, Homo sapiens
catgcagtgactcagacacagg

SEQ ID NO: 9112422 - DNA, 22 bp, Homo sapiens
catgcagtattcaggacagttc

SEQ ID NO: 9112423 - DNA, 22 bp, Homo sapiens
catgcaggttatatgtgcttct

SEQ ID NO: 9112424 - DNA, 22 bp, Homo sapiens
catgcagtggtaaaaagtcagg

SEQ ID NO: 9112425 - DNA, 22 bp, Homo sapiens
catgcagttgaagcacagagag

SEQ ID NO: 9112426 - DNA, 22 bp, Homo sapiens
catgaatttatattattagtga

SEQ ID NO: 9112427 - DNA, 22 bp, Homo sapiens
catgaattatttttcacaagat

SEQ ID NO: 9112428 - DNA, 22 bp, Homo sapiens
catgaccccccaaggcctgcag

SEQ ID NO: 9112429 - DNA, 22 bp, Homo sapiens
catgaccctgaccctgtgctcc

SEQ ID NO: 9112430 - DNA, 22 bp, Homo sapiens
catgacagatgcaaaggattgg

SEQ ID NO: 9112431 - DNA, 22 bp, Homo sapiens
catgacatcctgaagctgcaca

SEQ ID NO: 9112432 - DNA, 22 bp, Homo sapiens
catgagaaccaggtctgtgttt

SEQ ID NO: 9112433 - DNA, 22 bp, Homo sapiens
catgagaaccaggtctgtgttt

SEQ ID NO: 9112434 - DNA, 20 bp, Homo sapiens
catgagaagggcagtgtgag

SEQ ID NO: 9112435 - DNA, 22 bp, Homo sapiens
catgagaaggggtggagttaga

SEQ ID NO: 9112436 - DNA, 22 bp, Homo sapiens
catgcacacacgtgcatgtacg

SEQ ID NO: 9112437 - DNA, 22 bp, Homo sapiens
catggcagcaattttcctgact

SEQ ID NO: 9112438 - DNA, 22 bp, Homo sapiens
catggcagcaattttcctgact

SEQ ID NO: 9112439 - DNA, 23 bp, Homo sapiens
catggcagcaagagctcatggcc

SEQ ID NO: 9112440 - DNA, 23 bp, Homo sapiens
catggcagcaagagctcatggcc

SEQ ID NO: 9112441 - DNA, 22 bp, Homo sapiens
catggcagagcctgcaggtggg

SEQ ID NO: 9112442 - DNA, 22 bp, Homo sapiens
catggcagctttgggaggagga

SEQ ID NO: 9112443 - DNA, 22 bp, Homo sapiens
catggcagctttgggaggagga

SEQ ID NO: 9112444 - DNA, 22 bp, Homo sapiens
catggcagctttgggaggagga

SEQ ID NO: 9112445 - DNA, 22 bp, Homo sapiens
catggcaggaaaatgaacaggc

SEQ ID NO: 9112446 - DNA, 22 bp, Homo sapiens
catggcaggaaaatgaacaggc

SEQ ID NO: 9112447 - DNA, 22 bp, Homo sapiens
catgcattacaattgcatagta

SEQ ID NO: 9112448 - DNA, 22 bp, Homo sapiens
catgcattcctcctctgcctta

SEQ ID NO: 9112449 - DNA, 22 bp, Homo sapiens
catgcattcagaatctctcaca

SEQ ID NO: 9112450 - DNA, 22 bp, Homo sapiens
catgcatttggagttttcaagt

SEQ ID NO: 9112451 - DNA, 22 bp, Homo sapiens
catgcatttctaccaaggaata

SEQ ID NO: 9112452 - DNA, 22 bp, Homo sapiens
catgcattgtaatttttagtct

SEQ ID NO: 9112453 - DNA, 22 bp, Homo sapiens
catgcatttggagttttcaagt

SEQ ID NO: 9112454 - DNA, 22 bp, Homo sapiens
catggcagagaaggggaactgg

SEQ ID NO: 9112455 - DNA, 22 bp, Homo sapiens
catggcagtgattcagcctttg

SEQ ID NO: 9112456 - DNA, 22 bp, Homo sapiens
catggcaggtgcagattctgtg

SEQ ID NO: 9112457 - DNA, 22 bp, Homo sapiens
catggcagggctgtgggcaggt

SEQ ID NO: 9112458 - DNA, 22 bp, Homo sapiens
catggcagggctgtgggcaggt

SEQ ID NO: 9112459 - DNA, 22 bp, Homo sapiens
catggcaggatctgggcccaca

SEQ ID NO: 9112460 - DNA, 22 bp, Homo sapiens
catggcaggaggctgctggcag

SEQ ID NO: 9112461 - DNA, 22 bp, Homo sapiens
catggcaggaggctgctggcag

SEQ ID NO: 9112462 - DNA, 22 bp, Homo sapiens
catggcaggaaggacatgcact

SEQ ID NO: 9112463 - DNA, 22 bp, Homo sapiens
catggccaaggatgctcaacca

SEQ ID NO: 9112464 - DNA, 22 bp, Homo sapiens
catggccaaggatgctcaacca

SEQ ID NO: 9112465 - DNA, 22 bp, Homo sapiens
catggccaaggatgctcaacca

SEQ ID NO: 9112466 - DNA, 22 bp, Homo sapiens
catggccaaagaattatatttt

SEQ ID NO: 9112467 - DNA, 22 bp, Homo sapiens
catggccacatctagctgcaag

SEQ ID NO: 9112468 - DNA, 22 bp, Homo sapiens
catggccacatgataatcaagt

SEQ ID NO: 9112469 - DNA, 22 bp, Homo sapiens
catggccagcccccagttcctc

SEQ ID NO: 9112470 - DNA, 22 bp, Homo sapiens
catggccagcccccagttcctc

SEQ ID NO: 9112471 - DNA, 22 bp, Homo sapiens
catggccagattctttcttctc

SEQ ID NO: 9112472 - DNA, 22 bp, Homo sapiens
catggccacattggaccgaagc

SEQ ID NO: 9112473 - DNA, 20 bp, Homo sapiens
tccagctgggaacagctgat

SEQ ID NO: 9112474 - DNA, 22 bp, Homo sapiens
tccaggagaaggccatccagcg

SEQ ID NO: 9112475 - DNA, 22 bp, Homo sapiens
tcagggaggtgtctgccagaga

SEQ ID NO: 9112476 - DNA, 22 bp, Homo sapiens
tcagggagggacctgaggctgg

SEQ ID NO: 9112477 - DNA, 22 bp, Homo sapiens
tcagggagggacctgaggctgg

SEQ ID NO: 9112478 - DNA, 22 bp, Homo sapiens
tcagtgctcaggggagccgagg

SEQ ID NO: 9112479 - DNA, 22 bp, Homo sapiens
tcagtgctcctaaagtgaatgc

SEQ ID NO: 9112480 - DNA, 22 bp, Homo sapiens
tcagtgctaaaagagctggtgt

SEQ ID NO: 9112481 - DNA, 22 bp, Homo sapiens
catctcaggtctgtggttcact

SEQ ID NO: 9112482 - DNA, 22 bp, Homo sapiens
catctattttctgtgaggtatc

SEQ ID NO: 9112483 - DNA, 22 bp, Homo sapiens
tcagtgcattcatgggtggctg

SEQ ID NO: 9112484 - DNA, 21 bp, Homo sapiens
tcagtccctgggtgtgtccca

SEQ ID NO: 9112485 - DNA, 22 bp, Homo sapiens
tcagtgcattctaccaaaaggc

SEQ ID NO: 9112486 - DNA, 22 bp, Homo sapiens
tcagtgcattgttcattgtagg

SEQ ID NO: 9112487 - DNA, 22 bp, Homo sapiens
catgaaaataacattgttgtga

SEQ ID NO: 9112488 - DNA, 22 bp, Homo sapiens
catgaaaataacattgttgtga

SEQ ID NO: 9112489 - DNA, 22 bp, Homo sapiens
catgaaaataacattgttgtga

SEQ ID NO: 9112490 - DNA, 22 bp, Homo sapiens
catcttaaattaaagcttaagg

SEQ ID NO: 9112491 - DNA, 22 bp, Homo sapiens
catcttaaaatgtgtcataact

SEQ ID NO: 9112492 - DNA, 22 bp, Homo sapiens
catctgtttcctaatctgtagc

SEQ ID NO: 9112493 - DNA, 22 bp, Homo sapiens
catctgtctgcatgctctgggt

SEQ ID NO: 9112494 - DNA, 22 bp, Homo sapiens
catgaagatcctgtatgttttt

SEQ ID NO: 9112495 - DNA, 22 bp, Homo sapiens
catgaacagattcttcatttct

SEQ ID NO: 9112496 - DNA, 22 bp, Homo sapiens
catgaacagctaacattttggg

SEQ ID NO: 9112497 - DNA, 22 bp, Homo sapiens
catgaacaccaggcatgaacaa

SEQ ID NO: 9112498 - DNA, 22 bp, Homo sapiens
catgaacaaattctgtttgagg

SEQ ID NO: 9112499 - DNA, 22 bp, Homo sapiens
catctgaagagctttgcaagag

SEQ ID NO: 9112500 - DNA, 22 bp, Homo sapiens
catctgaagtgaattgcttttt

SEQ ID NO: 9112501 - DNA, 22 bp, Homo sapiens
catctgcctaagtggccctgtt

SEQ ID NO: 9112502 - DNA, 22 bp, Homo sapiens
catctgctgctacaaaaagctt

SEQ ID NO: 9112503 - DNA, 22 bp, Homo sapiens
catctgctctgtctgccatgtt

SEQ ID NO: 9112504 - DNA, 22 bp, Homo sapiens
catctgctgacttgacaagtac

SEQ ID NO: 9112505 - DNA, 22 bp, Homo sapiens
catctgggttctcagatggata

SEQ ID NO: 9112506 - DNA, 22 bp, Homo sapiens
catctgtagctccatgacaatt

SEQ ID NO: 9112507 - DNA, 22 bp, Homo sapiens
catctggtttaaaagaagaaag

SEQ ID NO: 9112508 - DNA, 19 bp, Homo sapiens
catctgtaaggacagaaac

SEQ ID NO: 9112509 - DNA, 22 bp, Homo sapiens
catctgctgttccttggactca

SEQ ID NO: 9112510 - DNA, 19 bp, Homo sapiens
catctggatgattctcctg

SEQ ID NO: 9112511 - DNA, 19 bp, Homo sapiens
catctggatgattctcctg

SEQ ID NO: 9112512 - DNA, 18 bp, Homo sapiens
cataattttctttcttta

SEQ ID NO: 9112513 - DNA, 18 bp, Homo sapiens
cataattttctttcttta

SEQ ID NO: 9112514 - DNA, 18 bp, Homo sapiens
cataattttctttcttta

SEQ ID NO: 9112515 - DNA, 22 bp, Homo sapiens
tcaggcagagtggaagctgcaa

SEQ ID NO: 9112516 - DNA, 22 bp, Homo sapiens
tcaggcagagtggaagctgcaa

SEQ ID NO: 9112517 - DNA, 22 bp, Homo sapiens
tcaggcccagagtcacggatcc

SEQ ID NO: 9112518 - DNA, 22 bp, Homo sapiens
tcaggcagagtggaagctgcaa

SEQ ID NO: 9112519 - DNA, 22 bp, Homo sapiens
cataattactgatatgctgatt

SEQ ID NO: 9112520 - DNA, 22 bp, Homo sapiens
cataatgttgtaacacatagag

SEQ ID NO: 9112521 - DNA, 22 bp, Homo sapiens
cataattaggcagttgatcatt

SEQ ID NO: 9112522 - DNA, 22 bp, Homo sapiens
tcagcaggtctgaggcggggcc

SEQ ID NO: 9112523 - DNA, 22 bp, Homo sapiens
tcagcagggtttgacttctaat

SEQ ID NO: 9112524 - DNA, 22 bp, Homo sapiens
tcagcaggtggtgggcaggtga

SEQ ID NO: 9112525 - DNA, 22 bp, Homo sapiens
tcagcagtagagggggcacagt

SEQ ID NO: 9112526 - DNA, 17 bp, Homo sapiens
tcagcagtaatggtggg

SEQ ID NO: 9112527 - DNA, 22 bp, Homo sapiens
tcagcaggtgcctcagattctt

SEQ ID NO: 9112528 - DNA, 22 bp, Homo sapiens
cataatcagatgtgtacataag

SEQ ID NO: 9112529 - DNA, 22 bp, Homo sapiens
cataatgaacattagctactgt

SEQ ID NO: 9112530 - DNA, 22 bp, Homo sapiens
cataatgtctgacacagtaaga

SEQ ID NO: 9112531 - DNA, 22 bp, Homo sapiens
tcagcagtcctccaggatcaag

SEQ ID NO: 9112532 - DNA, 22 bp, Homo sapiens
catagaaacttgcagcaagcac

SEQ ID NO: 9112533 - DNA, 22 bp, Homo sapiens
catagaaagtattatggaattt

SEQ ID NO: 9112534 - DNA, 22 bp, Homo sapiens
catagaaagtattatggaattt

SEQ ID NO: 9112535 - DNA, 22 bp, Homo sapiens
catagaaatcaggtgagaatct

SEQ ID NO: 9112536 - DNA, 22 bp, Homo sapiens
catagaaatcaggtgagaatct

SEQ ID NO: 9112537 - DNA, 22 bp, Homo sapiens
catagaaaagagtaggtaatgt

SEQ ID NO: 9112538 - DNA, 22 bp, Homo sapiens
tcaggcctgagaaaaatccttt

SEQ ID NO: 9112539 - DNA, 22 bp, Homo sapiens
catagaaactgagacaaggatt

SEQ ID NO: 9112540 - DNA, 22 bp, Homo sapiens
catagaaactgagacaaggatt

SEQ ID NO: 9112541 - DNA, 22 bp, Homo sapiens
tcaggcctccaggttaccattt

SEQ ID NO: 9112542 - DNA, 22 bp, Homo sapiens
tcaggcctccaggttaccattt

SEQ ID NO: 9112543 - DNA, 22 bp, Homo sapiens
tcaggcctcagcagcccacagg

SEQ ID NO: 9112544 - DNA, 22 bp, Homo sapiens
tcaggcctccaggttaccattt

SEQ ID NO: 9112545 - DNA, 22 bp, Homo sapiens
tcaggcctcagcagcccacagg

SEQ ID NO: 9112546 - DNA, 22 bp, Homo sapiens
tcaggcctcaagctgctttaag

SEQ ID NO: 9112547 - DNA, 22 bp, Homo sapiens
tcaggcctcaagctgctttaag

SEQ ID NO: 9112548 - DNA, 22 bp, Homo sapiens
tcaggcctagggagccacacca

SEQ ID NO: 9112549 - DNA, 22 bp, Homo sapiens
tcaggcctcagaaattgcactg

SEQ ID NO: 9112550 - DNA, 22 bp, Homo sapiens
tcaggcctcagaaattgcactg

SEQ ID NO: 9112551 - DNA, 22 bp, Homo sapiens
tcaggcctagggagaaaattca

SEQ ID NO: 9112552 - DNA, 22 bp, Homo sapiens
tcaggcctagggagccacacca

SEQ ID NO: 9112553 - DNA, 22 bp, Homo sapiens
tcaggcctagaacacagcagat

SEQ ID NO: 9112554 - DNA, 22 bp, Homo sapiens
tcaggccccttgtcagctctgt

SEQ ID NO: 9112555 - DNA, 22 bp, Homo sapiens
tcaggccccatcccagacttat

SEQ ID NO: 9112556 - DNA, 22 bp, Homo sapiens
tcaggcccagagtcacggatcc

SEQ ID NO: 9112557 - DNA, 22 bp, Homo sapiens
tcaggccccatcccagacttat

SEQ ID NO: 9112558 - DNA, 22 bp, Homo sapiens
tcaggccccttgtcagctctgt

SEQ ID NO: 9112559 - DNA, 22 bp, Homo sapiens
tcaggcccttctcccaggactc

SEQ ID NO: 9112560 - DNA, 22 bp, Homo sapiens
catagaaatcaggtgagaatct

SEQ ID NO: 9112561 - DNA, 22 bp, Homo sapiens
catagaatatgtgtgattgtta

SEQ ID NO: 9112562 - DNA, 21 bp, Homo sapiens
tcaggctgtctgctggttcca

SEQ ID NO: 9112563 - DNA, 17 bp, Homo sapiens
tcaggctgtgcctggta

SEQ ID NO: 9112564 - DNA, 17 bp, Homo sapiens
tcaggctgtgcctggta

SEQ ID NO: 9112565 - DNA, 22 bp, Homo sapiens
tcaggctgtgggcactggccat

SEQ ID NO: 9112566 - DNA, 22 bp, Homo sapiens
tcaggctgtgggcactggccat

SEQ ID NO: 9112567 - DNA, 22 bp, Homo sapiens
tcaggctgtggcttcagttctt

SEQ ID NO: 9112568 - DNA, 22 bp, Homo sapiens
tcaggctgtggctttgaccgca

SEQ ID NO: 9112569 - DNA, 22 bp, Homo sapiens
tcagggagaggtgagagcctgt

SEQ ID NO: 9112570 - DNA, 22 bp, Homo sapiens
tcagggagaggtgagagcctgt

SEQ ID NO: 9112571 - DNA, 22 bp, Homo sapiens
tcaggctgtgtctttaaacaat

SEQ ID NO: 9112572 - DNA, 22 bp, Homo sapiens
tcaggctgttagccacctcctc

SEQ ID NO: 9112573 - DNA, 22 bp, Homo sapiens
tcaggctgttagccacctcctc

SEQ ID NO: 9112574 - DNA, 18 bp, Homo sapiens
tcagaggagatacctaaa

SEQ ID NO: 9112575 - DNA, 18 bp, Homo sapiens
tcagaggagatacctaaa

SEQ ID NO: 9112576 - DNA, 18 bp, Homo sapiens
tcagaggagatacctaaa

SEQ ID NO: 9112577 - DNA, 22 bp, Homo sapiens
tcagaggagatggttaccaggg

SEQ ID NO: 9112578 - DNA, 22 bp, Homo sapiens
tcagaggagcaaaagaggggat

SEQ ID NO: 9112579 - DNA, 22 bp, Homo sapiens
tcagaggagcaaaagaggggat

SEQ ID NO: 9112580 - DNA, 22 bp, Homo sapiens
tcagaggagccaaagttctgag

SEQ ID NO: 9112581 - DNA, 22 bp, Homo sapiens
tcagaggagcaaaagaggggat

SEQ ID NO: 9112582 - DNA, 22 bp, Homo sapiens
tcagaggaggcatttaaacaga

SEQ ID NO: 9112583 - DNA, 22 bp, Homo sapiens
tcagaggagctgcagaacgctg

SEQ ID NO: 9112584 - DNA, 22 bp, Homo sapiens
tcagaggagggactcagaccca

SEQ ID NO: 9112585 - DNA, 22 bp, Homo sapiens
tcagaggagctgcagaacgctg

SEQ ID NO: 9112586 - DNA, 22 bp, Homo sapiens
tcagaggaggcatttaaacaga

SEQ ID NO: 9112587 - DNA, 22 bp, Homo sapiens
tcagaggatcatgtccctactc

SEQ ID NO: 9112588 - DNA, 22 bp, Homo sapiens
tcagaggatcatgtccctactc

SEQ ID NO: 9112589 - DNA, 22 bp, Homo sapiens
tcagaggatagaaatacttatt

SEQ ID NO: 9112590 - DNA, 22 bp, Homo sapiens
tcagaggatagaaatacttatt

SEQ ID NO: 9112591 - DNA, 22 bp, Homo sapiens
tcagatactagctctcagcctc

SEQ ID NO: 9112592 - DNA, 22 bp, Homo sapiens
tcagaggatgctgttctttaat

SEQ ID NO: 9112593 - DNA, 22 bp, Homo sapiens
tcagagttggcctttctgtatt

SEQ ID NO: 9112594 - DNA, 22 bp, Homo sapiens
tcagagttggcctttctgtatt

SEQ ID NO: 9112595 - DNA, 22 bp, Homo sapiens
tcagagtttcaggatacaaata

SEQ ID NO: 9112596 - DNA, 22 bp, Homo sapiens
tcagagtttctgatttagtagg

SEQ ID NO: 9112597 - DNA, 22 bp, Homo sapiens
cagtttttagattagttggtgg

SEQ ID NO: 9112598 - DNA, 22 bp, Homo sapiens
cagttttggtcctttctaggta

SEQ ID NO: 9112599 - DNA, 22 bp, Homo sapiens
cagttttggtcctttctaggta

SEQ ID NO: 9112600 - DNA, 22 bp, Homo sapiens
cagtttgtgctaggcactattt

SEQ ID NO: 9112601 - DNA, 22 bp, Homo sapiens
tcagatctggtgaagttatagt

SEQ ID NO: 9112602 - DNA, 22 bp, Homo sapiens
cagtttgtcttgattcagaaca

SEQ ID NO: 9112603 - DNA, 22 bp, Homo sapiens
tcagatattctctaagaacaat

SEQ ID NO: 9112604 - DNA, 22 bp, Homo sapiens
cagtttttgccattaagagtaa

SEQ ID NO: 9112605 - DNA, 22 bp, Homo sapiens
cagtttttcaaaattacatgat

SEQ ID NO: 9112606 - DNA, 23 bp, Homo sapiens
cataaaatattagtatggtagca

SEQ ID NO: 9112607 - DNA, 23 bp, Homo sapiens
cataaaatattagtatggtagca

SEQ ID NO: 9112608 - DNA, 22 bp, Homo sapiens
cagttcttatttggccagtgtc

SEQ ID NO: 9112609 - DNA, 22 bp, Homo sapiens
cagttcttaataccatgtggtt

SEQ ID NO: 9112610 - DNA, 22 bp, Homo sapiens
cagttctggtttgcagatatat

SEQ ID NO: 9112611 - DNA, 22 bp, Homo sapiens
cagttagtaaagcttgttcatg

SEQ ID NO: 9112612 - DNA, 22 bp, Homo sapiens
cagttgagtctgctagctagga

SEQ ID NO: 9112613 - DNA, 22 bp, Homo sapiens
tcaatcacgtgttccatgttct

SEQ ID NO: 9112614 - DNA, 22 bp, Homo sapiens
tcaatcattcttgccatttatt

SEQ ID NO: 9112615 - DNA, 22 bp, Homo sapiens
tcaatcatagtccttctctaga

SEQ ID NO: 9112616 - DNA, 22 bp, Homo sapiens
tcaatcacgtgttccatgttct

SEQ ID NO: 9112617 - DNA, 22 bp, Homo sapiens
tcaatcaatgtgtcagttccca

SEQ ID NO: 9112618 - DNA, 22 bp, Homo sapiens
tcaatcaatgtgtcagttccca

SEQ ID NO: 9112619 - DNA, 22 bp, Homo sapiens
tcaatcaaagccagatgtcctt

SEQ ID NO: 9112620 - DNA, 22 bp, Homo sapiens
tcaatcaaagcactgggctttg

SEQ ID NO: 9112621 - DNA, 22 bp, Homo sapiens
tcaatcaatggtttccaaattt

SEQ ID NO: 9112622 - DNA, 22 bp, Homo sapiens
tcaatcaaagccagatgtcctt

SEQ ID NO: 9112623 - DNA, 22 bp, Homo sapiens
tcaatcaatggtttccaaattt

SEQ ID NO: 9112624 - DNA, 22 bp, Homo sapiens
tcaatatagcagtgtacttgag

SEQ ID NO: 9112625 - DNA, 22 bp, Homo sapiens
tcaatagctcagtgtggaagct

SEQ ID NO: 9112626 - DNA, 22 bp, Homo sapiens
tcaatagcatagcaattaatgt

SEQ ID NO: 9112627 - DNA, 22 bp, Homo sapiens
tcaatagcaatcaagccttcca

SEQ ID NO: 9112628 - DNA, 22 bp, Homo sapiens
tcaatagattaggtattagatt

SEQ ID NO: 9112629 - DNA, 22 bp, Homo sapiens
tcaatatattccatgttttctc

SEQ ID NO: 9112630 - DNA, 22 bp, Homo sapiens
tcaatattcttctttagtagga

SEQ ID NO: 9112631 - DNA, 22 bp, Homo sapiens
tcaatatattccatgttttctc

SEQ ID NO: 9112632 - DNA, 22 bp, Homo sapiens
tcagagaggttggtgataagaa

SEQ ID NO: 9112633 - DNA, 22 bp, Homo sapiens
tcagagagtgcaaaatatagct

SEQ ID NO: 9112634 - DNA, 21 bp, Homo sapiens
tcagagagtcacagtgaactg

SEQ ID NO: 9112635 - DNA, 22 bp, Homo sapiens
tcagagagttttcactagggtg

SEQ ID NO: 9112636 - DNA, 22 bp, Homo sapiens
tcagagagttttcactagggtg

SEQ ID NO: 9112637 - DNA, 22 bp, Homo sapiens
tcagagagttagtgtcttagct

SEQ ID NO: 9112638 - DNA, 22 bp, Homo sapiens
tcagagagttagtgtcttagct

SEQ ID NO: 9112639 - DNA, 22 bp, Homo sapiens
tcagagcaaattcctgtgagcc

SEQ ID NO: 9112640 - DNA, 23 bp, Homo sapiens
tcagagcaaagggtgcctccgtt

SEQ ID NO: 9112641 - DNA, 17 bp, Homo sapiens
cagggctgtctgcctag

SEQ ID NO: 9112642 - DNA, 22 bp, Homo sapiens
cagggctgtgcccatcttcccc

SEQ ID NO: 9112643 - DNA, 22 bp, Homo sapiens
caggggcctgtcctggcttctg

SEQ ID NO: 9112644 - DNA, 22 bp, Homo sapiens
cagggggctcaaaggagagtgc

SEQ ID NO: 9112645 - DNA, 22 bp, Homo sapiens
caggggctgtttgcctcaggcc

SEQ ID NO: 9112646 - DNA, 22 bp, Homo sapiens
caggggcctgtcctggcttctg

SEQ ID NO: 9112647 - DNA, 22 bp, Homo sapiens
cagggtccatctttcatcactg

SEQ ID NO: 9112648 - DNA, 22 bp, Homo sapiens
cagggtcatggcacctgcacgg

SEQ ID NO: 9112649 - DNA, 22 bp, Homo sapiens
cagggtccatctttcatcactg

SEQ ID NO: 9112650 - DNA, 22 bp, Homo sapiens
cagggtcaggctgctagaagct

SEQ ID NO: 9112651 - DNA, 22 bp, Homo sapiens
cagggtcaccagagatctgcat

SEQ ID NO: 9112652 - DNA, 22 bp, Homo sapiens
cagggtcaggaggatctggctt

SEQ ID NO: 9112653 - DNA, 22 bp, Homo sapiens
cagggtcaggaggatctggctt

SEQ ID NO: 9112654 - DNA, 22 bp, Homo sapiens
cagggtccggctgcctggctgt

SEQ ID NO: 9112655 - DNA, 22 bp, Homo sapiens
cagggtccggctgcctggctgt

SEQ ID NO: 9112656 - DNA, 22 bp, Homo sapiens
cagggtcaggctgctagaagct

SEQ ID NO: 9112657 - DNA, 22 bp, Homo sapiens
cagggtccccgggtctcctgtg

SEQ ID NO: 9112658 - DNA, 22 bp, Homo sapiens
cagggtcccaggagctgctttc

SEQ ID NO: 9112659 - DNA, 22 bp, Homo sapiens
cagggtagacagtaggtgtctg

SEQ ID NO: 9112660 - DNA, 22 bp, Homo sapiens
caggggtggctgcagcagaggt

SEQ ID NO: 9112661 - DNA, 22 bp, Homo sapiens
cagggggtggtccaggctgcgc

SEQ ID NO: 9112662 - DNA, 22 bp, Homo sapiens
cagggctggtttgtcgaagaaa

SEQ ID NO: 9112663 - DNA, 22 bp, Homo sapiens
cagggctgtaaattagtgctga

SEQ ID NO: 9112664 - DNA, 22 bp, Homo sapiens
taggctttgtgttttgggaaca

SEQ ID NO: 9112665 - DNA, 22 bp, Homo sapiens
taggcttgcttctcctccacag

SEQ ID NO: 9112666 - DNA, 22 bp, Homo sapiens
cagggctggatttcatttctag

SEQ ID NO: 9112667 - DNA, 22 bp, Homo sapiens
taggctgggcctgccttccagg

SEQ ID NO: 9112668 - DNA, 18 bp, Homo sapiens
taggctgggggctgtagt

SEQ ID NO: 9112669 - DNA, 22 bp, Homo sapiens
taggctgggggtaggaattgag

SEQ ID NO: 9112670 - DNA, 22 bp, Homo sapiens
taggctgtaagagagggcagag

SEQ ID NO: 9112671 - DNA, 22 bp, Homo sapiens
taggctgggctgagctggacgg

SEQ ID NO: 9112672 - DNA, 22 bp, Homo sapiens
cagggctcttccggagcaggga

SEQ ID NO: 9112673 - DNA, 22 bp, Homo sapiens
cagggctcttccggagcaggga

SEQ ID NO: 9112674 - DNA, 22 bp, Homo sapiens
cagggctgaactgagcttgtga

SEQ ID NO: 9112675 - DNA, 22 bp, Homo sapiens
cagggctccatgcagggactcc

SEQ ID NO: 9112676 - DNA, 22 bp, Homo sapiens
cagggctccatgcagggactcc

SEQ ID NO: 9112677 - DNA, 22 bp, Homo sapiens
cagggcctcatcctcagagatt

SEQ ID NO: 9112678 - DNA, 22 bp, Homo sapiens
cagggcccatggctcaggtagg

SEQ ID NO: 9112679 - DNA, 22 bp, Homo sapiens
cagggcccatggctcaggtagg

SEQ ID NO: 9112680 - DNA, 22 bp, Homo sapiens
taggccaagttgatcagacatc

SEQ ID NO: 9112681 - DNA, 22 bp, Homo sapiens
cagggcccaggccactgggttg

SEQ ID NO: 9112682 - DNA, 22 bp, Homo sapiens
cagggcccagtccctgctgtca

SEQ ID NO: 9112683 - DNA, 22 bp, Homo sapiens
tagcttcttgagaaagggtgcc

SEQ ID NO: 9112684 - DNA, 22 bp, Homo sapiens
tagcttggaataaaatgagaat

SEQ ID NO: 9112685 - DNA, 22 bp, Homo sapiens
tagcttccctgctggatcataa

SEQ ID NO: 9112686 - DNA, 22 bp, Homo sapiens
tagcttctaatacttaccaatt

SEQ ID NO: 9112687 - DNA, 21 bp, Homo sapiens
tagcttccagctcaagctgag

SEQ ID NO: 9112688 - DNA, 22 bp, Homo sapiens
tagcttccctagctaaagaggt

SEQ ID NO: 9112689 - DNA, 22 bp, Homo sapiens
tagcttatcccacagtgcccag

SEQ ID NO: 9112690 - DNA, 22 bp, Homo sapiens
tagcttcagtggccctagacac

SEQ ID NO: 9112691 - DNA, 22 bp, Homo sapiens
taggcatgcaaataaatgtgca

SEQ ID NO: 9112692 - DNA, 22 bp, Homo sapiens
taggcagtgctctgtgcttcag

SEQ ID NO: 9112693 - DNA, 22 bp, Homo sapiens
taggcagtagcttgagatataa

SEQ ID NO: 9112694 - DNA, 22 bp, Homo sapiens
taggcagtagcaggatctgcca

SEQ ID NO: 9112695 - DNA, 22 bp, Homo sapiens
taggcagtagcaggatctgcca

SEQ ID NO: 9112696 - DNA, 22 bp, Homo sapiens
taggcatgtgtttgccatagcc

SEQ ID NO: 9112697 - DNA, 22 bp, Homo sapiens
taggccaaatgacttgatgttt

SEQ ID NO: 9112698 - DNA, 22 bp, Homo sapiens
taggaggccatccagcctgcct

SEQ ID NO: 9112699 - DNA, 22 bp, Homo sapiens
taggcaggtgtgcactgcccac

SEQ ID NO: 9112700 - DNA, 22 bp, Homo sapiens
taggcaggtgtgcactgcccac

SEQ ID NO: 9112701 - DNA, 22 bp, Homo sapiens
taggcagggattagggttgatt

SEQ ID NO: 9112702 - DNA, 22 bp, Homo sapiens
cagggagccccaattccatgcc

SEQ ID NO: 9112703 - DNA, 22 bp, Homo sapiens
cagggagcaggctctgtccatc

SEQ ID NO: 9112704 - DNA, 22 bp, Homo sapiens
cagggagccccaattccatgcc

SEQ ID NO: 9112705 - DNA, 22 bp, Homo sapiens
cagggccagttctcgcagcagt

SEQ ID NO: 9112706 - DNA, 22 bp, Homo sapiens
tagcttaaggagtaccagatca

SEQ ID NO: 9112707 - DNA, 22 bp, Homo sapiens
cagggccattggaacaaagagg

SEQ ID NO: 9112708 - DNA, 22 bp, Homo sapiens
cagggagcaggctctgtccatc

SEQ ID NO: 9112709 - DNA, 22 bp, Homo sapiens
cagggagcagcgctggggcctc

SEQ ID NO: 9112710 - DNA, 22 bp, Homo sapiens
cagggagcagcccctagaagta

SEQ ID NO: 9112711 - DNA, 22 bp, Homo sapiens
cagggagcagcccctagaagta

SEQ ID NO: 9112712 - DNA, 22 bp, Homo sapiens
cagggagcactgcgagcggcag

SEQ ID NO: 9112713 - DNA, 22 bp, Homo sapiens
cagggagatcttggctcctggt

SEQ ID NO: 9112714 - DNA, 22 bp, Homo sapiens
tagattctttgctagatcattg

SEQ ID NO: 9112715 - DNA, 22 bp, Homo sapiens
tagattgattgcaaagacaggc

SEQ ID NO: 9112716 - DNA, 22 bp, Homo sapiens
tagatttaagaccctgaatttg

SEQ ID NO: 9112717 - DNA, 22 bp, Homo sapiens
tagatttgatgtaagcatagtc

SEQ ID NO: 9112718 - DNA, 22 bp, Homo sapiens
tagatttgatgtaagcatagtc

SEQ ID NO: 9112719 - DNA, 22 bp, Homo sapiens
tagatttgcctgggaaagctca

SEQ ID NO: 9112720 - DNA, 22 bp, Homo sapiens
tagatttgtgcaagaagggatt

SEQ ID NO: 9112721 - DNA, 22 bp, Homo sapiens
tagatttgtgtttgggatgaga

SEQ ID NO: 9112722 - DNA, 22 bp, Homo sapiens
caggtggccagtactcaaggat

SEQ ID NO: 9112723 - DNA, 22 bp, Homo sapiens
caggtggccttgccatctcctg

SEQ ID NO: 9112724 - DNA, 22 bp, Homo sapiens
caggtggccttgccatctcctg

SEQ ID NO: 9112725 - DNA, 22 bp, Homo sapiens
tattaaatgttatttgggttgt

SEQ ID NO: 9112726 - DNA, 18 bp, Homo sapiens
caggtgggtctcctgccc

SEQ ID NO: 9112727 - DNA, 22 bp, Homo sapiens
tattatggttgtaggttaacaa

SEQ ID NO: 9112728 - DNA, 22 bp, Homo sapiens
tattatggcagcattcagtatg

SEQ ID NO: 9112729 - DNA, 22 bp, Homo sapiens
tattatggggggaacatcactc

SEQ ID NO: 9112730 - DNA, 22 bp, Homo sapiens
tattatgtagagtaagggttaa

SEQ ID NO: 9112731 - DNA, 22 bp, Homo sapiens
tattatctagtaactgatagtg

SEQ ID NO: 9112732 - DNA, 22 bp, Homo sapiens
tattagttgcaaaacattgact

SEQ ID NO: 9112733 - DNA, 22 bp, Homo sapiens
cagggtttctgttgagaagtcc

SEQ ID NO: 9112734 - DNA, 22 bp, Homo sapiens
caggtagctgcagagactattt

SEQ ID NO: 9112735 - DNA, 22 bp, Homo sapiens
caggtagcttttgatattaggg

SEQ ID NO: 9112736 - DNA, 22 bp, Homo sapiens
caggtagctgctggccatgtac

SEQ ID NO: 9112737 - DNA, 22 bp, Homo sapiens
caggtcagaggtagatgagatg

SEQ ID NO: 9112738 - DNA, 22 bp, Homo sapiens
caggtcagaggcgcagccccca

SEQ ID NO: 9112739 - DNA, 22 bp, Homo sapiens
caggtcagaggcgcagccccca

SEQ ID NO: 9112740 - DNA, 22 bp, Homo sapiens
caggtatgaggacactgacagc

SEQ ID NO: 9112741 - DNA, 22 bp, Homo sapiens
caggtgctgcgtggcggagctg

SEQ ID NO: 9112742 - DNA, 22 bp, Homo sapiens
caggtgctgcagggctggcgtc

SEQ ID NO: 9112743 - DNA, 22 bp, Homo sapiens
caggtgcccagctcctgctgtg

SEQ ID NO: 9112744 - DNA, 22 bp, Homo sapiens
caggtgccgggaatgcagcaat

SEQ ID NO: 9112745 - DNA, 22 bp, Homo sapiens
caggtgcctcaggatgagacaa

SEQ ID NO: 9112746 - DNA, 22 bp, Homo sapiens
caggtgaagaggataaaaagtt

SEQ ID NO: 9112747 - DNA, 18 bp, Homo sapiens
caggtcagcctggcctca

SEQ ID NO: 9112748 - DNA, 18 bp, Homo sapiens
caggtcagcctggcctca

SEQ ID NO: 9112749 - DNA, 22 bp, Homo sapiens
caggtgggtgtatgaatgcaaa

SEQ ID NO: 9112750 - DNA, 22 bp, Homo sapiens
cagtatatgctctttcatcaaa

SEQ ID NO: 9112751 - DNA, 19 bp, Homo sapiens
caggtggtaatctgagcct

SEQ ID NO: 9112752 - DNA, 19 bp, Homo sapiens
caggtggtaatctgagcct

SEQ ID NO: 9112753 - DNA, 22 bp, Homo sapiens
cagtatctccacatgtaaagtg

SEQ ID NO: 9112754 - DNA, 22 bp, Homo sapiens
cagtcaacagagagcccgtcag

SEQ ID NO: 9112755 - DNA, 22 bp, Homo sapiens
cagtcaaacttataggcacatt

SEQ ID NO: 9112756 - DNA, 22 bp, Homo sapiens
cagtcaccttgaggactcagac

SEQ ID NO: 9112757 - DNA, 22 bp, Homo sapiens
cagtcagggacaccagctagga

SEQ ID NO: 9112758 - DNA, 22 bp, Homo sapiens
cagtcagaaggaagatgcttaa

SEQ ID NO: 9112759 - DNA, 22 bp, Homo sapiens
cagtcagaggtcttctaaaaca

SEQ ID NO: 9112760 - DNA, 22 bp, Homo sapiens
cagtcagagtcacagtaatttg

SEQ ID NO: 9112761 - DNA, 22 bp, Homo sapiens
tattttacagactactttagat

SEQ ID NO: 9112762 - DNA, 22 bp, Homo sapiens
tattttacaaatgggaatgctg

SEQ ID NO: 9112763 - DNA, 22 bp, Homo sapiens
tattttacagactactttagat

SEQ ID NO: 9112764 - DNA, 22 bp, Homo sapiens
tattttacagactactttagat

SEQ ID NO: 9112765 - DNA, 22 bp, Homo sapiens
tattttacagactactttagat

SEQ ID NO: 9112766 - DNA, 22 bp, Homo sapiens
tattttaaagtgaagggtcttg

SEQ ID NO: 9112767 - DNA, 22 bp, Homo sapiens
tcaaaaatgttttatattggta

SEQ ID NO: 9112768 - DNA, 22 bp, Homo sapiens
tattttacatgacaggtgttta

SEQ ID NO: 9112769 - DNA, 22 bp, Homo sapiens
tattttactatttggcaaagtc

SEQ ID NO: 9112770 - DNA, 22 bp, Homo sapiens
tattttactatttggcaaagtc

SEQ ID NO: 9112771 - DNA, 22 bp, Homo sapiens
tattttacatgatccagagttg

SEQ ID NO: 9112772 - DNA, 22 bp, Homo sapiens
tattttactttaaagcgagaga

SEQ ID NO: 9112773 - DNA, 22 bp, Homo sapiens
tcaaaacactattacctttaat

SEQ ID NO: 9112774 - DNA, 19 bp, Homo sapiens
tcaaaacacaaatggttga

SEQ ID NO: 9112775 - DNA, 22 bp, Homo sapiens
tcaaaacaatcattggatgtgc

SEQ ID NO: 9112776 - DNA, 22 bp, Homo sapiens
tcaaaacaacactcaggtgtaa

SEQ ID NO: 9112777 - DNA, 22 bp, Homo sapiens
tcaaaacaatcattggatgtgc

SEQ ID NO: 9112778 - DNA, 22 bp, Homo sapiens
tcaaaacaacactcaggtgtaa

SEQ ID NO: 9112779 - DNA, 22 bp, Homo sapiens
tcaagatgaaagatgtagccat

SEQ ID NO: 9112780 - DNA, 22 bp, Homo sapiens
tcaagatgaaccaggacattca

SEQ ID NO: 9112781 - DNA, 19 bp, Homo sapiens
tcaagatggatggctccca

SEQ ID NO: 9112782 - DNA, 22 bp, Homo sapiens
tcaagatgattgcttcaggccc

SEQ ID NO: 9112783 - DNA, 22 bp, Homo sapiens
tcaagatgcatgggtggcataa

SEQ ID NO: 9112784 - DNA, 20 bp, Homo sapiens
tcaagatgaggtcatactgg

SEQ ID NO: 9112785 - DNA, 22 bp, Homo sapiens
tcaaaacccagccatcaggact

SEQ ID NO: 9112786 - DNA, 22 bp, Homo sapiens
tcaacaaatacttaaagcagag

SEQ ID NO: 9112787 - DNA, 22 bp, Homo sapiens
tcaagcaagttgcatattgcta

SEQ ID NO: 9112788 - DNA, 22 bp, Homo sapiens
tcaagcaagtgtttggtgtaaa

SEQ ID NO: 9112789 - DNA, 22 bp, Homo sapiens
tcaagcaaagtttagctggtta

SEQ ID NO: 9112790 - DNA, 22 bp, Homo sapiens
tcaagcaaagatacaaatggaa

SEQ ID NO: 9112791 - DNA, 22 bp, Homo sapiens
tcaagatgtccagtgcctataa

SEQ ID NO: 9112792 - DNA, 22 bp, Homo sapiens
tcaagatgtgatgtaacttttg

SEQ ID NO: 9112793 - DNA, 22 bp, Homo sapiens
tcaagcagggtagcaagctggt

SEQ ID NO: 9112794 - DNA, 22 bp, Homo sapiens
tcaagcggactgagatactctg

SEQ ID NO: 9112795 - DNA, 22 bp, Homo sapiens
tcaagctacaaccatattcatt

SEQ ID NO: 9112796 - DNA, 22 bp, Homo sapiens
tcaatagataaagctacataaa

SEQ ID NO: 9112797 - DNA, 22 bp, Homo sapiens
tcaatagagccttctttcaggt

SEQ ID NO: 9112798 - DNA, 22 bp, Homo sapiens
tcaatagaaatgcagagtctca

SEQ ID NO: 9112799 - DNA, 22 bp, Homo sapiens
tcaatagaaatgcagagtctca

SEQ ID NO: 9112800 - DNA, 22 bp, Homo sapiens
taatgtatttgttcagaagagt

SEQ ID NO: 9112801 - DNA, 22 bp, Homo sapiens
taatgtataacaaatactcatc

SEQ ID NO: 9112802 - DNA, 22 bp, Homo sapiens
taatgtataacaaatactcatc

SEQ ID NO: 9112803 - DNA, 22 bp, Homo sapiens
taatatgggcagtctgaatata

SEQ ID NO: 9112804 - DNA, 22 bp, Homo sapiens
taatatgtgttactgacttttt

SEQ ID NO: 9112805 - DNA, 22 bp, Homo sapiens
taatatttctaccctgctgcct

SEQ ID NO: 9112806 - DNA, 22 bp, Homo sapiens
taatatctggcattcaaacatg

SEQ ID NO: 9112807 - DNA, 22 bp, Homo sapiens
taatacagaagtgtattaaaat

SEQ ID NO: 9112808 - DNA, 22 bp, Homo sapiens
taatacagacaacttgccaaat

SEQ ID NO: 9112809 - DNA, 22 bp, Homo sapiens
taatacagacaacttgccaaat

SEQ ID NO: 9112810 - DNA, 22 bp, Homo sapiens
taatatctacttcatagagttt

SEQ ID NO: 9112811 - DNA, 22 bp, Homo sapiens
taatcacaattcagatgtctta

SEQ ID NO: 9112812 - DNA, 22 bp, Homo sapiens
taatatttctaccctgctgcct

SEQ ID NO: 9112813 - DNA, 22 bp, Homo sapiens
taatgtcttcttttaatttggc

SEQ ID NO: 9112814 - DNA, 22 bp, Homo sapiens
taatgtctatgggccagataat

SEQ ID NO: 9112815 - DNA, 20 bp, Homo sapiens
taatgtcaaagtcacaaggt

SEQ ID NO: 9112816 - DNA, 22 bp, Homo sapiens
caggcatgcttctgtctgggca

SEQ ID NO: 9112817 - DNA, 22 bp, Homo sapiens
caggcatgagccaggcccctcc

SEQ ID NO: 9112818 - DNA, 22 bp, Homo sapiens
caggcatgagccaggcccctcc

SEQ ID NO: 9112819 - DNA, 22 bp, Homo sapiens
caggcatgagccaggcccctcc

SEQ ID NO: 9112820 - DNA, 22 bp, Homo sapiens
caggcatgatcataggagttta

SEQ ID NO: 9112821 - DNA, 22 bp, Homo sapiens
caggcatggagaggcagagact

SEQ ID NO: 9112822 - DNA, 22 bp, Homo sapiens
caggcatggagaggcagagact

SEQ ID NO: 9112823 - DNA, 22 bp, Homo sapiens
caggccagggttgagaagagaa

SEQ ID NO: 9112824 - DNA, 22 bp, Homo sapiens
caggccagtgggaaatagggat

SEQ ID NO: 9112825 - DNA, 22 bp, Homo sapiens
caggcccaagactgatgagtct

SEQ ID NO: 9112826 - DNA, 22 bp, Homo sapiens
caggccagtgtgcttcccaggc

SEQ ID NO: 9112827 - DNA, 22 bp, Homo sapiens
caggccagtgtgcttcccaggc

SEQ ID NO: 9112828 - DNA, 20 bp, Homo sapiens
tacaaacctccacactggtg

SEQ ID NO: 9112829 - DNA, 22 bp, Homo sapiens
tacaaaccaaggaacagtgatc

SEQ ID NO: 9112830 - DNA, 22 bp, Homo sapiens
tacaaaagtaattacggttttt

SEQ ID NO: 9112831 - DNA, 22 bp, Homo sapiens
caggccagagcgcgtggttggg

SEQ ID NO: 9112832 - DNA, 22 bp, Homo sapiens
caggccagagcgcgtggttggg

SEQ ID NO: 9112833 - DNA, 22 bp, Homo sapiens
tacaaaacagtgctctggtcct

SEQ ID NO: 9112834 - DNA, 22 bp, Homo sapiens
tacaaaacagtgctctggtcct

SEQ ID NO: 9112835 - DNA, 22 bp, Homo sapiens
tacaaaaggaagagggatctta

SEQ ID NO: 9112836 - DNA, 22 bp, Homo sapiens
tacaaaaggaagagggatctta

SEQ ID NO: 9112837 - DNA, 22 bp, Homo sapiens
tacaaaacagtgctctggtcct

SEQ ID NO: 9112838 - DNA, 22 bp, Homo sapiens
tacaaaaggaagagggatctta

SEQ ID NO: 9112839 - DNA, 22 bp, Homo sapiens
tacaaaaaattgatactgacga

SEQ ID NO: 9112840 - DNA, 22 bp, Homo sapiens
tacaaaaaattgatactgacga

SEQ ID NO: 9112841 - DNA, 22 bp, Homo sapiens
tacaaaaaattgatactgacga

SEQ ID NO: 9112842 - DNA, 21 bp, Homo sapiens
caggccaaaaggttcaacatt

SEQ ID NO: 9112843 - DNA, 23 bp, Homo sapiens
cagctcagcacataggaggtact

SEQ ID NO: 9112844 - DNA, 22 bp, Homo sapiens
taagtagttccatccaaacagc

SEQ ID NO: 9112845 - DNA, 22 bp, Homo sapiens
taagtattggcctatagctaga

SEQ ID NO: 9112846 - DNA, 22 bp, Homo sapiens
taaggcaggaactggctgtttt

SEQ ID NO: 9112847 - DNA, 22 bp, Homo sapiens
taagtagtcagacataccccat

SEQ ID NO: 9112848 - DNA, 22 bp, Homo sapiens
taaggcagcctcagggtagggt

SEQ ID NO: 9112849 - DNA, 22 bp, Homo sapiens
taaggcagctgagcttctaaca

SEQ ID NO: 9112850 - DNA, 22 bp, Homo sapiens
taagtctctcgtttgattcatt

SEQ ID NO: 9112851 - DNA, 22 bp, Homo sapiens
gtgcttcctgtattgattccat

SEQ ID NO: 9112852 - DNA, 22 bp, Homo sapiens
gtgcttctcttcacacccaact

SEQ ID NO: 9112853 - DNA, 20 bp, Homo sapiens
gtgcttcagaagccattgct

SEQ ID NO: 9112854 - DNA, 22 bp, Homo sapiens
gtgcttcaagttcttaatgttt

SEQ ID NO: 9112855 - DNA, 22 bp, Homo sapiens
cagctcagacgcaggtcgagca

SEQ ID NO: 9112856 - DNA, 22 bp, Homo sapiens
cagctcaagtttcccaggtcag

SEQ ID NO: 9112857 - DNA, 22 bp, Homo sapiens
cagctcaagtttcccaggtcag

SEQ ID NO: 9112858 - DNA, 22 bp, Homo sapiens
cagctcacccatcacgtctgct

SEQ ID NO: 9112859 - DNA, 22 bp, Homo sapiens
cagctattggcaagaagtggtg

SEQ ID NO: 9112860 - DNA, 22 bp, Homo sapiens
caggcagatatgttcgctttaa

SEQ ID NO: 9112861 - DNA, 22 bp, Homo sapiens
caggcagagttagagcaactgg

SEQ ID NO: 9112862 - DNA, 22 bp, Homo sapiens
caggcagagttagagcaactgg

SEQ ID NO: 9112863 - DNA, 22 bp, Homo sapiens
caggcagagctgaagatagatg

SEQ ID NO: 9112864 - DNA, 22 bp, Homo sapiens
caggcaccctctgaggggaagc

SEQ ID NO: 9112865 - DNA, 22 bp, Homo sapiens
caggcaccccaggtgagcactg

SEQ ID NO: 9112866 - DNA, 22 bp, Homo sapiens
caggcaccccaggtgagcactg

SEQ ID NO: 9112867 - DNA, 22 bp, Homo sapiens
caggcaccagtgagaagggcct

SEQ ID NO: 9112868 - DNA, 22 bp, Homo sapiens
caggcacctttgtgcatgggca

SEQ ID NO: 9112869 - DNA, 22 bp, Homo sapiens
caggcacctttgtgcatgggca

SEQ ID NO: 9112870 - DNA, 22 bp, Homo sapiens
caggcaccccaggtgagcactg

SEQ ID NO: 9112871 - DNA, 22 bp, Homo sapiens
caggcaccccaggtgagcactg

SEQ ID NO: 9112872 - DNA, 22 bp, Homo sapiens
taatacaaggcaggaagcagta

SEQ ID NO: 9112873 - DNA, 22 bp, Homo sapiens
taatacaatggagttgggcccc

SEQ ID NO: 9112874 - DNA, 22 bp, Homo sapiens
taatacaaggcaggaagcagta

SEQ ID NO: 9112875 - DNA, 22 bp, Homo sapiens
taatacacaagggccagctctt

SEQ ID NO: 9112876 - DNA, 22 bp, Homo sapiens
taatacacactctcattcctaa

SEQ ID NO: 9112877 - DNA, 22 bp, Homo sapiens
taatacactgctttttgtaact

SEQ ID NO: 9112878 - DNA, 22 bp, Homo sapiens
taatacagaagtgtattaaaat

SEQ ID NO: 9112879 - DNA, 22 bp, Homo sapiens
taatacagaagtgtattaaaat

SEQ ID NO: 9112880 - DNA, 22 bp, Homo sapiens
caggcagatttgctgccctcca

SEQ ID NO: 9112881 - DNA, 22 bp, Homo sapiens
caggcagatttgctgccctcca

SEQ ID NO: 9112882 - DNA, 22 bp, Homo sapiens
caggcagatgctgacaagagtt

SEQ ID NO: 9112883 - DNA, 22 bp, Homo sapiens
caggcagatgctgacaagagtt

SEQ ID NO: 9112884 - DNA, 22 bp, Homo sapiens
caggcagatttgctgccctcca

SEQ ID NO: 9112885 - DNA, 22 bp, Homo sapiens
caggcagatttgctgccctcca

SEQ ID NO: 9112886 - DNA, 22 bp, Homo sapiens
caggcagatttgctgccctcca

SEQ ID NO: 9112887 - DNA, 22 bp, Homo sapiens
caggcagcagaggagtgtggga

SEQ ID NO: 9112888 - DNA, 22 bp, Homo sapiens
tagattcaagtattcagtttgg

SEQ ID NO: 9112889 - DNA, 22 bp, Homo sapiens
tagattcatgcagtatgctagt

SEQ ID NO: 9112890 - DNA, 22 bp, Homo sapiens
tagattctaagattctaagaat

SEQ ID NO: 9112891 - DNA, 22 bp, Homo sapiens
tagattcagatatttaggacaa

SEQ ID NO: 9112892 - DNA, 20 bp, Homo sapiens
tagattctgtctgtccaaac

SEQ ID NO: 9112893 - DNA, 22 bp, Homo sapiens
tagattctgtttcctctggttt

SEQ ID NO: 9112894 - DNA, 22 bp, Homo sapiens
tagattctgtgagagtcaaagt

SEQ ID NO: 9112895 - DNA, 22 bp, Homo sapiens
tagattctgtatgtctgctctc

SEQ ID NO: 9112896 - DNA, 22 bp, Homo sapiens
tagattctgtaaataatcaagg

SEQ ID NO: 9112897 - DNA, 22 bp, Homo sapiens
tagattcttagtttcatagaat

SEQ ID NO: 9112898 - DNA, 22 bp, Homo sapiens
tagattcttctaggtctttagc

SEQ ID NO: 9112899 - DNA, 22 bp, Homo sapiens
tagattcttgaaccagtgcctc

SEQ ID NO: 9112900 - DNA, 22 bp, Homo sapiens
tagattcttcttttgagtctct

SEQ ID NO: 9112901 - DNA, 22 bp, Homo sapiens
tagattctcccatcatgagatg

SEQ ID NO: 9112902 - DNA, 22 bp, Homo sapiens
tagattctctgctggctgacat

SEQ ID NO: 9112903 - DNA, 22 bp, Homo sapiens
tagattctgaccctctttttac

SEQ ID NO: 9112904 - DNA, 22 bp, Homo sapiens
tagattctggagagacagcagt

SEQ ID NO: 9112905 - DNA, 22 bp, Homo sapiens
tagattctacagctcagctgtc

SEQ ID NO: 9112906 - DNA, 22 bp, Homo sapiens
tagattctcagaattttagaaa

SEQ ID NO: 9112907 - DNA, 22 bp, Homo sapiens
tagattctactgtcacttagtt

SEQ ID NO: 9112908 - DNA, 22 bp, Homo sapiens
tagattctccacatgtagcaat

SEQ ID NO: 9112909 - DNA, 22 bp, Homo sapiens
tagattctcccacctgccaggc

SEQ ID NO: 9112910 - DNA, 22 bp, Homo sapiens
cagggacagcactaaactcttg

SEQ ID NO: 9112911 - DNA, 22 bp, Homo sapiens
cagggacagcactaaactcttg

SEQ ID NO: 9112912 - DNA, 22 bp, Homo sapiens
cagggacagacagatatatttg

SEQ ID NO: 9112913 - DNA, 22 bp, Homo sapiens
cagggacagagactgcaccttg

SEQ ID NO: 9112914 - DNA, 22 bp, Homo sapiens
cagggacaaggaataagattag

SEQ ID NO: 9112915 - DNA, 22 bp, Homo sapiens
cagggacaatggcagagcctga

SEQ ID NO: 9112916 - DNA, 22 bp, Homo sapiens
cagggaaggctgcaaatgttaa

SEQ ID NO: 9112917 - DNA, 22 bp, Homo sapiens
cagggaagaatagttagcaaag

SEQ ID NO: 9112918 - DNA, 22 bp, Homo sapiens
cagggaagaatagttagcaaag

SEQ ID NO: 9112919 - DNA, 22 bp, Homo sapiens
cagggaagagccgatgctgcag

SEQ ID NO: 9112920 - DNA, 22 bp, Homo sapiens
cagggaagagccgatgctgcag

SEQ ID NO: 9112921 - DNA, 22 bp, Homo sapiens
caggctttcaggacagcgagcc

SEQ ID NO: 9112922 - DNA, 22 bp, Homo sapiens
caggcttttgcatagcactggg

SEQ ID NO: 9112923 - DNA, 22 bp, Homo sapiens
caggctgtctgaatggaggccc

SEQ ID NO: 9112924 - DNA, 22 bp, Homo sapiens
tagaaacaaagacctgggtgct

SEQ ID NO: 9112925 - DNA, 22 bp, Homo sapiens
caggcttggcagggaggctggt

SEQ ID NO: 9112926 - DNA, 22 bp, Homo sapiens
caggcttggagggcagtggcat

SEQ ID NO: 9112927 - DNA, 22 bp, Homo sapiens
caggcttggagggcagtggcat

SEQ ID NO: 9112928 - DNA, 22 bp, Homo sapiens
caggcttgggagcagagccact

SEQ ID NO: 9112929 - DNA, 22 bp, Homo sapiens
caggcttggcagggaggctggt

SEQ ID NO: 9112930 - DNA, 22 bp, Homo sapiens
tagaaacaaaatctgatgactc

SEQ ID NO: 9112931 - DNA, 22 bp, Homo sapiens
tagaaacaaagacctgggtgct

SEQ ID NO: 9112932 - DNA, 22 bp, Homo sapiens
tagaaacaaaatctgatgactc

SEQ ID NO: 9112933 - DNA, 22 bp, Homo sapiens
tagaaaatggccaagcaggact

SEQ ID NO: 9112934 - DNA, 22 bp, Homo sapiens
tagaaaagtatgggactgacat

SEQ ID NO: 9112935 - DNA, 22 bp, Homo sapiens
caggctgggactgacccctgct

SEQ ID NO: 9112936 - DNA, 22 bp, Homo sapiens
caggctgggactgacccctgct

SEQ ID NO: 9112937 - DNA, 22 bp, Homo sapiens
caggctggcaatgcgtcaagca

SEQ ID NO: 9112938 - DNA, 22 bp, Homo sapiens
caggctggcaatgcgtcaagca

SEQ ID NO: 9112939 - DNA, 22 bp, Homo sapiens
caggctgggaacgccacccgct

SEQ ID NO: 9112940 - DNA, 22 bp, Homo sapiens
caggctgggaacgccacccgct

SEQ ID NO: 9112941 - DNA, 22 bp, Homo sapiens
caggctgggaacgccacccgct

SEQ ID NO: 9112942 - DNA, 22 bp, Homo sapiens
caggctgggaacgccacccgct

SEQ ID NO: 9112943 - DNA, 22 bp, Homo sapiens
caggctggagtgcagtggtgcc

SEQ ID NO: 9112944 - DNA, 22 bp, Homo sapiens
caggctggagttcagtggtgtg

SEQ ID NO: 9112945 - DNA, 22 bp, Homo sapiens
caggctggagttcagtggtgtg

SEQ ID NO: 9112946 - DNA, 22 bp, Homo sapiens
caggctggagttcagtggtgtg

SEQ ID NO: 9112947 - DNA, 22 bp, Homo sapiens
caggctggagttcagtggtgtg

SEQ ID NO: 9112948 - DNA, 22 bp, Homo sapiens
caggctggagttcagtggtgtg

SEQ ID NO: 9112949 - DNA, 22 bp, Homo sapiens
caggctgccaaggctggggagg

SEQ ID NO: 9112950 - DNA, 22 bp, Homo sapiens
caggccttttttcctgcagtgt

SEQ ID NO: 9112951 - DNA, 22 bp, Homo sapiens
caggccttttttcctgcagtgt

SEQ ID NO: 9112952 - DNA, 22 bp, Homo sapiens
caggccttttttcctgcagtgt

SEQ ID NO: 9112953 - DNA, 22 bp, Homo sapiens
caggcgggcaggtgcggcccct

SEQ ID NO: 9112954 - DNA, 22 bp, Homo sapiens
caggccttgtcaagaaaatgcc

SEQ ID NO: 9112955 - DNA, 22 bp, Homo sapiens
caggcctttctggggaagtgag

SEQ ID NO: 9112956 - DNA, 22 bp, Homo sapiens
caggcctttctggggaagtgag

SEQ ID NO: 9112957 - DNA, 22 bp, Homo sapiens
caggcctttctggggaagtgag

SEQ ID NO: 9112958 - DNA, 22 bp, Homo sapiens
caggccttgtcaagaaaatgcc

SEQ ID NO: 9112959 - DNA, 22 bp, Homo sapiens
caggccttgtcaagaaaatgcc

SEQ ID NO: 9112960 - DNA, 22 bp, Homo sapiens
caggcctttcttggggcttaga

SEQ ID NO: 9112961 - DNA, 18 bp, Homo sapiens
caggcctttgagacagaa

SEQ ID NO: 9112962 - DNA, 18 bp, Homo sapiens
caggcctttgagacagaa

SEQ ID NO: 9112963 - DNA, 18 bp, Homo sapiens
caggcctttgagacagaa

SEQ ID NO: 9112964 - DNA, 22 bp, Homo sapiens
caggcctttgcagggagagaga

SEQ ID NO: 9112965 - DNA, 22 bp, Homo sapiens
caggcctttgcacgtgcagttg

SEQ ID NO: 9112966 - DNA, 22 bp, Homo sapiens
caggcctttgcacgtgcagttg

SEQ ID NO: 9112967 - DNA, 22 bp, Homo sapiens
caggcctttgggaatcaccaca

SEQ ID NO: 9112968 - DNA, 22 bp, Homo sapiens
caggcctttgggaatcaccaca

SEQ ID NO: 9112969 - DNA, 22 bp, Homo sapiens
caggcctttgcagggagagaga

SEQ ID NO: 9112970 - DNA, 22 bp, Homo sapiens
caggcctttgcagggagagaga

SEQ ID NO: 9112971 - DNA, 22 bp, Homo sapiens
tacatttataaggcttctctgt

SEQ ID NO: 9112972 - DNA, 22 bp, Homo sapiens
tacatttataaggcttctctgt

SEQ ID NO: 9112973 - DNA, 22 bp, Homo sapiens
tacatttataaggcttctctgt

SEQ ID NO: 9112974 - DNA, 22 bp, Homo sapiens
tactttacagtattagataatt

SEQ ID NO: 9112975 - DNA, 22 bp, Homo sapiens
tactttacagtattagataatt

SEQ ID NO: 9112976 - DNA, 22 bp, Homo sapiens
tactttagaaggaaataagttc

SEQ ID NO: 9112977 - DNA, 22 bp, Homo sapiens
caggctatgttttaggagctta

SEQ ID NO: 9112978 - DNA, 22 bp, Homo sapiens
caggctaaagctttgagcatgt

SEQ ID NO: 9112979 - DNA, 22 bp, Homo sapiens
tactttaaaaactgataattca

SEQ ID NO: 9112980 - DNA, 22 bp, Homo sapiens
caggcctgagacatctgagata

SEQ ID NO: 9112981 - DNA, 22 bp, Homo sapiens
caggcctgagacatctgagata

SEQ ID NO: 9112982 - DNA, 22 bp, Homo sapiens
caggcctgaccctgagcttcac

SEQ ID NO: 9112983 - DNA, 22 bp, Homo sapiens
caggcctgaccctgagcttcac

SEQ ID NO: 9112984 - DNA, 18 bp, Homo sapiens
caggcctcttgatcttcc

SEQ ID NO: 9112985 - DNA, 19 bp, Homo sapiens
caggcctcttaccctctct

SEQ ID NO: 9112986 - DNA, 22 bp, Homo sapiens
tacatgttcaaatttgtctttc

SEQ ID NO: 9112987 - DNA, 22 bp, Homo sapiens
caggcctgcaggaaaggctccc

SEQ ID NO: 9112988 - DNA, 22 bp, Homo sapiens
caggcctgagacatctgagata

SEQ ID NO: 9112989 - DNA, 22 bp, Homo sapiens
caggcctgagtgtggaagtctt

SEQ ID NO: 9112990 - DNA, 22 bp, Homo sapiens
tacattgctttctaatacatct

SEQ ID NO: 9112991 - DNA, 22 bp, Homo sapiens
tacattgctagaaatgtatttt

SEQ ID NO: 9112992 - DNA, 22 bp, Homo sapiens
caggcccagcccttagccaggt

SEQ ID NO: 9112993 - DNA, 22 bp, Homo sapiens
caggcccagcccagcccttcga

SEQ ID NO: 9112994 - DNA, 22 bp, Homo sapiens
caggcccagaggcctcttccca

SEQ ID NO: 9112995 - DNA, 22 bp, Homo sapiens
caggcctcctatgagcactagc

SEQ ID NO: 9112996 - DNA, 22 bp, Homo sapiens
caggcctctatggtcagctgag

SEQ ID NO: 9112997 - DNA, 22 bp, Homo sapiens
caggcctctatggtcagctgag

SEQ ID NO: 9112998 - DNA, 22 bp, Homo sapiens
caggcctctatggtcagctgag

SEQ ID NO: 9112999 - DNA, 19 bp, Homo sapiens
caggcctctggtctgctgt

SEQ ID NO: 9113000 - DNA, 19 bp, Homo sapiens
caggcctctggtctgctgt

SEQ ID NO: 9113001 - DNA, 20 bp, Homo sapiens
caggcctctgggggccctgg

SEQ ID NO: 9113002 - DNA, 20 bp, Homo sapiens
caggcctctgggggccctgg

SEQ ID NO: 9113003 - DNA, 22 bp, Homo sapiens
caggcctctccttagtctggca

SEQ ID NO: 9113004 - DNA, 22 bp, Homo sapiens
caggcctctccttagtctggca

SEQ ID NO: 9113005 - DNA, 20 bp, Homo sapiens
caggcctctgggggccctgg

SEQ ID NO: 9113006 - DNA, 22 bp, Homo sapiens
caggcctctccttagtctggca

SEQ ID NO: 9113007 - DNA, 22 bp, Homo sapiens
cctctgtggccctgactctctt

SEQ ID NO: 9113008 - DNA, 22 bp, Homo sapiens
cctctgtggccctgactctctt

SEQ ID NO: 9113009 - DNA, 22 bp, Homo sapiens
tgggaaggcagtcactgtccta

SEQ ID NO: 9113010 - DNA, 22 bp, Homo sapiens
tgggaaggcagtcactgtccta

SEQ ID NO: 9113011 - DNA, 22 bp, Homo sapiens
tgggaaggatacgttacaagat

SEQ ID NO: 9113012 - DNA, 22 bp, Homo sapiens
tgggaaggacgtgtcagtggca

SEQ ID NO: 9113013 - DNA, 22 bp, Homo sapiens
tgggaaggacgtgtcagtggca

SEQ ID NO: 9113014 - DNA, 22 bp, Homo sapiens
tgggaaggacgtgtcagtggca

SEQ ID NO: 9113015 - DNA, 22 bp, Homo sapiens
tgggaaggaatggtgattaata

SEQ ID NO: 9113016 - DNA, 22 bp, Homo sapiens
tgggaaggaactgcctttagct

SEQ ID NO: 9113017 - DNA, 22 bp, Homo sapiens
tgggaaggaactgcctttagct

SEQ ID NO: 9113018 - DNA, 22 bp, Homo sapiens
tgggaagctactcatgcaggca

SEQ ID NO: 9113019 - DNA, 22 bp, Homo sapiens
tgggaagctgcattttaacaag

SEQ ID NO: 9113020 - DNA, 22 bp, Homo sapiens
tgggaagctgcattttaacaag

SEQ ID NO: 9113021 - DNA, 22 bp, Homo sapiens
cctctgctgctgttgagcaccg

SEQ ID NO: 9113022 - DNA, 22 bp, Homo sapiens
cctctgcctgcacatcatcctg

SEQ ID NO: 9113023 - DNA, 22 bp, Homo sapiens
cctctgcctgcacatcatcctg

SEQ ID NO: 9113024 - DNA, 22 bp, Homo sapiens
cctctgagtcctccctggttgc

SEQ ID NO: 9113025 - DNA, 22 bp, Homo sapiens
tggcttccagagctgctccacc

SEQ ID NO: 9113026 - DNA, 22 bp, Homo sapiens
tggcttccaaattatccctaga

SEQ ID NO: 9113027 - DNA, 22 bp, Homo sapiens
tggcttccactgtgtgccccct

SEQ ID NO: 9113028 - DNA, 22 bp, Homo sapiens
tggcttccagaactgagcaaca

SEQ ID NO: 9113029 - DNA, 22 bp, Homo sapiens
tggcttccagtaatcaggattt

SEQ ID NO: 9113030 - DNA, 22 bp, Homo sapiens
tggcttccagtaatcaggattt

SEQ ID NO: 9113031 - DNA, 20 bp, Homo sapiens
cctctgcctttctagtctga

SEQ ID NO: 9113032 - DNA, 22 bp, Homo sapiens
cctctgcgcccttgatcagcca

SEQ ID NO: 9113033 - DNA, 20 bp, Homo sapiens
cctctgcctttctagtctga

SEQ ID NO: 9113034 - DNA, 22 bp, Homo sapiens
cctctgctctggtccatgtgct

SEQ ID NO: 9113035 - DNA, 22 bp, Homo sapiens
cctctgctgctgttgagcaccg

SEQ ID NO: 9113036 - DNA, 22 bp, Homo sapiens
cctctgctccctggtgtctgag

SEQ ID NO: 9113037 - DNA, 22 bp, Homo sapiens
cctctgctccctggtgtctgag

SEQ ID NO: 9113038 - DNA, 20 bp, Homo sapiens
tggcttcataatggtttctg

SEQ ID NO: 9113039 - DNA, 22 bp, Homo sapiens
tggcttcatcactcgggctgcc

SEQ ID NO: 9113040 - DNA, 17 bp, Homo sapiens
tggcttcaggctgagca

SEQ ID NO: 9113041 - DNA, 17 bp, Homo sapiens
tggcttcaggctgagca

SEQ ID NO: 9113042 - DNA, 22 bp, Homo sapiens
tggcttcattctcctgtgaata

SEQ ID NO: 9113043 - DNA, 22 bp, Homo sapiens
tggctggctgtccagctgggca

SEQ ID NO: 9113044 - DNA, 22 bp, Homo sapiens
tggctgggagctggaactgggc

SEQ ID NO: 9113045 - DNA, 17 bp, Homo sapiens
tggctctgtcctcagct

SEQ ID NO: 9113046 - DNA, 22 bp, Homo sapiens
tggctctgtcactgtgagctat

SEQ ID NO: 9113047 - DNA, 19 bp, Homo sapiens
tggctctgtcgaaggcaca

SEQ ID NO: 9113048 - DNA, 22 bp, Homo sapiens
tggctgagaagttctggtggga

SEQ ID NO: 9113049 - DNA, 22 bp, Homo sapiens
tggctgagaccatcagggtgta

SEQ ID NO: 9113050 - DNA, 22 bp, Homo sapiens
tggctgagaccatcagggtgta

SEQ ID NO: 9113051 - DNA, 22 bp, Homo sapiens
tggctgagaccatcagggtgta

SEQ ID NO: 9113052 - DNA, 22 bp, Homo sapiens
tggctgagagaagacggggaag

SEQ ID NO: 9113053 - DNA, 16 bp, Homo sapiens
tggctgagagagggtt

SEQ ID NO: 9113054 - DNA, 22 bp, Homo sapiens
tggctgctagccagagcttcag

SEQ ID NO: 9113055 - DNA, 21 bp, Homo sapiens
cctgagcctgtttatccagaa

SEQ ID NO: 9113056 - DNA, 22 bp, Homo sapiens
cctgagcctggctcatgcactc

SEQ ID NO: 9113057 - DNA, 22 bp, Homo sapiens
cctgagcctggctcatgcactc

SEQ ID NO: 9113058 - DNA, 22 bp, Homo sapiens
tgggctggcccaccacacctcg

SEQ ID NO: 9113059 - DNA, 22 bp, Homo sapiens
cctgagctcaagaaggtgacca

SEQ ID NO: 9113060 - DNA, 22 bp, Homo sapiens
cctgagctgaactaagcagttt

SEQ ID NO: 9113061 - DNA, 22 bp, Homo sapiens
cctgagctagggaaggaagacc

SEQ ID NO: 9113062 - DNA, 22 bp, Homo sapiens
cctgagctcaaagggtgcctgg

SEQ ID NO: 9113063 - DNA, 22 bp, Homo sapiens
cctgagctcaaagggtgcctgg

SEQ ID NO: 9113064 - DNA, 22 bp, Homo sapiens
cctgagctgcggggcagtgctc

SEQ ID NO: 9113065 - DNA, 22 bp, Homo sapiens
cctgagctggaagagcttgtgc

SEQ ID NO: 9113066 - DNA, 22 bp, Homo sapiens
tggggaggaagtcagatttcag

SEQ ID NO: 9113067 - DNA, 22 bp, Homo sapiens
tgggctcctcgtcactcgctgt

SEQ ID NO: 9113068 - DNA, 22 bp, Homo sapiens
tgggctgcggataggcctcgga

SEQ ID NO: 9113069 - DNA, 22 bp, Homo sapiens
tgggctgctgtctgcacatgct

SEQ ID NO: 9113070 - DNA, 22 bp, Homo sapiens
tgggctgctgtctgcacatgct

SEQ ID NO: 9113071 - DNA, 22 bp, Homo sapiens
tgggccctgacttcaagcatcc

SEQ ID NO: 9113072 - DNA, 22 bp, Homo sapiens
tgggccccagcacgtctgggga

SEQ ID NO: 9113073 - DNA, 22 bp, Homo sapiens
cctgagcaaaggcccagaggga

SEQ ID NO: 9113074 - DNA, 22 bp, Homo sapiens
cctgagcaacttcaagggcctg

SEQ ID NO: 9113075 - DNA, 22 bp, Homo sapiens
cctgagcaaaggcccagaggga

SEQ ID NO: 9113076 - DNA, 22 bp, Homo sapiens
cctgagatttcattgtctggcc

SEQ ID NO: 9113077 - DNA, 22 bp, Homo sapiens
cctgagatttcattgtctggcc

SEQ ID NO: 9113078 - DNA, 22 bp, Homo sapiens
cctgagcaaaggaaggatgact

SEQ ID NO: 9113079 - DNA, 22 bp, Homo sapiens
cctgagattggctagtatgagt

SEQ ID NO: 9113080 - DNA, 22 bp, Homo sapiens
cctgagatggccagtgctggga

SEQ ID NO: 9113081 - DNA, 21 bp, Homo sapiens
cctgagatctggagtggcttt

SEQ ID NO: 9113082 - DNA, 23 bp, Homo sapiens
cctgagatctgtaagggaccttg

SEQ ID NO: 9113083 - DNA, 22 bp, Homo sapiens
cctgagagagaagcgacctggt

SEQ ID NO: 9113084 - DNA, 22 bp, Homo sapiens
cctgagccgagcgctctttctc

SEQ ID NO: 9113085 - DNA, 22 bp, Homo sapiens
cctgagccaagagtcagaatct

SEQ ID NO: 9113086 - DNA, 22 bp, Homo sapiens
cctgagcattagacatccatca

SEQ ID NO: 9113087 - DNA, 22 bp, Homo sapiens
cctgagcattagacatccatca

SEQ ID NO: 9113088 - DNA, 22 bp, Homo sapiens
cctgagcatcagcgcctcctta

SEQ ID NO: 9113089 - DNA, 22 bp, Homo sapiens
cctgagcatcagcgcctcctta

SEQ ID NO: 9113090 - DNA, 22 bp, Homo sapiens
cctgagcctgagtggtgcaggg

SEQ ID NO: 9113091 - DNA, 22 bp, Homo sapiens
cctgagcctgagtggtgcaggg

SEQ ID NO: 9113092 - DNA, 22 bp, Homo sapiens
tgggccatttttggaagactgg

SEQ ID NO: 9113093 - DNA, 22 bp, Homo sapiens
cctcttctaggacgtccttgtg

SEQ ID NO: 9113094 - DNA, 19 bp, Homo sapiens
cctcttcctctgacactat

SEQ ID NO: 9113095 - DNA, 22 bp, Homo sapiens
tgggagtgttcttggcttgctt

SEQ ID NO: 9113096 - DNA, 22 bp, Homo sapiens
tgggagtggggcatagaaggta

SEQ ID NO: 9113097 - DNA, 19 bp, Homo sapiens
tgggagtggggaaggtcct

SEQ ID NO: 9113098 - DNA, 19 bp, Homo sapiens
tgggagtggggaaggtcct

SEQ ID NO: 9113099 - DNA, 18 bp, Homo sapiens
tgggagtgggagtggata

SEQ ID NO: 9113100 - DNA, 22 bp, Homo sapiens
tggcctgggccggcagatatac

SEQ ID NO: 9113101 - DNA, 22 bp, Homo sapiens
tggcctgggccggcagatatac

SEQ ID NO: 9113102 - DNA, 22 bp, Homo sapiens
tggcctgggccggcagatatac

SEQ ID NO: 9113103 - DNA, 22 bp, Homo sapiens
tggcctggctgccctgtctgga

SEQ ID NO: 9113104 - DNA, 22 bp, Homo sapiens
tggcctggctgccctgtctgga

SEQ ID NO: 9113105 - DNA, 22 bp, Homo sapiens
tggcctgggcatgaagcatcgt

SEQ ID NO: 9113106 - DNA, 22 bp, Homo sapiens
tggcctgggcatgaagcatcgt

SEQ ID NO: 9113107 - DNA, 22 bp, Homo sapiens
tggcctggggaagaccatgggc

SEQ ID NO: 9113108 - DNA, 22 bp, Homo sapiens
tggcctgggcctgccggtgcaa

SEQ ID NO: 9113109 - DNA, 22 bp, Homo sapiens
tggcctgggcctgccggtgcaa

SEQ ID NO: 9113110 - DNA, 22 bp, Homo sapiens
tggctctggtgcgggctcctgc

SEQ ID NO: 9113111 - DNA, 22 bp, Homo sapiens
tggctctggtgcgggctcctgc

SEQ ID NO: 9113112 - DNA, 22 bp, Homo sapiens
tggctctggtgcgggctcctgc

SEQ ID NO: 9113113 - DNA, 22 bp, Homo sapiens
tggctctgtcaaactgcacaca

SEQ ID NO: 9113114 - DNA, 21 bp, Homo sapiens
tggctctgggtaggagagtgc

SEQ ID NO: 9113115 - DNA, 22 bp, Homo sapiens
tggctctggtaacattgggtag

SEQ ID NO: 9113116 - DNA, 22 bp, Homo sapiens
tggctctgaccaggtagaggag

SEQ ID NO: 9113117 - DNA, 22 bp, Homo sapiens
cctcagtgttaggataagagaa

SEQ ID NO: 9113118 - DNA, 22 bp, Homo sapiens
cctcagtgtgtttggggtgagg

SEQ ID NO: 9113119 - DNA, 22 bp, Homo sapiens
cctcagtgtgtggatgttagag

SEQ ID NO: 9113120 - DNA, 22 bp, Homo sapiens
cctcagtgtgtggatgttagag

SEQ ID NO: 9113121 - DNA, 20 bp, Homo sapiens
cctcagtgtcctggactggg

SEQ ID NO: 9113122 - DNA, 22 bp, Homo sapiens
cctcagtgtgcagcagcatctg

SEQ ID NO: 9113123 - DNA, 22 bp, Homo sapiens
cctcagtgcgtactgaacagtg

SEQ ID NO: 9113124 - DNA, 22 bp, Homo sapiens
cctcagtgcgtactgaacagtg

SEQ ID NO: 9113125 - DNA, 22 bp, Homo sapiens
cctcagtgagtgtttccttctt

SEQ ID NO: 9113126 - DNA, 22 bp, Homo sapiens
cctcagtgagtgtttccttctt

SEQ ID NO: 9113127 - DNA, 22 bp, Homo sapiens
cctccaagcttcatctcaacca

SEQ ID NO: 9113128 - DNA, 22 bp, Homo sapiens
cctccaaggctgagttaatgaa

SEQ ID NO: 9113129 - DNA, 22 bp, Homo sapiens
cctccaagctggtcctctgtgt

SEQ ID NO: 9113130 - DNA, 22 bp, Homo sapiens
cctccaaggtgagagaggatgg

SEQ ID NO: 9113131 - DNA, 18 bp, Homo sapiens
cctccaagtccccagcct

SEQ ID NO: 9113132 - DNA, 22 bp, Homo sapiens
cctccaagtgagagatggtaca

SEQ ID NO: 9113133 - DNA, 22 bp, Homo sapiens
cctcatgagttcttctgcccat

SEQ ID NO: 9113134 - DNA, 22 bp, Homo sapiens
cctcatgttgctcgcatctgca

SEQ ID NO: 9113135 - DNA, 22 bp, Homo sapiens
cctcattaacacaatgtcattt

SEQ ID NO: 9113136 - DNA, 22 bp, Homo sapiens
cctcattaacacaatgtcattt

SEQ ID NO: 9113137 - DNA, 22 bp, Homo sapiens
cctcaggcttacgggcaatgga

SEQ ID NO: 9113138 - DNA, 22 bp, Homo sapiens
cctcaggcttacgggcaatgga

SEQ ID NO: 9113139 - DNA, 22 bp, Homo sapiens
cctcaggctgtcttccttctgg

SEQ ID NO: 9113140 - DNA, 22 bp, Homo sapiens
cctcagggaatgggaggctggg

SEQ ID NO: 9113141 - DNA, 22 bp, Homo sapiens
cctcaggcttgtgagccttcag

SEQ ID NO: 9113142 - DNA, 22 bp, Homo sapiens
cctcaggctagctactgtccct

SEQ ID NO: 9113143 - DNA, 22 bp, Homo sapiens
cctcaggctagctactgtccct

SEQ ID NO: 9113144 - DNA, 22 bp, Homo sapiens
cctcaggctgggctgcccctgg

SEQ ID NO: 9113145 - DNA, 22 bp, Homo sapiens
cctcaggctgggctgcccctgg

SEQ ID NO: 9113146 - DNA, 22 bp, Homo sapiens
cctcaggctgggctgcccctgg

SEQ ID NO: 9113147 - DNA, 22 bp, Homo sapiens
cctcaggctgctcacacttgtc

SEQ ID NO: 9113148 - DNA, 22 bp, Homo sapiens
cctcaggctgctcacacttgtc

SEQ ID NO: 9113149 - DNA, 20 bp, Homo sapiens
tggcccagcacgacgaggac

SEQ ID NO: 9113150 - DNA, 22 bp, Homo sapiens
tggcccagagcactgctgggca

SEQ ID NO: 9113151 - DNA, 22 bp, Homo sapiens
tggcccagagcactgctgggca

SEQ ID NO: 9113152 - DNA, 22 bp, Homo sapiens
tggcccagatctctgaccttga

SEQ ID NO: 9113153 - DNA, 22 bp, Homo sapiens
cctcagcatcctcatgctcagt

SEQ ID NO: 9113154 - DNA, 22 bp, Homo sapiens
cctcagcatcctcctgctcagt

SEQ ID NO: 9113155 - DNA, 22 bp, Homo sapiens
cctcagagtaggtctcagctgt

SEQ ID NO: 9113156 - DNA, 22 bp, Homo sapiens
cctcagaggttttcattctgta

SEQ ID NO: 9113157 - DNA, 22 bp, Homo sapiens
cctcagagttggaatcacattt

SEQ ID NO: 9113158 - DNA, 22 bp, Homo sapiens
cctcagagttatttgaagtgaa

SEQ ID NO: 9113159 - DNA, 22 bp, Homo sapiens
ccctgcaggggacctgcagcct

SEQ ID NO: 9113160 - DNA, 22 bp, Homo sapiens
ccctgcaggggacctgcagcct

SEQ ID NO: 9113161 - DNA, 22 bp, Homo sapiens
ccctgcaggggacctgcagcct

SEQ ID NO: 9113162 - DNA, 22 bp, Homo sapiens
ccctgcagggaggattctgaag

SEQ ID NO: 9113163 - DNA, 21 bp, Homo sapiens
ccctgcaggccagggctgagc

SEQ ID NO: 9113164 - DNA, 21 bp, Homo sapiens
ccctgcaggccagggctgagc

SEQ ID NO: 9113165 - DNA, 22 bp, Homo sapiens
ccctgcaggctcagactggagt

SEQ ID NO: 9113166 - DNA, 22 bp, Homo sapiens
ccctgcaggctcagactggagt

SEQ ID NO: 9113167 - DNA, 18 bp, Homo sapiens
tggagcaggtaggcatga

SEQ ID NO: 9113168 - DNA, 22 bp, Homo sapiens
ccctgcagccttgcatgccttc

SEQ ID NO: 9113169 - DNA, 22 bp, Homo sapiens
ccctgcagccttgcatgccttc

SEQ ID NO: 9113170 - DNA, 18 bp, Homo sapiens
tggagcaggtaggcatga

SEQ ID NO: 9113171 - DNA, 22 bp, Homo sapiens
tggagcaggccggaagtggctt

SEQ ID NO: 9113172 - DNA, 22 bp, Homo sapiens
tggagcagggcatcactgtgcg

SEQ ID NO: 9113173 - DNA, 22 bp, Homo sapiens
tggagcagggcatcactgtgcg

SEQ ID NO: 9113174 - DNA, 21 bp, Homo sapiens
cccttcttactcaagctcatt

SEQ ID NO: 9113175 - DNA, 22 bp, Homo sapiens
cccttccttgtgactggtgggg

SEQ ID NO: 9113176 - DNA, 21 bp, Homo sapiens
cccttcttgggtcaaagtata

SEQ ID NO: 9113177 - DNA, 22 bp, Homo sapiens
cccttctttgtaataaagatta

SEQ ID NO: 9113178 - DNA, 19 bp, Homo sapiens
tggcagaggacaaggactt

SEQ ID NO: 9113179 - DNA, 22 bp, Homo sapiens
cccttcctcccaggcttctgtg

SEQ ID NO: 9113180 - DNA, 22 bp, Homo sapiens
cctaggcccattaattcccctt

SEQ ID NO: 9113181 - DNA, 22 bp, Homo sapiens
cctaggagagggaaaatctagg

SEQ ID NO: 9113182 - DNA, 22 bp, Homo sapiens
cctaggaagctgagattgcagt

SEQ ID NO: 9113183 - DNA, 22 bp, Homo sapiens
cctaggaacccccaggcttctg

SEQ ID NO: 9113184 - DNA, 22 bp, Homo sapiens
tggcagggttggccaccttacc

SEQ ID NO: 9113185 - DNA, 22 bp, Homo sapiens
cctaggcccattaattcccctt

SEQ ID NO: 9113186 - DNA, 22 bp, Homo sapiens
cctcagaagctcaaggacattg

SEQ ID NO: 9113187 - DNA, 22 bp, Homo sapiens
tggcaggtagagttctgagatg

SEQ ID NO: 9113188 - DNA, 18 bp, Homo sapiens
tggcaggtagactcaggt

SEQ ID NO: 9113189 - DNA, 22 bp, Homo sapiens
cctcagaaggacaagagacaaa

SEQ ID NO: 9113190 - DNA, 22 bp, Homo sapiens
cctcagaggtgaacatcagtgc

SEQ ID NO: 9113191 - DNA, 22 bp, Homo sapiens
cctcagaggtgtggcatctctg

SEQ ID NO: 9113192 - DNA, 19 bp, Homo sapiens
cctagagcagtacctggta

SEQ ID NO: 9113193 - DNA, 22 bp, Homo sapiens
cctagagccgcacctcctccac

SEQ ID NO: 9113194 - DNA, 22 bp, Homo sapiens
cctagagctctgctttatctaa

SEQ ID NO: 9113195 - DNA, 18 bp, Homo sapiens
cctaggaaagggaggcaa

SEQ ID NO: 9113196 - DNA, 22 bp, Homo sapiens
cctaagaattaatgaatacacc

SEQ ID NO: 9113197 - DNA, 22 bp, Homo sapiens
tggcagaggctctgtgatgttg

SEQ ID NO: 9113198 - DNA, 22 bp, Homo sapiens
tgccttcctgctttgagttctg

SEQ ID NO: 9113199 - DNA, 22 bp, Homo sapiens
tgcctgttgcccacctgataaa

SEQ ID NO: 9113200 - DNA, 22 bp, Homo sapiens
tgcctgttgcccacctgataaa

SEQ ID NO: 9113201 - DNA, 22 bp, Homo sapiens
tgcctgttattgttggcttagt

SEQ ID NO: 9113202 - DNA, 22 bp, Homo sapiens
tgcctgttgcccacctgataaa

SEQ ID NO: 9113203 - DNA, 22 bp, Homo sapiens
tgcctgttgcccacctgataaa

SEQ ID NO: 9113204 - DNA, 22 bp, Homo sapiens
cccagggacagatgggcagcta

SEQ ID NO: 9113205 - DNA, 22 bp, Homo sapiens
cccagggacagatgggcagcta

SEQ ID NO: 9113206 - DNA, 22 bp, Homo sapiens
cccagggacagatgggcagcta

SEQ ID NO: 9113207 - DNA, 22 bp, Homo sapiens
tgcctgtgttgattactttgtc

SEQ ID NO: 9113208 - DNA, 22 bp, Homo sapiens
cccagggtagctgagctggcag

SEQ ID NO: 9113209 - DNA, 22 bp, Homo sapiens
cccagggtagctgagctggcag

SEQ ID NO: 9113210 - DNA, 22 bp, Homo sapiens
cccagggtagctgagctggcag

SEQ ID NO: 9113211 - DNA, 22 bp, Homo sapiens
cccagggtccctgctctctgtg

SEQ ID NO: 9113212 - DNA, 22 bp, Homo sapiens
cccagggtccctgctctctgtg

SEQ ID NO: 9113213 - DNA, 22 bp, Homo sapiens
cccagggtccctgctctctgtg

SEQ ID NO: 9113214 - DNA, 22 bp, Homo sapiens
cccagggtccggataaccctgg

SEQ ID NO: 9113215 - DNA, 22 bp, Homo sapiens
cccagggtggatgcaagcagca

SEQ ID NO: 9113216 - DNA, 22 bp, Homo sapiens
cccagggttgcctgcctctgct

SEQ ID NO: 9113217 - DNA, 22 bp, Homo sapiens
cccagggttgcctgcctctgct

SEQ ID NO: 9113218 - DNA, 19 bp, Homo sapiens
cccagggtttcctctctcc

SEQ ID NO: 9113219 - DNA, 19 bp, Homo sapiens
cccagggtttcctctctcc

SEQ ID NO: 9113220 - DNA, 22 bp, Homo sapiens
tgccttcctggagctgaaggct

SEQ ID NO: 9113221 - DNA, 22 bp, Homo sapiens
cccagggattataaaggtgaaa

SEQ ID NO: 9113222 - DNA, 22 bp, Homo sapiens
cccaggctggtcctgaactcct

SEQ ID NO: 9113223 - DNA, 21 bp, Homo sapiens
cccagggaagccgcagtcacc

SEQ ID NO: 9113224 - DNA, 21 bp, Homo sapiens
cccagggaagccgcagtcacc

SEQ ID NO: 9113225 - DNA, 22 bp, Homo sapiens
cccaggctggggctcctccagc

SEQ ID NO: 9113226 - DNA, 22 bp, Homo sapiens
cccaggctggtcctgaactcct

SEQ ID NO: 9113227 - DNA, 22 bp, Homo sapiens
cccaggctggggctcctccagc

SEQ ID NO: 9113228 - DNA, 22 bp, Homo sapiens
cccaggctggggctcctccagc

SEQ ID NO: 9113229 - DNA, 22 bp, Homo sapiens
cccaggctggcctccgcagtgc

SEQ ID NO: 9113230 - DNA, 22 bp, Homo sapiens
cccaggctggcctccgcagtgc

SEQ ID NO: 9113231 - DNA, 22 bp, Homo sapiens
cccaggctggcactgctgaagt

SEQ ID NO: 9113232 - DNA, 22 bp, Homo sapiens
cccaggctggatttcggtggca

SEQ ID NO: 9113233 - DNA, 22 bp, Homo sapiens
cccaggctggagtgtaatggtg

SEQ ID NO: 9113234 - DNA, 22 bp, Homo sapiens
cccaggctggatttcggtggca

SEQ ID NO: 9113235 - DNA, 22 bp, Homo sapiens
cccaggctggcactgctgaagt

SEQ ID NO: 9113236 - DNA, 22 bp, Homo sapiens
tgccctggtgaagtgctctcct

SEQ ID NO: 9113237 - DNA, 22 bp, Homo sapiens
tgccctggttacactggagtcc

SEQ ID NO: 9113238 - DNA, 22 bp, Homo sapiens
tgccctggtgaagtgctctcct

SEQ ID NO: 9113239 - DNA, 22 bp, Homo sapiens
tgccctggtagacacagactgt

SEQ ID NO: 9113240 - DNA, 22 bp, Homo sapiens
cccaggctgagttagaggtgtc

SEQ ID NO: 9113241 - DNA, 22 bp, Homo sapiens
cccaggctggaattccaggcct

SEQ ID NO: 9113242 - DNA, 22 bp, Homo sapiens
cccaggctggaattccaggcct

SEQ ID NO: 9113243 - DNA, 22 bp, Homo sapiens
cccaggctggagggcagtgtca

SEQ ID NO: 9113244 - DNA, 22 bp, Homo sapiens
cccaggctggagtgcaatggtg

SEQ ID NO: 9113245 - DNA, 22 bp, Homo sapiens
cccaggctggagtgcaatggtg

SEQ ID NO: 9113246 - DNA, 22 bp, Homo sapiens
cccaggctggagtgcaatggtg

SEQ ID NO: 9113247 - DNA, 22 bp, Homo sapiens
cccaggctggagtgcaatggtg

SEQ ID NO: 9113248 - DNA, 22 bp, Homo sapiens
cccaggctggagtgcaatggtg

SEQ ID NO: 9113249 - DNA, 22 bp, Homo sapiens
cccaggctggagtgcagtggcg

SEQ ID NO: 9113250 - DNA, 22 bp, Homo sapiens
cccaggctggagtgcagtggcg

SEQ ID NO: 9113251 - DNA, 22 bp, Homo sapiens
cccaggctggagtgcagtggcg

SEQ ID NO: 9113252 - DNA, 22 bp, Homo sapiens
cccaggctggagtgcagtggcg

SEQ ID NO: 9113253 - DNA, 22 bp, Homo sapiens
cccaggctggagtgcagtggcg

SEQ ID NO: 9113254 - DNA, 22 bp, Homo sapiens
cccaggctggagtgcaatggca

SEQ ID NO: 9113255 - DNA, 22 bp, Homo sapiens
cccaggctggagtgcaatggca

SEQ ID NO: 9113256 - DNA, 22 bp, Homo sapiens
cccaggctggagtgcaatggca

SEQ ID NO: 9113257 - DNA, 22 bp, Homo sapiens
cccaggctggagggcagtgtca

SEQ ID NO: 9113258 - DNA, 22 bp, Homo sapiens
cccaggctggagtgcaatggca

SEQ ID NO: 9113259 - DNA, 22 bp, Homo sapiens
cccaggctggagtgcaatggca

SEQ ID NO: 9113260 - DNA, 22 bp, Homo sapiens
tgccagcttgtggtcagaggct

SEQ ID NO: 9113261 - DNA, 22 bp, Homo sapiens
tgccagcttttgactatcttag

SEQ ID NO: 9113262 - DNA, 21 bp, Homo sapiens
tgccagctgctgcatctgtct

SEQ ID NO: 9113263 - DNA, 22 bp, Homo sapiens
tgcacagagagatgagacacgt

SEQ ID NO: 9113264 - DNA, 22 bp, Homo sapiens
tgcacagagagatgagacacgt

SEQ ID NO: 9113265 - DNA, 20 bp, Homo sapiens
tgcacagacaatgagcccag

SEQ ID NO: 9113266 - DNA, 22 bp, Homo sapiens
tgcacagagggaggcataaaat

SEQ ID NO: 9113267 - DNA, 22 bp, Homo sapiens
tgcacagagcaggcaccagcgg

SEQ ID NO: 9113268 - DNA, 22 bp, Homo sapiens
tgccacagaggtgaagcccact

SEQ ID NO: 9113269 - DNA, 22 bp, Homo sapiens
tgccacagaggtgaagcccact

SEQ ID NO: 9113270 - DNA, 19 bp, Homo sapiens
tgccacagataaaaactga

SEQ ID NO: 9113271 - DNA, 22 bp, Homo sapiens
tgccacagcagtgctttgacag

SEQ ID NO: 9113272 - DNA, 22 bp, Homo sapiens
tgccagctccgaggagctgcag

SEQ ID NO: 9113273 - DNA, 22 bp, Homo sapiens
tgccagctcccttttctcctcc

SEQ ID NO: 9113274 - DNA, 22 bp, Homo sapiens
cccaggagacatatagaaggac

SEQ ID NO: 9113275 - DNA, 22 bp, Homo sapiens
cccaggagacatatagaaggac

SEQ ID NO: 9113276 - DNA, 22 bp, Homo sapiens
cccaggagacatatagaaggac

SEQ ID NO: 9113277 - DNA, 22 bp, Homo sapiens
cccaggagacctgtgaaaggac

SEQ ID NO: 9113278 - DNA, 22 bp, Homo sapiens
cccaggagacctgtgaaaggac

SEQ ID NO: 9113279 - DNA, 22 bp, Homo sapiens
cccaggagagaggggataaagc

SEQ ID NO: 9113280 - DNA, 22 bp, Homo sapiens
cccaggagagaggggataaagc

SEQ ID NO: 9113281 - DNA, 22 bp, Homo sapiens
cccaggagagaggccagttggc

SEQ ID NO: 9113282 - DNA, 22 bp, Homo sapiens
cccaggagagaggccagttggc

SEQ ID NO: 9113283 - DNA, 22 bp, Homo sapiens
tgccagtgaaacgtggtctcat

SEQ ID NO: 9113284 - DNA, 22 bp, Homo sapiens
tgccaggctaagtggaggactt

SEQ ID NO: 9113285 - DNA, 22 bp, Homo sapiens
tgccctggggtctggagcagca

SEQ ID NO: 9113286 - DNA, 22 bp, Homo sapiens
tgccctggggagcccagccagg

SEQ ID NO: 9113287 - DNA, 22 bp, Homo sapiens
tgccctggggagcccagccagg

SEQ ID NO: 9113288 - DNA, 22 bp, Homo sapiens
tgccctgggctttgctatgact

SEQ ID NO: 9113289 - DNA, 22 bp, Homo sapiens
tgccctgggagttggagctgct

SEQ ID NO: 9113290 - DNA, 22 bp, Homo sapiens
cccaggctcccaggtgggacaa

SEQ ID NO: 9113291 - DNA, 22 bp, Homo sapiens
cccaggctagaaaggccaacaa

SEQ ID NO: 9113292 - DNA, 22 bp, Homo sapiens
cccaggctagtatgatatcagt

SEQ ID NO: 9113293 - DNA, 22 bp, Homo sapiens
cccaggctagaaaggccaacaa

SEQ ID NO: 9113294 - DNA, 22 bp, Homo sapiens
cccaggctcagactggcttgtt

SEQ ID NO: 9113295 - DNA, 22 bp, Homo sapiens
cccaggctcagactggcttgtt

SEQ ID NO: 9113296 - DNA, 22 bp, Homo sapiens
cccaggctcagactggcttgtt

SEQ ID NO: 9113297 - DNA, 22 bp, Homo sapiens
cccaggctcactgtccgcttcc

SEQ ID NO: 9113298 - DNA, 22 bp, Homo sapiens
tgccagtgtggaactaggaaga

SEQ ID NO: 9113299 - DNA, 22 bp, Homo sapiens
tgccagtgggtgtgcagagact

SEQ ID NO: 9113300 - DNA, 22 bp, Homo sapiens
tgccatagcaatggtaagctga

SEQ ID NO: 9113301 - DNA, 22 bp, Homo sapiens
tgcccagccagtttatggtaat

SEQ ID NO: 9113302 - DNA, 22 bp, Homo sapiens
tgcccagccaatttgttatgtt

SEQ ID NO: 9113303 - DNA, 22 bp, Homo sapiens
tgcccagccaatttgttatgtt

SEQ ID NO: 9113304 - DNA, 23 bp, Homo sapiens
cccaggctacaaattatgctctg

SEQ ID NO: 9113305 - DNA, 23 bp, Homo sapiens
cccaggctacaaattatgctctg

SEQ ID NO: 9113306 - DNA, 22 bp, Homo sapiens
cccaggcagtgtgtgcatgcgt

SEQ ID NO: 9113307 - DNA, 22 bp, Homo sapiens
tgcccagctgtcaaagtagata

SEQ ID NO: 9113308 - DNA, 22 bp, Homo sapiens
cccaggcagtgtgtgcatgcgt

SEQ ID NO: 9113309 - DNA, 22 bp, Homo sapiens
cccaggcagtgtgtgcatgcgt

SEQ ID NO: 9113310 - DNA, 22 bp, Homo sapiens
tgcccagctattcctttcttag

SEQ ID NO: 9113311 - DNA, 22 bp, Homo sapiens
tgcccagcgcccacattctgtc

SEQ ID NO: 9113312 - DNA, 22 bp, Homo sapiens
tgcccagcctaaacttggcaag

SEQ ID NO: 9113313 - DNA, 22 bp, Homo sapiens
tgcccagcccctatccctggga

SEQ ID NO: 9113314 - DNA, 22 bp, Homo sapiens
tgcccagcctaaacttggcaag

SEQ ID NO: 9113315 - DNA, 22 bp, Homo sapiens
tgcccagcctaaacttggcaag

SEQ ID NO: 9113316 - DNA, 22 bp, Homo sapiens
cccgcagtcggaatttctcagt

SEQ ID NO: 9113317 - DNA, 22 bp, Homo sapiens
cccgagtgtctactcactccca

SEQ ID NO: 9113318 - DNA, 22 bp, Homo sapiens
cccgactagctgggattacagg

SEQ ID NO: 9113319 - DNA, 22 bp, Homo sapiens
ccccttctctgcaagcctgctc

SEQ ID NO: 9113320 - DNA, 22 bp, Homo sapiens
ccccttctggtcttcaatggtg

SEQ ID NO: 9113321 - DNA, 22 bp, Homo sapiens
ccccttctgtgtcctgtcagcc

SEQ ID NO: 9113322 - DNA, 22 bp, Homo sapiens
cccctttctcccgcgtctggcc

SEQ ID NO: 9113323 - DNA, 22 bp, Homo sapiens
cccctttctcccgcgtctggcc

SEQ ID NO: 9113324 - DNA, 22 bp, Homo sapiens
cccctttctcccgcgactggcc

SEQ ID NO: 9113325 - DNA, 22 bp, Homo sapiens
tgctggctttttggtccttgct

SEQ ID NO: 9113326 - DNA, 22 bp, Homo sapiens
tgctggctttttggtccttgct

SEQ ID NO: 9113327 - DNA, 22 bp, Homo sapiens
tgctggctttttggtccttgct

SEQ ID NO: 9113328 - DNA, 22 bp, Homo sapiens
tgctggctttttgtgtcaaaga

SEQ ID NO: 9113329 - DNA, 22 bp, Homo sapiens
ccccttccttcctcagacagcc

SEQ ID NO: 9113330 - DNA, 23 bp, Homo sapiens
cccctctggtggctcagctcctg

SEQ ID NO: 9113331 - DNA, 23 bp, Homo sapiens
cccctctggtggctcagctcctg

SEQ ID NO: 9113332 - DNA, 22 bp, Homo sapiens
cccctcttggcattgagtgcca

SEQ ID NO: 9113333 - DNA, 23 bp, Homo sapiens
tgctggcttttatctggtcccta

SEQ ID NO: 9113334 - DNA, 22 bp, Homo sapiens
tgctggcttttccttcaggcag

SEQ ID NO: 9113335 - DNA, 22 bp, Homo sapiens
tgctggctttctgtccctggca

SEQ ID NO: 9113336 - DNA, 22 bp, Homo sapiens
tgctggctttagtgattggggt

SEQ ID NO: 9113337 - DNA, 22 bp, Homo sapiens
tgctggctttctgtccctggca

SEQ ID NO: 9113338 - DNA, 22 bp, Homo sapiens
tgctggctttgcgagatgcatt

SEQ ID NO: 9113339 - DNA, 23 bp, Homo sapiens
tgctggctaagaatctgcatttt

SEQ ID NO: 9113340 - DNA, 22 bp, Homo sapiens
tgctggctacattattgctgtc

SEQ ID NO: 9113341 - DNA, 22 bp, Homo sapiens
tgctggctaatggaaaccagat

SEQ ID NO: 9113342 - DNA, 22 bp, Homo sapiens
tgctggctttagtgattggggt

SEQ ID NO: 9113343 - DNA, 22 bp, Homo sapiens
tgctggctttaaggttaaagtg

SEQ ID NO: 9113344 - DNA, 22 bp, Homo sapiens
tgctggctttaaggttaaagtg

SEQ ID NO: 9113345 - DNA, 22 bp, Homo sapiens
tgctggccggccaggtgctgag

SEQ ID NO: 9113346 - DNA, 22 bp, Homo sapiens
tgctggcccatgaagacgcagt

SEQ ID NO: 9113347 - DNA, 22 bp, Homo sapiens
tgctggcccatgaagacgcagt

SEQ ID NO: 9113348 - DNA, 22 bp, Homo sapiens
tgctggccctggctcagggaac

SEQ ID NO: 9113349 - DNA, 22 bp, Homo sapiens
tgctggcctcggcgctgggcct

SEQ ID NO: 9113350 - DNA, 22 bp, Homo sapiens
tgctggcctgggctgcaccttg

SEQ ID NO: 9113351 - DNA, 22 bp, Homo sapiens
tgctggcctggttagaaagggg

SEQ ID NO: 9113352 - DNA, 22 bp, Homo sapiens
cccaggtctatgccagctctga

SEQ ID NO: 9113353 - DNA, 22 bp, Homo sapiens
cccagttgttgccggctctgga

SEQ ID NO: 9113354 - DNA, 22 bp, Homo sapiens
cccagttgttgccggctctgga

SEQ ID NO: 9113355 - DNA, 22 bp, Homo sapiens
cccaggtctccctgcagccctg

SEQ ID NO: 9113356 - DNA, 22 bp, Homo sapiens
cccagttgttgccggctctgga

SEQ ID NO: 9113357 - DNA, 22 bp, Homo sapiens
cccaggtcccgccccagctcta

SEQ ID NO: 9113358 - DNA, 22 bp, Homo sapiens
cccaggtccccacctgtctgct

SEQ ID NO: 9113359 - DNA, 22 bp, Homo sapiens
cccaggtccccacctgtctgct

SEQ ID NO: 9113360 - DNA, 22 bp, Homo sapiens
cccaggtcccggggccagctgc

SEQ ID NO: 9113361 - DNA, 21 bp, Homo sapiens
cccaggtcgtggtcttcccag

SEQ ID NO: 9113362 - DNA, 22 bp, Homo sapiens
cccattgcccaaatagtaaaca

SEQ ID NO: 9113363 - DNA, 22 bp, Homo sapiens
cccattcttcatggtttcctgt

SEQ ID NO: 9113364 - DNA, 22 bp, Homo sapiens
ccccaaaacttggtgacttcca

SEQ ID NO: 9113365 - DNA, 18 bp, Homo sapiens
ccccaaaagtcaccctgg

SEQ ID NO: 9113366 - DNA, 22 bp, Homo sapiens
ccccaaaattcttaagttgaat

SEQ ID NO: 9113367 - DNA, 22 bp, Homo sapiens
ccccaaaacttagtgacttaaa

SEQ ID NO: 9113368 - DNA, 22 bp, Homo sapiens
ccccaaccctggttccgtggcg

SEQ ID NO: 9113369 - DNA, 20 bp, Homo sapiens
ccccacactattgagcactt

SEQ ID NO: 9113370 - DNA, 19 bp, Homo sapiens
ccccaaagtttagatgttg

SEQ ID NO: 9113371 - DNA, 22 bp, Homo sapiens
ccccaaggtgctcactgtctgg

SEQ ID NO: 9113372 - DNA, 22 bp, Homo sapiens
ccccaaggtgctcactgtctgg

SEQ ID NO: 9113373 - DNA, 22 bp, Homo sapiens
ccccacaggtgtctgaggcagg

SEQ ID NO: 9113374 - DNA, 22 bp, Homo sapiens
ccccacagccgccagcagggag

SEQ ID NO: 9113375 - DNA, 22 bp, Homo sapiens
ccccaccctcgctccatttcgg

SEQ ID NO: 9113376 - DNA, 22 bp, Homo sapiens
tgctggccaagcagaggtcaat

SEQ ID NO: 9113377 - DNA, 21 bp, Homo sapiens
tgctggccatgtgctgggcat

SEQ ID NO: 9113378 - DNA, 22 bp, Homo sapiens
tgctggccaatggcagaggcgg

SEQ ID NO: 9113379 - DNA, 22 bp, Homo sapiens
ccccaccagcaccctctctatc

SEQ ID NO: 9113380 - DNA, 22 bp, Homo sapiens
tggaatgtcaagaagcagtaag

SEQ ID NO: 9113381 - DNA, 22 bp, Homo sapiens
tggaatgtcagctacaagaggg

SEQ ID NO: 9113382 - DNA, 20 bp, Homo sapiens
tggaatgggtccttgaaaaa

SEQ ID NO: 9113383 - DNA, 22 bp, Homo sapiens
tggaatgtaatcagaatatgaa

SEQ ID NO: 9113384 - DNA, 22 bp, Homo sapiens
tggaatgtggtatcagtagaaa

SEQ ID NO: 9113385 - DNA, 22 bp, Homo sapiens
ccctcctctccctaagagtcac

SEQ ID NO: 9113386 - DNA, 22 bp, Homo sapiens
ccctcctctccctaagagtcac

SEQ ID NO: 9113387 - DNA, 22 bp, Homo sapiens
ccctcgtgcatccatcatttag

SEQ ID NO: 9113388 - DNA, 22 bp, Homo sapiens
tgctgtggttcccagagtggat

SEQ ID NO: 9113389 - DNA, 22 bp, Homo sapiens
tgctgtggattcagagatgaaa

SEQ ID NO: 9113390 - DNA, 18 bp, Homo sapiens
cccggctaatttttggta

SEQ ID NO: 9113391 - DNA, 18 bp, Homo sapiens
cccggctaatttttggta

SEQ ID NO: 9113392 - DNA, 23 bp, Homo sapiens
tgctgtgcctttgtctgcctcca

SEQ ID NO: 9113393 - DNA, 22 bp, Homo sapiens
tgctgtgctccattgtcttcac

SEQ ID NO: 9113394 - DNA, 22 bp, Homo sapiens
tggaagggagctggaatttgga

SEQ ID NO: 9113395 - DNA, 22 bp, Homo sapiens
ccctctctcaggctgacagcct

SEQ ID NO: 9113396 - DNA, 22 bp, Homo sapiens
ccctctctcaggctgacagcct

SEQ ID NO: 9113397 - DNA, 19 bp, Homo sapiens
ccctcttgcacaaagcaaa

SEQ ID NO: 9113398 - DNA, 22 bp, Homo sapiens
ccctcttgctgactcttaaagg

SEQ ID NO: 9113399 - DNA, 18 bp, Homo sapiens
ccctctcctgctagtggg

SEQ ID NO: 9113400 - DNA, 22 bp, Homo sapiens
ccctctacagggaagcgctttc

SEQ ID NO: 9113401 - DNA, 22 bp, Homo sapiens
ccctctcagtcagagccagata

SEQ ID NO: 9113402 - DNA, 22 bp, Homo sapiens
ccctgaccagcagtacttggta

SEQ ID NO: 9113403 - DNA, 18 bp, Homo sapiens
ccctgaagggcaagataa

SEQ ID NO: 9113404 - DNA, 22 bp, Homo sapiens
ccctgaccaccagctccatttg

SEQ ID NO: 9113405 - DNA, 22 bp, Homo sapiens
ccctgaccccacggctggagaa

SEQ ID NO: 9113406 - DNA, 22 bp, Homo sapiens
ccctgacccaaaactgtcagaa

SEQ ID NO: 9113407 - DNA, 22 bp, Homo sapiens
ccctgagaacaacttaggggtc

SEQ ID NO: 9113408 - DNA, 22 bp, Homo sapiens
ccctgagaagatcattgccacg

SEQ ID NO: 9113409 - DNA, 20 bp, Homo sapiens
ccctgagacaaaggaggggc

SEQ ID NO: 9113410 - DNA, 22 bp, Homo sapiens
ccctgagagcagggtctttctc

SEQ ID NO: 9113411 - DNA, 20 bp, Homo sapiens
ccctgagacgactgagctcc

SEQ ID NO: 9113412 - DNA, 20 bp, Homo sapiens
ccctgagacgactgagctcc

SEQ ID NO: 9113413 - DNA, 20 bp, Homo sapiens
ccctgagacgactgagctcc

SEQ ID NO: 9113414 - DNA, 20 bp, Homo sapiens
ccctgagacaaaggaggggc

SEQ ID NO: 9113415 - DNA, 20 bp, Homo sapiens
ccctgagacaaaggaggggc

SEQ ID NO: 9113416 - DNA, 20 bp, Homo sapiens
ccctgagaccagagagcagc

SEQ ID NO: 9113417 - DNA, 20 bp, Homo sapiens
ccctgagaccagagagcagc

SEQ ID NO: 9113418 - DNA, 22 bp, Homo sapiens
ccctgagatgcctcaccctagt

SEQ ID NO: 9113419 - DNA, 18 bp, Homo sapiens
ccctgagatgatgctgtg

SEQ ID NO: 9113420 - DNA, 22 bp, Homo sapiens
ccctgagagtgagtgccacctt

SEQ ID NO: 9113421 - DNA, 22 bp, Homo sapiens
ccctgagagtgagtgccacctt

SEQ ID NO: 9113422 - DNA, 22 bp, Homo sapiens
ccctgagaggttgagtgtctgc

SEQ ID NO: 9113423 - DNA, 22 bp, Homo sapiens
ccctgagatgcctcaccctagt

SEQ ID NO: 9113424 - DNA, 22 bp, Homo sapiens
ccctgagcacacctggcagaca

SEQ ID NO: 9113425 - DNA, 22 bp, Homo sapiens
ccctgagcagtctgcagagagc

SEQ ID NO: 9113426 - DNA, 22 bp, Homo sapiens
ccctgagccacacagagcaggt

SEQ ID NO: 9113427 - DNA, 22 bp, Homo sapiens
ccctgagcgtgaggaggaagta

SEQ ID NO: 9113428 - DNA, 22 bp, Homo sapiens
ccctgagcccatagttgacatt

SEQ ID NO: 9113429 - DNA, 22 bp, Homo sapiens
ccctgagcattcatgtgagctt

SEQ ID NO: 9113430 - DNA, 22 bp, Homo sapiens
ccctgagcagtctgcagagagc

SEQ ID NO: 9113431 - DNA, 22 bp, Homo sapiens
tggagcaggactgctgccctca

SEQ ID NO: 9113432 - DNA, 22 bp, Homo sapiens
tggagcaggcatctttctctct

SEQ ID NO: 9113433 - DNA, 23 bp, Homo sapiens
ccctgagctggtccaggctcaac

SEQ ID NO: 9113434 - DNA, 22 bp, Homo sapiens
tggagcaagctggagagaacat

SEQ ID NO: 9113435 - DNA, 22 bp, Homo sapiens
ccaggctgaatatgttccaggg

SEQ ID NO: 9113436 - DNA, 22 bp, Homo sapiens
ccaggctgaatatgttccaggg

SEQ ID NO: 9113437 - DNA, 22 bp, Homo sapiens
ccaggctgaatatgttccaggg

SEQ ID NO: 9113438 - DNA, 23 bp, Homo sapiens
ccaggctctttcacctgctattc

SEQ ID NO: 9113439 - DNA, 22 bp, Homo sapiens
ccaggctctgttccccgaggag

SEQ ID NO: 9113440 - DNA, 22 bp, Homo sapiens
ccaggcctggaccatgccaggg

SEQ ID NO: 9113441 - DNA, 22 bp, Homo sapiens
ccaggcctggaccatgccaggg

SEQ ID NO: 9113442 - DNA, 22 bp, Homo sapiens
ccaggcctggaccatgccaggg

SEQ ID NO: 9113443 - DNA, 22 bp, Homo sapiens
ccaggcctggacgggtggcctg

SEQ ID NO: 9113444 - DNA, 22 bp, Homo sapiens
ccaggcctggacgggtggcctg

SEQ ID NO: 9113445 - DNA, 22 bp, Homo sapiens
ccaggcctggacgggtggcctg

SEQ ID NO: 9113446 - DNA, 22 bp, Homo sapiens
ccaggctctgtctggtcagaag

SEQ ID NO: 9113447 - DNA, 22 bp, Homo sapiens
ccaggcctggccaggggatgcc

SEQ ID NO: 9113448 - DNA, 22 bp, Homo sapiens
ccaggcctggccaggggatgcc

SEQ ID NO: 9113449 - DNA, 21 bp, Homo sapiens
ccaggctcctgaggctggtca

SEQ ID NO: 9113450 - DNA, 19 bp, Homo sapiens
tctttggctaaattgggtg

SEQ ID NO: 9113451 - DNA, 22 bp, Homo sapiens
tctttgggctaggagtttggat

SEQ ID NO: 9113452 - DNA, 22 bp, Homo sapiens
tctttggggcatctgggagatt

SEQ ID NO: 9113453 - DNA, 22 bp, Homo sapiens
ccaggctgagcatgattggagc

SEQ ID NO: 9113454 - DNA, 22 bp, Homo sapiens
ccaggctggagtgcaatggcgt

SEQ ID NO: 9113455 - DNA, 22 bp, Homo sapiens
ccaggctggagtgcaatggcgt

SEQ ID NO: 9113456 - DNA, 22 bp, Homo sapiens
ccaggctggagtgcaatggtgc

SEQ ID NO: 9113457 - DNA, 22 bp, Homo sapiens
ccaggctggagtgcaatggcat

SEQ ID NO: 9113458 - DNA, 22 bp, Homo sapiens
ccaggctgctgttggtgtccgc

SEQ ID NO: 9113459 - DNA, 22 bp, Homo sapiens
ccaggctgctgttggtgtccgc

SEQ ID NO: 9113460 - DNA, 22 bp, Homo sapiens
ccaggctggagtgcaatggcat

SEQ ID NO: 9113461 - DNA, 22 bp, Homo sapiens
ccaggctgctgttggtgtccgc

SEQ ID NO: 9113462 - DNA, 22 bp, Homo sapiens
tctttggtgatatctctttggt

SEQ ID NO: 9113463 - DNA, 22 bp, Homo sapiens
tctttcttcagccctgtaagat

SEQ ID NO: 9113464 - DNA, 22 bp, Homo sapiens
tctttcttcagccctgtaagat

SEQ ID NO: 9113465 - DNA, 22 bp, Homo sapiens
tctttcttggtataaagcaggg

SEQ ID NO: 9113466 - DNA, 22 bp, Homo sapiens
tctttcttggtataaagcaggg

SEQ ID NO: 9113467 - DNA, 22 bp, Homo sapiens
tctttcttggtattctgagcta

SEQ ID NO: 9113468 - DNA, 22 bp, Homo sapiens
ccaggcctgcatctgctgcgca

SEQ ID NO: 9113469 - DNA, 22 bp, Homo sapiens
ccaggcctgcatctgctgcgca

SEQ ID NO: 9113470 - DNA, 22 bp, Homo sapiens
ccaggcctgcattccctctcag

SEQ ID NO: 9113471 - DNA, 22 bp, Homo sapiens
ccaggcctgcattccctctcag

SEQ ID NO: 9113472 - DNA, 22 bp, Homo sapiens
ccaggcctgcattccctctcag

SEQ ID NO: 9113473 - DNA, 19 bp, Homo sapiens
ccaggcctgcgggcgttgg

SEQ ID NO: 9113474 - DNA, 19 bp, Homo sapiens
ccaggcctgcgggcgttgg

SEQ ID NO: 9113475 - DNA, 19 bp, Homo sapiens
ccaggcctgcgggcgttgg

SEQ ID NO: 9113476 - DNA, 22 bp, Homo sapiens
ccaggcctgcatctgctgcgca

SEQ ID NO: 9113477 - DNA, 22 bp, Homo sapiens
ccaggcctggaccatgccaggg

SEQ ID NO: 9113478 - DNA, 22 bp, Homo sapiens
ccaggcctggaccatgccaggg

SEQ ID NO: 9113479 - DNA, 22 bp, Homo sapiens
tctttgaaaagatattcctcct

SEQ ID NO: 9113480 - DNA, 22 bp, Homo sapiens
tctttgaaacaccctaaccttt

SEQ ID NO: 9113481 - DNA, 22 bp, Homo sapiens
ccaggcctgcatctgctgcgca

SEQ ID NO: 9113482 - DNA, 22 bp, Homo sapiens
ccaggcctgcatctgctgcgca

SEQ ID NO: 9113483 - DNA, 22 bp, Homo sapiens
tctttgaaagctgttctagagt

SEQ ID NO: 9113484 - DNA, 19 bp, Homo sapiens
ccaggccatcccagttccc

SEQ ID NO: 9113485 - DNA, 19 bp, Homo sapiens
ccaggccatcccagttccc

SEQ ID NO: 9113486 - DNA, 22 bp, Homo sapiens
ccaggccagtgtttggtccagg

SEQ ID NO: 9113487 - DNA, 22 bp, Homo sapiens
ccaggccattcccagagttgct

SEQ ID NO: 9113488 - DNA, 18 bp, Homo sapiens
ccaggccatgaacctctg

SEQ ID NO: 9113489 - DNA, 22 bp, Homo sapiens
ccaggccagggctgcagcgagc

SEQ ID NO: 9113490 - DNA, 22 bp, Homo sapiens
ccaggccccagggctggctttc

SEQ ID NO: 9113491 - DNA, 22 bp, Homo sapiens
ccaggcccaccttggccactta

SEQ ID NO: 9113492 - DNA, 22 bp, Homo sapiens
ccaggcccaccttggccactta

SEQ ID NO: 9113493 - DNA, 22 bp, Homo sapiens
ccaggcccagggtactgaccaa

SEQ ID NO: 9113494 - DNA, 22 bp, Homo sapiens
ccaggagacccagggaaggagc

SEQ ID NO: 9113495 - DNA, 22 bp, Homo sapiens
ccaggaggttgaggctgcagtg

SEQ ID NO: 9113496 - DNA, 22 bp, Homo sapiens
ccaggaggttgaggctgcagtg

SEQ ID NO: 9113497 - DNA, 22 bp, Homo sapiens
ccaggaggttgaggctgcagtg

SEQ ID NO: 9113498 - DNA, 22 bp, Homo sapiens
ccaggaggttgaggctgcagtg

SEQ ID NO: 9113499 - DNA, 22 bp, Homo sapiens
ccaggagtcaataaaggaagct

SEQ ID NO: 9113500 - DNA, 22 bp, Homo sapiens
ccaggatctgatattgggctcc

SEQ ID NO: 9113501 - DNA, 22 bp, Homo sapiens
ccaggatctgtacacctctgag

SEQ ID NO: 9113502 - DNA, 22 bp, Homo sapiens
ccaggatctgggtccatgggac

SEQ ID NO: 9113503 - DNA, 22 bp, Homo sapiens
ccaggatggggagcagatagaa

SEQ ID NO: 9113504 - DNA, 22 bp, Homo sapiens
ccaggagttggaggctgcagtg

SEQ ID NO: 9113505 - DNA, 22 bp, Homo sapiens
ccaggagttggaggctgcagtg

SEQ ID NO: 9113506 - DNA, 22 bp, Homo sapiens
ccaggagtttgaggctgcagtg

SEQ ID NO: 9113507 - DNA, 22 bp, Homo sapiens
ccaggagtttgaggctgcagtg

SEQ ID NO: 9113508 - DNA, 22 bp, Homo sapiens
ccaggagttggaggttgcagtg

SEQ ID NO: 9113509 - DNA, 22 bp, Homo sapiens
tcttcacattttagtggtttgt

SEQ ID NO: 9113510 - DNA, 22 bp, Homo sapiens
tcttcacatggaacatgaagct

SEQ ID NO: 9113511 - DNA, 21 bp, Homo sapiens
tcttccctcaggatgtcctgc

SEQ ID NO: 9113512 - DNA, 22 bp, Homo sapiens
tcttcccccgtgctccagtgca

SEQ ID NO: 9113513 - DNA, 22 bp, Homo sapiens
tcttcccccgtgctccagtgca

SEQ ID NO: 9113514 - DNA, 22 bp, Homo sapiens
tcttcccattagtaatgaagtg

SEQ ID NO: 9113515 - DNA, 22 bp, Homo sapiens
tcttcctagaaggaagaaatct

SEQ ID NO: 9113516 - DNA, 22 bp, Homo sapiens
ccaggccagcgctggctggagg

SEQ ID NO: 9113517 - DNA, 22 bp, Homo sapiens
ccaggccagcgctggctggagg

SEQ ID NO: 9113518 - DNA, 22 bp, Homo sapiens
ccaggccagcaggcacacctgc

SEQ ID NO: 9113519 - DNA, 22 bp, Homo sapiens
ccaggccagagtgcagtggcac

SEQ ID NO: 9113520 - DNA, 22 bp, Homo sapiens
ccaggccagagtgcagtggcac

SEQ ID NO: 9113521 - DNA, 22 bp, Homo sapiens
tcttcagagactctgagcccct

SEQ ID NO: 9113522 - DNA, 22 bp, Homo sapiens
tcttcagagactctgagcccct

SEQ ID NO: 9113523 - DNA, 22 bp, Homo sapiens
tcttccagtctgtaggactagg

SEQ ID NO: 9113524 - DNA, 22 bp, Homo sapiens
tcttcagataaagggagagtat

SEQ ID NO: 9113525 - DNA, 22 bp, Homo sapiens
tcttcagagtgagcagtgtcat

SEQ ID NO: 9113526 - DNA, 22 bp, Homo sapiens
tctggtgtcagtattctttgaa

SEQ ID NO: 9113527 - DNA, 20 bp, Homo sapiens
tctggtgccccttcctgaga

SEQ ID NO: 9113528 - DNA, 20 bp, Homo sapiens
tctggtccaggtcttcatgg

SEQ ID NO: 9113529 - DNA, 22 bp, Homo sapiens
tctggtccctgctcacttcttg

SEQ ID NO: 9113530 - DNA, 22 bp, Homo sapiens
tctggtcccttttcctgcagtc

SEQ ID NO: 9113531 - DNA, 22 bp, Homo sapiens
tctggtcctctctgtgatgcta

SEQ ID NO: 9113532 - DNA, 22 bp, Homo sapiens
ccaggacttcgaggctacagtg

SEQ ID NO: 9113533 - DNA, 22 bp, Homo sapiens
ccaggactttaagtccagcact

SEQ ID NO: 9113534 - DNA, 22 bp, Homo sapiens
ccaggagaataatggcagatta

SEQ ID NO: 9113535 - DNA, 22 bp, Homo sapiens
tctgggagcagctcagcagatt

SEQ ID NO: 9113536 - DNA, 22 bp, Homo sapiens
tctgggagcctgaaagtgaatg

SEQ ID NO: 9113537 - DNA, 22 bp, Homo sapiens
tctggtaacctttatccctcct

SEQ ID NO: 9113538 - DNA, 21 bp, Homo sapiens
ccaggactccatggggtctct

SEQ ID NO: 9113539 - DNA, 22 bp, Homo sapiens
ccaggactcaatgaccacaggg

SEQ ID NO: 9113540 - DNA, 22 bp, Homo sapiens
tctgggagcacacgcagtgatc

SEQ ID NO: 9113541 - DNA, 22 bp, Homo sapiens
tctgggagatccaagcagaact

SEQ ID NO: 9113542 - DNA, 22 bp, Homo sapiens
tctgggagatccaagcagaact

SEQ ID NO: 9113543 - DNA, 22 bp, Homo sapiens
tctgggagcacacgcagtgatc

SEQ ID NO: 9113544 - DNA, 22 bp, Homo sapiens
tctggcctactggagtccatga

SEQ ID NO: 9113545 - DNA, 22 bp, Homo sapiens
tctggcctatttctgtcagatc

SEQ ID NO: 9113546 - DNA, 22 bp, Homo sapiens
tctggccctgctgctgtgagca

SEQ ID NO: 9113547 - DNA, 22 bp, Homo sapiens
tctggcaggggttctgcacttg

SEQ ID NO: 9113548 - DNA, 22 bp, Homo sapiens
tctggcaggggttctgcacttg

SEQ ID NO: 9113549 - DNA, 22 bp, Homo sapiens
tctggcctcctccaccagggaa

SEQ ID NO: 9113550 - DNA, 22 bp, Homo sapiens
tctggcctcttgggatgctccc

SEQ ID NO: 9113551 - DNA, 22 bp, Homo sapiens
tctggcctcttgggatgctccc

SEQ ID NO: 9113552 - DNA, 22 bp, Homo sapiens
tctggcctcttgggatgctccc

SEQ ID NO: 9113553 - DNA, 22 bp, Homo sapiens
tctggcctgaaagtccatgctt

SEQ ID NO: 9113554 - DNA, 22 bp, Homo sapiens
tctggcctgggcctgccggtgc

SEQ ID NO: 9113555 - DNA, 22 bp, Homo sapiens
tctggcctgtgttggtggcccc

SEQ ID NO: 9113556 - DNA, 22 bp, Homo sapiens
tctggccttatctgtccaagcc

SEQ ID NO: 9113557 - DNA, 22 bp, Homo sapiens
tctggccttatctgtccaagcc

SEQ ID NO: 9113558 - DNA, 22 bp, Homo sapiens
tctggcagctatcctctggcca

SEQ ID NO: 9113559 - DNA, 22 bp, Homo sapiens
tctggcagctatcctctggcca

SEQ ID NO: 9113560 - DNA, 22 bp, Homo sapiens
tctggcaggacatgctgaccat

SEQ ID NO: 9113561 - DNA, 21 bp, Homo sapiens
ccaggaaggactgagctccct

SEQ ID NO: 9113562 - DNA, 21 bp, Homo sapiens
ccaggaaggactgagctccct

SEQ ID NO: 9113563 - DNA, 17 bp, Homo sapiens
tctggccttcctgaact

SEQ ID NO: 9113564 - DNA, 22 bp, Homo sapiens
tctggctagattgatgagtccc

SEQ ID NO: 9113565 - DNA, 22 bp, Homo sapiens
tctggctcacttcaggcttcac

SEQ ID NO: 9113566 - DNA, 22 bp, Homo sapiens
tctggctcaaaatacgtactct

SEQ ID NO: 9113567 - DNA, 22 bp, Homo sapiens
tctggctcagggctctgaggga

SEQ ID NO: 9113568 - DNA, 22 bp, Homo sapiens
tctggctcagggctctgaggga

SEQ ID NO: 9113569 - DNA, 22 bp, Homo sapiens
tctggctcaggagctgtgttca

SEQ ID NO: 9113570 - DNA, 22 bp, Homo sapiens
tctggctcacttcaggcttcac

SEQ ID NO: 9113571 - DNA, 18 bp, Homo sapiens
tctggctcaggactgaac

SEQ ID NO: 9113572 - DNA, 22 bp, Homo sapiens
ccagctctgattttgacctcca

SEQ ID NO: 9113573 - DNA, 22 bp, Homo sapiens
ccagctctgattttgacctcca

SEQ ID NO: 9113574 - DNA, 22 bp, Homo sapiens
ccagctctgcagggcctggggt

SEQ ID NO: 9113575 - DNA, 22 bp, Homo sapiens
ccagctctgattttgacctcca

SEQ ID NO: 9113576 - DNA, 22 bp, Homo sapiens
ccagctctgcatgtttcccttg

SEQ ID NO: 9113577 - DNA, 22 bp, Homo sapiens
ccagctctgccaagcgtcagct

SEQ ID NO: 9113578 - DNA, 22 bp, Homo sapiens
ccagctctctgcagaaaggact

SEQ ID NO: 9113579 - DNA, 22 bp, Homo sapiens
ccagctctctgcagaaaggact

SEQ ID NO: 9113580 - DNA, 22 bp, Homo sapiens
ccagctctctgtcctccccaca

SEQ ID NO: 9113581 - DNA, 22 bp, Homo sapiens
ccagctctctgtcctccccaca

SEQ ID NO: 9113582 - DNA, 22 bp, Homo sapiens
ccagctctgattttgacctcca

SEQ ID NO: 9113583 - DNA, 22 bp, Homo sapiens
ccagctgaggcagccacacagg

SEQ ID NO: 9113584 - DNA, 22 bp, Homo sapiens
ccagctctgccaagcgtcagct

SEQ ID NO: 9113585 - DNA, 20 bp, Homo sapiens
ccagctgagccaaggggaga

SEQ ID NO: 9113586 - DNA, 22 bp, Homo sapiens
ccagctctgccaagcgtcagct

SEQ ID NO: 9113587 - DNA, 22 bp, Homo sapiens
ccagctgattcggtggtggttg

SEQ ID NO: 9113588 - DNA, 22 bp, Homo sapiens
ccagctgcaggggagcagtgga

SEQ ID NO: 9113589 - DNA, 22 bp, Homo sapiens
ccagctgcaggggagcagtgga

SEQ ID NO: 9113590 - DNA, 22 bp, Homo sapiens
ccagctgcaggtgttccagatg

SEQ ID NO: 9113591 - DNA, 22 bp, Homo sapiens
ccagctgcatcctattcactgc

SEQ ID NO: 9113592 - DNA, 22 bp, Homo sapiens
ccagctgcgggcatcgagagtt

SEQ ID NO: 9113593 - DNA, 22 bp, Homo sapiens
ccagctgctgtgaggaccacag

SEQ ID NO: 9113594 - DNA, 22 bp, Homo sapiens
ccagctgctgacatgggcaggt

SEQ ID NO: 9113595 - DNA, 22 bp, Homo sapiens
ccagctctcagcgggagactca

SEQ ID NO: 9113596 - DNA, 22 bp, Homo sapiens
ccagctctcagcgggagactca

SEQ ID NO: 9113597 - DNA, 22 bp, Homo sapiens
ccagctctcagcgggagactca

SEQ ID NO: 9113598 - DNA, 22 bp, Homo sapiens
ccagctctcagcgggagactca

SEQ ID NO: 9113599 - DNA, 22 bp, Homo sapiens
tctgctttgctgcctcctgatc

SEQ ID NO: 9113600 - DNA, 22 bp, Homo sapiens
tctggaaagatcattaaatcca

SEQ ID NO: 9113601 - DNA, 22 bp, Homo sapiens
tctgctttttcattgactgaaa

SEQ ID NO: 9113602 - DNA, 22 bp, Homo sapiens
tctgctttcttgcgcagatgtg

SEQ ID NO: 9113603 - DNA, 22 bp, Homo sapiens
tctgctttcttgcgcagatgtg

SEQ ID NO: 9113604 - DNA, 22 bp, Homo sapiens
tctgctttcttgcgcagatgtg

SEQ ID NO: 9113605 - DNA, 22 bp, Homo sapiens
tctgctttgctgcctcctgatc

SEQ ID NO: 9113606 - DNA, 22 bp, Homo sapiens
tctgctttattacactagccaa

SEQ ID NO: 9113607 - DNA, 22 bp, Homo sapiens
tctgctttagtgcaaagtctta

SEQ ID NO: 9113608 - DNA, 22 bp, Homo sapiens
tctgctttagaatccagtagct

SEQ ID NO: 9113609 - DNA, 22 bp, Homo sapiens
tctgctttagaatccagtagct

SEQ ID NO: 9113610 - DNA, 22 bp, Homo sapiens
tctcagagaacagttggtgctt

SEQ ID NO: 9113611 - DNA, 22 bp, Homo sapiens
tctcagaatccttgcccaggtg

SEQ ID NO: 9113612 - DNA, 22 bp, Homo sapiens
tctcagaattgtgtccactggg

SEQ ID NO: 9113613 - DNA, 22 bp, Homo sapiens
tctcagaagtgatcaggatgtt

SEQ ID NO: 9113614 - DNA, 22 bp, Homo sapiens
ccagagagagaggtcaatggca

SEQ ID NO: 9113615 - DNA, 22 bp, Homo sapiens
ccagagagaaatggatttgagt

SEQ ID NO: 9113616 - DNA, 22 bp, Homo sapiens
ccagagacgtcggtcagggcgc

SEQ ID NO: 9113617 - DNA, 22 bp, Homo sapiens
ccagagaccagaacatggggat

SEQ ID NO: 9113618 - DNA, 22 bp, Homo sapiens
ccagagagaaaatggagggcca

SEQ ID NO: 9113619 - DNA, 22 bp, Homo sapiens
ccagagactggctgagagatct

SEQ ID NO: 9113620 - DNA, 22 bp, Homo sapiens
ccagagagaaaatggagggcca

SEQ ID NO: 9113621 - DNA, 22 bp, Homo sapiens
tgcacacattaaggatacacag

SEQ ID NO: 9113622 - DNA, 22 bp, Homo sapiens
tgcacacattctatggggctga

SEQ ID NO: 9113623 - DNA, 22 bp, Homo sapiens
tgcacacattctatggggctga

SEQ ID NO: 9113624 - DNA, 22 bp, Homo sapiens
tgcacacctctccaccactctc

SEQ ID NO: 9113625 - DNA, 22 bp, Homo sapiens
tgcacacattctatggggctga

SEQ ID NO: 9113626 - DNA, 22 bp, Homo sapiens
tgcacacatgtttacaagcatc

SEQ ID NO: 9113627 - DNA, 22 bp, Homo sapiens
tgcacacatgtttacaagcatc

SEQ ID NO: 9113628 - DNA, 22 bp, Homo sapiens
tgcacacatgtttacaagcatc

SEQ ID NO: 9113629 - DNA, 22 bp, Homo sapiens
tgcacacatgtatgtatatgtg

SEQ ID NO: 9113630 - DNA, 22 bp, Homo sapiens
cccagactcatccctgggagct

SEQ ID NO: 9113631 - DNA, 22 bp, Homo sapiens
cccagacagtcaagaggcctgc

SEQ ID NO: 9113632 - DNA, 22 bp, Homo sapiens
cccagacataacagcagagagg

SEQ ID NO: 9113633 - DNA, 22 bp, Homo sapiens
cccagacataacagcagagagg

SEQ ID NO: 9113634 - DNA, 22 bp, Homo sapiens
cccagaaggtcgaggctgcagt

SEQ ID NO: 9113635 - DNA, 22 bp, Homo sapiens
cccagaaggcttgccaggaagc

SEQ ID NO: 9113636 - DNA, 22 bp, Homo sapiens
cccacccctggacaggtgagtg

SEQ ID NO: 9113637 - DNA, 22 bp, Homo sapiens
cccactgtggaagaaaggggag

SEQ ID NO: 9113638 - DNA, 22 bp, Homo sapiens
cccactgtgttgctgttaatct

SEQ ID NO: 9113639 - DNA, 22 bp, Homo sapiens
cccactgtgttgcagtctagtg

SEQ ID NO: 9113640 - DNA, 22 bp, Homo sapiens
cccactgtttccctgaggctct

SEQ ID NO: 9113641 - DNA, 22 bp, Homo sapiens
cccactgttgcctcaaatatca

SEQ ID NO: 9113642 - DNA, 22 bp, Homo sapiens
tgcaaatagcctatatttatag

SEQ ID NO: 9113643 - DNA, 22 bp, Homo sapiens
tgcaaatagcctgatgaaagaa

SEQ ID NO: 9113644 - DNA, 22 bp, Homo sapiens
tgcaaataggggacaactcttt

SEQ ID NO: 9113645 - DNA, 22 bp, Homo sapiens
tgcaaataaatttctgttcatt

SEQ ID NO: 9113646 - DNA, 22 bp, Homo sapiens
tgcaaataaatttctgttcatt

SEQ ID NO: 9113647 - DNA, 22 bp, Homo sapiens
tgcaaatacaaaatggtacagc

SEQ ID NO: 9113648 - DNA, 22 bp, Homo sapiens
tgcaaatacaaaatggtacagc

SEQ ID NO: 9113649 - DNA, 22 bp, Homo sapiens
tgcaaatacaaaatggtacagc

SEQ ID NO: 9113650 - DNA, 22 bp, Homo sapiens
tgcaaatacaaaatggtacagc

SEQ ID NO: 9113651 - DNA, 22 bp, Homo sapiens
tgcaaagccacaatgaaatcag

SEQ ID NO: 9113652 - DNA, 22 bp, Homo sapiens
tgcaaaggaggatgggaaagaa

SEQ ID NO: 9113653 - DNA, 22 bp, Homo sapiens
ccattaaaatggaatgtagtga

SEQ ID NO: 9113654 - DNA, 22 bp, Homo sapiens
ccatgttgtcaaacttagagta

SEQ ID NO: 9113655 - DNA, 22 bp, Homo sapiens
ccatgttgtcaaacttagagta

SEQ ID NO: 9113656 - DNA, 22 bp, Homo sapiens
ccattcaataccttagagaaaa

SEQ ID NO: 9113657 - DNA, 22 bp, Homo sapiens
ccattaaagcaccactgtaata

SEQ ID NO: 9113658 - DNA, 22 bp, Homo sapiens
ccattactgaaataaagagaat

SEQ ID NO: 9113659 - DNA, 22 bp, Homo sapiens
ccattactttccaatatatcag

SEQ ID NO: 9113660 - DNA, 19 bp, Homo sapiens
ccattctgtctctgccaca

SEQ ID NO: 9113661 - DNA, 22 bp, Homo sapiens
ccattggagagttttaagaagg

SEQ ID NO: 9113662 - DNA, 22 bp, Homo sapiens
ccattggagccaagagttttac

SEQ ID NO: 9113663 - DNA, 22 bp, Homo sapiens
ccattctgagtcttatgtcttt

SEQ ID NO: 9113664 - DNA, 22 bp, Homo sapiens
ccattccatgtgctacacataa

SEQ ID NO: 9113665 - DNA, 23 bp, Homo sapiens
ccattcccactgtgccttccctg

SEQ ID NO: 9113666 - DNA, 22 bp, Homo sapiens
tgattcaagccaccacatactg

SEQ ID NO: 9113667 - DNA, 22 bp, Homo sapiens
tgatttctcatattgttcaaaa

SEQ ID NO: 9113668 - DNA, 22 bp, Homo sapiens
tgatttctcttggcaatatgtt

SEQ ID NO: 9113669 - DNA, 20 bp, Homo sapiens
tgatttctcttctattcctt

SEQ ID NO: 9113670 - DNA, 22 bp, Homo sapiens
tgatttctctccgttatttcag

SEQ ID NO: 9113671 - DNA, 22 bp, Homo sapiens
tgatttcttccttgtcattaga

SEQ ID NO: 9113672 - DNA, 22 bp, Homo sapiens
tgatttcttccttgtcattaga

SEQ ID NO: 9113673 - DNA, 22 bp, Homo sapiens
tgattttattggtgaggaaatt

SEQ ID NO: 9113674 - DNA, 22 bp, Homo sapiens
tgattttacttagcatgatgtt

SEQ ID NO: 9113675 - DNA, 22 bp, Homo sapiens
tgattttattgaaacttcactt

SEQ ID NO: 9113676 - DNA, 23 bp, Homo sapiens
tgattttaaaaagtaagttatca

SEQ ID NO: 9113677 - DNA, 22 bp, Homo sapiens
tgatttcttctaatttccatca

SEQ ID NO: 9113678 - DNA, 22 bp, Homo sapiens
ccatgctccttaccactcactt

SEQ ID NO: 9113679 - DNA, 22 bp, Homo sapiens
ccatgctgtgacacagtagtta

SEQ ID NO: 9113680 - DNA, 22 bp, Homo sapiens
ccatgctgtgccattagcagtt

SEQ ID NO: 9113681 - DNA, 22 bp, Homo sapiens
ccatgccctaaaggactggcag

SEQ ID NO: 9113682 - DNA, 22 bp, Homo sapiens
ccatgccctaaaggactggcag

SEQ ID NO: 9113683 - DNA, 22 bp, Homo sapiens
ccatgccccaccaggacgctgc

SEQ ID NO: 9113684 - DNA, 22 bp, Homo sapiens
ccatgccccaccaggacgctgc

SEQ ID NO: 9113685 - DNA, 22 bp, Homo sapiens
ccatgcgcacccaggggaagct

SEQ ID NO: 9113686 - DNA, 22 bp, Homo sapiens
ccatgcctttcactgaaccagt

SEQ ID NO: 9113687 - DNA, 22 bp, Homo sapiens
ccatgcctggactccactctca

SEQ ID NO: 9113688 - DNA, 22 bp, Homo sapiens
ccatgcctggactccactctca

SEQ ID NO: 9113689 - DNA, 22 bp, Homo sapiens
ccatgcagtgctggagctgatt

SEQ ID NO: 9113690 - DNA, 22 bp, Homo sapiens
ccatgccagctgctaggtcaca

SEQ ID NO: 9113691 - DNA, 22 bp, Homo sapiens
ccatgccatactggccacccgg

SEQ ID NO: 9113692 - DNA, 22 bp, Homo sapiens
ccatgccccaatacaggacacc

SEQ ID NO: 9113693 - DNA, 22 bp, Homo sapiens
ccatgccatactggccacccgg

SEQ ID NO: 9113694 - DNA, 19 bp, Homo sapiens
ccatgccatcattttaaag

SEQ ID NO: 9113695 - DNA, 22 bp, Homo sapiens
ccatggcctgaaggagtgcatc

SEQ ID NO: 9113696 - DNA, 22 bp, Homo sapiens
ccatgtggtgggaaggagaatg

SEQ ID NO: 9113697 - DNA, 22 bp, Homo sapiens
tgaggtatggtaaggtaaaatc

SEQ ID NO: 9113698 - DNA, 22 bp, Homo sapiens
ccatggcctgaaggagtgcatc

SEQ ID NO: 9113699 - DNA, 22 bp, Homo sapiens
tgaggtcacctggaggcagcct

SEQ ID NO: 9113700 - DNA, 22 bp, Homo sapiens
tgaggtagggaaggctggtatt

SEQ ID NO: 9113701 - DNA, 22 bp, Homo sapiens
tgaggtagtgcttgtcatgttt

SEQ ID NO: 9113702 - DNA, 22 bp, Homo sapiens
tgaggtagtaaaggtgttagtt

SEQ ID NO: 9113703 - DNA, 21 bp, Homo sapiens
tgaggtagtgtttgtcaagtt

SEQ ID NO: 9113704 - DNA, 22 bp, Homo sapiens
tgaggtagtttgttgtacagta

SEQ ID NO: 9113705 - DNA, 22 bp, Homo sapiens
ccagtcctgtgtgaccctgcac

SEQ ID NO: 9113706 - DNA, 22 bp, Homo sapiens
ccagtcctcagatggtctgtgc

SEQ ID NO: 9113707 - DNA, 19 bp, Homo sapiens
ccagtcctctttgggcctg

SEQ ID NO: 9113708 - DNA, 22 bp, Homo sapiens
ccagtcctgccaccctgtctat

SEQ ID NO: 9113709 - DNA, 22 bp, Homo sapiens
ccagtcctgccaccctgtctat

SEQ ID NO: 9113710 - DNA, 22 bp, Homo sapiens
ccagtcctgctccctgaccacc

SEQ ID NO: 9113711 - DNA, 22 bp, Homo sapiens
ccagtctcctaagagcccctga

SEQ ID NO: 9113712 - DNA, 22 bp, Homo sapiens
ccagtcctagaagaggagtcga

SEQ ID NO: 9113713 - DNA, 22 bp, Homo sapiens
ccagtcccgcatggtccagaat

SEQ ID NO: 9113714 - DNA, 22 bp, Homo sapiens
tgaggcagcccactttccttag

SEQ ID NO: 9113715 - DNA, 22 bp, Homo sapiens
tgaggcagcattcttcaagaca

SEQ ID NO: 9113716 - DNA, 22 bp, Homo sapiens
tgagggctgcttccagagctag

SEQ ID NO: 9113717 - DNA, 22 bp, Homo sapiens
tgagggctgcttccagagctag

SEQ ID NO: 9113718 - DNA, 22 bp, Homo sapiens
tgagggctaaattgtggcaggt

SEQ ID NO: 9113719 - DNA, 22 bp, Homo sapiens
tgagggatccagaggcagtggt

SEQ ID NO: 9113720 - DNA, 23 bp, Homo sapiens
tgaggctgattgatttttgctca

SEQ ID NO: 9113721 - DNA, 22 bp, Homo sapiens
tgacaagcatttttgagtatct

SEQ ID NO: 9113722 - DNA, 22 bp, Homo sapiens
tgacaagtacataatttcatgt

SEQ ID NO: 9113723 - DNA, 22 bp, Homo sapiens
tgacaagtcactgttcttcaat

SEQ ID NO: 9113724 - DNA, 23 bp, Homo sapiens
tgacaagtctcagccaatgcaga

SEQ ID NO: 9113725 - DNA, 22 bp, Homo sapiens
tgacaatacagagagagcaaaa

SEQ ID NO: 9113726 - DNA, 22 bp, Homo sapiens
tgacaagtttcctggtgatttt

SEQ ID NO: 9113727 - DNA, 22 bp, Homo sapiens
tgacaagttggaaagcagtgca

SEQ ID NO: 9113728 - DNA, 22 bp, Homo sapiens
ccagggctgctgtgggactcca

SEQ ID NO: 9113729 - DNA, 17 bp, Homo sapiens
tgacaatgacaagcact

SEQ ID NO: 9113730 - DNA, 22 bp, Homo sapiens
tgacaatacagagagagcaaaa

SEQ ID NO: 9113731 - DNA, 23 bp, Homo sapiens
tgacagtgtatttgactatatgg

SEQ ID NO: 9113732 - DNA, 22 bp, Homo sapiens
tgacagttgtattacatgggaa

SEQ ID NO: 9113733 - DNA, 22 bp, Homo sapiens
tgacagttaaggtatacattca

SEQ ID NO: 9113734 - DNA, 20 bp, Homo sapiens
tgacagtttcatatggttca

SEQ ID NO: 9113735 - DNA, 22 bp, Homo sapiens
tgacatcattagtaacatagct

SEQ ID NO: 9113736 - DNA, 22 bp, Homo sapiens
tgagaaggaaacaatggctttt

SEQ ID NO: 9113737 - DNA, 22 bp, Homo sapiens
tgagaaaagtacatggagaagc

SEQ ID NO: 9113738 - DNA, 22 bp, Homo sapiens
tgacataataatccaaacatac

SEQ ID NO: 9113739 - DNA, 19 bp, Homo sapiens
tgacatagcaagacaaaac

SEQ ID NO: 9113740 - DNA, 22 bp, Homo sapiens
tgacatagggcaaaagagtagg

SEQ ID NO: 9113741 - DNA, 22 bp, Homo sapiens
ccaggctggagtgcagtggcac

SEQ ID NO: 9113742 - DNA, 22 bp, Homo sapiens
ccaggctggagtgcagtggcac

SEQ ID NO: 9113743 - DNA, 22 bp, Homo sapiens
ccaggctggagtgcagtggcac

SEQ ID NO: 9113744 - DNA, 22 bp, Homo sapiens
ccaggctggagtgcaatggtgc

SEQ ID NO: 9113745 - DNA, 22 bp, Homo sapiens
ccaggctggagtgcaatggtgc

SEQ ID NO: 9113746 - DNA, 22 bp, Homo sapiens
ccaggctggagtgcaatggtgc

SEQ ID NO: 9113747 - DNA, 22 bp, Homo sapiens
ccaggctggagtgcaatggtgc

SEQ ID NO: 9113748 - DNA, 22 bp, Homo sapiens
ccaggctggagtgcagtagtgt

SEQ ID NO: 9113749 - DNA, 22 bp, Homo sapiens
ccaggctggattttgcagttca

SEQ ID NO: 9113750 - DNA, 22 bp, Homo sapiens
ccaggctggattttgcagttca

SEQ ID NO: 9113751 - DNA, 22 bp, Homo sapiens
ccaggctggattttgcagttca

SEQ ID NO: 9113752 - DNA, 22 bp, Homo sapiens
ccaggctggagtgtagtcgcat

SEQ ID NO: 9113753 - DNA, 22 bp, Homo sapiens
ccaggctggagtgcagtggcac

SEQ ID NO: 9113754 - DNA, 22 bp, Homo sapiens
ccaggctggagtgtagtcgcat

SEQ ID NO: 9113755 - DNA, 22 bp, Homo sapiens
ccaggctggagtgtagtcgcat

SEQ ID NO: 9113756 - DNA, 21 bp, Homo sapiens
ccaggctggccatggtattga

SEQ ID NO: 9113757 - DNA, 20 bp, Homo sapiens
ccaggctggcaaatgggggc

SEQ ID NO: 9113758 - DNA, 20 bp, Homo sapiens
ccaggctggcaaatgggggc

SEQ ID NO: 9113759 - DNA, 22 bp, Homo sapiens
tgacaagagacccctccgcagg

SEQ ID NO: 9113760 - DNA, 22 bp, Homo sapiens
tgacaactttacaaaattcttc

SEQ ID NO: 9113761 - DNA, 22 bp, Homo sapiens
tgacaacattgagttatgtgca

SEQ ID NO: 9113762 - DNA, 19 bp, Homo sapiens
ccaggtggaactgaggtag

SEQ ID NO: 9113763 - DNA, 22 bp, Homo sapiens
ccaggtggacaaggctttcaca

SEQ ID NO: 9113764 - DNA, 22 bp, Homo sapiens
ccaggtggaaggtctgtgctct

SEQ ID NO: 9113765 - DNA, 22 bp, Homo sapiens
ccaggtggaaggtctgtgctct

SEQ ID NO: 9113766 - DNA, 17 bp, Homo sapiens
ccaggtctccttgcttt

SEQ ID NO: 9113767 - DNA, 17 bp, Homo sapiens
ccaggtctccttgcttt

SEQ ID NO: 9113768 - DNA, 21 bp, Homo sapiens
ccagggtccagctgccatggt

SEQ ID NO: 9113769 - DNA, 22 bp, Homo sapiens
ccagggggcttggtgaggccat

SEQ ID NO: 9113770 - DNA, 22 bp, Homo sapiens
ccaggggctggtgctgagctgg

SEQ ID NO: 9113771 - DNA, 22 bp, Homo sapiens
ccaggggttggaggttgcagtg

SEQ ID NO: 9113772 - DNA, 22 bp, Homo sapiens
tgagaatcatccagaggcttct

SEQ ID NO: 9113773 - DNA, 22 bp, Homo sapiens
tgagaatgagggggtagaaggt

SEQ ID NO: 9113774 - DNA, 22 bp, Homo sapiens
tgagaatcagctgcacagaggt

SEQ ID NO: 9113775 - DNA, 22 bp, Homo sapiens
tgagaataggcatagaacctgg

SEQ ID NO: 9113776 - DNA, 22 bp, Homo sapiens
tgagaatagcagactggtaact

SEQ ID NO: 9113777 - DNA, 22 bp, Homo sapiens
tgagaatactgcattgttagga

SEQ ID NO: 9113778 - DNA, 22 bp, Homo sapiens
ccaggggctgcagatccatggt

SEQ ID NO: 9113779 - DNA, 22 bp, Homo sapiens
ccaggggctggtgctgagctgg

SEQ ID NO: 9113780 - DNA, 22 bp, Homo sapiens
ccaggggctctcagggtgtgtg

SEQ ID NO: 9113781 - DNA, 21 bp, Homo sapiens
tgagaagtatgtcttcagcca

SEQ ID NO: 9113782 - DNA, 22 bp, Homo sapiens
tgagaataacagcctgtgttcc

SEQ ID NO: 9113783 - DNA, 22 bp, Homo sapiens
tgagaataagagatagtttatt

SEQ ID NO: 9113784 - DNA, 22 bp, Homo sapiens
tgagaataactgatttaaatgc

SEQ ID NO: 9113785 - DNA, 17 bp, Homo sapiens
tgagaagtaggcatcat

SEQ ID NO: 9113786 - DNA, 22 bp, Homo sapiens
tgagaaggtgaaagtgtggaga

SEQ ID NO: 9113787 - DNA, 19 bp, Homo sapiens
tgagaaggtttccgtgggt

SEQ ID NO: 9113788 - DNA, 22 bp, Homo sapiens
tgagaaggtgaaagtgtggaga

SEQ ID NO: 9113789 - DNA, 22 bp, Homo sapiens
tgagaaggctcaggcttagaga

SEQ ID NO: 9113790 - DNA, 22 bp, Homo sapiens
tgagaaggctcaggcttagaga

SEQ ID NO: 9113791 - DNA, 22 bp, Homo sapiens
tgagaaggctcaggcttagaga

SEQ ID NO: 9113792 - DNA, 22 bp, Homo sapiens
tgagaagggttggagaaataat

SEQ ID NO: 9113793 - DNA, 20 bp, Homo sapiens
tgagaaggggtcagctgtac

SEQ ID NO: 9113794 - DNA, 20 bp, Homo sapiens
tgagaaggggtcagctgtac

SEQ ID NO: 9113795 - DNA, 22 bp, Homo sapiens
tgagaaggaaacaatggctttt

SEQ ID NO: 9113796 - DNA, 19 bp, Homo sapiens
tgagaaggcagtggggagc

SEQ ID NO: 9113797 - DNA, 22 bp, Homo sapiens
tgagaaggcctgtgtgacaggg

SEQ ID NO: 9113798 - DNA, 22 bp, Homo sapiens
tgagacgaagtcttgctctgtt

SEQ ID NO: 9113799 - DNA, 17 bp, Homo sapiens
ccaggtgggaggtgggg

SEQ ID NO: 9113800 - DNA, 17 bp, Homo sapiens
ccaggtgggaggtgggg

SEQ ID NO: 9113801 - DNA, 22 bp, Homo sapiens
tgagacgaagtcttgctctgtt

SEQ ID NO: 9113802 - DNA, 22 bp, Homo sapiens
tgagaccttggggagccctgtt

SEQ ID NO: 9113803 - DNA, 22 bp, Homo sapiens
tgagacagttggtgaaatctaa

SEQ ID NO: 9113804 - DNA, 22 bp, Homo sapiens
tgagacagttctgcagctgggt

SEQ ID NO: 9113805 - DNA, 22 bp, Homo sapiens
tgagacagttggtgaaatctaa

SEQ ID NO: 9113806 - DNA, 22 bp, Homo sapiens
tgagacagtttttctatttcca

SEQ ID NO: 9113807 - DNA, 22 bp, Homo sapiens
tgagacagttctgcagctgggt

SEQ ID NO: 9113808 - DNA, 22 bp, Homo sapiens
tgagacagttctgcagctgggt

SEQ ID NO: 9113809 - DNA, 22 bp, Homo sapiens
tgagacagttctgcagctgggt

SEQ ID NO: 9113810 - DNA, 22 bp, Homo sapiens
tgaggcagaaaatagcagttca

SEQ ID NO: 9113811 - DNA, 22 bp, Homo sapiens
tgaggcagaaaatagcagttca

SEQ ID NO: 9113812 - DNA, 22 bp, Homo sapiens
tgaggcagaaattcctgttttc

SEQ ID NO: 9113813 - DNA, 22 bp, Homo sapiens
tgaggcagaaaatagcagttca

SEQ ID NO: 9113814 - DNA, 22 bp, Homo sapiens
tgaggcagagtaagatacatga

SEQ ID NO: 9113815 - DNA, 22 bp, Homo sapiens
tgaggcagaaattcctgttttc

SEQ ID NO: 9113816 - DNA, 22 bp, Homo sapiens
tgaggcagcaattgattattca

SEQ ID NO: 9113817 - DNA, 22 bp, Homo sapiens
tgaggcagcaattgtattgtat

SEQ ID NO: 9113818 - DNA, 22 bp, Homo sapiens
tgaggcagagtaagatacatga

SEQ ID NO: 9113819 - DNA, 22 bp, Homo sapiens
tgaggcagatatttattgggtt

SEQ ID NO: 9113820 - DNA, 22 bp, Homo sapiens
tgaggcagatatttattgggtt

SEQ ID NO: 9113821 - DNA, 22 bp, Homo sapiens
ccaggtgtgatttggcagtgtc

SEQ ID NO: 9113822 - DNA, 22 bp, Homo sapiens
ccaggtgtgctctgcagtggat

SEQ ID NO: 9113823 - DNA, 23 bp, Homo sapiens
tgaggacctctcaggggccaggc

SEQ ID NO: 9113824 - DNA, 22 bp, Homo sapiens
ctcctcagttgtcccatggaga

SEQ ID NO: 9113825 - DNA, 22 bp, Homo sapiens
ctcctccacagacctactgaat

SEQ ID NO: 9113826 - DNA, 22 bp, Homo sapiens
tttagtcatagatacccaaggt

SEQ ID NO: 9113827 - DNA, 22 bp, Homo sapiens
tttagtattctctatttccatc

SEQ ID NO: 9113828 - DNA, 22 bp, Homo sapiens
tttaggttttttcacgtggcta

SEQ ID NO: 9113829 - DNA, 22 bp, Homo sapiens
tttaggttaatcaacaaacatt

SEQ ID NO: 9113830 - DNA, 22 bp, Homo sapiens
tttagggtgatgtatgtgcagc

SEQ ID NO: 9113831 - DNA, 22 bp, Homo sapiens
tttagtaccatcatttgcctct

SEQ ID NO: 9113832 - DNA, 22 bp, Homo sapiens
tttaatcaggcaaagcataata

SEQ ID NO: 9113833 - DNA, 22 bp, Homo sapiens
tttaatcataagaaggaaaata

SEQ ID NO: 9113834 - DNA, 23 bp, Homo sapiens
ctccccagtgtcctcatgcatct

SEQ ID NO: 9113835 - DNA, 22 bp, Homo sapiens
tttaatcataagaaggaaaata

SEQ ID NO: 9113836 - DNA, 23 bp, Homo sapiens
ctccccagtgtcctcatgcatct

SEQ ID NO: 9113837 - DNA, 22 bp, Homo sapiens
ctcccccttagctcttgtcttt

SEQ ID NO: 9113838 - DNA, 22 bp, Homo sapiens
ctccccatccaggcagcaggtg

SEQ ID NO: 9113839 - DNA, 22 bp, Homo sapiens
tttagacatttgtggtttgcaa

SEQ ID NO: 9113840 - DNA, 19 bp, Homo sapiens
tttagacattgtctggtat

SEQ ID NO: 9113841 - DNA, 22 bp, Homo sapiens
tttagacatggcttgctcactt

SEQ ID NO: 9113842 - DNA, 22 bp, Homo sapiens
ctcccgtgatcctggaggagag

SEQ ID NO: 9113843 - DNA, 20 bp, Homo sapiens
ctcccctctacagagggctg

SEQ ID NO: 9113844 - DNA, 20 bp, Homo sapiens
ctcccctctacagagggctg

SEQ ID NO: 9113845 - DNA, 22 bp, Homo sapiens
ctcccctccttaggtcttctag

SEQ ID NO: 9113846 - DNA, 22 bp, Homo sapiens
tttatttaccttatgtcctcca

SEQ ID NO: 9113847 - DNA, 16 bp, Homo sapiens
tttatttactagtgtt

SEQ ID NO: 9113848 - DNA, 22 bp, Homo sapiens
tttatttaaagtcgtgtgttaa

SEQ ID NO: 9113849 - DNA, 22 bp, Homo sapiens
tttatttaaagtcgtgtgttaa

SEQ ID NO: 9113850 - DNA, 22 bp, Homo sapiens
tttattccagtgtttctcaaat

SEQ ID NO: 9113851 - DNA, 22 bp, Homo sapiens
ctcctccagtgggtccctcagg

SEQ ID NO: 9113852 - DNA, 22 bp, Homo sapiens
ctcctccagtgggtccctcagg

SEQ ID NO: 9113853 - DNA, 22 bp, Homo sapiens
ctcctccagtgggtccctcagg

SEQ ID NO: 9113854 - DNA, 22 bp, Homo sapiens
tttattccatgtgtctatgacc

SEQ ID NO: 9113855 - DNA, 22 bp, Homo sapiens
tttattgttgggtcttaagctg

SEQ ID NO: 9113856 - DNA, 22 bp, Homo sapiens
tttattgttgggtcttaagctg

SEQ ID NO: 9113857 - DNA, 22 bp, Homo sapiens
tttattgttatcatgggtgagt

SEQ ID NO: 9113858 - DNA, 22 bp, Homo sapiens
tttattgttgttagtcataagt

SEQ ID NO: 9113859 - DNA, 22 bp, Homo sapiens
tttattgttgttagtcataagt

SEQ ID NO: 9113860 - DNA, 22 bp, Homo sapiens
tttattgttgttagtcataagt

SEQ ID NO: 9113861 - DNA, 22 bp, Homo sapiens
tttattgtttagaagggggctg

SEQ ID NO: 9113862 - DNA, 22 bp, Homo sapiens
tttcacaaagcatagcacttta

SEQ ID NO: 9113863 - DNA, 19 bp, Homo sapiens
tttcacaaagagagcgtga

SEQ ID NO: 9113864 - DNA, 21 bp, Homo sapiens
tttcacaaaagtatgtgacaa

SEQ ID NO: 9113865 - DNA, 22 bp, Homo sapiens
tttcaaatggatccctcagcct

SEQ ID NO: 9113866 - DNA, 22 bp, Homo sapiens
tttcaaatggagtcgtgaaatg

SEQ ID NO: 9113867 - DNA, 22 bp, Homo sapiens
tttcaatgtaacatttccaggc

SEQ ID NO: 9113868 - DNA, 22 bp, Homo sapiens
tttcctagagtctctagaagaa

SEQ ID NO: 9113869 - DNA, 22 bp, Homo sapiens
tttcctagagtctctagaagaa

SEQ ID NO: 9113870 - DNA, 22 bp, Homo sapiens
tttcctaaggctcattttaaaa

SEQ ID NO: 9113871 - DNA, 22 bp, Homo sapiens
tttcctaacacaatgcatgaga

SEQ ID NO: 9113872 - DNA, 20 bp, Homo sapiens
tttccactgtaatgtatgat

SEQ ID NO: 9113873 - DNA, 22 bp, Homo sapiens
tttcacagtcaatttggagtca

SEQ ID NO: 9113874 - DNA, 22 bp, Homo sapiens
tttcacagtagaaatcattatg

SEQ ID NO: 9113875 - DNA, 22 bp, Homo sapiens
tttcacagttagcatgaggact

SEQ ID NO: 9113876 - DNA, 22 bp, Homo sapiens
tttcacataaatattatgccta

SEQ ID NO: 9113877 - DNA, 22 bp, Homo sapiens
tttcacagtgctctgtaagtat

SEQ ID NO: 9113878 - DNA, 18 bp, Homo sapiens
tttccttgtatgaacata

SEQ ID NO: 9113879 - DNA, 22 bp, Homo sapiens
tttccttgggtctcttagtggc

SEQ ID NO: 9113880 - DNA, 22 bp, Homo sapiens
ctctctggaagggggagctgat

SEQ ID NO: 9113881 - DNA, 22 bp, Homo sapiens
tttccttgcctcctgtccttct

SEQ ID NO: 9113882 - DNA, 22 bp, Homo sapiens
tttccttgcctcctgtccttct

SEQ ID NO: 9113883 - DNA, 22 bp, Homo sapiens
ctctctggaagggggagctgat

SEQ ID NO: 9113884 - DNA, 22 bp, Homo sapiens
ctctctcttgtgttgctgcaga

SEQ ID NO: 9113885 - DNA, 22 bp, Homo sapiens
ctctccaggcgaggtcctactg

SEQ ID NO: 9113886 - DNA, 22 bp, Homo sapiens
ctctccaggagctcagagtcta

SEQ ID NO: 9113887 - DNA, 22 bp, Homo sapiens
tttcctagttctaagaaatgta

SEQ ID NO: 9113888 - DNA, 22 bp, Homo sapiens
tttcctcacacagaagatcttg

SEQ ID NO: 9113889 - DNA, 22 bp, Homo sapiens
tttcctcacacagaagatcttg

SEQ ID NO: 9113890 - DNA, 22 bp, Homo sapiens
tttcctcacacagaagatcttg

SEQ ID NO: 9113891 - DNA, 22 bp, Homo sapiens
tttcctcaactgtcaaatgggg

SEQ ID NO: 9113892 - DNA, 22 bp, Homo sapiens
tttcctcactcatgtcatcagt

SEQ ID NO: 9113893 - DNA, 22 bp, Homo sapiens
tttcctcactcatgtcatcagt

SEQ ID NO: 9113894 - DNA, 22 bp, Homo sapiens
ctctccaggggtagatgccttc

SEQ ID NO: 9113895 - DNA, 22 bp, Homo sapiens
ctctccagggaagcagtgtact

SEQ ID NO: 9113896 - DNA, 22 bp, Homo sapiens
ctctccagggcatgagttccac

SEQ ID NO: 9113897 - DNA, 22 bp, Homo sapiens
ctccacaggtgtactgtacctt

SEQ ID NO: 9113898 - DNA, 22 bp, Homo sapiens
ctccacagcccctccagtggca

SEQ ID NO: 9113899 - DNA, 22 bp, Homo sapiens
ctccacagcccctccagtggca

SEQ ID NO: 9113900 - DNA, 22 bp, Homo sapiens
ctccaagtccgagggctctcaa

SEQ ID NO: 9113901 - DNA, 19 bp, Homo sapiens
ctccaagtgccaaggacag

SEQ ID NO: 9113902 - DNA, 22 bp, Homo sapiens
ctccaaggaagccccaagggat

SEQ ID NO: 9113903 - DNA, 22 bp, Homo sapiens
ctccaagggctcccagacgtct

SEQ ID NO: 9113904 - DNA, 20 bp, Homo sapiens
ctccaaggcttgcaggaggc

SEQ ID NO: 9113905 - DNA, 22 bp, Homo sapiens
ttgtacaaatgcatattcctgg

SEQ ID NO: 9113906 - DNA, 22 bp, Homo sapiens
ttgtacaaataggaacctctga

SEQ ID NO: 9113907 - DNA, 22 bp, Homo sapiens
ttgtacaaatgcatattcctgg

SEQ ID NO: 9113908 - DNA, 22 bp, Homo sapiens
ttgtacaaatgcatattcctgg

SEQ ID NO: 9113909 - DNA, 22 bp, Homo sapiens
ttgtacaacacatattctacag

SEQ ID NO: 9113910 - DNA, 22 bp, Homo sapiens
ttgtacaacacatattctacag

SEQ ID NO: 9113911 - DNA, 22 bp, Homo sapiens
ttgtacaacgttttaaatttga

SEQ ID NO: 9113912 - DNA, 22 bp, Homo sapiens
ttgtacaacgttttaaatttga

SEQ ID NO: 9113913 - DNA, 22 bp, Homo sapiens
ttgtacaacgttttaaatttga

SEQ ID NO: 9113914 - DNA, 22 bp, Homo sapiens
ttgtacaacgttttaaatttga

SEQ ID NO: 9113915 - DNA, 22 bp, Homo sapiens
ctccagattccgtttattcagg

SEQ ID NO: 9113916 - DNA, 22 bp, Homo sapiens
ttgtacaagtattatgtgaaca

SEQ ID NO: 9113917 - DNA, 22 bp, Homo sapiens
ttgtacaagtattatgtgaaca

SEQ ID NO: 9113918 - DNA, 22 bp, Homo sapiens
ttgtacaagtattatgtgaaca

SEQ ID NO: 9113919 - DNA, 22 bp, Homo sapiens
ttgtacaaagatttcacagctc

SEQ ID NO: 9113920 - DNA, 22 bp, Homo sapiens
ttgtacaaagatttcacagctc

SEQ ID NO: 9113921 - DNA, 22 bp, Homo sapiens
ttgtacaaaggatttggaagag

SEQ ID NO: 9113922 - DNA, 22 bp, Homo sapiens
ttgtacaaaggatttggaagag

SEQ ID NO: 9113923 - DNA, 22 bp, Homo sapiens
ttgtacaaaggatttggaagag

SEQ ID NO: 9113924 - DNA, 22 bp, Homo sapiens
ttgtacaaataggaacctctga

SEQ ID NO: 9113925 - DNA, 22 bp, Homo sapiens
ttggtcagctaataaggacagg

SEQ ID NO: 9113926 - DNA, 22 bp, Homo sapiens
ttcttttacattaagatttcag

SEQ ID NO: 9113927 - DNA, 22 bp, Homo sapiens
ttcttttagaatttcctaaggt

SEQ ID NO: 9113928 - DNA, 22 bp, Homo sapiens
ttcttttagtcattcagggaag

SEQ ID NO: 9113929 - DNA, 22 bp, Homo sapiens
ttcttttaatttctgtctgcag

SEQ ID NO: 9113930 - DNA, 22 bp, Homo sapiens
ttcttttacattaagatttcag

SEQ ID NO: 9113931 - DNA, 22 bp, Homo sapiens
ttcttttaattgtgggggagtg

SEQ ID NO: 9113932 - DNA, 22 bp, Homo sapiens
ttcttttcggcctgtgagaagg

SEQ ID NO: 9113933 - DNA, 22 bp, Homo sapiens
ttcttttcctgtggctcatcca

SEQ ID NO: 9113934 - DNA, 22 bp, Homo sapiens
ttcttttcctacacagcgattt

SEQ ID NO: 9113935 - DNA, 18 bp, Homo sapiens
ttcttttcatgtgatctc

SEQ ID NO: 9113936 - DNA, 22 bp, Homo sapiens
ttcttttcccaatattttgctg

SEQ ID NO: 9113937 - DNA, 22 bp, Homo sapiens
ttcttttcaagaggggcaagga

SEQ ID NO: 9113938 - DNA, 22 bp, Homo sapiens
ctcatttactcatctgcaaaac

SEQ ID NO: 9113939 - DNA, 22 bp, Homo sapiens
ctccaaatataatcacattgga

SEQ ID NO: 9113940 - DNA, 22 bp, Homo sapiens
ttgaaatagatgcgtcagagat

SEQ ID NO: 9113941 - DNA, 22 bp, Homo sapiens
ttgaaataaggaagctcgaaat

SEQ ID NO: 9113942 - DNA, 22 bp, Homo sapiens
ttgaaatactgcattgttcagt

SEQ ID NO: 9113943 - DNA, 22 bp, Homo sapiens
tttaatatctcacacttccatg

SEQ ID NO: 9113944 - DNA, 22 bp, Homo sapiens
tttaatatttctttcctgaagc

SEQ ID NO: 9113945 - DNA, 22 bp, Homo sapiens
tttaatatccagtggatacaaa

SEQ ID NO: 9113946 - DNA, 22 bp, Homo sapiens
tttaatacagaacttgtcaggg

SEQ ID NO: 9113947 - DNA, 22 bp, Homo sapiens
tttaacagatgctatgtctacc

SEQ ID NO: 9113948 - DNA, 22 bp, Homo sapiens
tttaacagatgctatgtctacc

SEQ ID NO: 9113949 - DNA, 22 bp, Homo sapiens
ctcccaggcacagggaggagcc

SEQ ID NO: 9113950 - DNA, 22 bp, Homo sapiens
ctcccagacatgtgcctccttg

SEQ ID NO: 9113951 - DNA, 22 bp, Homo sapiens
ctcccagaaaattctcagacaa

SEQ ID NO: 9113952 - DNA, 22 bp, Homo sapiens
ctcccactcctggctcaccaca

SEQ ID NO: 9113953 - DNA, 22 bp, Homo sapiens
ctccatgggggctggcctgtgt

SEQ ID NO: 9113954 - DNA, 22 bp, Homo sapiens
ctccatggggaaatgaaggtgg

SEQ ID NO: 9113955 - DNA, 22 bp, Homo sapiens
ctcccaaggggtaagggagctg

SEQ ID NO: 9113956 - DNA, 22 bp, Homo sapiens
ctcccacatggaatagcaggga

SEQ ID NO: 9113957 - DNA, 22 bp, Homo sapiens
ctcccaaggggtaagggagctg

SEQ ID NO: 9113958 - DNA, 22 bp, Homo sapiens
ctcccagccttcgccagtctga

SEQ ID NO: 9113959 - DNA, 22 bp, Homo sapiens
ctcccagccttcgccagtctga

SEQ ID NO: 9113960 - DNA, 22 bp, Homo sapiens
ctcccagaggtgtcattcgagc

SEQ ID NO: 9113961 - DNA, 22 bp, Homo sapiens
ctcccagattcctgctgtggga

SEQ ID NO: 9113962 - DNA, 22 bp, Homo sapiens
ctcccagagaccaagctgagaa

SEQ ID NO: 9113963 - DNA, 22 bp, Homo sapiens
ctcccagagagcaggtgggccg

SEQ ID NO: 9113964 - DNA, 22 bp, Homo sapiens
ttgtggggttggcagttcttta

SEQ ID NO: 9113965 - DNA, 22 bp, Homo sapiens
ttgtgggggctgccctgtacgg

SEQ ID NO: 9113966 - DNA, 22 bp, Homo sapiens
ttgtggggtgatttgccacggg

SEQ ID NO: 9113967 - DNA, 22 bp, Homo sapiens
ctccagtgcgcaggacagcccc

SEQ ID NO: 9113968 - DNA, 22 bp, Homo sapiens
ttgtgtaattagcaaacaaatc

SEQ ID NO: 9113969 - DNA, 22 bp, Homo sapiens
ttgtgtaatgaagttatcatgt

SEQ ID NO: 9113970 - DNA, 22 bp, Homo sapiens
ctccatggaaccggggctgctt

SEQ ID NO: 9113971 - DNA, 22 bp, Homo sapiens
ctccatggctttcgcatctgca

SEQ ID NO: 9113972 - DNA, 22 bp, Homo sapiens
ttgtgaaacattcatggatttg

SEQ ID NO: 9113973 - DNA, 18 bp, Homo sapiens
ttgtgaaatattggagtc

SEQ ID NO: 9113974 - DNA, 21 bp, Homo sapiens
ttgtgaaagtccaggaacaac

SEQ ID NO: 9113975 - DNA, 21 bp, Homo sapiens
ttgtgaaagtccaggaacaac

SEQ ID NO: 9113976 - DNA, 22 bp, Homo sapiens
ttgtggggcaacagcaggtgaa

SEQ ID NO: 9113977 - DNA, 20 bp, Homo sapiens
ttgtgggggcaatggtatgc

SEQ ID NO: 9113978 - DNA, 22 bp, Homo sapiens
ttgtggggccccaatgttgctg

SEQ ID NO: 9113979 - DNA, 22 bp, Homo sapiens
ttgtggggaggatttgatgaga

SEQ ID NO: 9113980 - DNA, 22 bp, Homo sapiens
ttgtggggaacccctgtcccac

SEQ ID NO: 9113981 - DNA, 22 bp, Homo sapiens
ttgtggggaaacactgtttctt

SEQ ID NO: 9113982 - DNA, 22 bp, Homo sapiens
ttgtctttggaaatttaatgtt

SEQ ID NO: 9113983 - DNA, 22 bp, Homo sapiens
ttgtcttttgtgggaaatatgg

SEQ ID NO: 9113984 - DNA, 22 bp, Homo sapiens
ttgtctttcccagcttctagag

SEQ ID NO: 9113985 - DNA, 22 bp, Homo sapiens
ttgtctttcccagcttctagag

SEQ ID NO: 9113986 - DNA, 22 bp, Homo sapiens
ttgtcttaaatggatggacaat

SEQ ID NO: 9113987 - DNA, 23 bp, Homo sapiens
ttgtctgtgcttttccagttgct

SEQ ID NO: 9113988 - DNA, 22 bp, Homo sapiens
ttgtctgtgaaatggaaatagt

SEQ ID NO: 9113989 - DNA, 22 bp, Homo sapiens
ttgtctgtcccagcttgtgcat

SEQ ID NO: 9113990 - DNA, 22 bp, Homo sapiens
ctccagcctcagatgacggtac

SEQ ID NO: 9113991 - DNA, 20 bp, Homo sapiens
ctccagcccctgccctggtc

SEQ ID NO: 9113992 - DNA, 20 bp, Homo sapiens
ctccagcccctgccctggtc

SEQ ID NO: 9113993 - DNA, 22 bp, Homo sapiens
ctccagccagagtgcctctgtt

SEQ ID NO: 9113994 - DNA, 22 bp, Homo sapiens
ctccagccagagtgcctctgtt

SEQ ID NO: 9113995 - DNA, 22 bp, Homo sapiens
ctccagccagagtgcctctgtt

SEQ ID NO: 9113996 - DNA, 19 bp, Homo sapiens
ctctttggagatccttgga

SEQ ID NO: 9113997 - DNA, 22 bp, Homo sapiens
ctctttggatgtttatgataag

SEQ ID NO: 9113998 - DNA, 22 bp, Homo sapiens
ctctttggatagaattacaaag

SEQ ID NO: 9113999 - DNA, 22 bp, Homo sapiens
ctctttgaaatccatcactgct

SEQ ID NO: 9114000 - DNA, 22 bp, Homo sapiens
ctctttgaaatccatcactgct

SEQ ID NO: 9114001 - DNA, 20 bp, Homo sapiens
ctctttgaaatgctcttggg

SEQ ID NO: 9114002 - DNA, 22 bp, Homo sapiens
ctctttgacgtgcccatgtccc

SEQ ID NO: 9114003 - DNA, 22 bp, Homo sapiens
ctctttctgattcgctgggacc

SEQ ID NO: 9114004 - DNA, 22 bp, Homo sapiens
ctctttctggaaggcagagtgg

SEQ ID NO: 9114005 - DNA, 21 bp, Homo sapiens
ctctttatatagtaaagatat

SEQ ID NO: 9114006 - DNA, 22 bp, Homo sapiens
ctctttctgattcgctgggacc

SEQ ID NO: 9114007 - DNA, 22 bp, Homo sapiens
ctctttctcgccgcccgcagtc

SEQ ID NO: 9114008 - DNA, 22 bp, Homo sapiens
ctctttctcattgtcagcagaa

SEQ ID NO: 9114009 - DNA, 22 bp, Homo sapiens
ctctttcctcagccacagtcta

SEQ ID NO: 9114010 - DNA, 22 bp, Homo sapiens
ctgaccagggtagaggtgagag

SEQ ID NO: 9114011 - DNA, 20 bp, Homo sapiens
ctgacccaatctctgtcccc

SEQ ID NO: 9114012 - DNA, 22 bp, Homo sapiens
ctgacccagaggaactgcaaag

SEQ ID NO: 9114013 - DNA, 22 bp, Homo sapiens
ctgacccatataagagtggagg

SEQ ID NO: 9114014 - DNA, 22 bp, Homo sapiens
ctgaccctagcatctctgtgca

SEQ ID NO: 9114015 - DNA, 19 bp, Homo sapiens
ctgacccaggacaccacgg

SEQ ID NO: 9114016 - DNA, 22 bp, Homo sapiens
ctgaatcatgccattttgctta

SEQ ID NO: 9114017 - DNA, 22 bp, Homo sapiens
ctgacagattagatgtgcatat

SEQ ID NO: 9114018 - DNA, 22 bp, Homo sapiens
ctgacagctgttgcagtgaatg

SEQ ID NO: 9114019 - DNA, 22 bp, Homo sapiens
ctgacagggtagacagagggca

SEQ ID NO: 9114020 - DNA, 22 bp, Homo sapiens
ctgacagggtagacagagggca

SEQ ID NO: 9114021 - DNA, 22 bp, Homo sapiens
ctgacagcagcaaatggagata

SEQ ID NO: 9114022 - DNA, 19 bp, Homo sapiens
ctgagcctcagtttcctag

SEQ ID NO: 9114023 - DNA, 22 bp, Homo sapiens
ctgagcccttgaacccaagtcc

SEQ ID NO: 9114024 - DNA, 22 bp, Homo sapiens
ctgaggcagagggcagaccaga

SEQ ID NO: 9114025 - DNA, 22 bp, Homo sapiens
ctgaggcagagggcagaccaga

SEQ ID NO: 9114026 - DNA, 22 bp, Homo sapiens
ctgaggcagagggcagaccaga

SEQ ID NO: 9114027 - DNA, 22 bp, Homo sapiens
ctgagcctcctgcttctatttc

SEQ ID NO: 9114028 - DNA, 22 bp, Homo sapiens
ctgagcccctctgacctcagag

SEQ ID NO: 9114029 - DNA, 17 bp, Homo sapiens
ctgagccccgggcagct

SEQ ID NO: 9114030 - DNA, 22 bp, Homo sapiens
ctgagccccatctgaggtgccc

SEQ ID NO: 9114031 - DNA, 22 bp, Homo sapiens
ctgactcagcagctgatgatcc

SEQ ID NO: 9114032 - DNA, 22 bp, Homo sapiens
ctgactcactgtggctcttaat

SEQ ID NO: 9114033 - DNA, 22 bp, Homo sapiens
ctgacctggccttggtgggcca

SEQ ID NO: 9114034 - DNA, 22 bp, Homo sapiens
ctgacctgctaagcccctgtcc

SEQ ID NO: 9114035 - DNA, 22 bp, Homo sapiens
ctgagccaaccacagcaggagc

SEQ ID NO: 9114036 - DNA, 22 bp, Homo sapiens
ctgagccaaccacagcaggagc

SEQ ID NO: 9114037 - DNA, 20 bp, Homo sapiens
ctgactctccttggcttgga

SEQ ID NO: 9114038 - DNA, 22 bp, Homo sapiens
ctgactctcctcaagcataaat

SEQ ID NO: 9114039 - DNA, 22 bp, Homo sapiens
ctgactctcctgagatggggag

SEQ ID NO: 9114040 - DNA, 20 bp, Homo sapiens
ctgagccaactctcttcttg

SEQ ID NO: 9114041 - DNA, 22 bp, Homo sapiens
ctgagccaaccacagcaggagc

SEQ ID NO: 9114042 - DNA, 22 bp, Homo sapiens
ctgagccaaccacagcaggagc

SEQ ID NO: 9114043 - DNA, 20 bp, Homo sapiens
ctgagccaactctcttcttg

SEQ ID NO: 9114044 - DNA, 22 bp, Homo sapiens
ctgagccataagggaggctggg

SEQ ID NO: 9114045 - DNA, 22 bp, Homo sapiens
ctgagccataagggaggctggg

SEQ ID NO: 9114046 - DNA, 22 bp, Homo sapiens
ctgagccagtagtcagggacaa

SEQ ID NO: 9114047 - DNA, 22 bp, Homo sapiens
ctgagccagtagtcagggacaa

SEQ ID NO: 9114048 - DNA, 22 bp, Homo sapiens
ctgagccatccataccagctta

SEQ ID NO: 9114049 - DNA, 22 bp, Homo sapiens
ctgagccatgggtctaagcact

SEQ ID NO: 9114050 - DNA, 22 bp, Homo sapiens
ctgagccatgggtctaagcact

SEQ ID NO: 9114051 - DNA, 22 bp, Homo sapiens
ctgagccatgggtctaagcact

SEQ ID NO: 9114052 - DNA, 22 bp, Homo sapiens
ctgagccatgagcctgcgccca

SEQ ID NO: 9114053 - DNA, 22 bp, Homo sapiens
ctgagccatgagcctgcgccca

SEQ ID NO: 9114054 - DNA, 22 bp, Homo sapiens
ctgagccatgagcctgcgccca

SEQ ID NO: 9114055 - DNA, 22 bp, Homo sapiens
ctgcagggcccgcctgagccct

SEQ ID NO: 9114056 - DNA, 22 bp, Homo sapiens
ctgcaggggaccaaagtctgac

SEQ ID NO: 9114057 - DNA, 19 bp, Homo sapiens
ctgcagggatgtgcagagt

SEQ ID NO: 9114058 - DNA, 19 bp, Homo sapiens
ctgcagggatgtgcagagt

SEQ ID NO: 9114059 - DNA, 22 bp, Homo sapiens
ctgcacagtgttggaagctgcc

SEQ ID NO: 9114060 - DNA, 22 bp, Homo sapiens
ctgcactgacttccccggctgc

SEQ ID NO: 9114061 - DNA, 20 bp, Homo sapiens
ctgcactgaacatgtctgag

SEQ ID NO: 9114062 - DNA, 22 bp, Homo sapiens
ctgcacgtataatcagtctgtt

SEQ ID NO: 9114063 - DNA, 22 bp, Homo sapiens
ctgcaggcccccttcctggagt

SEQ ID NO: 9114064 - DNA, 22 bp, Homo sapiens
ctgcaggcatctaactgtgggc

SEQ ID NO: 9114065 - DNA, 22 bp, Homo sapiens
ctgcaggcatctaactgtgggc

SEQ ID NO: 9114066 - DNA, 22 bp, Homo sapiens
ctgcactgagctctcccagccc

SEQ ID NO: 9114067 - DNA, 20 bp, Homo sapiens
ctgcaaaatgacattaggaa

SEQ ID NO: 9114068 - DNA, 22 bp, Homo sapiens
ctgcaaaagtcattgtggtttt

SEQ ID NO: 9114069 - DNA, 22 bp, Homo sapiens
ctgaggcccctcttgtgagcat

SEQ ID NO: 9114070 - DNA, 22 bp, Homo sapiens
ctgcaaaattgttctttgctcc

SEQ ID NO: 9114071 - DNA, 21 bp, Homo sapiens
ctgcaaatacctagttatctg

SEQ ID NO: 9114072 - DNA, 22 bp, Homo sapiens
ctgcacagagcagggcagacac

SEQ ID NO: 9114073 - DNA, 22 bp, Homo sapiens
ctgcacagaggtcggtctgcca

SEQ ID NO: 9114074 - DNA, 22 bp, Homo sapiens
ctgcacacatcgcactgcccgt

SEQ ID NO: 9114075 - DNA, 22 bp, Homo sapiens
ctgcacacatatggcttctctc

SEQ ID NO: 9114076 - DNA, 22 bp, Homo sapiens
ctgcacagtggacagtgaagat

SEQ ID NO: 9114077 - DNA, 22 bp, Homo sapiens
ctgcacagtgggtggggcgtca

SEQ ID NO: 9114078 - DNA, 22 bp, Homo sapiens
ctgcacagtggacagtgaagat

SEQ ID NO: 9114079 - DNA, 22 bp, Homo sapiens
ctgcacaggggatgagggcagt

SEQ ID NO: 9114080 - DNA, 22 bp, Homo sapiens
ctgcacagggatatggggagct

SEQ ID NO: 9114081 - DNA, 22 bp, Homo sapiens
ctgcacaggggatgagggcagt

SEQ ID NO: 9114082 - DNA, 22 bp, Homo sapiens
ctgcacagctggccagggagag

SEQ ID NO: 9114083 - DNA, 22 bp, Homo sapiens
ctgcacagctgggcaagatata

SEQ ID NO: 9114084 - DNA, 22 bp, Homo sapiens
ctgcacagctggccagggagag

SEQ ID NO: 9114085 - DNA, 22 bp, Homo sapiens
ctgcacagcctgtctgggggcc

SEQ ID NO: 9114086 - DNA, 22 bp, Homo sapiens
ctgcacagccctcaagagcctg

SEQ ID NO: 9114087 - DNA, 22 bp, Homo sapiens
ctgaggcatgttacaggacata

SEQ ID NO: 9114088 - DNA, 22 bp, Homo sapiens
ctgaggcatgggaagttgggtg

SEQ ID NO: 9114089 - DNA, 21 bp, Homo sapiens
ctgaggcatgcaggcctgggc

SEQ ID NO: 9114090 - DNA, 21 bp, Homo sapiens
ctgaggcatgcaggcctgggc

SEQ ID NO: 9114091 - DNA, 22 bp, Homo sapiens
ctgaggccagctgcagagctct

SEQ ID NO: 9114092 - DNA, 22 bp, Homo sapiens
ctgaggccagctgcagagctct

SEQ ID NO: 9114093 - DNA, 22 bp, Homo sapiens
ctgaggccagctgcagagctct

SEQ ID NO: 9114094 - DNA, 22 bp, Homo sapiens
ctgaggccagctgcagagctct

SEQ ID NO: 9114095 - DNA, 18 bp, Homo sapiens
ctgaggcccagagagggc

SEQ ID NO: 9114096 - DNA, 17 bp, Homo sapiens
ctgaggcccagggccca

SEQ ID NO: 9114097 - DNA, 18 bp, Homo sapiens
ctgaggcccagagagggc

SEQ ID NO: 9114098 - DNA, 22 bp, Homo sapiens
ctgaggcccctctcttgagctt

SEQ ID NO: 9114099 - DNA, 22 bp, Homo sapiens
ctgaggcccctctcttgagctt

SEQ ID NO: 9114100 - DNA, 19 bp, Homo sapiens
ctgaggcccatgtaccatg

SEQ ID NO: 9114101 - DNA, 19 bp, Homo sapiens
ctgaggcccatgtaccatg

SEQ ID NO: 9114102 - DNA, 20 bp, Homo sapiens
ctcttcaaatattttattct

SEQ ID NO: 9114103 - DNA, 22 bp, Homo sapiens
ctcttatacatatttttaggcg

SEQ ID NO: 9114104 - DNA, 22 bp, Homo sapiens
ttttagtaccaaccagaagatg

SEQ ID NO: 9114105 - DNA, 22 bp, Homo sapiens
ctcttcaggatggcttgtgatg

SEQ ID NO: 9114106 - DNA, 22 bp, Homo sapiens
ctcttcaggaatatgtcagtca

SEQ ID NO: 9114107 - DNA, 22 bp, Homo sapiens
ctcttcagataaaagggatatt

SEQ ID NO: 9114108 - DNA, 22 bp, Homo sapiens
ctcttcagtaaatgacactgtt

SEQ ID NO: 9114109 - DNA, 22 bp, Homo sapiens
ttttcaggtacatcacatactg

SEQ ID NO: 9114110 - DNA, 22 bp, Homo sapiens
ttttcaggtgcagtaatcatat

SEQ ID NO: 9114111 - DNA, 22 bp, Homo sapiens
ttttcaggctgatttgtgttag

SEQ ID NO: 9114112 - DNA, 22 bp, Homo sapiens
ttttcaggccagaagatagacc

SEQ ID NO: 9114113 - DNA, 22 bp, Homo sapiens
ttttcaccatagacactggtcc

SEQ ID NO: 9114114 - DNA, 22 bp, Homo sapiens
ttttcagtggtatctttgtaaa

SEQ ID NO: 9114115 - DNA, 22 bp, Homo sapiens
ttttcagttactgtttatgtga

SEQ ID NO: 9114116 - DNA, 22 bp, Homo sapiens
ttttcagttactgtttatgtga

SEQ ID NO: 9114117 - DNA, 22 bp, Homo sapiens
ctctttactgctactacaaaga

SEQ ID NO: 9114118 - DNA, 21 bp, Homo sapiens
ctcttgtgtcagagccagagg

SEQ ID NO: 9114119 - DNA, 22 bp, Homo sapiens
tttgtacatataaatcttgtat

SEQ ID NO: 9114120 - DNA, 22 bp, Homo sapiens
tttgtacatatataaaatctgt

SEQ ID NO: 9114121 - DNA, 22 bp, Homo sapiens
tttgtacatataaatcttgtat

SEQ ID NO: 9114122 - DNA, 22 bp, Homo sapiens
tttgtacatatataaaatctgt

SEQ ID NO: 9114123 - DNA, 22 bp, Homo sapiens
ttttaagatgctagtatttcag

SEQ ID NO: 9114124 - DNA, 22 bp, Homo sapiens
tttgggcagaaacatgcgcccc

SEQ ID NO: 9114125 - DNA, 20 bp, Homo sapiens
tttgggcacggctagatttt

SEQ ID NO: 9114126 - DNA, 22 bp, Homo sapiens
tttgggcacagatattaagtat

SEQ ID NO: 9114127 - DNA, 22 bp, Homo sapiens
tttgggcacacaaatattttat

SEQ ID NO: 9114128 - DNA, 22 bp, Homo sapiens
tttgggcagaagctgaatgtct

SEQ ID NO: 9114129 - DNA, 22 bp, Homo sapiens
tttgtacacctacctaatacag

SEQ ID NO: 9114130 - DNA, 22 bp, Homo sapiens
tttgtacacaggatgttataat

SEQ ID NO: 9114131 - DNA, 22 bp, Homo sapiens
tttgtacacaggatgttataat

SEQ ID NO: 9114132 - DNA, 22 bp, Homo sapiens
tttgtacacaggtcattcaggg

SEQ ID NO: 9114133 - DNA, 22 bp, Homo sapiens
tttgtacacaggtcattcaggg

SEQ ID NO: 9114134 - DNA, 22 bp, Homo sapiens
tttgtacacaggtcattcaggg

SEQ ID NO: 9114135 - DNA, 22 bp, Homo sapiens
tttgtacactgtctactatgaa

SEQ ID NO: 9114136 - DNA, 22 bp, Homo sapiens
tttgtacactgtctactatgaa

SEQ ID NO: 9114137 - DNA, 22 bp, Homo sapiens
tttgtacagtgatgttgtatgc

SEQ ID NO: 9114138 - DNA, 22 bp, Homo sapiens
tttgtacaggtgcaggcatttg

SEQ ID NO: 9114139 - DNA, 22 bp, Homo sapiens
tttgtacactgtctactatgaa

SEQ ID NO: 9114140 - DNA, 22 bp, Homo sapiens
tttgtacactgtctactatgaa

SEQ ID NO: 9114141 - DNA, 22 bp, Homo sapiens
tttgtacaggtgcaggcatttg

SEQ ID NO: 9114142 - DNA, 22 bp, Homo sapiens
ttttaatactgctattgtagga

SEQ ID NO: 9114143 - DNA, 22 bp, Homo sapiens
ttttaatactgctattgtagga

SEQ ID NO: 9114144 - DNA, 19 bp, Homo sapiens
ttttaagtcctctctattc

SEQ ID NO: 9114145 - DNA, 19 bp, Homo sapiens
ttttaagtcctctctattc

SEQ ID NO: 9114146 - DNA, 22 bp, Homo sapiens
ttttaagttaatataattgagg

SEQ ID NO: 9114147 - DNA, 22 bp, Homo sapiens
ttttaagttaatataattgagg

SEQ ID NO: 9114148 - DNA, 22 bp, Homo sapiens
ttttaagtgcaatctgaatgcg

SEQ ID NO: 9114149 - DNA, 22 bp, Homo sapiens
ttttagcactaagtgatatgct

SEQ ID NO: 9114150 - DNA, 20 bp, Homo sapiens
ttttagcagaaagaaagctc

SEQ ID NO: 9114151 - DNA, 22 bp, Homo sapiens
ttttagaatcaggttgtctggg

SEQ ID NO: 9114152 - DNA, 22 bp, Homo sapiens
ttttagactccatctgattcag

SEQ ID NO: 9114153 - DNA, 22 bp, Homo sapiens
ttttagacttgtatgtaaagcc

SEQ ID NO: 9114154 - DNA, 22 bp, Homo sapiens
tttgctcagttctctgtatttt

SEQ ID NO: 9114155 - DNA, 22 bp, Homo sapiens
tttgctatttttctgtgcagct

SEQ ID NO: 9114156 - DNA, 22 bp, Homo sapiens
tttgctctgctgttgccaggtg

SEQ ID NO: 9114157 - DNA, 22 bp, Homo sapiens
tttgctctgacagtgccagaga

SEQ ID NO: 9114158 - DNA, 22 bp, Homo sapiens
ctctgctttcctcttacacact

SEQ ID NO: 9114159 - DNA, 20 bp, Homo sapiens
ctctgctttaggagagtcag

SEQ ID NO: 9114160 - DNA, 20 bp, Homo sapiens
ctctgctttccacctttcag

SEQ ID NO: 9114161 - DNA, 22 bp, Homo sapiens
ctctgcttttatgtgccggcgc

SEQ ID NO: 9114162 - DNA, 22 bp, Homo sapiens
ctctgctttttagggagcctag

SEQ ID NO: 9114163 - DNA, 22 bp, Homo sapiens
tttgccattgcctgtcagttgt

SEQ ID NO: 9114164 - DNA, 22 bp, Homo sapiens
tttgcctctcagagtctacaca

SEQ ID NO: 9114165 - DNA, 22 bp, Homo sapiens
tttgcctgattctaagagctca

SEQ ID NO: 9114166 - DNA, 21 bp, Homo sapiens
tttgccttcacgaagcatcct

SEQ ID NO: 9114167 - DNA, 19 bp, Homo sapiens
tttgccttgcagctgtgtg

SEQ ID NO: 9114168 - DNA, 22 bp, Homo sapiens
tttgctataaaagggtcacacg

SEQ ID NO: 9114169 - DNA, 20 bp, Homo sapiens
tttgctatgcatatctgacc

SEQ ID NO: 9114170 - DNA, 22 bp, Homo sapiens
tttgggaaatagtagaaaatgt

SEQ ID NO: 9114171 - DNA, 22 bp, Homo sapiens
tttgggaaatattgtgttcaag

SEQ ID NO: 9114172 - DNA, 21 bp, Homo sapiens
tttgggcaaaattaaatgaga

SEQ ID NO: 9114173 - DNA, 22 bp, Homo sapiens
tttgggcaaaggtagaaggaga

SEQ ID NO: 9114174 - DNA, 22 bp, Homo sapiens
tttgggcaattcagtgggacct

SEQ ID NO: 9114175 - DNA, 22 bp, Homo sapiens
tttgggcaaggtccagattcct

SEQ ID NO: 9114176 - DNA, 22 bp, Homo sapiens
tttgggcaagctcactgattca

SEQ ID NO: 9114177 - DNA, 22 bp, Homo sapiens
tttgggaataattgcacagatt

SEQ ID NO: 9114178 - DNA, 22 bp, Homo sapiens
tttgggaagtgggagcaaggtg

SEQ ID NO: 9114179 - DNA, 22 bp, Homo sapiens
tttgggaagtttaaaataagta

SEQ ID NO: 9114180 - DNA, 22 bp, Homo sapiens
tttgggaattgtagctgtcttg

SEQ ID NO: 9114181 - DNA, 22 bp, Homo sapiens
tttgggaatctttgtgcatgac

SEQ ID NO: 9114182 - DNA, 22 bp, Homo sapiens
tttgggaattgtagctgtcttg

SEQ ID NO: 9114183 - DNA, 22 bp, Homo sapiens
tttgggaatctttgtgcatgac

SEQ ID NO: 9114184 - DNA, 19 bp, Homo sapiens
tttgggaagcccagagtgt

SEQ ID NO: 9114185 - DNA, 22 bp, Homo sapiens
tttgggaagaggaatctctgga

SEQ ID NO: 9114186 - DNA, 22 bp, Homo sapiens
tttgggaagaggaatctctgga

SEQ ID NO: 9114187 - DNA, 23 bp, Homo sapiens
tttgggaagggagagagtaagca

SEQ ID NO: 9114188 - DNA, 22 bp, Homo sapiens
tttgggaagtgggagcaaggtg

SEQ ID NO: 9114189 - DNA, 22 bp, Homo sapiens
tttgggaagaagttgcaaattt

SEQ ID NO: 9114190 - DNA, 22 bp, Homo sapiens
tttgggaagaagttgcaaattt

SEQ ID NO: 9114191 - DNA, 20 bp, Homo sapiens
ctctgcagcaaggcctgggt

SEQ ID NO: 9114192 - DNA, 22 bp, Homo sapiens
ctctgcagaggcccaaggctga

SEQ ID NO: 9114193 - DNA, 22 bp, Homo sapiens
tttccttgttattatttgtcct

SEQ ID NO: 9114194 - DNA, 22 bp, Homo sapiens
tttccttgttcatttgccctat

SEQ ID NO: 9114195 - DNA, 22 bp, Homo sapiens
ctctgccatcttggagctcaag

SEQ ID NO: 9114196 - DNA, 22 bp, Homo sapiens
ctctgcccacgtcttgcccaga

SEQ ID NO: 9114197 - DNA, 22 bp, Homo sapiens
ctctgccactcgaagtcaagga

SEQ ID NO: 9114198 - DNA, 22 bp, Homo sapiens
tttgcaaagtgcttgcagagta

SEQ ID NO: 9114199 - DNA, 22 bp, Homo sapiens
tttgcaaagttatttagactca

SEQ ID NO: 9114200 - DNA, 22 bp, Homo sapiens
tttgcaaagttatttagactca

SEQ ID NO: 9114201 - DNA, 19 bp, Homo sapiens
ctctgcctccctcctgggt

SEQ ID NO: 9114202 - DNA, 19 bp, Homo sapiens
ctctgcctccctcctgggt

SEQ ID NO: 9114203 - DNA, 22 bp, Homo sapiens
tttgcaaagtgcttgcagagta

SEQ ID NO: 9114204 - DNA, 22 bp, Homo sapiens
tttgcattttgataagatcact

SEQ ID NO: 9114205 - DNA, 22 bp, Homo sapiens
tttgcattttagatttaggcct

SEQ ID NO: 9114206 - DNA, 22 bp, Homo sapiens
tttgcattttagatttaggcct

SEQ ID NO: 9114207 - DNA, 22 bp, Homo sapiens
ctctgcctcagtgatttcttta

SEQ ID NO: 9114208 - DNA, 22 bp, Homo sapiens
ctctgccctcgcacatctgcca

SEQ ID NO: 9114209 - DNA, 22 bp, Homo sapiens
ctctgccctcgcacatctgcca

SEQ ID NO: 9114210 - DNA, 22 bp, Homo sapiens
ctctgcctcccaggttcaagcg

SEQ ID NO: 9114211 - DNA, 19 bp, Homo sapiens
ctctgcctccctcctgggt

SEQ ID NO: 9114212 - DNA, 22 bp, Homo sapiens
ctctgcccgcggatgccacgtc

SEQ ID NO: 9114213 - DNA, 22 bp, Homo sapiens
ctctgcccgcggatgccacgtc

SEQ ID NO: 9114214 - DNA, 22 bp, Homo sapiens
ctctgcccgcggatgccacgtc

SEQ ID NO: 9114215 - DNA, 22 bp, Homo sapiens
ctctgcccgtgcctttcccagt

SEQ ID NO: 9114216 - DNA, 22 bp, Homo sapiens
ctctgcccagtgcccacaggag

SEQ ID NO: 9114217 - DNA, 21 bp, Homo sapiens
ctctgcccagggcctcctgcc

SEQ ID NO: 9114218 - DNA, 22 bp, Homo sapiens
cctgggatttcctgagcactct

SEQ ID NO: 9114219 - DNA, 22 bp, Homo sapiens
cctgggcaaatgccagagacaa

SEQ ID NO: 9114220 - DNA, 22 bp, Homo sapiens
cctgggcaaatgccagagacaa

SEQ ID NO: 9114221 - DNA, 22 bp, Homo sapiens
tgtgtatacgagtatgaatatg

SEQ ID NO: 9114222 - DNA, 19 bp, Homo sapiens
tgtgtctctgtgtagcctg

SEQ ID NO: 9114223 - DNA, 22 bp, Homo sapiens
tgtgtctcctttccctgtctaa

SEQ ID NO: 9114224 - DNA, 22 bp, Homo sapiens
tgtgtctgaacatgctttgtaa

SEQ ID NO: 9114225 - DNA, 22 bp, Homo sapiens
tgtgtctcctttccctgtctaa

SEQ ID NO: 9114226 - DNA, 22 bp, Homo sapiens
tgtgtctccatagccagctagc

SEQ ID NO: 9114227 - DNA, 22 bp, Homo sapiens
tgtgtctcatttcctcctgctg

SEQ ID NO: 9114228 - DNA, 22 bp, Homo sapiens
tgtgtctgaactagttgctctc

SEQ ID NO: 9114229 - DNA, 22 bp, Homo sapiens
tgtgtctgaactagttgctctc

SEQ ID NO: 9114230 - DNA, 22 bp, Homo sapiens
tgtgtctgcactgagtcctcac

SEQ ID NO: 9114231 - DNA, 22 bp, Homo sapiens
tgtgtctgcactgagtcctcac

SEQ ID NO: 9114232 - DNA, 22 bp, Homo sapiens
tgtgtctgcactgagtcctcac

SEQ ID NO: 9114233 - DNA, 23 bp, Homo sapiens
tgtgtctgaggatatatgtgcat

SEQ ID NO: 9114234 - DNA, 22 bp, Homo sapiens
tgtgtattaatgtttgtatatg

SEQ ID NO: 9114235 - DNA, 22 bp, Homo sapiens
tggggcagccacatagacaaca

SEQ ID NO: 9114236 - DNA, 22 bp, Homo sapiens
tggggcagctccatctattcca

SEQ ID NO: 9114237 - DNA, 22 bp, Homo sapiens
tggggcagctccatctattcca

SEQ ID NO: 9114238 - DNA, 22 bp, Homo sapiens
tggggcagggatgggaaactat

SEQ ID NO: 9114239 - DNA, 22 bp, Homo sapiens
tggggcagtggcttttcaccct

SEQ ID NO: 9114240 - DNA, 22 bp, Homo sapiens
tggggctgtgagactacaggat

SEQ ID NO: 9114241 - DNA, 22 bp, Homo sapiens
cctgggagtgtgccatctctgt

SEQ ID NO: 9114242 - DNA, 22 bp, Homo sapiens
cctgggagtgtgccatctctgt

SEQ ID NO: 9114243 - DNA, 22 bp, Homo sapiens
cctgggagtgtgccatctctgt

SEQ ID NO: 9114244 - DNA, 22 bp, Homo sapiens
cctgggatgctgtcctcatcta

SEQ ID NO: 9114245 - DNA, 22 bp, Homo sapiens
cctgggagtgcacaggtttcgt

SEQ ID NO: 9114246 - DNA, 19 bp, Homo sapiens
cctgggagtcagctgaagg

SEQ ID NO: 9114247 - DNA, 22 bp, Homo sapiens
cctgggagtggcactcacagca

SEQ ID NO: 9114248 - DNA, 22 bp, Homo sapiens
cctgggagtggcactcacagca

SEQ ID NO: 9114249 - DNA, 21 bp, Homo sapiens
tgggggagaattggttgcttt

SEQ ID NO: 9114250 - DNA, 21 bp, Homo sapiens
tgggggagaattggttgcttt

SEQ ID NO: 9114251 - DNA, 22 bp, Homo sapiens
cctgggaggctgaggctgcagt

SEQ ID NO: 9114252 - DNA, 22 bp, Homo sapiens
cctgggaggctgaggctgcagt

SEQ ID NO: 9114253 - DNA, 22 bp, Homo sapiens
tgttacagtactacaattctgc

SEQ ID NO: 9114254 - DNA, 22 bp, Homo sapiens
tgttcagttaacacagacacca

SEQ ID NO: 9114255 - DNA, 23 bp, Homo sapiens
tgttccagatacgccttttcctc

SEQ ID NO: 9114256 - DNA, 22 bp, Homo sapiens
tgttccaataaggagttgaaat

SEQ ID NO: 9114257 - DNA, 23 bp, Homo sapiens
tgttccagatacgccttttcctc

SEQ ID NO: 9114258 - DNA, 22 bp, Homo sapiens
cctggtggccttcagcccacaa

SEQ ID NO: 9114259 - DNA, 22 bp, Homo sapiens
cctggtggaaggtgagtgaggc

SEQ ID NO: 9114260 - DNA, 22 bp, Homo sapiens
cctggtgcttaccagagctttt

SEQ ID NO: 9114261 - DNA, 22 bp, Homo sapiens
cctgggtgtcatgggcagctgg

SEQ ID NO: 9114262 - DNA, 22 bp, Homo sapiens
cctggtgttgtgaagtagccgt

SEQ ID NO: 9114263 - DNA, 22 bp, Homo sapiens
cctggtgttgccaatctgtgcc

SEQ ID NO: 9114264 - DNA, 22 bp, Homo sapiens
cctggtgtctgtttacagcagc

SEQ ID NO: 9114265 - DNA, 22 bp, Homo sapiens
tgtgttctgaaggagaagagtg

SEQ ID NO: 9114266 - DNA, 22 bp, Homo sapiens
tgttaatatactaaaatccact

SEQ ID NO: 9114267 - DNA, 22 bp, Homo sapiens
tgttaatttctttagaagtgga

SEQ ID NO: 9114268 - DNA, 22 bp, Homo sapiens
tgttacaaactgttgtttctat

SEQ ID NO: 9114269 - DNA, 17 bp, Homo sapiens
tgttaattccaatgata

SEQ ID NO: 9114270 - DNA, 22 bp, Homo sapiens
tgttaatgtgctttgaaagact

SEQ ID NO: 9114271 - DNA, 17 bp, Homo sapiens
tgttaattccaatgata

SEQ ID NO: 9114272 - DNA, 22 bp, Homo sapiens
tgttacaacagtaccgtgctgt

SEQ ID NO: 9114273 - DNA, 23 bp, Homo sapiens
tgttacaagcaccacaggtggct

SEQ ID NO: 9114274 - DNA, 22 bp, Homo sapiens
tgttacaaggaagaatgtaggt

SEQ ID NO: 9114275 - DNA, 22 bp, Homo sapiens
cctgggctgttgcatcatcctt

SEQ ID NO: 9114276 - DNA, 22 bp, Homo sapiens
cctgggcttacgacctctgact

SEQ ID NO: 9114277 - DNA, 22 bp, Homo sapiens
cctgggcttacgacctctgact

SEQ ID NO: 9114278 - DNA, 22 bp, Homo sapiens
cctgggctgtacctgtgcgcgg

SEQ ID NO: 9114279 - DNA, 21 bp, Homo sapiens
cctgggctgtggtttggagac

SEQ ID NO: 9114280 - DNA, 22 bp, Homo sapiens
cctgggctgggcgtctcatggg

SEQ ID NO: 9114281 - DNA, 22 bp, Homo sapiens
cctgggctgggcgtctcatggg

SEQ ID NO: 9114282 - DNA, 22 bp, Homo sapiens
cctgggctgctcatggggatga

SEQ ID NO: 9114283 - DNA, 22 bp, Homo sapiens
cctgggctgctcatggggatga

SEQ ID NO: 9114284 - DNA, 22 bp, Homo sapiens
cctgggctggagtacagcagtg

SEQ ID NO: 9114285 - DNA, 22 bp, Homo sapiens
cctgggctggagtacagcagtg

SEQ ID NO: 9114286 - DNA, 22 bp, Homo sapiens
cctgggctggagtacagcagtg

SEQ ID NO: 9114287 - DNA, 22 bp, Homo sapiens
cctgggctggagtacagcagtg

SEQ ID NO: 9114288 - DNA, 22 bp, Homo sapiens
cctgggctgcatgatggcattt

SEQ ID NO: 9114289 - DNA, 22 bp, Homo sapiens
cctgggctgcatgatggcattt

SEQ ID NO: 9114290 - DNA, 22 bp, Homo sapiens
cctgggctgaagtcaagtgtgg

SEQ ID NO: 9114291 - DNA, 22 bp, Homo sapiens
cctgggctgaagtcaagtgtgg

SEQ ID NO: 9114292 - DNA, 22 bp, Homo sapiens
cctgggctctgtcagaattggg

SEQ ID NO: 9114293 - DNA, 16 bp, Homo sapiens
cctgggctctgttgga

SEQ ID NO: 9114294 - DNA, 22 bp, Homo sapiens
cctgggctcaagtgatcctcct

SEQ ID NO: 9114295 - DNA, 22 bp, Homo sapiens
cctgggctcaagtgatcctcct

SEQ ID NO: 9114296 - DNA, 22 bp, Homo sapiens
tgtgtctggataggtaatggat

SEQ ID NO: 9114297 - DNA, 22 bp, Homo sapiens
tgtgtctgcccttagtacatct

SEQ ID NO: 9114298 - DNA, 22 bp, Homo sapiens
tgtgtctggaccggggaggagc

SEQ ID NO: 9114299 - DNA, 22 bp, Homo sapiens
cctgggctctgaggagggagtc

SEQ ID NO: 9114300 - DNA, 22 bp, Homo sapiens
cctgggctctgaggagggagtc

SEQ ID NO: 9114301 - DNA, 22 bp, Homo sapiens
cctgggctctatcctgacccag

SEQ ID NO: 9114302 - DNA, 22 bp, Homo sapiens
cctgggctctatcctgacccag

SEQ ID NO: 9114303 - DNA, 22 bp, Homo sapiens
cctgggctctatcctgacccag

SEQ ID NO: 9114304 - DNA, 22 bp, Homo sapiens
cctgggctctatcctgacccag

SEQ ID NO: 9114305 - DNA, 22 bp, Homo sapiens
ttaaagtaatctgtgtgaattt

SEQ ID NO: 9114306 - DNA, 22 bp, Homo sapiens
ttaaaggctgatcttaatatta

SEQ ID NO: 9114307 - DNA, 22 bp, Homo sapiens
ttaaaggctatggctgcctggg

SEQ ID NO: 9114308 - DNA, 22 bp, Homo sapiens
ttaaaggcatggttagacatgg

SEQ ID NO: 9114309 - DNA, 22 bp, Homo sapiens
ttaaaggcgataaggcagtgtt

SEQ ID NO: 9114310 - DNA, 22 bp, Homo sapiens
ttaaagtatagaggacaaaaac

SEQ ID NO: 9114311 - DNA, 22 bp, Homo sapiens
cctgtgggaaaggtctgctctc

SEQ ID NO: 9114312 - DNA, 22 bp, Homo sapiens
cctgtggcttccacgacctaat

SEQ ID NO: 9114313 - DNA, 22 bp, Homo sapiens
cctgtggcttccacgacctaat

SEQ ID NO: 9114314 - DNA, 22 bp, Homo sapiens
cctgtgtcaccggaacggagga

SEQ ID NO: 9114315 - DNA, 22 bp, Homo sapiens
cctgtgtcagcccctgcctcca

SEQ ID NO: 9114316 - DNA, 22 bp, Homo sapiens
cctgtgtcagcccctgcctcca

SEQ ID NO: 9114317 - DNA, 22 bp, Homo sapiens
cctgtgtccagttccaggttgt

SEQ ID NO: 9114318 - DNA, 19 bp, Homo sapiens
cctgtgtcccacgtagatg

SEQ ID NO: 9114319 - DNA, 22 bp, Homo sapiens
cctgtgtcatcagctgtggcta

SEQ ID NO: 9114320 - DNA, 22 bp, Homo sapiens
cctgtgtcatcagctgtggcta

SEQ ID NO: 9114321 - DNA, 22 bp, Homo sapiens
cctgtgggttttcaagatgcta

SEQ ID NO: 9114322 - DNA, 22 bp, Homo sapiens
cctgtgggttttctgtagaaat

SEQ ID NO: 9114323 - DNA, 22 bp, Homo sapiens
cctgtgggtcacatgggtgact

SEQ ID NO: 9114324 - DNA, 22 bp, Homo sapiens
cctgtgccctcagcctggctct

SEQ ID NO: 9114325 - DNA, 22 bp, Homo sapiens
cctgtgccttccttaggcacct

SEQ ID NO: 9114326 - DNA, 22 bp, Homo sapiens
cctgtgctcccatagcttctgt

SEQ ID NO: 9114327 - DNA, 18 bp, Homo sapiens
cctgtgctccagcatctg

SEQ ID NO: 9114328 - DNA, 22 bp, Homo sapiens
ttaaaggaattgagtttcttgt

SEQ ID NO: 9114329 - DNA, 22 bp, Homo sapiens
ttaaaggaattgagtttcttgt

SEQ ID NO: 9114330 - DNA, 23 bp, Homo sapiens
ttaaaggcagatgttgagtatta

SEQ ID NO: 9114331 - DNA, 20 bp, Homo sapiens
cctgtgcttatcacttgctg

SEQ ID NO: 9114332 - DNA, 22 bp, Homo sapiens
cctgtgccatcctgagcatccc

SEQ ID NO: 9114333 - DNA, 22 bp, Homo sapiens
cctgtgaatgcattaatgagtg

SEQ ID NO: 9114334 - DNA, 22 bp, Homo sapiens
cctgtgaatgcattaatgagtg

SEQ ID NO: 9114335 - DNA, 22 bp, Homo sapiens
cctgtgaatccatcattatttc

SEQ ID NO: 9114336 - DNA, 23 bp, Homo sapiens
cctgtctgtgctgggtggacaca

SEQ ID NO: 9114337 - DNA, 19 bp, Homo sapiens
cctgtctgtcttcagctag

SEQ ID NO: 9114338 - DNA, 19 bp, Homo sapiens
cctgtctgtcttcagctag

SEQ ID NO: 9114339 - DNA, 20 bp, Homo sapiens
cctgtctggagacaaagaga

SEQ ID NO: 9114340 - DNA, 22 bp, Homo sapiens
cctgtctgtcctctcatgagcc

SEQ ID NO: 9114341 - DNA, 22 bp, Homo sapiens
cctgtctgtattggtttgctat

SEQ ID NO: 9114342 - DNA, 22 bp, Homo sapiens
cctgtctgtattggtttgctat

SEQ ID NO: 9114343 - DNA, 22 bp, Homo sapiens
tgtttagaggaactggaatcag

SEQ ID NO: 9114344 - DNA, 22 bp, Homo sapiens
tgtttagactcaaaattgaaag

SEQ ID NO: 9114345 - DNA, 22 bp, Homo sapiens
tgtttagatgcaaagtctcaca

SEQ ID NO: 9114346 - DNA, 22 bp, Homo sapiens
tgtttactttccttctcacagg

SEQ ID NO: 9114347 - DNA, 22 bp, Homo sapiens
cctgtcagatgaagtaattgtg

SEQ ID NO: 9114348 - DNA, 22 bp, Homo sapiens
tgtttataaattttcttgccat

SEQ ID NO: 9114349 - DNA, 22 bp, Homo sapiens
cctgtctctttcaatctgagag

SEQ ID NO: 9114350 - DNA, 22 bp, Homo sapiens
cctgtctgaggaggtgctcttt

SEQ ID NO: 9114351 - DNA, 22 bp, Homo sapiens
cctgtctctgttaccacatttg

SEQ ID NO: 9114352 - DNA, 22 bp, Homo sapiens
cctgtctgagccagggtgggca

SEQ ID NO: 9114353 - DNA, 21 bp, Homo sapiens
ttactaaacaaaacatgcagg

SEQ ID NO: 9114354 - DNA, 22 bp, Homo sapiens
ttactaagttttatgcaactta

SEQ ID NO: 9114355 - DNA, 22 bp, Homo sapiens
ttacttttgcaccaaactaata

SEQ ID NO: 9114356 - DNA, 22 bp, Homo sapiens
ttagaaaaaggctgtggtctta

SEQ ID NO: 9114357 - DNA, 22 bp, Homo sapiens
ccttccttcaagcacacatcta

SEQ ID NO: 9114358 - DNA, 22 bp, Homo sapiens
ccttccttgagaagcaattcct

SEQ ID NO: 9114359 - DNA, 22 bp, Homo sapiens
ccttccttgtctacaaaagctc

SEQ ID NO: 9114360 - DNA, 22 bp, Homo sapiens
ccttccttgtctacaaaagctc

SEQ ID NO: 9114361 - DNA, 22 bp, Homo sapiens
ccttcctttcagggctatgcct

SEQ ID NO: 9114362 - DNA, 22 bp, Homo sapiens
ccttcctttgcaggtcaggtca

SEQ ID NO: 9114363 - DNA, 22 bp, Homo sapiens
ccttcctttgcatcatttctag

SEQ ID NO: 9114364 - DNA, 22 bp, Homo sapiens
ccttccttttactgtctccgga

SEQ ID NO: 9114365 - DNA, 22 bp, Homo sapiens
ccttctagcaaatcaacataaa

SEQ ID NO: 9114366 - DNA, 22 bp, Homo sapiens
ccttcgagatttaaacactgat

SEQ ID NO: 9114367 - DNA, 22 bp, Homo sapiens
ttagacaatctgttggtaaggt

SEQ ID NO: 9114368 - DNA, 22 bp, Homo sapiens
ttagaatctaacattcttatct

SEQ ID NO: 9114369 - DNA, 22 bp, Homo sapiens
ttagaaaaatgttcagtagttt

SEQ ID NO: 9114370 - DNA, 22 bp, Homo sapiens
ttagaaaacataagtggtaaag

SEQ ID NO: 9114371 - DNA, 22 bp, Homo sapiens
ttagaaaatttgcttctttgga

SEQ ID NO: 9114372 - DNA, 17 bp, Homo sapiens
ccttcctcatctccttc

SEQ ID NO: 9114373 - DNA, 22 bp, Homo sapiens
ccttcctggagcccatgcagat

SEQ ID NO: 9114374 - DNA, 22 bp, Homo sapiens
ccttcctggctgtccgcctgat

SEQ ID NO: 9114375 - DNA, 19 bp, Homo sapiens
ccttccccttcagcctctg

SEQ ID NO: 9114376 - DNA, 22 bp, Homo sapiens
ccttcagtcccatgtttctctt

SEQ ID NO: 9114377 - DNA, 22 bp, Homo sapiens
ccttccagtgactaaggaggaa

SEQ ID NO: 9114378 - DNA, 22 bp, Homo sapiens
ccttcccaggctagaccaacat

SEQ ID NO: 9114379 - DNA, 22 bp, Homo sapiens
cctgtgtcctcccactcagtcc

SEQ ID NO: 9114380 - DNA, 22 bp, Homo sapiens
cctgtgtccttggcagatatcc

SEQ ID NO: 9114381 - DNA, 22 bp, Homo sapiens
cctgtgtccttggcagatatcc

SEQ ID NO: 9114382 - DNA, 23 bp, Homo sapiens
cctgtgtctgttgctgaataatg

SEQ ID NO: 9114383 - DNA, 22 bp, Homo sapiens
cctgtgtcttccccactggtgt

SEQ ID NO: 9114384 - DNA, 22 bp, Homo sapiens
cctgtgtcttccccactggtgt

SEQ ID NO: 9114385 - DNA, 22 bp, Homo sapiens
cctgtgtggaaaccgcatgacg

SEQ ID NO: 9114386 - DNA, 22 bp, Homo sapiens
cctgtgtgctgatgacgacaga

SEQ ID NO: 9114387 - DNA, 23 bp, Homo sapiens
cctgtgtgcccttaattcacagc

SEQ ID NO: 9114388 - DNA, 22 bp, Homo sapiens
cctgtgtgctgatgacgacaga

SEQ ID NO: 9114389 - DNA, 22 bp, Homo sapiens
cctgtgtgcacacgaggccatg

SEQ ID NO: 9114390 - DNA, 20 bp, Homo sapiens
cctgtgtggccagctgaggc

SEQ ID NO: 9114391 - DNA, 22 bp, Homo sapiens
cctgtgtggccgcactgctccc

SEQ ID NO: 9114392 - DNA, 22 bp, Homo sapiens
cctgtgtggccaggctggagtc

SEQ ID NO: 9114393 - DNA, 19 bp, Homo sapiens
cctgtgtggggtagagatc

SEQ ID NO: 9114394 - DNA, 19 bp, Homo sapiens
cctgtgtggggtagagatc

SEQ ID NO: 9114395 - DNA, 22 bp, Homo sapiens
cctgtgtgtaggccaggggagt

SEQ ID NO: 9114396 - DNA, 20 bp, Homo sapiens
cctgtgtggtttgcactaca

SEQ ID NO: 9114397 - DNA, 22 bp, Homo sapiens
cctgtgtgtaggccaggggagt

SEQ ID NO: 9114398 - DNA, 21 bp, Homo sapiens
cctgtgtgtctgactgggcta

SEQ ID NO: 9114399 - DNA, 22 bp, Homo sapiens
cctgtgtgtctgtcactgcaca

SEQ ID NO: 9114400 - DNA, 22 bp, Homo sapiens
ccttcaggtcatatatgtcaga

SEQ ID NO: 9114401 - DNA, 22 bp, Homo sapiens
ttcctgggcaggacgagagtct

SEQ ID NO: 9114402 - DNA, 22 bp, Homo sapiens
ctacagagttcacaggatttta

SEQ ID NO: 9114403 - DNA, 22 bp, Homo sapiens
ctacagctgtaaaaggaatgtc

SEQ ID NO: 9114404 - DNA, 22 bp, Homo sapiens
ctacagctggccttggaaaact

SEQ ID NO: 9114405 - DNA, 22 bp, Homo sapiens
ctacagcagagctacactaact

SEQ ID NO: 9114406 - DNA, 22 bp, Homo sapiens
ctacaggagtaaaataatttca

SEQ ID NO: 9114407 - DNA, 22 bp, Homo sapiens
ctacaggtatgtgcatgacatc

SEQ ID NO: 9114408 - DNA, 22 bp, Homo sapiens
ctacaggtcaagcagtagctct

SEQ ID NO: 9114409 - DNA, 22 bp, Homo sapiens
ctaaatgacaggtaccatagtg

SEQ ID NO: 9114410 - DNA, 22 bp, Homo sapiens
ttccaggaccaggaagagggga

SEQ ID NO: 9114411 - DNA, 22 bp, Homo sapiens
ctaaatcatcatttatgtttgt

SEQ ID NO: 9114412 - DNA, 22 bp, Homo sapiens
ctaaatgacttccagtggttat

SEQ ID NO: 9114413 - DNA, 22 bp, Homo sapiens
ttccaggaattcagctctcagt

SEQ ID NO: 9114414 - DNA, 22 bp, Homo sapiens
ttccaggacttcatggctctga

SEQ ID NO: 9114415 - DNA, 22 bp, Homo sapiens
ttccaggacttcatggctctga

SEQ ID NO: 9114416 - DNA, 22 bp, Homo sapiens
ttccaggactcgttctggctca

SEQ ID NO: 9114417 - DNA, 22 bp, Homo sapiens
ttccaggactgggtgtttgaag

SEQ ID NO: 9114418 - DNA, 22 bp, Homo sapiens
ttccaggactcgttctggctca

SEQ ID NO: 9114419 - DNA, 22 bp, Homo sapiens
ctacagagaactcagctgccct

SEQ ID NO: 9114420 - DNA, 22 bp, Homo sapiens
ttccaggaggaggtactagagg

SEQ ID NO: 9114421 - DNA, 22 bp, Homo sapiens
ttccaggaggcattcttagttt

SEQ ID NO: 9114422 - DNA, 22 bp, Homo sapiens
ttccaggatagctttcaggaat

SEQ ID NO: 9114423 - DNA, 22 bp, Homo sapiens
ttccaggatgctgctgcttttt

SEQ ID NO: 9114424 - DNA, 22 bp, Homo sapiens
ttccaggatgctgctgcttttt

SEQ ID NO: 9114425 - DNA, 22 bp, Homo sapiens
ctacttctgtgatgaaactaca

SEQ ID NO: 9114426 - DNA, 22 bp, Homo sapiens
ctacttctgtgatgaaactaca

SEQ ID NO: 9114427 - DNA, 22 bp, Homo sapiens
ctactgttgtgttttaaaggta

SEQ ID NO: 9114428 - DNA, 22 bp, Homo sapiens
ctactttgctgcccagcagtgc

SEQ ID NO: 9114429 - DNA, 19 bp, Homo sapiens
ctactttataatatgcctc

SEQ ID NO: 9114430 - DNA, 22 bp, Homo sapiens
ttctctggagggctgcccggcc

SEQ ID NO: 9114431 - DNA, 22 bp, Homo sapiens
ttctctggagagtatcttctta

SEQ ID NO: 9114432 - DNA, 21 bp, Homo sapiens
ttctctggataggccagtcct

SEQ ID NO: 9114433 - DNA, 20 bp, Homo sapiens
ttctctggatagccagatgt

SEQ ID NO: 9114434 - DNA, 19 bp, Homo sapiens
ttctctggactagatgctg

SEQ ID NO: 9114435 - DNA, 22 bp, Homo sapiens
ttctctaaatgtgaaccggctt

SEQ ID NO: 9114436 - DNA, 22 bp, Homo sapiens
ttctctggactatttgcactcc

SEQ ID NO: 9114437 - DNA, 22 bp, Homo sapiens
ttctctaaagagttaggccaag

SEQ ID NO: 9114438 - DNA, 22 bp, Homo sapiens
ttctctaaacatattggatctg

SEQ ID NO: 9114439 - DNA, 22 bp, Homo sapiens
ttctctaaaattaagtgaggta

SEQ ID NO: 9114440 - DNA, 22 bp, Homo sapiens
ttctctaaaattaagtgaggta

SEQ ID NO: 9114441 - DNA, 22 bp, Homo sapiens
ctactggccatctgatctacaa

SEQ ID NO: 9114442 - DNA, 22 bp, Homo sapiens
ctactgagtccttcagctgcca

SEQ ID NO: 9114443 - DNA, 22 bp, Homo sapiens
ctacctaataatttgatattca

SEQ ID NO: 9114444 - DNA, 22 bp, Homo sapiens
ctacatttcatccagggagagc

SEQ ID NO: 9114445 - DNA, 22 bp, Homo sapiens
ttcctgggctttcccctctggt

SEQ ID NO: 9114446 - DNA, 22 bp, Homo sapiens
ctacccaggctggagtgcagta

SEQ ID NO: 9114447 - DNA, 22 bp, Homo sapiens
ctacatttcatccagggagagc

SEQ ID NO: 9114448 - DNA, 22 bp, Homo sapiens
ctatatatatcatcttccagtt

SEQ ID NO: 9114449 - DNA, 22 bp, Homo sapiens
ctatgagaagaaaacaagatta

SEQ ID NO: 9114450 - DNA, 22 bp, Homo sapiens
ctatgcagggctgggagggaaa

SEQ ID NO: 9114451 - DNA, 23 bp, Homo sapiens
ctatggaataccaatgattctca

SEQ ID NO: 9114452 - DNA, 22 bp, Homo sapiens
ctatggtgatagaaatcagaat

SEQ ID NO: 9114453 - DNA, 22 bp, Homo sapiens
ctattaaacactactgtgcact

SEQ ID NO: 9114454 - DNA, 22 bp, Homo sapiens
ctattaaatactcttcaaattg

SEQ ID NO: 9114455 - DNA, 18 bp, Homo sapiens
ctattacaatgcagtggt

SEQ ID NO: 9114456 - DNA, 22 bp, Homo sapiens
ctattacatttctggacattca

SEQ ID NO: 9114457 - DNA, 22 bp, Homo sapiens
ctattaaatactcttcaaattg

SEQ ID NO: 9114458 - DNA, 23 bp, Homo sapiens
ctagatgcaagctccatgaggga

SEQ ID NO: 9114459 - DNA, 22 bp, Homo sapiens
ttctctgggaacataaatgaag

SEQ ID NO: 9114460 - DNA, 21 bp, Homo sapiens
ttctctggcttctgtagctgg

SEQ ID NO: 9114461 - DNA, 22 bp, Homo sapiens
ctagcactgagaatagtgcata

SEQ ID NO: 9114462 - DNA, 22 bp, Homo sapiens
ttctctggcgcgctgtgctatg

SEQ ID NO: 9114463 - DNA, 22 bp, Homo sapiens
ttctctggcggtgtgttttcct

SEQ ID NO: 9114464 - DNA, 22 bp, Homo sapiens
ttctctggcctgaggcgaggcc

SEQ ID NO: 9114465 - DNA, 22 bp, Homo sapiens
ttctctggcctgaggcgaggcc

SEQ ID NO: 9114466 - DNA, 22 bp, Homo sapiens
ttctctggccatagctggctag

SEQ ID NO: 9114467 - DNA, 22 bp, Homo sapiens
ttctctggatgtttctcagtca

SEQ ID NO: 9114468 - DNA, 22 bp, Homo sapiens
ctatatacttttcacagatgtt

SEQ ID NO: 9114469 - DNA, 22 bp, Homo sapiens
ctatatacttttcacagatgtt

SEQ ID NO: 9114470 - DNA, 22 bp, Homo sapiens
ctagcagtgtactcaacaaggg

SEQ ID NO: 9114471 - DNA, 22 bp, Homo sapiens
ctagcagggattgggcactggg

SEQ ID NO: 9114472 - DNA, 22 bp, Homo sapiens
ctagcagcatcacaggaagact

SEQ ID NO: 9114473 - DNA, 22 bp, Homo sapiens
ctagcacttagggattgttatg

SEQ ID NO: 9114474 - DNA, 22 bp, Homo sapiens
ctagcagcatcacaggaagact

SEQ ID NO: 9114475 - DNA, 22 bp, Homo sapiens
ctagcagctctgatatttacaa

SEQ ID NO: 9114476 - DNA, 22 bp, Homo sapiens
ctagcagcattcttctagttag

SEQ ID NO: 9114477 - DNA, 22 bp, Homo sapiens
ctagcagcattcttctagttag

SEQ ID NO: 9114478 - DNA, 22 bp, Homo sapiens
ctattattagataatctacttg

SEQ ID NO: 9114479 - DNA, 22 bp, Homo sapiens
ctcaaaagacttaaacataaga

SEQ ID NO: 9114480 - DNA, 22 bp, Homo sapiens
ctattatttcctcatctataaa

SEQ ID NO: 9114481 - DNA, 22 bp, Homo sapiens
ctattatttcctcatctataaa

SEQ ID NO: 9114482 - DNA, 22 bp, Homo sapiens
ctattattatgttaactggact

SEQ ID NO: 9114483 - DNA, 22 bp, Homo sapiens
ctcaaggaaagtctggagaaga

SEQ ID NO: 9114484 - DNA, 22 bp, Homo sapiens
ctcaagtctattgataagtgca

SEQ ID NO: 9114485 - DNA, 22 bp, Homo sapiens
ctcaagtctgagtactggctct

SEQ ID NO: 9114486 - DNA, 22 bp, Homo sapiens
ctcaagtctgatgggttaggtt

SEQ ID NO: 9114487 - DNA, 22 bp, Homo sapiens
ctcaagtccatagaatcaggaa

SEQ ID NO: 9114488 - DNA, 22 bp, Homo sapiens
ctcaagtcccgcagtgttcctc

SEQ ID NO: 9114489 - DNA, 22 bp, Homo sapiens
ctcaagtcagaaataaaagcat

SEQ ID NO: 9114490 - DNA, 22 bp, Homo sapiens
ctcacaggcatctcatcaggct

SEQ ID NO: 9114491 - DNA, 22 bp, Homo sapiens
ctcacaggtcatgtggtggctt

SEQ ID NO: 9114492 - DNA, 22 bp, Homo sapiens
ctcacaggttagttgtgtggat

SEQ ID NO: 9114493 - DNA, 22 bp, Homo sapiens
ctcacagggttctatcgaagag

SEQ ID NO: 9114494 - DNA, 22 bp, Homo sapiens
ctcacaggagaaagtcatggtc

SEQ ID NO: 9114495 - DNA, 22 bp, Homo sapiens
ctcacagagcctctgtgtcttc

SEQ ID NO: 9114496 - DNA, 22 bp, Homo sapiens
ctcacaaccttatgaagcatga

SEQ ID NO: 9114497 - DNA, 22 bp, Homo sapiens
ctcacagatgctgtgggtcagg

SEQ ID NO: 9114498 - DNA, 22 bp, Homo sapiens
ctcacagatgatgtctatgtgg

SEQ ID NO: 9114499 - DNA, 22 bp, Homo sapiens
cctttcccgctttgagggcaag

SEQ ID NO: 9114500 - DNA, 22 bp, Homo sapiens
cctttcagatgggcatggaccg

SEQ ID NO: 9114501 - DNA, 19 bp, Homo sapiens
cctttcagaacagaagcca

SEQ ID NO: 9114502 - DNA, 22 bp, Homo sapiens
cctttctcattttaagcattag

SEQ ID NO: 9114503 - DNA, 16 bp, Homo sapiens
cctttctctgccttcc

SEQ ID NO: 9114504 - DNA, 22 bp, Homo sapiens
cctttctctatcgacccatcgc

SEQ ID NO: 9114505 - DNA, 22 bp, Homo sapiens
cctttctctttgctgatcatgt

SEQ ID NO: 9114506 - DNA, 22 bp, Homo sapiens
cctttctctttgctgatcatgt

SEQ ID NO: 9114507 - DNA, 22 bp, Homo sapiens
cctttctctggcagcaggacag

SEQ ID NO: 9114508 - DNA, 17 bp, Homo sapiens
cctttctctttcatctc

SEQ ID NO: 9114509 - DNA, 22 bp, Homo sapiens
cctttctcttggataccgattg

SEQ ID NO: 9114510 - DNA, 22 bp, Homo sapiens
cgcagtgagtctgtaaaaggct

SEQ ID NO: 9114511 - DNA, 22 bp, Homo sapiens
cgcagctggatatcatgtgcct

SEQ ID NO: 9114512 - DNA, 19 bp, Homo sapiens
cgcaggtggaaggagccgc

SEQ ID NO: 9114513 - DNA, 22 bp, Homo sapiens
cgcatccagggcgcaggatctg

SEQ ID NO: 9114514 - DNA, 22 bp, Homo sapiens
cgcatccagggcgcaggatctg

SEQ ID NO: 9114515 - DNA, 22 bp, Homo sapiens
cgccaggcttggtagctcatgc

SEQ ID NO: 9114516 - DNA, 22 bp, Homo sapiens
ttaggatttgaaaaggggcaga

SEQ ID NO: 9114517 - DNA, 22 bp, Homo sapiens
ttaggagtccagatgtcttggg

SEQ ID NO: 9114518 - DNA, 22 bp, Homo sapiens
ttaggcatagttttgataaata

SEQ ID NO: 9114519 - DNA, 22 bp, Homo sapiens
ttaggcatatgaaatagaatgt

SEQ ID NO: 9114520 - DNA, 22 bp, Homo sapiens
ttaggcatgaacaggattcatt

SEQ ID NO: 9114521 - DNA, 22 bp, Homo sapiens
ttaggctactgtgactttcctg

SEQ ID NO: 9114522 - DNA, 22 bp, Homo sapiens
ttaggctctctgcaactaagta

SEQ ID NO: 9114523 - DNA, 22 bp, Homo sapiens
ttaggccaatcaggaaaactca

SEQ ID NO: 9114524 - DNA, 22 bp, Homo sapiens
ttaggcattagagaaatgcaat

SEQ ID NO: 9114525 - DNA, 22 bp, Homo sapiens
cgcagctgctgctctgaaacag

SEQ ID NO: 9114526 - DNA, 22 bp, Homo sapiens
cgcagctgccttgtcagccgtt

SEQ ID NO: 9114527 - DNA, 20 bp, Homo sapiens
ttcaagttgggtctctggct

SEQ ID NO: 9114528 - DNA, 22 bp, Homo sapiens
ttcacaattaactttatactta

SEQ ID NO: 9114529 - DNA, 22 bp, Homo sapiens
ttcaataggatgcatgatataa

SEQ ID NO: 9114530 - DNA, 22 bp, Homo sapiens
ttcaatacaaagaaaggaattt

SEQ ID NO: 9114531 - DNA, 22 bp, Homo sapiens
ttcaatagaaatgacattcttt

SEQ ID NO: 9114532 - DNA, 22 bp, Homo sapiens
ttcaatagcatacttttgctct

SEQ ID NO: 9114533 - DNA, 22 bp, Homo sapiens
ttcaataggatgcatgatataa

SEQ ID NO: 9114534 - DNA, 22 bp, Homo sapiens
ttcaatagcatacttttgctct

SEQ ID NO: 9114535 - DNA, 22 bp, Homo sapiens
ttcaatagaaagtccctagtta

SEQ ID NO: 9114536 - DNA, 20 bp, Homo sapiens
ttcaatacattactttgatt

SEQ ID NO: 9114537 - DNA, 21 bp, Homo sapiens
ttcaatactatttcaatagtc

SEQ ID NO: 9114538 - DNA, 22 bp, Homo sapiens
ttcacaatttcccttcatcagg

SEQ ID NO: 9114539 - DNA, 22 bp, Homo sapiens
ttcacacagaatctgaggagct

SEQ ID NO: 9114540 - DNA, 22 bp, Homo sapiens
ttcaagtctgaagaggactaat

SEQ ID NO: 9114541 - DNA, 22 bp, Homo sapiens
cgccggcttgaggcaggcggca

SEQ ID NO: 9114542 - DNA, 22 bp, Homo sapiens
cgccggcttgaggcaggcggca

SEQ ID NO: 9114543 - DNA, 22 bp, Homo sapiens
ttcaagtgaggctgtctttaga

SEQ ID NO: 9114544 - DNA, 22 bp, Homo sapiens
ttcaagtcttccatggtattct

SEQ ID NO: 9114545 - DNA, 22 bp, Homo sapiens
ttcaagtctggagatctggaac

SEQ ID NO: 9114546 - DNA, 22 bp, Homo sapiens
ttcaagtctgtttcattgcatg

SEQ ID NO: 9114547 - DNA, 22 bp, Homo sapiens
ttcaagtctgcccagagtcagc

SEQ ID NO: 9114548 - DNA, 22 bp, Homo sapiens
cgcccctcagcgacccaccagc

SEQ ID NO: 9114549 - DNA, 22 bp, Homo sapiens
cgcccaggctggagtgcagtgg

SEQ ID NO: 9114550 - DNA, 20 bp, Homo sapiens
cgcccagtgcggttctgacc

SEQ ID NO: 9114551 - DNA, 22 bp, Homo sapiens
cgcccaggctggagtgcagtga

SEQ ID NO: 9114552 - DNA, 22 bp, Homo sapiens
cgcccaggctggagagcagtgg

SEQ ID NO: 9114553 - DNA, 22 bp, Homo sapiens
ttcagaggacaaccagccatct

SEQ ID NO: 9114554 - DNA, 21 bp, Homo sapiens
ttcagaggatgccaaggtcca

SEQ ID NO: 9114555 - DNA, 22 bp, Homo sapiens
ttcagagggacattcaagggaa

SEQ ID NO: 9114556 - DNA, 22 bp, Homo sapiens
ttcagaggctgtatgactagat

SEQ ID NO: 9114557 - DNA, 22 bp, Homo sapiens
ttcacagaattgtcttgactgg

SEQ ID NO: 9114558 - DNA, 22 bp, Homo sapiens
ttcacagaattgtcttgactgg

SEQ ID NO: 9114559 - DNA, 22 bp, Homo sapiens
ttcacagaagaggtcacatttc

SEQ ID NO: 9114560 - DNA, 22 bp, Homo sapiens
ttcacactgtttttcatagtgg

SEQ ID NO: 9114561 - DNA, 20 bp, Homo sapiens
ttcagagtttactcaaactg

SEQ ID NO: 9114562 - DNA, 22 bp, Homo sapiens
ttcagagttagacgaaaagcaa

SEQ ID NO: 9114563 - DNA, 20 bp, Homo sapiens
ttcagagtcagcaaatgcag

SEQ ID NO: 9114564 - DNA, 20 bp, Homo sapiens
ttcagagtcagcaaatgcag

SEQ ID NO: 9114565 - DNA, 20 bp, Homo sapiens
ttcagagtcagcaaatgcag

SEQ ID NO: 9114566 - DNA, 22 bp, Homo sapiens
ttcagagtcagggatctcagag

SEQ ID NO: 9114567 - DNA, 22 bp, Homo sapiens
ttcagaggggctaagtacttgc

SEQ ID NO: 9114568 - DNA, 22 bp, Homo sapiens
ttcagagggttcagagggttcg

SEQ ID NO: 9114569 - DNA, 22 bp, Homo sapiens
ttcagagggttcagagggttcg

SEQ ID NO: 9114570 - DNA, 22 bp, Homo sapiens
ttcagagggacattcaagggaa

SEQ ID NO: 9114571 - DNA, 22 bp, Homo sapiens
ttcagagggacattcaagggaa

SEQ ID NO: 9114572 - DNA, 22 bp, Homo sapiens
ttcagagggttttagggtcaga

SEQ ID NO: 9114573 - DNA, 22 bp, Homo sapiens
ttcagagggttttagggtcaga

SEQ ID NO: 9114574 - DNA, 22 bp, Homo sapiens
ttcagagggttttagggtcaga

SEQ ID NO: 9114575 - DNA, 22 bp, Homo sapiens
ttcagaggtaagggtctcagaa

SEQ ID NO: 9114576 - DNA, 22 bp, Homo sapiens
ttcagaggtaagggtctcagaa

SEQ ID NO: 9114577 - DNA, 22 bp, Homo sapiens
ttcagaggtgggctgagaggat

SEQ ID NO: 9114578 - DNA, 22 bp, Homo sapiens
ttcagaggtgggctgagaggat

SEQ ID NO: 9114579 - DNA, 22 bp, Homo sapiens
ttcagaggtagagaggatcttg

SEQ ID NO: 9114580 - DNA, 20 bp, Homo sapiens
ttcagaggtgaagttgtggt

SEQ ID NO: 9114581 - DNA, 22 bp, Homo sapiens
ttcagaggtttccgggccatgc

SEQ ID NO: 9114582 - DNA, 22 bp, Homo sapiens
ttcagaggttagagcagtggga

SEQ ID NO: 9114583 - DNA, 22 bp, Homo sapiens
ttcagaggttagagcagtggga

SEQ ID NO: 9114584 - DNA, 22 bp, Homo sapiens
ttcagataatgacaggtcagga

SEQ ID NO: 9114585 - DNA, 22 bp, Homo sapiens
ttcagatatcattaatttagta

SEQ ID NO: 9114586 - DNA, 22 bp, Homo sapiens
ttcagcaaacacgatgcttgtt

SEQ ID NO: 9114587 - DNA, 22 bp, Homo sapiens
ttcagcaaaatatctcagatag

SEQ ID NO: 9114588 - DNA, 22 bp, Homo sapiens
ttcaggatgacaccatgtccag

SEQ ID NO: 9114589 - DNA, 22 bp, Homo sapiens
ttcaggcagctgaggagaaagt

SEQ ID NO: 9114590 - DNA, 22 bp, Homo sapiens
ttcaggattctttcagactggg

SEQ ID NO: 9114591 - DNA, 22 bp, Homo sapiens
ttcaggcctaatttctagcccc

SEQ ID NO: 9114592 - DNA, 22 bp, Homo sapiens
ttcaggcatggaaactggatta

SEQ ID NO: 9114593 - DNA, 22 bp, Homo sapiens
ttcaggcctaatttctagcccc

SEQ ID NO: 9114594 - DNA, 22 bp, Homo sapiens
ttcagggacttagtgtcagttt

SEQ ID NO: 9114595 - DNA, 22 bp, Homo sapiens
ttcagggactttgatgtatcag

SEQ ID NO: 9114596 - DNA, 22 bp, Homo sapiens
ttcagggacttagtgtcagttt

SEQ ID NO: 9114597 - DNA, 22 bp, Homo sapiens
ttcagggactttgatgtatcag

SEQ ID NO: 9114598 - DNA, 22 bp, Homo sapiens
ttcatgaagggtgaatatagtc

SEQ ID NO: 9114599 - DNA, 22 bp, Homo sapiens
ttcatgaacgaacatatgtata

SEQ ID NO: 9114600 - DNA, 22 bp, Homo sapiens
ttcatgaaagacagcaactgtg

SEQ ID NO: 9114601 - DNA, 22 bp, Homo sapiens
ttcatgaatggaatcaatgctc

SEQ ID NO: 9114602 - DNA, 22 bp, Homo sapiens
ctaaacttttataacattgaga

SEQ ID NO: 9114603 - DNA, 22 bp, Homo sapiens
ctaaagaagctagcaatctata

SEQ ID NO: 9114604 - DNA, 22 bp, Homo sapiens
ctaaaattacctaccagtttag

SEQ ID NO: 9114605 - DNA, 22 bp, Homo sapiens
ctaaaatgtttggggcagaacc

SEQ ID NO: 9114606 - DNA, 22 bp, Homo sapiens
ctaaagagagttcaagactcct

SEQ ID NO: 9114607 - DNA, 22 bp, Homo sapiens
ctaaagagaagatgtttgctga

SEQ ID NO: 9114608 - DNA, 22 bp, Homo sapiens
ctaaagacacaataagtagctt

SEQ ID NO: 9114609 - DNA, 22 bp, Homo sapiens
ctaaagtccttatcaagtgtaa

SEQ ID NO: 9114610 - DNA, 22 bp, Homo sapiens
ctaaagtcatacaaggtgggag

SEQ ID NO: 9114611 - DNA, 22 bp, Homo sapiens
ctaaaggctcagcattcttttc

SEQ ID NO: 9114612 - DNA, 22 bp, Homo sapiens
ctaaaggctaggtctgaactca

SEQ ID NO: 9114613 - DNA, 22 bp, Homo sapiens
ctaaagcattctcagattttgc

SEQ ID NO: 9114614 - DNA, 22 bp, Homo sapiens
ctaaagcaactgagacacatag

SEQ ID NO: 9114615 - DNA, 22 bp, Homo sapiens
ctaaagcaactgagacacatag

SEQ ID NO: 9114616 - DNA, 22 bp, Homo sapiens
ctaaagcaactgagacacatag

SEQ ID NO: 9114617 - DNA, 17 bp, Homo sapiens
ctaaatacttgcgtttc

SEQ ID NO: 9114618 - DNA, 22 bp, Homo sapiens
ctaaatactagccttcagattt

SEQ ID NO: 9114619 - DNA, 22 bp, Homo sapiens
ctaaataatccctctggtctta

SEQ ID NO: 9114620 - DNA, 22 bp, Homo sapiens
cggtcctggcacttgcggctcc

SEQ ID NO: 9114621 - DNA, 22 bp, Homo sapiens
cggtcctgtacttgatgagata

SEQ ID NO: 9114622 - DNA, 22 bp, Homo sapiens
cggtcctggcacttgcggctcc

SEQ ID NO: 9114623 - DNA, 22 bp, Homo sapiens
cggtctcccgtgtgtgtgcgct

SEQ ID NO: 9114624 - DNA, 19 bp, Homo sapiens
cgtacctgacacagaacag

SEQ ID NO: 9114625 - DNA, 22 bp, Homo sapiens
cgtaggtggctcagcacctggg

SEQ ID NO: 9114626 - DNA, 22 bp, Homo sapiens
cgtagctcacgccccctctccc

SEQ ID NO: 9114627 - DNA, 22 bp, Homo sapiens
ctttcatgaacagacaaggaac

SEQ ID NO: 9114628 - DNA, 22 bp, Homo sapiens
ctttcatgcacttctttagatc

SEQ ID NO: 9114629 - DNA, 22 bp, Homo sapiens
ctttcatgcagttgacaaggtg

SEQ ID NO: 9114630 - DNA, 19 bp, Homo sapiens
ctttcatgtggttcttctt

SEQ ID NO: 9114631 - DNA, 22 bp, Homo sapiens
ctttcatagttaaaatagtttg

SEQ ID NO: 9114632 - DNA, 22 bp, Homo sapiens
ctttcattcttagatattagtg

SEQ ID NO: 9114633 - DNA, 22 bp, Homo sapiens
ctttcatttgataagaatgcca

SEQ ID NO: 9114634 - DNA, 22 bp, Homo sapiens
ctttcatttgataagaatgcca

SEQ ID NO: 9114635 - DNA, 22 bp, Homo sapiens
gaaatcaaggctacattcaggt

SEQ ID NO: 9114636 - DNA, 22 bp, Homo sapiens
gaaatcaatttcttggttgata

SEQ ID NO: 9114637 - DNA, 22 bp, Homo sapiens
gaaatcagttctgaaatttaca

SEQ ID NO: 9114638 - DNA, 20 bp, Homo sapiens
gaaatcagttaatgatggtt

SEQ ID NO: 9114639 - DNA, 22 bp, Homo sapiens
gaaatatttctcttgagcccct

SEQ ID NO: 9114640 - DNA, 22 bp, Homo sapiens
gaaatatttctcttgagcccct

SEQ ID NO: 9114641 - DNA, 22 bp, Homo sapiens
ctttcaatcaaagtttctagtg

SEQ ID NO: 9114642 - DNA, 18 bp, Homo sapiens
ctttatgtgcagagcttt

SEQ ID NO: 9114643 - DNA, 22 bp, Homo sapiens
ctttcacagtcatatgatgaat

SEQ ID NO: 9114644 - DNA, 22 bp, Homo sapiens
ctttcaggtcacataacgccaa

SEQ ID NO: 9114645 - DNA, 22 bp, Homo sapiens
ctttcaggttctataggaagcc

SEQ ID NO: 9114646 - DNA, 22 bp, Homo sapiens
ctttcagggcagacaacgagca

SEQ ID NO: 9114647 - DNA, 22 bp, Homo sapiens
ctttcaggagaggattataaca

SEQ ID NO: 9114648 - DNA, 22 bp, Homo sapiens
ctttcaggggcttgactccaca

SEQ ID NO: 9114649 - DNA, 22 bp, Homo sapiens
ctttcaggaaggttaaatataa

SEQ ID NO: 9114650 - DNA, 18 bp, Homo sapiens
ctttcagatggatatgct

SEQ ID NO: 9114651 - DNA, 22 bp, Homo sapiens
ctttcagggcaacacttctttt

SEQ ID NO: 9114652 - DNA, 22 bp, Homo sapiens
ctttcagaagccggaagggcag

SEQ ID NO: 9114653 - DNA, 22 bp, Homo sapiens
ctttcagaggggcgtacacagc

SEQ ID NO: 9114654 - DNA, 22 bp, Homo sapiens
gaacagggttgggtgagagagg

SEQ ID NO: 9114655 - DNA, 22 bp, Homo sapiens
gaacagggagtacggcacattt

SEQ ID NO: 9114656 - DNA, 22 bp, Homo sapiens
gaacagcttcttgggagctggg

SEQ ID NO: 9114657 - DNA, 22 bp, Homo sapiens
gaacagctgctagagatctgtg

SEQ ID NO: 9114658 - DNA, 22 bp, Homo sapiens
gaacagctgctagagatctgtg

SEQ ID NO: 9114659 - DNA, 22 bp, Homo sapiens
gaacagcttcttgggagctggg

SEQ ID NO: 9114660 - DNA, 22 bp, Homo sapiens
gaacagctctgaagcagtaaat

SEQ ID NO: 9114661 - DNA, 22 bp, Homo sapiens
gaacagctataatcatctgtcc

SEQ ID NO: 9114662 - DNA, 22 bp, Homo sapiens
gaacagtgccagcacacaataa

SEQ ID NO: 9114663 - DNA, 22 bp, Homo sapiens
gaacagtactaagagctttaca

SEQ ID NO: 9114664 - DNA, 17 bp, Homo sapiens
gaacagtgtaagacact

SEQ ID NO: 9114665 - DNA, 22 bp, Homo sapiens
gaacatttggatttgtaaattt

SEQ ID NO: 9114666 - DNA, 22 bp, Homo sapiens
gaacatttggatttgtaaattt

SEQ ID NO: 9114667 - DNA, 22 bp, Homo sapiens
gaaatcatctgagtaataatct

SEQ ID NO: 9114668 - DNA, 22 bp, Homo sapiens
gaaatcattagcaaagatatgt

SEQ ID NO: 9114669 - DNA, 22 bp, Homo sapiens
gaaatgcagattctgattctgt

SEQ ID NO: 9114670 - DNA, 22 bp, Homo sapiens
gaaatgcaaattctctctcgct

SEQ ID NO: 9114671 - DNA, 22 bp, Homo sapiens
gaaatgcagaacctgagaccat

SEQ ID NO: 9114672 - DNA, 22 bp, Homo sapiens
gaaatctacgattagtgaaaat

SEQ ID NO: 9114673 - DNA, 22 bp, Homo sapiens
gaaatgcatggatcttggcaga

SEQ ID NO: 9114674 - DNA, 22 bp, Homo sapiens
gaaatgcataatcttagtagat

SEQ ID NO: 9114675 - DNA, 22 bp, Homo sapiens
gaaatgcataatcttagtagat

SEQ ID NO: 9114676 - DNA, 22 bp, Homo sapiens
gaaatggtgtgctgtgcaatga

SEQ ID NO: 9114677 - DNA, 22 bp, Homo sapiens
gaaatgcaggcttggattcagc

SEQ ID NO: 9114678 - DNA, 22 bp, Homo sapiens
gaaatgctacacttgttaatga

SEQ ID NO: 9114679 - DNA, 22 bp, Homo sapiens
gaacagcagctcgttctcgatg

SEQ ID NO: 9114680 - DNA, 22 bp, Homo sapiens
gaagaccatattcagcaggcat

SEQ ID NO: 9114681 - DNA, 22 bp, Homo sapiens
gaagacatgtttttaatatgta

SEQ ID NO: 9114682 - DNA, 22 bp, Homo sapiens
gaagacatgtttttaatatgta

SEQ ID NO: 9114683 - DNA, 22 bp, Homo sapiens
gaagacactaaggcccagggag

SEQ ID NO: 9114684 - DNA, 22 bp, Homo sapiens
gaagacactaaactggggcttc

SEQ ID NO: 9114685 - DNA, 21 bp, Homo sapiens
gaagacacataacctctctcc

SEQ ID NO: 9114686 - DNA, 20 bp, Homo sapiens
gaagacacagagttcatctc

SEQ ID NO: 9114687 - DNA, 22 bp, Homo sapiens
gaagacacctactgtcatttct

SEQ ID NO: 9114688 - DNA, 22 bp, Homo sapiens
gaagacactctgcagagttatc

SEQ ID NO: 9114689 - DNA, 22 bp, Homo sapiens
gaagacacaattggtgggtcca

SEQ ID NO: 9114690 - DNA, 21 bp, Homo sapiens
gaacatttgggttgtttctac

SEQ ID NO: 9114691 - DNA, 21 bp, Homo sapiens
gaacatttgggttgtttctac

SEQ ID NO: 9114692 - DNA, 22 bp, Homo sapiens
gaacatttggcatgagaatttg

SEQ ID NO: 9114693 - DNA, 22 bp, Homo sapiens
gaagagctggaatccagtctgg

SEQ ID NO: 9114694 - DNA, 22 bp, Homo sapiens
gaagagctgtcagaaaagctaa

SEQ ID NO: 9114695 - DNA, 22 bp, Homo sapiens
gaagagcttagacagaatcaaa

SEQ ID NO: 9114696 - DNA, 22 bp, Homo sapiens
gaagaggactgtggcatcctag

SEQ ID NO: 9114697 - DNA, 22 bp, Homo sapiens
gaagaggatgacaggagccggt

SEQ ID NO: 9114698 - DNA, 22 bp, Homo sapiens
gaagaggatgacaggagccggt

SEQ ID NO: 9114699 - DNA, 22 bp, Homo sapiens
gaagagaaaggcaaggagtttt

SEQ ID NO: 9114700 - DNA, 22 bp, Homo sapiens
gaagagctatgtccagggagca

SEQ ID NO: 9114701 - DNA, 22 bp, Homo sapiens
gaagagctgacagtgtcatcct

SEQ ID NO: 9114702 - DNA, 22 bp, Homo sapiens
gaagatttcagttaagtatcta

SEQ ID NO: 9114703 - DNA, 22 bp, Homo sapiens
gaagatttctttatgaaagatg

SEQ ID NO: 9114704 - DNA, 22 bp, Homo sapiens
gaagatttataaggaccttatt

SEQ ID NO: 9114705 - DNA, 22 bp, Homo sapiens
gaagatttaagcacaatagtct

SEQ ID NO: 9114706 - DNA, 22 bp, Homo sapiens
gaagattaaacatatttagtgt

SEQ ID NO: 9114707 - DNA, 20 bp, Homo sapiens
gaagatgggtagaggcacag

SEQ ID NO: 9114708 - DNA, 20 bp, Homo sapiens
gaagatgggtagaggcacag

SEQ ID NO: 9114709 - DNA, 22 bp, Homo sapiens
gaagatgggaatgatgagtggg

SEQ ID NO: 9114710 - DNA, 22 bp, Homo sapiens
gaagaggctttcctagggcaag

SEQ ID NO: 9114711 - DNA, 22 bp, Homo sapiens
gaagaggctttcctagggcaag

SEQ ID NO: 9114712 - DNA, 22 bp, Homo sapiens
gaagaggctttcctagggcaag

SEQ ID NO: 9114713 - DNA, 22 bp, Homo sapiens
gaagaggtagcattggcaggtg

SEQ ID NO: 9114714 - DNA, 22 bp, Homo sapiens
gaagaggtagcattggcaggtg

SEQ ID NO: 9114715 - DNA, 22 bp, Homo sapiens
gaagagtggttatccctgctgt

SEQ ID NO: 9114716 - DNA, 22 bp, Homo sapiens
gaagattttctcctttaaatga

SEQ ID NO: 9114717 - DNA, 22 bp, Homo sapiens
gaagcaaaatgtctgcacatat

SEQ ID NO: 9114718 - DNA, 22 bp, Homo sapiens
gaagatttgaaacacatagaca

SEQ ID NO: 9114719 - DNA, 22 bp, Homo sapiens
gaagatttgaaacacatagaca

SEQ ID NO: 9114720 - DNA, 22 bp, Homo sapiens
gaagatttgcccatgcactttt

SEQ ID NO: 9114721 - DNA, 20 bp, Homo sapiens
gaagccagaggggaaaggag

SEQ ID NO: 9114722 - DNA, 22 bp, Homo sapiens
gaagccagattatcacaagcca

SEQ ID NO: 9114723 - DNA, 22 bp, Homo sapiens
gaagccagatttggggcatatc

SEQ ID NO: 9114724 - DNA, 22 bp, Homo sapiens
gaagcccaagcttcacagctat

SEQ ID NO: 9114725 - DNA, 22 bp, Homo sapiens
gaagccaggggcctgacaggca

SEQ ID NO: 9114726 - DNA, 22 bp, Homo sapiens
gaagccaggggcctgacaggca

SEQ ID NO: 9114727 - DNA, 22 bp, Homo sapiens
gaagcccatttgtacagcacat

SEQ ID NO: 9114728 - DNA, 22 bp, Homo sapiens
gaagcccatttgtacagcacat

SEQ ID NO: 9114729 - DNA, 22 bp, Homo sapiens
gaagccccaaaccctcgccatc

SEQ ID NO: 9114730 - DNA, 22 bp, Homo sapiens
gaagccccaaaccctcgccatc

SEQ ID NO: 9114731 - DNA, 22 bp, Homo sapiens
gaagccctaagagaatagagct

SEQ ID NO: 9114732 - DNA, 22 bp, Homo sapiens
gaagccctaatacacagtacct

SEQ ID NO: 9114733 - DNA, 22 bp, Homo sapiens
gaagccccatggatatatgtga

SEQ ID NO: 9114734 - DNA, 22 bp, Homo sapiens
gaagccctatcctctcctggga

SEQ ID NO: 9114735 - DNA, 22 bp, Homo sapiens
gaagccctatcctctcctggga

SEQ ID NO: 9114736 - DNA, 22 bp, Homo sapiens
gaagccctaatacacagtacct

SEQ ID NO: 9114737 - DNA, 22 bp, Homo sapiens
gaagccctcctatagtcatctg

SEQ ID NO: 9114738 - DNA, 23 bp, Homo sapiens
gaagccctcattggttctccaga

SEQ ID NO: 9114739 - DNA, 22 bp, Homo sapiens
gaagcccttagcagagtctgac

SEQ ID NO: 9114740 - DNA, 22 bp, Homo sapiens
gaagccctgtaggtgcaaaggt

SEQ ID NO: 9114741 - DNA, 22 bp, Homo sapiens
gaagccctggggtcagtgtcgt

SEQ ID NO: 9114742 - DNA, 19 bp, Homo sapiens
gaagccctgcattctccgc

SEQ ID NO: 9114743 - DNA, 22 bp, Homo sapiens
gacagtaagagtgtctgggttc

SEQ ID NO: 9114744 - DNA, 22 bp, Homo sapiens
gacagtatccaggtggtgaaga

SEQ ID NO: 9114745 - DNA, 22 bp, Homo sapiens
gacagtacaggtagaagtcact

SEQ ID NO: 9114746 - DNA, 22 bp, Homo sapiens
gaccctgtttctacaaataatt

SEQ ID NO: 9114747 - DNA, 22 bp, Homo sapiens
gaccctggtgtccaggtcctgc

SEQ ID NO: 9114748 - DNA, 22 bp, Homo sapiens
gaccctggtgtccaggtcctgc

SEQ ID NO: 9114749 - DNA, 22 bp, Homo sapiens
gaccctgtttctacaaataatt

SEQ ID NO: 9114750 - DNA, 22 bp, Homo sapiens
gacagtaactacagttctgtgg

SEQ ID NO: 9114751 - DNA, 22 bp, Homo sapiens
gacaggtgtgatgatttaggct

SEQ ID NO: 9114752 - DNA, 22 bp, Homo sapiens
gacagggtacgggctaggcaca

SEQ ID NO: 9114753 - DNA, 22 bp, Homo sapiens
gacagggtccaaaggcagggga

SEQ ID NO: 9114754 - DNA, 22 bp, Homo sapiens
gacagggtccaaaggcagggga

SEQ ID NO: 9114755 - DNA, 22 bp, Homo sapiens
gacaggtaaagatggtggcagg

SEQ ID NO: 9114756 - DNA, 22 bp, Homo sapiens
gacaggtgagatgaggaacacc

SEQ ID NO: 9114757 - DNA, 22 bp, Homo sapiens
gacaggtgaaacagcaaggtaa

SEQ ID NO: 9114758 - DNA, 21 bp, Homo sapiens
gacaggggaagaagcaaggag

SEQ ID NO: 9114759 - DNA, 22 bp, Homo sapiens
gacaggctggcaatgccctgct

SEQ ID NO: 9114760 - DNA, 22 bp, Homo sapiens
gacacagacagttagaggtaat

SEQ ID NO: 9114761 - DNA, 22 bp, Homo sapiens
gacacagaccaccaggccctgg

SEQ ID NO: 9114762 - DNA, 22 bp, Homo sapiens
gacaggccaggggctgaggtgg

SEQ ID NO: 9114763 - DNA, 22 bp, Homo sapiens
gacacagagataggcctgtgtt

SEQ ID NO: 9114764 - DNA, 22 bp, Homo sapiens
gacaggccccctcaggactgat

SEQ ID NO: 9114765 - DNA, 22 bp, Homo sapiens
gacaggcctagattcactgctg

SEQ ID NO: 9114766 - DNA, 22 bp, Homo sapiens
gacaaggaaattactagctgga

SEQ ID NO: 9114767 - DNA, 22 bp, Homo sapiens
gacaaggagccaccagtcacgt

SEQ ID NO: 9114768 - DNA, 22 bp, Homo sapiens
gaatacatttgccgtggttctc

SEQ ID NO: 9114769 - DNA, 22 bp, Homo sapiens
gaatacatggcagggagtcatc

SEQ ID NO: 9114770 - DNA, 22 bp, Homo sapiens
gaatacatggcagggagtcatc

SEQ ID NO: 9114771 - DNA, 22 bp, Homo sapiens
gaatacatgtgtgtatagaggt

SEQ ID NO: 9114772 - DNA, 22 bp, Homo sapiens
gaatacatgattaaagtttgat

SEQ ID NO: 9114773 - DNA, 22 bp, Homo sapiens
gaatacatgcacgacacggggg

SEQ ID NO: 9114774 - DNA, 22 bp, Homo sapiens
gaatacatgttgtttccctgga

SEQ ID NO: 9114775 - DNA, 22 bp, Homo sapiens
gaatacattggaaatcagaata

SEQ ID NO: 9114776 - DNA, 21 bp, Homo sapiens
gaataggaacctgatcatggg

SEQ ID NO: 9114777 - DNA, 22 bp, Homo sapiens
gaatagcttagattccttagtg

SEQ ID NO: 9114778 - DNA, 22 bp, Homo sapiens
gaatagataagtgactatttgg

SEQ ID NO: 9114779 - DNA, 22 bp, Homo sapiens
gaatatattggtgaaaatagtt

SEQ ID NO: 9114780 - DNA, 22 bp, Homo sapiens
gaatatattggtgaaaatagtt

SEQ ID NO: 9114781 - DNA, 22 bp, Homo sapiens
gaatagataagtgactatttgg

SEQ ID NO: 9114782 - DNA, 22 bp, Homo sapiens
gaatataggacctctgggaaca

SEQ ID NO: 9114783 - DNA, 22 bp, Homo sapiens
gaatatattattcagcttttca

SEQ ID NO: 9114784 - DNA, 22 bp, Homo sapiens
gaatatattattcagcttttca

SEQ ID NO: 9114785 - DNA, 22 bp, Homo sapiens
gaatatatttctcttaccttta

SEQ ID NO: 9114786 - DNA, 22 bp, Homo sapiens
gaatatcccgctatgcaaagta

SEQ ID NO: 9114787 - DNA, 22 bp, Homo sapiens
gaatatcccgctatgcaaagta

SEQ ID NO: 9114788 - DNA, 22 bp, Homo sapiens
gaatatatttctcttaccttta

SEQ ID NO: 9114789 - DNA, 22 bp, Homo sapiens
gaatattagtatcagttatacc

SEQ ID NO: 9114790 - DNA, 22 bp, Homo sapiens
gacaagacattggtaaagatat

SEQ ID NO: 9114791 - DNA, 22 bp, Homo sapiens
gacaagactggtttatttaagg

SEQ ID NO: 9114792 - DNA, 22 bp, Homo sapiens
gacaagcaggctcctgaagaaa

SEQ ID NO: 9114793 - DNA, 22 bp, Homo sapiens
gacaagacacctctctccatcc

SEQ ID NO: 9114794 - DNA, 17 bp, Homo sapiens
gacaagacagaattcat

SEQ ID NO: 9114795 - DNA, 22 bp, Homo sapiens
gacaagacagcttgcagacaac

SEQ ID NO: 9114796 - DNA, 22 bp, Homo sapiens
gacaagacattggtaaagatat

SEQ ID NO: 9114797 - DNA, 22 bp, Homo sapiens
gacaagactatgtagaaagtat

SEQ ID NO: 9114798 - DNA, 22 bp, Homo sapiens
gacaagacatgtgatgacatca

SEQ ID NO: 9114799 - DNA, 22 bp, Homo sapiens
gaagttctttgctccccagtac

SEQ ID NO: 9114800 - DNA, 23 bp, Homo sapiens
gaagttctttcttctcatgctgt

SEQ ID NO: 9114801 - DNA, 22 bp, Homo sapiens
gaagttctttatagcagtgtga

SEQ ID NO: 9114802 - DNA, 22 bp, Homo sapiens
gaagttcttagtctcatttgca

SEQ ID NO: 9114803 - DNA, 22 bp, Homo sapiens
gaagttctggtgtatgtgataa

SEQ ID NO: 9114804 - DNA, 22 bp, Homo sapiens
gaagttctcagctaggtgatgt

SEQ ID NO: 9114805 - DNA, 22 bp, Homo sapiens
gaagttctcttgggggcctgag

SEQ ID NO: 9114806 - DNA, 22 bp, Homo sapiens
gaaggaagactggtttaaatgt

SEQ ID NO: 9114807 - DNA, 22 bp, Homo sapiens
gaaggaagattctgttggaatc

SEQ ID NO: 9114808 - DNA, 22 bp, Homo sapiens
gaaggaagattctgttggaatc

SEQ ID NO: 9114809 - DNA, 22 bp, Homo sapiens
gaaggaaatctgtgatttatgc

SEQ ID NO: 9114810 - DNA, 22 bp, Homo sapiens
gaaggaaaggtctcatgccttt

SEQ ID NO: 9114811 - DNA, 22 bp, Homo sapiens
gaagcttctggcatttctcaaa

SEQ ID NO: 9114812 - DNA, 22 bp, Homo sapiens
gaagcttcgtggctcttcaaat

SEQ ID NO: 9114813 - DNA, 22 bp, Homo sapiens
gaagcttcgaaagagtgatttc

SEQ ID NO: 9114814 - DNA, 22 bp, Homo sapiens
gaagcttagggataataggctg

SEQ ID NO: 9114815 - DNA, 22 bp, Homo sapiens
gaaggaaaacagatctgcctga

SEQ ID NO: 9114816 - DNA, 22 bp, Homo sapiens
gaaggaaaaatactctgtaagg

SEQ ID NO: 9114817 - DNA, 22 bp, Homo sapiens
gaatacatatcagatgtgtttc

SEQ ID NO: 9114818 - DNA, 19 bp, Homo sapiens
gaatacagataataagcag

SEQ ID NO: 9114819 - DNA, 22 bp, Homo sapiens
gaatacatccagagcagggctg

SEQ ID NO: 9114820 - DNA, 22 bp, Homo sapiens
gaatacatctgaaggctatgaa

SEQ ID NO: 9114821 - DNA, 22 bp, Homo sapiens
gaatacatgatacatgaactgc

SEQ ID NO: 9114822 - DNA, 22 bp, Homo sapiens
gaatacatgaaccctcctgtgg

SEQ ID NO: 9114823 - DNA, 22 bp, Homo sapiens
gaatacacgcacgacacggggg

SEQ ID NO: 9114824 - DNA, 22 bp, Homo sapiens
gaatacacgaatagagcatggt

SEQ ID NO: 9114825 - DNA, 22 bp, Homo sapiens
gaatacacgaaggcaagagtcc

SEQ ID NO: 9114826 - DNA, 22 bp, Homo sapiens
gaatacaccaaggaatcagaat

SEQ ID NO: 9114827 - DNA, 22 bp, Homo sapiens
gaatacaagccaggcacaaggc

SEQ ID NO: 9114828 - DNA, 22 bp, Homo sapiens
gaatacaagccaggcacaaggc

SEQ ID NO: 9114829 - DNA, 22 bp, Homo sapiens
gaatacaagcctgccacctgga

SEQ ID NO: 9114830 - DNA, 22 bp, Homo sapiens
gaggcacatcacttggtgcatt

SEQ ID NO: 9114831 - DNA, 22 bp, Homo sapiens
gaggcacatcacttggtgcatt

SEQ ID NO: 9114832 - DNA, 22 bp, Homo sapiens
gaggcaccagccccgctagcct

SEQ ID NO: 9114833 - DNA, 22 bp, Homo sapiens
gaggcacatcacttggtgcatt

SEQ ID NO: 9114834 - DNA, 22 bp, Homo sapiens
gaggcagaagttgcagtgagca

SEQ ID NO: 9114835 - DNA, 22 bp, Homo sapiens
gaggcagaagttgcagtgagca

SEQ ID NO: 9114836 - DNA, 22 bp, Homo sapiens
gaggcagaagttgcagtgagca

SEQ ID NO: 9114837 - DNA, 22 bp, Homo sapiens
gaggcagaagttgcagtgagca

SEQ ID NO: 9114838 - DNA, 22 bp, Homo sapiens
gaggcagagaccttcaggacct

SEQ ID NO: 9114839 - DNA, 22 bp, Homo sapiens
gaggcagaggaaggtggtctct

SEQ ID NO: 9114840 - DNA, 22 bp, Homo sapiens
gaggcagaggaaggtggtctct

SEQ ID NO: 9114841 - DNA, 22 bp, Homo sapiens
gaggcagaggaaggtggtctct

SEQ ID NO: 9114842 - DNA, 22 bp, Homo sapiens
gaggccagcccctcttgaaggc

SEQ ID NO: 9114843 - DNA, 22 bp, Homo sapiens
gaggccagcgcgcagcactttt

SEQ ID NO: 9114844 - DNA, 22 bp, Homo sapiens
gaggccagcgcgcagcactttt

SEQ ID NO: 9114845 - DNA, 22 bp, Homo sapiens
gaggccagcgcgcagcactttt

SEQ ID NO: 9114846 - DNA, 22 bp, Homo sapiens
gaggccagcgcgcagcactttt

SEQ ID NO: 9114847 - DNA, 22 bp, Homo sapiens
gaggccaggaagcccaagatca

SEQ ID NO: 9114848 - DNA, 22 bp, Homo sapiens
gaggccaggacatgaaagctga

SEQ ID NO: 9114849 - DNA, 22 bp, Homo sapiens
gaggccaggacatgaaagctga

SEQ ID NO: 9114850 - DNA, 22 bp, Homo sapiens
gaggccagctagtccaggaagt

SEQ ID NO: 9114851 - DNA, 22 bp, Homo sapiens
gaggccagctacccaagggtca

SEQ ID NO: 9114852 - DNA, 19 bp, Homo sapiens
gaggaggaaaactagtgta

SEQ ID NO: 9114853 - DNA, 22 bp, Homo sapiens
gaggaggaaaggagttgaaatg

SEQ ID NO: 9114854 - DNA, 22 bp, Homo sapiens
gaggaggaagttctctgtaggc

SEQ ID NO: 9114855 - DNA, 22 bp, Homo sapiens
gaggaggaggaagtggaaccca

SEQ ID NO: 9114856 - DNA, 22 bp, Homo sapiens
gaggaggaggaagtggaaccca

SEQ ID NO: 9114857 - DNA, 22 bp, Homo sapiens
gaggaggaggaagtggaaccca

SEQ ID NO: 9114858 - DNA, 22 bp, Homo sapiens
gaggaggagtatatattagaat

SEQ ID NO: 9114859 - DNA, 22 bp, Homo sapiens
gaggaggcacttgagcagatgt

SEQ ID NO: 9114860 - DNA, 22 bp, Homo sapiens
gaggaggctaagtgggctctgg

SEQ ID NO: 9114861 - DNA, 22 bp, Homo sapiens
gaggaggctaagtgggctctgg

SEQ ID NO: 9114862 - DNA, 22 bp, Homo sapiens
gaggcaaggccgcacgtctcag

SEQ ID NO: 9114863 - DNA, 19 bp, Homo sapiens
gaggcaaggagtttaagcc

SEQ ID NO: 9114864 - DNA, 19 bp, Homo sapiens
gaggcaaggagtttaagcc

SEQ ID NO: 9114865 - DNA, 22 bp, Homo sapiens
gaggcaagagaagccagctttc

SEQ ID NO: 9114866 - DNA, 22 bp, Homo sapiens
gaggcaagagaagccagctttc

SEQ ID NO: 9114867 - DNA, 22 bp, Homo sapiens
gaggcaagagaagccagctttc

SEQ ID NO: 9114868 - DNA, 22 bp, Homo sapiens
gaggcaagcccagtgggtctaa

SEQ ID NO: 9114869 - DNA, 22 bp, Homo sapiens
gaggagcttcagaggaatctta

SEQ ID NO: 9114870 - DNA, 22 bp, Homo sapiens
gaggagcttcagaggaatctta

SEQ ID NO: 9114871 - DNA, 22 bp, Homo sapiens
gaggagcttcagaggaatctta

SEQ ID NO: 9114872 - DNA, 22 bp, Homo sapiens
gaggagcttgaggctaggagcc

SEQ ID NO: 9114873 - DNA, 22 bp, Homo sapiens
gaggagccctgttccccaggcc

SEQ ID NO: 9114874 - DNA, 18 bp, Homo sapiens
gaggagccgtccctacta

SEQ ID NO: 9114875 - DNA, 18 bp, Homo sapiens
gaggagccgtccctacta

SEQ ID NO: 9114876 - DNA, 22 bp, Homo sapiens
gaggagcctggccccacatcca

SEQ ID NO: 9114877 - DNA, 22 bp, Homo sapiens
gaggagcctggccccacatcca

SEQ ID NO: 9114878 - DNA, 22 bp, Homo sapiens
gaggagctgttccctcacctct

SEQ ID NO: 9114879 - DNA, 19 bp, Homo sapiens
gaggagctatcggagacag

SEQ ID NO: 9114880 - DNA, 19 bp, Homo sapiens
gaggagctatcggagacag

SEQ ID NO: 9114881 - DNA, 19 bp, Homo sapiens
gaggagctatcggagacag

SEQ ID NO: 9114882 - DNA, 22 bp, Homo sapiens
gaggaaaatattcagggaggtt

SEQ ID NO: 9114883 - DNA, 22 bp, Homo sapiens
gaggaaaatgcaacaggaatgc

SEQ ID NO: 9114884 - DNA, 22 bp, Homo sapiens
gaggaaaatgcaacaggaatgc

SEQ ID NO: 9114885 - DNA, 22 bp, Homo sapiens
gaggaaaagagacaggttattg

SEQ ID NO: 9114886 - DNA, 22 bp, Homo sapiens
gaggaaaagagacaggttattg

SEQ ID NO: 9114887 - DNA, 22 bp, Homo sapiens
gaggaaaataacaactaagggc

SEQ ID NO: 9114888 - DNA, 22 bp, Homo sapiens
gagctaaggcacaggcaggctt

SEQ ID NO: 9114889 - DNA, 22 bp, Homo sapiens
gagctaagtttctggaggcaga

SEQ ID NO: 9114890 - DNA, 22 bp, Homo sapiens
gagctaagctatgttatgcagc

SEQ ID NO: 9114891 - DNA, 22 bp, Homo sapiens
gagctaagagtctagaaaggct

SEQ ID NO: 9114892 - DNA, 22 bp, Homo sapiens
gagctaagaactgtgccaggtg

SEQ ID NO: 9114893 - DNA, 22 bp, Homo sapiens
gagctaaaatgtgtttttctca

SEQ ID NO: 9114894 - DNA, 22 bp, Homo sapiens
gagctagcttcttccaggtttc

SEQ ID NO: 9114895 - DNA, 22 bp, Homo sapiens
gagctaggctagggggagtcgc

SEQ ID NO: 9114896 - DNA, 22 bp, Homo sapiens
gagctagggaggaggcttgctc

SEQ ID NO: 9114897 - DNA, 22 bp, Homo sapiens
gagctaggttttccagtcgcat

SEQ ID NO: 9114898 - DNA, 22 bp, Homo sapiens
gagctactgaaatattgatttt

SEQ ID NO: 9114899 - DNA, 22 bp, Homo sapiens
gagctactgaaatattgatttt

SEQ ID NO: 9114900 - DNA, 22 bp, Homo sapiens
gagctctgttctcgtcctgctg

SEQ ID NO: 9114901 - DNA, 22 bp, Homo sapiens
gagctctgtgtagcctgagggt

SEQ ID NO: 9114902 - DNA, 22 bp, Homo sapiens
gagctctgtgtagcctgagggt

SEQ ID NO: 9114903 - DNA, 22 bp, Homo sapiens
gagctctgtgtggcttgggtgg

SEQ ID NO: 9114904 - DNA, 22 bp, Homo sapiens
gagctctgactgctgggtgaca

SEQ ID NO: 9114905 - DNA, 22 bp, Homo sapiens
gagcctgcccagccctgtccac

SEQ ID NO: 9114906 - DNA, 22 bp, Homo sapiens
gagcctgatgaaacaggcagac

SEQ ID NO: 9114907 - DNA, 22 bp, Homo sapiens
gagcctgatgaaacaggcagac

SEQ ID NO: 9114908 - DNA, 22 bp, Homo sapiens
gagcctgaaatacaggtcactg

SEQ ID NO: 9114909 - DNA, 22 bp, Homo sapiens
gagcctcgtggcggccactgcg

SEQ ID NO: 9114910 - DNA, 22 bp, Homo sapiens
gagcctcgtggcggccactgcg

SEQ ID NO: 9114911 - DNA, 22 bp, Homo sapiens
gagccctgttcaggcctcctca

SEQ ID NO: 9114912 - DNA, 22 bp, Homo sapiens
gagccctgttcaggcctcctca

SEQ ID NO: 9114913 - DNA, 22 bp, Homo sapiens
gagccctgttcaggcctcctca

SEQ ID NO: 9114914 - DNA, 22 bp, Homo sapiens
gagccgtgccagccctgtctcg

SEQ ID NO: 9114915 - DNA, 22 bp, Homo sapiens
gagccgaggcgcacagctcggg

SEQ ID NO: 9114916 - DNA, 22 bp, Homo sapiens
gagcctggagctggaacgaagc

SEQ ID NO: 9114917 - DNA, 22 bp, Homo sapiens
gagcctggagctggaacgaagc

SEQ ID NO: 9114918 - DNA, 22 bp, Homo sapiens
gagcctggattgaagtgggtgg

SEQ ID NO: 9114919 - DNA, 22 bp, Homo sapiens
gagcctggagctggaacgaagc

SEQ ID NO: 9114920 - DNA, 22 bp, Homo sapiens
gagcctggatagccttgttcca

SEQ ID NO: 9114921 - DNA, 22 bp, Homo sapiens
gagcctggattgaagtgggtgg

SEQ ID NO: 9114922 - DNA, 22 bp, Homo sapiens
gagcctggattgaagtgggtgg

SEQ ID NO: 9114923 - DNA, 22 bp, Homo sapiens
gagcttaggccagggacaggga

SEQ ID NO: 9114924 - DNA, 22 bp, Homo sapiens
gagcttcagctgccatgactgt

SEQ ID NO: 9114925 - DNA, 22 bp, Homo sapiens
gagcttcagcgtgtgctaaggg

SEQ ID NO: 9114926 - DNA, 18 bp, Homo sapiens
gagcttcaggctaacctg

SEQ ID NO: 9114927 - DNA, 22 bp, Homo sapiens
gagcttccatggacgccatctg

SEQ ID NO: 9114928 - DNA, 22 bp, Homo sapiens
gagcttccctctgcagtccctg

SEQ ID NO: 9114929 - DNA, 22 bp, Homo sapiens
gagcttccagagacatcagagt

SEQ ID NO: 9114930 - DNA, 22 bp, Homo sapiens
gagcttccatccttactgtgtg

SEQ ID NO: 9114931 - DNA, 22 bp, Homo sapiens
gagcttctcaacagttatctct

SEQ ID NO: 9114932 - DNA, 22 bp, Homo sapiens
gagcttctgccatagagggact

SEQ ID NO: 9114933 - DNA, 22 bp, Homo sapiens
gagcttggaagcagatcctcac

SEQ ID NO: 9114934 - DNA, 22 bp, Homo sapiens
gagcttcttgtttcttcatctg

SEQ ID NO: 9114935 - DNA, 22 bp, Homo sapiens
gagcttccatggacgccatctg

SEQ ID NO: 9114936 - DNA, 22 bp, Homo sapiens
gagcttccctctgcagtccctg

SEQ ID NO: 9114937 - DNA, 22 bp, Homo sapiens
gagcttcctcagcctttctcac

SEQ ID NO: 9114938 - DNA, 22 bp, Homo sapiens
gagcttcctcagcctttctcac

SEQ ID NO: 9114939 - DNA, 22 bp, Homo sapiens
gagcttcctcagcctttctcac

SEQ ID NO: 9114940 - DNA, 22 bp, Homo sapiens
gagcttcctgatgccgaccagt

SEQ ID NO: 9114941 - DNA, 22 bp, Homo sapiens
gagcttcctgcaggtcactgtg

SEQ ID NO: 9114942 - DNA, 22 bp, Homo sapiens
gagcttcctttttctgcatgac

SEQ ID NO: 9114943 - DNA, 22 bp, Homo sapiens
gagcttcctttttctgcatgac

SEQ ID NO: 9114944 - DNA, 22 bp, Homo sapiens
gagcttggctggacctcacgga

SEQ ID NO: 9114945 - DNA, 22 bp, Homo sapiens
gagcttggcagtgtcactaggg

SEQ ID NO: 9114946 - DNA, 22 bp, Homo sapiens
gagcttggcctcttgaacgtgg

SEQ ID NO: 9114947 - DNA, 22 bp, Homo sapiens
gagcttggacaccttggcaggt

SEQ ID NO: 9114948 - DNA, 22 bp, Homo sapiens
gagcttggacaagctctgaagg

SEQ ID NO: 9114949 - DNA, 22 bp, Homo sapiens
gagcttggatgtcttttgttca

SEQ ID NO: 9114950 - DNA, 22 bp, Homo sapiens
gagcttggacaccttggcaggt

SEQ ID NO: 9114951 - DNA, 19 bp, Homo sapiens
gagctgagagtagcactgg

SEQ ID NO: 9114952 - DNA, 19 bp, Homo sapiens
gagctgagagtagcactgg

SEQ ID NO: 9114953 - DNA, 22 bp, Homo sapiens
gagctgtgttcatgaggagaaa

SEQ ID NO: 9114954 - DNA, 22 bp, Homo sapiens
gagctgagaagcagcgcttgat

SEQ ID NO: 9114955 - DNA, 22 bp, Homo sapiens
gagctgaattgaagcaaggagc

SEQ ID NO: 9114956 - DNA, 22 bp, Homo sapiens
gagctgacatccagcagtgacc

SEQ ID NO: 9114957 - DNA, 18 bp, Homo sapiens
gagctgagaagaggatgc

SEQ ID NO: 9114958 - DNA, 18 bp, Homo sapiens
gagctgagaagaggatgc

SEQ ID NO: 9114959 - DNA, 18 bp, Homo sapiens
gagctgagaagaggatgc

SEQ ID NO: 9114960 - DNA, 22 bp, Homo sapiens
gagctgaatcagagatattatt

SEQ ID NO: 9114961 - DNA, 22 bp, Homo sapiens
gagctgaattgaagcaaggagc

SEQ ID NO: 9114962 - DNA, 22 bp, Homo sapiens
gagctgaagcgctacagcatcc

SEQ ID NO: 9114963 - DNA, 22 bp, Homo sapiens
gagctcttctggttagatgttg

SEQ ID NO: 9114964 - DNA, 22 bp, Homo sapiens
gagctcttccccatcttacatc

SEQ ID NO: 9114965 - DNA, 22 bp, Homo sapiens
gagctcttccccatcttacatc

SEQ ID NO: 9114966 - DNA, 22 bp, Homo sapiens
gagctgaacatcatggaaaggc

SEQ ID NO: 9114967 - DNA, 22 bp, Homo sapiens
gagctgaagatgtcagaaccgt

SEQ ID NO: 9114968 - DNA, 22 bp, Homo sapiens
gagctgaaggagaaagcagggg

SEQ ID NO: 9114969 - DNA, 22 bp, Homo sapiens
gagctgaacatcatggaaaggc

SEQ ID NO: 9114970 - DNA, 22 bp, Homo sapiens
gagctctttcggttgttttcga

SEQ ID NO: 9114971 - DNA, 22 bp, Homo sapiens
gagctctttcatggttctgtga

SEQ ID NO: 9114972 - DNA, 22 bp, Homo sapiens
gagcagcaggtggggctggctt

SEQ ID NO: 9114973 - DNA, 22 bp, Homo sapiens
gagcagcaggtggctgtgatgg

SEQ ID NO: 9114974 - DNA, 22 bp, Homo sapiens
gagcagcaggtggctgtgatgg

SEQ ID NO: 9114975 - DNA, 22 bp, Homo sapiens
gagcagcaggccaggttgcagg

SEQ ID NO: 9114976 - DNA, 22 bp, Homo sapiens
gagcagcagctgggccaggttc

SEQ ID NO: 9114977 - DNA, 22 bp, Homo sapiens
gagcagcagctgggccaggttc

SEQ ID NO: 9114978 - DNA, 18 bp, Homo sapiens
gagcagcaggatcaagaa

SEQ ID NO: 9114979 - DNA, 18 bp, Homo sapiens
gagcagcaggatcaagaa

SEQ ID NO: 9114980 - DNA, 22 bp, Homo sapiens
gagcagcactgagttagcagct

SEQ ID NO: 9114981 - DNA, 21 bp, Homo sapiens
gagatttagaaggatcaattt

SEQ ID NO: 9114982 - DNA, 23 bp, Homo sapiens
gagatttagcagacaaagctctt

SEQ ID NO: 9114983 - DNA, 22 bp, Homo sapiens
gagcagatgtgtgccaggatgc

SEQ ID NO: 9114984 - DNA, 22 bp, Homo sapiens
gagcagagtctatttccacact

SEQ ID NO: 9114985 - DNA, 22 bp, Homo sapiens
gagcagagtctatttccacact

SEQ ID NO: 9114986 - DNA, 22 bp, Homo sapiens
gagattctaagtcgttggttag

SEQ ID NO: 9114987 - DNA, 22 bp, Homo sapiens
gagattctaatataaggatggg

SEQ ID NO: 9114988 - DNA, 22 bp, Homo sapiens
gagattctatgttgttgattat

SEQ ID NO: 9114989 - DNA, 22 bp, Homo sapiens
gagatgttttgctgagaatggg

SEQ ID NO: 9114990 - DNA, 22 bp, Homo sapiens
gagatgttttgctgagaatggg

SEQ ID NO: 9114991 - DNA, 22 bp, Homo sapiens
gagattagagttgtttcattgt

SEQ ID NO: 9114992 - DNA, 22 bp, Homo sapiens
gagatgttattcttcagtgtgt

SEQ ID NO: 9114993 - DNA, 22 bp, Homo sapiens
gagatgttaactacatagctac

SEQ ID NO: 9114994 - DNA, 23 bp, Homo sapiens
gagatgtgggtttgttcagtgtc

SEQ ID NO: 9114995 - DNA, 22 bp, Homo sapiens
gagatttaattggattaactta

SEQ ID NO: 9114996 - DNA, 22 bp, Homo sapiens
gagattctgtgaaacggacatt

SEQ ID NO: 9114997 - DNA, 22 bp, Homo sapiens
gagattctttccagaactttga

SEQ ID NO: 9114998 - DNA, 22 bp, Homo sapiens
gagattctgtagtcaggcatct

SEQ ID NO: 9114999 - DNA, 22 bp, Homo sapiens
gagattctggttaggtgtattt

SEQ ID NO: 9115000 - DNA, 22 bp, Homo sapiens
gagattctggttaggtgtattt

SEQ ID NO: 9115001 - DNA, 22 bp, Homo sapiens
gagattctgagaagttaagtcc

SEQ ID NO: 9115002 - DNA, 22 bp, Homo sapiens
gagattctcgagggcttccagc

SEQ ID NO: 9115003 - DNA, 22 bp, Homo sapiens
gagattctcagaagtactagga

SEQ ID NO: 9115004 - DNA, 23 bp, Homo sapiens
gagattctcctgttgtcaagtct

SEQ ID NO: 9115005 - DNA, 20 bp, Homo sapiens
gagatggacagatgaagggg

SEQ ID NO: 9115006 - DNA, 20 bp, Homo sapiens
gagatggacagatgaagggg

SEQ ID NO: 9115007 - DNA, 22 bp, Homo sapiens
gagatggagtctttttctgtca

SEQ ID NO: 9115008 - DNA, 22 bp, Homo sapiens
gagatggagaaggaagctgttt

SEQ ID NO: 9115009 - DNA, 22 bp, Homo sapiens
gagatggagtctttttctgtca

SEQ ID NO: 9115010 - DNA, 22 bp, Homo sapiens
gagccaggggtcagctccgagg

SEQ ID NO: 9115011 - DNA, 22 bp, Homo sapiens
gagccagcagccggcaccacca

SEQ ID NO: 9115012 - DNA, 22 bp, Homo sapiens
gagccagccgcaagagctgtga

SEQ ID NO: 9115013 - DNA, 22 bp, Homo sapiens
gagccaccttcaactcaggaat

SEQ ID NO: 9115014 - DNA, 22 bp, Homo sapiens
gagccagaaaagctgcctgact

SEQ ID NO: 9115015 - DNA, 22 bp, Homo sapiens
gagccagactgcctgaagctca

SEQ ID NO: 9115016 - DNA, 22 bp, Homo sapiens
gagcagctggaggccttgttgg

SEQ ID NO: 9115017 - DNA, 22 bp, Homo sapiens
gagcagctggacaggcctccct

SEQ ID NO: 9115018 - DNA, 22 bp, Homo sapiens
gagcagctggacaggcctccct

SEQ ID NO: 9115019 - DNA, 22 bp, Homo sapiens
gagcagctgcagtgcagaccct

SEQ ID NO: 9115020 - DNA, 22 bp, Homo sapiens
gagcagctgcagtgcagaccct

SEQ ID NO: 9115021 - DNA, 22 bp, Homo sapiens
gagcagctgcagtgcagaccct

SEQ ID NO: 9115022 - DNA, 22 bp, Homo sapiens
gagcagctgtccccaaagcttc

SEQ ID NO: 9115023 - DNA, 22 bp, Homo sapiens
gagcagctggctgtattggttt

SEQ ID NO: 9115024 - DNA, 22 bp, Homo sapiens
gagcagctggtaggtgaaccca

SEQ ID NO: 9115025 - DNA, 22 bp, Homo sapiens
gagcagctgttctgacttgtct

SEQ ID NO: 9115026 - DNA, 20 bp, Homo sapiens
gagcagctgtttgcattgca

SEQ ID NO: 9115027 - DNA, 22 bp, Homo sapiens
gagcagctgtggggttgaccat

SEQ ID NO: 9115028 - DNA, 22 bp, Homo sapiens
gagccacagcaacctcaaagga

SEQ ID NO: 9115029 - DNA, 22 bp, Homo sapiens
gagccacagtggtggcccacgt

SEQ ID NO: 9115030 - DNA, 22 bp, Homo sapiens
gagccacagtggattgattcca

SEQ ID NO: 9115031 - DNA, 22 bp, Homo sapiens
gagcagcttatgtcaagccaga

SEQ ID NO: 9115032 - DNA, 20 bp, Homo sapiens
gagcagctgtttgcattgca

SEQ ID NO: 9115033 - DNA, 22 bp, Homo sapiens
gagcagcttatgtcaagccaga

SEQ ID NO: 9115034 - DNA, 22 bp, Homo sapiens
gagccaagggcgtgctggagag

SEQ ID NO: 9115035 - DNA, 22 bp, Homo sapiens
gagccaagggcgtgctggagag

SEQ ID NO: 9115036 - DNA, 22 bp, Homo sapiens
gagccaagcaatatacccaacc

SEQ ID NO: 9115037 - DNA, 22 bp, Homo sapiens
gagccaagcaccacattaagtt

SEQ ID NO: 9115038 - DNA, 22 bp, Homo sapiens
gagatgagtgggggatctctca

SEQ ID NO: 9115039 - DNA, 22 bp, Homo sapiens
gagatgagtgggggatctctca

SEQ ID NO: 9115040 - DNA, 22 bp, Homo sapiens
gagatgacatgcctgttgtagg

SEQ ID NO: 9115041 - DNA, 22 bp, Homo sapiens
gagatgaatgtaaacaaaggca

SEQ ID NO: 9115042 - DNA, 22 bp, Homo sapiens
gagatgaatgtaaacaaaggca

SEQ ID NO: 9115043 - DNA, 22 bp, Homo sapiens
gagatgaatcattccatggtca

SEQ ID NO: 9115044 - DNA, 22 bp, Homo sapiens
gagatcggtaaagagcatgcac

SEQ ID NO: 9115045 - DNA, 22 bp, Homo sapiens
gagatgaagaggcccttggagt

SEQ ID NO: 9115046 - DNA, 20 bp, Homo sapiens
gagatgcaagtgtatctgac

SEQ ID NO: 9115047 - DNA, 22 bp, Homo sapiens
gagagggagccagccaggaacc

SEQ ID NO: 9115048 - DNA, 22 bp, Homo sapiens
gagaggctgggttggagatcga

SEQ ID NO: 9115049 - DNA, 22 bp, Homo sapiens
gagaggctgtgtgccattgttg

SEQ ID NO: 9115050 - DNA, 22 bp, Homo sapiens
gagacacaaacacatttagagg

SEQ ID NO: 9115051 - DNA, 22 bp, Homo sapiens
gagaggccacctgacgagcagt

SEQ ID NO: 9115052 - DNA, 22 bp, Homo sapiens
gagaggccaaaatccctgcccc

SEQ ID NO: 9115053 - DNA, 22 bp, Homo sapiens
gagaggccaaaatccctgcccc

SEQ ID NO: 9115054 - DNA, 22 bp, Homo sapiens
gagaggccatggctgtgcagtg

SEQ ID NO: 9115055 - DNA, 22 bp, Homo sapiens
gagaggccatggctgtgcagtg

SEQ ID NO: 9115056 - DNA, 22 bp, Homo sapiens
gagaggccctgtggtcccagct

SEQ ID NO: 9115057 - DNA, 22 bp, Homo sapiens
gagaggccctgaagcccacaga

SEQ ID NO: 9115058 - DNA, 19 bp, Homo sapiens
gagaggcctgtgcttgaag

SEQ ID NO: 9115059 - DNA, 19 bp, Homo sapiens
gagaggcctgtgcttgaag

SEQ ID NO: 9115060 - DNA, 22 bp, Homo sapiens
gagaggcctgggcccgtgagct

SEQ ID NO: 9115061 - DNA, 22 bp, Homo sapiens
gacctcttgcaccctggctctt

SEQ ID NO: 9115062 - DNA, 22 bp, Homo sapiens
gacctctgaaggcagagcaggg

SEQ ID NO: 9115063 - DNA, 22 bp, Homo sapiens
gacctgaaatttgtggtagaac

SEQ ID NO: 9115064 - DNA, 22 bp, Homo sapiens
gagaaggaggcgaagcgtgtgc

SEQ ID NO: 9115065 - DNA, 22 bp, Homo sapiens
gagaaggagctcaaatatggct

SEQ ID NO: 9115066 - DNA, 22 bp, Homo sapiens
gagaaggagtagctgacctggg

SEQ ID NO: 9115067 - DNA, 22 bp, Homo sapiens
gagaaggagtagctgacctggg

SEQ ID NO: 9115068 - DNA, 22 bp, Homo sapiens
gacctccattctgtcatgactg

SEQ ID NO: 9115069 - DNA, 22 bp, Homo sapiens
gacctccagcggccctgcagag

SEQ ID NO: 9115070 - DNA, 22 bp, Homo sapiens
gacctccagcggccctgcagag

SEQ ID NO: 9115071 - DNA, 22 bp, Homo sapiens
gacctccagcggccctgcagag

SEQ ID NO: 9115072 - DNA, 22 bp, Homo sapiens
gacctcagtgaatggtcatgta

SEQ ID NO: 9115073 - DNA, 22 bp, Homo sapiens
gacctcagattttcccaggcca

SEQ ID NO: 9115074 - DNA, 22 bp, Homo sapiens
gacctcagtattgttcaggatg

SEQ ID NO: 9115075 - DNA, 22 bp, Homo sapiens
gagaagggcttgggagtcaaca

SEQ ID NO: 9115076 - DNA, 22 bp, Homo sapiens
gagaagggcttgggagtcaaca

SEQ ID NO: 9115077 - DNA, 22 bp, Homo sapiens
gagaagggggctcgagtgtcct

SEQ ID NO: 9115078 - DNA, 22 bp, Homo sapiens
gagaagggatatggcttcttga

SEQ ID NO: 9115079 - DNA, 22 bp, Homo sapiens
gagaagggatatggcttcttga

SEQ ID NO: 9115080 - DNA, 22 bp, Homo sapiens
gagaagggatatgccactctcg

SEQ ID NO: 9115081 - DNA, 22 bp, Homo sapiens
gagaaggcttcttttcctctga

SEQ ID NO: 9115082 - DNA, 22 bp, Homo sapiens
gagaaggctggtcttaagtcga

SEQ ID NO: 9115083 - DNA, 22 bp, Homo sapiens
gagaaggctggtcttaagtcga

SEQ ID NO: 9115084 - DNA, 22 bp, Homo sapiens
gagaaggccaggaacccagtgt

SEQ ID NO: 9115085 - DNA, 22 bp, Homo sapiens
gagaaggctgatccttggagtt

SEQ ID NO: 9115086 - DNA, 22 bp, Homo sapiens
gagaaggctgatccttggagtt

SEQ ID NO: 9115087 - DNA, 22 bp, Homo sapiens
gagaaggcttccaaattctgtg

SEQ ID NO: 9115088 - DNA, 22 bp, Homo sapiens
gagaaggcttccaaattctgtg

SEQ ID NO: 9115089 - DNA, 22 bp, Homo sapiens
gagaaggcttccaaattctgtg

SEQ ID NO: 9115090 - DNA, 22 bp, Homo sapiens
gagaaggcttcttttcctctga

SEQ ID NO: 9115091 - DNA, 22 bp, Homo sapiens
gagaaggccaggaacccagtgt

SEQ ID NO: 9115092 - DNA, 18 bp, Homo sapiens
gagaaggccacttgtttt

SEQ ID NO: 9115093 - DNA, 18 bp, Homo sapiens
gagaaggccacttgtttt

SEQ ID NO: 9115094 - DNA, 18 bp, Homo sapiens
gagaaggccacttgtttt

SEQ ID NO: 9115095 - DNA, 22 bp, Homo sapiens
gagaatgggaatgaaagtagca

SEQ ID NO: 9115096 - DNA, 22 bp, Homo sapiens
gagaattagggcgtaattcaga

SEQ ID NO: 9115097 - DNA, 22 bp, Homo sapiens
ctggcaggaagttagatggtaa

SEQ ID NO: 9115098 - DNA, 22 bp, Homo sapiens
ctggcaggaagaggaaaggtca

SEQ ID NO: 9115099 - DNA, 19 bp, Homo sapiens
ctggcagcctgtctgtgtc

SEQ ID NO: 9115100 - DNA, 22 bp, Homo sapiens
ctggcagcccaacctagagtct

SEQ ID NO: 9115101 - DNA, 22 bp, Homo sapiens
ctggcagcttcaggacactcgg

SEQ ID NO: 9115102 - DNA, 22 bp, Homo sapiens
ctgccagcagaggccagcgctg

SEQ ID NO: 9115103 - DNA, 22 bp, Homo sapiens
ctgccagcagaggccagcgctg

SEQ ID NO: 9115104 - DNA, 22 bp, Homo sapiens
ctgccagcactgcctcctgagg

SEQ ID NO: 9115105 - DNA, 22 bp, Homo sapiens
ctgccagcaatgtgaccatgct

SEQ ID NO: 9115106 - DNA, 22 bp, Homo sapiens
ctgccagctcaaagcgcagcta

SEQ ID NO: 9115107 - DNA, 22 bp, Homo sapiens
ctgccagctagctcctagttga

SEQ ID NO: 9115108 - DNA, 22 bp, Homo sapiens
ctgccagctcaccggctcagac

SEQ ID NO: 9115109 - DNA, 22 bp, Homo sapiens
ctgccagctcaaagcgcagcta

SEQ ID NO: 9115110 - DNA, 22 bp, Homo sapiens
ctgccagctcgccacaatgaca

SEQ ID NO: 9115111 - DNA, 22 bp, Homo sapiens
ctgcatccatgttgctgcaaag

SEQ ID NO: 9115112 - DNA, 22 bp, Homo sapiens
ctgcatccatgttgctgcaaag

SEQ ID NO: 9115113 - DNA, 22 bp, Homo sapiens
ctgccaagtaatgcctgggctc

SEQ ID NO: 9115114 - DNA, 22 bp, Homo sapiens
ctgccaaggctggggaggacaa

SEQ ID NO: 9115115 - DNA, 22 bp, Homo sapiens
ctgccagaagagaacaccagtt

SEQ ID NO: 9115116 - DNA, 22 bp, Homo sapiens
ctgccagaaggttcctgctgca

SEQ ID NO: 9115117 - DNA, 22 bp, Homo sapiens
ctgccactagctttcacatctt

SEQ ID NO: 9115118 - DNA, 22 bp, Homo sapiens
ctgccacttactaggcatggtg

SEQ ID NO: 9115119 - DNA, 18 bp, Homo sapiens
ctgccacttaatgtggtg

SEQ ID NO: 9115120 - DNA, 22 bp, Homo sapiens
ctgccactttcacccagtgctc

SEQ ID NO: 9115121 - DNA, 22 bp, Homo sapiens
ctggcaggcggaggttgcagtg

SEQ ID NO: 9115122 - DNA, 22 bp, Homo sapiens
ctggcaggcggaggttgcagtg

SEQ ID NO: 9115123 - DNA, 22 bp, Homo sapiens
ctggccactgattcctcccctg

SEQ ID NO: 9115124 - DNA, 22 bp, Homo sapiens
ctggcaggatctaaccagggaa

SEQ ID NO: 9115125 - DNA, 22 bp, Homo sapiens
ctggcaggcaaattggtgggag

SEQ ID NO: 9115126 - DNA, 22 bp, Homo sapiens
ctggcaggagcattcacagagg

SEQ ID NO: 9115127 - DNA, 22 bp, Homo sapiens
ctggcaggagctgtggccgtag

SEQ ID NO: 9115128 - DNA, 22 bp, Homo sapiens
ctggccagcctgtcgatgccct

SEQ ID NO: 9115129 - DNA, 22 bp, Homo sapiens
ctggccagcatggctgaagtac

SEQ ID NO: 9115130 - DNA, 22 bp, Homo sapiens
ctggccagcatttttgctttag

SEQ ID NO: 9115131 - DNA, 22 bp, Homo sapiens
ctggccagagttggagggtgtg

SEQ ID NO: 9115132 - DNA, 21 bp, Homo sapiens
ctggccactgcacctcttcct

SEQ ID NO: 9115133 - DNA, 22 bp, Homo sapiens
ctggccagaggttcctctgccc

SEQ ID NO: 9115134 - DNA, 22 bp, Homo sapiens
ctggccctgccagagatcaaca

SEQ ID NO: 9115135 - DNA, 22 bp, Homo sapiens
ctggccctgcctaatgtacttg

SEQ ID NO: 9115136 - DNA, 22 bp, Homo sapiens
ctggccctggagggctgtgcga

SEQ ID NO: 9115137 - DNA, 22 bp, Homo sapiens
ctggccctggagggctgtgcga

SEQ ID NO: 9115138 - DNA, 22 bp, Homo sapiens
ctggccctgctccgcgccgcgg

SEQ ID NO: 9115139 - DNA, 22 bp, Homo sapiens
ctggccctcggagtccagctgc

SEQ ID NO: 9115140 - DNA, 22 bp, Homo sapiens
ctggccctcggagtccagctgc

SEQ ID NO: 9115141 - DNA, 22 bp, Homo sapiens
ctggccctcagactcatgggca

SEQ ID NO: 9115142 - DNA, 22 bp, Homo sapiens
ctggcccagtctcagagtgtca

SEQ ID NO: 9115143 - DNA, 22 bp, Homo sapiens
ctggccctatgagcctcctgat

SEQ ID NO: 9115144 - DNA, 22 bp, Homo sapiens
ctggcccagtctcagagtgtca

SEQ ID NO: 9115145 - DNA, 22 bp, Homo sapiens
ctggcccagtctcagagtgtca

SEQ ID NO: 9115146 - DNA, 22 bp, Homo sapiens
ctggccaggcatcccctgatcc

SEQ ID NO: 9115147 - DNA, 22 bp, Homo sapiens
ctggccctgtaggatgtgagtt

SEQ ID NO: 9115148 - DNA, 22 bp, Homo sapiens
ctggccctgtcagcacagaatc

SEQ ID NO: 9115149 - DNA, 22 bp, Homo sapiens
ctggcctggtctggcctctcca

SEQ ID NO: 9115150 - DNA, 22 bp, Homo sapiens
ctggcctgtcctgacccagcct

SEQ ID NO: 9115151 - DNA, 22 bp, Homo sapiens
ctggcctggtctggcctctcca

SEQ ID NO: 9115152 - DNA, 22 bp, Homo sapiens
ctggcctggtctggcctctcca

SEQ ID NO: 9115153 - DNA, 22 bp, Homo sapiens
ctggccctggctggagcccagg

SEQ ID NO: 9115154 - DNA, 22 bp, Homo sapiens
ctggccctggtaaggacaccca

SEQ ID NO: 9115155 - DNA, 22 bp, Homo sapiens
ctggccctggctggagcccagg

SEQ ID NO: 9115156 - DNA, 22 bp, Homo sapiens
ctggccctggtaaggacaccca

SEQ ID NO: 9115157 - DNA, 23 bp, Homo sapiens
ctggccctggctctgtgatcatg

SEQ ID NO: 9115158 - DNA, 23 bp, Homo sapiens
ctggccctggctctgtgatcatg

SEQ ID NO: 9115159 - DNA, 22 bp, Homo sapiens
ctggccctggctggagcccagg

SEQ ID NO: 9115160 - DNA, 22 bp, Homo sapiens
ctggctcacctccgctccagca

SEQ ID NO: 9115161 - DNA, 22 bp, Homo sapiens
ctggctcagacagctgtgcagt

SEQ ID NO: 9115162 - DNA, 22 bp, Homo sapiens
ctggctcacctccgctccagca

SEQ ID NO: 9115163 - DNA, 22 bp, Homo sapiens
ctggctcactagccctgccctg

SEQ ID NO: 9115164 - DNA, 22 bp, Homo sapiens
ctggctcagacagctgtgcagt

SEQ ID NO: 9115165 - DNA, 22 bp, Homo sapiens
ctggctcatagagcagctccaa

SEQ ID NO: 9115166 - DNA, 22 bp, Homo sapiens
ctggctcatagagcagctccaa

SEQ ID NO: 9115167 - DNA, 22 bp, Homo sapiens
ctggctcatagagcagctccaa

SEQ ID NO: 9115168 - DNA, 22 bp, Homo sapiens
ctggctcatagagcagctccaa

SEQ ID NO: 9115169 - DNA, 22 bp, Homo sapiens
ctggctcatgtgatgagggcaa

SEQ ID NO: 9115170 - DNA, 22 bp, Homo sapiens
ctggctcattttagcatcaggt

SEQ ID NO: 9115171 - DNA, 23 bp, Homo sapiens
ctggctcatcctggttgcagtgg

SEQ ID NO: 9115172 - DNA, 22 bp, Homo sapiens
ctggctcatgtgatgagggcaa

SEQ ID NO: 9115173 - DNA, 22 bp, Homo sapiens
ctggctgcaggatgaggctgcc

SEQ ID NO: 9115174 - DNA, 22 bp, Homo sapiens
ctggctgcaggaaggagtgggc

SEQ ID NO: 9115175 - DNA, 22 bp, Homo sapiens
ctggctccaaattctgatgttc

SEQ ID NO: 9115176 - DNA, 22 bp, Homo sapiens
ctggctccaaattctgatgttc

SEQ ID NO: 9115177 - DNA, 22 bp, Homo sapiens
ctggctccaaggaagaggtttt

SEQ ID NO: 9115178 - DNA, 22 bp, Homo sapiens
ctggctccaaggaagaggtttt

SEQ ID NO: 9115179 - DNA, 22 bp, Homo sapiens
ctggctcattttagcatcaggt

SEQ ID NO: 9115180 - DNA, 22 bp, Homo sapiens
ctggctgcctggagtgagggag

SEQ ID NO: 9115181 - DNA, 22 bp, Homo sapiens
ctggctgcctatagtctccctt

SEQ ID NO: 9115182 - DNA, 22 bp, Homo sapiens
ctggctgccagcatttggggga

SEQ ID NO: 9115183 - DNA, 22 bp, Homo sapiens
ctggctgcattggcaagtcaat

SEQ ID NO: 9115184 - DNA, 22 bp, Homo sapiens
ctggctgccacttcagggtctt

SEQ ID NO: 9115185 - DNA, 22 bp, Homo sapiens
ctggctgctggcctgaggatgc

SEQ ID NO: 9115186 - DNA, 22 bp, Homo sapiens
ctggctgcttgggacagccatg

SEQ ID NO: 9115187 - DNA, 22 bp, Homo sapiens
ctggctgcgtctgctctgacag

SEQ ID NO: 9115188 - DNA, 22 bp, Homo sapiens
ctggctgcgctagtccagaaga

SEQ ID NO: 9115189 - DNA, 22 bp, Homo sapiens
ctggctggaagttagagaactt

SEQ ID NO: 9115190 - DNA, 22 bp, Homo sapiens
ctggctggaagttagagaactt

SEQ ID NO: 9115191 - DNA, 22 bp, Homo sapiens
ctggctgcttgtagactcgact

SEQ ID NO: 9115192 - DNA, 22 bp, Homo sapiens
ctggctgcttgttttgatgggt

SEQ ID NO: 9115193 - DNA, 22 bp, Homo sapiens
ctggctggaacgccgaggcggc

SEQ ID NO: 9115194 - DNA, 22 bp, Homo sapiens
ctggctggacttgtgcatgtca

SEQ ID NO: 9115195 - DNA, 22 bp, Homo sapiens
ctggctggagctgttgtaggct

SEQ ID NO: 9115196 - DNA, 22 bp, Homo sapiens
ctggctgtgcagtcttccagaa

SEQ ID NO: 9115197 - DNA, 22 bp, Homo sapiens
ctggctgtgcagtcttccagaa

SEQ ID NO: 9115198 - DNA, 22 bp, Homo sapiens
ctggcttttggaaacaggctca

SEQ ID NO: 9115199 - DNA, 22 bp, Homo sapiens
ctggcttttttcccattatgca

SEQ ID NO: 9115200 - DNA, 22 bp, Homo sapiens
ctggctttggtcccctgtgcct

SEQ ID NO: 9115201 - DNA, 22 bp, Homo sapiens
ctggcttttcctaaactgggaa

SEQ ID NO: 9115202 - DNA, 22 bp, Homo sapiens
ctggcttttcctaaactgggaa

SEQ ID NO: 9115203 - DNA, 22 bp, Homo sapiens
ctgggaggattcattgaggtga

SEQ ID NO: 9115204 - DNA, 22 bp, Homo sapiens
ctgggaagaaattgtgggaggc

SEQ ID NO: 9115205 - DNA, 22 bp, Homo sapiens
ctgggagctgaggctgacgctg

SEQ ID NO: 9115206 - DNA, 22 bp, Homo sapiens
ctgggaggcaccgcgtcgtgct

SEQ ID NO: 9115207 - DNA, 22 bp, Homo sapiens
ctgggaggattcattgaggtga

SEQ ID NO: 9115208 - DNA, 22 bp, Homo sapiens
ctgggaggcaccgcgtcgtgct

SEQ ID NO: 9115209 - DNA, 22 bp, Homo sapiens
ctgggaggattcattgaggtga

SEQ ID NO: 9115210 - DNA, 22 bp, Homo sapiens
ctgggaggattcattgaggtga

SEQ ID NO: 9115211 - DNA, 22 bp, Homo sapiens
ctgggaggcaccgcgtcgtgct

SEQ ID NO: 9115212 - DNA, 22 bp, Homo sapiens
ctgggaagaaattgtgggaggc

SEQ ID NO: 9115213 - DNA, 22 bp, Homo sapiens
ctgggagctcagccctggggtg

SEQ ID NO: 9115214 - DNA, 22 bp, Homo sapiens
ctggctgtgctgactgagaggg

SEQ ID NO: 9115215 - DNA, 22 bp, Homo sapiens
ctggctgtgctgcaggctttgg

SEQ ID NO: 9115216 - DNA, 22 bp, Homo sapiens
ctggctgtgctggagttgagga

SEQ ID NO: 9115217 - DNA, 22 bp, Homo sapiens
ctggcttgggtctacctgcctt

SEQ ID NO: 9115218 - DNA, 22 bp, Homo sapiens
ctggcttgggtctacctgcctt

SEQ ID NO: 9115219 - DNA, 22 bp, Homo sapiens
ctggcttgttttaagaatacaa

SEQ ID NO: 9115220 - DNA, 22 bp, Homo sapiens
ctggcttgttttaagaatacaa

SEQ ID NO: 9115221 - DNA, 22 bp, Homo sapiens
ctggctttaatgtcatctttct

SEQ ID NO: 9115222 - DNA, 22 bp, Homo sapiens
ctggctttcattcattcaggcc

SEQ ID NO: 9115223 - DNA, 22 bp, Homo sapiens
ctggctttccttgtctgcatcc

SEQ ID NO: 9115224 - DNA, 22 bp, Homo sapiens
ctggctttacctcactggggct

SEQ ID NO: 9115225 - DNA, 22 bp, Homo sapiens
ctggctttaggttggagagctg

SEQ ID NO: 9115226 - DNA, 22 bp, Homo sapiens
ctggctttccttgtctgcatcc

SEQ ID NO: 9115227 - DNA, 22 bp, Homo sapiens
ctggctttctatttggtgctat

SEQ ID NO: 9115228 - DNA, 22 bp, Homo sapiens
ctggctttctgaacatcagtga

SEQ ID NO: 9115229 - DNA, 22 bp, Homo sapiens
ctggctttctctgtggtgttca

SEQ ID NO: 9115230 - DNA, 22 bp, Homo sapiens
ctggctttgctggactgggagt

SEQ ID NO: 9115231 - DNA, 22 bp, Homo sapiens
ctggctttgcgtctttgccaca

SEQ ID NO: 9115232 - DNA, 22 bp, Homo sapiens
ctggctttgaggatcccctctt

SEQ ID NO: 9115233 - DNA, 22 bp, Homo sapiens
ctgggccactccagatgcccac

SEQ ID NO: 9115234 - DNA, 22 bp, Homo sapiens
ctgggccacatcagatgaagac

SEQ ID NO: 9115235 - DNA, 22 bp, Homo sapiens
ctgggccactccagatgcccac

SEQ ID NO: 9115236 - DNA, 22 bp, Homo sapiens
ctgggccacttcctcaggggaa

SEQ ID NO: 9115237 - DNA, 19 bp, Homo sapiens
ctgggccagaatcagctca

SEQ ID NO: 9115238 - DNA, 22 bp, Homo sapiens
ctgggccagaagacatttagga

SEQ ID NO: 9115239 - DNA, 22 bp, Homo sapiens
ctgggccacatcagatgaagac

SEQ ID NO: 9115240 - DNA, 22 bp, Homo sapiens
ctgggccacaagcctgtgtgat

SEQ ID NO: 9115241 - DNA, 22 bp, Homo sapiens
ctgggccacagactcaaggcag

SEQ ID NO: 9115242 - DNA, 22 bp, Homo sapiens
ctgggccacaagcctgtgtgat

SEQ ID NO: 9115243 - DNA, 22 bp, Homo sapiens
ctgggccaaaagaagtgttctt

SEQ ID NO: 9115244 - DNA, 22 bp, Homo sapiens
ctgggccacaaaaaactcctgt

SEQ ID NO: 9115245 - DNA, 22 bp, Homo sapiens
ctgggcaggagaggtggttgga

SEQ ID NO: 9115246 - DNA, 22 bp, Homo sapiens
ctgggcaggagggctctatgga

SEQ ID NO: 9115247 - DNA, 22 bp, Homo sapiens
ctgggcaggagggctctatgga

SEQ ID NO: 9115248 - DNA, 22 bp, Homo sapiens
ctgggcagttttacatcattgc

SEQ ID NO: 9115249 - DNA, 22 bp, Homo sapiens
ctgggcagtttattcagttctg

SEQ ID NO: 9115250 - DNA, 22 bp, Homo sapiens
ctgggaggcactattcaggagg

SEQ ID NO: 9115251 - DNA, 22 bp, Homo sapiens
ctgggaggcactattcaggagg

SEQ ID NO: 9115252 - DNA, 22 bp, Homo sapiens
ctgggaggcaccgcgtcgtgct

SEQ ID NO: 9115253 - DNA, 22 bp, Homo sapiens
ctgggaggcactattcaggagg

SEQ ID NO: 9115254 - DNA, 22 bp, Homo sapiens
ctgggaggcagaggttgcagtg

SEQ ID NO: 9115255 - DNA, 22 bp, Homo sapiens
ctgggaggcactattcaggagg

SEQ ID NO: 9115256 - DNA, 22 bp, Homo sapiens
ctgggaggcactattcaggagg

SEQ ID NO: 9115257 - DNA, 22 bp, Homo sapiens
ctgggaggcactattcaggagg

SEQ ID NO: 9115258 - DNA, 22 bp, Homo sapiens
ctgggaggcagaggttgtagtg

SEQ ID NO: 9115259 - DNA, 22 bp, Homo sapiens
ctgggaggcagaggttgtagtg

SEQ ID NO: 9115260 - DNA, 22 bp, Homo sapiens
ctgggaggcagaggttgcagtg

SEQ ID NO: 9115261 - DNA, 22 bp, Homo sapiens
ctgggaggcagaggttgcagtg

SEQ ID NO: 9115262 - DNA, 22 bp, Homo sapiens
ctgggaggcagaggttgcagtg

SEQ ID NO: 9115263 - DNA, 22 bp, Homo sapiens
ctgggaggcccacgttgggaag

SEQ ID NO: 9115264 - DNA, 22 bp, Homo sapiens
ctgggaggcccacgttgggaag

SEQ ID NO: 9115265 - DNA, 22 bp, Homo sapiens
ctgggaggcccacgttgggaag

SEQ ID NO: 9115266 - DNA, 22 bp, Homo sapiens
ctgggaggcagtctctctagaa

SEQ ID NO: 9115267 - DNA, 22 bp, Homo sapiens
ctgggaggcagtctctctagaa

SEQ ID NO: 9115268 - DNA, 22 bp, Homo sapiens
ctgggaggcggagcttgcagtg

SEQ ID NO: 9115269 - DNA, 22 bp, Homo sapiens
ctgggcaggagaggtggttgga

SEQ ID NO: 9115270 - DNA, 22 bp, Homo sapiens
ctgggaggcggagcttgcagtg

SEQ ID NO: 9115271 - DNA, 22 bp, Homo sapiens
ctgggaggcggagcttgcagtg

SEQ ID NO: 9115272 - DNA, 22 bp, Homo sapiens
ctgggtctgggcctcctggagt

SEQ ID NO: 9115273 - DNA, 22 bp, Homo sapiens
ctgggtctgggcctcctggagt

SEQ ID NO: 9115274 - DNA, 22 bp, Homo sapiens
ctgggtctggtgtcaggcgacg

SEQ ID NO: 9115275 - DNA, 22 bp, Homo sapiens
ctgggtctggccacaggaagta

SEQ ID NO: 9115276 - DNA, 22 bp, Homo sapiens
ctgggtctggctactgcttcct

SEQ ID NO: 9115277 - DNA, 22 bp, Homo sapiens
ctgggtctggctactgcttcct

SEQ ID NO: 9115278 - DNA, 22 bp, Homo sapiens
ctgggtctggccacaggaagta

SEQ ID NO: 9115279 - DNA, 22 bp, Homo sapiens
ctgggtctggccacaggaagta

SEQ ID NO: 9115280 - DNA, 22 bp, Homo sapiens
ctgggtctcttaccatgtgact

SEQ ID NO: 9115281 - DNA, 22 bp, Homo sapiens
ctgggtctccggcagcctcggg

SEQ ID NO: 9115282 - DNA, 22 bp, Homo sapiens
ctgggtctggaggccaagggtg

SEQ ID NO: 9115283 - DNA, 22 bp, Homo sapiens
ctgggtctctttagggtgccgt

SEQ ID NO: 9115284 - DNA, 22 bp, Homo sapiens
ctggggtgtgctcagagcaggg

SEQ ID NO: 9115285 - DNA, 22 bp, Homo sapiens
ctggggtgtgctcagagcaggg

SEQ ID NO: 9115286 - DNA, 22 bp, Homo sapiens
ctggggtgtgctcagagcaggg

SEQ ID NO: 9115287 - DNA, 22 bp, Homo sapiens
ctggggctgcggtggaggagcc

SEQ ID NO: 9115288 - DNA, 22 bp, Homo sapiens
ctggggctgcggacgggagccc

SEQ ID NO: 9115289 - DNA, 22 bp, Homo sapiens
ctggggctgcggacgggagccc

SEQ ID NO: 9115290 - DNA, 22 bp, Homo sapiens
ctggggctgcagcgatcttcat

SEQ ID NO: 9115291 - DNA, 22 bp, Homo sapiens
ctggggctgcagcgatcttcat

SEQ ID NO: 9115292 - DNA, 22 bp, Homo sapiens
ctggggccagtgaggaggcttt

SEQ ID NO: 9115293 - DNA, 22 bp, Homo sapiens
ctggggccagtgaggaggcttt

SEQ ID NO: 9115294 - DNA, 22 bp, Homo sapiens
ctggggcccatcgagggctgag

SEQ ID NO: 9115295 - DNA, 22 bp, Homo sapiens
ctggggcccatcgagggctgag

SEQ ID NO: 9115296 - DNA, 22 bp, Homo sapiens
ctggggccacaacggcgcacgc

SEQ ID NO: 9115297 - DNA, 20 bp, Homo sapiens
ctggggaggaggatgtgttc

SEQ ID NO: 9115298 - DNA, 22 bp, Homo sapiens
ctggggcattgggagaggcctg

SEQ ID NO: 9115299 - DNA, 22 bp, Homo sapiens
ctggggctcactttggtcaggc

SEQ ID NO: 9115300 - DNA, 22 bp, Homo sapiens
ctggggctcactttggtcaggc

SEQ ID NO: 9115301 - DNA, 22 bp, Homo sapiens
ctggggctcactccagccctgg

SEQ ID NO: 9115302 - DNA, 22 bp, Homo sapiens
ctggggctcactccagccctgg

SEQ ID NO: 9115303 - DNA, 22 bp, Homo sapiens
ctgggctgctgtccactagggt

SEQ ID NO: 9115304 - DNA, 22 bp, Homo sapiens
ctgggctggacacacttaacct

SEQ ID NO: 9115305 - DNA, 22 bp, Homo sapiens
ctgggctggacacacttaacct

SEQ ID NO: 9115306 - DNA, 20 bp, Homo sapiens
ctggggaggaggatgtgttc

SEQ ID NO: 9115307 - DNA, 20 bp, Homo sapiens
ctggggaggaggatgtgttc

SEQ ID NO: 9115308 - DNA, 22 bp, Homo sapiens
ctgggctgccaggtaggcacac

SEQ ID NO: 9115309 - DNA, 20 bp, Homo sapiens
ctgggctgcccagctatggg

SEQ ID NO: 9115310 - DNA, 22 bp, Homo sapiens
ctgggctgcatcaaagaggcat

SEQ ID NO: 9115311 - DNA, 22 bp, Homo sapiens
ctgggctgcagttcctggtcct

SEQ ID NO: 9115312 - DNA, 22 bp, Homo sapiens
ctgggctgcagcgggagcgacg

SEQ ID NO: 9115313 - DNA, 22 bp, Homo sapiens
ctgggctgcagcgggagcgacg

SEQ ID NO: 9115314 - DNA, 22 bp, Homo sapiens
ctgggctgcagcgggagcgacg

SEQ ID NO: 9115315 - DNA, 22 bp, Homo sapiens
ctgggctgcagcgggagcgacg

SEQ ID NO: 9115316 - DNA, 22 bp, Homo sapiens
ctgggctgcaggagtggggcaa

SEQ ID NO: 9115317 - DNA, 22 bp, Homo sapiens
ctgggctctgcagttgatgttt

SEQ ID NO: 9115318 - DNA, 22 bp, Homo sapiens
ctgggctctaggaaccattcct

SEQ ID NO: 9115319 - DNA, 22 bp, Homo sapiens
ctgggccagatccagcctcaca

SEQ ID NO: 9115320 - DNA, 22 bp, Homo sapiens
ctgggccagatccagcctcaca

SEQ ID NO: 9115321 - DNA, 18 bp, Homo sapiens
ctgggccagagtttctgc

SEQ ID NO: 9115322 - DNA, 22 bp, Homo sapiens
ctgggccagaccttgtggtctt

SEQ ID NO: 9115323 - DNA, 18 bp, Homo sapiens
ctgggccagagtttctgc

SEQ ID NO: 9115324 - DNA, 22 bp, Homo sapiens
ctgtgtcttctgcttacagtct

SEQ ID NO: 9115325 - DNA, 23 bp, Homo sapiens
ctgttaaattccttaagagcagg

SEQ ID NO: 9115326 - DNA, 22 bp, Homo sapiens
ctgtgtctgtggaatagcgaat

SEQ ID NO: 9115327 - DNA, 22 bp, Homo sapiens
ctgtgtcttcaatgtactggga

SEQ ID NO: 9115328 - DNA, 22 bp, Homo sapiens
ctgtgtcttcaatgtactggga

SEQ ID NO: 9115329 - DNA, 22 bp, Homo sapiens
ctgtgtctctacctccccatcc

SEQ ID NO: 9115330 - DNA, 22 bp, Homo sapiens
ctgtgtctctccttacaagact

SEQ ID NO: 9115331 - DNA, 22 bp, Homo sapiens
ctgtgtctgcctgggatccatt

SEQ ID NO: 9115332 - DNA, 22 bp, Homo sapiens
ctgtgtctgaataactctgtgt

SEQ ID NO: 9115333 - DNA, 22 bp, Homo sapiens
ctgtgtctgaataactctgtgt

SEQ ID NO: 9115334 - DNA, 22 bp, Homo sapiens
ctgtgtctgaataactctgtgt

SEQ ID NO: 9115335 - DNA, 22 bp, Homo sapiens
ctgtgtctctccttacaagact

SEQ ID NO: 9115336 - DNA, 22 bp, Homo sapiens
ctgtgtctcatccgcctctggc

SEQ ID NO: 9115337 - DNA, 22 bp, Homo sapiens
ctgtgtctcatccgcctctggc

SEQ ID NO: 9115338 - DNA, 22 bp, Homo sapiens
ctgtgtctctacctccccatcc

SEQ ID NO: 9115339 - DNA, 22 bp, Homo sapiens
ctgtgtctcgttaaagcattgg

SEQ ID NO: 9115340 - DNA, 22 bp, Homo sapiens
ctgttcacagaatcctcccctg

SEQ ID NO: 9115341 - DNA, 22 bp, Homo sapiens
ctgttcagaaaaaatcttcatg

SEQ ID NO: 9115342 - DNA, 22 bp, Homo sapiens
ctgttcagaaaaaatcttcatg

SEQ ID NO: 9115343 - DNA, 22 bp, Homo sapiens
ctgttcagatggcacattcagt

SEQ ID NO: 9115344 - DNA, 18 bp, Homo sapiens
ctgttcagctgaactaca

SEQ ID NO: 9115345 - DNA, 22 bp, Homo sapiens
ctgttcagatggcacattcagt

SEQ ID NO: 9115346 - DNA, 22 bp, Homo sapiens
ctgttctatcattaaaagctat

SEQ ID NO: 9115347 - DNA, 22 bp, Homo sapiens
ctgttctctggcggtggctgtt

SEQ ID NO: 9115348 - DNA, 22 bp, Homo sapiens
ctgttcttctagtccactgaca

SEQ ID NO: 9115349 - DNA, 22 bp, Homo sapiens
ctgttctttagttccactgcaa

SEQ ID NO: 9115350 - DNA, 22 bp, Homo sapiens
ctgttgctgggaacgcatgtca

SEQ ID NO: 9115351 - DNA, 22 bp, Homo sapiens
ctgttgctctgaacaggtcttg

SEQ ID NO: 9115352 - DNA, 22 bp, Homo sapiens
ctgttgcatgactgtgcatgct

SEQ ID NO: 9115353 - DNA, 22 bp, Homo sapiens
ctgttgctaagtagtgcaggta

SEQ ID NO: 9115354 - DNA, 22 bp, Homo sapiens
ctgttgcagaggggcggagagg

SEQ ID NO: 9115355 - DNA, 22 bp, Homo sapiens
ctgtgtcctcccgctgcaccca

SEQ ID NO: 9115356 - DNA, 22 bp, Homo sapiens
ctgtgtcctgcgtcaagccaat

SEQ ID NO: 9115357 - DNA, 23 bp, Homo sapiens
ctgtgtctatgcagccatatcca

SEQ ID NO: 9115358 - DNA, 23 bp, Homo sapiens
ctgtgtctatgcagccatatcca

SEQ ID NO: 9115359 - DNA, 23 bp, Homo sapiens
ctgtgtctatgcagccatatcca

SEQ ID NO: 9115360 - DNA, 22 bp, Homo sapiens
ctgtgtctaatcttatacatca

SEQ ID NO: 9115361 - DNA, 22 bp, Homo sapiens
ctgtggctgcgtaggtctggca

SEQ ID NO: 9115362 - DNA, 22 bp, Homo sapiens
ctgtggctggcctgtctgacat

SEQ ID NO: 9115363 - DNA, 22 bp, Homo sapiens
ctgtggctggcctgtctgacat

SEQ ID NO: 9115364 - DNA, 22 bp, Homo sapiens
ctgtggctgtatttggccagag

SEQ ID NO: 9115365 - DNA, 22 bp, Homo sapiens
ctgtggctggctcatcataggt

SEQ ID NO: 9115366 - DNA, 22 bp, Homo sapiens
ctgtggctgtatttggccagag

SEQ ID NO: 9115367 - DNA, 22 bp, Homo sapiens
ctgtggctgtgaaacttctcag

SEQ ID NO: 9115368 - DNA, 22 bp, Homo sapiens
ctgtggtgggccctgggcttca

SEQ ID NO: 9115369 - DNA, 22 bp, Homo sapiens
ctgtggctctctgcagggtccc

SEQ ID NO: 9115370 - DNA, 22 bp, Homo sapiens
ctgtggctctctgcagggtccc

SEQ ID NO: 9115371 - DNA, 22 bp, Homo sapiens
ctgtggctctccaatggaggga

SEQ ID NO: 9115372 - DNA, 22 bp, Homo sapiens
ctgtggctctccaatggaggga

SEQ ID NO: 9115373 - DNA, 22 bp, Homo sapiens
ctgtggctctcagaggctgctg

SEQ ID NO: 9115374 - DNA, 22 bp, Homo sapiens
ctgtggctctcagaggctgctg

SEQ ID NO: 9115375 - DNA, 22 bp, Homo sapiens
ctgtggctctcagaggctgctg

SEQ ID NO: 9115376 - DNA, 22 bp, Homo sapiens
ctgtggctccatagaagttgca

SEQ ID NO: 9115377 - DNA, 22 bp, Homo sapiens
ctgtggctccagtgaaccaatg

SEQ ID NO: 9115378 - DNA, 20 bp, Homo sapiens
ctgtggctcatgcatctgcc

SEQ ID NO: 9115379 - DNA, 20 bp, Homo sapiens
ctgtggctcatgcatctgcc

SEQ ID NO: 9115380 - DNA, 20 bp, Homo sapiens
ctgtggctcatgcatctgcc

SEQ ID NO: 9115381 - DNA, 19 bp, Homo sapiens
ctgtggctgacctctggcc

SEQ ID NO: 9115382 - DNA, 22 bp, Homo sapiens
ctgtggctgagttccttatgtt

SEQ ID NO: 9115383 - DNA, 23 bp, Homo sapiens
ctgtggctgagtcctgttggagt

SEQ ID NO: 9115384 - DNA, 23 bp, Homo sapiens
ctgtggctgagtcctgttggagt

SEQ ID NO: 9115385 - DNA, 22 bp, Homo sapiens
ctgtggctctttagttgagcac

SEQ ID NO: 9115386 - DNA, 22 bp, Homo sapiens
ctgtggctgcagccttggtcct

SEQ ID NO: 9115387 - DNA, 22 bp, Homo sapiens
ctgtggctgcagccttggtcct

SEQ ID NO: 9115388 - DNA, 22 bp, Homo sapiens
ctgtggctgcagccttggtcct

SEQ ID NO: 9115389 - DNA, 22 bp, Homo sapiens
ctgtggctgcgtaggtctggca

SEQ ID NO: 9115390 - DNA, 22 bp, Homo sapiens
ctgtggctgcgccctgggggag

SEQ ID NO: 9115391 - DNA, 22 bp, Homo sapiens
ctgtcctgatggtgccactggt

SEQ ID NO: 9115392 - DNA, 20 bp, Homo sapiens
ctgtcctgatcttttcagaa

SEQ ID NO: 9115393 - DNA, 22 bp, Homo sapiens
ctgtcctgcccaccctgcaggg

SEQ ID NO: 9115394 - DNA, 22 bp, Homo sapiens
ctgtcctgcccaccctgcaggg

SEQ ID NO: 9115395 - DNA, 21 bp, Homo sapiens
ctgtcctggtctagaggcaca

SEQ ID NO: 9115396 - DNA, 22 bp, Homo sapiens
ctgtcctgtactttgaggccct

SEQ ID NO: 9115397 - DNA, 22 bp, Homo sapiens
ctgtcctgtagctccatcagtc

SEQ ID NO: 9115398 - DNA, 22 bp, Homo sapiens
ctgtcctgtagctccatcagtc

SEQ ID NO: 9115399 - DNA, 22 bp, Homo sapiens
ctgtcctgcccaccctgcaggg

SEQ ID NO: 9115400 - DNA, 22 bp, Homo sapiens
ctgtcctggagggcataggacg

SEQ ID NO: 9115401 - DNA, 22 bp, Homo sapiens
ctgtccctgagcaactcctgtt

SEQ ID NO: 9115402 - DNA, 22 bp, Homo sapiens
ctgggtgctgtgggctcagagg

SEQ ID NO: 9115403 - DNA, 22 bp, Homo sapiens
ctgggtgccagcatggctgagt

SEQ ID NO: 9115404 - DNA, 22 bp, Homo sapiens
ctgtcctctgtcctcagcagga

SEQ ID NO: 9115405 - DNA, 22 bp, Homo sapiens
ctgtcctctgtcctcagcagga

SEQ ID NO: 9115406 - DNA, 22 bp, Homo sapiens
ctgtcctctgtcctcagcagga

SEQ ID NO: 9115407 - DNA, 22 bp, Homo sapiens
ctgggtctttttcttccattga

SEQ ID NO: 9115408 - DNA, 22 bp, Homo sapiens
ctgggtcttcagcagcaggcgg

SEQ ID NO: 9115409 - DNA, 19 bp, Homo sapiens
ctgggtcttattctgtgaa

SEQ ID NO: 9115410 - DNA, 22 bp, Homo sapiens
ctgggtctgtgcccagggacct

SEQ ID NO: 9115411 - DNA, 22 bp, Homo sapiens
ctgggtctgtcactagataaat

SEQ ID NO: 9115412 - DNA, 22 bp, Homo sapiens
ctgggtgacagagtgagatggt

SEQ ID NO: 9115413 - DNA, 22 bp, Homo sapiens
ctgggtgagctggccagagggt

SEQ ID NO: 9115414 - DNA, 22 bp, Homo sapiens
ctgggtgagttgatgaaggaga

SEQ ID NO: 9115415 - DNA, 22 bp, Homo sapiens
ctgtgagggccagagtcagggc

SEQ ID NO: 9115416 - DNA, 22 bp, Homo sapiens
ctgtgagggccagagtcagggc

SEQ ID NO: 9115417 - DNA, 22 bp, Homo sapiens
ctgtgcagtaggtcagggctgg

SEQ ID NO: 9115418 - DNA, 19 bp, Homo sapiens
ctgtgagtcttgtggcctc

SEQ ID NO: 9115419 - DNA, 22 bp, Homo sapiens
ctgtgcagtaggtcagggctgg

SEQ ID NO: 9115420 - DNA, 22 bp, Homo sapiens
ctgtgcagtccagccctggaca

SEQ ID NO: 9115421 - DNA, 22 bp, Homo sapiens
ctgtgcagtggcagcgtgtggg

SEQ ID NO: 9115422 - DNA, 22 bp, Homo sapiens
ctgtgccagcctgtcccaggag

SEQ ID NO: 9115423 - DNA, 22 bp, Homo sapiens
ctgtgccactgccctgccacgc

SEQ ID NO: 9115424 - DNA, 22 bp, Homo sapiens
ctgtgccactgggggccggcaa

SEQ ID NO: 9115425 - DNA, 22 bp, Homo sapiens
ctgtgccagagggtgaccaagg

SEQ ID NO: 9115426 - DNA, 21 bp, Homo sapiens
ctgtgccagcagaagaaagct

SEQ ID NO: 9115427 - DNA, 22 bp, Homo sapiens
ctgtgccactgccccaggcctc

SEQ ID NO: 9115428 - DNA, 22 bp, Homo sapiens
ctgtgccactgccccaggcctc

SEQ ID NO: 9115429 - DNA, 22 bp, Homo sapiens
ctgtgccactgccctgccacgc

SEQ ID NO: 9115430 - DNA, 22 bp, Homo sapiens
ctgtgccactgccctgccacgc

SEQ ID NO: 9115431 - DNA, 22 bp, Homo sapiens
ctgtgcagtgtggggtaggcct

SEQ ID NO: 9115432 - DNA, 22 bp, Homo sapiens
ctgtgccacctgagggactcta

SEQ ID NO: 9115433 - DNA, 22 bp, Homo sapiens
ctgtgccacaaactcgcgaaaa

SEQ ID NO: 9115434 - DNA, 22 bp, Homo sapiens
ctgtgcattgtcttgtctgtag

SEQ ID NO: 9115435 - DNA, 22 bp, Homo sapiens
ctgtgccatccgcttgacctgg

SEQ ID NO: 9115436 - DNA, 22 bp, Homo sapiens
ctgtgccatcctagggctgctg

SEQ ID NO: 9115437 - DNA, 22 bp, Homo sapiens
ctgtgccatctgcactctcgtc

SEQ ID NO: 9115438 - DNA, 22 bp, Homo sapiens
ctgtgccatctgcactctcgtc

SEQ ID NO: 9115439 - DNA, 22 bp, Homo sapiens
ctgtgccatccgcttgacctgg

SEQ ID NO: 9115440 - DNA, 22 bp, Homo sapiens
ctgtgccagtgtattcctgtga

SEQ ID NO: 9115441 - DNA, 22 bp, Homo sapiens
ctgtgccagggtctattccaga

SEQ ID NO: 9115442 - DNA, 22 bp, Homo sapiens
ctgtgccagtgtattcctgtga

SEQ ID NO: 9115443 - DNA, 22 bp, Homo sapiens
ctgtgccaggcccagctgactt

SEQ ID NO: 9115444 - DNA, 22 bp, Homo sapiens
ctgtgccaggcccagctgactt

SEQ ID NO: 9115445 - DNA, 22 bp, Homo sapiens
ctgtgccaggcccagctgactt

SEQ ID NO: 9115446 - DNA, 22 bp, Homo sapiens
ctgtgccagagggtgaccaagg

SEQ ID NO: 9115447 - DNA, 22 bp, Homo sapiens
ctgtgccagggtctattccaga

SEQ ID NO: 9115448 - DNA, 22 bp, Homo sapiens
ctgtgccaggcccgggtgggtg

SEQ ID NO: 9115449 - DNA, 22 bp, Homo sapiens
ctgtgcccacctggctctgagg

SEQ ID NO: 9115450 - DNA, 22 bp, Homo sapiens
ctgtgccatctttttgctacct

SEQ ID NO: 9115451 - DNA, 22 bp, Homo sapiens
ctgtgccattctttgtagcatg

SEQ ID NO: 9115452 - DNA, 22 bp, Homo sapiens
ctgtggccagtcccacacctcc

SEQ ID NO: 9115453 - DNA, 22 bp, Homo sapiens
ctgtggccagatggtgccagtt

SEQ ID NO: 9115454 - DNA, 19 bp, Homo sapiens
ctgtgccctatgacttgta

SEQ ID NO: 9115455 - DNA, 22 bp, Homo sapiens
cttattttaagtcagtttgggt

SEQ ID NO: 9115456 - DNA, 22 bp, Homo sapiens
cttattttgctgatgacccagg

SEQ ID NO: 9115457 - DNA, 22 bp, Homo sapiens
cttcaaaagccagaagcctgcg

SEQ ID NO: 9115458 - DNA, 22 bp, Homo sapiens
cttattttgctgatgacccagg

SEQ ID NO: 9115459 - DNA, 22 bp, Homo sapiens
cttattttgctgatgacccagg

SEQ ID NO: 9115460 - DNA, 22 bp, Homo sapiens
cttcagaagaaaagcagtgtgt

SEQ ID NO: 9115461 - DNA, 18 bp, Homo sapiens
cttattgtttaaatggcc

SEQ ID NO: 9115462 - DNA, 22 bp, Homo sapiens
cttattgttcagatagagatga

SEQ ID NO: 9115463 - DNA, 22 bp, Homo sapiens
cttattgtgtctttgaataagt

SEQ ID NO: 9115464 - DNA, 22 bp, Homo sapiens
cttattgtgtgtattttctagt

SEQ ID NO: 9115465 - DNA, 22 bp, Homo sapiens
cttattgtcttacagtaataga

SEQ ID NO: 9115466 - DNA, 22 bp, Homo sapiens
cttattgtgaggtattgagatt

SEQ ID NO: 9115467 - DNA, 22 bp, Homo sapiens
cttattgtgagatgcgataatt

SEQ ID NO: 9115468 - DNA, 22 bp, Homo sapiens
cttatattttaggaacagacaa

SEQ ID NO: 9115469 - DNA, 22 bp, Homo sapiens
ctgttgtcttcattgtcatatc

SEQ ID NO: 9115470 - DNA, 22 bp, Homo sapiens
ctgttgtcttcattgtcatatc

SEQ ID NO: 9115471 - DNA, 22 bp, Homo sapiens
ctgttgctccagggaacacaga

SEQ ID NO: 9115472 - DNA, 23 bp, Homo sapiens
cttcagtgtgggactgcagcgtg

SEQ ID NO: 9115473 - DNA, 19 bp, Homo sapiens
cttcagtgttcacctggcc

SEQ ID NO: 9115474 - DNA, 18 bp, Homo sapiens
cttcagtggctgctctgc

SEQ ID NO: 9115475 - DNA, 22 bp, Homo sapiens
cttcagtggtcatttgtgataa

SEQ ID NO: 9115476 - DNA, 22 bp, Homo sapiens
cttccctttttatgtcttcagc

SEQ ID NO: 9115477 - DNA, 22 bp, Homo sapiens
cttccgtgtcagttccaggtgg

SEQ ID NO: 9115478 - DNA, 22 bp, Homo sapiens
cttcctctgcggcgccgggcgc

SEQ ID NO: 9115479 - DNA, 22 bp, Homo sapiens
cttcctctgcggcgccgggcgc

SEQ ID NO: 9115480 - DNA, 22 bp, Homo sapiens
cttcctctgcctcccgtgctca

SEQ ID NO: 9115481 - DNA, 22 bp, Homo sapiens
cttcctctgcctcccgtgctca

SEQ ID NO: 9115482 - DNA, 22 bp, Homo sapiens
cttcctctgaggcttctgagtc

SEQ ID NO: 9115483 - DNA, 22 bp, Homo sapiens
cttcctctgaggcttctgagtc

SEQ ID NO: 9115484 - DNA, 18 bp, Homo sapiens
cttcctcttctggagaaa

SEQ ID NO: 9115485 - DNA, 22 bp, Homo sapiens
cttcctgaaggatggcagcctc

SEQ ID NO: 9115486 - DNA, 22 bp, Homo sapiens
cttcctctgtggccagagtgta

SEQ ID NO: 9115487 - DNA, 22 bp, Homo sapiens
cttcctctgtggccagagtgta

SEQ ID NO: 9115488 - DNA, 22 bp, Homo sapiens
cttcctctgtgtcctgggcttc

SEQ ID NO: 9115489 - DNA, 22 bp, Homo sapiens
cttcctctgtgtcctgggcttc

SEQ ID NO: 9115490 - DNA, 22 bp, Homo sapiens
cttcctctgtgtcctgggcttc

SEQ ID NO: 9115491 - DNA, 16 bp, Homo sapiens
cttcctcttcactggc

SEQ ID NO: 9115492 - DNA, 22 bp, Homo sapiens
cttcctctgtgtcctgggcttg

SEQ ID NO: 9115493 - DNA, 16 bp, Homo sapiens
cttcctcttcactggc

SEQ ID NO: 9115494 - DNA, 22 bp, Homo sapiens
cttcctctgtgtcctgggcttg

SEQ ID NO: 9115495 - DNA, 22 bp, Homo sapiens
cttcctctgtgtcctgggcttg

SEQ ID NO: 9115496 - DNA, 22 bp, Homo sapiens
cttcaggagtagttacctagca

SEQ ID NO: 9115497 - DNA, 20 bp, Homo sapiens
cttcaggacccatcctcccc

SEQ ID NO: 9115498 - DNA, 22 bp, Homo sapiens
cttcaggattaatttggggcct

SEQ ID NO: 9115499 - DNA, 22 bp, Homo sapiens
cttcaggaaaatctctaaggat

SEQ ID NO: 9115500 - DNA, 22 bp, Homo sapiens
cttcagtgaatgttgagtaagg

SEQ ID NO: 9115501 - DNA, 22 bp, Homo sapiens
cttcagtgacattccttccctc

SEQ ID NO: 9115502 - DNA, 22 bp, Homo sapiens
cttcagtgattgcagaaagcct

SEQ ID NO: 9115503 - DNA, 18 bp, Homo sapiens
cttcagtgacagtctggc

SEQ ID NO: 9115504 - DNA, 22 bp, Homo sapiens
cttcagtgatataggcttctcc

SEQ ID NO: 9115505 - DNA, 22 bp, Homo sapiens
cttcagtatcctccacatgtta

SEQ ID NO: 9115506 - DNA, 22 bp, Homo sapiens
cttcaggggtgttagttttgtg

SEQ ID NO: 9115507 - DNA, 22 bp, Homo sapiens
cttcagggcatattattggctc

SEQ ID NO: 9115508 - DNA, 22 bp, Homo sapiens
cttcaggatttaggaagatgaa

SEQ ID NO: 9115509 - DNA, 22 bp, Homo sapiens
cttgtattaggaagaatgcttt

SEQ ID NO: 9115510 - DNA, 22 bp, Homo sapiens
cttgtattcagagtggacatga

SEQ ID NO: 9115511 - DNA, 22 bp, Homo sapiens
cttgtattcccctatctctaaa

SEQ ID NO: 9115512 - DNA, 22 bp, Homo sapiens
cttgtattcccctatctctaaa

SEQ ID NO: 9115513 - DNA, 22 bp, Homo sapiens
cttgtattgcaaactggccagg

SEQ ID NO: 9115514 - DNA, 22 bp, Homo sapiens
cttgtattgctgttttgcatct

SEQ ID NO: 9115515 - DNA, 22 bp, Homo sapiens
cttgtattcagagtggacatga

SEQ ID NO: 9115516 - DNA, 22 bp, Homo sapiens
cttgtcagccaattgtggattt

SEQ ID NO: 9115517 - DNA, 21 bp, Homo sapiens
cttgtcttgcttagaatagac

SEQ ID NO: 9115518 - DNA, 22 bp, Homo sapiens
cttgtctgtgtcggataaaact

SEQ ID NO: 9115519 - DNA, 22 bp, Homo sapiens
ctttatgtccaccagactgcaa

SEQ ID NO: 9115520 - DNA, 22 bp, Homo sapiens
cttgtccagatgtttgttaggt

SEQ ID NO: 9115521 - DNA, 22 bp, Homo sapiens
cttgtacagatcttgcaaggac

SEQ ID NO: 9115522 - DNA, 20 bp, Homo sapiens
cttgtacatgataaagattt

SEQ ID NO: 9115523 - DNA, 22 bp, Homo sapiens
cttgtacatagagaagaagcct

SEQ ID NO: 9115524 - DNA, 22 bp, Homo sapiens
cttgtacaggatattataggct

SEQ ID NO: 9115525 - DNA, 22 bp, Homo sapiens
cttgtagacccctggactcacg

SEQ ID NO: 9115526 - DNA, 22 bp, Homo sapiens
cttgtagaattgaaatggtctc

SEQ ID NO: 9115527 - DNA, 22 bp, Homo sapiens
cttgtacattgatttctgcatt

SEQ ID NO: 9115528 - DNA, 22 bp, Homo sapiens
cttgcctacttgtcaaccagca

SEQ ID NO: 9115529 - DNA, 22 bp, Homo sapiens
cttgccaatggtacaaacgatt

SEQ ID NO: 9115530 - DNA, 22 bp, Homo sapiens
cttgccaaattaacatacagaa

SEQ ID NO: 9115531 - DNA, 20 bp, Homo sapiens
cttgcagtttcaccttcact

SEQ ID NO: 9115532 - DNA, 22 bp, Homo sapiens
cttgcagtttaggtcctctgtg

SEQ ID NO: 9115533 - DNA, 22 bp, Homo sapiens
cttgcaaacactcaaagccatc

SEQ ID NO: 9115534 - DNA, 22 bp, Homo sapiens
cttgcaaagtagctgagaggtt

SEQ ID NO: 9115535 - DNA, 22 bp, Homo sapiens
cttgatgactcaggaggaggag

SEQ ID NO: 9115536 - DNA, 22 bp, Homo sapiens
cttgatgaatgacctgggtggt

SEQ ID NO: 9115537 - DNA, 22 bp, Homo sapiens
cttgatgaaatttttcaattgt

SEQ ID NO: 9115538 - DNA, 22 bp, Homo sapiens
cttgacttcttctagaaataag

SEQ ID NO: 9115539 - DNA, 22 bp, Homo sapiens
cttgatggaggggccaggcttt

SEQ ID NO: 9115540 - DNA, 22 bp, Homo sapiens
cttgatgatttgcagagggagt

SEQ ID NO: 9115541 - DNA, 22 bp, Homo sapiens
cttgatgatgacgtcggtgatg

SEQ ID NO: 9115542 - DNA, 22 bp, Homo sapiens
cttgatgatagcaggcagggaa

SEQ ID NO: 9115543 - DNA, 22 bp, Homo sapiens
cttgatgagtcagaactgaagg

SEQ ID NO: 9115544 - DNA, 22 bp, Homo sapiens
cttgatgatagaatgtgaggag

SEQ ID NO: 9115545 - DNA, 20 bp, Homo sapiens
cttgatgagataaacagcag

SEQ ID NO: 9115546 - DNA, 22 bp, Homo sapiens
cttgatgagcctagtgcttaga

SEQ ID NO: 9115547 - DNA, 22 bp, Homo sapiens
cttgatgaggtatgaacctctc

SEQ ID NO: 9115548 - DNA, 22 bp, Homo sapiens
cttgcaggattttgctgctgta

SEQ ID NO: 9115549 - DNA, 22 bp, Homo sapiens
cttgcaggattttgctgctgta

SEQ ID NO: 9115550 - DNA, 22 bp, Homo sapiens
cttgcagccttaccaaggcatt

SEQ ID NO: 9115551 - DNA, 22 bp, Homo sapiens
cttgcagatgtgactaaattaa

SEQ ID NO: 9115552 - DNA, 22 bp, Homo sapiens
cttgcagaggctgttccagatg

SEQ ID NO: 9115553 - DNA, 22 bp, Homo sapiens
cttcctgctcccctgccaattc

SEQ ID NO: 9115554 - DNA, 22 bp, Homo sapiens
cttcctgcccacttcctgctgg

SEQ ID NO: 9115555 - DNA, 22 bp, Homo sapiens
cttcctgcattgtgccagagtt

SEQ ID NO: 9115556 - DNA, 22 bp, Homo sapiens
cttcctgcatggagtctgaatg

SEQ ID NO: 9115557 - DNA, 22 bp, Homo sapiens
cttcctgcaacacctgtgttgc

SEQ ID NO: 9115558 - DNA, 22 bp, Homo sapiens
cttcctgcaacacctgtgttgc

SEQ ID NO: 9115559 - DNA, 22 bp, Homo sapiens
cttcctggctcggtgcctcacc

SEQ ID NO: 9115560 - DNA, 22 bp, Homo sapiens
cttcctggctcggtgcctcacc

SEQ ID NO: 9115561 - DNA, 22 bp, Homo sapiens
cttcctgggtctggagactgga

SEQ ID NO: 9115562 - DNA, 22 bp, Homo sapiens
cttgacactgtcactcaggcca

SEQ ID NO: 9115563 - DNA, 22 bp, Homo sapiens
cttgaccctaccccccagaagg

SEQ ID NO: 9115564 - DNA, 21 bp, Homo sapiens
cttgacatagcctgtcagctt

SEQ ID NO: 9115565 - DNA, 22 bp, Homo sapiens
ggttttattaccccttaaacac

SEQ ID NO: 9115566 - DNA, 22 bp, Homo sapiens
ggttttctccccctcttctcag

SEQ ID NO: 9115567 - DNA, 22 bp, Homo sapiens
ggttttatcctacccacacagc

SEQ ID NO: 9115568 - DNA, 22 bp, Homo sapiens
ggttttatagcagtactatcag

SEQ ID NO: 9115569 - DNA, 22 bp, Homo sapiens
ggttttattaactttaacatca

SEQ ID NO: 9115570 - DNA, 22 bp, Homo sapiens
ggttttattaactttaacatca

SEQ ID NO: 9115571 - DNA, 22 bp, Homo sapiens
gtaaaaaggccaagcccttgtg

SEQ ID NO: 9115572 - DNA, 22 bp, Homo sapiens
gtaaaacaagctttatggttcc

SEQ ID NO: 9115573 - DNA, 22 bp, Homo sapiens
gtaaaacatgttttaactagga

SEQ ID NO: 9115574 - DNA, 22 bp, Homo sapiens
ggtttctcaccttcagcactac

SEQ ID NO: 9115575 - DNA, 22 bp, Homo sapiens
ggtttgcattctgaaaggctca

SEQ ID NO: 9115576 - DNA, 22 bp, Homo sapiens
ggtttggttctgagagttggca

SEQ ID NO: 9115577 - DNA, 22 bp, Homo sapiens
ggtttctagcagagtctcttta

SEQ ID NO: 9115578 - DNA, 22 bp, Homo sapiens
ggtttcagccctgctgttcctg

SEQ ID NO: 9115579 - DNA, 22 bp, Homo sapiens
ggtttcaacttttgtgaggaat

SEQ ID NO: 9115580 - DNA, 22 bp, Homo sapiens
gtaaaactgcagaacttggagg

SEQ ID NO: 9115581 - DNA, 22 bp, Homo sapiens
gtacatttatttttgcagcata

SEQ ID NO: 9115582 - DNA, 22 bp, Homo sapiens
gtacatttcatttaaatgatgt

SEQ ID NO: 9115583 - DNA, 22 bp, Homo sapiens
gtacatttcatttaaatgatgt

SEQ ID NO: 9115584 - DNA, 22 bp, Homo sapiens
gtacattttgaggttaaaacaa

SEQ ID NO: 9115585 - DNA, 22 bp, Homo sapiens
gtaccctgtggccagccagcca

SEQ ID NO: 9115586 - DNA, 22 bp, Homo sapiens
gtaccagtctctgtgggcacct

SEQ ID NO: 9115587 - DNA, 22 bp, Homo sapiens
gtaccataatgagtctcttaaa

SEQ ID NO: 9115588 - DNA, 22 bp, Homo sapiens
gtaccatgggatctagggccca

SEQ ID NO: 9115589 - DNA, 22 bp, Homo sapiens
gtacattttactttgtttgaat

SEQ ID NO: 9115590 - DNA, 22 bp, Homo sapiens
gtacatttctcccaacactaaa

SEQ ID NO: 9115591 - DNA, 22 bp, Homo sapiens
gtagacagaaagcggaatcata

SEQ ID NO: 9115592 - DNA, 22 bp, Homo sapiens
gtattagaagaaattataggta

SEQ ID NO: 9115593 - DNA, 22 bp, Homo sapiens
gtattattgtcatgaaataata

SEQ ID NO: 9115594 - DNA, 22 bp, Homo sapiens
gtattattgtcatgaaataata

SEQ ID NO: 9115595 - DNA, 22 bp, Homo sapiens
gtattattaagtgtatttgacc

SEQ ID NO: 9115596 - DNA, 22 bp, Homo sapiens
gtattatgaatgccgaggcggc

SEQ ID NO: 9115597 - DNA, 22 bp, Homo sapiens
gtattatgttccttgcttcttt

SEQ ID NO: 9115598 - DNA, 22 bp, Homo sapiens
gtagaaatggtgtgtttcttct

SEQ ID NO: 9115599 - DNA, 22 bp, Homo sapiens
gtagaaatggtgtgtttcttct

SEQ ID NO: 9115600 - DNA, 22 bp, Homo sapiens
gtagaaattccatttactttga

SEQ ID NO: 9115601 - DNA, 22 bp, Homo sapiens
gtagaaatgtaaccaggagata

SEQ ID NO: 9115602 - DNA, 22 bp, Homo sapiens
gtagaattttaataatggagat

SEQ ID NO: 9115603 - DNA, 22 bp, Homo sapiens
gtagaattacctctctatgtcc

SEQ ID NO: 9115604 - DNA, 22 bp, Homo sapiens
gtatttataggggaatgagagt

SEQ ID NO: 9115605 - DNA, 22 bp, Homo sapiens
gtatttataggggaatgagagt

SEQ ID NO: 9115606 - DNA, 17 bp, Homo sapiens
gtattctttgccttcca

SEQ ID NO: 9115607 - DNA, 22 bp, Homo sapiens
gtattgcattttaatatgtgca

SEQ ID NO: 9115608 - DNA, 22 bp, Homo sapiens
gtattgtagctacaatagacgt

SEQ ID NO: 9115609 - DNA, 22 bp, Homo sapiens
gtattgggtgagggcaaagggt

SEQ ID NO: 9115610 - DNA, 22 bp, Homo sapiens
gtattcttatactcagtgagct

SEQ ID NO: 9115611 - DNA, 22 bp, Homo sapiens
gtattcttaaggattgagcaaa

SEQ ID NO: 9115612 - DNA, 22 bp, Homo sapiens
gtattcttgagtggcaactagg

SEQ ID NO: 9115613 - DNA, 22 bp, Homo sapiens
gtattcttgagtggcaactagg

SEQ ID NO: 9115614 - DNA, 22 bp, Homo sapiens
gtattcttggttatcaaaatac

SEQ ID NO: 9115615 - DNA, 21 bp, Homo sapiens
gtattctttatgaagtgaaaa

SEQ ID NO: 9115616 - DNA, 21 bp, Homo sapiens
gtattctttatgaagtgaaaa

SEQ ID NO: 9115617 - DNA, 22 bp, Homo sapiens
gtcatttttttcgtaatagtgg

SEQ ID NO: 9115618 - DNA, 22 bp, Homo sapiens
gtccaaaagagccagccgggcg

SEQ ID NO: 9115619 - DNA, 22 bp, Homo sapiens
gtcattttatgggaacagattt

SEQ ID NO: 9115620 - DNA, 22 bp, Homo sapiens
gtcatttttcactgcatataga

SEQ ID NO: 9115621 - DNA, 22 bp, Homo sapiens
gtcatttttcactgcatataga

SEQ ID NO: 9115622 - DNA, 18 bp, Homo sapiens
gtccacagccctcacagc

SEQ ID NO: 9115623 - DNA, 22 bp, Homo sapiens
gtccacagagggctgggcaggc

SEQ ID NO: 9115624 - DNA, 22 bp, Homo sapiens
gtccacagctctgaggtctccc

SEQ ID NO: 9115625 - DNA, 22 bp, Homo sapiens
gtccacagctggccagggcctc

SEQ ID NO: 9115626 - DNA, 18 bp, Homo sapiens
gtccacagccctcacagc

SEQ ID NO: 9115627 - DNA, 22 bp, Homo sapiens
gtccacagctggccagggcctc

SEQ ID NO: 9115628 - DNA, 22 bp, Homo sapiens
gtccacataggaacccagcttc

SEQ ID NO: 9115629 - DNA, 22 bp, Homo sapiens
gtccagaaagggcagtgatttg

SEQ ID NO: 9115630 - DNA, 23 bp, Homo sapiens
gtccagaacccaggctggggtgg

SEQ ID NO: 9115631 - DNA, 23 bp, Homo sapiens
gtccagaacccaggctggggtgg

SEQ ID NO: 9115632 - DNA, 22 bp, Homo sapiens
gtccccagaaaggtgaggcagg

SEQ ID NO: 9115633 - DNA, 22 bp, Homo sapiens
gtccccagaaaggtgaggcagg

SEQ ID NO: 9115634 - DNA, 22 bp, Homo sapiens
gtccccagagctggtggtggtt

SEQ ID NO: 9115635 - DNA, 22 bp, Homo sapiens
gtccctctgcctgtggttctct

SEQ ID NO: 9115636 - DNA, 22 bp, Homo sapiens
gtccctctgggccatcaggtcc

SEQ ID NO: 9115637 - DNA, 22 bp, Homo sapiens
gtccctctgctctagagagcca

SEQ ID NO: 9115638 - DNA, 22 bp, Homo sapiens
gtccctctgtgtccctgcagtc

SEQ ID NO: 9115639 - DNA, 22 bp, Homo sapiens
gtccctctgctctagagagcca

SEQ ID NO: 9115640 - DNA, 22 bp, Homo sapiens
gtccctctgtgtccctgcagtc

SEQ ID NO: 9115641 - DNA, 22 bp, Homo sapiens
gtccctgcatcaccacgggact

SEQ ID NO: 9115642 - DNA, 22 bp, Homo sapiens
gtccctgacacccgggtggagg

SEQ ID NO: 9115643 - DNA, 22 bp, Homo sapiens
gtccctctcaaatttatatgct

SEQ ID NO: 9115644 - DNA, 22 bp, Homo sapiens
gtccctagtggaaagacatgat

SEQ ID NO: 9115645 - DNA, 22 bp, Homo sapiens
gtcccctcaaaattcatatgtt

SEQ ID NO: 9115646 - DNA, 22 bp, Homo sapiens
gtccccgacgtttggcttgatg

SEQ ID NO: 9115647 - DNA, 22 bp, Homo sapiens
gtccccagctaatctctttgcc

SEQ ID NO: 9115648 - DNA, 22 bp, Homo sapiens
gtccccagctaatctctttgcc

SEQ ID NO: 9115649 - DNA, 22 bp, Homo sapiens
gtccccagctgtgacgagagcc

SEQ ID NO: 9115650 - DNA, 22 bp, Homo sapiens
gtccccagctgtgacgagagcc

SEQ ID NO: 9115651 - DNA, 22 bp, Homo sapiens
gtcccctcagccacccatgggg

SEQ ID NO: 9115652 - DNA, 22 bp, Homo sapiens
gtcccctcagccacccatgggg

SEQ ID NO: 9115653 - DNA, 22 bp, Homo sapiens
gtcccctggcccccagcgtcgg

SEQ ID NO: 9115654 - DNA, 22 bp, Homo sapiens
gtccccttaaacatgctctctt

SEQ ID NO: 9115655 - DNA, 22 bp, Homo sapiens
gtcccctgtccagggccagcca

SEQ ID NO: 9115656 - DNA, 22 bp, Homo sapiens
gtccccttggtaaccttcagct

SEQ ID NO: 9115657 - DNA, 17 bp, Homo sapiens
gtcctgggaggagagag

SEQ ID NO: 9115658 - DNA, 17 bp, Homo sapiens
gtcctgggaggagagag

SEQ ID NO: 9115659 - DNA, 17 bp, Homo sapiens
gtcctgggaggagagag

SEQ ID NO: 9115660 - DNA, 20 bp, Homo sapiens
gtcctgggagccacagcaca

SEQ ID NO: 9115661 - DNA, 20 bp, Homo sapiens
gtcctgggagccacagcaca

SEQ ID NO: 9115662 - DNA, 22 bp, Homo sapiens
gtcctgggaggggctggtcctg

SEQ ID NO: 9115663 - DNA, 22 bp, Homo sapiens
gtcctgggcccaggggctgcct

SEQ ID NO: 9115664 - DNA, 22 bp, Homo sapiens
gtcctgggcccaggggctgcct

SEQ ID NO: 9115665 - DNA, 22 bp, Homo sapiens
gtcctgggaactggacagctaa

SEQ ID NO: 9115666 - DNA, 22 bp, Homo sapiens
gtcctgggaactggacagctaa

SEQ ID NO: 9115667 - DNA, 22 bp, Homo sapiens
gtccctgccctcctgggactca

SEQ ID NO: 9115668 - DNA, 22 bp, Homo sapiens
gtcctgggaaggaagccaggga

SEQ ID NO: 9115669 - DNA, 22 bp, Homo sapiens
gtcctgggaactggacagctaa

SEQ ID NO: 9115670 - DNA, 22 bp, Homo sapiens
gtcctgggagatgggaccctga

SEQ ID NO: 9115671 - DNA, 22 bp, Homo sapiens
gtcctgggagatgggaccctga

SEQ ID NO: 9115672 - DNA, 20 bp, Homo sapiens
gtcctgggagccacagcaca

SEQ ID NO: 9115673 - DNA, 22 bp, Homo sapiens
gtgaaggataaggatctaaatt

SEQ ID NO: 9115674 - DNA, 22 bp, Homo sapiens
gtgaccataatagattatgagt

SEQ ID NO: 9115675 - DNA, 23 bp, Homo sapiens
gtgacccaaggaccttccagaat

SEQ ID NO: 9115676 - DNA, 22 bp, Homo sapiens
gtgacccaggtaggtaagcaat

SEQ ID NO: 9115677 - DNA, 22 bp, Homo sapiens
gtgacccagaggctgactaaca

SEQ ID NO: 9115678 - DNA, 22 bp, Homo sapiens
gtgacccaggacactgtgtatc

SEQ ID NO: 9115679 - DNA, 22 bp, Homo sapiens
gtgaccatttgacatatccttg

SEQ ID NO: 9115680 - DNA, 22 bp, Homo sapiens
gtgaaggaccaatatgactcat

SEQ ID NO: 9115681 - DNA, 22 bp, Homo sapiens
gtgaagccacagagccacgccg

SEQ ID NO: 9115682 - DNA, 22 bp, Homo sapiens
gtgaagcctcggaaccaagctc

SEQ ID NO: 9115683 - DNA, 22 bp, Homo sapiens
gtgaaggactgaatgaaaatgt

SEQ ID NO: 9115684 - DNA, 22 bp, Homo sapiens
gtgaaggactagcatggagggc

SEQ ID NO: 9115685 - DNA, 22 bp, Homo sapiens
gtgaaggaggggccacagatat

SEQ ID NO: 9115686 - DNA, 22 bp, Homo sapiens
gtgaaggaggggccacagatat

SEQ ID NO: 9115687 - DNA, 22 bp, Homo sapiens
gtgaaggaggggccacagatat

SEQ ID NO: 9115688 - DNA, 22 bp, Homo sapiens
gtgaagcagttgcgtgggttcc

SEQ ID NO: 9115689 - DNA, 22 bp, Homo sapiens
gtgaagcagggaaggaaaggat

SEQ ID NO: 9115690 - DNA, 22 bp, Homo sapiens
gtgaagcataactgaaggattt

SEQ ID NO: 9115691 - DNA, 22 bp, Homo sapiens
gtgaagcatatgcttctctgcc

SEQ ID NO: 9115692 - DNA, 22 bp, Homo sapiens
gtgaagcacatgggcgttgggt

SEQ ID NO: 9115693 - DNA, 22 bp, Homo sapiens
gtgaagatgcctcaggtgaccc

SEQ ID NO: 9115694 - DNA, 22 bp, Homo sapiens
gtgaagcagggaaggaaaggat

SEQ ID NO: 9115695 - DNA, 22 bp, Homo sapiens
gtgaagcagagtgtggaagcaa

SEQ ID NO: 9115696 - DNA, 22 bp, Homo sapiens
gtgaagcacgctgccgcactgg

SEQ ID NO: 9115697 - DNA, 22 bp, Homo sapiens
gtgaacttccagatgataaaca

SEQ ID NO: 9115698 - DNA, 22 bp, Homo sapiens
gtgaagatctgagccctcaggt

SEQ ID NO: 9115699 - DNA, 22 bp, Homo sapiens
gtgaagacttggagaagttaag

SEQ ID NO: 9115700 - DNA, 22 bp, Homo sapiens
gtgaacagttcattttatcatg

SEQ ID NO: 9115701 - DNA, 22 bp, Homo sapiens
gtgaaatattttgtttatgtca

SEQ ID NO: 9115702 - DNA, 22 bp, Homo sapiens
gtgaaattgtatttggcattga

SEQ ID NO: 9115703 - DNA, 22 bp, Homo sapiens
gtgaaatatttaacgtccaggt

SEQ ID NO: 9115704 - DNA, 22 bp, Homo sapiens
gtgaaagacagcattaatggct

SEQ ID NO: 9115705 - DNA, 18 bp, Homo sapiens
gtctggaggtcaggagct

SEQ ID NO: 9115706 - DNA, 17 bp, Homo sapiens
gtctggagtggccttca

SEQ ID NO: 9115707 - DNA, 22 bp, Homo sapiens
gtctggagggaagagatgtcag

SEQ ID NO: 9115708 - DNA, 22 bp, Homo sapiens
gtctggagtggggcctgagaat

SEQ ID NO: 9115709 - DNA, 22 bp, Homo sapiens
gtgaaaataaggctggttcttg

SEQ ID NO: 9115710 - DNA, 22 bp, Homo sapiens
gtctgccctcacgccagctggg

SEQ ID NO: 9115711 - DNA, 22 bp, Homo sapiens
gtcctgggggcagctgtgtcca

SEQ ID NO: 9115712 - DNA, 22 bp, Homo sapiens
gtcctgggcctgctgaggctga

SEQ ID NO: 9115713 - DNA, 22 bp, Homo sapiens
gtcctggggaatacagaagccg

SEQ ID NO: 9115714 - DNA, 22 bp, Homo sapiens
gtcctggggatacagaagtgaa

SEQ ID NO: 9115715 - DNA, 22 bp, Homo sapiens
gtcctggggattatagagtgtt

SEQ ID NO: 9115716 - DNA, 22 bp, Homo sapiens
gtcctggggatacagaagtgaa

SEQ ID NO: 9115717 - DNA, 22 bp, Homo sapiens
gtcctggggaatacagaagccg

SEQ ID NO: 9115718 - DNA, 22 bp, Homo sapiens
gtctgctgcagtcgtggctcta

SEQ ID NO: 9115719 - DNA, 22 bp, Homo sapiens
gtctgctggcacgtcacagata

SEQ ID NO: 9115720 - DNA, 22 bp, Homo sapiens
gtctggaggcccgtcagcccta

SEQ ID NO: 9115721 - DNA, 22 bp, Homo sapiens
gtctggaggcactttctcatga

SEQ ID NO: 9115722 - DNA, 22 bp, Homo sapiens
gtctggagcctgggtccctgct

SEQ ID NO: 9115723 - DNA, 22 bp, Homo sapiens
gtctgctgttcagagatgttgc

SEQ ID NO: 9115724 - DNA, 22 bp, Homo sapiens
gtctgctgttcagagatgttgc

SEQ ID NO: 9115725 - DNA, 22 bp, Homo sapiens
gtctgctcatgctaccgcgggc

SEQ ID NO: 9115726 - DNA, 22 bp, Homo sapiens
gtctgctgcagtcgtggctcta

SEQ ID NO: 9115727 - DNA, 22 bp, Homo sapiens
gtctgcctgtctggatgacaga

SEQ ID NO: 9115728 - DNA, 18 bp, Homo sapiens
gtctgccttctcccttcc

SEQ ID NO: 9115729 - DNA, 22 bp, Homo sapiens
gtctgcctttatcatctcctta

SEQ ID NO: 9115730 - DNA, 22 bp, Homo sapiens
gtctgcctgggacgctgggagt

SEQ ID NO: 9115731 - DNA, 22 bp, Homo sapiens
gtctgcctggaggcagctgctg

SEQ ID NO: 9115732 - DNA, 22 bp, Homo sapiens
gtctgcctgctagtggctgcct

SEQ ID NO: 9115733 - DNA, 22 bp, Homo sapiens
gtctgcctgcaatccagagact

SEQ ID NO: 9115734 - DNA, 22 bp, Homo sapiens
gtctgcctctttctttctgggt

SEQ ID NO: 9115735 - DNA, 22 bp, Homo sapiens
gtctgcctctattgcctacctg

SEQ ID NO: 9115736 - DNA, 22 bp, Homo sapiens
gtctgcctcagccgggggccgc

SEQ ID NO: 9115737 - DNA, 22 bp, Homo sapiens
gtgcaggtggcttctagcttct

SEQ ID NO: 9115738 - DNA, 22 bp, Homo sapiens
gtgcaggtggttggcccagccg

SEQ ID NO: 9115739 - DNA, 22 bp, Homo sapiens
gtgcagtgaccctggagagctg

SEQ ID NO: 9115740 - DNA, 22 bp, Homo sapiens
gtgcagtgaccctggagagctg

SEQ ID NO: 9115741 - DNA, 22 bp, Homo sapiens
gtgcagtgaccctggagagctg

SEQ ID NO: 9115742 - DNA, 22 bp, Homo sapiens
gtgcagtgaaaaaagaatgtcc

SEQ ID NO: 9115743 - DNA, 22 bp, Homo sapiens
gtgcagtggcagatcctagctc

SEQ ID NO: 9115744 - DNA, 22 bp, Homo sapiens
gtgcagtgagcagtgcagcacc

SEQ ID NO: 9115745 - DNA, 22 bp, Homo sapiens
gtgcagtgagcagtgcagcacc

SEQ ID NO: 9115746 - DNA, 22 bp, Homo sapiens
gtgcagtgaaaaaagaatgtcc

SEQ ID NO: 9115747 - DNA, 22 bp, Homo sapiens
gtgcagtgaccctggagagctg

SEQ ID NO: 9115748 - DNA, 22 bp, Homo sapiens
gtgcagtgagcagtgcagcacc

SEQ ID NO: 9115749 - DNA, 22 bp, Homo sapiens
gtgcagatcctgattgcagttc

SEQ ID NO: 9115750 - DNA, 20 bp, Homo sapiens
gtgcagatgtcctttcacac

SEQ ID NO: 9115751 - DNA, 22 bp, Homo sapiens
gtgcagaggtcacaaaagtgaa

SEQ ID NO: 9115752 - DNA, 21 bp, Homo sapiens
gtgcagaggaatgtagggggc

SEQ ID NO: 9115753 - DNA, 16 bp, Homo sapiens
gtgcagagcaattcac

SEQ ID NO: 9115754 - DNA, 22 bp, Homo sapiens
gtgcatatatgcacatatgtgt

SEQ ID NO: 9115755 - DNA, 22 bp, Homo sapiens
gtgcatatatatgggagggagc

SEQ ID NO: 9115756 - DNA, 22 bp, Homo sapiens
gtgcatatatgcacatatgtgt

SEQ ID NO: 9115757 - DNA, 22 bp, Homo sapiens
gtgcatatatgtgcagcatcaa

SEQ ID NO: 9115758 - DNA, 22 bp, Homo sapiens
gtgcatatggttacagcaccgc

SEQ ID NO: 9115759 - DNA, 22 bp, Homo sapiens
gtgcagtgtgtaatccaggaac

SEQ ID NO: 9115760 - DNA, 22 bp, Homo sapiens
gtgcatatgtacctgtgatcat

SEQ ID NO: 9115761 - DNA, 22 bp, Homo sapiens
gtgctaggattacaggcatggg

SEQ ID NO: 9115762 - DNA, 22 bp, Homo sapiens
gtgcatttgtgcatgcacatgt

SEQ ID NO: 9115763 - DNA, 22 bp, Homo sapiens
gtgcatttgtgcatgcacatgt

SEQ ID NO: 9115764 - DNA, 22 bp, Homo sapiens
gtgagaagataagtattgcaaa

SEQ ID NO: 9115765 - DNA, 22 bp, Homo sapiens
gtgagaagataagtattgcaaa

SEQ ID NO: 9115766 - DNA, 22 bp, Homo sapiens
gtgactgtgatcttatttgcaa

SEQ ID NO: 9115767 - DNA, 22 bp, Homo sapiens
gtgactttaacttcagattaga

SEQ ID NO: 9115768 - DNA, 22 bp, Homo sapiens
gtgactgtttttaggaggagta

SEQ ID NO: 9115769 - DNA, 22 bp, Homo sapiens
gtgactgtaattaccttagcaa

SEQ ID NO: 9115770 - DNA, 22 bp, Homo sapiens
gtgactcttacctacccagcct

SEQ ID NO: 9115771 - DNA, 22 bp, Homo sapiens
gtgactcttacctacccagcct

SEQ ID NO: 9115772 - DNA, 22 bp, Homo sapiens
gtgacccatgcagtggttttgg

SEQ ID NO: 9115773 - DNA, 22 bp, Homo sapiens
gtgactctcactttacctgact

SEQ ID NO: 9115774 - DNA, 22 bp, Homo sapiens
gtgactctgcattttatggatc

SEQ ID NO: 9115775 - DNA, 22 bp, Homo sapiens
gtgactctacttaagattaagc

SEQ ID NO: 9115776 - DNA, 22 bp, Homo sapiens
gtgagacctccttgggctgact

SEQ ID NO: 9115777 - DNA, 19 bp, Homo sapiens
gtgagaccctgcatagggc

SEQ ID NO: 9115778 - DNA, 22 bp, Homo sapiens
gtgagacacgtgtgtgacctgg

SEQ ID NO: 9115779 - DNA, 22 bp, Homo sapiens
gtgagagaatttgagttaaatt

SEQ ID NO: 9115780 - DNA, 23 bp, Homo sapiens
gtgagcagcccactaggaatgcc

SEQ ID NO: 9115781 - DNA, 23 bp, Homo sapiens
gtgagcagcccactaggaatgcc

SEQ ID NO: 9115782 - DNA, 22 bp, Homo sapiens
gtgagagaatttgagttaaatt

SEQ ID NO: 9115783 - DNA, 22 bp, Homo sapiens
gtgagcaggataggggctccct

SEQ ID NO: 9115784 - DNA, 22 bp, Homo sapiens
gtgagcaggataggggctccct

SEQ ID NO: 9115785 - DNA, 22 bp, Homo sapiens
gtgcagaagtaacaattaaaga

SEQ ID NO: 9115786 - DNA, 22 bp, Homo sapiens
gtgcagagaaatgagaagtcga

SEQ ID NO: 9115787 - DNA, 22 bp, Homo sapiens
gtgcagagaaatgagaagtcga

SEQ ID NO: 9115788 - DNA, 22 bp, Homo sapiens
gtgcagagaggtggagggactt

SEQ ID NO: 9115789 - DNA, 21 bp, Homo sapiens
gtgcacagtcctgcacacagg

SEQ ID NO: 9115790 - DNA, 22 bp, Homo sapiens
gtgcacatcgtgcaggtttgtt

SEQ ID NO: 9115791 - DNA, 23 bp, Homo sapiens
gtgcacagtcaagcccagcttag

SEQ ID NO: 9115792 - DNA, 23 bp, Homo sapiens
gtgcacagtcaagcccagcttag

SEQ ID NO: 9115793 - DNA, 22 bp, Homo sapiens
gtgcacaggtgggaaaatgagt

SEQ ID NO: 9115794 - DNA, 22 bp, Homo sapiens
gtgcacagatttaattttattc

SEQ ID NO: 9115795 - DNA, 22 bp, Homo sapiens
gtgagcaggatttcatggtgta

SEQ ID NO: 9115796 - DNA, 22 bp, Homo sapiens
gtgcacagaaattggtaagact

SEQ ID NO: 9115797 - DNA, 22 bp, Homo sapiens
gtgcacagaaattggtaagact

SEQ ID NO: 9115798 - DNA, 22 bp, Homo sapiens
gtgcacagaagcagaagctaga

SEQ ID NO: 9115799 - DNA, 22 bp, Homo sapiens
gtgcacagagcccagggccgcg

SEQ ID NO: 9115800 - DNA, 22 bp, Homo sapiens
gtgcacagattcagaggttttg

SEQ ID NO: 9115801 - DNA, 22 bp, Homo sapiens
gtgcacagagcccagggccgcg

SEQ ID NO: 9115802 - DNA, 22 bp, Homo sapiens
gtgcacagattcagaggttttg

SEQ ID NO: 9115803 - DNA, 22 bp, Homo sapiens
gggccacacagaacctcctggt

SEQ ID NO: 9115804 - DNA, 22 bp, Homo sapiens
gggccacacagaacctcctggt

SEQ ID NO: 9115805 - DNA, 22 bp, Homo sapiens
gggcatggtgatgtgcacctgt

SEQ ID NO: 9115806 - DNA, 21 bp, Homo sapiens
gggccacaccttctgcagacc

SEQ ID NO: 9115807 - DNA, 22 bp, Homo sapiens
gggctgagagctggaatctgag

SEQ ID NO: 9115808 - DNA, 22 bp, Homo sapiens
gggctgagagctggaatctgag

SEQ ID NO: 9115809 - DNA, 22 bp, Homo sapiens
gggctgagattggtgccctgtc

SEQ ID NO: 9115810 - DNA, 22 bp, Homo sapiens
gggctgaggctaccactggtct

SEQ ID NO: 9115811 - DNA, 22 bp, Homo sapiens
gggctgcatcagcaggacccgg

SEQ ID NO: 9115812 - DNA, 22 bp, Homo sapiens
gggctgccaagcctgcctgcct

SEQ ID NO: 9115813 - DNA, 22 bp, Homo sapiens
gggctgcacgtattctgctcac

SEQ ID NO: 9115814 - DNA, 22 bp, Homo sapiens
gggctgctacgagaactgaata

SEQ ID NO: 9115815 - DNA, 22 bp, Homo sapiens
gggctgagttcctgcctcactc

SEQ ID NO: 9115816 - DNA, 22 bp, Homo sapiens
gggctgagttcctgcctcactc

SEQ ID NO: 9115817 - DNA, 22 bp, Homo sapiens
gggctgatcgcttgagctcagg

SEQ ID NO: 9115818 - DNA, 22 bp, Homo sapiens
gggctgatgatgagcagaggtg

SEQ ID NO: 9115819 - DNA, 22 bp, Homo sapiens
gggctgagggccaattcctact

SEQ ID NO: 9115820 - DNA, 22 bp, Homo sapiens
gggctgagtgtcccaggccgaa

SEQ ID NO: 9115821 - DNA, 22 bp, Homo sapiens
gggcttggcacatgggctcagc

SEQ ID NO: 9115822 - DNA, 22 bp, Homo sapiens
gggcttggagtaggctgatgaa

SEQ ID NO: 9115823 - DNA, 22 bp, Homo sapiens
gggcttggccccagaagagcta

SEQ ID NO: 9115824 - DNA, 22 bp, Homo sapiens
gggcttggctcataagtggatg

SEQ ID NO: 9115825 - DNA, 22 bp, Homo sapiens
gggcttggctcataagtggatg

SEQ ID NO: 9115826 - DNA, 22 bp, Homo sapiens
gggcttgggtattgtgagaggt

SEQ ID NO: 9115827 - DNA, 19 bp, Homo sapiens
gggcttggggctgaagcct

SEQ ID NO: 9115828 - DNA, 19 bp, Homo sapiens
gggcttggggctgaagcct

SEQ ID NO: 9115829 - DNA, 22 bp, Homo sapiens
gggcttcttgccatggggacgg

SEQ ID NO: 9115830 - DNA, 22 bp, Homo sapiens
ggggaagaggcgtgatggatcc

SEQ ID NO: 9115831 - DNA, 22 bp, Homo sapiens
ggggaagagcattgcacggtgt

SEQ ID NO: 9115832 - DNA, 22 bp, Homo sapiens
ggggaagaatggcagaaaacat

SEQ ID NO: 9115833 - DNA, 22 bp, Homo sapiens
gggctttagattgcagaggatt

SEQ ID NO: 9115834 - DNA, 22 bp, Homo sapiens
gggctttaggggccagtgacca

SEQ ID NO: 9115835 - DNA, 17 bp, Homo sapiens
gggctttaggtggtgta

SEQ ID NO: 9115836 - DNA, 22 bp, Homo sapiens
gggctttatgagattgagatct

SEQ ID NO: 9115837 - DNA, 22 bp, Homo sapiens
gggcttggtggagagaatgctg

SEQ ID NO: 9115838 - DNA, 22 bp, Homo sapiens
gggctttaacacccagtcaggg

SEQ ID NO: 9115839 - DNA, 22 bp, Homo sapiens
gggctttaatcttgttaactag

SEQ ID NO: 9115840 - DNA, 18 bp, Homo sapiens
gggctttacagagtggag

SEQ ID NO: 9115841 - DNA, 19 bp, Homo sapiens
gggctttactccaagtggg

SEQ ID NO: 9115842 - DNA, 22 bp, Homo sapiens
ggggccgaccgcggttcaggcc

SEQ ID NO: 9115843 - DNA, 22 bp, Homo sapiens
ggggctgctggtatttccagtt

SEQ ID NO: 9115844 - DNA, 22 bp, Homo sapiens
gggtggagtagaaagatgaatt

SEQ ID NO: 9115845 - DNA, 22 bp, Homo sapiens
gggtggagcttggacaccagta

SEQ ID NO: 9115846 - DNA, 22 bp, Homo sapiens
gggtaggatggtagaagggacc

SEQ ID NO: 9115847 - DNA, 22 bp, Homo sapiens
gggtaggagaggtgtctgtgtg

SEQ ID NO: 9115848 - DNA, 22 bp, Homo sapiens
gggtagggtgacttaggctggc

SEQ ID NO: 9115849 - DNA, 22 bp, Homo sapiens
gggtaggctgctcctggggccc

SEQ ID NO: 9115850 - DNA, 22 bp, Homo sapiens
ggggttaacagtattgctcatg

SEQ ID NO: 9115851 - DNA, 22 bp, Homo sapiens
ggggtggggttactcattgtgc

SEQ ID NO: 9115852 - DNA, 22 bp, Homo sapiens
ggggtggggttactcattgtgc

SEQ ID NO: 9115853 - DNA, 22 bp, Homo sapiens
ggggtgggcgtgcagggacacc

SEQ ID NO: 9115854 - DNA, 22 bp, Homo sapiens
ggggtgggcgtgcagggacacc

SEQ ID NO: 9115855 - DNA, 22 bp, Homo sapiens
ggggtgggcgtgcagggacacc

SEQ ID NO: 9115856 - DNA, 22 bp, Homo sapiens
ggtggcggccacttcagccctg

SEQ ID NO: 9115857 - DNA, 19 bp, Homo sapiens
ggtggctcagggcccagcc

SEQ ID NO: 9115858 - DNA, 22 bp, Homo sapiens
ggtggctcaaagagagcacaga

SEQ ID NO: 9115859 - DNA, 22 bp, Homo sapiens
ggtggcctcggtggtgcacagg

SEQ ID NO: 9115860 - DNA, 22 bp, Homo sapiens
ggtggcctcggtggtgcacagg

SEQ ID NO: 9115861 - DNA, 22 bp, Homo sapiens
ggtctctgtttggggctggcaa

SEQ ID NO: 9115862 - DNA, 22 bp, Homo sapiens
ggtctctgttgcctccatcaag

SEQ ID NO: 9115863 - DNA, 22 bp, Homo sapiens
ggtctggcactcatgcagcagg

SEQ ID NO: 9115864 - DNA, 22 bp, Homo sapiens
ggtctggcactcatgcagcagg

SEQ ID NO: 9115865 - DNA, 22 bp, Homo sapiens
ggtctggccaatagacagcccc

SEQ ID NO: 9115866 - DNA, 22 bp, Homo sapiens
ggtctggcaggtgaggactcag

SEQ ID NO: 9115867 - DNA, 22 bp, Homo sapiens
ggtgttggaacatggtgagatt

SEQ ID NO: 9115868 - DNA, 22 bp, Homo sapiens
ggtgttgcagttgaagactggt

SEQ ID NO: 9115869 - DNA, 22 bp, Homo sapiens
ggtttattgaaggccaccccac

SEQ ID NO: 9115870 - DNA, 22 bp, Homo sapiens
ggtttattgttaataagtttga

SEQ ID NO: 9115871 - DNA, 22 bp, Homo sapiens
ggtttattaatgtgaactgtat

SEQ ID NO: 9115872 - DNA, 19 bp, Homo sapiens
ggtgtgtgctggggcctgt

SEQ ID NO: 9115873 - DNA, 19 bp, Homo sapiens
ggtgtgtgctggggcctgt

SEQ ID NO: 9115874 - DNA, 22 bp, Homo sapiens
ggtgtgtgaggagtcacttagt

SEQ ID NO: 9115875 - DNA, 22 bp, Homo sapiens
ggtgtgtgaggagtcacttagt

SEQ ID NO: 9115876 - DNA, 22 bp, Homo sapiens
ggtgtggtttgaagggagatgg

SEQ ID NO: 9115877 - DNA, 22 bp, Homo sapiens
ggtgtgtggttttgatacagtc

SEQ ID NO: 9115878 - DNA, 22 bp, Homo sapiens
ggtgtgtgtggattagcatgcc

SEQ ID NO: 9115879 - DNA, 22 bp, Homo sapiens
ggtgtgggccctgatgtcagca

SEQ ID NO: 9115880 - DNA, 22 bp, Homo sapiens
ggtggctctctgtcagtgacag

SEQ ID NO: 9115881 - DNA, 22 bp, Homo sapiens
ggtggctctcttaagggcagcg

SEQ ID NO: 9115882 - DNA, 22 bp, Homo sapiens
ggtctcagactggcaggcagtg

SEQ ID NO: 9115883 - DNA, 22 bp, Homo sapiens
ggtctcaaggaatataatgagt

SEQ ID NO: 9115884 - DNA, 22 bp, Homo sapiens
ggtccttgggtctcctgtgttt

SEQ ID NO: 9115885 - DNA, 22 bp, Homo sapiens
ggtccttgggtctcctgtgttt

SEQ ID NO: 9115886 - DNA, 22 bp, Homo sapiens
ggtcgctgtgtaggttcagcta

SEQ ID NO: 9115887 - DNA, 22 bp, Homo sapiens
ggtcgcacccgggcgctgctgg

SEQ ID NO: 9115888 - DNA, 22 bp, Homo sapiens
ggtcctgtctgacatcactgct

SEQ ID NO: 9115889 - DNA, 18 bp, Homo sapiens
ggtcctgggcctggctca

SEQ ID NO: 9115890 - DNA, 18 bp, Homo sapiens
ggtcctgggcctggctca

SEQ ID NO: 9115891 - DNA, 22 bp, Homo sapiens
ggtcagcagtgcagggcagagc

SEQ ID NO: 9115892 - DNA, 22 bp, Homo sapiens
ggtctcaggtagggcctaggaa

SEQ ID NO: 9115893 - DNA, 20 bp, Homo sapiens
ggtctctgacagctggttgc

SEQ ID NO: 9115894 - DNA, 22 bp, Homo sapiens
ggtctccattccttcatctcac

SEQ ID NO: 9115895 - DNA, 22 bp, Homo sapiens
ggtctcctgaggctgccacacc

SEQ ID NO: 9115896 - DNA, 22 bp, Homo sapiens
ggtctctgtcactgagtggccc

SEQ ID NO: 9115897 - DNA, 22 bp, Homo sapiens
ggtctctgctcagatgccactt

SEQ ID NO: 9115898 - DNA, 22 bp, Homo sapiens
ggtctctggccttggagattga

SEQ ID NO: 9115899 - DNA, 22 bp, Homo sapiens
ggtctctggccttggagattga

SEQ ID NO: 9115900 - DNA, 22 bp, Homo sapiens
ggtctctgagtgaggacctggg

SEQ ID NO: 9115901 - DNA, 22 bp, Homo sapiens
ggtctctgacttagagatggat

SEQ ID NO: 9115902 - DNA, 22 bp, Homo sapiens
gggtggcatctctctgagctgt

SEQ ID NO: 9115903 - DNA, 22 bp, Homo sapiens
gggtggcacaggtgcagagggt

SEQ ID NO: 9115904 - DNA, 22 bp, Homo sapiens
gggtggcaggattggcaggagt

SEQ ID NO: 9115905 - DNA, 22 bp, Homo sapiens
ggtcagagggtgggctgcctgt

SEQ ID NO: 9115906 - DNA, 22 bp, Homo sapiens
ggtcagaattaggtctagagta

SEQ ID NO: 9115907 - DNA, 22 bp, Homo sapiens
ggtcagaagtgcaaaatcagtt

SEQ ID NO: 9115908 - DNA, 22 bp, Homo sapiens
ggtcagaaggattctgggaaat

SEQ ID NO: 9115909 - DNA, 22 bp, Homo sapiens
ggtcacccatgatcacatcacc

SEQ ID NO: 9115910 - DNA, 22 bp, Homo sapiens
ggtcacatggttgagcttgatc

SEQ ID NO: 9115911 - DNA, 22 bp, Homo sapiens
ggcttctctcttcacatggctt

SEQ ID NO: 9115912 - DNA, 22 bp, Homo sapiens
ggcttctctcccccagctccac

SEQ ID NO: 9115913 - DNA, 22 bp, Homo sapiens
ggctgggctgctgggtcagagc

SEQ ID NO: 9115914 - DNA, 22 bp, Homo sapiens
ggctgggctccgggagcatgcg

SEQ ID NO: 9115915 - DNA, 22 bp, Homo sapiens
ggctgggcaggtctgcacaggg

SEQ ID NO: 9115916 - DNA, 22 bp, Homo sapiens
ggctgctgcccacccctgcatg

SEQ ID NO: 9115917 - DNA, 22 bp, Homo sapiens
ggctgctgagttggccaggaga

SEQ ID NO: 9115918 - DNA, 22 bp, Homo sapiens
ggctgagcaattttgatgacat

SEQ ID NO: 9115919 - DNA, 22 bp, Homo sapiens
ggctgctgacaaacatgatcat

SEQ ID NO: 9115920 - DNA, 22 bp, Homo sapiens
ggctgctgacaaacatgatcat

SEQ ID NO: 9115921 - DNA, 22 bp, Homo sapiens
ggctgagcactttaggcaggag

SEQ ID NO: 9115922 - DNA, 19 bp, Homo sapiens
ggctgctgaagagaattac

SEQ ID NO: 9115923 - DNA, 22 bp, Homo sapiens
ggctgctgaagtgtggcaatct

SEQ ID NO: 9115924 - DNA, 22 bp, Homo sapiens
ggctggcttgcggagtcacaga

SEQ ID NO: 9115925 - DNA, 22 bp, Homo sapiens
ggctggcttggtgagctgtcac

SEQ ID NO: 9115926 - DNA, 22 bp, Homo sapiens
ggctggcttgccaagctcaggg

SEQ ID NO: 9115927 - DNA, 22 bp, Homo sapiens
ggctgggcaaacaagactcttc

SEQ ID NO: 9115928 - DNA, 22 bp, Homo sapiens
ggctgctggccagcctaggagt

SEQ ID NO: 9115929 - DNA, 22 bp, Homo sapiens
ggctccagatgtctcctggcaa

SEQ ID NO: 9115930 - DNA, 22 bp, Homo sapiens
ggctccagccctggctcttcac

SEQ ID NO: 9115931 - DNA, 22 bp, Homo sapiens
ggctccaggagatgctgggcag

SEQ ID NO: 9115932 - DNA, 22 bp, Homo sapiens
ggctctgctcacagcccgcagc

SEQ ID NO: 9115933 - DNA, 22 bp, Homo sapiens
ggctctgctgcaagtcttcctc

SEQ ID NO: 9115934 - DNA, 22 bp, Homo sapiens
ggctccaccctgcttccagaag

SEQ ID NO: 9115935 - DNA, 22 bp, Homo sapiens
ggctccaccctgcttccagaag

SEQ ID NO: 9115936 - DNA, 22 bp, Homo sapiens
ggcgggggtccaggagcctgca

SEQ ID NO: 9115937 - DNA, 22 bp, Homo sapiens
ggcggggcctcgcgaacggcct

SEQ ID NO: 9115938 - DNA, 22 bp, Homo sapiens
ggcgggagatggggccgttcag

SEQ ID NO: 9115939 - DNA, 22 bp, Homo sapiens
ggcggccctgcacgtgctgagg

SEQ ID NO: 9115940 - DNA, 22 bp, Homo sapiens
ggctctttggcgggccttgaac

SEQ ID NO: 9115941 - DNA, 22 bp, Homo sapiens
ggctgaaaggtgggaggatggc

SEQ ID NO: 9115942 - DNA, 22 bp, Homo sapiens
ggctgaaaccgttatccactga

SEQ ID NO: 9115943 - DNA, 22 bp, Homo sapiens
ggctcttctgtggcagccaagg

SEQ ID NO: 9115944 - DNA, 20 bp, Homo sapiens
ggctgaaagtagaaagtatt

SEQ ID NO: 9115945 - DNA, 22 bp, Homo sapiens
ggctcttgttcgtaccatggct

SEQ ID NO: 9115946 - DNA, 22 bp, Homo sapiens
ggctctgggccagagttggctt

SEQ ID NO: 9115947 - DNA, 22 bp, Homo sapiens
ggctcttctgtggcagccaagg

SEQ ID NO: 9115948 - DNA, 22 bp, Homo sapiens
ggctgacttctccagatctaaa

SEQ ID NO: 9115949 - DNA, 22 bp, Homo sapiens
ggctgaatgttggacacttacg

SEQ ID NO: 9115950 - DNA, 22 bp, Homo sapiens
ggctgagaatcaacaacctgct

SEQ ID NO: 9115951 - DNA, 23 bp, Homo sapiens
ggctgagaagtcccatgataggt

SEQ ID NO: 9115952 - DNA, 22 bp, Homo sapiens
ggctctgggcatagaaggaagc

SEQ ID NO: 9115953 - DNA, 22 bp, Homo sapiens
ggctctgggaaatggtcttcct

SEQ ID NO: 9115954 - DNA, 22 bp, Homo sapiens
ggctctggctactccaccctgt

SEQ ID NO: 9115955 - DNA, 22 bp, Homo sapiens
ggctctggctactccaccctgt

SEQ ID NO: 9115956 - DNA, 22 bp, Homo sapiens
ggctctggcgtccaatggagcg

SEQ ID NO: 9115957 - DNA, 22 bp, Homo sapiens
ggctctggcgtccaatggagcg

SEQ ID NO: 9115958 - DNA, 22 bp, Homo sapiens
ggctctggcaaggggaggctac

SEQ ID NO: 9115959 - DNA, 22 bp, Homo sapiens
ggctctggagatgtccgacctg

SEQ ID NO: 9115960 - DNA, 22 bp, Homo sapiens
ggctctggagcacagacgtctg

SEQ ID NO: 9115961 - DNA, 22 bp, Homo sapiens
ggctctggagcacagacgtctg

SEQ ID NO: 9115962 - DNA, 22 bp, Homo sapiens
ggctctggagatgtccgacctg

SEQ ID NO: 9115963 - DNA, 22 bp, Homo sapiens
ggctctggagacatgtggagag

SEQ ID NO: 9115964 - DNA, 22 bp, Homo sapiens
ggctctggagacatgtggagag

SEQ ID NO: 9115965 - DNA, 22 bp, Homo sapiens
gggatggggagctggaaagggg

SEQ ID NO: 9115966 - DNA, 22 bp, Homo sapiens
gggaggagctgagtgtgtgtgc

SEQ ID NO: 9115967 - DNA, 22 bp, Homo sapiens
gggaggacggtccagggcaaag

SEQ ID NO: 9115968 - DNA, 22 bp, Homo sapiens
gggaggagctgagtgtgtgtgc

SEQ ID NO: 9115969 - DNA, 22 bp, Homo sapiens
gggaggagcttggagattcact

SEQ ID NO: 9115970 - DNA, 23 bp, Homo sapiens
gggagctgtggtgaaaagaggtg

SEQ ID NO: 9115971 - DNA, 22 bp, Homo sapiens
gggcaagcacagcgagcgtgcg

SEQ ID NO: 9115972 - DNA, 22 bp, Homo sapiens
gggcacagcccagtggggtccc

SEQ ID NO: 9115973 - DNA, 22 bp, Homo sapiens
gggcacagcccagtggggtccc

SEQ ID NO: 9115974 - DNA, 22 bp, Homo sapiens
gggcacagcctaactatggaga

SEQ ID NO: 9115975 - DNA, 22 bp, Homo sapiens
gggcacagcctaactatggaga

SEQ ID NO: 9115976 - DNA, 22 bp, Homo sapiens
gggcacagcctaactatggaga

SEQ ID NO: 9115977 - DNA, 19 bp, Homo sapiens
gggcacagcctccccccag

SEQ ID NO: 9115978 - DNA, 22 bp, Homo sapiens
gggattcatcaactgttttaca

SEQ ID NO: 9115979 - DNA, 22 bp, Homo sapiens
gggatttgtgggatggccagtg

SEQ ID NO: 9115980 - DNA, 22 bp, Homo sapiens
gggatggggtcgggaccctgct

SEQ ID NO: 9115981 - DNA, 22 bp, Homo sapiens
gggatggggtcgggaccctgct

SEQ ID NO: 9115982 - DNA, 22 bp, Homo sapiens
gggcaggagaaggtggatgtcc

SEQ ID NO: 9115983 - DNA, 22 bp, Homo sapiens
gggcaggagagggccacctgga

SEQ ID NO: 9115984 - DNA, 22 bp, Homo sapiens
gggcaggagagggccacctgga

SEQ ID NO: 9115985 - DNA, 22 bp, Homo sapiens
gggcaggagagaacagtcatgg

SEQ ID NO: 9115986 - DNA, 18 bp, Homo sapiens
gggcatggatgcagcatc

SEQ ID NO: 9115987 - DNA, 23 bp, Homo sapiens
gggcatggagtgtaggtggaagg

SEQ ID NO: 9115988 - DNA, 22 bp, Homo sapiens
gggcatgcctgcgcagtgcatg

SEQ ID NO: 9115989 - DNA, 22 bp, Homo sapiens
gggcacaggaatttgggatgtg

SEQ ID NO: 9115990 - DNA, 22 bp, Homo sapiens
gggcacaggaatttgggatgtg

SEQ ID NO: 9115991 - DNA, 22 bp, Homo sapiens
gggcacagctgctacccagtgc

SEQ ID NO: 9115992 - DNA, 22 bp, Homo sapiens
gggcagctgccagaggccatgg

SEQ ID NO: 9115993 - DNA, 22 bp, Homo sapiens
gggcagctgtatctgagcttat

SEQ ID NO: 9115994 - DNA, 22 bp, Homo sapiens
gggagacaaggagaaccaaaga

SEQ ID NO: 9115995 - DNA, 22 bp, Homo sapiens
gggagacacgctgcaggcataa

SEQ ID NO: 9115996 - DNA, 22 bp, Homo sapiens
gggagacacgctgcaggcataa

SEQ ID NO: 9115997 - DNA, 22 bp, Homo sapiens
gggagacacgctgcaggcataa

SEQ ID NO: 9115998 - DNA, 22 bp, Homo sapiens
gggagacccccaatgccaggtc

SEQ ID NO: 9115999 - DNA, 22 bp, Homo sapiens
gggagagcgcgctagggccgag

SEQ ID NO: 9116000 - DNA, 22 bp, Homo sapiens
gggagagcgcgctagggccgag

SEQ ID NO: 9116001 - DNA, 19 bp, Homo sapiens
gggagagccaggctcaccc

SEQ ID NO: 9116002 - DNA, 22 bp, Homo sapiens
gggagagagaaaacgtggcgca

SEQ ID NO: 9116003 - DNA, 22 bp, Homo sapiens
gggagctgtcatcagtgttgtc

SEQ ID NO: 9116004 - DNA, 19 bp, Homo sapiens
gggagctgtctgcccgtgg

SEQ ID NO: 9116005 - DNA, 22 bp, Homo sapiens
gggagctgtaagggacaggtag

SEQ ID NO: 9116006 - DNA, 22 bp, Homo sapiens
gggagctgtaagggacaggtag

SEQ ID NO: 9116007 - DNA, 22 bp, Homo sapiens
gggagctggttcctgccctcca

SEQ ID NO: 9116008 - DNA, 18 bp, Homo sapiens
gggagctgggaagctggt

SEQ ID NO: 9116009 - DNA, 18 bp, Homo sapiens
gggagctgggaagctggt

SEQ ID NO: 9116010 - DNA, 17 bp, Homo sapiens
gggagatgaagggatat

SEQ ID NO: 9116011 - DNA, 17 bp, Homo sapiens
gggagatgaagggatat

SEQ ID NO: 9116012 - DNA, 22 bp, Homo sapiens
gggagaggttacccgagcaact

SEQ ID NO: 9116013 - DNA, 22 bp, Homo sapiens
gggagaggttacccgagcaact

SEQ ID NO: 9116014 - DNA, 22 bp, Homo sapiens
gggagaggttacccgagcaact

SEQ ID NO: 9116015 - DNA, 22 bp, Homo sapiens
gggagaggttacccgagcaact

SEQ ID NO: 9116016 - DNA, 22 bp, Homo sapiens
gggagaggttacccgagcaact

SEQ ID NO: 9116017 - DNA, 22 bp, Homo sapiens
gggagaggttacccgagcaact

SEQ ID NO: 9116018 - DNA, 23 bp, Homo sapiens
gggagaatatgaggatgatggtg

SEQ ID NO: 9116019 - DNA, 22 bp, Homo sapiens
gggaccagaagaaggatggtga

SEQ ID NO: 9116020 - DNA, 22 bp, Homo sapiens
gggaatgtaatcatggaatgct

SEQ ID NO: 9116021 - DNA, 22 bp, Homo sapiens
gggaatgtaattaatctccttc
